United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 84

SEQ ID NO: 3015590 - RNA, 11 nt, Mycobacterium avium subsp. paratuberculosis
ggccaccagca

SEQ ID NO: 3015591 - RNA, 20 nt, Mycobacterium avium subsp. paratuberculosis
ggccaccagcagcgagaccg

SEQ ID NO: 3015592 - RNA, 22 nt, Mycobacterium avium subsp. paratuberculosis
ggccaccagcagcgagaccggc

SEQ ID NO: 3015593 - RNA, 17 nt, Mycobacterium avium subsp. paratuberculosis
ggccaccagccggccgg

SEQ ID NO: 3015594 - RNA, 17 nt, Mycobacterium avium subsp. paratuberculosis
ggccaccagcgcggcca

SEQ ID NO: 3015595 - RNA, 13 nt, Mycobacterium avium subsp. paratuberculosis
ggccaccagcggc

SEQ ID NO: 3015596 - RNA, 16 nt, Mycobacterium avium subsp. paratuberculosis
ggccaccagcggccgg

SEQ ID NO: 3015597 - RNA, 17 nt, Mycobacterium avium subsp. paratuberculosis
ggccaccagcggccgga

SEQ ID NO: 3015598 - RNA, 14 nt, Mycobacterium avium subsp. paratuberculosis
ggccaccaggccga

SEQ ID NO: 3015599 - RNA, 23 nt, Mycobacterium avium subsp. paratuberculosis
ggccaccaggccgaagacgauga

SEQ ID NO: 3015600 - RNA, 18 nt, Mycobacterium avium subsp. paratuberculosis
ggccaccaggcgccgucg

SEQ ID NO: 3015601 - RNA, 23 nt, Mycobacterium avium subsp. paratuberculosis
ggccaccagggucucgcgcagca

SEQ ID NO: 3015602 - RNA, 17 nt, Mycobacterium avium subsp. paratuberculosis
ggccaccaucaggccgg

SEQ ID NO: 3015603 - RNA, 20 nt, Mycobacterium avium subsp. paratuberculosis
ggccaccaucaggccggccu

SEQ ID NO: 3015604 - RNA, 24 nt, Mycobacterium avium subsp. paratuberculosis
ggccaccaucaggccggccugcca

SEQ ID NO: 3015605 - RNA, 21 nt, Mycobacterium avium subsp. paratuberculosis
ggccaccaucuccgcggcgcg

SEQ ID NO: 3015606 - RNA, 16 nt, Mycobacterium avium subsp. paratuberculosis
ggccaccaugccggcg

SEQ ID NO: 3015607 - RNA, 19 nt, Mycobacterium avium subsp. paratuberculosis
ggccaccaugucggcgucg

SEQ ID NO: 3015608 - RNA, 21 nt, Mycobacterium avium subsp. paratuberculosis
ggccaccaugucggcgucgcc

SEQ ID NO: 3015609 - RNA, 12 nt, Mycobacterium avium subsp. paratuberculosis
ggccaccccgga

SEQ ID NO: 3015610 - RNA, 13 nt, Mycobacterium avium subsp. paratuberculosis
ggccacccgcgau

SEQ ID NO: 3015611 - RNA, 14 nt, Mycobacterium avium subsp. paratuberculosis
ggccacccgcgauc

SEQ ID NO: 3015612 - RNA, 15 nt, Mycobacterium avium subsp. paratuberculosis
ggccacccgggcgcc

SEQ ID NO: 3015613 - RNA, 17 nt, Mycobacterium avium subsp. paratuberculosis
ggccacccucgccgccg

SEQ ID NO: 3015614 - RNA, 20 nt, Mycobacterium avium subsp. paratuberculosis
ggccaccgaagccgacgucg

SEQ ID NO: 3015615 - RNA, 11 nt, Mycobacterium avium subsp. paratuberculosis
ggccaccgacu

SEQ ID NO: 3015616 - RNA, 17 nt, Mycobacterium avium subsp. paratuberculosis
ggccaccgacugcgacg

SEQ ID NO: 3015617 - RNA, 18 nt, Mycobacterium avium subsp. paratuberculosis
ggccaccgaugcccgaca

SEQ ID NO: 3015618 - RNA, 16 nt, Mycobacterium avium subsp. paratuberculosis
ggccaccgcaucgccg

SEQ ID NO: 3015619 - RNA, 21 nt, Mycobacterium avium subsp. paratuberculosis
ggccaccgcaucgccgagggc

SEQ ID NO: 3015620 - RNA, 22 nt, Mycobacterium avium subsp. paratuberculosis
ggccaccgcaucgccgagggcg

SEQ ID NO: 3015621 - RNA, 15 nt, Mycobacterium avium subsp. paratuberculosis
ggccaccgccccagc

SEQ ID NO: 3015622 - RNA, 14 nt, Mycobacterium avium subsp. paratuberculosis
ggccaccgccgcca

SEQ ID NO: 3015623 - RNA, 18 nt, Mycobacterium avium subsp. paratuberculosis
ggccaccgccgccagcag

SEQ ID NO: 3015624 - RNA, 20 nt, Mycobacterium avium subsp. paratuberculosis
ggccaccgccgccagcagca

SEQ ID NO: 3015625 - RNA, 23 nt, Mycobacterium avium subsp. paratuberculosis
ggccaccgccugcgcgaucgccg

SEQ ID NO: 3015626 - RNA, 15 nt, Mycobacterium avium subsp. paratuberculosis
ggccaccgcgacgcc

SEQ ID NO: 3015627 - RNA, 19 nt, Mycobacterium avium subsp. paratuberculosis
ggccaccgcgacgcccagg

SEQ ID NO: 3015628 - RNA, 15 nt, Mycobacterium avium subsp. paratuberculosis
ggccaccgcgacgcu

SEQ ID NO: 3015629 - RNA, 16 nt, Mycobacterium avium subsp. paratuberculosis
ggccaccgcgacgcug

SEQ ID NO: 3015630 - RNA, 17 nt, Mycobacterium avium subsp. paratuberculosis
ggccaccgcgacgcugc

SEQ ID NO: 3015631 - RNA, 19 nt, Mycobacterium avium subsp. paratuberculosis
ggccaccgcgccccggcgc

SEQ ID NO: 3015632 - RNA, 13 nt, Mycobacterium avium subsp. paratuberculosis
ggccaccgcgccu

SEQ ID NO: 3015633 - RNA, 12 nt, Mycobacterium avium subsp. paratuberculosis
ggccaccgcgcg

SEQ ID NO: 3015634 - RNA, 15 nt, Mycobacterium avium subsp. paratuberculosis
ggccaccgcgcgcug

SEQ ID NO: 3015635 - RNA, 17 nt, Mycobacterium avium subsp. paratuberculosis
ggccaccgcgcgcugcc

SEQ ID NO: 3015636 - RNA, 18 nt, Mycobacterium avium subsp. paratuberculosis
ggccaccgcgcgcugccg

SEQ ID NO: 3015637 - RNA, 20 nt, Mycobacterium avium subsp. paratuberculosis
ggccaccgcgcgcugccgcg

SEQ ID NO: 3015638 - RNA, 15 nt, Mycobacterium avium subsp. paratuberculosis
ggccaccgcgcggcg

SEQ ID NO: 3015639 - RNA, 17 nt, Mycobacterium avium subsp. paratuberculosis
ggccaccgcgcggcggu

SEQ ID NO: 3015640 - RNA, 20 nt, Mycobacterium avium subsp. paratuberculosis
ggccaccgcgcggcggucca

SEQ ID NO: 3015641 - RNA, 14 nt, Mycobacterium avium subsp. paratuberculosis
ggccaccgcgcggu

SEQ ID NO: 3015642 - RNA, 16 nt, Mycobacterium avium subsp. paratuberculosis
ggccaccgcgcggugc

SEQ ID NO: 3015643 - RNA, 21 nt, Mycobacterium avium subsp. paratuberculosis
ggccaccgcgcggugcaccag

SEQ ID NO: 3015644 - RNA, 14 nt, Mycobacterium avium subsp. paratuberculosis
ggccaccgcggcca

SEQ ID NO: 3015645 - RNA, 15 nt, Mycobacterium avium subsp. paratuberculosis
ggccaccgcggccag

SEQ ID NO: 3015646 - RNA, 18 nt, Mycobacterium avium subsp. paratuberculosis
ggccaccgcggccagcug

SEQ ID NO: 3015647 - RNA, 19 nt, Mycobacterium avium subsp. paratuberculosis
ggccaccgcggccagcugc

SEQ ID NO: 3015648 - RNA, 16 nt, Mycobacterium avium subsp. paratuberculosis
ggccaccgcggcguug

SEQ ID NO: 3015649 - RNA, 13 nt, Mycobacterium avium subsp. paratuberculosis
ggccaccggcgcc

SEQ ID NO: 3015650 - RNA, 17 nt, Mycobacterium avium subsp. paratuberculosis
ggccaccggcgccaggu

SEQ ID NO: 3015651 - RNA, 20 nt, Mycobacterium avium subsp. paratuberculosis
ggccaccggcgcgacggcgg

SEQ ID NO: 3015652 - RNA, 18 nt, Mycobacterium avium subsp. paratuberculosis
ggccaccgggaccgucgg

SEQ ID NO: 3015653 - RNA, 19 nt, Mycobacterium avium subsp. paratuberculosis
ggccaccgggaccgucggg

SEQ ID NO: 3015654 - RNA, 14 nt, Mycobacterium avium subsp. paratuberculosis
ggccaccgggccga

SEQ ID NO: 3015655 - RNA, 11 nt, Mycobacterium avium subsp. paratuberculosis
ggccaccgggg

SEQ ID NO: 3015656 - RNA, 18 nt, Mycobacterium avium subsp. paratuberculosis
ggccaccgggucgccaag

SEQ ID NO: 3015657 - RNA, 21 nt, Mycobacterium avium subsp. paratuberculosis
ggccaccgggucguccgcgac

SEQ ID NO: 3015658 - RNA, 20 nt, Mycobacterium avium subsp. paratuberculosis
ggccaccgucagcgucagca

SEQ ID NO: 3015659 - RNA, 16 nt, Mycobacterium avium subsp. paratuberculosis
ggccaccgucccggug

SEQ ID NO: 3015660 - RNA, 19 nt, Mycobacterium avium subsp. paratuberculosis
ggccaccgucccggugucg

SEQ ID NO: 3015661 - RNA, 22 nt, Mycobacterium avium subsp. paratuberculosis
ggccaccgucccggugucgccg

SEQ ID NO: 3015662 - RNA, 23 nt, Mycobacterium avium subsp. paratuberculosis
ggccaccgucccggugucgccgu

SEQ ID NO: 3015663 - RNA, 13 nt, Mycobacterium avium subsp. paratuberculosis
ggccaccgucuuc

SEQ ID NO: 3015664 - RNA, 17 nt, Mycobacterium avium subsp. paratuberculosis
ggccaccgucuucgggg

SEQ ID NO: 3015665 - RNA, 19 nt, Mycobacterium avium subsp. paratuberculosis
ggccaccgucuucggggcc

SEQ ID NO: 3015666 - RNA, 20 nt, Mycobacterium avium subsp. paratuberculosis
ggccaccgucuucggggccg

SEQ ID NO: 3015667 - RNA, 14 nt, Mycobacterium avium subsp. paratuberculosis
ggccaccuccagcc

SEQ ID NO: 3015668 - RNA, 18 nt, Mycobacterium avium subsp. paratuberculosis
ggccaccucgacggcgug

SEQ ID NO: 3015669 - RNA, 12 nt, Mycobacterium avium subsp. paratuberculosis
ggccaccucggc

SEQ ID NO: 3015670 - RNA, 13 nt, Mycobacterium avium subsp. paratuberculosis
ggccaccucggcg

SEQ ID NO: 3015671 - RNA, 19 nt, Mycobacterium avium subsp. paratuberculosis
ggccaccucgucccagcgc

SEQ ID NO: 3015672 - RNA, 15 nt, Mycobacterium avium subsp. paratuberculosis
ggccaccucgucggc

SEQ ID NO: 3015673 - RNA, 16 nt, Mycobacterium avium subsp. paratuberculosis
ggccaccucgucggcg

SEQ ID NO: 3015674 - RNA, 18 nt, Mycobacterium avium subsp. paratuberculosis
ggccaccucgucggcggu

SEQ ID NO: 3015675 - RNA, 19 nt, Mycobacterium avium subsp. paratuberculosis
ggccaccucgucggcgguc

SEQ ID NO: 3015676 - RNA, 17 nt, Mycobacterium avium subsp. paratuberculosis
ggccaccugggcggggc

SEQ ID NO: 3015677 - RNA, 19 nt, Mycobacterium avium subsp. paratuberculosis
ggccaccuugcgcgggucg

SEQ ID NO: 3015678 - RNA, 23 nt, Mycobacterium avium subsp. paratuberculosis
ggccaccuugcgcgggucgccgg

SEQ ID NO: 3015679 - RNA, 22 nt, Mycobacterium avium subsp. paratuberculosis
ggccaccuuggacaggcccagc

SEQ ID NO: 3015680 - RNA, 23 nt, Mycobacterium avium subsp. paratuberculosis
ggccaccuugucggcgcccagga

SEQ ID NO: 3015681 - RNA, 13 nt, Mycobacterium avium subsp. paratuberculosis
ggccacgaccucg

SEQ ID NO: 3015682 - RNA, 16 nt, Mycobacterium avium subsp. paratuberculosis
ggccacgaccucgggg

SEQ ID NO: 3015683 - RNA, 16 nt, Mycobacterium avium subsp. paratuberculosis
ggccacgacgcgccac

SEQ ID NO: 3015684 - RNA, 17 nt, Mycobacterium avium subsp. paratuberculosis
ggccacgacgcgccacg

SEQ ID NO: 3015685 - RNA, 13 nt, Mycobacterium avium subsp. paratuberculosis
ggccacgacgcgg

SEQ ID NO: 3015686 - RNA, 15 nt, Mycobacterium avium subsp. paratuberculosis
ggccacgacgcggcg

SEQ ID NO: 3015687 - RNA, 16 nt, Mycobacterium avium subsp. paratuberculosis
ggccacgacgcggcgc

SEQ ID NO: 3015688 - RNA, 14 nt, Mycobacterium avium subsp. paratuberculosis
ggccacgacggcgc

SEQ ID NO: 3015689 - RNA, 15 nt, Mycobacterium avium subsp. paratuberculosis
ggccacgacggcgcu

SEQ ID NO: 3015690 - RNA, 14 nt, Mycobacterium avium subsp. paratuberculosis
ggccacgauccgcg

SEQ ID NO: 3015691 - RNA, 15 nt, Mycobacterium avium subsp. paratuberculosis
ggccacgauccgcgc

SEQ ID NO: 3015692 - RNA, 16 nt, Mycobacterium avium subsp. paratuberculosis
ggccacgauccgcgcg

SEQ ID NO: 3015693 - RNA, 23 nt, Mycobacterium avium subsp. paratuberculosis
ggccacgauccgcgcggccacca

SEQ ID NO: 3015694 - RNA, 22 nt, Mycobacterium avium subsp. paratuberculosis
ggccacgauccggggcagcagc

SEQ ID NO: 3015695 - RNA, 13 nt, Mycobacterium avium subsp. paratuberculosis
ggccacgaucgcg

SEQ ID NO: 3015696 - RNA, 23 nt, Mycobacterium avium subsp. paratuberculosis
ggccacgaucgcgaucgccgauc

SEQ ID NO: 3015697 - RNA, 21 nt, Mycobacterium avium subsp. paratuberculosis
ggccacgaucgcggccagcgu

SEQ ID NO: 3015698 - RNA, 13 nt, Mycobacterium avium subsp. paratuberculosis
ggccacgaugauc

SEQ ID NO: 3015699 - RNA, 21 nt, Mycobacterium avium subsp. paratuberculosis
ggccacgaugaucgucggcag

SEQ ID NO: 3015700 - RNA, 22 nt, Mycobacterium avium subsp. paratuberculosis
ggccacgaugaucgucggcagc

SEQ ID NO: 3015701 - RNA, 23 nt, Mycobacterium avium subsp. paratuberculosis
ggccacgaugaucgucggcagcg

SEQ ID NO: 3015702 - RNA, 19 nt, Mycobacterium avium subsp. paratuberculosis
ggccacgauggggacgucg

SEQ ID NO: 3015703 - RNA, 17 nt, Mycobacterium avium subsp. paratuberculosis
ggccacgcagucgucga

SEQ ID NO: 3015704 - RNA, 18 nt, Mycobacterium avium subsp. paratuberculosis
ggccacgcagucgucgau

SEQ ID NO: 3015705 - RNA, 12 nt, Mycobacterium avium subsp. paratuberculosis
ggccacgcccac

SEQ ID NO: 3015706 - RNA, 13 nt, Mycobacterium avium subsp. paratuberculosis
ggccacgcccacg

SEQ ID NO: 3015707 - RNA, 15 nt, Mycobacterium avium subsp. paratuberculosis
ggccacgcccacgcc

SEQ ID NO: 3015708 - RNA, 19 nt, Mycobacterium avium subsp. paratuberculosis
ggccacgcccacgccgagg

SEQ ID NO: 3015709 - RNA, 19 nt, Mycobacterium avium subsp. paratuberculosis
ggccacgccccauugccgc

SEQ ID NO: 3015710 - RNA, 23 nt, Mycobacterium avium subsp. paratuberculosis
ggccacgccccauugccgcgccg

SEQ ID NO: 3015711 - RNA, 19 nt, Mycobacterium avium subsp. paratuberculosis
ggccacgcccuggccgccg

SEQ ID NO: 3015712 - RNA, 21 nt, Mycobacterium avium subsp. paratuberculosis
ggccacgcccuggccgccggc

SEQ ID NO: 3015713 - RNA, 22 nt, Mycobacterium avium subsp. paratuberculosis
ggccacgcccuggccgccggcc

SEQ ID NO: 3015714 - RNA, 13 nt, Mycobacterium avium subsp. paratuberculosis
ggccacgccgggc

SEQ ID NO: 3015715 - RNA, 14 nt, Mycobacterium avium subsp. paratuberculosis
ggccacgccggguu

SEQ ID NO: 3015716 - RNA, 18 nt, Mycobacterium avium subsp. paratuberculosis
ggccacgcuagcgugacg

SEQ ID NO: 3015717 - RNA, 19 nt, Mycobacterium avium subsp. paratuberculosis
gcuggcguggcacccgggc

SEQ ID NO: 3015718 - RNA, 21 nt, Mycobacterium avium subsp. paratuberculosis
gcuggcguggcacccgggcgc

SEQ ID NO: 3015719 - RNA, 17 nt, Mycobacterium avium subsp. paratuberculosis
gcuggcguggcgccggc

SEQ ID NO: 3015720 - RNA, 19 nt, Mycobacterium avium subsp. paratuberculosis
gcuggcguggcgccggcgc

SEQ ID NO: 3015721 - RNA, 17 nt, Mycobacterium avium subsp. paratuberculosis
gcuggcguucgccgagg

SEQ ID NO: 3015722 - RNA, 17 nt, Mycobacterium avium subsp. paratuberculosis
gcuggcguugagcacgc

SEQ ID NO: 3015723 - RNA, 18 nt, Mycobacterium avium subsp. paratuberculosis
gcuggcugcggccccggu

SEQ ID NO: 3015724 - RNA, 13 nt, Mycobacterium avium subsp. paratuberculosis
gcuggcuucgcgg

SEQ ID NO: 3015725 - RNA, 19 nt, Mycobacterium avium subsp. paratuberculosis
gcugggacgggucggcggc

SEQ ID NO: 3015726 - RNA, 13 nt, Mycobacterium avium subsp. paratuberculosis
gcugggagcggcc

SEQ ID NO: 3015727 - RNA, 14 nt, Mycobacterium avium subsp. paratuberculosis
gcugggcagccaga

SEQ ID NO: 3015728 - RNA, 14 nt, Mycobacterium avium subsp. paratuberculosis
gcugggcagccgcg

SEQ ID NO: 3015729 - RNA, 15 nt, Mycobacterium avium subsp. paratuberculosis
gcugggcagccgcgc

SEQ ID NO: 3015730 - RNA, 17 nt, Mycobacterium avium subsp. paratuberculosis
gcugggcagccgcgcgu

SEQ ID NO: 3015731 - RNA, 17 nt, Mycobacterium avium subsp. paratuberculosis
gcugggccacgauccgc

SEQ ID NO: 3015732 - RNA, 20 nt, Mycobacterium avium subsp. paratuberculosis
gcugggccacgauccgcgcg

SEQ ID NO: 3015733 - RNA, 22 nt, Mycobacterium avium subsp. paratuberculosis
gcugggccacgauccgcgcggc

SEQ ID NO: 3015734 - RNA, 19 nt, Mycobacterium avium subsp. paratuberculosis
gcugggccagcgcgguggc

SEQ ID NO: 3015735 - RNA, 18 nt, Mycobacterium avium subsp. paratuberculosis
gcugggccccuccagccg

SEQ ID NO: 3015736 - RNA, 20 nt, Mycobacterium avium subsp. paratuberculosis
gcugggccccuccagccgcc

SEQ ID NO: 3015737 - RNA, 13 nt, Mycobacterium avium subsp. paratuberculosis
gcugggcccgcgc

SEQ ID NO: 3015738 - RNA, 15 nt, Mycobacterium avium subsp. paratuberculosis
gcugggcccgcgcau

SEQ ID NO: 3015739 - RNA, 13 nt, Mycobacterium avium subsp. paratuberculosis
gcugggccgccag

SEQ ID NO: 3015740 - RNA, 16 nt, Mycobacterium avium subsp. paratuberculosis
gcugggccgccagccg

SEQ ID NO: 3015741 - RNA, 14 nt, Mycobacterium avium subsp. paratuberculosis
gcugggccgcggcg

SEQ ID NO: 3015742 - RNA, 17 nt, Mycobacterium avium subsp. paratuberculosis
gcugggccgcggcgccg

SEQ ID NO: 3015743 - RNA, 12 nt, Mycobacterium avium subsp. paratuberculosis
gcugggccggcg

SEQ ID NO: 3015744 - RNA, 15 nt, Mycobacterium avium subsp. paratuberculosis
gcugggccggcgccg

SEQ ID NO: 3015745 - RNA, 16 nt, Mycobacterium avium subsp. paratuberculosis
gcugggccggcgccga

SEQ ID NO: 3015746 - RNA, 14 nt, Mycobacterium avium subsp. paratuberculosis
gcugggcgaagccg

SEQ ID NO: 3015747 - RNA, 18 nt, Mycobacterium avium subsp. paratuberculosis
gcugggcgaagccgaggu

SEQ ID NO: 3015748 - RNA, 23 nt, Mycobacterium avium subsp. paratuberculosis
gcugggcgccauggcccacgacg

SEQ ID NO: 3015749 - RNA, 17 nt, Mycobacterium avium subsp. paratuberculosis
gcugggcgcgcaacucg

SEQ ID NO: 3015750 - RNA, 12 nt, Mycobacterium avium subsp. paratuberculosis
gcugggcggcac

SEQ ID NO: 3015751 - RNA, 14 nt, Mycobacterium avium subsp. paratuberculosis
gcugggcggcacca

SEQ ID NO: 3015752 - RNA, 20 nt, Mycobacterium avium subsp. paratuberculosis
gcugggcggcgacaucgccg

SEQ ID NO: 3015753 - RNA, 21 nt, Mycobacterium avium subsp. paratuberculosis
gcugggcggcgacaucgccga

SEQ ID NO: 3015754 - RNA, 16 nt, Mycobacterium avium subsp. paratuberculosis
gcugggcggcgcgcug

SEQ ID NO: 3015755 - RNA, 14 nt, Mycobacterium avium subsp. paratuberculosis
gcugggcggcgcgg

SEQ ID NO: 3015756 - RNA, 16 nt, Mycobacterium avium subsp. paratuberculosis
gcugggcgggcagccg

SEQ ID NO: 3015757 - RNA, 18 nt, Mycobacterium avium subsp. paratuberculosis
gcugggcgggcagccgcu

SEQ ID NO: 3015758 - RNA, 22 nt, Mycobacterium avium subsp. paratuberculosis
gcugggcgggcagccgcuuggc

SEQ ID NO: 3015759 - RNA, 16 nt, Mycobacterium avium subsp. paratuberculosis
gcugggcguugccggu

SEQ ID NO: 3015760 - RNA, 17 nt, Mycobacterium avium subsp. paratuberculosis
gcugggcguugccgguc

SEQ ID NO: 3015761 - RNA, 15 nt, Mycobacterium avium subsp. paratuberculosis
gcugggcuaccagcc

SEQ ID NO: 3015762 - RNA, 17 nt, Mycobacterium avium subsp. paratuberculosis
gcugggcuaccagcccc

SEQ ID NO: 3015763 - RNA, 18 nt, Mycobacterium avium subsp. paratuberculosis
gcugggcuccgaccguga

SEQ ID NO: 3015764 - RNA, 23 nt, Mycobacterium avium subsp. paratuberculosis
gcugggcucgagugccggcagcc

SEQ ID NO: 3015765 - RNA, 16 nt, Mycobacterium avium subsp. paratuberculosis
gcugggcugccagcga

SEQ ID NO: 3015766 - RNA, 17 nt, Mycobacterium avium subsp. paratuberculosis
gcugggcuuccacagcc

SEQ ID NO: 3015767 - RNA, 20 nt, Mycobacterium avium subsp. paratuberculosis
gcugggcuuccacagcccgu

SEQ ID NO: 3015768 - RNA, 15 nt, Mycobacterium avium subsp. paratuberculosis
gcuggggcgcaccgc

SEQ ID NO: 3015769 - RNA, 17 nt, Mycobacterium avium subsp. paratuberculosis
gcuggggguggcgucga

SEQ ID NO: 3015770 - RNA, 19 nt, Mycobacterium avium subsp. paratuberculosis
gcuggggguggcgucgacg

SEQ ID NO: 3015771 - RNA, 20 nt, Mycobacterium avium subsp. paratuberculosis
gcuggggguggcgucgacgg

SEQ ID NO: 3015772 - RNA, 16 nt, Mycobacterium avium subsp. paratuberculosis
gcuggggucggccagc

SEQ ID NO: 3015773 - RNA, 18 nt, Mycobacterium avium subsp. paratuberculosis
gcuggggucggccagcga

SEQ ID NO: 3015774 - RNA, 18 nt, Mycobacterium avium subsp. paratuberculosis
gcuggggugcccaccagc

SEQ ID NO: 3015775 - RNA, 20 nt, Mycobacterium avium subsp. paratuberculosis
gcuggggugcucgaucagcg

SEQ ID NO: 3015776 - RNA, 14 nt, Mycobacterium avium subsp. paratuberculosis
gcugggucaccacg

SEQ ID NO: 3015777 - RNA, 15 nt, Mycobacterium avium subsp. paratuberculosis
gcugggucaccacgg

SEQ ID NO: 3015778 - RNA, 17 nt, Mycobacterium avium subsp. paratuberculosis
gcugggucaccacgguc

SEQ ID NO: 3015779 - RNA, 17 nt, Mycobacterium avium subsp. paratuberculosis
gcugggugaacaccccg

SEQ ID NO: 3015780 - RNA, 22 nt, Mycobacterium avium subsp. paratuberculosis
gcugggugaacaccccgcggga

SEQ ID NO: 3015781 - RNA, 13 nt, Mycobacterium avium subsp. paratuberculosis
gcugggugccgcg

SEQ ID NO: 3015782 - RNA, 21 nt, Mycobacterium avium subsp. paratuberculosis
gcuggguggacaccuuggcgg

SEQ ID NO: 3015783 - RNA, 17 nt, Mycobacterium avium subsp. paratuberculosis
gcuggguggucaccagc

SEQ ID NO: 3015784 - RNA, 18 nt, Mycobacterium avium subsp. paratuberculosis
gcuggguggucaccagcg

SEQ ID NO: 3015785 - RNA, 21 nt, Mycobacterium avium subsp. paratuberculosis
gcuggguggucaccagcgcgg

SEQ ID NO: 3015786 - RNA, 23 nt, Mycobacterium avium subsp. paratuberculosis
gcuggguggucaccagcgcgguc

SEQ ID NO: 3015787 - RNA, 22 nt, Mycobacterium avium subsp. paratuberculosis
gcuggguguuccccgggcgagc

SEQ ID NO: 3015788 - RNA, 14 nt, Mycobacterium avium subsp. paratuberculosis
gcuggguuccgcga

SEQ ID NO: 3015789 - RNA, 20 nt, Mycobacterium avium subsp. paratuberculosis
gcugguagaugccgaagccg

SEQ ID NO: 3015790 - RNA, 16 nt, Mycobacterium avium subsp. paratuberculosis
gcugguaggcggcgca

SEQ ID NO: 3015791 - RNA, 18 nt, Mycobacterium avium subsp. paratuberculosis
gcugguaguacaccgggc

SEQ ID NO: 3015792 - RNA, 18 nt, Mycobacterium avium subsp. paratuberculosis
gcugguaguggcgugcgg

SEQ ID NO: 3015793 - RNA, 19 nt, Mycobacterium avium subsp. paratuberculosis
gcuggucacccacuggcgg

SEQ ID NO: 3015794 - RNA, 19 nt, Mycobacterium avium subsp. paratuberculosis
gcuggucaugccgucgacg

SEQ ID NO: 3015795 - RNA, 15 nt, Mycobacterium avium subsp. paratuberculosis
gcuggucccacagcg

SEQ ID NO: 3015796 - RNA, 19 nt, Mycobacterium avium subsp. paratuberculosis
gcuggucccacagcggggu

SEQ ID NO: 3015797 - RNA, 19 nt, Mycobacterium avium subsp. paratuberculosis
gcugguccggaaccgcgcc

SEQ ID NO: 3015798 - RNA, 15 nt, Mycobacterium avium subsp. paratuberculosis
gcugguccggccggc

SEQ ID NO: 3015799 - RNA, 16 nt, Mycobacterium avium subsp. paratuberculosis
gcugguccggccggcc

SEQ ID NO: 3015800 - RNA, 17 nt, Mycobacterium avium subsp. paratuberculosis
gcugguccggccggccg

SEQ ID NO: 3015801 - RNA, 18 nt, Mycobacterium avium subsp. paratuberculosis
gcugguccggccggccga

SEQ ID NO: 3015802 - RNA, 13 nt, Mycobacterium avium subsp. paratuberculosis
gcugguccucggg

SEQ ID NO: 3015803 - RNA, 17 nt, Mycobacterium avium subsp. paratuberculosis
gcuggucgaaccgcgag

SEQ ID NO: 3015804 - RNA, 22 nt, Mycobacterium avium subsp. paratuberculosis
gcuggucgaaccgcgagcgcgc

SEQ ID NO: 3015805 - RNA, 19 nt, Mycobacterium avium subsp. paratuberculosis
gcuggucgacgucauccgg

SEQ ID NO: 3015806 - RNA, 18 nt, Mycobacterium avium subsp. paratuberculosis
gcuggucgcccaccacga

SEQ ID NO: 3015807 - RNA, 20 nt, Mycobacterium avium subsp. paratuberculosis
gcuggucgcccaccacgacg

SEQ ID NO: 3015808 - RNA, 23 nt, Mycobacterium avium subsp. paratuberculosis
gcuggucgcccaccacgacgacg

SEQ ID NO: 3015809 - RNA, 17 nt, Mycobacterium avium subsp. paratuberculosis
gcuggucgcgaagcgua

SEQ ID NO: 3015810 - RNA, 13 nt, Mycobacterium avium subsp. paratuberculosis
gcuggucggcggc

SEQ ID NO: 3015811 - RNA, 15 nt, Mycobacterium avium subsp. paratuberculosis
gcuggucggcgggua

SEQ ID NO: 3015812 - RNA, 18 nt, Mycobacterium avium subsp. paratuberculosis
gcuggucucgggcaccac

SEQ ID NO: 3015813 - RNA, 19 nt, Mycobacterium avium subsp. paratuberculosis
gcuggucucgggcaccacg

SEQ ID NO: 3015814 - RNA, 20 nt, Mycobacterium avium subsp. paratuberculosis
gcuggucucgggcaccacgc

SEQ ID NO: 3015815 - RNA, 21 nt, Mycobacterium avium subsp. paratuberculosis
gcuggucuucggugucgcaca

SEQ ID NO: 3015816 - RNA, 23 nt, Mycobacterium avium subsp. paratuberculosis
gcuggucuucggugucgcacagc

SEQ ID NO: 3015817 - RNA, 19 nt, Mycobacterium avium subsp. paratuberculosis
gcuggucuugccgugcagc

SEQ ID NO: 3015818 - RNA, 20 nt, Mycobacterium avium subsp. paratuberculosis
gcuggucuugccgugcagca

SEQ ID NO: 3015819 - RNA, 22 nt, Mycobacterium avium subsp. paratuberculosis
gcuggucuugccgugcagcagu

SEQ ID NO: 3015820 - RNA, 14 nt, Mycobacterium avium subsp. paratuberculosis
gcuggugaacucgc

SEQ ID NO: 3015821 - RNA, 20 nt, Mycobacterium avium subsp. paratuberculosis
gcuggugaacucgccgaucg

SEQ ID NO: 3015822 - RNA, 13 nt, Mycobacterium avium subsp. paratuberculosis
gcuggugacgccg

SEQ ID NO: 3015823 - RNA, 20 nt, Mycobacterium avium subsp. paratuberculosis
gcuggugacgugcaccugca

SEQ ID NO: 3015824 - RNA, 16 nt, Mycobacterium avium subsp. paratuberculosis
gcuggugaggucgcgc

SEQ ID NO: 3015825 - RNA, 14 nt, Mycobacterium avium subsp. paratuberculosis
gcuggugauggcca

SEQ ID NO: 3015826 - RNA, 14 nt, Mycobacterium avium subsp. paratuberculosis
gcuggugcacccga

SEQ ID NO: 3015827 - RNA, 23 nt, Mycobacterium avium subsp. paratuberculosis
gcuggugcagcagggcgcgcauc

SEQ ID NO: 3015828 - RNA, 14 nt, Mycobacterium avium subsp. paratuberculosis
gcuggugccgccga

SEQ ID NO: 3015829 - RNA, 16 nt, Mycobacterium avium subsp. paratuberculosis
gcuggugccgccgaug

SEQ ID NO: 3015830 - RNA, 14 nt, Mycobacterium avium subsp. paratuberculosis
gcuggugccgccgg

SEQ ID NO: 3015831 - RNA, 15 nt, Mycobacterium avium subsp. paratuberculosis
gcuggugccgccggc

SEQ ID NO: 3015832 - RNA, 19 nt, Mycobacterium avium subsp. paratuberculosis
gcuggugccgccggcgauc

SEQ ID NO: 3015833 - RNA, 16 nt, Mycobacterium avium subsp. paratuberculosis
gcuggugcgcagcccg

SEQ ID NO: 3015834 - RNA, 20 nt, Mycobacterium avium subsp. paratuberculosis
gcuggugcgcagccgucgca

SEQ ID NO: 3015835 - RNA, 14 nt, Mycobacterium avium subsp. paratuberculosis
gcuggugcgcgccg

SEQ ID NO: 3015836 - RNA, 16 nt, Mycobacterium avium subsp. paratuberculosis
gcuggugcgcgccggc

SEQ ID NO: 3015837 - RNA, 17 nt, Mycobacterium avium subsp. paratuberculosis
gcuggugcgcgccggcg

SEQ ID NO: 3015838 - RNA, 20 nt, Mycobacterium avium subsp. paratuberculosis
gcuggugcgcgccggcgucg

SEQ ID NO: 3015839 - RNA, 20 nt, Mycobacterium avium subsp. paratuberculosis
gcuggugggccaucgccagg

SEQ ID NO: 3015840 - RNA, 20 nt, Mycobacterium avium subsp. paratuberculosis
gcuggugucccgcguggccg

SEQ ID NO: 3015841 - RNA, 19 nt, Mycobacterium avium subsp. paratuberculosis
gcuggugugacgcucgcgg

SEQ ID NO: 3015842 - RNA, 15 nt, Mycobacterium avium subsp. paratuberculosis
gcugguuucgggucg

SEQ ID NO: 3015843 - RNA, 16 nt, Mycobacterium avium subsp. paratuberculosis
gcugguuucgggucga

SEQ ID NO: 3015844 - RNA, 22 nt, Mycobacterium avium subsp. paratuberculosis
gcuguaccgcgagaucagcgcc

SEQ ID NO: 3015845 - RNA, 20 nt, Mycobacterium avium subsp. paratuberculosis
gcuguacgacaacagugccu

SEQ ID NO: 3015846 - RNA, 13 nt, Mycobacterium avium subsp. paratuberculosis
gcuguagagcagu

SEQ ID NO: 3015847 - RNA, 15 nt, Mycobacterium avium subsp. paratuberculosis
gcuguagcacccggc

SEQ ID NO: 3015848 - RNA, 22 nt, Mycobacterium avium subsp. paratuberculosis
gcuguagcacccggccggcgaa

SEQ ID NO: 3015849 - RNA, 19 nt, Mycobacterium avium subsp. paratuberculosis
gcuguagcggucgugcggg

SEQ ID NO: 3015850 - RNA, 13 nt, Mycobacterium avium subsp. paratuberculosis
gcuguaggccagc

SEQ ID NO: 3015851 - RNA, 16 nt, Mycobacterium avium subsp. paratuberculosis
gcuguaggccagcccg

SEQ ID NO: 3015852 - RNA, 15 nt, Mycobacterium avium subsp. paratuberculosis
gcuguagggccacca

SEQ ID NO: 3015853 - RNA, 16 nt, Mycobacterium avium subsp. paratuberculosis
gcuguaguagccgggg

SEQ ID NO: 3015854 - RNA, 19 nt, Mycobacterium avium subsp. paratuberculosis
gcuguaguagccggggacg

SEQ ID NO: 3015855 - RNA, 17 nt, Mycobacterium avium subsp. paratuberculosis
gcugucaauccccgcgg

SEQ ID NO: 3015856 - RNA, 18 nt, Mycobacterium avium subsp. paratuberculosis
gcuguccacguccugcca

SEQ ID NO: 3015857 - RNA, 22 nt, Mycobacterium avium subsp. paratuberculosis
gcugucccagugcgugaccugc

SEQ ID NO: 3015858 - RNA, 17 nt, Mycobacterium avium subsp. paratuberculosis
gcugucccggccgcgac

SEQ ID NO: 3015859 - RNA, 20 nt, Mycobacterium avium subsp. paratuberculosis
gcugucccggccgcgacagc

SEQ ID NO: 3015860 - RNA, 22 nt, Mycobacterium avium subsp. paratuberculosis
gcugucccggccgcgacagccg

SEQ ID NO: 3015861 - RNA, 15 nt, Mycobacterium avium subsp. paratuberculosis
gcuguccgcguggcc

SEQ ID NO: 3015862 - RNA, 17 nt, Mycobacterium avium subsp. paratuberculosis
gcuguccucccagcgcc

SEQ ID NO: 3015863 - RNA, 23 nt, Mycobacterium avium subsp. paratuberculosis
gcuguccucccagcgcccgggcg

SEQ ID NO: 3015864 - RNA, 22 nt, Mycobacterium avium subsp. paratuberculosis
gcuguccucgagcgcgucgacc

SEQ ID NO: 3015865 - RNA, 16 nt, Mycobacterium avium subsp. paratuberculosis
gcuguccugccgggcg

SEQ ID NO: 3015866 - RNA, 19 nt, Mycobacterium avium subsp. paratuberculosis
gcuguccugccgggcgucg

SEQ ID NO: 3015867 - RNA, 19 nt, Mycobacterium avium subsp. paratuberculosis
gcugucgaacaccgugccg

SEQ ID NO: 3015868 - RNA, 17 nt, Mycobacterium avium subsp. paratuberculosis
gcugucgcccucgaucg

SEQ ID NO: 3015869 - RNA, 22 nt, Mycobacterium avium subsp. paratuberculosis
gcugucgcccucgaucgcgacc

SEQ ID NO: 3015870 - RNA, 14 nt, Mycobacterium avium subsp. paratuberculosis
gcugucgccgaggu

SEQ ID NO: 3015871 - RNA, 14 nt, Mycobacterium avium subsp. paratuberculosis
gcugucgcgggccc

SEQ ID NO: 3015872 - RNA, 17 nt, Mycobacterium avium subsp. paratuberculosis
gcugucgcgggcccgcg

SEQ ID NO: 3015873 - RNA, 18 nt, Mycobacterium avium subsp. paratuberculosis
gcugucgcgggcccgcgu

SEQ ID NO: 3015874 - RNA, 17 nt, Mycobacterium avium subsp. paratuberculosis
gcugucgcgggucuggc

SEQ ID NO: 3015875 - RNA, 21 nt, Mycobacterium avium subsp. paratuberculosis
gcugucggcgaaacaccaagc

SEQ ID NO: 3015876 - RNA, 16 nt, Mycobacterium avium subsp. paratuberculosis
gcugucggcgcccaga

SEQ ID NO: 3015877 - RNA, 20 nt, Mycobacterium avium subsp. paratuberculosis
gcugucgggcaggccggugc

SEQ ID NO: 3015878 - RNA, 22 nt, Mycobacterium avium subsp. paratuberculosis
gcugucgggcaggccggugcug

SEQ ID NO: 3015879 - RNA, 16 nt, Mycobacterium avium subsp. paratuberculosis
gcugucggggucgcgg

SEQ ID NO: 3015880 - RNA, 17 nt, Mycobacterium avium subsp. paratuberculosis
gcugucggggucgcggc

SEQ ID NO: 3015881 - RNA, 18 nt, Mycobacterium avium subsp. paratuberculosis
gcugucggggucgcggcc

SEQ ID NO: 3015882 - RNA, 21 nt, Mycobacterium avium subsp. paratuberculosis
gcugucggggucgcggcccgc

SEQ ID NO: 3015883 - RNA, 15 nt, Mycobacterium avium subsp. paratuberculosis
gcugucgggugccgc

SEQ ID NO: 3015884 - RNA, 16 nt, Mycobacterium avium subsp. paratuberculosis
gcugucgggugccgcc

SEQ ID NO: 3015885 - RNA, 15 nt, Mycobacterium avium subsp. paratuberculosis
gcugucggguggcag

SEQ ID NO: 3015886 - RNA, 16 nt, Mycobacterium avium subsp. paratuberculosis
gcguucccagcccggc

SEQ ID NO: 3015887 - RNA, 19 nt, Mycobacterium avium subsp. paratuberculosis
gcguucccagcccggccag

SEQ ID NO: 3015888 - RNA, 13 nt, Mycobacterium avium subsp. paratuberculosis
gcguucccgggcc

SEQ ID NO: 3015889 - RNA, 15 nt, Mycobacterium avium subsp. paratuberculosis
gcguucccgggcccg

SEQ ID NO: 3015890 - RNA, 16 nt, Mycobacterium avium subsp. paratuberculosis
gcguucccgggcccgc

SEQ ID NO: 3015891 - RNA, 22 nt, Mycobacterium avium subsp. paratuberculosis
gcguucccgggcccgcugcagc

SEQ ID NO: 3015892 - RNA, 15 nt, Mycobacterium avium subsp. paratuberculosis
gcguuccggcggccg

SEQ ID NO: 3015893 - RNA, 18 nt, Mycobacterium avium subsp. paratuberculosis
gcguuccucgacggcgaa

SEQ ID NO: 3015894 - RNA, 20 nt, Mycobacterium avium subsp. paratuberculosis
gcguuccucgacggcgaagc

SEQ ID NO: 3015895 - RNA, 17 nt, Mycobacterium avium subsp. paratuberculosis
gcguuccuuacgccgac

SEQ ID NO: 3015896 - RNA, 20 nt, Mycobacterium avium subsp. paratuberculosis
gcguucgacccacaccucgc

SEQ ID NO: 3015897 - RNA, 19 nt, Mycobacterium avium subsp. paratuberculosis
gcguucgaugcccugcccc

SEQ ID NO: 3015898 - RNA, 14 nt, Mycobacterium avium subsp. paratuberculosis
gcguucgccggcgu

SEQ ID NO: 3015899 - RNA, 20 nt, Mycobacterium avium subsp. paratuberculosis
gcguucgcguucgggcagcg

SEQ ID NO: 3015900 - RNA, 22 nt, Mycobacterium avium subsp. paratuberculosis
gcguucggccaguucggguccg

SEQ ID NO: 3015901 - RNA, 13 nt, Mycobacterium avium subsp. paratuberculosis
gcguucggcgauc

SEQ ID NO: 3015902 - RNA, 23 nt, Mycobacterium avium subsp. paratuberculosis
gcguucggcgauccgggcacgca

SEQ ID NO: 3015903 - RNA, 15 nt, Mycobacterium avium subsp. paratuberculosis
gcguucggcgccacc

SEQ ID NO: 3015904 - RNA, 16 nt, Mycobacterium avium subsp. paratuberculosis
gcguucggcgccaccc

SEQ ID NO: 3015905 - RNA, 19 nt, Mycobacterium avium subsp. paratuberculosis
gcguucggcgccaccccgg

SEQ ID NO: 3015906 - RNA, 16 nt, Mycobacterium avium subsp. paratuberculosis
gcguucggcggcgcgc

SEQ ID NO: 3015907 - RNA, 20 nt, Mycobacterium avium subsp. paratuberculosis
gcguucggcggcgcgcugca

SEQ ID NO: 3015908 - RNA, 16 nt, Mycobacterium avium subsp. paratuberculosis
gcguucgggauccucg

SEQ ID NO: 3015909 - RNA, 17 nt, Mycobacterium avium subsp. paratuberculosis
gcguucgggauccucgc

SEQ ID NO: 3015910 - RNA, 13 nt, Mycobacterium avium subsp. paratuberculosis
gcguucgggcagc

SEQ ID NO: 3015911 - RNA, 16 nt, Mycobacterium avium subsp. paratuberculosis
gcguucgggcccggcc

SEQ ID NO: 3015912 - RNA, 17 nt, Mycobacterium avium subsp. paratuberculosis
gcguucgucgccgguga

SEQ ID NO: 3015913 - RNA, 14 nt, Mycobacterium avium subsp. paratuberculosis
gcguucgucggcgc

SEQ ID NO: 3015914 - RNA, 15 nt, Mycobacterium avium subsp. paratuberculosis
gcguucgucggcgcg

SEQ ID NO: 3015915 - RNA, 15 nt, Mycobacterium avium subsp. paratuberculosis
gcguucuccacccgc

SEQ ID NO: 3015916 - RNA, 20 nt, Mycobacterium avium subsp. paratuberculosis
gcguucuccacccgccccuc

SEQ ID NO: 3015917 - RNA, 16 nt, Mycobacterium avium subsp. paratuberculosis
gcguucuccaccgcgc

SEQ ID NO: 3015918 - RNA, 16 nt, Mycobacterium avium subsp. paratuberculosis
gcguucuccagcaccc

SEQ ID NO: 3015919 - RNA, 16 nt, Mycobacterium avium subsp. paratuberculosis
gcguucuccucgaaca

SEQ ID NO: 3015920 - RNA, 13 nt, Mycobacterium avium subsp. paratuberculosis
gcguucugcacca

SEQ ID NO: 3015921 - RNA, 16 nt, Mycobacterium avium subsp. paratuberculosis
gcguucugcaccagcu

SEQ ID NO: 3015922 - RNA, 18 nt, Mycobacterium avium subsp. paratuberculosis
gcguucugcaccagcucg

SEQ ID NO: 3015923 - RNA, 22 nt, Mycobacterium avium subsp. paratuberculosis
gcuacggacgcauccacggccg

SEQ ID NO: 3015924 - RNA, 17 nt, Mycobacterium avium subsp. paratuberculosis
gcuacucggacgccggc

SEQ ID NO: 3015925 - RNA, 18 nt, Mycobacterium avium subsp. paratuberculosis
gcuacucggacgccggca

SEQ ID NO: 3015926 - RNA, 18 nt, Mycobacterium avium subsp. paratuberculosis
gcuacugccgacgcauuu

SEQ ID NO: 3015927 - RNA, 15 nt, Mycobacterium avium subsp. paratuberculosis
gcuagcagcuccggu

SEQ ID NO: 3015928 - RNA, 19 nt, Mycobacterium avium subsp. paratuberculosis
gcuagcagcuccggucggc

SEQ ID NO: 3015929 - RNA, 16 nt, Mycobacterium avium subsp. paratuberculosis
gcuagcgagcgggcac

SEQ ID NO: 3015930 - RNA, 23 nt, Mycobacterium avium subsp. paratuberculosis
gcuagcgagcgggcacgccgccg

SEQ ID NO: 3015931 - RNA, 13 nt, Mycobacterium avium subsp. paratuberculosis
gcuagcgggcgcg

SEQ ID NO: 3015932 - RNA, 18 nt, Mycobacterium avium subsp. paratuberculosis
gcuagcgggcgcgcagcc

SEQ ID NO: 3015933 - RNA, 21 nt, Mycobacterium avium subsp. paratuberculosis
gcuagcgggcgcgcagccacg

SEQ ID NO: 3015934 - RNA, 22 nt, Mycobacterium avium subsp. paratuberculosis
gcuagcgggcgcgcagccacga

SEQ ID NO: 3015935 - RNA, 14 nt, Mycobacterium avium subsp. paratuberculosis
gcuagcgugacagu

SEQ ID NO: 3015936 - RNA, 22 nt, Mycobacterium avium subsp. paratuberculosis
gcuagcgugacagucgaccucg

SEQ ID NO: 3015937 - RNA, 23 nt, Mycobacterium avium subsp. paratuberculosis
gcuagcgugacagucgaccucgc

SEQ ID NO: 3015938 - RNA, 15 nt, Mycobacterium avium subsp. paratuberculosis
gcuagcugcgccggc

SEQ ID NO: 3015939 - RNA, 18 nt, Mycobacterium avium subsp. paratuberculosis
gcuagcuucacgcucggc

SEQ ID NO: 3015940 - RNA, 20 nt, Mycobacterium avium subsp. paratuberculosis
gcuagcuucacgcucggcgc

SEQ ID NO: 3015941 - RNA, 23 nt, Mycobacterium avium subsp. paratuberculosis
gcuagcuucacgcucggcgccga

SEQ ID NO: 3015942 - RNA, 19 nt, Mycobacterium avium subsp. paratuberculosis
gcuaggacgcgggccuggg

SEQ ID NO: 3015943 - RNA, 11 nt, Mycobacterium avium subsp. paratuberculosis
gcuaggccagc

SEQ ID NO: 3015944 - RNA, 14 nt, Mycobacterium avium subsp. paratuberculosis
gcuaggccagcagc

SEQ ID NO: 3015945 - RNA, 15 nt, Mycobacterium avium subsp. paratuberculosis
gcuaggccagcagcg

SEQ ID NO: 3015946 - RNA, 17 nt, Mycobacterium avium subsp. paratuberculosis
gcuaggccagcagcgcg

SEQ ID NO: 3015947 - RNA, 12 nt, Mycobacterium avium subsp. paratuberculosis
gcuaggcggccg

SEQ ID NO: 3015948 - RNA, 14 nt, Mycobacterium avium subsp. paratuberculosis
gcuaggcggccggg

SEQ ID NO: 3015949 - RNA, 16 nt, Mycobacterium avium subsp. paratuberculosis
gcuaggcggccgggcg

SEQ ID NO: 3015950 - RNA, 17 nt, Mycobacterium avium subsp. paratuberculosis
gcuaggcggccgggcgg

SEQ ID NO: 3015951 - RNA, 17 nt, Mycobacterium avium subsp. paratuberculosis
gcuaggcucggcagccg

SEQ ID NO: 3015952 - RNA, 15 nt, Mycobacterium avium subsp. paratuberculosis
gcuagguagcagacg

SEQ ID NO: 3015953 - RNA, 16 nt, Mycobacterium avium subsp. paratuberculosis
gcuagguagcagacgg

SEQ ID NO: 3015954 - RNA, 20 nt, Mycobacterium avium subsp. paratuberculosis
gcuaggucaccggauucggc

SEQ ID NO: 3015955 - RNA, 19 nt, Mycobacterium avium subsp. paratuberculosis
gcuagguuuggccagcacc

SEQ ID NO: 3015956 - RNA, 14 nt, Mycobacterium avium subsp. paratuberculosis
gcuagucgcccagc

SEQ ID NO: 3015957 - RNA, 16 nt, Mycobacterium avium subsp. paratuberculosis
gcuagucgcccagcag

SEQ ID NO: 3015958 - RNA, 19 nt, Mycobacterium avium subsp. paratuberculosis
gcuagucgcccagcagccc

SEQ ID NO: 3015959 - RNA, 20 nt, Mycobacterium avium subsp. paratuberculosis
gcuagucgcccagcagcccg

SEQ ID NO: 3015960 - RNA, 18 nt, Mycobacterium avium subsp. paratuberculosis
gcuaguuucacgcucggc

SEQ ID NO: 3015961 - RNA, 19 nt, Mycobacterium avium subsp. paratuberculosis
gcuaguuucacgcucggcg

SEQ ID NO: 3015962 - RNA, 16 nt, Mycobacterium avium subsp. paratuberculosis
gcuauaucgcaccggc

SEQ ID NO: 3015963 - RNA, 17 nt, Mycobacterium avium subsp. paratuberculosis
gcuauaucgcaccggcg

SEQ ID NO: 3015964 - RNA, 11 nt, Mycobacterium avium subsp. paratuberculosis
gcuauccgggg

SEQ ID NO: 3015965 - RNA, 15 nt, Mycobacterium avium subsp. paratuberculosis
gcuaucgcccggcgc

SEQ ID NO: 3015966 - RNA, 17 nt, Mycobacterium avium subsp. paratuberculosis
gcuaucgcccggcgccc

SEQ ID NO: 3015967 - RNA, 18 nt, Mycobacterium avium subsp. paratuberculosis
gcuaucgcccggcgcccg

SEQ ID NO: 3015968 - RNA, 22 nt, Mycobacterium avium subsp. paratuberculosis
gcuaucgcccggcgcccggccg

SEQ ID NO: 3015969 - RNA, 21 nt, Mycobacterium avium subsp. paratuberculosis
gcuauucgggccugaccaagg

SEQ ID NO: 3015970 - RNA, 18 nt, Mycobacterium avium subsp. paratuberculosis
gcucgagcaucuccagcc

SEQ ID NO: 3015971 - RNA, 19 nt, Mycobacterium avium subsp. paratuberculosis
gcucgagcaucuccagccg

SEQ ID NO: 3015972 - RNA, 18 nt, Mycobacterium avium subsp. paratuberculosis
gcucgagcaucucggugc

SEQ ID NO: 3015973 - RNA, 16 nt, Mycobacterium avium subsp. paratuberculosis
gcucgagccccaguuc

SEQ ID NO: 3015974 - RNA, 16 nt, Mycobacterium avium subsp. paratuberculosis
gcucgagcucggcgag

SEQ ID NO: 3015975 - RNA, 17 nt, Mycobacterium avium subsp. paratuberculosis
gcucgagcucgucgggu

SEQ ID NO: 3015976 - RNA, 14 nt, Mycobacterium avium subsp. paratuberculosis
gcucgaggccccgc

SEQ ID NO: 3015977 - RNA, 15 nt, Mycobacterium avium subsp. paratuberculosis
gcucgaggccccgcg

SEQ ID NO: 3015978 - RNA, 18 nt, Mycobacterium avium subsp. paratuberculosis
gcucgaggccccgcguga

SEQ ID NO: 3015979 - RNA, 16 nt, Mycobacterium avium subsp. paratuberculosis
gcucgaggccgcgggc

SEQ ID NO: 3015980 - RNA, 20 nt, Mycobacterium avium subsp. paratuberculosis
gcucgagggccuccaccacc

SEQ ID NO: 3015981 - RNA, 16 nt, Mycobacterium avium subsp. paratuberculosis
gcucgagggcggcgac

SEQ ID NO: 3015982 - RNA, 19 nt, Mycobacterium avium subsp. paratuberculosis
gcucgagggcggcgaccug

SEQ ID NO: 3015983 - RNA, 18 nt, Mycobacterium avium subsp. paratuberculosis
gcucgaguuuggccagcu

SEQ ID NO: 3015984 - RNA, 19 nt, Mycobacterium avium subsp. paratuberculosis
gcucgaguuuggccagcuc

SEQ ID NO: 3015985 - RNA, 13 nt, Mycobacterium avium subsp. paratuberculosis
gcucgaucaccca

SEQ ID NO: 3015986 - RNA, 15 nt, Mycobacterium avium subsp. paratuberculosis
gcucgaucagcgacu

SEQ ID NO: 3015987 - RNA, 23 nt, Mycobacterium avium subsp. paratuberculosis
gcucgaucagcgacucgaccccg

SEQ ID NO: 3015988 - RNA, 14 nt, Mycobacterium avium subsp. paratuberculosis
gcucgaucgccgcg

SEQ ID NO: 3015989 - RNA, 15 nt, Mycobacterium avium subsp. paratuberculosis
gcucgaucgccgcgc

SEQ ID NO: 3015990 - RNA, 20 nt, Mycobacterium avium subsp. paratuberculosis
gcucgaucgccgcgcccagc

SEQ ID NO: 3015991 - RNA, 16 nt, Mycobacterium avium subsp. paratuberculosis
gcucgaucgcguucug

SEQ ID NO: 3015992 - RNA, 21 nt, Mycobacterium avium subsp. paratuberculosis
gcucgaucgcguucugcacca

SEQ ID NO: 3015993 - RNA, 15 nt, Mycobacterium avium subsp. paratuberculosis
gcucgaucggcgcgc

SEQ ID NO: 3015994 - RNA, 16 nt, Mycobacterium avium subsp. paratuberculosis
gcucgaucggcgcgcc

SEQ ID NO: 3015995 - RNA, 16 nt, Mycobacterium avium subsp. paratuberculosis
gcucgaucgucaggaa

SEQ ID NO: 3015996 - RNA, 17 nt, Mycobacterium avium subsp. paratuberculosis
gcucgaucgucaggaau

SEQ ID NO: 3015997 - RNA, 15 nt, Mycobacterium avium subsp. paratuberculosis
gcucgaucucggcca

SEQ ID NO: 3015998 - RNA, 20 nt, Mycobacterium avium subsp. paratuberculosis
gcucgaucucggccaccguc

SEQ ID NO: 3015999 - RNA, 15 nt, Mycobacterium avium subsp. paratuberculosis
gcucgaucugcuccg

SEQ ID NO: 3016000 - RNA, 13 nt, Mycobacterium avium subsp. paratuberculosis
gcucgaucuggcg

SEQ ID NO: 3016001 - RNA, 14 nt, Mycobacterium avium subsp. paratuberculosis
gcucgaucuggcgg

SEQ ID NO: 3016002 - RNA, 19 nt, Mycobacterium avium subsp. paratuberculosis
gcucgaugccguucgcgcc

SEQ ID NO: 3016003 - RNA, 23 nt, Mycobacterium avium subsp. paratuberculosis
gcucgaugcgacgcaccucggcc

SEQ ID NO: 3016004 - RNA, 18 nt, Mycobacterium avium subsp. paratuberculosis
gcugcacgacgaccgcga

SEQ ID NO: 3016005 - RNA, 21 nt, Mycobacterium avium subsp. paratuberculosis
gcugcacgacgaccgcgacgg

SEQ ID NO: 3016006 - RNA, 22 nt, Mycobacterium avium subsp. paratuberculosis
gcugcacgacgaccgcgacggc

SEQ ID NO: 3016007 - RNA, 23 nt, Mycobacterium avium subsp. paratuberculosis
gcugcacgcguugcagcgccgcg

SEQ ID NO: 3016008 - RNA, 15 nt, Mycobacterium avium subsp. paratuberculosis
gcugcacgcugcgca

SEQ ID NO: 3016009 - RNA, 19 nt, Mycobacterium avium subsp. paratuberculosis
gcugcacgucacgggccag

SEQ ID NO: 3016010 - RNA, 23 nt, Mycobacterium avium subsp. paratuberculosis
gcugcacgucacgggccaggcgc

SEQ ID NO: 3016011 - RNA, 13 nt, Mycobacterium avium subsp. paratuberculosis
gcugcacgucgcc

SEQ ID NO: 3016012 - RNA, 14 nt, Mycobacterium avium subsp. paratuberculosis
gcugcacgucgccg

SEQ ID NO: 3016013 - RNA, 19 nt, Mycobacterium avium subsp. paratuberculosis
gcugcacgucgccggcgac

SEQ ID NO: 3016014 - RNA, 17 nt, Mycobacterium avium subsp. paratuberculosis
gcugcagaccgaacguc

SEQ ID NO: 3016015 - RNA, 14 nt, Mycobacterium avium subsp. paratuberculosis
gcugcagauccgcu

SEQ ID NO: 3016016 - RNA, 21 nt, Mycobacterium avium subsp. paratuberculosis
gcugcagcagaugcgccucga

SEQ ID NO: 3016017 - RNA, 12 nt, Mycobacterium avium subsp. paratuberculosis
gcugcagcagcc

SEQ ID NO: 3016018 - RNA, 15 nt, Mycobacterium avium subsp. paratuberculosis
gcugcagcagcccga

SEQ ID NO: 3016019 - RNA, 16 nt, Mycobacterium avium subsp. paratuberculosis
gcugcagcagcccgau

SEQ ID NO: 3016020 - RNA, 22 nt, Mycobacterium avium subsp. paratuberculosis
gcugcagcagcccgaucacccc

SEQ ID NO: 3016021 - RNA, 19 nt, Mycobacterium avium subsp. paratuberculosis
gcugcagcauuuccgagcg

SEQ ID NO: 3016022 - RNA, 21 nt, Mycobacterium avium subsp. paratuberculosis
gcugcagcauuuccgagcgac

SEQ ID NO: 3016023 - RNA, 14 nt, Mycobacterium avium subsp. paratuberculosis
gcugcagccgggcg

SEQ ID NO: 3016024 - RNA, 15 nt, Mycobacterium avium subsp. paratuberculosis
gcugcagccgggcgg

SEQ ID NO: 3016025 - RNA, 15 nt, Mycobacterium avium subsp. paratuberculosis
gcugcagccgguccg

SEQ ID NO: 3016026 - RNA, 16 nt, Mycobacterium avium subsp. paratuberculosis
gcugcagccgguccgg

SEQ ID NO: 3016027 - RNA, 18 nt, Mycobacterium avium subsp. paratuberculosis
gcugcagccgguccggcg

SEQ ID NO: 3016028 - RNA, 20 nt, Mycobacterium avium subsp. paratuberculosis
gcugcagccgguccggcggc

SEQ ID NO: 3016029 - RNA, 15 nt, Mycobacterium avium subsp. paratuberculosis
gcugcagcgacugga

SEQ ID NO: 3016030 - RNA, 20 nt, Mycobacterium avium subsp. paratuberculosis
gcugcagcgacuggaccacc

SEQ ID NO: 3016031 - RNA, 12 nt, Mycobacterium avium subsp. paratuberculosis
gcugcagcgaga

SEQ ID NO: 3016032 - RNA, 20 nt, Mycobacterium avium subsp. paratuberculosis
gcugcagcgagaccucccgg

SEQ ID NO: 3016033 - RNA, 23 nt, Mycobacterium avium subsp. paratuberculosis
gcugcagcgccgaggccagcacg

SEQ ID NO: 3016034 - RNA, 16 nt, Mycobacterium avium subsp. paratuberculosis
gcugcagcgccgcccg

SEQ ID NO: 3016035 - RNA, 18 nt, Mycobacterium avium subsp. paratuberculosis
gcugcagcgccgcccgca

SEQ ID NO: 3016036 - RNA, 23 nt, Mycobacterium avium subsp. paratuberculosis
gcugcagcgccgcccgcaccugc

SEQ ID NO: 3016037 - RNA, 18 nt, Mycobacterium avium subsp. paratuberculosis
gcugcagcgcgaggcgca

SEQ ID NO: 3016038 - RNA, 20 nt, Mycobacterium avium subsp. paratuberculosis
gcugcagcggaaacgacguc

SEQ ID NO: 3016039 - RNA, 18 nt, Mycobacterium avium subsp. paratuberculosis
gcugcagcggcggccagu

SEQ ID NO: 3016040 - RNA, 21 nt, Mycobacterium avium subsp. paratuberculosis
gcugcagcggcggccaguuga

SEQ ID NO: 3016041 - RNA, 14 nt, Mycobacterium avium subsp. paratuberculosis
gcugcagcgucggg

SEQ ID NO: 3016042 - RNA, 17 nt, Mycobacterium avium subsp. paratuberculosis
gcugcagcuccucggcg

SEQ ID NO: 3016043 - RNA, 22 nt, Mycobacterium avium subsp. paratuberculosis
gcugcagcuccucggcggccuc

SEQ ID NO: 3016044 - RNA, 14 nt, Mycobacterium avium subsp. paratuberculosis
gcugcagcugcucg

SEQ ID NO: 3016045 - RNA, 18 nt, Mycobacterium avium subsp. paratuberculosis
gcugcagcugcucguccu

SEQ ID NO: 3016046 - RNA, 10 nt, Mycobacterium avium subsp. paratuberculosis
gcugcagggc

SEQ ID NO: 3016047 - RNA, 15 nt, Mycobacterium avium subsp. paratuberculosis
gcugcagguggccca

SEQ ID NO: 3016048 - RNA, 18 nt, Mycobacterium avium subsp. paratuberculosis
gcugcauagucggcccga

SEQ ID NO: 3016049 - RNA, 19 nt, Mycobacterium avium subsp. paratuberculosis
gcugcauagucggcccgau

SEQ ID NO: 3016050 - RNA, 21 nt, Mycobacterium avium subsp. paratuberculosis
gcugcauagucggcccgaucg

SEQ ID NO: 3016051 - RNA, 17 nt, Mycobacterium avium subsp. paratuberculosis
gcugcaucaugccgccc

SEQ ID NO: 3016052 - RNA, 22 nt, Mycobacterium avium subsp. paratuberculosis
gcugcaucaugccgcccaucac

SEQ ID NO: 3016053 - RNA, 13 nt, Mycobacterium avium subsp. paratuberculosis
gcugcauccgcag

SEQ ID NO: 3016054 - RNA, 19 nt, Mycobacterium avium subsp. paratuberculosis
gcugcauccgcagcaccag

SEQ ID NO: 3016055 - RNA, 16 nt, Mycobacterium avium subsp. paratuberculosis
gcugcaucuccagccg

SEQ ID NO: 3016056 - RNA, 19 nt, Mycobacterium avium subsp. paratuberculosis
gcugcaucuccagccgcgg

SEQ ID NO: 3016057 - RNA, 16 nt, Mycobacterium avium subsp. paratuberculosis
gcugcaucuccgugga

SEQ ID NO: 3016058 - RNA, 21 nt, Mycobacterium avium subsp. paratuberculosis
gcugcaucuccguggacggcg

SEQ ID NO: 3016059 - RNA, 22 nt, Mycobacterium avium subsp. paratuberculosis
gcugccaaaguuggcaucccgc

SEQ ID NO: 3016060 - RNA, 21 nt, Mycobacterium avium subsp. paratuberculosis
gcugccaagauugggccacag

SEQ ID NO: 3016061 - RNA, 18 nt, Mycobacterium avium subsp. paratuberculosis
gcugccacguacaccggg

SEQ ID NO: 3016062 - RNA, 22 nt, Mycobacterium avium subsp. paratuberculosis
gcugccaggcgguggccgaacc

SEQ ID NO: 3016063 - RNA, 15 nt, Mycobacterium avium subsp. paratuberculosis
gcugccagggccggg

SEQ ID NO: 3016064 - RNA, 22 nt, Mycobacterium avium subsp. paratuberculosis
gcugccagggccgggcgugccc

SEQ ID NO: 3016065 - RNA, 17 nt, Mycobacterium avium subsp. paratuberculosis
gcugcccaacgucgacu

SEQ ID NO: 3016066 - RNA, 13 nt, Mycobacterium avium subsp. paratuberculosis
gcugcccaccacc

SEQ ID NO: 3016067 - RNA, 14 nt, Mycobacterium avium subsp. paratuberculosis
gcugcccaccacca

SEQ ID NO: 3016068 - RNA, 13 nt, Mycobacterium avium subsp. paratuberculosis
gcugcccaccagc

SEQ ID NO: 3016069 - RNA, 17 nt, Mycobacterium avium subsp. paratuberculosis
gcugcccaccagcaggu

SEQ ID NO: 3016070 - RNA, 19 nt, Mycobacterium avium subsp. paratuberculosis
gcugcccaccagcaggucg

SEQ ID NO: 3016071 - RNA, 20 nt, Mycobacterium avium subsp. paratuberculosis
gcugcccaccagcaggucga

SEQ ID NO: 3016072 - RNA, 20 nt, Mycobacterium avium subsp. paratuberculosis
gcugcccagauacgccgcga

SEQ ID NO: 3016073 - RNA, 13 nt, Mycobacterium avium subsp. paratuberculosis
gcugcccagcgcg

SEQ ID NO: 3016074 - RNA, 20 nt, Mycobacterium avium subsp. paratuberculosis
gcugcccagcgcggucgcca

SEQ ID NO: 3016075 - RNA, 19 nt, Mycobacterium avium subsp. paratuberculosis
gcugcccaggaucaccggg

SEQ ID NO: 3016076 - RNA, 21 nt, Mycobacterium avium subsp. paratuberculosis
gcugcccaggaucaccgggac

SEQ ID NO: 3016077 - RNA, 13 nt, Mycobacterium avium subsp. paratuberculosis
gcugcccagggcg

SEQ ID NO: 3016078 - RNA, 17 nt, Mycobacterium avium subsp. paratuberculosis
gcugcccauccaggcca

SEQ ID NO: 3016079 - RNA, 18 nt, Mycobacterium avium subsp. paratuberculosis
gcugccccggcgaggcca

SEQ ID NO: 3016080 - RNA, 10 nt, Mycobacterium avium subsp. paratuberculosis
gcugccccuc

SEQ ID NO: 3016081 - RNA, 20 nt, Mycobacterium avium subsp. paratuberculosis
gcugcccgacccgcaccacc

SEQ ID NO: 3016082 - RNA, 14 nt, Mycobacterium avium subsp. paratuberculosis
gcugcccgagcggc

SEQ ID NO: 3016083 - RNA, 17 nt, Mycobacterium avium subsp. paratuberculosis
gcugcccgagcggcgac

SEQ ID NO: 3016084 - RNA, 13 nt, Mycobacterium avium subsp. paratuberculosis
gcugcccgcccga

SEQ ID NO: 3016085 - RNA, 17 nt, Mycobacterium avium subsp. paratuberculosis
gcugcccgccgacgccc

SEQ ID NO: 3016086 - RNA, 14 nt, Mycobacterium avium subsp. paratuberculosis
gcugcccgccgcgg

SEQ ID NO: 3016087 - RNA, 15 nt, Mycobacterium avium subsp. paratuberculosis
gcugcccgccgcggu

SEQ ID NO: 3016088 - RNA, 17 nt, Mycobacterium avium subsp. paratuberculosis
gcugcccgccgcggugc

SEQ ID NO: 3016089 - RNA, 17 nt, Mycobacterium avium subsp. paratuberculosis
gcugcgacagcacgggc

SEQ ID NO: 3016090 - RNA, 19 nt, Mycobacterium avium subsp. paratuberculosis
gcugcgacagcacgggcgg

SEQ ID NO: 3016091 - RNA, 14 nt, Mycobacterium avium subsp. paratuberculosis
gcugcgagcccggc

SEQ ID NO: 3016092 - RNA, 18 nt, Mycobacterium avium subsp. paratuberculosis
gcugcgagcccggccagu

SEQ ID NO: 3016093 - RNA, 14 nt, Mycobacterium avium subsp. paratuberculosis
gcugcgaggcgggc

SEQ ID NO: 3016094 - RNA, 16 nt, Mycobacterium avium subsp. paratuberculosis
gcugcgaggcgggcac

SEQ ID NO: 3016095 - RNA, 21 nt, Mycobacterium avium subsp. paratuberculosis
gcugcgaugauggucaccguc

SEQ ID NO: 3016096 - RNA, 22 nt, Mycobacterium avium subsp. paratuberculosis
gcugcgaugauggucaccgucg

SEQ ID NO: 3016097 - RNA, 16 nt, Mycobacterium avium subsp. paratuberculosis
gcugcgauugguggcc

SEQ ID NO: 3016098 - RNA, 22 nt, Mycobacterium avium subsp. paratuberculosis
gcugcgcaacaccucggcgacg

SEQ ID NO: 3016099 - RNA, 22 nt, Mycobacterium avium subsp. paratuberculosis
gcugcgcacccgguccggcugg

SEQ ID NO: 3016100 - RNA, 23 nt, Mycobacterium avium subsp. paratuberculosis
gcugcgcacccgguccggcuggu

SEQ ID NO: 3016101 - RNA, 22 nt, Mycobacterium avium subsp. paratuberculosis
gcugcgcacguagcccagcgcg

SEQ ID NO: 3016102 - RNA, 21 nt, Mycobacterium avium subsp. paratuberculosis
gcugcgcagacccgguggccg

SEQ ID NO: 3016103 - RNA, 13 nt, Mycobacterium avium subsp. paratuberculosis
gcugcgcagcacc

SEQ ID NO: 3016104 - RNA, 22 nt, Mycobacterium avium subsp. paratuberculosis
gcugcgcagcaccguccgcaga

SEQ ID NO: 3016105 - RNA, 14 nt, Mycobacterium avium subsp. paratuberculosis
gcugcgcagcagcg

SEQ ID NO: 3016106 - RNA, 19 nt, Mycobacterium avium subsp. paratuberculosis
gcugcgcagcagcgccagc

SEQ ID NO: 3016107 - RNA, 16 nt, Mycobacterium avium subsp. paratuberculosis
gcugcgcagccgugcc

SEQ ID NO: 3016108 - RNA, 16 nt, Mycobacterium avium subsp. paratuberculosis
gcugcgcagcgcagca

SEQ ID NO: 3016109 - RNA, 22 nt, Mycobacterium avium subsp. paratuberculosis
gcugcgccaucuucacgugcgc

SEQ ID NO: 3016110 - RNA, 13 nt, Mycobacterium avium subsp. paratuberculosis
gcugcgcccagcg

SEQ ID NO: 3016111 - RNA, 15 nt, Mycobacterium avium subsp. paratuberculosis
gcugcgcccagcgcg

SEQ ID NO: 3016112 - RNA, 16 nt, Mycobacterium avium subsp. paratuberculosis
gcugcgcccagcgcgc

SEQ ID NO: 3016113 - RNA, 18 nt, Mycobacterium avium subsp. paratuberculosis
gcugcgcccagcgcgcga

SEQ ID NO: 3016114 - RNA, 20 nt, Mycobacterium avium subsp. paratuberculosis
gcugcgcccagcgcgcgauc

SEQ ID NO: 3016115 - RNA, 24 nt, Mycobacterium avium subsp. paratuberculosis
gcugcgcccagcgcgcgaucgccg

SEQ ID NO: 3016116 - RNA, 14 nt, Mycobacterium avium subsp. paratuberculosis
gcugcgcccgccgc

SEQ ID NO: 3016117 - RNA, 15 nt, Mycobacterium avium subsp. paratuberculosis
gcugcgcccgccgcc

SEQ ID NO: 3016118 - RNA, 18 nt, Mycobacterium avium subsp. paratuberculosis
gcugcgcccgccgccacc

SEQ ID NO: 3016119 - RNA, 20 nt, Mycobacterium avium subsp. paratuberculosis
gcugcgcccgccgccaccac

SEQ ID NO: 3016120 - RNA, 20 nt, Mycobacterium avium subsp. paratuberculosis
gcugcgccgacuugaucgcg

SEQ ID NO: 3016121 - RNA, 24 nt, Mycobacterium avium subsp. paratuberculosis
gcugcgccgcgcuugcgaucgccg

SEQ ID NO: 3016122 - RNA, 15 nt, Mycobacterium avium subsp. paratuberculosis
gcugcgccggcgcgg

SEQ ID NO: 3016123 - RNA, 17 nt, Mycobacterium avium subsp. paratuberculosis
gcugcgccggcgcggcc

SEQ ID NO: 3016124 - RNA, 13 nt, Mycobacterium avium subsp. paratuberculosis
gcugcgccggcgg

SEQ ID NO: 3016125 - RNA, 13 nt, Mycobacterium avium subsp. paratuberculosis
gcugcgcgccccg

SEQ ID NO: 3016126 - RNA, 21 nt, Mycobacterium avium subsp. paratuberculosis
gcugcgcgccccggcccggcg

SEQ ID NO: 3016127 - RNA, 13 nt, Mycobacterium avium subsp. paratuberculosis
gcugcgcgccggc

SEQ ID NO: 3016128 - RNA, 16 nt, Mycobacterium avium subsp. paratuberculosis
gcugcgcgccggcggc

SEQ ID NO: 3016129 - RNA, 18 nt, Mycobacterium avium subsp. paratuberculosis
gcugcgcgccggcggccg

SEQ ID NO: 3016130 - RNA, 23 nt, Mycobacterium avium subsp. paratuberculosis
gcugcgcgcgcgaucggugucca

SEQ ID NO: 3016131 - RNA, 22 nt, Mycobacterium avium subsp. paratuberculosis
gcugcgcgcguuguccagcagc

SEQ ID NO: 3016132 - RNA, 17 nt, Mycobacterium avium subsp. paratuberculosis
gcugcgcggccgaacuc

SEQ ID NO: 3016133 - RNA, 13 nt, Mycobacterium avium subsp. paratuberculosis
gcugcgcggcggc

SEQ ID NO: 3016134 - RNA, 13 nt, Mycobacterium avium subsp. paratuberculosis
gcugcgcgggcgc

SEQ ID NO: 3016135 - RNA, 19 nt, Mycobacterium avium subsp. paratuberculosis
gcugcgcgggcgcggccag

SEQ ID NO: 3016136 - RNA, 23 nt, Mycobacterium avium subsp. paratuberculosis
gcugcgcgggcgcggccagcgcg

SEQ ID NO: 3016137 - RNA, 14 nt, Mycobacterium avium subsp. paratuberculosis
gcugcgcgggucgg

SEQ ID NO: 3016138 - RNA, 13 nt, Mycobacterium avium subsp. paratuberculosis
gcugcgcgguggc

SEQ ID NO: 3016139 - RNA, 15 nt, Mycobacterium avium subsp. paratuberculosis
gcugcgcgucgagca

SEQ ID NO: 3016140 - RNA, 20 nt, Mycobacterium avium subsp. paratuberculosis
gcugcgcgucgagcagcacc

SEQ ID NO: 3016141 - RNA, 21 nt, Mycobacterium avium subsp. paratuberculosis
gcugcgcgucgagcagcacca

SEQ ID NO: 3016142 - RNA, 15 nt, Mycobacterium avium subsp. paratuberculosis
gcugcgcgucggccg

SEQ ID NO: 3016143 - RNA, 22 nt, Mycobacterium avium subsp. paratuberculosis
gcugcgcgucggccgcacaaca

SEQ ID NO: 3016144 - RNA, 13 nt, Mycobacterium avium subsp. paratuberculosis
gcugcgcguucgg

SEQ ID NO: 3016145 - RNA, 14 nt, Mycobacterium avium subsp. paratuberculosis
gcugcgcguucggc

SEQ ID NO: 3016146 - RNA, 22 nt, Mycobacterium avium subsp. paratuberculosis
gcugcgcguucggcgccacccc

SEQ ID NO: 3016147 - RNA, 21 nt, Mycobacterium avium subsp. paratuberculosis
gcugcgcucgccgucggccag

SEQ ID NO: 3016148 - RNA, 19 nt, Mycobacterium avium subsp. paratuberculosis
gcugcgcuucgagcagauc

SEQ ID NO: 3016149 - RNA, 18 nt, Mycobacterium avium subsp. paratuberculosis
gcugcggaaaugcccgcg

SEQ ID NO: 3016150 - RNA, 19 nt, Mycobacterium avium subsp. paratuberculosis
gcugcggaaaugcccgcgc

SEQ ID NO: 3016151 - RNA, 22 nt, Mycobacterium avium subsp. paratuberculosis
gcugcggaaaugcccgcgcccc

SEQ ID NO: 3016152 - RNA, 14 nt, Mycobacterium avium subsp. paratuberculosis
gcugcggaacccac

SEQ ID NO: 3016153 - RNA, 21 nt, Mycobacterium avium subsp. paratuberculosis
gcugcggaacccacgugcggc

SEQ ID NO: 3016154 - RNA, 16 nt, Mycobacterium avium subsp. paratuberculosis
gcugcggaaucacuuc

SEQ ID NO: 3016155 - RNA, 18 nt, Mycobacterium avium subsp. paratuberculosis
gcugcggauaaccgucca

SEQ ID NO: 3016156 - RNA, 22 nt, Mycobacterium avium subsp. paratuberculosis
gcugcggauaaccguccacacc

SEQ ID NO: 3016157 - RNA, 13 nt, Mycobacterium avium subsp. paratuberculosis
gcugcggaucggg

SEQ ID NO: 3016158 - RNA, 14 nt, Mycobacterium avium subsp. paratuberculosis
gcugcggaucgggc

SEQ ID NO: 3016159 - RNA, 19 nt, Mycobacterium avium subsp. paratuberculosis
gcugcggcaaugccguugg

SEQ ID NO: 3016160 - RNA, 17 nt, Mycobacterium avium subsp. paratuberculosis
gcugcggccccggugga

SEQ ID NO: 3016161 - RNA, 22 nt, Mycobacterium avium subsp. paratuberculosis
gcugcggcgagucccggcgcac

SEQ ID NO: 3016162 - RNA, 13 nt, Mycobacterium avium subsp. paratuberculosis
gcugcggcgcagu

SEQ ID NO: 3016163 - RNA, 12 nt, Mycobacterium avium subsp. paratuberculosis
gcugcggcgucg

SEQ ID NO: 3016164 - RNA, 17 nt, Mycobacterium avium subsp. paratuberculosis
gcugcgggaagccgagu

SEQ ID NO: 3016165 - RNA, 14 nt, Mycobacterium avium subsp. paratuberculosis
gcugcgggaccagc

SEQ ID NO: 3016166 - RNA, 17 nt, Mycobacterium avium subsp. paratuberculosis
gcugcgggaccagcgcc

SEQ ID NO: 3016167 - RNA, 18 nt, Mycobacterium avium subsp. paratuberculosis
gcugcgggccaggcggga

SEQ ID NO: 3016168 - RNA, 17 nt, Mycobacterium avium subsp. paratuberculosis
gcugcgggcgggccgcc

SEQ ID NO: 3016169 - RNA, 19 nt, Mycobacterium avium subsp. paratuberculosis
gcugcgggcgggccgccag

SEQ ID NO: 3016170 - RNA, 14 nt, Mycobacterium avium subsp. paratuberculosis
gcugcgggucagca

SEQ ID NO: 3016171 - RNA, 16 nt, Mycobacterium avium subsp. paratuberculosis
gcugcgggucagcagc

SEQ ID NO: 3016172 - RNA, 18 nt, Mycobacterium avium subsp. paratuberculosis
gcugcgggucucgcccac

SEQ ID NO: 3016173 - RNA, 16 nt, Mycobacterium avium subsp. paratuberculosis
gcuggacggcccgacg

SEQ ID NO: 3016174 - RNA, 19 nt, Mycobacterium avium subsp. paratuberculosis
gcuggacggcccgacgacg

SEQ ID NO: 3016175 - RNA, 20 nt, Mycobacterium avium subsp. paratuberculosis
gcuggacggcccgacgacgc

SEQ ID NO: 3016176 - RNA, 18 nt, Mycobacterium avium subsp. paratuberculosis
gcuggacguugggguggu

SEQ ID NO: 3016177 - RNA, 21 nt, Mycobacterium avium subsp. paratuberculosis
gcuggagaggcccggcagccg

SEQ ID NO: 3016178 - RNA, 21 nt, Mycobacterium avium subsp. paratuberculosis
gcuggagugaggggauccagc

SEQ ID NO: 3016179 - RNA, 12 nt, Mycobacterium avium subsp. paratuberculosis
gcuggaucugcc

SEQ ID NO: 3016180 - RNA, 22 nt, Mycobacterium avium subsp. paratuberculosis
gcuggaugaaggucgcggacug

SEQ ID NO: 3016181 - RNA, 17 nt, Mycobacterium avium subsp. paratuberculosis
gcuggauggcgcccagc

SEQ ID NO: 3016182 - RNA, 21 nt, Mycobacterium avium subsp. paratuberculosis
gcuggauggcgcccagcccga

SEQ ID NO: 3016183 - RNA, 17 nt, Mycobacterium avium subsp. paratuberculosis
gcuggauguccaggccg

SEQ ID NO: 3016184 - RNA, 23 nt, Mycobacterium avium subsp. paratuberculosis
gcuggauguccaggccgucgagg

SEQ ID NO: 3016185 - RNA, 23 nt, Mycobacterium avium subsp. paratuberculosis
gcuggauuccaccguggucggca

SEQ ID NO: 3016186 - RNA, 17 nt, Mycobacterium avium subsp. paratuberculosis
gcuggauucgucgcugg

SEQ ID NO: 3016187 - RNA, 23 nt, Mycobacterium avium subsp. paratuberculosis
gcuggauucgucgcuggccaggu

SEQ ID NO: 3016188 - RNA, 14 nt, Mycobacterium avium subsp. paratuberculosis
gcuggcaacaguag

SEQ ID NO: 3016189 - RNA, 19 nt, Mycobacterium avium subsp. paratuberculosis
gcuggcaggacgggcacca

SEQ ID NO: 3016190 - RNA, 19 nt, Mycobacterium avium subsp. paratuberculosis
gcuggcaggguugccccaa

SEQ ID NO: 3016191 - RNA, 15 nt, Mycobacterium avium subsp. paratuberculosis
gcuggcaggucgcgc

SEQ ID NO: 3016192 - RNA, 17 nt, Mycobacterium avium subsp. paratuberculosis
gcuggcaggucgcgccg

SEQ ID NO: 3016193 - RNA, 18 nt, Mycobacterium avium subsp. paratuberculosis
gcuggcaggucgcgccgg

SEQ ID NO: 3016194 - RNA, 19 nt, Mycobacterium avium subsp. paratuberculosis
gcuggcaggucgcgccgga

SEQ ID NO: 3016195 - RNA, 15 nt, Mycobacterium avium subsp. paratuberculosis
gcuggcaucgucggc

SEQ ID NO: 3016196 - RNA, 19 nt, Mycobacterium avium subsp. paratuberculosis
gcuggcaucgucggcgccg

SEQ ID NO: 3016197 - RNA, 20 nt, Mycobacterium avium subsp. paratuberculosis
gcuggcaucgucggcgccgg

SEQ ID NO: 3016198 - RNA, 21 nt, Mycobacterium avium subsp. paratuberculosis
gcuggcaucgucggcgccggc

SEQ ID NO: 3016199 - RNA, 22 nt, Mycobacterium avium subsp. paratuberculosis
gcuggcaucgucggcgccggcg

SEQ ID NO: 3016200 - RNA, 13 nt, Mycobacterium avium subsp. paratuberculosis
gcuggccaccacg

SEQ ID NO: 3016201 - RNA, 19 nt, Mycobacterium avium subsp. paratuberculosis
gcuggccaccacgggucgg

SEQ ID NO: 3016202 - RNA, 21 nt, Mycobacterium avium subsp. paratuberculosis
gcuggccaccacgggucgguc

SEQ ID NO: 3016203 - RNA, 13 nt, Mycobacterium avium subsp. paratuberculosis
gcuggccaccgca

SEQ ID NO: 3016204 - RNA, 21 nt, Mycobacterium avium subsp. paratuberculosis
gcuggccaccgcaucgccgag

SEQ ID NO: 3016205 - RNA, 22 nt, Mycobacterium avium subsp. paratuberculosis
gcuggccacgauccggggcagc

SEQ ID NO: 3016206 - RNA, 14 nt, Mycobacterium avium subsp. paratuberculosis
gcuggccagcacca

SEQ ID NO: 3016207 - RNA, 16 nt, Mycobacterium avium subsp. paratuberculosis
gcuggccagcaccagc

SEQ ID NO: 3016208 - RNA, 22 nt, Mycobacterium avium subsp. paratuberculosis
gcuggccagcaccagcgcgcgg

SEQ ID NO: 3016209 - RNA, 14 nt, Mycobacterium avium subsp. paratuberculosis
gcuggccagcgcga

SEQ ID NO: 3016210 - RNA, 16 nt, Mycobacterium avium subsp. paratuberculosis
gcuggccagcgcgacg

SEQ ID NO: 3016211 - RNA, 19 nt, Mycobacterium avium subsp. paratuberculosis
gcuggccagcgucagggcg

SEQ ID NO: 3016212 - RNA, 16 nt, Mycobacterium avium subsp. paratuberculosis
gcuggccagcucggcg

SEQ ID NO: 3016213 - RNA, 15 nt, Mycobacterium avium subsp. paratuberculosis
gcuggccagguacac

SEQ ID NO: 3016214 - RNA, 17 nt, Mycobacterium avium subsp. paratuberculosis
gcuggccaucgcgggug

SEQ ID NO: 3016215 - RNA, 23 nt, Mycobacterium avium subsp. paratuberculosis
gcuggccccgguuuucgccucgg

SEQ ID NO: 3016216 - RNA, 15 nt, Mycobacterium avium subsp. paratuberculosis
gcuggcccggcgcgg

SEQ ID NO: 3016217 - RNA, 16 nt, Mycobacterium avium subsp. paratuberculosis
gcuggcccggcgcggc

SEQ ID NO: 3016218 - RNA, 17 nt, Mycobacterium avium subsp. paratuberculosis
gcuggcccggcgcggcg

SEQ ID NO: 3016219 - RNA, 14 nt, Mycobacterium avium subsp. paratuberculosis
gcuggccgaccccg

SEQ ID NO: 3016220 - RNA, 15 nt, Mycobacterium avium subsp. paratuberculosis
gcuggccgaccccga

SEQ ID NO: 3016221 - RNA, 17 nt, Mycobacterium avium subsp. paratuberculosis
gcuggccgagagccggu

SEQ ID NO: 3016222 - RNA, 18 nt, Mycobacterium avium subsp. paratuberculosis
gcuggccgagcggcugcu

SEQ ID NO: 3016223 - RNA, 20 nt, Mycobacterium avium subsp. paratuberculosis
gcuggccgaucccggccacg

SEQ ID NO: 3016224 - RNA, 22 nt, Mycobacterium avium subsp. paratuberculosis
gcuggccgcacggugcagcagc

SEQ ID NO: 3016225 - RNA, 19 nt, Mycobacterium avium subsp. paratuberculosis
gcuggccgcccaccacgaa

SEQ ID NO: 3016226 - RNA, 13 nt, Mycobacterium avium subsp. paratuberculosis
gcuggccgccccg

SEQ ID NO: 3016227 - RNA, 14 nt, Mycobacterium avium subsp. paratuberculosis
gcuggccgccccga

SEQ ID NO: 3016228 - RNA, 20 nt, Mycobacterium avium subsp. paratuberculosis
gcuggccgcgaacggcccgc

SEQ ID NO: 3016229 - RNA, 23 nt, Mycobacterium avium subsp. paratuberculosis
gcuggccgcgaacggcccgccgc

SEQ ID NO: 3016230 - RNA, 13 nt, Mycobacterium avium subsp. paratuberculosis
gcuggccgcgacg

SEQ ID NO: 3016231 - RNA, 14 nt, Mycobacterium avium subsp. paratuberculosis
gcuggccgcgcagc

SEQ ID NO: 3016232 - RNA, 14 nt, Mycobacterium avium subsp. paratuberculosis
gcuggccgcgccac

SEQ ID NO: 3016233 - RNA, 11 nt, Mycobacterium avium subsp. paratuberculosis
gcuggccgcgg

SEQ ID NO: 3016234 - RNA, 14 nt, Mycobacterium avium subsp. paratuberculosis
gcuggccgcggcga

SEQ ID NO: 3016235 - RNA, 20 nt, Mycobacterium avium subsp. paratuberculosis
gcuggccgcggcgaucggcg

SEQ ID NO: 3016236 - RNA, 19 nt, Mycobacterium avium subsp. paratuberculosis
gcuggccgcgugcaacaca

SEQ ID NO: 3016237 - RNA, 13 nt, Mycobacterium avium subsp. paratuberculosis
gcuggccggccac

SEQ ID NO: 3016238 - RNA, 14 nt, Mycobacterium avium subsp. paratuberculosis
gcuggccggccacc

SEQ ID NO: 3016239 - RNA, 18 nt, Mycobacterium avium subsp. paratuberculosis
gcuggccggccaccagcg

SEQ ID NO: 3016240 - RNA, 22 nt, Mycobacterium avium subsp. paratuberculosis
gcuggccggccaccagcggccg

SEQ ID NO: 3016241 - RNA, 23 nt, Mycobacterium avium subsp. paratuberculosis
gcuggccggccaccagcggccgg

SEQ ID NO: 3016242 - RNA, 20 nt, Mycobacterium avium subsp. paratuberculosis
gcuggccgggcucgagggcg

SEQ ID NO: 3016243 - RNA, 14 nt, Mycobacterium avium subsp. paratuberculosis
gcuggccgucggcg

SEQ ID NO: 3016244 - RNA, 18 nt, Mycobacterium avium subsp. paratuberculosis
gcuggccgugcaccgucg

SEQ ID NO: 3016245 - RNA, 21 nt, Mycobacterium avium subsp. paratuberculosis
gcuggccgugcaccgucgccg

SEQ ID NO: 3016246 - RNA, 20 nt, Mycobacterium avium subsp. paratuberculosis
gcuggccguggccgugaugc

SEQ ID NO: 3016247 - RNA, 15 nt, Mycobacterium avium subsp. paratuberculosis
gcuggccuccagcuu

SEQ ID NO: 3016248 - RNA, 16 nt, Mycobacterium avium subsp. paratuberculosis
gcuggccuugaucggg

SEQ ID NO: 3016249 - RNA, 18 nt, Mycobacterium avium subsp. paratuberculosis
gcuggccuugaucgggua

SEQ ID NO: 3016250 - RNA, 16 nt, Mycobacterium avium subsp. paratuberculosis
gcuggcgaacauggug

SEQ ID NO: 3016251 - RNA, 17 nt, Mycobacterium avium subsp. paratuberculosis
gcuggcgaauccgggcc

SEQ ID NO: 3016252 - RNA, 13 nt, Mycobacterium avium subsp. paratuberculosis
gcuggcgaccauc

SEQ ID NO: 3016253 - RNA, 19 nt, Mycobacterium avium subsp. paratuberculosis
gcuggcgaccaucagccug

SEQ ID NO: 3016254 - RNA, 23 nt, Mycobacterium avium subsp. paratuberculosis
gcuggcgaccaucagccugcggu

SEQ ID NO: 3016255 - RNA, 22 nt, Mycobacterium avium subsp. paratuberculosis
gcuggcgaucaccuugcggccg

SEQ ID NO: 3016256 - RNA, 19 nt, Mycobacterium avium subsp. paratuberculosis
gcuggcgaucaucgucguc

SEQ ID NO: 3016257 - RNA, 22 nt, Mycobacterium avium subsp. paratuberculosis
gcugucggugaaugucgugacc

SEQ ID NO: 3016258 - RNA, 13 nt, Mycobacterium avium subsp. paratuberculosis
gcugucgucgccc

SEQ ID NO: 3016259 - RNA, 19 nt, Mycobacterium avium subsp. paratuberculosis
gcugugagcuuccugccaa

SEQ ID NO: 3016260 - RNA, 13 nt, Mycobacterium avium subsp. paratuberculosis
gcugugccgcggu

SEQ ID NO: 3016261 - RNA, 21 nt, Mycobacterium avium subsp. paratuberculosis
gcugugccgcggugcggcccg

SEQ ID NO: 3016262 - RNA, 13 nt, Mycobacterium avium subsp. paratuberculosis
gcugugccggcgg

SEQ ID NO: 3016263 - RNA, 14 nt, Mycobacterium avium subsp. paratuberculosis
gcugugcgccaugu

SEQ ID NO: 3016264 - RNA, 23 nt, Mycobacterium avium subsp. paratuberculosis
gcugugcgcuugggucgccgggu

SEQ ID NO: 3016265 - RNA, 13 nt, Mycobacterium avium subsp. paratuberculosis
gcugugcggcccg

SEQ ID NO: 3016266 - RNA, 14 nt, Mycobacterium avium subsp. paratuberculosis
gcugugcggcccgg

SEQ ID NO: 3016267 - RNA, 13 nt, Mycobacterium avium subsp. paratuberculosis
gcugugcgggcgg

SEQ ID NO: 3016268 - RNA, 17 nt, Mycobacterium avium subsp. paratuberculosis
gcugugcgggcggugcu

SEQ ID NO: 3016269 - RNA, 22 nt, Mycobacterium avium subsp. paratuberculosis
gcugugcgggugaggccaggcg

SEQ ID NO: 3016270 - RNA, 17 nt, Mycobacterium avium subsp. paratuberculosis
gcugugcugccugccgu

SEQ ID NO: 3016271 - RNA, 17 nt, Mycobacterium avium subsp. paratuberculosis
gcuguggaacacgucgg

SEQ ID NO: 3016272 - RNA, 19 nt, Mycobacterium avium subsp. paratuberculosis
gcuguggaagggccccggc

SEQ ID NO: 3016273 - RNA, 20 nt, Mycobacterium avium subsp. paratuberculosis
gcuguggaugacgcagccga

SEQ ID NO: 3016274 - RNA, 21 nt, Mycobacterium avium subsp. paratuberculosis
gcugugggagguacucgagcg

SEQ ID NO: 3016275 - RNA, 14 nt, Mycobacterium avium subsp. paratuberculosis
gcugugggccagca

SEQ ID NO: 3016276 - RNA, 21 nt, Mycobacterium avium subsp. paratuberculosis
gcugugggccagcagcgucgu

SEQ ID NO: 3016277 - RNA, 15 nt, Mycobacterium avium subsp. paratuberculosis
gcuguggugacggcc

SEQ ID NO: 3016278 - RNA, 20 nt, Mycobacterium avium subsp. paratuberculosis
gcuguucgggcagauggucg

SEQ ID NO: 3016279 - RNA, 18 nt, Mycobacterium avium subsp. paratuberculosis
gcuguugaccacggccug

SEQ ID NO: 3016280 - RNA, 21 nt, Mycobacterium avium subsp. paratuberculosis
gcuguugaccacggccuggua

SEQ ID NO: 3016281 - RNA, 15 nt, Mycobacterium avium subsp. paratuberculosis
gcuguugacgggccg

SEQ ID NO: 3016282 - RNA, 17 nt, Mycobacterium avium subsp. paratuberculosis
gcuguugacgggccgcg

SEQ ID NO: 3016283 - RNA, 18 nt, Mycobacterium avium subsp. paratuberculosis
gcuguugacgggccgcgg

SEQ ID NO: 3016284 - RNA, 22 nt, Mycobacterium avium subsp. paratuberculosis
gcuguugacgggccgcggccag

SEQ ID NO: 3016285 - RNA, 15 nt, Mycobacterium avium subsp. paratuberculosis
gcuguugcggcguca

SEQ ID NO: 3016286 - RNA, 15 nt, Mycobacterium avium subsp. paratuberculosis
gcuguugcucggggc

SEQ ID NO: 3016287 - RNA, 17 nt, Mycobacterium avium subsp. paratuberculosis
gcuguugcucggggcuc

SEQ ID NO: 3016288 - RNA, 21 nt, Mycobacterium avium subsp. paratuberculosis
gcuguugcucggggcucgcgg

SEQ ID NO: 3016289 - RNA, 20 nt, Mycobacterium avium subsp. paratuberculosis
gcuguuggaaccggccacca

SEQ ID NO: 3016290 - RNA, 23 nt, Mycobacterium avium subsp. paratuberculosis
gcuguuggauuuggccgucaucu

SEQ ID NO: 3016291 - RNA, 22 nt, Mycobacterium avium subsp. paratuberculosis
gcuguuggccagcuugcagcug

SEQ ID NO: 3016292 - RNA, 23 nt, Mycobacterium avium subsp. paratuberculosis
gcuguuggcgacggugcaugcgc

SEQ ID NO: 3016293 - RNA, 23 nt, Mycobacterium avium subsp. paratuberculosis
gcuguuuuaggcagccaaugggg

SEQ ID NO: 3016294 - RNA, 19 nt, Mycobacterium avium subsp. paratuberculosis
gcuuaaucgcccaacaacu

SEQ ID NO: 3016295 - RNA, 16 nt, Mycobacterium avium subsp. paratuberculosis
gcuuaccgaccucgag

SEQ ID NO: 3016296 - RNA, 20 nt, Mycobacterium avium subsp. paratuberculosis
gcuuaccggcgggcggcggc

SEQ ID NO: 3016297 - RNA, 21 nt, Mycobacterium avium subsp. paratuberculosis
gcuuaccggcgggcggcggcg

SEQ ID NO: 3016298 - RNA, 17 nt, Mycobacterium avium subsp. paratuberculosis
gcuuagccccucccacc

SEQ ID NO: 3016299 - RNA, 21 nt, Mycobacterium avium subsp. paratuberculosis
gcuuagccccucccaccacgg

SEQ ID NO: 3016300 - RNA, 12 nt, Mycobacterium avium subsp. paratuberculosis
gcuucacgcucg

SEQ ID NO: 3016301 - RNA, 15 nt, Mycobacterium avium subsp. paratuberculosis
gcuucacgcucggca

SEQ ID NO: 3016302 - RNA, 16 nt, Mycobacterium avium subsp. paratuberculosis
gcuucacgcucggcag

SEQ ID NO: 3016303 - RNA, 24 nt, Mycobacterium avium subsp. paratuberculosis
gcuucacgcucggcgccgagcgug

SEQ ID NO: 3016304 - RNA, 21 nt, Mycobacterium avium subsp. paratuberculosis
gcuucacggucggagcccagc

SEQ ID NO: 3016305 - RNA, 17 nt, Mycobacterium avium subsp. paratuberculosis
gcuucacguucggcgag

SEQ ID NO: 3016306 - RNA, 20 nt, Mycobacterium avium subsp. paratuberculosis
gcuucacguucggcgaguga

SEQ ID NO: 3016307 - RNA, 15 nt, Mycobacterium avium subsp. paratuberculosis
gcuucagucccgcga

SEQ ID NO: 3016308 - RNA, 18 nt, Mycobacterium avium subsp. paratuberculosis
gcuucauaugacgccggc

SEQ ID NO: 3016309 - RNA, 19 nt, Mycobacterium avium subsp. paratuberculosis
gcuucauaugacgccggcc

SEQ ID NO: 3016310 - RNA, 19 nt, Mycobacterium avium subsp. paratuberculosis
gcuucaucccgucguugaa

SEQ ID NO: 3016311 - RNA, 19 nt, Mycobacterium avium subsp. paratuberculosis
gcuucaugcccuuggcccg

SEQ ID NO: 3016312 - RNA, 13 nt, Mycobacterium avium subsp. paratuberculosis
gcuuccagcgcgg

SEQ ID NO: 3016313 - RNA, 15 nt, Mycobacterium avium subsp. paratuberculosis
gcuuccagcgcggcg

SEQ ID NO: 3016314 - RNA, 17 nt, Mycobacterium avium subsp. paratuberculosis
gcuuccagcgcggcgau

SEQ ID NO: 3016315 - RNA, 18 nt, Mycobacterium avium subsp. paratuberculosis
gcuucccacagucgcugg

SEQ ID NO: 3016316 - RNA, 19 nt, Mycobacterium avium subsp. paratuberculosis
gcuucccacagucgcuggg

SEQ ID NO: 3016317 - RNA, 15 nt, Mycobacterium avium subsp. paratuberculosis
gcuucccacccgguc

SEQ ID NO: 3016318 - RNA, 18 nt, Mycobacterium avium subsp. paratuberculosis
gcuucccauuucggcgaa

SEQ ID NO: 3016319 - RNA, 12 nt, Mycobacterium avium subsp. paratuberculosis
gcuucccggcgg

SEQ ID NO: 3016320 - RNA, 15 nt, Mycobacterium avium subsp. paratuberculosis
gcuucccggcggucg

SEQ ID NO: 3016321 - RNA, 18 nt, Mycobacterium avium subsp. paratuberculosis
gcuucccggcggucgccg

SEQ ID NO: 3016322 - RNA, 19 nt, Mycobacterium avium subsp. paratuberculosis
gcuucccggcggucgccga

SEQ ID NO: 3016323 - RNA, 13 nt, Mycobacterium avium subsp. paratuberculosis
gcuuccgccgaga

SEQ ID NO: 3016324 - RNA, 15 nt, Mycobacterium avium subsp. paratuberculosis
gcuuccgccgagacg

SEQ ID NO: 3016325 - RNA, 18 nt, Mycobacterium avium subsp. paratuberculosis
gcuuccgccgagacggcg

SEQ ID NO: 3016326 - RNA, 23 nt, Mycobacterium avium subsp. paratuberculosis
gcuuccgccgagacggcguggcu

SEQ ID NO: 3016327 - RNA, 13 nt, Mycobacterium avium subsp. paratuberculosis
gcuuccgccgagu

SEQ ID NO: 3016328 - RNA, 19 nt, Mycobacterium avium subsp. paratuberculosis
gcuuccggaugggagcggg

SEQ ID NO: 3016329 - RNA, 12 nt, Mycobacterium avium subsp. paratuberculosis
gcuucgccgccg

SEQ ID NO: 3016330 - RNA, 20 nt, Mycobacterium avium subsp. paratuberculosis
gcuucgccgccgcaccggcc

SEQ ID NO: 3016331 - RNA, 11 nt, Mycobacterium avium subsp. paratuberculosis
gcuucgccgcg

SEQ ID NO: 3016332 - RNA, 21 nt, Mycobacterium avium subsp. paratuberculosis
gcuucgccgcgcuugcgaccg

SEQ ID NO: 3016333 - RNA, 22 nt, Mycobacterium avium subsp. paratuberculosis
gcuucgccgcgcuugcgaccgc

SEQ ID NO: 3016334 - RNA, 24 nt, Mycobacterium avium subsp. paratuberculosis
gcuucgccgcgcuugcgaccgccg

SEQ ID NO: 3016335 - RNA, 13 nt, Mycobacterium avium subsp. paratuberculosis
gcuucgcggaucg

SEQ ID NO: 3016336 - RNA, 15 nt, Mycobacterium avium subsp. paratuberculosis
gcuucgcugcgccgg

SEQ ID NO: 3016337 - RNA, 13 nt, Mycobacterium avium subsp. paratuberculosis
gcuucggcucggg

SEQ ID NO: 3016338 - RNA, 15 nt, Mycobacterium avium subsp. paratuberculosis
gcuucgggagcaagg

SEQ ID NO: 3016339 - RNA, 21 nt, Mycobacterium avium subsp. paratuberculosis
gcuucgggcgcgcgcgccacg

SEQ ID NO: 3016340 - RNA, 23 nt, Mycobacterium avium subsp. paratuberculosis
gcuucggguuguuguccgaccag

SEQ ID NO: 3016341 - RNA, 20 nt, Mycobacterium avium subsp. paratuberculosis
gcuucguacggcccgggaag

SEQ ID NO: 3016342 - RNA, 13 nt, Mycobacterium avium subsp. paratuberculosis
gcuucgucgccgg

SEQ ID NO: 3016343 - RNA, 18 nt, Mycobacterium avium subsp. paratuberculosis
gcuucgucgccggccgcc

SEQ ID NO: 3016344 - RNA, 23 nt, Mycobacterium avium subsp. paratuberculosis
gcuucuccucgguacccccgccg

SEQ ID NO: 3016345 - RNA, 14 nt, Mycobacterium avium subsp. paratuberculosis
gcuucucgccgucg

SEQ ID NO: 3016346 - RNA, 16 nt, Mycobacterium avium subsp. paratuberculosis
gcuucucggcgucccc

SEQ ID NO: 3016347 - RNA, 16 nt, Mycobacterium avium subsp. paratuberculosis
gcuucucggcgugccc

SEQ ID NO: 3016348 - RNA, 20 nt, Mycobacterium avium subsp. paratuberculosis
gcuucucggcgugcccgccg

SEQ ID NO: 3016349 - RNA, 15 nt, Mycobacterium avium subsp. paratuberculosis
gcuucugcagcucgc

SEQ ID NO: 3016350 - RNA, 16 nt, Mycobacterium avium subsp. paratuberculosis
gcuucugcccggccag

SEQ ID NO: 3016351 - RNA, 20 nt, Mycobacterium avium subsp. paratuberculosis
gcuucugcccggccagcagg

SEQ ID NO: 3016352 - RNA, 14 nt, Mycobacterium avium subsp. paratuberculosis
gcuucugcgccggu

SEQ ID NO: 3016353 - RNA, 19 nt, Mycobacterium avium subsp. paratuberculosis
gcuucuugcugccgucggu

SEQ ID NO: 3016354 - RNA, 22 nt, Mycobacterium avium subsp. paratuberculosis
gcuugaacagcacccccucggc

SEQ ID NO: 3016355 - RNA, 15 nt, Mycobacterium avium subsp. paratuberculosis
gcuugaacgccgccc

SEQ ID NO: 3016356 - RNA, 13 nt, Mycobacterium avium subsp. paratuberculosis
gcuugaagcccuc

SEQ ID NO: 3016357 - RNA, 18 nt, Mycobacterium avium subsp. paratuberculosis
gcuugaagcccucgucga

SEQ ID NO: 3016358 - RNA, 14 nt, Mycobacterium avium subsp. paratuberculosis
gcuugaccacccgg

SEQ ID NO: 3016359 - RNA, 17 nt, Mycobacterium avium subsp. paratuberculosis
gcuugacccgcuccagc

SEQ ID NO: 3016360 - RNA, 20 nt, Mycobacterium avium subsp. paratuberculosis
gcuugacccgcuccagcggc

SEQ ID NO: 3016361 - RNA, 23 nt, Mycobacterium avium subsp. paratuberculosis
gcuugacccgcuccagcggccac

SEQ ID NO: 3016362 - RNA, 14 nt, Mycobacterium avium subsp. paratuberculosis
gcuugaccgugacg

SEQ ID NO: 3016363 - RNA, 22 nt, Mycobacterium avium subsp. paratuberculosis
gcuugaccucgccgagcagccg

SEQ ID NO: 3016364 - RNA, 20 nt, Mycobacterium avium subsp. paratuberculosis
gcuugacggcuuccgcggac

SEQ ID NO: 3016365 - RNA, 16 nt, Mycobacterium avium subsp. paratuberculosis
gcuugagccccgccgg

SEQ ID NO: 3016366 - RNA, 15 nt, Mycobacterium avium subsp. paratuberculosis
gcuugagcccgucga

SEQ ID NO: 3016367 - RNA, 20 nt, Mycobacterium avium subsp. paratuberculosis
gcuugagcccgucgacgucg

SEQ ID NO: 3016368 - RNA, 16 nt, Mycobacterium avium subsp. paratuberculosis
gcuugagccgccacgg

SEQ ID NO: 3016369 - RNA, 15 nt, Mycobacterium avium subsp. paratuberculosis
gcuugagccggaucg

SEQ ID NO: 3016370 - RNA, 17 nt, Mycobacterium avium subsp. paratuberculosis
gcuugagccggaucggg

SEQ ID NO: 3016371 - RNA, 15 nt, Mycobacterium avium subsp. paratuberculosis
gcuugagcgccagcg

SEQ ID NO: 3016372 - RNA, 13 nt, Mycobacterium avium subsp. paratuberculosis
gcuugagcgcguc

SEQ ID NO: 3016373 - RNA, 15 nt, Mycobacterium avium subsp. paratuberculosis
gcuugagcgcgucgu

SEQ ID NO: 3016374 - RNA, 16 nt, Mycobacterium avium subsp. paratuberculosis
gcuugagcgcgucguc

SEQ ID NO: 3016375 - RNA, 17 nt, Mycobacterium avium subsp. paratuberculosis
gcuugaucagcgggcug

SEQ ID NO: 3016376 - RNA, 15 nt, Mycobacterium avium subsp. paratuberculosis
gcuugaucgcaccca

SEQ ID NO: 3016377 - RNA, 20 nt, Mycobacterium avium subsp. paratuberculosis
gcuugaucucgaccuucuug

SEQ ID NO: 3016378 - RNA, 18 nt, Mycobacterium avium subsp. paratuberculosis
gcuugaugaacgcguuga

SEQ ID NO: 3016379 - RNA, 20 nt, Mycobacterium avium subsp. paratuberculosis
gcuugaugaugccggccgcg

SEQ ID NO: 3016380 - RNA, 20 nt, Mycobacterium avium subsp. paratuberculosis
gcuugaugaugucggcggcc

SEQ ID NO: 3016381 - RNA, 18 nt, Mycobacterium avium subsp. paratuberculosis
gcuugauguugccgugcu

SEQ ID NO: 3016382 - RNA, 18 nt, Mycobacterium avium subsp. paratuberculosis
gcuugcagcuuggcggug

SEQ ID NO: 3016383 - RNA, 23 nt, Mycobacterium avium subsp. paratuberculosis
gcuugccaacgguuuccaccacc

SEQ ID NO: 3016384 - RNA, 15 nt, Mycobacterium avium subsp. paratuberculosis
gcuugccagccgggc

SEQ ID NO: 3016385 - RNA, 16 nt, Mycobacterium avium subsp. paratuberculosis
gcuugccagccgggcc

SEQ ID NO: 3016386 - RNA, 18 nt, Mycobacterium avium subsp. paratuberculosis
gcuugccagccgggccga

SEQ ID NO: 3016387 - RNA, 23 nt, Mycobacterium avium subsp. paratuberculosis
gcuugccccggucccggggcucg

SEQ ID NO: 3016388 - RNA, 23 nt, Mycobacterium avium subsp. paratuberculosis
gcuugcccguucgaugaugggcg

SEQ ID NO: 3016389 - RNA, 15 nt, Mycobacterium avium subsp. paratuberculosis
gcuugccgaucgccg

SEQ ID NO: 3016390 - RNA, 18 nt, Mycobacterium avium subsp. paratuberculosis
gcuugccgaucgccgcgg

SEQ ID NO: 3016391 - RNA, 14 nt, Mycobacterium avium subsp. paratuberculosis
gcuugccgaucugg

SEQ ID NO: 3016392 - RNA, 16 nt, Mycobacterium avium subsp. paratuberculosis
gcuugccgaucugguc

SEQ ID NO: 3016393 - RNA, 22 nt, Mycobacterium avium subsp. paratuberculosis
gcuugccgaucugguccagcgu

SEQ ID NO: 3016394 - RNA, 14 nt, Mycobacterium avium subsp. paratuberculosis
gcuugccgaugucg

SEQ ID NO: 3016395 - RNA, 16 nt, Mycobacterium avium subsp. paratuberculosis
gcuugccgccgggcca

SEQ ID NO: 3016396 - RNA, 15 nt, Mycobacterium avium subsp. paratuberculosis
gcuugccgcgacccg

SEQ ID NO: 3016397 - RNA, 22 nt, Mycobacterium avium subsp. paratuberculosis
gcuugccgcgacccgggccgcc

SEQ ID NO: 3016398 - RNA, 17 nt, Mycobacterium avium subsp. paratuberculosis
gcuugccggagcccagc

SEQ ID NO: 3016399 - RNA, 22 nt, Mycobacterium avium subsp. paratuberculosis
gcuugccggauugcgagccggu

SEQ ID NO: 3016400 - RNA, 14 nt, Mycobacterium avium subsp. paratuberculosis
gcuugccgucgacg

SEQ ID NO: 3016401 - RNA, 15 nt, Mycobacterium avium subsp. paratuberculosis
gcuugccgucgacgc

SEQ ID NO: 3016402 - RNA, 16 nt, Mycobacterium avium subsp. paratuberculosis
gcuugccgucgacgcg

SEQ ID NO: 3016403 - RNA, 16 nt, Mycobacterium avium subsp. paratuberculosis
gcuugcgacuggaugg

SEQ ID NO: 3016404 - RNA, 14 nt, Mycobacterium avium subsp. paratuberculosis
gcuugcgaucgccg

SEQ ID NO: 3016405 - RNA, 16 nt, Mycobacterium avium subsp. paratuberculosis
gcuugcgaucgccgcg

SEQ ID NO: 3016406 - RNA, 17 nt, Mycobacterium avium subsp. paratuberculosis
gcuugcgaucgccgcgc

SEQ ID NO: 3016407 - RNA, 18 nt, Mycobacterium avium subsp. paratuberculosis
gcuugcgcaacagcgugc

SEQ ID NO: 3016408 - RNA, 14 nt, Mycobacterium avium subsp. paratuberculosis
gcuugcgcucggcc

SEQ ID NO: 3016409 - RNA, 18 nt, Mycobacterium avium subsp. paratuberculosis
gcuugcgcucggucgcgg

SEQ ID NO: 3016410 - RNA, 13 nt, Mycobacterium avium subsp. paratuberculosis
gcuugcggcucaa

SEQ ID NO: 3016411 - RNA, 14 nt, Mycobacterium avium subsp. paratuberculosis
gcuugcguucccag

SEQ ID NO: 3016412 - RNA, 20 nt, Mycobacterium avium subsp. paratuberculosis
gcuugcguucccagcccggc

SEQ ID NO: 3016413 - RNA, 13 nt, Mycobacterium avium subsp. paratuberculosis
gcuuggcaggcgg

SEQ ID NO: 3016414 - RNA, 20 nt, Mycobacterium avium subsp. paratuberculosis
gcuuggccagcucggcggcc

SEQ ID NO: 3016415 - RNA, 21 nt, Mycobacterium avium subsp. paratuberculosis
gcuuggccagcucggcggcca

SEQ ID NO: 3016416 - RNA, 15 nt, Mycobacterium avium subsp. paratuberculosis
gcuuggcccgccgcc

SEQ ID NO: 3016417 - RNA, 14 nt, Mycobacterium avium subsp. paratuberculosis
gcuuggccgggcgg

SEQ ID NO: 3016418 - RNA, 17 nt, Mycobacterium avium subsp. paratuberculosis
gcuuggcgacgaagucg

SEQ ID NO: 3016419 - RNA, 23 nt, Mycobacterium avium subsp. paratuberculosis
gcuuggcgacgaagucgacggcg

SEQ ID NO: 3016420 - RNA, 16 nt, Mycobacterium avium subsp. paratuberculosis
gcuuggcgguggccug

SEQ ID NO: 3016421 - RNA, 20 nt, Mycobacterium avium subsp. paratuberculosis
gcuugggcagcaaccggguc

SEQ ID NO: 3016422 - RNA, 15 nt, Mycobacterium avium subsp. paratuberculosis
gcuugggcagcagcu

SEQ ID NO: 3016423 - RNA, 17 nt, Mycobacterium avium subsp. paratuberculosis
gcuugggcgccucgccg

SEQ ID NO: 3016424 - RNA, 21 nt, Mycobacterium avium subsp. paratuberculosis
gcuugggcgccucgccgaccu

SEQ ID NO: 3016425 - RNA, 23 nt, Mycobacterium avium subsp. paratuberculosis
gcuugggcgccucgccgaccuug

SEQ ID NO: 3016426 - RNA, 16 nt, Mycobacterium avium subsp. paratuberculosis
gcuugggcgcgaucgg

SEQ ID NO: 3016427 - RNA, 18 nt, Mycobacterium avium subsp. paratuberculosis
gcuuggggaagccggcca

SEQ ID NO: 3016428 - RNA, 21 nt, Mycobacterium avium subsp. paratuberculosis
gcuuggggaagccggccaguu

SEQ ID NO: 3016429 - RNA, 19 nt, Mycobacterium avium subsp. paratuberculosis
gcuuggguugcuccucggu

SEQ ID NO: 3016430 - RNA, 22 nt, Mycobacterium avium subsp. paratuberculosis
gcuuggucagcgcggcccgcgg

SEQ ID NO: 3016431 - RNA, 17 nt, Mycobacterium avium subsp. paratuberculosis
gcuuggucuccggcccc

SEQ ID NO: 3016432 - RNA, 16 nt, Mycobacterium avium subsp. paratuberculosis
gcuuggugaaggacuc

SEQ ID NO: 3016433 - RNA, 20 nt, Mycobacterium avium subsp. paratuberculosis
gcuuggugggcgccggcguc

SEQ ID NO: 3016434 - RNA, 17 nt, Mycobacterium avium subsp. paratuberculosis
gcuugucggcguggccg

SEQ ID NO: 3016435 - RNA, 19 nt, Mycobacterium avium subsp. paratuberculosis
gcuuuacgaggcgugcagc

SEQ ID NO: 3016436 - RNA, 12 nt, Mycobacterium avium subsp. paratuberculosis
gcuuuccaccuc

SEQ ID NO: 3016437 - RNA, 19 nt, Mycobacterium avium subsp. paratuberculosis
gcuuuccaccucgagcaac

SEQ ID NO: 3016438 - RNA, 14 nt, Mycobacterium avium subsp. paratuberculosis
gcuuuccgacggcu

SEQ ID NO: 3016439 - RNA, 19 nt, Mycobacterium avium subsp. paratuberculosis
gcuuuccggccgccucguc

SEQ ID NO: 3016440 - RNA, 22 nt, Mycobacterium avium subsp. paratuberculosis
gcuuucgaagugacgccgcucg

SEQ ID NO: 3016441 - RNA, 14 nt, Mycobacterium avium subsp. paratuberculosis
gcuuucgccgggcg

SEQ ID NO: 3016442 - RNA, 20 nt, Mycobacterium avium subsp. paratuberculosis
gcuuucgcgucugcucgcgg

SEQ ID NO: 3016443 - RNA, 20 nt, Mycobacterium avium subsp. paratuberculosis
gcuuucgcguucgcucucgc

SEQ ID NO: 3016444 - RNA, 13 nt, Mycobacterium avium subsp. paratuberculosis
gcuuucgcugguc

SEQ ID NO: 3016445 - RNA, 13 nt, Mycobacterium avium subsp. paratuberculosis
gcuuucggcgcca

SEQ ID NO: 3016446 - RNA, 23 nt, Mycobacterium avium subsp. paratuberculosis
gcuuucggcgccaacaacucgac

SEQ ID NO: 3016447 - RNA, 17 nt, Mycobacterium avium subsp. paratuberculosis
gcuuucgggucgacgag

SEQ ID NO: 3016448 - RNA, 21 nt, Mycobacterium avium subsp. paratuberculosis
gcuuucgggucgacgagcagg

SEQ ID NO: 3016449 - RNA, 14 nt, Mycobacterium avium subsp. paratuberculosis
gcuuugcugccaag

SEQ ID NO: 3016450 - RNA, 15 nt, Mycobacterium avium subsp. paratuberculosis
gcuuuggaccagggc

SEQ ID NO: 3016451 - RNA, 16 nt, Mycobacterium avium subsp. paratuberculosis
gcuuuggaccagggcg

SEQ ID NO: 3016452 - RNA, 21 nt, Mycobacterium avium subsp. paratuberculosis
gcuuuuccaccaucgggguga

SEQ ID NO: 3016453 - RNA, 19 nt, Mycobacterium avium subsp. paratuberculosis
gcuuuugcgggucugcuca

SEQ ID NO: 3016454 - RNA, 18 nt, Mycobacterium avium subsp. paratuberculosis
gcuuuugcgucugcucgc

SEQ ID NO: 3016455 - RNA, 19 nt, Mycobacterium avium subsp. paratuberculosis
gcuuuugcgucugcucgcc

SEQ ID NO: 3016456 - RNA, 20 nt, Mycobacterium avium subsp. paratuberculosis
gcuuuugcgucugcucgcgc

SEQ ID NO: 3016457 - RNA, 14 nt, Mycobacterium avium subsp. paratuberculosis
gcuuuuugaccacc

SEQ ID NO: 3016458 - RNA, 21 nt, Mycobacterium avium subsp. paratuberculosis
gcuuuuugcggacccaggcag

SEQ ID NO: 3016459 - RNA, 22 nt, Mycobacterium avium subsp. paratuberculosis
gcuuuuugcggacccaggcagc

SEQ ID NO: 3016460 - RNA, 15 nt, Mycobacterium avium subsp. paratuberculosis
ggaaaaccccacccc

SEQ ID NO: 3016461 - RNA, 21 nt, Mycobacterium avium subsp. paratuberculosis
ggaaaauuuccuggccgauga

SEQ ID NO: 3016462 - RNA, 16 nt, Mycobacterium avium subsp. paratuberculosis
ggaaaccaccugccgc

SEQ ID NO: 3016463 - RNA, 20 nt, Mycobacterium avium subsp. paratuberculosis
ggaaacccucgacgccgggc

SEQ ID NO: 3016464 - RNA, 19 nt, Mycobacterium avium subsp. paratuberculosis
ggaaaccguuuucacagcu

SEQ ID NO: 3016465 - RNA, 13 nt, Mycobacterium avium subsp. paratuberculosis
ggaaacgcgucgc

SEQ ID NO: 3016466 - RNA, 18 nt, Mycobacterium avium subsp. paratuberculosis
ggaaacgggaugcggucg

SEQ ID NO: 3016467 - RNA, 23 nt, Mycobacterium avium subsp. paratuberculosis
ggaaacuccuggccccgaucauc

SEQ ID NO: 3016468 - RNA, 20 nt, Mycobacterium avium subsp. paratuberculosis
ggaaagcgcgggcagcccag

SEQ ID NO: 3016469 - RNA, 23 nt, Mycobacterium avium subsp. paratuberculosis
ggaaagcgcuugucgcagacccu

SEQ ID NO: 3016470 - RNA, 12 nt, Mycobacterium avium subsp. paratuberculosis
ggaaaggcagca

SEQ ID NO: 3016471 - RNA, 16 nt, Mycobacterium avium subsp. paratuberculosis
ggaaaggcagcagcca

SEQ ID NO: 3016472 - RNA, 16 nt, Mycobacterium avium subsp. paratuberculosis
ggaaauagguguagcc

SEQ ID NO: 3016473 - RNA, 14 nt, Mycobacterium avium subsp. paratuberculosis
ggaaaugcccgcgc

SEQ ID NO: 3016474 - RNA, 14 nt, Mycobacterium avium subsp. paratuberculosis
ggaacaccacggcc

SEQ ID NO: 3016475 - RNA, 17 nt, Mycobacterium avium subsp. paratuberculosis
ggaacaccacggccggc

SEQ ID NO: 3016476 - RNA, 19 nt, Mycobacterium avium subsp. paratuberculosis
ggaacaccacggccggcaa

SEQ ID NO: 3016477 - RNA, 14 nt, Mycobacterium avium subsp. paratuberculosis
ggaacaccacgucg

SEQ ID NO: 3016478 - RNA, 17 nt, Mycobacterium avium subsp. paratuberculosis
ggaacaccgagccggcg

SEQ ID NO: 3016479 - RNA, 20 nt, Mycobacterium avium subsp. paratuberculosis
ggaacaccgagccggcggcg

SEQ ID NO: 3016480 - RNA, 21 nt, Mycobacterium avium subsp. paratuberculosis
ggaacaccgccuugcccggcu

SEQ ID NO: 3016481 - RNA, 14 nt, Mycobacterium avium subsp. paratuberculosis
ggaacacgcccagc

SEQ ID NO: 3016482 - RNA, 16 nt, Mycobacterium avium subsp. paratuberculosis
ggaacacgucggcgau

SEQ ID NO: 3016483 - RNA, 18 nt, Mycobacterium avium subsp. paratuberculosis
ggaacagacacagcacgc

SEQ ID NO: 3016484 - RNA, 22 nt, Mycobacterium avium subsp. paratuberculosis
ggaacagacucagcccggccca

SEQ ID NO: 3016485 - RNA, 24 nt, Mycobacterium avium subsp. paratuberculosis
ggaacagacucagcccggcccagc

SEQ ID NO: 3016486 - RNA, 13 nt, Mycobacterium avium subsp. paratuberculosis
ggaacagccggcu

SEQ ID NO: 3016487 - RNA, 15 nt, Mycobacterium avium subsp. paratuberculosis
ggaacagcgggccgg

SEQ ID NO: 3016488 - RNA, 21 nt, Mycobacterium avium subsp. paratuberculosis
ggaacagcgggccggcgucgu

SEQ ID NO: 3016489 - RNA, 15 nt, Mycobacterium avium subsp. paratuberculosis
ggaacagcgucgccg

SEQ ID NO: 3016490 - RNA, 17 nt, Mycobacterium avium subsp. paratuberculosis
ggaacagcgucgccgac

SEQ ID NO: 3016491 - RNA, 13 nt, Mycobacterium avium subsp. paratuberculosis
ggaacaucuccag

SEQ ID NO: 3016492 - RNA, 18 nt, Mycobacterium avium subsp. paratuberculosis
ggaacaucuccagcgcgg

SEQ ID NO: 3016493 - RNA, 19 nt, Mycobacterium avium subsp. paratuberculosis
ggaacaucuccagcgcggu

SEQ ID NO: 3016494 - RNA, 15 nt, Mycobacterium avium subsp. paratuberculosis
ggaaccagcccaggu

SEQ ID NO: 3016495 - RNA, 17 nt, Mycobacterium avium subsp. paratuberculosis
ggaacccacgugcggcg

SEQ ID NO: 3016496 - RNA, 18 nt, Mycobacterium avium subsp. paratuberculosis
ggaacccacgugcggcgc

SEQ ID NO: 3016497 - RNA, 20 nt, Mycobacterium avium subsp. paratuberculosis
ggaacccauucggucaucgg

SEQ ID NO: 3016498 - RNA, 20 nt, Mycobacterium avium subsp. paratuberculosis
ggaacccgcguggcaggucg

SEQ ID NO: 3016499 - RNA, 20 nt, Mycobacterium avium subsp. paratuberculosis
ggaacccggguggcccgcac

SEQ ID NO: 3016500 - RNA, 22 nt, Mycobacterium avium subsp. paratuberculosis
ggaaccgaaucggucgaccagc

SEQ ID NO: 3016501 - RNA, 20 nt, Mycobacterium avium subsp. paratuberculosis
ggaaccgacaccucgccguc

SEQ ID NO: 3016502 - RNA, 15 nt, Mycobacterium avium subsp. paratuberculosis
ggaaccggcagccgg

SEQ ID NO: 3016503 - RNA, 17 nt, Mycobacterium avium subsp. paratuberculosis
ggaaccggcagccggcg

SEQ ID NO: 3016504 - RNA, 14 nt, Mycobacterium avium subsp. paratuberculosis
ggaaccggccgggg

SEQ ID NO: 3016505 - RNA, 16 nt, Mycobacterium avium subsp. paratuberculosis
ggaaccgggcacccgg

SEQ ID NO: 3016506 - RNA, 14 nt, Mycobacterium avium subsp. paratuberculosis
ggaaccgggccgcu

SEQ ID NO: 3016507 - RNA, 15 nt, Mycobacterium avium subsp. paratuberculosis
ggaaccgggccgcug

SEQ ID NO: 3016508 - RNA, 17 nt, Mycobacterium avium subsp. paratuberculosis
ggaaccuggucggggug

SEQ ID NO: 3016509 - RNA, 13 nt, Mycobacterium avium subsp. paratuberculosis
ggaacgacggugc

SEQ ID NO: 3016510 - RNA, 21 nt, Mycobacterium avium subsp. paratuberculosis
ggaacgacggugcgcccgucg

SEQ ID NO: 3016511 - RNA, 13 nt, Mycobacterium avium subsp. paratuberculosis
ggaacgagccgga

SEQ ID NO: 3016512 - RNA, 22 nt, Mycobacterium avium subsp. paratuberculosis
ggaacgaucggcuccagcgccc

SEQ ID NO: 3016513 - RNA, 21 nt, Mycobacterium avium subsp. paratuberculosis
ggaacgccgaggaggccgcgg

SEQ ID NO: 3016514 - RNA, 12 nt, Mycobacterium avium subsp. paratuberculosis
ggaacgccggcu

SEQ ID NO: 3016515 - RNA, 17 nt, Mycobacterium avium subsp. paratuberculosis
ggaacgccuugaccgcc

SEQ ID NO: 3016516 - RNA, 12 nt, Mycobacterium avium subsp. paratuberculosis
ggaacgcgaccg

SEQ ID NO: 3016517 - RNA, 16 nt, Mycobacterium avium subsp. paratuberculosis
ggaacgcgcccggcgg

SEQ ID NO: 3016518 - RNA, 13 nt, Mycobacterium avium subsp. paratuberculosis
ggaacgcgccggc

SEQ ID NO: 3016519 - RNA, 16 nt, Mycobacterium avium subsp. paratuberculosis
ggaacgcgccgggcaa

SEQ ID NO: 3016520 - RNA, 15 nt, Mycobacterium avium subsp. paratuberculosis
ggaacgcggcgaagg

SEQ ID NO: 3016521 - RNA, 19 nt, Mycobacterium avium subsp. paratuberculosis
ggaacgcgucgaccgccgc

SEQ ID NO: 3016522 - RNA, 16 nt, Mycobacterium avium subsp. paratuberculosis
ggaacgcgucgcccac

SEQ ID NO: 3016523 - RNA, 19 nt, Mycobacterium avium subsp. paratuberculosis
ggaacgcgucgcccacgcc

SEQ ID NO: 3016524 - RNA, 22 nt, Mycobacterium avium subsp. paratuberculosis
ggaacgcgucgcccacgccggu

SEQ ID NO: 3016525 - RNA, 16 nt, Mycobacterium avium subsp. paratuberculosis
ggaacgcgucgcgcca

SEQ ID NO: 3016526 - RNA, 18 nt, Mycobacterium avium subsp. paratuberculosis
ggaacgcucacucgucuu

SEQ ID NO: 3016527 - RNA, 19 nt, Mycobacterium avium subsp. paratuberculosis
ggaacgcucuucagcgcga

SEQ ID NO: 3016528 - RNA, 21 nt, Mycobacterium avium subsp. paratuberculosis
ggaacgcucuucagcgcgaca

SEQ ID NO: 3016529 - RNA, 14 nt, Mycobacterium avium subsp. paratuberculosis
ggaacggcacccgc

SEQ ID NO: 3016530 - RNA, 21 nt, Mycobacterium avium subsp. paratuberculosis
ggaacggcacccgcagcucca

SEQ ID NO: 3016531 - RNA, 21 nt, Mycobacterium avium subsp. paratuberculosis
ggaacggccggauggccagca

SEQ ID NO: 3016532 - RNA, 20 nt, Mycobacterium avium subsp. paratuberculosis
ggaacgggaagaucgucguc

SEQ ID NO: 3016533 - RNA, 21 nt, Mycobacterium avium subsp. paratuberculosis
ggaacgggaagaucgucgucc

SEQ ID NO: 3016534 - RNA, 14 nt, Mycobacterium avium subsp. paratuberculosis
ggaacgggccggcg

SEQ ID NO: 3016535 - RNA, 17 nt, Mycobacterium avium subsp. paratuberculosis
ggaacgucauggccagc

SEQ ID NO: 3016536 - RNA, 14 nt, Mycobacterium avium subsp. paratuberculosis
ggaacuccagcagc

SEQ ID NO: 3016537 - RNA, 13 nt, Mycobacterium avium subsp. paratuberculosis
ggaacuccugcag

SEQ ID NO: 3016538 - RNA, 14 nt, Mycobacterium avium subsp. paratuberculosis
ggaacuccugcagg

SEQ ID NO: 3016539 - RNA, 20 nt, Mycobacterium avium subsp. paratuberculosis
ggaacucggccagcuggucg

SEQ ID NO: 3016540 - RNA, 12 nt, Mycobacterium avium subsp. paratuberculosis
ggaacucggccg

SEQ ID NO: 3016541 - RNA, 14 nt, Mycobacterium avium subsp. paratuberculosis
ggaacucggccggc

SEQ ID NO: 3016542 - RNA, 15 nt, Mycobacterium avium subsp. paratuberculosis
ggaacucggccggca

SEQ ID NO: 3016543 - RNA, 16 nt, Mycobacterium avium subsp. paratuberculosis
ggaacucggccggcac

SEQ ID NO: 3016544 - RNA, 17 nt, Mycobacterium avium subsp. paratuberculosis
ggaacucggccggcacc

SEQ ID NO: 3016545 - RNA, 19 nt, Mycobacterium avium subsp. paratuberculosis
ggaacucggugaugccggc

SEQ ID NO: 3016546 - RNA, 21 nt, Mycobacterium avium subsp. paratuberculosis
ggaacucggugaugccggcca

SEQ ID NO: 3016547 - RNA, 15 nt, Mycobacterium avium subsp. paratuberculosis
ggaacugacuucgga

SEQ ID NO: 3016548 - RNA, 14 nt, Mycobacterium avium subsp. paratuberculosis
ggaacuugcgccgg

SEQ ID NO: 3016549 - RNA, 18 nt, Mycobacterium avium subsp. paratuberculosis
ggaagacguaggcggcca

SEQ ID NO: 3016550 - RNA, 20 nt, Mycobacterium avium subsp. paratuberculosis
ggaagacguaggcggccagc

SEQ ID NO: 3016551 - RNA, 20 nt, Mycobacterium avium subsp. paratuberculosis
ggaagacgugcacgugcagg

SEQ ID NO: 3016552 - RNA, 21 nt, Mycobacterium avium subsp. paratuberculosis
ggaagaucgcagcggugacac

SEQ ID NO: 3016553 - RNA, 23 nt, Mycobacterium avium subsp. paratuberculosis
ggaagaucgucgucccgucggcg

SEQ ID NO: 3016554 - RNA, 14 nt, Mycobacterium avium subsp. paratuberculosis
ggaagaugacccgc

SEQ ID NO: 3016555 - RNA, 14 nt, Mycobacterium avium subsp. paratuberculosis
ggaagcccaccgcg

SEQ ID NO: 3016556 - RNA, 18 nt, Mycobacterium avium subsp. paratuberculosis
ggaagcccuugcagcaca

SEQ ID NO: 3016557 - RNA, 18 nt, Mycobacterium avium subsp. paratuberculosis
ggaagccgaggucgccga

SEQ ID NO: 3016558 - RNA, 17 nt, Mycobacterium avium subsp. paratuberculosis
ggaagccgcagcaggug

SEQ ID NO: 3016559 - RNA, 18 nt, Mycobacterium avium subsp. paratuberculosis
ggaagccgcagcaggugc

SEQ ID NO: 3016560 - RNA, 13 nt, Mycobacterium avium subsp. paratuberculosis
ggaagccgccgcc

SEQ ID NO: 3016561 - RNA, 15 nt, Mycobacterium avium subsp. paratuberculosis
ggaagccgucggugc

SEQ ID NO: 3016562 - RNA, 22 nt, Mycobacterium avium subsp. paratuberculosis
ggaagcgaagcgggacugcagc

SEQ ID NO: 3016563 - RNA, 17 nt, Mycobacterium avium subsp. paratuberculosis
ggaagcgaauccgggug

SEQ ID NO: 3016564 - RNA, 21 nt, Mycobacterium avium subsp. paratuberculosis
ggaagcgaauccgggugucga

SEQ ID NO: 3016565 - RNA, 19 nt, Mycobacterium avium subsp. paratuberculosis
ggaagcgcaucgccggcgc

SEQ ID NO: 3016566 - RNA, 20 nt, Mycobacterium avium subsp. paratuberculosis
ggaagcgcaucgccggcgcg

SEQ ID NO: 3016567 - RNA, 21 nt, Mycobacterium avium subsp. paratuberculosis
ggaagcgcaucgccggcgcgc

SEQ ID NO: 3016568 - RNA, 14 nt, Mycobacterium avium subsp. paratuberculosis
ggaagcgcccgcgc

SEQ ID NO: 3016569 - RNA, 17 nt, Mycobacterium avium subsp. paratuberculosis
ggaagcgguugagccac

SEQ ID NO: 3016570 - RNA, 22 nt, Mycobacterium avium subsp. paratuberculosis
ggaagcugccguugcgccagcg

SEQ ID NO: 3016571 - RNA, 21 nt, Mycobacterium avium subsp. paratuberculosis
ggaaggacgucaggccgguca

SEQ ID NO: 3016572 - RNA, 17 nt, Mycobacterium avium subsp. paratuberculosis
ggaaggccaaggccagc

SEQ ID NO: 3016573 - RNA, 18 nt, Mycobacterium avium subsp. paratuberculosis
ggaaggccaaggccagca

SEQ ID NO: 3016574 - RNA, 19 nt, Mycobacterium avium subsp. paratuberculosis
ggaaggccaaggccagcaa

SEQ ID NO: 3016575 - RNA, 15 nt, Mycobacterium avium subsp. paratuberculosis
ggaaggcgaucacga

SEQ ID NO: 3016576 - RNA, 14 nt, Mycobacterium avium subsp. paratuberculosis
ggaaggcgccggcg

SEQ ID NO: 3016577 - RNA, 12 nt, Mycobacterium avium subsp. paratuberculosis
ggaaggcggccg

SEQ ID NO: 3016578 - RNA, 13 nt, Mycobacterium avium subsp. paratuberculosis
ggaaggcggccgc

SEQ ID NO: 3016579 - RNA, 23 nt, Mycobacterium avium subsp. paratuberculosis
ggaagggcccgggaugggccugg

SEQ ID NO: 3016580 - RNA, 21 nt, Mycobacterium avium subsp. paratuberculosis
ggaaggugguccuggcggugg

SEQ ID NO: 3016581 - RNA, 14 nt, Mycobacterium avium subsp. paratuberculosis
ggaagguguuggug

SEQ ID NO: 3016582 - RNA, 15 nt, Mycobacterium avium subsp. paratuberculosis
ggaaguacaccaccg

SEQ ID NO: 3016583 - RNA, 19 nt, Mycobacterium avium subsp. paratuberculosis
ggaaguacaccaccgcggc

SEQ ID NO: 3016584 - RNA, 16 nt, Mycobacterium avium subsp. paratuberculosis
ggaaguagccggccag

SEQ ID NO: 3016585 - RNA, 20 nt, Mycobacterium avium subsp. paratuberculosis
ggaaguagccggccagcguc

SEQ ID NO: 3016586 - RNA, 17 nt, Mycobacterium avium subsp. paratuberculosis
ggaaguccggcgcgccc

SEQ ID NO: 3016587 - RNA, 13 nt, Mycobacterium avium subsp. paratuberculosis
ggaagucgaccgg

SEQ ID NO: 3016588 - RNA, 17 nt, Mycobacterium avium subsp. paratuberculosis
ggaagucgaccggggcg

SEQ ID NO: 3016589 - RNA, 20 nt, Mycobacterium avium subsp. paratuberculosis
ggaagucgccguccggggcc

SEQ ID NO: 3016590 - RNA, 22 nt, Mycobacterium avium subsp. paratuberculosis
ggaagucgccguccggggccgg

SEQ ID NO: 3016591 - RNA, 12 nt, Mycobacterium avium subsp. paratuberculosis
ggaagucgucgu

SEQ ID NO: 3016592 - RNA, 13 nt, Mycobacterium avium subsp. paratuberculosis
ggaagugccggcg

SEQ ID NO: 3016593 - RNA, 13 nt, Mycobacterium avium subsp. paratuberculosis
ggaaguggaccgc

SEQ ID NO: 3016594 - RNA, 16 nt, Mycobacterium avium subsp. paratuberculosis
ggaaguucucgccgug

SEQ ID NO: 3016595 - RNA, 17 nt, Mycobacterium avium subsp. paratuberculosis
ggaauacagcagcugcg

SEQ ID NO: 3016596 - RNA, 18 nt, Mycobacterium avium subsp. paratuberculosis
ggaauaggccgcguaggc

SEQ ID NO: 3016597 - RNA, 23 nt, Mycobacterium avium subsp. paratuberculosis
ggaauauccaucgauggcggugu

SEQ ID NO: 3016598 - RNA, 12 nt, Mycobacterium avium subsp. paratuberculosis
ggaauccacagc

SEQ ID NO: 3016599 - RNA, 18 nt, Mycobacterium avium subsp. paratuberculosis
ggaaucccacccgcaacg

SEQ ID NO: 3016600 - RNA, 14 nt, Mycobacterium avium subsp. paratuberculosis
ggaauccuggccga

SEQ ID NO: 3016601 - RNA, 17 nt, Mycobacterium avium subsp. paratuberculosis
ggaauccuggccgaugg

SEQ ID NO: 3016602 - RNA, 19 nt, Mycobacterium avium subsp. paratuberculosis
ggaaucgcccgggccaggu

SEQ ID NO: 3016603 - RNA, 15 nt, Mycobacterium avium subsp. paratuberculosis
ggaaugaacugccgc

SEQ ID NO: 3016604 - RNA, 18 nt, Mycobacterium avium subsp. paratuberculosis
ggaaugcaggaucgcggu

SEQ ID NO: 3016605 - RNA, 13 nt, Mycobacterium avium subsp. paratuberculosis
ggaaugcaucgcg

SEQ ID NO: 3016606 - RNA, 15 nt, Mycobacterium avium subsp. paratuberculosis
ggaauggcagcagcc

SEQ ID NO: 3016607 - RNA, 13 nt, Mycobacterium avium subsp. paratuberculosis
ggaauggggcccg

SEQ ID NO: 3016608 - RNA, 21 nt, Mycobacterium avium subsp. paratuberculosis
ggaaugucauuugagcggccg

SEQ ID NO: 3016609 - RNA, 23 nt, Mycobacterium avium subsp. paratuberculosis
ggaaugucauuugagcggccgac

SEQ ID NO: 3016610 - RNA, 19 nt, Mycobacterium avium subsp. paratuberculosis
ggaaugugccugcgggccc

SEQ ID NO: 3016611 - RNA, 20 nt, Mycobacterium avium subsp. paratuberculosis
ggaauucagugaggccagca

SEQ ID NO: 3016612 - RNA, 12 nt, Mycobacterium avium subsp. paratuberculosis
ggaauuccagcg

SEQ ID NO: 3016613 - RNA, 17 nt, Mycobacterium avium subsp. paratuberculosis
ggaauuccagcgacaac

SEQ ID NO: 3016614 - RNA, 17 nt, Mycobacterium avium subsp. paratuberculosis
ggaauuccggcgcgauc

SEQ ID NO: 3016615 - RNA, 16 nt, Mycobacterium avium subsp. paratuberculosis
ggaauucgccgacgcg

SEQ ID NO: 3016616 - RNA, 20 nt, Mycobacterium avium subsp. paratuberculosis
ggaauucgccgacgcgcugc

SEQ ID NO: 3016617 - RNA, 17 nt, Mycobacterium avium subsp. paratuberculosis
ggaauucgggugcggcg

SEQ ID NO: 3016618 - RNA, 14 nt, Mycobacterium avium subsp. paratuberculosis
ggaauucgucggcg

SEQ ID NO: 3016619 - RNA, 15 nt, Mycobacterium avium subsp. paratuberculosis
ggaauucgucggcgg

SEQ ID NO: 3016620 - RNA, 16 nt, Mycobacterium avium subsp. paratuberculosis
ggaauucgucggcggu

SEQ ID NO: 3016621 - RNA, 17 nt, Mycobacterium avium subsp. paratuberculosis
ggaauucgucggcggug

SEQ ID NO: 3016622 - RNA, 21 nt, Mycobacterium avium subsp. paratuberculosis
ggaauugaagcccugcucggu

SEQ ID NO: 3016623 - RNA, 10 nt, Mycobacterium avium subsp. paratuberculosis
ggaauugcuu

SEQ ID NO: 3016624 - RNA, 21 nt, Mycobacterium avium subsp. paratuberculosis
ggaauugcuuuuugaccaccg

SEQ ID NO: 3016625 - RNA, 19 nt, Mycobacterium avium subsp. paratuberculosis
ggacaacgcagguuucucg

SEQ ID NO: 3016626 - RNA, 23 nt, Mycobacterium avium subsp. paratuberculosis
ggacaacgcagguuucucgacca

SEQ ID NO: 3016627 - RNA, 23 nt, Mycobacterium avium subsp. paratuberculosis
ggacaacgcgucgaacagccggg

SEQ ID NO: 3016628 - RNA, 22 nt, Mycobacterium avium subsp. paratuberculosis
ggacaacggaucgagcgcaccg

SEQ ID NO: 3016629 - RNA, 23 nt, Mycobacterium avium subsp. paratuberculosis
ggacaacggaucgagcgcaccgc

SEQ ID NO: 3016630 - RNA, 14 nt, Mycobacterium avium subsp. paratuberculosis
ggacaccaccgcgg

SEQ ID NO: 3016631 - RNA, 17 nt, Mycobacterium avium subsp. paratuberculosis
ggacaccaccgcggugg

SEQ ID NO: 3016632 - RNA, 16 nt, Mycobacterium avium subsp. paratuberculosis
ggacaccacgaucagc

SEQ ID NO: 3016633 - RNA, 20 nt, Mycobacterium avium subsp. paratuberculosis
ggacaccacgaucagcgcgu

SEQ ID NO: 3016634 - RNA, 21 nt, Mycobacterium avium subsp. paratuberculosis
ggacaccacgguggcguccag

SEQ ID NO: 3016635 - RNA, 22 nt, Mycobacterium avium subsp. paratuberculosis
ggacaccacgguggcguccagc

SEQ ID NO: 3016636 - RNA, 13 nt, Mycobacterium avium subsp. paratuberculosis
ggacaccagcaug

SEQ ID NO: 3016637 - RNA, 12 nt, Mycobacterium avium subsp. paratuberculosis
ggacaccagguu

SEQ ID NO: 3016638 - RNA, 16 nt, Mycobacterium avium subsp. paratuberculosis
ggacaccccggccagu

SEQ ID NO: 3016639 - RNA, 17 nt, Mycobacterium avium subsp. paratuberculosis
ggacacccgcgcggugc

SEQ ID NO: 3016640 - RNA, 13 nt, Mycobacterium avium subsp. paratuberculosis
ggacaccgaaccg

SEQ ID NO: 3016641 - RNA, 23 nt, Mycobacterium avium subsp. paratuberculosis
ggacaccgcuggccgaggccucc

SEQ ID NO: 3016642 - RNA, 14 nt, Mycobacterium avium subsp. paratuberculosis
ggacaccggcacgu

SEQ ID NO: 3016643 - RNA, 20 nt, Mycobacterium avium subsp. paratuberculosis
ggacaccggcacgucggcca

SEQ ID NO: 3016644 - RNA, 22 nt, Mycobacterium avium subsp. paratuberculosis
ggacaccgucaugccguugaug

SEQ ID NO: 3016645 - RNA, 19 nt, Mycobacterium avium subsp. paratuberculosis
ggacaccucggccagcgcc

SEQ ID NO: 3016646 - RNA, 23 nt, Mycobacterium avium subsp. paratuberculosis
ggacaccucggccagcgccgcgc

SEQ ID NO: 3016647 - RNA, 17 nt, Mycobacterium avium subsp. paratuberculosis
ggacaccuuggcggcca

SEQ ID NO: 3016648 - RNA, 18 nt, Mycobacterium avium subsp. paratuberculosis
ggacaccuuggcggccac

SEQ ID NO: 3016649 - RNA, 22 nt, Mycobacterium avium subsp. paratuberculosis
ggacacgcugccgagguacgcg

SEQ ID NO: 3016650 - RNA, 13 nt, Mycobacterium avium subsp. paratuberculosis
ggacacggccagc

SEQ ID NO: 3016651 - RNA, 14 nt, Mycobacterium avium subsp. paratuberculosis
ggacacggccagcg

SEQ ID NO: 3016652 - RNA, 14 nt, Mycobacterium avium subsp. paratuberculosis
ggacacggccggga

SEQ ID NO: 3016653 - RNA, 16 nt, Mycobacterium avium subsp. paratuberculosis
ggacacggcgccgugc

SEQ ID NO: 3016654 - RNA, 15 nt, Mycobacterium avium subsp. paratuberculosis
ggacacggcggcgcg

SEQ ID NO: 3016655 - RNA, 16 nt, Mycobacterium avium subsp. paratuberculosis
ggacacggcggcgcgg

SEQ ID NO: 3016656 - RNA, 20 nt, Mycobacterium avium subsp. paratuberculosis
ggacacggcugcacccucug

SEQ ID NO: 3016657 - RNA, 16 nt, Mycobacterium avium subsp. paratuberculosis
ggacacguuggccaga

SEQ ID NO: 3016658 - RNA, 14 nt, Mycobacterium avium subsp. paratuberculosis
ggacagcaccacca

SEQ ID NO: 3016659 - RNA, 17 nt, Mycobacterium avium subsp. paratuberculosis
ggacagcaccaccaggu

SEQ ID NO: 3016660 - RNA, 18 nt, Mycobacterium avium subsp. paratuberculosis
ggacagcaccuugcccag

SEQ ID NO: 3016661 - RNA, 20 nt, Mycobacterium avium subsp. paratuberculosis
ggacagcaccuugcccaggu

SEQ ID NO: 3016662 - RNA, 11 nt, Mycobacterium avium subsp. paratuberculosis
ggacagcagca

SEQ ID NO: 3016663 - RNA, 14 nt, Mycobacterium avium subsp. paratuberculosis
ggacagcagcaccg

SEQ ID NO: 3016664 - RNA, 17 nt, Mycobacterium avium subsp. paratuberculosis
ggacagcagcagcuccc

SEQ ID NO: 3016665 - RNA, 11 nt, Mycobacterium avium subsp. paratuberculosis
ggacagcagcc

SEQ ID NO: 3016666 - RNA, 13 nt, Mycobacterium avium subsp. paratuberculosis
ggacagcagccgc

SEQ ID NO: 3016667 - RNA, 14 nt, Mycobacterium avium subsp. paratuberculosis
ggacagccacagcu

SEQ ID NO: 3016668 - RNA, 18 nt, Mycobacterium avium subsp. paratuberculosis
ggacagccacagcucggg

SEQ ID NO: 3016669 - RNA, 17 nt, Mycobacterium avium subsp. paratuberculosis
ggacagccggggcagcu

SEQ ID NO: 3016670 - RNA, 23 nt, Mycobacterium avium subsp. paratuberculosis
ggacagccggggcagcugcuggg

SEQ ID NO: 3016671 - RNA, 22 nt, Mycobacterium avium subsp. paratuberculosis
ggacagcgcgacgcacgccggc

SEQ ID NO: 3016672 - RNA, 23 nt, Mycobacterium avium subsp. paratuberculosis
ggacagcgcgacgcacgccggcg

SEQ ID NO: 3016673 - RNA, 17 nt, Mycobacterium avium subsp. paratuberculosis
ggacagcgcgacgggca

SEQ ID NO: 3016674 - RNA, 23 nt, Mycobacterium avium subsp. paratuberculosis
ggacagcgcgacgggcacccgcg

SEQ ID NO: 3016675 - RNA, 12 nt, Mycobacterium avium subsp. paratuberculosis
ggacagcgcggu

SEQ ID NO: 3016676 - RNA, 17 nt, Mycobacterium avium subsp. paratuberculosis
ggacagcgcggugaugu

SEQ ID NO: 3016677 - RNA, 20 nt, Mycobacterium avium subsp. paratuberculosis
ggacagcgcgguggucagcg

SEQ ID NO: 3016678 - RNA, 13 nt, Mycobacterium avium subsp. paratuberculosis
ggacagcggcgcg

SEQ ID NO: 3016679 - RNA, 15 nt, Mycobacterium avium subsp. paratuberculosis
ggacagcggcgcggu

SEQ ID NO: 3016680 - RNA, 21 nt, Mycobacterium avium subsp. paratuberculosis
ggacagcgggccgacccggcc

SEQ ID NO: 3016681 - RNA, 17 nt, Mycobacterium avium subsp. paratuberculosis
ggacagcgucaccaaug

SEQ ID NO: 3016682 - RNA, 17 nt, Mycobacterium avium subsp. paratuberculosis
ggacagcgucagccccg

SEQ ID NO: 3016683 - RNA, 13 nt, Mycobacterium avium subsp. paratuberculosis
ggacagcucaccg

SEQ ID NO: 3016684 - RNA, 19 nt, Mycobacterium avium subsp. paratuberculosis
ggacagcucaccgggcucg

SEQ ID NO: 3016685 - RNA, 20 nt, Mycobacterium avium subsp. paratuberculosis
ggacagcucaccgggcucgg

SEQ ID NO: 3016686 - RNA, 15 nt, Mycobacterium avium subsp. paratuberculosis
ggacagcucgccggc

SEQ ID NO: 3016687 - RNA, 14 nt, Mycobacterium avium subsp. paratuberculosis
ggacagcugcgcgg

SEQ ID NO: 3016688 - RNA, 15 nt, Mycobacterium avium subsp. paratuberculosis
ggacagcuggcgguc

SEQ ID NO: 3016689 - RNA, 20 nt, Mycobacterium avium subsp. paratuberculosis
ggacagcuggcggucgcuga

SEQ ID NO: 3016690 - RNA, 17 nt, Mycobacterium avium subsp. paratuberculosis
ggacaggaacgggccgg

SEQ ID NO: 3016691 - RNA, 22 nt, Mycobacterium avium subsp. paratuberculosis
ggacaggaacgggccggcgucc

SEQ ID NO: 3016692 - RNA, 16 nt, Mycobacterium avium subsp. paratuberculosis
ggacaggaucuggacg

SEQ ID NO: 3016693 - RNA, 22 nt, Mycobacterium avium subsp. paratuberculosis
ggacaggaugcguucggccagu

SEQ ID NO: 3016694 - RNA, 19 nt, Mycobacterium avium subsp. paratuberculosis
ggacaggcacucgcccagg

SEQ ID NO: 3016695 - RNA, 16 nt, Mycobacterium avium subsp. paratuberculosis
ggacaggccggcgacg

SEQ ID NO: 3016696 - RNA, 19 nt, Mycobacterium avium subsp. paratuberculosis
ggacaggccggcgacggcg

SEQ ID NO: 3016697 - RNA, 16 nt, Mycobacterium avium subsp. paratuberculosis
ggacagggaggacagc

SEQ ID NO: 3016698 - RNA, 20 nt, Mycobacterium avium subsp. paratuberculosis
ggacagggaggacagcaccg

SEQ ID NO: 3016699 - RNA, 16 nt, Mycobacterium avium subsp. paratuberculosis
ggacagggcgacaucg

SEQ ID NO: 3016700 - RNA, 13 nt, Mycobacterium avium subsp. paratuberculosis
ggacagggcggcg

SEQ ID NO: 3016701 - RNA, 14 nt, Mycobacterium avium subsp. paratuberculosis
ggacagggcggcga

SEQ ID NO: 3016702 - RNA, 16 nt, Mycobacterium avium subsp. paratuberculosis
ggacagggcggcgacc

SEQ ID NO: 3016703 - RNA, 17 nt, Mycobacterium avium subsp. paratuberculosis
ggacagguagcgcagcc

SEQ ID NO: 3016704 - RNA, 23 nt, Mycobacterium avium subsp. paratuberculosis
ggacaggucgagggugacccggg

SEQ ID NO: 3016705 - RNA, 14 nt, Mycobacterium avium subsp. paratuberculosis
ggacaggucgauga

SEQ ID NO: 3016706 - RNA, 15 nt, Mycobacterium avium subsp. paratuberculosis
ggacaggucgaugau

SEQ ID NO: 3016707 - RNA, 14 nt, Mycobacterium avium subsp. paratuberculosis
ggacaggucgggca

SEQ ID NO: 3016708 - RNA, 23 nt, Mycobacterium avium subsp. paratuberculosis
ggacaucaagugcaagggcgaca

SEQ ID NO: 3016709 - RNA, 22 nt, Mycobacterium avium subsp. paratuberculosis
ggacauccauugggccgcggcg

SEQ ID NO: 3016710 - RNA, 22 nt, Mycobacterium avium subsp. paratuberculosis
ggacauccgugagggaccucca

SEQ ID NO: 3016711 - RNA, 13 nt, Mycobacterium avium subsp. paratuberculosis
ggacaucgccucg

SEQ ID NO: 3016712 - RNA, 17 nt, Mycobacterium avium subsp. paratuberculosis
ggacaucgccucggcgu

SEQ ID NO: 3016713 - RNA, 20 nt, Mycobacterium avium subsp. paratuberculosis
ggacaucgucgcgcccagga

SEQ ID NO: 3016714 - RNA, 15 nt, Mycobacterium avium subsp. paratuberculosis
ggacaugccgagcag

SEQ ID NO: 3016715 - RNA, 17 nt, Mycobacterium avium subsp. paratuberculosis
ggacaugccgagcagca

SEQ ID NO: 3016716 - RNA, 12 nt, Mycobacterium avium subsp. paratuberculosis
ggacaugccggc

SEQ ID NO: 3016717 - RNA, 14 nt, Mycobacterium avium subsp. paratuberculosis
ggacauucugcacg

SEQ ID NO: 3016718 - RNA, 13 nt, Mycobacterium avium subsp. paratuberculosis
ggaccaccaggaa

SEQ ID NO: 3016719 - RNA, 18 nt, Mycobacterium avium subsp. paratuberculosis
ggaccacccacucccagc

SEQ ID NO: 3016720 - RNA, 22 nt, Mycobacterium avium subsp. paratuberculosis
ggaccacccacucccagccgcc

SEQ ID NO: 3016721 - RNA, 23 nt, Mycobacterium avium subsp. paratuberculosis
ggaccacccacucccagccgccg

SEQ ID NO: 3016722 - RNA, 15 nt, Mycobacterium avium subsp. paratuberculosis
ggaccacccgcagcg

SEQ ID NO: 3016723 - RNA, 19 nt, Mycobacterium avium subsp. paratuberculosis
ggaccacccgcagcgcggc

SEQ ID NO: 3016724 - RNA, 20 nt, Mycobacterium avium subsp. paratuberculosis
ggaccacccgcagcgcggcg

SEQ ID NO: 3016725 - RNA, 19 nt, Mycobacterium avium subsp. paratuberculosis
ggaccaccgcgugcgagcc

SEQ ID NO: 3016726 - RNA, 20 nt, Mycobacterium avium subsp. paratuberculosis
ggaccagcaugugcucccag

SEQ ID NO: 3016727 - RNA, 11 nt, Mycobacterium avium subsp. paratuberculosis
ggaccagcgcc

SEQ ID NO: 3016728 - RNA, 22 nt, Mycobacterium avium subsp. paratuberculosis
ggaccagcgccucggccugcgc

SEQ ID NO: 3016729 - RNA, 19 nt, Mycobacterium avium subsp. paratuberculosis
ggaccagcgggucgauggc

SEQ ID NO: 3016730 - RNA, 14 nt, Mycobacterium avium subsp. paratuberculosis
ggaccagggcggug

SEQ ID NO: 3016731 - RNA, 16 nt, Mycobacterium avium subsp. paratuberculosis
ggaccagggcgguggc

SEQ ID NO: 3016732 - RNA, 12 nt, Mycobacterium avium subsp. paratuberculosis
ggaccagggugg

SEQ ID NO: 3016733 - RNA, 18 nt, Mycobacterium avium subsp. paratuberculosis
ggaccaggguggccccag

SEQ ID NO: 3016734 - RNA, 19 nt, Mycobacterium avium subsp. paratuberculosis
ggaccaggguggccccagc

SEQ ID NO: 3016735 - RNA, 20 nt, Mycobacterium avium subsp. paratuberculosis
ggaccaggguggccccagcc

SEQ ID NO: 3016736 - RNA, 21 nt, Mycobacterium avium subsp. paratuberculosis
ggaccaggguggccccagccc

SEQ ID NO: 3016737 - RNA, 20 nt, Mycobacterium avium subsp. paratuberculosis
ggaccagguauucaucgcgg

SEQ ID NO: 3016738 - RNA, 23 nt, Mycobacterium avium subsp. paratuberculosis
ggaccaucuacgaccucgaagaa

SEQ ID NO: 3016739 - RNA, 14 nt, Mycobacterium avium subsp. paratuberculosis
ggacccagcccggc

SEQ ID NO: 3016740 - RNA, 13 nt, Mycobacterium avium subsp. paratuberculosis
ggacccagcuccu

SEQ ID NO: 3016741 - RNA, 14 nt, Mycobacterium avium subsp. paratuberculosis
ggacccauucgucg

SEQ ID NO: 3016742 - RNA, 17 nt, Mycobacterium avium subsp. paratuberculosis
ggacccauucgucggcg

SEQ ID NO: 3016743 - RNA, 16 nt, Mycobacterium avium subsp. paratuberculosis
ggaccccacagcgcgc

SEQ ID NO: 3016744 - RNA, 19 nt, Mycobacterium avium subsp. paratuberculosis
ggaccccgaugcgcucacc

SEQ ID NO: 3016745 - RNA, 23 nt, Mycobacterium avium subsp. paratuberculosis
ggacccgacggucgggcccaggu

SEQ ID NO: 3016746 - RNA, 13 nt, Mycobacterium avium subsp. paratuberculosis
ggacccgccccga

SEQ ID NO: 3016747 - RNA, 15 nt, Mycobacterium avium subsp. paratuberculosis
ggacccgccccgaca

SEQ ID NO: 3016748 - RNA, 15 nt, Mycobacterium avium subsp. paratuberculosis
ggacccgcucgccga

SEQ ID NO: 3016749 - RNA, 16 nt, Mycobacterium avium subsp. paratuberculosis
ggacccggaacccgcg

SEQ ID NO: 3016750 - RNA, 18 nt, Mycobacterium avium subsp. paratuberculosis
ggacccggaggcggcggg

SEQ ID NO: 3016751 - RNA, 15 nt, Mycobacterium avium subsp. paratuberculosis
ggacccggucggccg

SEQ ID NO: 3016752 - RNA, 14 nt, Mycobacterium avium subsp. paratuberculosis
ggacccuggccagc

SEQ ID NO: 3016753 - RNA, 15 nt, Mycobacterium avium subsp. paratuberculosis
ggacccuggccagca

SEQ ID NO: 3016754 - RNA, 16 nt, Mycobacterium avium subsp. paratuberculosis
ggacccuucgaacgcg

SEQ ID NO: 3016755 - RNA, 22 nt, Mycobacterium avium subsp. paratuberculosis
ggaccgagaugaagacccggcc

SEQ ID NO: 3016756 - RNA, 15 nt, Mycobacterium avium subsp. paratuberculosis
ggaccgagcgcgcga

SEQ ID NO: 3016757 - RNA, 17 nt, Mycobacterium avium subsp. paratuberculosis
ggaccgaggugccgcgg

SEQ ID NO: 3016758 - RNA, 16 nt, Mycobacterium avium subsp. paratuberculosis
ggaccgcacgccgggu

SEQ ID NO: 3016759 - RNA, 18 nt, Mycobacterium avium subsp. paratuberculosis
ggaccgcacgccggguug

SEQ ID NO: 3016760 - RNA, 18 nt, Mycobacterium avium subsp. paratuberculosis
ggaccgccgagagcucuu

SEQ ID NO: 3016761 - RNA, 14 nt, Mycobacterium avium subsp. paratuberculosis
ggaccgccgcggcg

SEQ ID NO: 3016762 - RNA, 15 nt, Mycobacterium avium subsp. paratuberculosis
ggaccgccgcggcgc

SEQ ID NO: 3016763 - RNA, 20 nt, Mycobacterium avium subsp. paratuberculosis
ggaccgccgcggcgcccggc

SEQ ID NO: 3016764 - RNA, 22 nt, Mycobacterium avium subsp. paratuberculosis
ggaccgccgcggcgcccggcgc

SEQ ID NO: 3016765 - RNA, 23 nt, Mycobacterium avium subsp. paratuberculosis
ggaccgccgcggcgcccggcgcc

SEQ ID NO: 3016766 - RNA, 12 nt, Mycobacterium avium subsp. paratuberculosis
ggaccgcgcagu

SEQ ID NO: 3016767 - RNA, 13 nt, Mycobacterium avium subsp. paratuberculosis
ggaccgcgcgccg

SEQ ID NO: 3016768 - RNA, 15 nt, Mycobacterium avium subsp. paratuberculosis
ggaccgcgcgccggc

SEQ ID NO: 3016769 - RNA, 16 nt, Mycobacterium avium subsp. paratuberculosis
ggaccgcgcgccggcc

SEQ ID NO: 3016770 - RNA, 19 nt, Mycobacterium avium subsp. paratuberculosis
ggaccgcgcgccggccagc

SEQ ID NO: 3016771 - RNA, 21 nt, Mycobacterium avium subsp. paratuberculosis
ggaccgcgcgccggccagcac

SEQ ID NO: 3016772 - RNA, 22 nt, Mycobacterium avium subsp. paratuberculosis
ggaccgcgcgccggccagcacg

SEQ ID NO: 3016773 - RNA, 14 nt, Mycobacterium avium subsp. paratuberculosis
ggaccgcgcgggcc

SEQ ID NO: 3016774 - RNA, 17 nt, Mycobacterium avium subsp. paratuberculosis
ggaccgcgcgggccagc

SEQ ID NO: 3016775 - RNA, 19 nt, Mycobacterium avium subsp. paratuberculosis
ggaccgcgcgggccagcgc

SEQ ID NO: 3016776 - RNA, 17 nt, Mycobacterium avium subsp. paratuberculosis
ggaccgcgugugcccgc

SEQ ID NO: 3016777 - RNA, 19 nt, Mycobacterium avium subsp. paratuberculosis
ggaccgcgugugcccgccu

SEQ ID NO: 3016778 - RNA, 12 nt, Mycobacterium avium subsp. paratuberculosis
ggaccggccagc

SEQ ID NO: 3016779 - RNA, 13 nt, Mycobacterium avium subsp. paratuberculosis
ggaccggccagca

SEQ ID NO: 3016780 - RNA, 14 nt, Mycobacterium avium subsp. paratuberculosis
ggaccggccagcag

SEQ ID NO: 3016781 - RNA, 18 nt, Mycobacterium avium subsp. paratuberculosis
ggaccggccagcagccgc

SEQ ID NO: 3016782 - RNA, 19 nt, Mycobacterium avium subsp. paratuberculosis
ggaccggccagcagccgcu

SEQ ID NO: 3016783 - RNA, 20 nt, Mycobacterium avium subsp. paratuberculosis
ggaccggccagcagccgcuc

SEQ ID NO: 3016784 - RNA, 14 nt, Mycobacterium avium subsp. paratuberculosis
ggaccggccgugcg

SEQ ID NO: 3016785 - RNA, 19 nt, Mycobacterium avium subsp. paratuberculosis
ggaccggcgauuucggccg

SEQ ID NO: 3016786 - RNA, 20 nt, Mycobacterium avium subsp. paratuberculosis
ggaccggcgauuucggccgu

SEQ ID NO: 3016787 - RNA, 16 nt, Mycobacterium avium subsp. paratuberculosis
ggaccggcgccggccg

SEQ ID NO: 3016788 - RNA, 18 nt, Mycobacterium avium subsp. paratuberculosis
ggaccggcgccggccgcc

SEQ ID NO: 3016789 - RNA, 15 nt, Mycobacterium avium subsp. paratuberculosis
ggaccggcggccgcc

SEQ ID NO: 3016790 - RNA, 19 nt, Mycobacterium avium subsp. paratuberculosis
ggaccggcggccgccauca

SEQ ID NO: 3016791 - RNA, 11 nt, Mycobacterium avium subsp. paratuberculosis
ggaccggcguc

SEQ ID NO: 3016792 - RNA, 21 nt, Mycobacterium avium subsp. paratuberculosis
ggaccggcucguagcuggugc

SEQ ID NO: 3016793 - RNA, 19 nt, Mycobacterium avium subsp. paratuberculosis
ggaccgggacgacggcgcc

SEQ ID NO: 3016794 - RNA, 15 nt, Mycobacterium avium subsp. paratuberculosis
ggaccgggcccggcg

SEQ ID NO: 3016795 - RNA, 16 nt, Mycobacterium avium subsp. paratuberculosis
ggaccgggcccggcgc

SEQ ID NO: 3016796 - RNA, 12 nt, Mycobacterium avium subsp. paratuberculosis
ggaccgggcggg

SEQ ID NO: 3016797 - RNA, 16 nt, Mycobacterium avium subsp. paratuberculosis
ggaccgggcgggcugc

SEQ ID NO: 3016798 - RNA, 21 nt, Mycobacterium avium subsp. paratuberculosis
ggaccgggugaccggcgcgca

SEQ ID NO: 3016799 - RNA, 13 nt, Mycobacterium avium subsp. paratuberculosis
ggaccggguggug

SEQ ID NO: 3016800 - RNA, 19 nt, Mycobacterium avium subsp. paratuberculosis
ggaccgguaggcgcaccgc

SEQ ID NO: 3016801 - RNA, 21 nt, Mycobacterium avium subsp. paratuberculosis
ggaccgguaggcgcaccgccg

SEQ ID NO: 3016802 - RNA, 23 nt, Mycobacterium avium subsp. paratuberculosis
ggaccgguccuccccgcuggcgc

SEQ ID NO: 3016803 - RNA, 19 nt, Mycobacterium avium subsp. paratuberculosis
ggaccgucgcgcagcccga

SEQ ID NO: 3016804 - RNA, 16 nt, Mycobacterium avium subsp. paratuberculosis
ggaccgucggugucga

SEQ ID NO: 3016805 - RNA, 15 nt, Mycobacterium avium subsp. paratuberculosis
ggaccucgaccagcc

SEQ ID NO: 3016806 - RNA, 20 nt, Mycobacterium avium subsp. paratuberculosis
ggaccucgaccagccggugg

SEQ ID NO: 3016807 - RNA, 21 nt, Mycobacterium avium subsp. paratuberculosis
ggaccugaccgaacagcuuug

SEQ ID NO: 3016808 - RNA, 12 nt, Mycobacterium avium subsp. paratuberculosis
ggaccugccggc

SEQ ID NO: 3016809 - RNA, 17 nt, Mycobacterium avium subsp. paratuberculosis
ggaccugcugcucgucg

SEQ ID NO: 3016810 - RNA, 17 nt, Mycobacterium avium subsp. paratuberculosis
ggaccuuggugucggcg

SEQ ID NO: 3016811 - RNA, 21 nt, Mycobacterium avium subsp. paratuberculosis
ggaccuuggugucggcgagcu

SEQ ID NO: 3016812 - RNA, 22 nt, Mycobacterium avium subsp. paratuberculosis
ggaccuugucgggccgcgggcc

SEQ ID NO: 3016813 - RNA, 17 nt, Mycobacterium avium subsp. paratuberculosis
ggacgaaacccggcgga

SEQ ID NO: 3016814 - RNA, 20 nt, Mycobacterium avium subsp. paratuberculosis
ggacgaaacccggcggacgg

SEQ ID NO: 3016815 - RNA, 21 nt, Mycobacterium avium subsp. paratuberculosis
ggacgaaccagugcccggcca

SEQ ID NO: 3016816 - RNA, 14 nt, Mycobacterium avium subsp. paratuberculosis
ggacgaacgcggcg

SEQ ID NO: 3016817 - RNA, 14 nt, Mycobacterium avium subsp. paratuberculosis
ggacgaagaccggg

SEQ ID NO: 3016818 - RNA, 15 nt, Mycobacterium avium subsp. paratuberculosis
ggacgaagaccgggu

SEQ ID NO: 3016819 - RNA, 15 nt, Mycobacterium avium subsp. paratuberculosis
ggacgaaugucucga

SEQ ID NO: 3016820 - RNA, 19 nt, Mycobacterium avium subsp. paratuberculosis
ggacgaccugggcgccguc

SEQ ID NO: 3016821 - RNA, 20 nt, Mycobacterium avium subsp. paratuberculosis
ggacgaccugggcgccgucg

SEQ ID NO: 3016822 - RNA, 11 nt, Mycobacterium avium subsp. paratuberculosis
ggacgacgccg

SEQ ID NO: 3016823 - RNA, 13 nt, Mycobacterium avium subsp. paratuberculosis
ggacgacggcgcc

SEQ ID NO: 3016824 - RNA, 12 nt, Mycobacterium avium subsp. paratuberculosis
ggacgacggcgg

SEQ ID NO: 3016825 - RNA, 13 nt, Mycobacterium avium subsp. paratuberculosis
ggacgacggcggg

SEQ ID NO: 3016826 - RNA, 14 nt, Mycobacterium avium subsp. paratuberculosis
ggacgacgucgaug

SEQ ID NO: 3016827 - RNA, 15 nt, Mycobacterium avium subsp. paratuberculosis
ggacgacgucgaugu

SEQ ID NO: 3016828 - RNA, 20 nt, Mycobacterium avium subsp. paratuberculosis
ggacgacgucgaugugcucg

SEQ ID NO: 3016829 - RNA, 13 nt, Mycobacterium avium subsp. paratuberculosis
ggacgagcagccg

SEQ ID NO: 3016830 - RNA, 15 nt, Mycobacterium avium subsp. paratuberculosis
ggacgagccgucgcg

SEQ ID NO: 3016831 - RNA, 14 nt, Mycobacterium avium subsp. paratuberculosis
ggacgaggcccgca

SEQ ID NO: 3016832 - RNA, 21 nt, Mycobacterium avium subsp. paratuberculosis
ggacgaggcccgcaagaugug

SEQ ID NO: 3016833 - RNA, 14 nt, Mycobacterium avium subsp. paratuberculosis
ggacgaggcgagua

SEQ ID NO: 3016834 - RNA, 15 nt, Mycobacterium avium subsp. paratuberculosis
ggacgaggcggguga

SEQ ID NO: 3016835 - RNA, 21 nt, Mycobacterium avium subsp. paratuberculosis
ggacgaugcgcacccccgggg

SEQ ID NO: 3016836 - RNA, 12 nt, Mycobacterium avium subsp. paratuberculosis
ggacgaugcgcg

SEQ ID NO: 3016837 - RNA, 15 nt, Mycobacterium avium subsp. paratuberculosis
ggacgaugcggggcc

SEQ ID NO: 3016838 - RNA, 18 nt, Mycobacterium avium subsp. paratuberculosis
ggacgauguccgccggcc

SEQ ID NO: 3016839 - RNA, 17 nt, Mycobacterium avium subsp. paratuberculosis
ggacgauucgcgaucaa

SEQ ID NO: 3016840 - RNA, 19 nt, Mycobacterium avium subsp. paratuberculosis
ggacgcagcgaucggcggc

SEQ ID NO: 3016841 - RNA, 16 nt, Mycobacterium avium subsp. paratuberculosis
ggacgcauccacggcc

SEQ ID NO: 3016842 - RNA, 13 nt, Mycobacterium avium subsp. paratuberculosis
ggacgccacggcg

SEQ ID NO: 3016843 - RNA, 14 nt, Mycobacterium avium subsp. paratuberculosis
ggacgccacggcga

SEQ ID NO: 3016844 - RNA, 20 nt, Mycobacterium avium subsp. paratuberculosis
ggacgccagcaugaucaccg

SEQ ID NO: 3016845 - RNA, 13 nt, Mycobacterium avium subsp. paratuberculosis
ggacgccaguggc

SEQ ID NO: 3016846 - RNA, 21 nt, Mycobacterium avium subsp. paratuberculosis
ggacgcccaacuacccgccga

SEQ ID NO: 3016847 - RNA, 12 nt, Mycobacterium avium subsp. paratuberculosis
ggacgcccgcga

SEQ ID NO: 3016848 - RNA, 14 nt, Mycobacterium avium subsp. paratuberculosis
ggacgcccgcgacc

SEQ ID NO: 3016849 - RNA, 15 nt, Mycobacterium avium subsp. paratuberculosis
ggacgcccgcgaccc

SEQ ID NO: 3016850 - RNA, 16 nt, Mycobacterium avium subsp. paratuberculosis
ggacgcccgcgacccg

SEQ ID NO: 3016851 - RNA, 15 nt, Mycobacterium avium subsp. paratuberculosis
ggacgcccgcgaggu

SEQ ID NO: 3016852 - RNA, 20 nt, Mycobacterium avium subsp. paratuberculosis
ggacgcccgcgaggugucga

SEQ ID NO: 3016853 - RNA, 16 nt, Mycobacterium avium subsp. paratuberculosis
ggacgcccgucgcgca

SEQ ID NO: 3016854 - RNA, 20 nt, Mycobacterium avium subsp. paratuberculosis
ggacgccgcacgcgaccgcg

SEQ ID NO: 3016855 - RNA, 12 nt, Mycobacterium avium subsp. paratuberculosis
ggacgccggcag

SEQ ID NO: 3016856 - RNA, 13 nt, Mycobacterium avium subsp. paratuberculosis
ggacgccggcagc

SEQ ID NO: 3016857 - RNA, 14 nt, Mycobacterium avium subsp. paratuberculosis
ggacgccggcagcc

SEQ ID NO: 3016858 - RNA, 15 nt, Mycobacterium avium subsp. paratuberculosis
ggacgccgugcagga

SEQ ID NO: 3016859 - RNA, 17 nt, Mycobacterium avium subsp. paratuberculosis
ggacgccguugacaccg

SEQ ID NO: 3016860 - RNA, 14 nt, Mycobacterium avium subsp. paratuberculosis
ggacgccuccccca

SEQ ID NO: 3016861 - RNA, 20 nt, Mycobacterium avium subsp. paratuberculosis
ggacgccucccccacccgca

SEQ ID NO: 3016862 - RNA, 21 nt, Mycobacterium avium subsp. paratuberculosis
ggacgccucccccacccgcac

SEQ ID NO: 3016863 - RNA, 17 nt, Mycobacterium avium subsp. paratuberculosis
ggacgccucgcgcagcg

SEQ ID NO: 3016864 - RNA, 20 nt, Mycobacterium avium subsp. paratuberculosis
ggacgccucgcgcagcgcgu

SEQ ID NO: 3016865 - RNA, 19 nt, Mycobacterium avium subsp. paratuberculosis
ggacgcgaccaggcccagc

SEQ ID NO: 3016866 - RNA, 17 nt, Mycobacterium avium subsp. paratuberculosis
ggacgcgaccggccauc

SEQ ID NO: 3016867 - RNA, 13 nt, Mycobacterium avium subsp. paratuberculosis
ggacgcgauggcg

SEQ ID NO: 3016868 - RNA, 15 nt, Mycobacterium avium subsp. paratuberculosis
ggacgcgauggcgcu

SEQ ID NO: 3016869 - RNA, 20 nt, Mycobacterium avium subsp. paratuberculosis
ggacgcgcacacggccucgc

SEQ ID NO: 3016870 - RNA, 22 nt, Mycobacterium avium subsp. paratuberculosis
ggacgcgcacacggccucgccc

SEQ ID NO: 3016871 - RNA, 18 nt, Mycobacterium avium subsp. paratuberculosis
ggacgcgcagaucgucga

SEQ ID NO: 3016872 - RNA, 13 nt, Mycobacterium avium subsp. paratuberculosis
ggacgcgcccggc

SEQ ID NO: 3016873 - RNA, 21 nt, Mycobacterium avium subsp. paratuberculosis
ggacgcggcaggcgccccagc

SEQ ID NO: 3016874 - RNA, 20 nt, Mycobacterium avium subsp. paratuberculosis
ggacgcggccagcgcccgcg

SEQ ID NO: 3016875 - RNA, 21 nt, Mycobacterium avium subsp. paratuberculosis
ggacgcggccagcgcccgcgc

SEQ ID NO: 3016876 - RNA, 15 nt, Mycobacterium avium subsp. paratuberculosis
ggacgcggccgagcc

SEQ ID NO: 3016877 - RNA, 16 nt, Mycobacterium avium subsp. paratuberculosis
ggacgcggccgagccg

SEQ ID NO: 3016878 - RNA, 16 nt, Mycobacterium avium subsp. paratuberculosis
ggacgcgguccagcuu

SEQ ID NO: 3016879 - RNA, 21 nt, Mycobacterium avium subsp. paratuberculosis
ggacgcggucgccgcccacgc

SEQ ID NO: 3016880 - RNA, 14 nt, Mycobacterium avium subsp. paratuberculosis
ggacgcggugacgg

SEQ ID NO: 3016881 - RNA, 17 nt, Mycobacterium avium subsp. paratuberculosis
ggacgcggugacgguga

SEQ ID NO: 3016882 - RNA, 13 nt, Mycobacterium avium subsp. paratuberculosis
ggacgcgguggug

SEQ ID NO: 3016883 - RNA, 13 nt, Mycobacterium avium subsp. paratuberculosis
ggacgcugaacag

SEQ ID NO: 3016884 - RNA, 22 nt, Mycobacterium avium subsp. paratuberculosis
ggacgcugaucuacgucggcug

SEQ ID NO: 3016885 - RNA, 21 nt, Mycobacterium avium subsp. paratuberculosis
ggacgcugcgguacacguggc

SEQ ID NO: 3016886 - RNA, 13 nt, Mycobacterium avium subsp. paratuberculosis
ggacggaaaucgc

SEQ ID NO: 3016887 - RNA, 13 nt, Mycobacterium avium subsp. paratuberculosis
ggacggaucgagu

SEQ ID NO: 3016888 - RNA, 23 nt, Mycobacterium avium subsp. paratuberculosis
ggacggaucgagucccgcgcggc

SEQ ID NO: 3016889 - RNA, 24 nt, Mycobacterium avium subsp. paratuberculosis
ggacggaucgagucccgcgcggcg

SEQ ID NO: 3016890 - RNA, 12 nt, Mycobacterium avium subsp. paratuberculosis
ggacggccagca

SEQ ID NO: 3016891 - RNA, 15 nt, Mycobacterium avium subsp. paratuberculosis
ggacggccagcaggg

SEQ ID NO: 3016892 - RNA, 18 nt, Mycobacterium avium subsp. paratuberculosis
ggacggccagcccgucgg

SEQ ID NO: 3016893 - RNA, 19 nt, Mycobacterium avium subsp. paratuberculosis
ggacggcccgacgacgccg

SEQ ID NO: 3016894 - RNA, 14 nt, Mycobacterium avium subsp. paratuberculosis
ggacggcgacggca

SEQ ID NO: 3016895 - RNA, 16 nt, Mycobacterium avium subsp. paratuberculosis
ggacggcgacggcagc

SEQ ID NO: 3016896 - RNA, 16 nt, Mycobacterium avium subsp. paratuberculosis
ggacggcgagcggccc

SEQ ID NO: 3016897 - RNA, 18 nt, Mycobacterium avium subsp. paratuberculosis
ggacggcgagcggcccug

SEQ ID NO: 3016898 - RNA, 20 nt, Mycobacterium avium subsp. paratuberculosis
ggacggcgaggaucgcgaug

SEQ ID NO: 3016899 - RNA, 23 nt, Mycobacterium avium subsp. paratuberculosis
ggacggcgaggaucgcgaugucg

SEQ ID NO: 3016900 - RNA, 13 nt, Mycobacterium avium subsp. paratuberculosis
ggacggcgggugg

SEQ ID NO: 3016901 - RNA, 15 nt, Mycobacterium avium subsp. paratuberculosis
ggacgggcauccggc

SEQ ID NO: 3016902 - RNA, 17 nt, Mycobacterium avium subsp. paratuberculosis
ggacgggcgugacaggg

SEQ ID NO: 3016903 - RNA, 16 nt, Mycobacterium avium subsp. paratuberculosis
ggacggggcgaugccg

SEQ ID NO: 3016904 - RNA, 17 nt, Mycobacterium avium subsp. paratuberculosis
ggacgggggccggugcg

SEQ ID NO: 3016905 - RNA, 18 nt, Mycobacterium avium subsp. paratuberculosis
ggacgggggugccgaccg

SEQ ID NO: 3016906 - RNA, 17 nt, Mycobacterium avium subsp. paratuberculosis
ggacgggucggcggcga

SEQ ID NO: 3016907 - RNA, 19 nt, Mycobacterium avium subsp. paratuberculosis
ggacggguugggcgccagc

SEQ ID NO: 3016908 - RNA, 20 nt, Mycobacterium avium subsp. paratuberculosis
ggacggguugggcgccagca

SEQ ID NO: 3016909 - RNA, 23 nt, Mycobacterium avium subsp. paratuberculosis
ggacggguugggcgccagcagca

SEQ ID NO: 3016910 - RNA, 20 nt, Mycobacterium avium subsp. paratuberculosis
ggacgguuucaccgccgucc

SEQ ID NO: 3016911 - RNA, 16 nt, Mycobacterium avium subsp. paratuberculosis
ggacgguuucugccgg

SEQ ID NO: 3016912 - RNA, 18 nt, Mycobacterium avium subsp. paratuberculosis
ggacgguuucugccggcc

SEQ ID NO: 3016913 - RNA, 19 nt, Mycobacterium avium subsp. paratuberculosis
ggacgucaggccggucagc

SEQ ID NO: 3016914 - RNA, 21 nt, Mycobacterium avium subsp. paratuberculosis
ggacgucgacgugggcggcca

SEQ ID NO: 3016915 - RNA, 16 nt, Mycobacterium avium subsp. paratuberculosis
ggacgucggccggcug

SEQ ID NO: 3016916 - RNA, 20 nt, Mycobacterium avium subsp. paratuberculosis
ggacgucggccggcugcagc

SEQ ID NO: 3016917 - RNA, 15 nt, Mycobacterium avium subsp. paratuberculosis
ggacgucgucgcugu

SEQ ID NO: 3016918 - RNA, 21 nt, Mycobacterium avium subsp. paratuberculosis
ggacgucgucgcuguccucga

SEQ ID NO: 3016919 - RNA, 12 nt, Mycobacterium avium subsp. paratuberculosis
ggacgugaucgc

SEQ ID NO: 3016920 - RNA, 14 nt, Mycobacterium avium subsp. paratuberculosis
ggacguggcucagc

SEQ ID NO: 3016921 - RNA, 14 nt, Mycobacterium avium subsp. paratuberculosis
ggacgugguccggu

SEQ ID NO: 3016922 - RNA, 18 nt, Mycobacterium avium subsp. paratuberculosis
ggacgugucgggguggug

SEQ ID NO: 3016923 - RNA, 14 nt, Mycobacterium avium subsp. paratuberculosis
ggacguugaggcgg

SEQ ID NO: 3016924 - RNA, 17 nt, Mycobacterium avium subsp. paratuberculosis
ggacguugaugucgucc

SEQ ID NO: 3016925 - RNA, 18 nt, Mycobacterium avium subsp. paratuberculosis
ggacuauacacgccugga

SEQ ID NO: 3016926 - RNA, 17 nt, Mycobacterium avium subsp. paratuberculosis
ggacucaaucggucagg

SEQ ID NO: 3016927 - RNA, 14 nt, Mycobacterium avium subsp. paratuberculosis
ggacuccaccgcca

SEQ ID NO: 3016928 - RNA, 19 nt, Mycobacterium avium subsp. paratuberculosis
ggacuccaccgccaccgcg

SEQ ID NO: 3016929 - RNA, 13 nt, Mycobacterium avium subsp. paratuberculosis
ggacuccagcacc

SEQ ID NO: 3016930 - RNA, 22 nt, Mycobacterium avium subsp. paratuberculosis
ggacuccagcaccagcacggcg

SEQ ID NO: 3016931 - RNA, 20 nt, Mycobacterium avium subsp. paratuberculosis
ggacuccaguugacggcgca

SEQ ID NO: 3016932 - RNA, 15 nt, Mycobacterium avium subsp. paratuberculosis
ggacucccccaccac

SEQ ID NO: 3016933 - RNA, 17 nt, Mycobacterium avium subsp. paratuberculosis
ggacucccccaccacgu

SEQ ID NO: 3016934 - RNA, 22 nt, Mycobacterium avium subsp. paratuberculosis
ggacucccccaccacguaggcg

SEQ ID NO: 3016935 - RNA, 21 nt, Mycobacterium avium subsp. paratuberculosis
ggacucgaagaucgccugcag

SEQ ID NO: 3016936 - RNA, 16 nt, Mycobacterium avium subsp. paratuberculosis
ggacucgaucgccacc

SEQ ID NO: 3016937 - RNA, 18 nt, Mycobacterium avium subsp. paratuberculosis
ggacucgaucgccaccga

SEQ ID NO: 3016938 - RNA, 20 nt, Mycobacterium avium subsp. paratuberculosis
ggacucgggguugacccggc

SEQ ID NO: 3016939 - RNA, 18 nt, Mycobacterium avium subsp. paratuberculosis
ggacucgucgcugaucgc

SEQ ID NO: 3016940 - RNA, 21 nt, Mycobacterium avium subsp. paratuberculosis
ggacucguuggggccaccaga

SEQ ID NO: 3016941 - RNA, 23 nt, Mycobacterium avium subsp. paratuberculosis
ggacucuucuuccugcuugacgg

SEQ ID NO: 3016942 - RNA, 21 nt, Mycobacterium avium subsp. paratuberculosis
ggacugaaguaguacgaccgc

SEQ ID NO: 3016943 - RNA, 13 nt, Mycobacterium avium subsp. paratuberculosis
ggacugcccgacc

SEQ ID NO: 3016944 - RNA, 14 nt, Mycobacterium avium subsp. paratuberculosis
ggacugcgccgggg

SEQ ID NO: 3016945 - RNA, 16 nt, Mycobacterium avium subsp. paratuberculosis
ggacugcgccggggcc

SEQ ID NO: 3016946 - RNA, 19 nt, Mycobacterium avium subsp. paratuberculosis
ggacugcgccggggccgcg

SEQ ID NO: 3016947 - RNA, 16 nt, Mycobacterium avium subsp. paratuberculosis
ggacuggaccgugccg

SEQ ID NO: 3016948 - RNA, 20 nt, Mycobacterium avium subsp. paratuberculosis
ggacuggcugagcagcaccc

SEQ ID NO: 3016949 - RNA, 13 nt, Mycobacterium avium subsp. paratuberculosis
ggacugggcgauu

SEQ ID NO: 3016950 - RNA, 14 nt, Mycobacterium avium subsp. paratuberculosis
ggacugggcgauug

SEQ ID NO: 3016951 - RNA, 15 nt, Mycobacterium avium subsp. paratuberculosis
ggacugggcgccgcc

SEQ ID NO: 3016952 - RNA, 18 nt, Mycobacterium avium subsp. paratuberculosis
ggacugggcgccgccggc

SEQ ID NO: 3016953 - RNA, 19 nt, Mycobacterium avium subsp. paratuberculosis
ggacuugacgauccccugg

SEQ ID NO: 3016954 - RNA, 15 nt, Mycobacterium avium subsp. paratuberculosis
ggacuugucgccguu

SEQ ID NO: 3016955 - RNA, 17 nt, Mycobacterium avium subsp. paratuberculosis
ggacuugucgccguugu

SEQ ID NO: 3016956 - RNA, 19 nt, Mycobacterium avium subsp. paratuberculosis
ggagaaaccgucggcccgc

SEQ ID NO: 3016957 - RNA, 19 nt, Mycobacterium avium subsp. paratuberculosis
ggagaacauuucgucgaag

SEQ ID NO: 3016958 - RNA, 23 nt, Mycobacterium avium subsp. paratuberculosis
ggagaaccgcucgauggcgccga

SEQ ID NO: 3016959 - RNA, 18 nt, Mycobacterium avium subsp. paratuberculosis
ggagaacgucaggcccag

SEQ ID NO: 3016960 - RNA, 19 nt, Mycobacterium avium subsp. paratuberculosis
ggagaacgucaggcccagc

SEQ ID NO: 3016961 - RNA, 13 nt, Mycobacterium avium subsp. paratuberculosis
ggagaacucgacg

SEQ ID NO: 3016962 - RNA, 14 nt, Mycobacterium avium subsp. paratuberculosis
ggagaacucgaucu

SEQ ID NO: 3016963 - RNA, 23 nt, Mycobacterium avium subsp. paratuberculosis
ggagaacucgaucugcagccggc

SEQ ID NO: 3016964 - RNA, 24 nt, Mycobacterium avium subsp. paratuberculosis
ggagaacucgaucugcagccggcg

SEQ ID NO: 3016965 - RNA, 15 nt, Mycobacterium avium subsp. paratuberculosis
ggagacagccgagau

SEQ ID NO: 3016966 - RNA, 13 nt, Mycobacterium avium subsp. paratuberculosis
ggagaccagcagc

SEQ ID NO: 3016967 - RNA, 17 nt, Mycobacterium avium subsp. paratuberculosis
ggagaccagguccccuu

SEQ ID NO: 3016968 - RNA, 16 nt, Mycobacterium avium subsp. paratuberculosis
ggagaccuccugcugg

SEQ ID NO: 3016969 - RNA, 17 nt, Mycobacterium avium subsp. paratuberculosis
ggagaccucuucgaccc

SEQ ID NO: 3016970 - RNA, 20 nt, Mycobacterium avium subsp. paratuberculosis
ggagaccucuucgacccgca

SEQ ID NO: 3016971 - RNA, 13 nt, Mycobacterium avium subsp. paratuberculosis
ggagacgacgacg

SEQ ID NO: 3016972 - RNA, 15 nt, Mycobacterium avium subsp. paratuberculosis
ggagacgucggccgg

SEQ ID NO: 3016973 - RNA, 16 nt, Mycobacterium avium subsp. paratuberculosis
ggagacguugccgcac

SEQ ID NO: 3016974 - RNA, 13 nt, Mycobacterium avium subsp. paratuberculosis
ggagacugcgacc

SEQ ID NO: 3016975 - RNA, 14 nt, Mycobacterium avium subsp. paratuberculosis
ggagacuuccacuu

SEQ ID NO: 3016976 - RNA, 16 nt, Mycobacterium avium subsp. paratuberculosis
ggagaggcccggcagc

SEQ ID NO: 3016977 - RNA, 20 nt, Mycobacterium avium subsp. paratuberculosis
ggagaggcccggcagccggg

SEQ ID NO: 3016978 - RNA, 19 nt, Mycobacterium avium subsp. paratuberculosis
ggagauacggucgcaccgc

SEQ ID NO: 3016979 - RNA, 20 nt, Mycobacterium avium subsp. paratuberculosis
ggagauacggucgcaccgcg

SEQ ID NO: 3016980 - RNA, 13 nt, Mycobacterium avium subsp. paratuberculosis
ggagaucaccgcg

SEQ ID NO: 3016981 - RNA, 14 nt, Mycobacterium avium subsp. paratuberculosis
ggagaucaccggca

SEQ ID NO: 3016982 - RNA, 20 nt, Mycobacterium avium subsp. paratuberculosis
ggagaucaccggcaccccca

SEQ ID NO: 3016983 - RNA, 14 nt, Mycobacterium avium subsp. paratuberculosis
ggagauccggccgc

SEQ ID NO: 3016984 - RNA, 18 nt, Mycobacterium avium subsp. paratuberculosis
ggagauccggccgcuggu

SEQ ID NO: 3016985 - RNA, 14 nt, Mycobacterium avium subsp. paratuberculosis
ggagaucggcgagu

SEQ ID NO: 3016986 - RNA, 15 nt, Mycobacterium avium subsp. paratuberculosis
ggagaucggcgagug

SEQ ID NO: 3016987 - RNA, 19 nt, Mycobacterium avium subsp. paratuberculosis
ggagaucggcgagugcacc

SEQ ID NO: 3016988 - RNA, 20 nt, Mycobacterium avium subsp. paratuberculosis
ggagaucggcgagugcaccu

SEQ ID NO: 3016989 - RNA, 14 nt, Mycobacterium avium subsp. paratuberculosis
ggagaucgugcugu

SEQ ID NO: 3016990 - RNA, 16 nt, Mycobacterium avium subsp. paratuberculosis
ggagaugauggccgcg

SEQ ID NO: 3016991 - RNA, 20 nt, Mycobacterium avium subsp. paratuberculosis
ggagaugauggccgcgccgc

SEQ ID NO: 3016992 - RNA, 17 nt, Mycobacterium avium subsp. paratuberculosis
ggagaugcgggccaccg

SEQ ID NO: 3016993 - RNA, 22 nt, Mycobacterium avium subsp. paratuberculosis
ggagauggccagcaccaccgcg

SEQ ID NO: 3016994 - RNA, 17 nt, Mycobacterium avium subsp. paratuberculosis
ggagcacagcacggcau

SEQ ID NO: 3016995 - RNA, 22 nt, Mycobacterium avium subsp. paratuberculosis
ggagcagcacgaucgagccggu

SEQ ID NO: 3016996 - RNA, 14 nt, Mycobacterium avium subsp. paratuberculosis
ggagcccagcguga

SEQ ID NO: 3016997 - RNA, 20 nt, Mycobacterium avium subsp. paratuberculosis
ggagcccagcuuggcgcccu

SEQ ID NO: 3016998 - RNA, 16 nt, Mycobacterium avium subsp. paratuberculosis
ggagccgaccucggcg

SEQ ID NO: 3016999 - RNA, 21 nt, Mycobacterium avium subsp. paratuberculosis
ggagccgacgaagaucccgcu

SEQ ID NO: 3017000 - RNA, 12 nt, Mycobacterium avium subsp. paratuberculosis
ggagccgagcac

SEQ ID NO: 3017001 - RNA, 23 nt, Mycobacterium avium subsp. paratuberculosis
ggagccgagcaccaggcgcacca

SEQ ID NO: 3017002 - RNA, 15 nt, Mycobacterium avium subsp. paratuberculosis
ggagccgagcaccgg

SEQ ID NO: 3017003 - RNA, 12 nt, Mycobacterium avium subsp. paratuberculosis
ggagccggccag

SEQ ID NO: 3017004 - RNA, 13 nt, Mycobacterium avium subsp. paratuberculosis
ggagccggccagg

SEQ ID NO: 3017005 - RNA, 19 nt, Mycobacterium avium subsp. paratuberculosis
ggagccggccgccgaagcc

SEQ ID NO: 3017006 - RNA, 20 nt, Mycobacterium avium subsp. paratuberculosis
ggagccggccgccgaagccg

SEQ ID NO: 3017007 - RNA, 21 nt, Mycobacterium avium subsp. paratuberculosis
ggagccggccucgccggcgcc

SEQ ID NO: 3017008 - RNA, 13 nt, Mycobacterium avium subsp. paratuberculosis
ggagccguccggg

SEQ ID NO: 3017009 - RNA, 22 nt, Mycobacterium avium subsp. paratuberculosis
ggagccguccggguucgacgcc

SEQ ID NO: 3017010 - RNA, 17 nt, Mycobacterium avium subsp. paratuberculosis
ggagccgucggugucca

SEQ ID NO: 3017011 - RNA, 13 nt, Mycobacterium avium subsp. paratuberculosis
ggagccgugcagc

SEQ ID NO: 3017012 - RNA, 14 nt, Mycobacterium avium subsp. paratuberculosis
ggagccgugcagcg

SEQ ID NO: 3017013 - RNA, 15 nt, Mycobacterium avium subsp. paratuberculosis
ggagccgugcagcgc

SEQ ID NO: 3017014 - RNA, 22 nt, Mycobacterium avium subsp. paratuberculosis
ggagccuucuucgccgcagccu

SEQ ID NO: 3017015 - RNA, 17 nt, Mycobacterium avium subsp. paratuberculosis
ggagccuucuugaccgc

SEQ ID NO: 3017016 - RNA, 19 nt, Mycobacterium avium subsp. paratuberculosis
ggagccuucuugaccgcag

SEQ ID NO: 3017017 - RNA, 21 nt, Mycobacterium avium subsp. paratuberculosis
ggagccuucuugaccgcagcc

SEQ ID NO: 3017018 - RNA, 22 nt, Mycobacterium avium subsp. paratuberculosis
ggagccuucuugaccgcagccu

SEQ ID NO: 3017019 - RNA, 17 nt, Mycobacterium avium subsp. paratuberculosis
ggagccuugcuggcggc

SEQ ID NO: 3017020 - RNA, 19 nt, Mycobacterium avium subsp. paratuberculosis
ggagccuugcuggcggccu

SEQ ID NO: 3017021 - RNA, 23 nt, Mycobacterium avium subsp. paratuberculosis
ggagccuugcuggcggccuucuu

SEQ ID NO: 3017022 - RNA, 18 nt, Mycobacterium avium subsp. paratuberculosis
ggagccuuggucgcggcc

SEQ ID NO: 3017023 - RNA, 23 nt, Mycobacterium avium subsp. paratuberculosis
ggagcgcaacguguacucggcgu

SEQ ID NO: 3017024 - RNA, 12 nt, Mycobacterium avium subsp. paratuberculosis
ggagcgcccggc

SEQ ID NO: 3017025 - RNA, 13 nt, Mycobacterium avium subsp. paratuberculosis
ggagcgcccggcc

SEQ ID NO: 3017026 - RNA, 16 nt, Mycobacterium avium subsp. paratuberculosis
ggagcgcccggccagc

SEQ ID NO: 3017027 - RNA, 11 nt, Mycobacterium avium subsp. paratuberculosis
ggagcgcggca

SEQ ID NO: 3017028 - RNA, 13 nt, Mycobacterium avium subsp. paratuberculosis
ggagcgcggcaug

SEQ ID NO: 3017029 - RNA, 14 nt, Mycobacterium avium subsp. paratuberculosis
ggagcgcuccacca

SEQ ID NO: 3017030 - RNA, 13 nt, Mycobacterium avium subsp. paratuberculosis
ggagcgcuggucg

SEQ ID NO: 3017031 - RNA, 15 nt, Mycobacterium avium subsp. paratuberculosis
ggagcgcuggucggc

SEQ ID NO: 3017032 - RNA, 17 nt, Mycobacterium avium subsp. paratuberculosis
ggagcgcuggucggcga

SEQ ID NO: 3017033 - RNA, 15 nt, Mycobacterium avium subsp. paratuberculosis
ggagcggaucccggu

SEQ ID NO: 3017034 - RNA, 14 nt, Mycobacterium avium subsp. paratuberculosis
ggagcggcccagcu

SEQ ID NO: 3017035 - RNA, 11 nt, Mycobacterium avium subsp. paratuberculosis
ggagcggcggu

SEQ ID NO: 3017036 - RNA, 23 nt, Mycobacterium avium subsp. paratuberculosis
ggagcgggccacgcagucgucga

SEQ ID NO: 3017037 - RNA, 13 nt, Mycobacterium avium subsp. paratuberculosis
ggagcggugcggc

SEQ ID NO: 3017038 - RNA, 15 nt, Mycobacterium avium subsp. paratuberculosis
ggagcggugcggcuc

SEQ ID NO: 3017039 - RNA, 16 nt, Mycobacterium avium subsp. paratuberculosis
ggagcggugcggcucg

SEQ ID NO: 3017040 - RNA, 19 nt, Mycobacterium avium subsp. paratuberculosis
ggagcggugcggcucgggc

SEQ ID NO: 3017041 - RNA, 14 nt, Mycobacterium avium subsp. paratuberculosis
ggagcgucgcgaug

SEQ ID NO: 3017042 - RNA, 15 nt, Mycobacterium avium subsp. paratuberculosis
ggagcgucgcgauga

SEQ ID NO: 3017043 - RNA, 20 nt, Mycobacterium avium subsp. paratuberculosis
ggagcguucuccacccgccc

SEQ ID NO: 3017044 - RNA, 19 nt, Mycobacterium avium subsp. paratuberculosis
ggagcuaggcggccgggcg

SEQ ID NO: 3017045 - RNA, 22 nt, Mycobacterium avium subsp. paratuberculosis
ggagcugaaguucaccaccgcg

SEQ ID NO: 3017046 - RNA, 13 nt, Mycobacterium avium subsp. paratuberculosis
ggagcugccggcg

SEQ ID NO: 3017047 - RNA, 16 nt, Mycobacterium avium subsp. paratuberculosis
ggagcugccggcgacc

SEQ ID NO: 3017048 - RNA, 19 nt, Mycobacterium avium subsp. paratuberculosis
ggagcugccggcgaccagc

SEQ ID NO: 3017049 - RNA, 19 nt, Mycobacterium avium subsp. paratuberculosis
ggagcugcgcgccccggcc

SEQ ID NO: 3017050 - RNA, 22 nt, Mycobacterium avium subsp. paratuberculosis
ggagcuucgaauccuguuggua

SEQ ID NO: 3017051 - RNA, 17 nt, Mycobacterium avium subsp. paratuberculosis
ggaggaauucgccgacg

SEQ ID NO: 3017052 - RNA, 17 nt, Mycobacterium avium subsp. paratuberculosis
ggaggacaacgcgucga

SEQ ID NO: 3017053 - RNA, 18 nt, Mycobacterium avium subsp. paratuberculosis
ggaggacaagucaugccg

SEQ ID NO: 3017054 - RNA, 19 nt, Mycobacterium avium subsp. paratuberculosis
ggaggacaagucaugccgc

SEQ ID NO: 3017055 - RNA, 21 nt, Mycobacterium avium subsp. paratuberculosis
ggaggacaagucaugccgcgc

SEQ ID NO: 3017056 - RNA, 17 nt, Mycobacterium avium subsp. paratuberculosis
ggaggacagcaccgcca

SEQ ID NO: 3017057 - RNA, 14 nt, Mycobacterium avium subsp. paratuberculosis
ggaggacagcgcgg

SEQ ID NO: 3017058 - RNA, 15 nt, Mycobacterium avium subsp. paratuberculosis
ggaggacagcgcggu

SEQ ID NO: 3017059 - RNA, 21 nt, Mycobacterium avium subsp. paratuberculosis
ggaggacagggaggacagcac

SEQ ID NO: 3017060 - RNA, 15 nt, Mycobacterium avium subsp. paratuberculosis
ggaggaugccggcca

SEQ ID NO: 3017061 - RNA, 15 nt, Mycobacterium avium subsp. paratuberculosis
ggaggccaccgcgcc

SEQ ID NO: 3017062 - RNA, 14 nt, Mycobacterium avium subsp. paratuberculosis
ggaggccagcaccu

SEQ ID NO: 3017063 - RNA, 20 nt, Mycobacterium avium subsp. paratuberculosis
ggaggccagcugcaccgggg

SEQ ID NO: 3017064 - RNA, 23 nt, Mycobacterium avium subsp. paratuberculosis
ggaggccagcugcaccggggccg

SEQ ID NO: 3017065 - RNA, 17 nt, Mycobacterium avium subsp. paratuberculosis
ggaggcccagcccgccg

SEQ ID NO: 3017066 - RNA, 12 nt, Mycobacterium avium subsp. paratuberculosis
ggaggccgcggc

SEQ ID NO: 3017067 - RNA, 14 nt, Mycobacterium avium subsp. paratuberculosis
ggaggccgcggcga

SEQ ID NO: 3017068 - RNA, 16 nt, Mycobacterium avium subsp. paratuberculosis
ggaggccgcggcgaca

SEQ ID NO: 3017069 - RNA, 13 nt, Mycobacterium avium subsp. paratuberculosis
ggaggccgcgggu

SEQ ID NO: 3017070 - RNA, 16 nt, Mycobacterium avium subsp. paratuberculosis
ggaggccuccaggcug

SEQ ID NO: 3017071 - RNA, 17 nt, Mycobacterium avium subsp. paratuberculosis
ggaggccugcgcggccg

SEQ ID NO: 3017072 - RNA, 22 nt, Mycobacterium avium subsp. paratuberculosis
ggaggccuucuuucguucgaug

SEQ ID NO: 3017073 - RNA, 14 nt, Mycobacterium avium subsp. paratuberculosis
ggaggcgagcagcc

SEQ ID NO: 3017074 - RNA, 19 nt, Mycobacterium avium subsp. paratuberculosis
ggaggcgagcagccgggug

SEQ ID NO: 3017075 - RNA, 15 nt, Mycobacterium avium subsp. paratuberculosis
ggaggcgaucaggug

SEQ ID NO: 3017076 - RNA, 19 nt, Mycobacterium avium subsp. paratuberculosis
ggaggcggcgggggcgggc

SEQ ID NO: 3017077 - RNA, 18 nt, Mycobacterium avium subsp. paratuberculosis
ggaggcguagugcgccca

SEQ ID NO: 3017078 - RNA, 20 nt, Mycobacterium avium subsp. paratuberculosis
ggaggcguagugcgcccaga

SEQ ID NO: 3017079 - RNA, 14 nt, Mycobacterium avium subsp. paratuberculosis
ggaggcgucgacgc

SEQ ID NO: 3017080 - RNA, 16 nt, Mycobacterium avium subsp. paratuberculosis
ggaggcgucgacgcgc

SEQ ID NO: 3017081 - RNA, 20 nt, Mycobacterium avium subsp. paratuberculosis
ggaggcguugcgucccgcgc

SEQ ID NO: 3017082 - RNA, 21 nt, Mycobacterium avium subsp. paratuberculosis
ggaggcguugcgucccgcgcc

SEQ ID NO: 3017083 - RNA, 19 nt, Mycobacterium avium subsp. paratuberculosis
ggaggcuucgcucaucccu

SEQ ID NO: 3017084 - RNA, 16 nt, Mycobacterium avium subsp. paratuberculosis
ggaggggucggugcgg

SEQ ID NO: 3017085 - RNA, 20 nt, Mycobacterium avium subsp. paratuberculosis
ggaggguauucgugugcuag

SEQ ID NO: 3017086 - RNA, 15 nt, Mycobacterium avium subsp. paratuberculosis
ggagggugucggcgg

SEQ ID NO: 3017087 - RNA, 17 nt, Mycobacterium avium subsp. paratuberculosis
ggaggguuuucggggcg

SEQ ID NO: 3017088 - RNA, 22 nt, Mycobacterium avium subsp. paratuberculosis
ggaggucagcagggugacgucg

SEQ ID NO: 3017089 - RNA, 13 nt, Mycobacterium avium subsp. paratuberculosis
ggaggucagcggc

SEQ ID NO: 3017090 - RNA, 21 nt, Mycobacterium avium subsp. paratuberculosis
ggaggucagcggcccgaucac

SEQ ID NO: 3017091 - RNA, 20 nt, Mycobacterium avium subsp. paratuberculosis
ggaggucauggcgaccgcga

SEQ ID NO: 3017092 - RNA, 15 nt, Mycobacterium avium subsp. paratuberculosis
ggaggugaucgccag

SEQ ID NO: 3017093 - RNA, 13 nt, Mycobacterium avium subsp. paratuberculosis
ggaggugccgcgc

SEQ ID NO: 3017094 - RNA, 14 nt, Mycobacterium avium subsp. paratuberculosis
ggaggugccgcgca

SEQ ID NO: 3017095 - RNA, 16 nt, Mycobacterium avium subsp. paratuberculosis
ggaggugccgcgcggc

SEQ ID NO: 3017096 - RNA, 15 nt, Mycobacterium avium subsp. paratuberculosis
ggagguugauggcca

SEQ ID NO: 3017097 - RNA, 20 nt, Mycobacterium avium subsp. paratuberculosis
ggaguagaccuuguccggcg

SEQ ID NO: 3017098 - RNA, 15 nt, Mycobacterium avium subsp. paratuberculosis
ggaguagccgguucg

SEQ ID NO: 3017099 - RNA, 15 nt, Mycobacterium avium subsp. paratuberculosis
ggaguaggcgccgcc

SEQ ID NO: 3017100 - RNA, 23 nt, Mycobacterium avium subsp. paratuberculosis
ggaguagucggcgaucagcuccu

SEQ ID NO: 3017101 - RNA, 17 nt, Mycobacterium avium subsp. paratuberculosis
ggaguaguuccggcggu

SEQ ID NO: 3017102 - RNA, 16 nt, Mycobacterium avium subsp. paratuberculosis
ggaguccaccggcgga

SEQ ID NO: 3017103 - RNA, 23 nt, Mycobacterium avium subsp. paratuberculosis
ggaguccaccggcggauucucgc

SEQ ID NO: 3017104 - RNA, 18 nt, Mycobacterium avium subsp. paratuberculosis
ggaguccggcucggugcc

SEQ ID NO: 3017105 - RNA, 14 nt, Mycobacterium avium subsp. paratuberculosis
ggagucgucggcgc

SEQ ID NO: 3017106 - RNA, 16 nt, Mycobacterium avium subsp. paratuberculosis
ggagugacgucgcgcg

SEQ ID NO: 3017107 - RNA, 16 nt, Mycobacterium avium subsp. paratuberculosis
ggagugcggcccaccc

SEQ ID NO: 3017108 - RNA, 13 nt, Mycobacterium avium subsp. paratuberculosis
ggaguggccggcg

SEQ ID NO: 3017109 - RNA, 13 nt, Mycobacterium avium subsp. paratuberculosis
ggaguggucaggc

SEQ ID NO: 3017110 - RNA, 17 nt, Mycobacterium avium subsp. paratuberculosis
ggaguucgcccgcagca

SEQ ID NO: 3017111 - RNA, 14 nt, Mycobacterium avium subsp. paratuberculosis
ggaguugucgguga

SEQ ID NO: 3017112 - RNA, 15 nt, Mycobacterium avium subsp. paratuberculosis
ggauacccgcggccu

SEQ ID NO: 3017113 - RNA, 16 nt, Mycobacterium avium subsp. paratuberculosis
ggauacgcccggccac

SEQ ID NO: 3017114 - RNA, 17 nt, Mycobacterium avium subsp. paratuberculosis
ggauagagcaccgcgcu

SEQ ID NO: 3017115 - RNA, 15 nt, Mycobacterium avium subsp. paratuberculosis
ggauagaggcggcgc

SEQ ID NO: 3017116 - RNA, 18 nt, Mycobacterium avium subsp. paratuberculosis
ggauagccgagcggcgcc

SEQ ID NO: 3017117 - RNA, 20 nt, Mycobacterium avium subsp. paratuberculosis
ggauauccagccuugcagcc

SEQ ID NO: 3017118 - RNA, 21 nt, Mycobacterium avium subsp. paratuberculosis
ggauaucccgcgggucgcggc

SEQ ID NO: 3017119 - RNA, 16 nt, Mycobacterium avium subsp. paratuberculosis
ggauauuucgcggccg

SEQ ID NO: 3017120 - RNA, 15 nt, Mycobacterium avium subsp. paratuberculosis
ggaucacacgcgcgc

SEQ ID NO: 3017121 - RNA, 20 nt, Mycobacterium avium subsp. paratuberculosis
ggaucaccaucacgucgcgc

SEQ ID NO: 3017122 - RNA, 23 nt, Mycobacterium avium subsp. paratuberculosis
ggaucaccaucacgucgcgcuug

SEQ ID NO: 3017123 - RNA, 15 nt, Mycobacterium avium subsp. paratuberculosis
ggaucacccucggcg

SEQ ID NO: 3017124 - RNA, 21 nt, Mycobacterium avium subsp. paratuberculosis
ggaucaccucaucgcccagcc

SEQ ID NO: 3017125 - RNA, 13 nt, Mycobacterium avium subsp. paratuberculosis
ggaucaccucgcu

SEQ ID NO: 3017126 - RNA, 21 nt, Mycobacterium avium subsp. paratuberculosis
ggaucaccucgcugacgucga

SEQ ID NO: 3017127 - RNA, 13 nt, Mycobacterium avium subsp. paratuberculosis
ggaucacgucggc

SEQ ID NO: 3017128 - RNA, 14 nt, Mycobacterium avium subsp. paratuberculosis
ggaucacgucggcg

SEQ ID NO: 3017129 - RNA, 14 nt, Mycobacterium avium subsp. paratuberculosis
ggaucagacccagc

SEQ ID NO: 3017130 - RNA, 23 nt, Mycobacterium avium subsp. paratuberculosis
ggaucagacccagcgucaggaug

SEQ ID NO: 3017131 - RNA, 17 nt, Mycobacterium avium subsp. paratuberculosis
ggaucagcaccgacgcg

SEQ ID NO: 3017132 - RNA, 22 nt, Mycobacterium avium subsp. paratuberculosis
ggaucagcaccgacgcggcgac

SEQ ID NO: 3017133 - RNA, 23 nt, Mycobacterium avium subsp. paratuberculosis
ggaucagcaccgacgcggcgacc

SEQ ID NO: 3017134 - RNA, 12 nt, Mycobacterium avium subsp. paratuberculosis
ggaucagcagca

SEQ ID NO: 3017135 - RNA, 18 nt, Mycobacterium avium subsp. paratuberculosis
ggaucagcagcaccggcg

SEQ ID NO: 3017136 - RNA, 13 nt, Mycobacterium avium subsp. paratuberculosis
ggaucagcgucgc

SEQ ID NO: 3017137 - RNA, 15 nt, Mycobacterium avium subsp. paratuberculosis
ggaucagcgucgcga

SEQ ID NO: 3017138 - RNA, 18 nt, Mycobacterium avium subsp. paratuberculosis
ggaucagcguuccggcgg

SEQ ID NO: 3017139 - RNA, 20 nt, Mycobacterium avium subsp. paratuberculosis
ggaucagcguuccggcggcc

SEQ ID NO: 3017140 - RNA, 13 nt, Mycobacterium avium subsp. paratuberculosis
ggaucagcuccuc

SEQ ID NO: 3017141 - RNA, 17 nt, Mycobacterium avium subsp. paratuberculosis
ggaucagcuccucgcgg

SEQ ID NO: 3017142 - RNA, 22 nt, Mycobacterium avium subsp. paratuberculosis
ggaucaggucggucaccgagcu

SEQ ID NO: 3017143 - RNA, 16 nt, Mycobacterium avium subsp. paratuberculosis
ggaucaucccgaccag

SEQ ID NO: 3017144 - RNA, 23 nt, Mycobacterium avium subsp. paratuberculosis
ggaucaugucgguaaggcaggca

SEQ ID NO: 3017145 - RNA, 14 nt, Mycobacterium avium subsp. paratuberculosis
ggaucaugucguug

SEQ ID NO: 3017146 - RNA, 15 nt, Mycobacterium avium subsp. paratuberculosis
ggaucaugucguuga

SEQ ID NO: 3017147 - RNA, 16 nt, Mycobacterium avium subsp. paratuberculosis
ggauccagcggcggcc

SEQ ID NO: 3017148 - RNA, 19 nt, Mycobacterium avium subsp. paratuberculosis
ggauccaggaacggcaccc

SEQ ID NO: 3017149 - RNA, 22 nt, Mycobacterium avium subsp. paratuberculosis
ggaucccagaauucgccggggc

SEQ ID NO: 3017150 - RNA, 16 nt, Mycobacterium avium subsp. paratuberculosis
ggauccccgcgcuggg

SEQ ID NO: 3017151 - RNA, 17 nt, Mycobacterium avium subsp. paratuberculosis
ggauccccgcgcugggc

SEQ ID NO: 3017152 - RNA, 14 nt, Mycobacterium avium subsp. paratuberculosis
ggauccccguccag

SEQ ID NO: 3017153 - RNA, 17 nt, Mycobacterium avium subsp. paratuberculosis
ggauccccguccagccc

SEQ ID NO: 3017154 - RNA, 18 nt, Mycobacterium avium subsp. paratuberculosis
ggauccccguccagccca

SEQ ID NO: 3017155 - RNA, 21 nt, Mycobacterium avium subsp. paratuberculosis
ggaucccgaaaccgucgacca

SEQ ID NO: 3017156 - RNA, 16 nt, Mycobacterium avium subsp. paratuberculosis
ggaucccgcagccgcg

SEQ ID NO: 3017157 - RNA, 20 nt, Mycobacterium avium subsp. paratuberculosis
ggaucccgcagccgcgacgg

SEQ ID NO: 3017158 - RNA, 15 nt, Mycobacterium avium subsp. paratuberculosis
ggaucccggggcgcg

SEQ ID NO: 3017159 - RNA, 14 nt, Mycobacterium avium subsp. paratuberculosis
ggaucccggugagc

SEQ ID NO: 3017160 - RNA, 21 nt, Mycobacterium avium subsp. paratuberculosis
ggauccgaggguucgguggcc

SEQ ID NO: 3017161 - RNA, 17 nt, Mycobacterium avium subsp. paratuberculosis
ggauccgaucagcagca

SEQ ID NO: 3017162 - RNA, 20 nt, Mycobacterium avium subsp. paratuberculosis
ggauccgaugacgcugccgc

SEQ ID NO: 3017163 - RNA, 12 nt, Mycobacterium avium subsp. paratuberculosis
ggauccgcaccg

SEQ ID NO: 3017164 - RNA, 14 nt, Mycobacterium avium subsp. paratuberculosis
ggauccgcaccggg

SEQ ID NO: 3017165 - RNA, 22 nt, Mycobacterium avium subsp. paratuberculosis
ggauccgcagcugaucggggcc

SEQ ID NO: 3017166 - RNA, 15 nt, Mycobacterium avium subsp. paratuberculosis
ggauccgcccgccgg

SEQ ID NO: 3017167 - RNA, 17 nt, Mycobacterium avium subsp. paratuberculosis
ggauccgcccgccggug

SEQ ID NO: 3017168 - RNA, 18 nt, Mycobacterium avium subsp. paratuberculosis
ggauccgcccgccggugg

SEQ ID NO: 3017169 - RNA, 21 nt, Mycobacterium avium subsp. paratuberculosis
ggauccggauugccgggcagc

SEQ ID NO: 3017170 - RNA, 14 nt, Mycobacterium avium subsp. paratuberculosis
ggauccgggccggc

SEQ ID NO: 3017171 - RNA, 15 nt, Mycobacterium avium subsp. paratuberculosis
ggauccgggccggcg

SEQ ID NO: 3017172 - RNA, 19 nt, Mycobacterium avium subsp. paratuberculosis
ggauccgggccggcgucgc

SEQ ID NO: 3017173 - RNA, 17 nt, Mycobacterium avium subsp. paratuberculosis
ggauccggugaccgcga

SEQ ID NO: 3017174 - RNA, 16 nt, Mycobacterium avium subsp. paratuberculosis
ggauccucgccgcggg

SEQ ID NO: 3017175 - RNA, 19 nt, Mycobacterium avium subsp. paratuberculosis
ggauccucgccgcgggcca

SEQ ID NO: 3017176 - RNA, 20 nt, Mycobacterium avium subsp. paratuberculosis
ggauccucgccgcgggccag

SEQ ID NO: 3017177 - RNA, 14 nt, Mycobacterium avium subsp. paratuberculosis
ggaucgaauccggc

SEQ ID NO: 3017178 - RNA, 16 nt, Mycobacterium avium subsp. paratuberculosis
ggaucgaauccggcgg

SEQ ID NO: 3017179 - RNA, 20 nt, Mycobacterium avium subsp. paratuberculosis
ggaucgaauccggcggcgcu

SEQ ID NO: 3017180 - RNA, 23 nt, Mycobacterium avium subsp. paratuberculosis
ggaucgacagguucuuggcggcc

SEQ ID NO: 3017181 - RNA, 21 nt, Mycobacterium avium subsp. paratuberculosis
ggaucgaccaacuccaccgcc

SEQ ID NO: 3017182 - RNA, 18 nt, Mycobacterium avium subsp. paratuberculosis
ggaucgagcacccggcgg

SEQ ID NO: 3017183 - RNA, 19 nt, Mycobacterium avium subsp. paratuberculosis
ggaucgagcacccggcggg

SEQ ID NO: 3017184 - RNA, 15 nt, Mycobacterium avium subsp. paratuberculosis
ggaucgagccggccg

SEQ ID NO: 3017185 - RNA, 16 nt, Mycobacterium avium subsp. paratuberculosis
ggaucgagcgcaccgc

SEQ ID NO: 3017186 - RNA, 17 nt, Mycobacterium avium subsp. paratuberculosis
ggaucgagucccgcgcg

SEQ ID NO: 3017187 - RNA, 23 nt, Mycobacterium avium subsp. paratuberculosis
ggaucgaguucagcgucgaugug

SEQ ID NO: 3017188 - RNA, 22 nt, Mycobacterium avium subsp. paratuberculosis
ggaucgcaggauggccugcacg

SEQ ID NO: 3017189 - RNA, 13 nt, Mycobacterium avium subsp. paratuberculosis
ggaucgccaggcg

SEQ ID NO: 3017190 - RNA, 21 nt, Mycobacterium avium subsp. paratuberculosis
ggaucgcccauuugccggugu

SEQ ID NO: 3017191 - RNA, 20 nt, Mycobacterium avium subsp. paratuberculosis
ggaucgccgagguagccgcg

SEQ ID NO: 3017192 - RNA, 21 nt, Mycobacterium avium subsp. paratuberculosis
ggaucgccgagguagccgcgc

SEQ ID NO: 3017193 - RNA, 22 nt, Mycobacterium avium subsp. paratuberculosis
ggaucgccgagguagccgcgca

SEQ ID NO: 3017194 - RNA, 23 nt, Mycobacterium avium subsp. paratuberculosis
ggaucgccgagguagccgcgcac

SEQ ID NO: 3017195 - RNA, 14 nt, Mycobacterium avium subsp. paratuberculosis
ggaucgccggacag

SEQ ID NO: 3017196 - RNA, 18 nt, Mycobacterium avium subsp. paratuberculosis
ggaucgcgaugucgacgg

SEQ ID NO: 3017197 - RNA, 12 nt, Mycobacterium avium subsp. paratuberculosis
ggaucgcgcagc

SEQ ID NO: 3017198 - RNA, 20 nt, Mycobacterium avium subsp. paratuberculosis
ggaucgcgcagccgcggugg

SEQ ID NO: 3017199 - RNA, 15 nt, Mycobacterium avium subsp. paratuberculosis
ggaucgcgcagguga

SEQ ID NO: 3017200 - RNA, 22 nt, Mycobacterium avium subsp. paratuberculosis
ggaucgcgcugaccaggccguc

SEQ ID NO: 3017201 - RNA, 22 nt, Mycobacterium avium subsp. paratuberculosis
ggaucgcggccacgcccuggcc

SEQ ID NO: 3017202 - RNA, 17 nt, Mycobacterium avium subsp. paratuberculosis
ggaucgcggcggucagg

SEQ ID NO: 3017203 - RNA, 19 nt, Mycobacterium avium subsp. paratuberculosis
ggaucgcuucggccagcgc

SEQ ID NO: 3017204 - RNA, 18 nt, Mycobacterium avium subsp. paratuberculosis
ggaucggcagcgcguuga

SEQ ID NO: 3017205 - RNA, 18 nt, Mycobacterium avium subsp. paratuberculosis
ggaucggccagcaggucg

SEQ ID NO: 3017206 - RNA, 16 nt, Mycobacterium avium subsp. paratuberculosis
ggaucggccgcgucgg

SEQ ID NO: 3017207 - RNA, 12 nt, Mycobacterium avium subsp. paratuberculosis
ggaucggccggc

SEQ ID NO: 3017208 - RNA, 15 nt, Mycobacterium avium subsp. paratuberculosis
ggaucggccggcgag

SEQ ID NO: 3017209 - RNA, 13 nt, Mycobacterium avium subsp. paratuberculosis
ggaucggcgccca

SEQ ID NO: 3017210 - RNA, 19 nt, Mycobacterium avium subsp. paratuberculosis
ggaucggcgcgucggcguc

SEQ ID NO: 3017211 - RNA, 14 nt, Mycobacterium avium subsp. paratuberculosis
ggaucggcggcggg

SEQ ID NO: 3017212 - RNA, 14 nt, Mycobacterium avium subsp. paratuberculosis
ggaucggcggggcg

SEQ ID NO: 3017213 - RNA, 16 nt, Mycobacterium avium subsp. paratuberculosis
ggaucggcggggcgcg

SEQ ID NO: 3017214 - RNA, 19 nt, Mycobacterium avium subsp. paratuberculosis
ggaucggcugcgggccagc

SEQ ID NO: 3017215 - RNA, 13 nt, Mycobacterium avium subsp. paratuberculosis
ggaucgggaaguc

SEQ ID NO: 3017216 - RNA, 21 nt, Mycobacterium avium subsp. paratuberculosis
ggaucgggaccgggaagccga

SEQ ID NO: 3017217 - RNA, 15 nt, Mycobacterium avium subsp. paratuberculosis
ggaucgggcguggcg

SEQ ID NO: 3017218 - RNA, 20 nt, Mycobacterium avium subsp. paratuberculosis
ggaucggggcgaccuggacg

SEQ ID NO: 3017219 - RNA, 13 nt, Mycobacterium avium subsp. paratuberculosis
ggaucggugaagc

SEQ ID NO: 3017220 - RNA, 16 nt, Mycobacterium avium subsp. paratuberculosis
ggaucggugcaggccg

SEQ ID NO: 3017221 - RNA, 13 nt, Mycobacterium avium subsp. paratuberculosis
ggaucggugcgcg

SEQ ID NO: 3017222 - RNA, 16 nt, Mycobacterium avium subsp. paratuberculosis
ggaucggugcgcggcg

SEQ ID NO: 3017223 - RNA, 13 nt, Mycobacterium avium subsp. paratuberculosis
ggaucgguuucuc

SEQ ID NO: 3017224 - RNA, 20 nt, Mycobacterium avium subsp. paratuberculosis
ggaucgguuucuccaccccc

SEQ ID NO: 3017225 - RNA, 13 nt, Mycobacterium avium subsp. paratuberculosis
ggaucgucgccgg

SEQ ID NO: 3017226 - RNA, 16 nt, Mycobacterium avium subsp. paratuberculosis
ggaucgucuugcggcc

SEQ ID NO: 3017227 - RNA, 12 nt, Mycobacterium avium subsp. paratuberculosis
ggaucgugucga

SEQ ID NO: 3017228 - RNA, 15 nt, Mycobacterium avium subsp. paratuberculosis
ggaucgugucuggcc

SEQ ID NO: 3017229 - RNA, 14 nt, Mycobacterium avium subsp. paratuberculosis
ggaucuccagcagc

SEQ ID NO: 3017230 - RNA, 13 nt, Mycobacterium avium subsp. paratuberculosis
ggaucuccggccg

SEQ ID NO: 3017231 - RNA, 14 nt, Mycobacterium avium subsp. paratuberculosis
ggaucuccggccgg

SEQ ID NO: 3017232 - RNA, 20 nt, Mycobacterium avium subsp. paratuberculosis
ggaucucgcgggcccgcgcg

SEQ ID NO: 3017233 - RNA, 17 nt, Mycobacterium avium subsp. paratuberculosis
ggaucucggugccggug

SEQ ID NO: 3017234 - RNA, 20 nt, Mycobacterium avium subsp. paratuberculosis
ggaucucggugccggugaug

SEQ ID NO: 3017235 - RNA, 19 nt, Mycobacterium avium subsp. paratuberculosis
ggaucugcacgucggcggc

SEQ ID NO: 3017236 - RNA, 23 nt, Mycobacterium avium subsp. paratuberculosis
ggaucugcacgucggcggccgcg

SEQ ID NO: 3017237 - RNA, 16 nt, Mycobacterium avium subsp. paratuberculosis
ggaucugcgcaagaag

SEQ ID NO: 3017238 - RNA, 15 nt, Mycobacterium avium subsp. paratuberculosis
ggaucugcucggcgu

SEQ ID NO: 3017239 - RNA, 14 nt, Mycobacterium avium subsp. paratuberculosis
ggaucugggcggcg

SEQ ID NO: 3017240 - RNA, 13 nt, Mycobacterium avium subsp. paratuberculosis
ggaucuggugcgc

SEQ ID NO: 3017241 - RNA, 17 nt, Mycobacterium avium subsp. paratuberculosis
ggaucuucucgcugcuc

SEQ ID NO: 3017242 - RNA, 15 nt, Mycobacterium avium subsp. paratuberculosis
ggaucuugacggcga

SEQ ID NO: 3017243 - RNA, 18 nt, Mycobacterium avium subsp. paratuberculosis
ggaucuugacggcgacgg

SEQ ID NO: 3017244 - RNA, 24 nt, Mycobacterium avium subsp. paratuberculosis
ggaucuugguguccagcggcucgg

SEQ ID NO: 3017245 - RNA, 18 nt, Mycobacterium avium subsp. paratuberculosis
ggaucuugucggcggccu

SEQ ID NO: 3017246 - RNA, 16 nt, Mycobacterium avium subsp. paratuberculosis
ggaugaacucgugcgg

SEQ ID NO: 3017247 - RNA, 17 nt, Mycobacterium avium subsp. paratuberculosis
ggaugaagugacuggcg

SEQ ID NO: 3017248 - RNA, 21 nt, Mycobacterium avium subsp. paratuberculosis
ggaugacaccgcggaccaccg

SEQ ID NO: 3017249 - RNA, 16 nt, Mycobacterium avium subsp. paratuberculosis
ggaugaccaggucgcc

SEQ ID NO: 3017250 - RNA, 15 nt, Mycobacterium avium subsp. paratuberculosis
ggaugaccgcccagg

SEQ ID NO: 3017251 - RNA, 22 nt, Mycobacterium avium subsp. paratuberculosis
ggaugaccgcccaggacccgua

SEQ ID NO: 3017252 - RNA, 17 nt, Mycobacterium avium subsp. paratuberculosis
ggaugaccgcgucggcg

SEQ ID NO: 3017253 - RNA, 18 nt, Mycobacterium avium subsp. paratuberculosis
ggaugaccgcgucggcgc

SEQ ID NO: 3017254 - RNA, 21 nt, Mycobacterium avium subsp. paratuberculosis
ggaugaccgcgucggcgccgu

SEQ ID NO: 3017255 - RNA, 23 nt, Mycobacterium avium subsp. paratuberculosis
ggaugacgaugaugucgcccggc

SEQ ID NO: 3017256 - RNA, 18 nt, Mycobacterium avium subsp. paratuberculosis
ggaugacgcagccgaugu

SEQ ID NO: 3017257 - RNA, 14 nt, Mycobacterium avium subsp. paratuberculosis
ggaugacgccgcgg

SEQ ID NO: 3017258 - RNA, 20 nt, Mycobacterium avium subsp. paratuberculosis
ggaugacggucugcaccggg

SEQ ID NO: 3017259 - RNA, 15 nt, Mycobacterium avium subsp. paratuberculosis
ggaugaucagcaggu

SEQ ID NO: 3017260 - RNA, 15 nt, Mycobacterium avium subsp. paratuberculosis
ggaugaucggcgccu

SEQ ID NO: 3017261 - RNA, 20 nt, Mycobacterium avium subsp. paratuberculosis
ggaugaucgucucggccgcg

SEQ ID NO: 3017262 - RNA, 18 nt, Mycobacterium avium subsp. paratuberculosis
ggaugaugccggcggugu

SEQ ID NO: 3017263 - RNA, 20 nt, Mycobacterium avium subsp. paratuberculosis
ggaugauguucuccggcccg

SEQ ID NO: 3017264 - RNA, 22 nt, Mycobacterium avium subsp. paratuberculosis
ggaugauguucuccggcccggc

SEQ ID NO: 3017265 - RNA, 23 nt, Mycobacterium avium subsp. paratuberculosis
ggaugauguucuccggcccggcg

SEQ ID NO: 3017266 - RNA, 17 nt, Mycobacterium avium subsp. paratuberculosis
ggaugcaccggcagcca

SEQ ID NO: 3017267 - RNA, 18 nt, Mycobacterium avium subsp. paratuberculosis
ggaugcaccggcagccag

SEQ ID NO: 3017268 - RNA, 22 nt, Mycobacterium avium subsp. paratuberculosis
ggaugcacgugcaccgcggcca

SEQ ID NO: 3017269 - RNA, 13 nt, Mycobacterium avium subsp. paratuberculosis
ggaugcagccggc

SEQ ID NO: 3017270 - RNA, 23 nt, Mycobacterium avium subsp. paratuberculosis
ggaugcagccggccaucucggcg

SEQ ID NO: 3017271 - RNA, 18 nt, Mycobacterium avium subsp. paratuberculosis
ggaugccagcagguccgc

SEQ ID NO: 3017272 - RNA, 23 nt, Mycobacterium avium subsp. paratuberculosis
ggaugccaguccugggccggggc

SEQ ID NO: 3017273 - RNA, 21 nt, Mycobacterium avium subsp. paratuberculosis
ggaugcccaacagcucgcggg

SEQ ID NO: 3017274 - RNA, 17 nt, Mycobacterium avium subsp. paratuberculosis
ggaugcccagcaccacu

SEQ ID NO: 3017275 - RNA, 21 nt, Mycobacterium avium subsp. paratuberculosis
ggaugccccguauugccgucg

SEQ ID NO: 3017276 - RNA, 15 nt, Mycobacterium avium subsp. paratuberculosis
ggaugcccgccggcg

SEQ ID NO: 3017277 - RNA, 14 nt, Mycobacterium avium subsp. paratuberculosis
ggaugcccgggccg

SEQ ID NO: 3017278 - RNA, 18 nt, Mycobacterium avium subsp. paratuberculosis
ggaugcccgggccguccg

SEQ ID NO: 3017279 - RNA, 13 nt, Mycobacterium avium subsp. paratuberculosis
ggaugcccggggg

SEQ ID NO: 3017280 - RNA, 19 nt, Mycobacterium avium subsp. paratuberculosis
ggaugcccgggggauaggg

SEQ ID NO: 3017281 - RNA, 15 nt, Mycobacterium avium subsp. paratuberculosis
ggaugccgagcagcu

SEQ ID NO: 3017282 - RNA, 19 nt, Mycobacterium avium subsp. paratuberculosis
ggaugccgagcagcucggc

SEQ ID NO: 3017283 - RNA, 12 nt, Mycobacterium avium subsp. paratuberculosis
ggaugccgaggu

SEQ ID NO: 3017284 - RNA, 18 nt, Mycobacterium avium subsp. paratuberculosis
ggaugccgcccaccaccg

SEQ ID NO: 3017285 - RNA, 22 nt, Mycobacterium avium subsp. paratuberculosis
ggaugccgcccuugcucgcggc

SEQ ID NO: 3017286 - RNA, 23 nt, Mycobacterium avium subsp. paratuberculosis
ggaugccgcccuugcucgcggcg

SEQ ID NO: 3017287 - RNA, 20 nt, Mycobacterium avium subsp. paratuberculosis
ggaugccgccggucacggcg

SEQ ID NO: 3017288 - RNA, 13 nt, Mycobacterium avium subsp. paratuberculosis
ggaugccgcgcgg

SEQ ID NO: 3017289 - RNA, 12 nt, Mycobacterium avium subsp. paratuberculosis
ggaugccggcgc

SEQ ID NO: 3017290 - RNA, 15 nt, Mycobacterium avium subsp. paratuberculosis
ggaugccggcgccca

SEQ ID NO: 3017291 - RNA, 20 nt, Mycobacterium avium subsp. paratuberculosis
ggaugccggcgcccagcggc

SEQ ID NO: 3017292 - RNA, 17 nt, Mycobacterium avium subsp. paratuberculosis
ggaugccugcccgcgca

SEQ ID NO: 3017293 - RNA, 17 nt, Mycobacterium avium subsp. paratuberculosis
ggaugcgccgugcccaa

SEQ ID NO: 3017294 - RNA, 14 nt, Mycobacterium avium subsp. paratuberculosis
ggaugcgcuggugc

SEQ ID NO: 3017295 - RNA, 19 nt, Mycobacterium avium subsp. paratuberculosis
ggaugcggcccuggcgggc

SEQ ID NO: 3017296 - RNA, 15 nt, Mycobacterium avium subsp. paratuberculosis
ggaugcggcgcccac

SEQ ID NO: 3017297 - RNA, 15 nt, Mycobacterium avium subsp. paratuberculosis
ggaugcggucgauca

SEQ ID NO: 3017298 - RNA, 23 nt, Mycobacterium avium subsp. paratuberculosis
ggaugcggucgaugagcuggugc

SEQ ID NO: 3017299 - RNA, 18 nt, Mycobacterium avium subsp. paratuberculosis
ggaugcggucgucgccca

SEQ ID NO: 3017300 - RNA, 15 nt, Mycobacterium avium subsp. paratuberculosis
ggaugcguucggcca

SEQ ID NO: 3017301 - RNA, 21 nt, Mycobacterium avium subsp. paratuberculosis
ggaugcugcgggucagcagcu

SEQ ID NO: 3017302 - RNA, 19 nt, Mycobacterium avium subsp. paratuberculosis
ggaugcuggggucggccag

SEQ ID NO: 3017303 - RNA, 15 nt, Mycobacterium avium subsp. paratuberculosis
ggauggacgcccaga

SEQ ID NO: 3017304 - RNA, 12 nt, Mycobacterium avium subsp. paratuberculosis
ggauggccagca

SEQ ID NO: 3017305 - RNA, 13 nt, Mycobacterium avium subsp. paratuberculosis
ggauggccagcag

SEQ ID NO: 3017306 - RNA, 22 nt, Mycobacterium avium subsp. paratuberculosis
ggauggcccgccagaucgccau

SEQ ID NO: 3017307 - RNA, 13 nt, Mycobacterium avium subsp. paratuberculosis
ggauggccggccg

SEQ ID NO: 3017308 - RNA, 12 nt, Mycobacterium avium subsp. paratuberculosis
ggauggccgggc

SEQ ID NO: 3017309 - RNA, 14 nt, Mycobacterium avium subsp. paratuberculosis
ggauggccgggcag

SEQ ID NO: 3017310 - RNA, 16 nt, Mycobacterium avium subsp. paratuberculosis
ggauggcgcccagccc

SEQ ID NO: 3017311 - RNA, 21 nt, Mycobacterium avium subsp. paratuberculosis
ggauggcgcccagcccgagca

SEQ ID NO: 3017312 - RNA, 15 nt, Mycobacterium avium subsp. paratuberculosis
ggauggcggcguugc

SEQ ID NO: 3017313 - RNA, 19 nt, Mycobacterium avium subsp. paratuberculosis
ggauggcuguggaugacgc

SEQ ID NO: 3017314 - RNA, 19 nt, Mycobacterium avium subsp. paratuberculosis
ggaugggcgcacgaucggg

SEQ ID NO: 3017315 - RNA, 21 nt, Mycobacterium avium subsp. paratuberculosis
ggaugggcgcacgaucgggcg

SEQ ID NO: 3017316 - RNA, 11 nt, Mycobacterium avium subsp. paratuberculosis
ggaugggcucg

SEQ ID NO: 3017317 - RNA, 20 nt, Mycobacterium avium subsp. paratuberculosis
ggauggguggcgaucaccgc

SEQ ID NO: 3017318 - RNA, 18 nt, Mycobacterium avium subsp. paratuberculosis
ggaugguccccgggccca

SEQ ID NO: 3017319 - RNA, 17 nt, Mycobacterium avium subsp. paratuberculosis
ggauggugaccagcgcc

SEQ ID NO: 3017320 - RNA, 20 nt, Mycobacterium avium subsp. paratuberculosis
ggauggugagcccgaugcug

SEQ ID NO: 3017321 - RNA, 23 nt, Mycobacterium avium subsp. paratuberculosis
ggauggugcccaccgggcagccg

SEQ ID NO: 3017322 - RNA, 23 nt, Mycobacterium avium subsp. paratuberculosis
ggauggugcgccgggucgcggug

SEQ ID NO: 3017323 - RNA, 17 nt, Mycobacterium avium subsp. paratuberculosis
ggaugguuuccacugcc

SEQ ID NO: 3017324 - RNA, 14 nt, Mycobacterium avium subsp. paratuberculosis
ggauguacccgcag

SEQ ID NO: 3017325 - RNA, 19 nt, Mycobacterium avium subsp. paratuberculosis
ggauguacccgcaggccau

SEQ ID NO: 3017326 - RNA, 14 nt, Mycobacterium avium subsp. paratuberculosis
ggauguagccgccg

SEQ ID NO: 3017327 - RNA, 17 nt, Mycobacterium avium subsp. paratuberculosis
ggauguccgaccgguug

SEQ ID NO: 3017328 - RNA, 15 nt, Mycobacterium avium subsp. paratuberculosis
ggauguccuacggcg

SEQ ID NO: 3017329 - RNA, 20 nt, Mycobacterium avium subsp. paratuberculosis
ggauguccuacggcgggugc

SEQ ID NO: 3017330 - RNA, 12 nt, Mycobacterium avium subsp. paratuberculosis
ggaugucgccgc

SEQ ID NO: 3017331 - RNA, 14 nt, Mycobacterium avium subsp. paratuberculosis
ggaugucgggcgag

SEQ ID NO: 3017332 - RNA, 21 nt, Mycobacterium avium subsp. paratuberculosis
ggaugucguccucggucaggc

SEQ ID NO: 3017333 - RNA, 12 nt, Mycobacterium avium subsp. paratuberculosis
ggaugucgucgg

SEQ ID NO: 3017334 - RNA, 17 nt, Mycobacterium avium subsp. paratuberculosis
ggaugucgucgggcgcg

SEQ ID NO: 3017335 - RNA, 18 nt, Mycobacterium avium subsp. paratuberculosis
ggaugucgugcggucgca

SEQ ID NO: 3017336 - RNA, 16 nt, Mycobacterium avium subsp. paratuberculosis
ggaugucuagccgccg

SEQ ID NO: 3017337 - RNA, 15 nt, Mycobacterium avium subsp. paratuberculosis
ggaugucuccgcgca

SEQ ID NO: 3017338 - RNA, 18 nt, Mycobacterium avium subsp. paratuberculosis
ggaugucuccgcgcagcc

SEQ ID NO: 3017339 - RNA, 15 nt, Mycobacterium avium subsp. paratuberculosis
ggaugugcugcaggu

SEQ ID NO: 3017340 - RNA, 19 nt, Mycobacterium avium subsp. paratuberculosis
ggauguggaggcgagcaac

SEQ ID NO: 3017341 - RNA, 21 nt, Mycobacterium avium subsp. paratuberculosis
ggaugugguugcuggcgucgu

SEQ ID NO: 3017342 - RNA, 17 nt, Mycobacterium avium subsp. paratuberculosis
ggauguucaccccggcg

SEQ ID NO: 3017343 - RNA, 23 nt, Mycobacterium avium subsp. paratuberculosis
ggauguuguccggaacacccagg

SEQ ID NO: 3017344 - RNA, 14 nt, Mycobacterium avium subsp. paratuberculosis
ggauuacucgccgg

SEQ ID NO: 3017345 - RNA, 16 nt, Mycobacterium avium subsp. paratuberculosis
ggauuacucgccggcg

SEQ ID NO: 3017346 - RNA, 20 nt, Mycobacterium avium subsp. paratuberculosis
ggauuacucgccggcggcgc

SEQ ID NO: 3017347 - RNA, 19 nt, Mycobacterium avium subsp. paratuberculosis
ggauucagcgucgccaugc

SEQ ID NO: 3017348 - RNA, 21 nt, Mycobacterium avium subsp. paratuberculosis
ggauuccagaucugucuucgc

SEQ ID NO: 3017349 - RNA, 14 nt, Mycobacterium avium subsp. paratuberculosis
ggauuccagcgcgu

SEQ ID NO: 3017350 - RNA, 15 nt, Mycobacterium avium subsp. paratuberculosis
ggauucccgaccccg

SEQ ID NO: 3017351 - RNA, 21 nt, Mycobacterium avium subsp. paratuberculosis
ggauucccgaccccgccagca

SEQ ID NO: 3017352 - RNA, 23 nt, Mycobacterium avium subsp. paratuberculosis
ggauucccgaccccgccagcacc

SEQ ID NO: 3017353 - RNA, 16 nt, Mycobacterium avium subsp. paratuberculosis
ggauucggcgcggcuc

SEQ ID NO: 3017354 - RNA, 22 nt, Mycobacterium avium subsp. paratuberculosis
ggauucguucauguagcagcgc

SEQ ID NO: 3017355 - RNA, 14 nt, Mycobacterium avium subsp. paratuberculosis
ggauugccgggcag

SEQ ID NO: 3017356 - RNA, 14 nt, Mycobacterium avium subsp. paratuberculosis
ggauuggcggccaa

SEQ ID NO: 3017357 - RNA, 20 nt, Mycobacterium avium subsp. paratuberculosis
ggauuucacgucugcucggc

SEQ ID NO: 3017358 - RNA, 16 nt, Mycobacterium avium subsp. paratuberculosis
ggauuucgcucagccg

SEQ ID NO: 3017359 - RNA, 23 nt, Mycobacterium avium subsp. paratuberculosis
ggcaaaauagcugcgacagaaau

SEQ ID NO: 3017360 - RNA, 16 nt, Mycobacterium avium subsp. paratuberculosis
ggcaaagaucggugcc

SEQ ID NO: 3017361 - RNA, 20 nt, Mycobacterium avium subsp. paratuberculosis
ggcaaagcguugccgcgcgc

SEQ ID NO: 3017362 - RNA, 16 nt, Mycobacterium avium subsp. paratuberculosis
ggcaacaccggcggcg

SEQ ID NO: 3017363 - RNA, 17 nt, Mycobacterium avium subsp. paratuberculosis
ggcaacaccggcggcga

SEQ ID NO: 3017364 - RNA, 13 nt, Mycobacterium avium subsp. paratuberculosis
ggcaacacgacca

SEQ ID NO: 3017365 - RNA, 16 nt, Mycobacterium avium subsp. paratuberculosis
ggcaacacgaccagga

SEQ ID NO: 3017366 - RNA, 19 nt, Mycobacterium avium subsp. paratuberculosis
ggcaacacgccggcggcca

SEQ ID NO: 3017367 - RNA, 19 nt, Mycobacterium avium subsp. paratuberculosis
ggcaacacguagucgccga

SEQ ID NO: 3017368 - RNA, 18 nt, Mycobacterium avium subsp. paratuberculosis
ggcaacacgucguccggc

SEQ ID NO: 3017369 - RNA, 19 nt, Mycobacterium avium subsp. paratuberculosis
ggcaacacgucguccggcg

SEQ ID NO: 3017370 - RNA, 23 nt, Mycobacterium avium subsp. paratuberculosis
ggcaacacgucguccggcgcgca

SEQ ID NO: 3017371 - RNA, 15 nt, Mycobacterium avium subsp. paratuberculosis
ggcaacagcgcgccg

SEQ ID NO: 3017372 - RNA, 17 nt, Mycobacterium avium subsp. paratuberculosis
ggcaacagcgcgccggc

SEQ ID NO: 3017373 - RNA, 18 nt, Mycobacterium avium subsp. paratuberculosis
ggcaacagcgcgccggcc

SEQ ID NO: 3017374 - RNA, 14 nt, Mycobacterium avium subsp. paratuberculosis
ggcaaccacagcgg

SEQ ID NO: 3017375 - RNA, 16 nt, Mycobacterium avium subsp. paratuberculosis
ggcaaccagcuccggc

SEQ ID NO: 3017376 - RNA, 17 nt, Mycobacterium avium subsp. paratuberculosis
ggcaacccgaccucguc

SEQ ID NO: 3017377 - RNA, 19 nt, Mycobacterium avium subsp. paratuberculosis
ggcaacccgaucgccgagu

SEQ ID NO: 3017378 - RNA, 12 nt, Mycobacterium avium subsp. paratuberculosis
ggcaaccgcagc

SEQ ID NO: 3017379 - RNA, 12 nt, Mycobacterium avium subsp. paratuberculosis
ggcaaccgcugc

SEQ ID NO: 3017380 - RNA, 13 nt, Mycobacterium avium subsp. paratuberculosis
ggcaaccugggcg

SEQ ID NO: 3017381 - RNA, 17 nt, Mycobacterium avium subsp. paratuberculosis
ggcaaccugggcggcgg

SEQ ID NO: 3017382 - RNA, 18 nt, Mycobacterium avium subsp. paratuberculosis
ggcaaccugggcggcggc

SEQ ID NO: 3017383 - RNA, 18 nt, Mycobacterium avium subsp. paratuberculosis
ggcaacgacccgucgggg

SEQ ID NO: 3017384 - RNA, 13 nt, Mycobacterium avium subsp. paratuberculosis
ggcaacgaggcca

SEQ ID NO: 3017385 - RNA, 23 nt, Mycobacterium avium subsp. paratuberculosis
ggcaacgaggccagggcccgcag

SEQ ID NO: 3017386 - RNA, 13 nt, Mycobacterium avium subsp. paratuberculosis
ggcaacgccagcc

SEQ ID NO: 3017387 - RNA, 21 nt, Mycobacterium avium subsp. paratuberculosis
ggcaacgccagccagaacacg

SEQ ID NO: 3017388 - RNA, 22 nt, Mycobacterium avium subsp. paratuberculosis
ggcaacgccagccagaacacgc

SEQ ID NO: 3017389 - RNA, 19 nt, Mycobacterium avium subsp. paratuberculosis
ggcaacgccggguccacga

SEQ ID NO: 3017390 - RNA, 12 nt, Mycobacterium avium subsp. paratuberculosis
ggcaacgccggu

SEQ ID NO: 3017391 - RNA, 16 nt, Mycobacterium avium subsp. paratuberculosis
ggcaacgcgccggcgg

SEQ ID NO: 3017392 - RNA, 21 nt, Mycobacterium avium subsp. paratuberculosis
ggcaacgcgccggcggucgac

SEQ ID NO: 3017393 - RNA, 15 nt, Mycobacterium avium subsp. paratuberculosis
ggcaacgcggcauga

SEQ ID NO: 3017394 - RNA, 19 nt, Mycobacterium avium subsp. paratuberculosis
ggcaacgucuggccaccga

SEQ ID NO: 3017395 - RNA, 17 nt, Mycobacterium avium subsp. paratuberculosis
ggcaacgugccacaggc

SEQ ID NO: 3017396 - RNA, 20 nt, Mycobacterium avium subsp. paratuberculosis
ggcaacucaguccucgccga

SEQ ID NO: 3017397 - RNA, 22 nt, Mycobacterium avium subsp. paratuberculosis
ggcaacucaguccucgccgaga

SEQ ID NO: 3017398 - RNA, 17 nt, Mycobacterium avium subsp. paratuberculosis
ggcaacucccgaucgcc

SEQ ID NO: 3017399 - RNA, 20 nt, Mycobacterium avium subsp. paratuberculosis
ggcaacucgcgaggccgcca

SEQ ID NO: 3017400 - RNA, 20 nt, Mycobacterium avium subsp. paratuberculosis
ggcaacugggcggccugcac

SEQ ID NO: 3017401 - RNA, 13 nt, Mycobacterium avium subsp. paratuberculosis
ggcaagcagcggc

SEQ ID NO: 3017402 - RNA, 16 nt, Mycobacterium avium subsp. paratuberculosis
ggcaagcagcggcagc

SEQ ID NO: 3017403 - RNA, 17 nt, Mycobacterium avium subsp. paratuberculosis
ggcaagcagcggcagcc

SEQ ID NO: 3017404 - RNA, 19 nt, Mycobacterium avium subsp. paratuberculosis
ggcaagcaguaugcccgcc

SEQ ID NO: 3017405 - RNA, 23 nt, Mycobacterium avium subsp. paratuberculosis
ggcaagcaguaugcccgccgcug

SEQ ID NO: 3017406 - RNA, 19 nt, Mycobacterium avium subsp. paratuberculosis
ggcaagcccuuuggcggcc

SEQ ID NO: 3017407 - RNA, 14 nt, Mycobacterium avium subsp. paratuberculosis
ggcaaggccagcaa

SEQ ID NO: 3017408 - RNA, 20 nt, Mycobacterium avium subsp. paratuberculosis
ggcaaggcguuccaucugcu

SEQ ID NO: 3017409 - RNA, 15 nt, Mycobacterium avium subsp. paratuberculosis
ggcaagggcaaagac

SEQ ID NO: 3017410 - RNA, 22 nt, Mycobacterium avium subsp. paratuberculosis
ggcaagggcaaagacgacggcu

SEQ ID NO: 3017411 - RNA, 14 nt, Mycobacterium avium subsp. paratuberculosis
ggcaaggugccguc

SEQ ID NO: 3017412 - RNA, 14 nt, Mycobacterium avium subsp. paratuberculosis
ggcaagucgucggu

SEQ ID NO: 3017413 - RNA, 16 nt, Mycobacterium avium subsp. paratuberculosis
ggcaagucgucggugg

SEQ ID NO: 3017414 - RNA, 20 nt, Mycobacterium avium subsp. paratuberculosis
ggcaagucgucggugggccg

SEQ ID NO: 3017415 - RNA, 16 nt, Mycobacterium avium subsp. paratuberculosis
ggcaauaccggcagca

SEQ ID NO: 3017416 - RNA, 17 nt, Mycobacterium avium subsp. paratuberculosis
ggcaauaccggcagcag

SEQ ID NO: 3017417 - RNA, 18 nt, Mycobacterium avium subsp. paratuberculosis
ggcaauaccggcagcagg

SEQ ID NO: 3017418 - RNA, 14 nt, Mycobacterium avium subsp. paratuberculosis
ggcaaucaggcggu

SEQ ID NO: 3017419 - RNA, 15 nt, Mycobacterium avium subsp. paratuberculosis
ggcaaucaggcgguc

SEQ ID NO: 3017420 - RNA, 14 nt, Mycobacterium avium subsp. paratuberculosis
ggcaauccggcccc

SEQ ID NO: 3017421 - RNA, 19 nt, Mycobacterium avium subsp. paratuberculosis
ggcaauccggccccgcugc

SEQ ID NO: 3017422 - RNA, 23 nt, Mycobacterium avium subsp. paratuberculosis
ggcaaucgcugcgcccgccgcca

SEQ ID NO: 3017423 - RNA, 17 nt, Mycobacterium avium subsp. paratuberculosis
ggcaaucggacccagcc

SEQ ID NO: 3017424 - RNA, 14 nt, Mycobacterium avium subsp. paratuberculosis
ggcaaucgggacgc

SEQ ID NO: 3017425 - RNA, 17 nt, Mycobacterium avium subsp. paratuberculosis
ggcaaucgggacgccac

SEQ ID NO: 3017426 - RNA, 19 nt, Mycobacterium avium subsp. paratuberculosis
ggcaaucgguuaagugccc

SEQ ID NO: 3017427 - RNA, 22 nt, Mycobacterium avium subsp. paratuberculosis
ggcaaugaugucggcgggccgg

SEQ ID NO: 3017428 - RNA, 17 nt, Mycobacterium avium subsp. paratuberculosis
ggcaaugguugcggcgg

SEQ ID NO: 3017429 - RNA, 18 nt, Mycobacterium avium subsp. paratuberculosis
ggcaaugguugcggcggg

SEQ ID NO: 3017430 - RNA, 19 nt, Mycobacterium avium subsp. paratuberculosis
ggcaaugguugcggcgggc

SEQ ID NO: 3017431 - RNA, 12 nt, Mycobacterium avium subsp. paratuberculosis
ggcacaccagcg

SEQ ID NO: 3017432 - RNA, 21 nt, Mycobacterium avium subsp. paratuberculosis
ggcacaccagguaggcggugg

SEQ ID NO: 3017433 - RNA, 17 nt, Mycobacterium avium subsp. paratuberculosis
ggcacagcagggcaccg

SEQ ID NO: 3017434 - RNA, 22 nt, Mycobacterium avium subsp. paratuberculosis
ggcacagcagggcaccgacggc

SEQ ID NO: 3017435 - RNA, 16 nt, Mycobacterium avium subsp. paratuberculosis
ggcacagccagcgccc

SEQ ID NO: 3017436 - RNA, 19 nt, Mycobacterium avium subsp. paratuberculosis
ggcacagccagcgcccggc

SEQ ID NO: 3017437 - RNA, 21 nt, Mycobacterium avium subsp. paratuberculosis
ggcacagcgaaagcgcuuggc

SEQ ID NO: 3017438 - RNA, 21 nt, Mycobacterium avium subsp. paratuberculosis
ggcaccaacccgaucggcccg

SEQ ID NO: 3017439 - RNA, 23 nt, Mycobacterium avium subsp. paratuberculosis
ggcaccaacccgaucggcccggc

SEQ ID NO: 3017440 - RNA, 16 nt, Mycobacterium avium subsp. paratuberculosis
ggcaccaccaccgaca

SEQ ID NO: 3017441 - RNA, 17 nt, Mycobacterium avium subsp. paratuberculosis
ggcaccaccaccgacac

SEQ ID NO: 3017442 - RNA, 16 nt, Mycobacterium avium subsp. paratuberculosis
ggcaccaccacggugg

SEQ ID NO: 3017443 - RNA, 19 nt, Mycobacterium avium subsp. paratuberculosis
ggcaccaccacgguggcgc

SEQ ID NO: 3017444 - RNA, 20 nt, Mycobacterium avium subsp. paratuberculosis
ggcaccaccacgguggcgcc

SEQ ID NO: 3017445 - RNA, 18 nt, Mycobacterium avium subsp. paratuberculosis
ggcaccaccagcgugugg

SEQ ID NO: 3017446 - RNA, 19 nt, Mycobacterium avium subsp. paratuberculosis
ggcaccacccgcggccggc

SEQ ID NO: 3017447 - RNA, 14 nt, Mycobacterium avium subsp. paratuberculosis
ggcaccacgccgac

SEQ ID NO: 3017448 - RNA, 18 nt, Mycobacterium avium subsp. paratuberculosis
ggcaccacgcugugcucg

SEQ ID NO: 3017449 - RNA, 16 nt, Mycobacterium avium subsp. paratuberculosis
ggcaccacguccacca

SEQ ID NO: 3017450 - RNA, 14 nt, Mycobacterium avium subsp. paratuberculosis
ggcaccagcaccga

SEQ ID NO: 3017451 - RNA, 16 nt, Mycobacterium avium subsp. paratuberculosis
ggcaccagcaccgaga

SEQ ID NO: 3017452 - RNA, 21 nt, Mycobacterium avium subsp. paratuberculosis
ggcaccagcaccgagaucucg

SEQ ID NO: 3017453 - RNA, 11 nt, Mycobacterium avium subsp. paratuberculosis
ggcaccagcag

SEQ ID NO: 3017454 - RNA, 12 nt, Mycobacterium avium subsp. paratuberculosis
ggcaccagcagc

SEQ ID NO: 3017455 - RNA, 14 nt, Mycobacterium avium subsp. paratuberculosis
ggcaccagcagcca

SEQ ID NO: 3017456 - RNA, 17 nt, Mycobacterium avium subsp. paratuberculosis
ggcaccagcagccagcc

SEQ ID NO: 3017457 - RNA, 22 nt, Mycobacterium avium subsp. paratuberculosis
ggcaccagcagccagcccagcc

SEQ ID NO: 3017458 - RNA, 17 nt, Mycobacterium avium subsp. paratuberculosis
ggcaccagcagccgcag

SEQ ID NO: 3017459 - RNA, 24 nt, Mycobacterium avium subsp. paratuberculosis
ggcaccagcagccgcagcgcgcga

SEQ ID NO: 3017460 - RNA, 16 nt, Mycobacterium avium subsp. paratuberculosis
ggcaccagcagcgcga

SEQ ID NO: 3017461 - RNA, 21 nt, Mycobacterium avium subsp. paratuberculosis
ggcaccagcagcgcgacgccg

SEQ ID NO: 3017462 - RNA, 15 nt, Mycobacterium avium subsp. paratuberculosis
ggcaccagcgcgacg

SEQ ID NO: 3017463 - RNA, 18 nt, Mycobacterium avium subsp. paratuberculosis
ggcaccagcgcgacggug

SEQ ID NO: 3017464 - RNA, 19 nt, Mycobacterium avium subsp. paratuberculosis
ggcaccagcgcgacggugu

SEQ ID NO: 3017465 - RNA, 20 nt, Mycobacterium avium subsp. paratuberculosis
ggcaccagcggcaucgccgc

SEQ ID NO: 3017466 - RNA, 14 nt, Mycobacterium avium subsp. paratuberculosis
ggcaccagcugcgg

SEQ ID NO: 3017467 - RNA, 11 nt, Mycobacterium avium subsp. paratuberculosis
ggcaccaggua

SEQ ID NO: 3017468 - RNA, 20 nt, Mycobacterium avium subsp. paratuberculosis
ggcaccagguaccggcgggc

SEQ ID NO: 3017469 - RNA, 21 nt, Mycobacterium avium subsp. paratuberculosis
ggcaccagguaccggcgggcg

SEQ ID NO: 3017470 - RNA, 18 nt, Mycobacterium avium subsp. paratuberculosis
ggcaccaguaggucaccc

SEQ ID NO: 3017471 - RNA, 18 nt, Mycobacterium avium subsp. paratuberculosis
ggcaccagucgcgcagcg

SEQ ID NO: 3017472 - RNA, 21 nt, Mycobacterium avium subsp. paratuberculosis
ggcaccagucgcgcagcguca

SEQ ID NO: 3017473 - RNA, 14 nt, Mycobacterium avium subsp. paratuberculosis
ggcaccauugcggg

SEQ ID NO: 3017474 - RNA, 20 nt, Mycobacterium avium subsp. paratuberculosis
ggcacccaggaaaaccagcg

SEQ ID NO: 3017475 - RNA, 17 nt, Mycobacterium avium subsp. paratuberculosis
ggcacccaggucaccga

SEQ ID NO: 3017476 - RNA, 13 nt, Mycobacterium avium subsp. paratuberculosis
ggcaccccaucgg

SEQ ID NO: 3017477 - RNA, 20 nt, Mycobacterium avium subsp. paratuberculosis
ggcacccccaauugccgggc

SEQ ID NO: 3017478 - RNA, 21 nt, Mycobacterium avium subsp. paratuberculosis
ggcacccccaauugccgggcc

SEQ ID NO: 3017479 - RNA, 19 nt, Mycobacterium avium subsp. paratuberculosis
ggcacccccgggguggugu

SEQ ID NO: 3017480 - RNA, 17 nt, Mycobacterium avium subsp. paratuberculosis
ggcaccccgcgccgggc

SEQ ID NO: 3017481 - RNA, 20 nt, Mycobacterium avium subsp. paratuberculosis
ggcaccccgcgccgggcguu

SEQ ID NO: 3017482 - RNA, 17 nt, Mycobacterium avium subsp. paratuberculosis
ggcaccccgcggucggc

SEQ ID NO: 3017483 - RNA, 19 nt, Mycobacterium avium subsp. paratuberculosis
ggcaccccugccgccaccg

SEQ ID NO: 3017484 - RNA, 22 nt, Mycobacterium avium subsp. paratuberculosis
ggcaccccugccgccaccgcga

SEQ ID NO: 3017485 - RNA, 17 nt, Mycobacterium avium subsp. paratuberculosis
ggcacccgaccgacgcc

SEQ ID NO: 3017486 - RNA, 18 nt, Mycobacterium avium subsp. paratuberculosis
ggcacccgaccgacgccc

SEQ ID NO: 3017487 - RNA, 16 nt, Mycobacterium avium subsp. paratuberculosis
ggcacccgcaacacca

SEQ ID NO: 3017488 - RNA, 19 nt, Mycobacterium avium subsp. paratuberculosis
ggcacccgcaacaccacgu

SEQ ID NO: 3017489 - RNA, 13 nt, Mycobacterium avium subsp. paratuberculosis
ggcacccgcagcu

SEQ ID NO: 3017490 - RNA, 14 nt, Mycobacterium avium subsp. paratuberculosis
ggcacccgccagcc

SEQ ID NO: 3017491 - RNA, 18 nt, Mycobacterium avium subsp. paratuberculosis
ggcacccgcgcgucgcgc

SEQ ID NO: 3017492 - RNA, 19 nt, Mycobacterium avium subsp. paratuberculosis
ggcacccgcgcgucgcgca

SEQ ID NO: 3017493 - RNA, 22 nt, Mycobacterium avium subsp. paratuberculosis
ggcacccgcgcgucgcgcagcg

SEQ ID NO: 3017494 - RNA, 19 nt, Mycobacterium avium subsp. paratuberculosis
ggcacccgcugcaccagcc

SEQ ID NO: 3017495 - RNA, 12 nt, Mycobacterium avium subsp. paratuberculosis
ggcacccggcgc

SEQ ID NO: 3017496 - RNA, 19 nt, Mycobacterium avium subsp. paratuberculosis
ggcacccggcgcggccgcc

SEQ ID NO: 3017497 - RNA, 21 nt, Mycobacterium avium subsp. paratuberculosis
ggcacccgggccuugacggcc

SEQ ID NO: 3017498 - RNA, 16 nt, Mycobacterium avium subsp. paratuberculosis
ggcacccgggcgacau

SEQ ID NO: 3017499 - RNA, 16 nt, Mycobacterium avium subsp. paratuberculosis
ggcacccggguggaca

SEQ ID NO: 3017500 - RNA, 22 nt, Mycobacterium avium subsp. paratuberculosis
ggcacccggguggacaccgcga

SEQ ID NO: 3017501 - RNA, 22 nt, Mycobacterium avium subsp. paratuberculosis
ggcacccgguccggcccgggga

SEQ ID NO: 3017502 - RNA, 17 nt, Mycobacterium avium subsp. paratuberculosis
ggcacccucggugcucu

SEQ ID NO: 3017503 - RNA, 16 nt, Mycobacterium avium subsp. paratuberculosis
ggcaccgaacgccagc

SEQ ID NO: 3017504 - RNA, 20 nt, Mycobacterium avium subsp. paratuberculosis
ggcaccgaacgccagcagcu

SEQ ID NO: 3017505 - RNA, 24 nt, Mycobacterium avium subsp. paratuberculosis
ggcaccgaacgccagcagcugcgg

SEQ ID NO: 3017506 - RNA, 18 nt, Mycobacterium avium subsp. paratuberculosis
ggcaccgacagggccagc

SEQ ID NO: 3017507 - RNA, 20 nt, Mycobacterium avium subsp. paratuberculosis
ggcaccgacaucagaucgcc

SEQ ID NO: 3017508 - RNA, 21 nt, Mycobacterium avium subsp. paratuberculosis
ggcaccgacaucagaucgccg

SEQ ID NO: 3017509 - RNA, 22 nt, Mycobacterium avium subsp. paratuberculosis
ggcaccgacaucagaucgccga

SEQ ID NO: 3017510 - RNA, 22 nt, Mycobacterium avium subsp. paratuberculosis
ggcaccgacgaggagaccuccu

SEQ ID NO: 3017511 - RNA, 19 nt, Mycobacterium avium subsp. paratuberculosis
ggcaccgacggagccgagc

SEQ ID NO: 3017512 - RNA, 20 nt, Mycobacterium avium subsp. paratuberculosis
ggcaccgacggagccgagca

SEQ ID NO: 3017513 - RNA, 14 nt, Mycobacterium avium subsp. paratuberculosis
ggcaccgacggccg

SEQ ID NO: 3017514 - RNA, 15 nt, Mycobacterium avium subsp. paratuberculosis
ggcaccgacggccgc

SEQ ID NO: 3017515 - RNA, 17 nt, Mycobacterium avium subsp. paratuberculosis
ggcaccgacggccgcac

SEQ ID NO: 3017516 - RNA, 18 nt, Mycobacterium avium subsp. paratuberculosis
ggcaccgacggccgcacc

SEQ ID NO: 3017517 - RNA, 19 nt, Mycobacterium avium subsp. paratuberculosis
ggcaccgacggccgcaccc

SEQ ID NO: 3017518 - RNA, 17 nt, Mycobacterium avium subsp. paratuberculosis
ggcaccgauaguagcca

SEQ ID NO: 3017519 - RNA, 20 nt, Mycobacterium avium subsp. paratuberculosis
ggcaccgauaguagccagca

SEQ ID NO: 3017520 - RNA, 22 nt, Mycobacterium avium subsp. paratuberculosis
ggcaccgauaguagccagcauc

SEQ ID NO: 3017521 - RNA, 20 nt, Mycobacterium avium subsp. paratuberculosis
ggcaccgaucggcacgucga

SEQ ID NO: 3017522 - RNA, 13 nt, Mycobacterium avium subsp. paratuberculosis
ggcaccgccagcc

SEQ ID NO: 3017523 - RNA, 17 nt, Mycobacterium avium subsp. paratuberculosis
ggcaccgccagccacca

SEQ ID NO: 3017524 - RNA, 23 nt, Mycobacterium avium subsp. paratuberculosis
ggcaccgccaucggcaucgcgcg

SEQ ID NO: 3017525 - RNA, 21 nt, Mycobacterium avium subsp. paratuberculosis
ggcaccgcccccgcggcggcc

SEQ ID NO: 3017526 - RNA, 22 nt, Mycobacterium avium subsp. paratuberculosis
ggcaccgcccccgcggcggcca

SEQ ID NO: 3017527 - RNA, 12 nt, Mycobacterium avium subsp. paratuberculosis
ggcaccgcccgg

SEQ ID NO: 3017528 - RNA, 16 nt, Mycobacterium avium subsp. paratuberculosis
ggcaccgccgcgcggc

SEQ ID NO: 3017529 - RNA, 18 nt, Mycobacterium avium subsp. paratuberculosis
ggcaccgccgcgcggccg

SEQ ID NO: 3017530 - RNA, 21 nt, Mycobacterium avium subsp. paratuberculosis
ggcaccgccgcgcggccgggc

SEQ ID NO: 3017531 - RNA, 22 nt, Mycobacterium avium subsp. paratuberculosis
ggcaccgccgcgcggccgggcu

SEQ ID NO: 3017532 - RNA, 16 nt, Mycobacterium avium subsp. paratuberculosis
ggcaccgccgcggugg

SEQ ID NO: 3017533 - RNA, 19 nt, Mycobacterium avium subsp. paratuberculosis
ggcaccgccggcggccucc

SEQ ID NO: 3017534 - RNA, 20 nt, Mycobacterium avium subsp. paratuberculosis
ggcaccgccggcggccuccg

SEQ ID NO: 3017535 - RNA, 12 nt, Mycobacterium avium subsp. paratuberculosis
ggcaccgcgaac

SEQ ID NO: 3017536 - RNA, 22 nt, Mycobacterium avium subsp. paratuberculosis
ggcaccgcggcggugucggcgc

SEQ ID NO: 3017537 - RNA, 16 nt, Mycobacterium avium subsp. paratuberculosis
ggcaccgcggcucggu

SEQ ID NO: 3017538 - RNA, 21 nt, Mycobacterium avium subsp. paratuberculosis
ggcaccgcggcucggucgcga

SEQ ID NO: 3017539 - RNA, 19 nt, Mycobacterium avium subsp. paratuberculosis
ggcaccgcggucugcgcca

SEQ ID NO: 3017540 - RNA, 21 nt, Mycobacterium avium subsp. paratuberculosis
ggcaccgcggucugcgccagc

SEQ ID NO: 3017541 - RNA, 22 nt, Mycobacterium avium subsp. paratuberculosis
ggcaccgcggucugcgccagcu

SEQ ID NO: 3017542 - RNA, 16 nt, Mycobacterium avium subsp. paratuberculosis
ggcaccgcugccggcc

SEQ ID NO: 3017543 - RNA, 12 nt, Mycobacterium avium subsp. paratuberculosis
ggcaccggaccg

SEQ ID NO: 3017544 - RNA, 15 nt, Mycobacterium avium subsp. paratuberculosis
ggcaccggaccgccg

SEQ ID NO: 3017545 - RNA, 16 nt, Mycobacterium avium subsp. paratuberculosis
ggcaccgggaccuggg

SEQ ID NO: 3017546 - RNA, 22 nt, Mycobacterium avium subsp. paratuberculosis
ggcaccgggugggccgaccugc

SEQ ID NO: 3017547 - RNA, 15 nt, Mycobacterium avium subsp. paratuberculosis
ggcaccggugcggcg

SEQ ID NO: 3017548 - RNA, 16 nt, Mycobacterium avium subsp. paratuberculosis
ggcaccggugcggcgg

SEQ ID NO: 3017549 - RNA, 14 nt, Mycobacterium avium subsp. paratuberculosis
ggcaccgucaccga

SEQ ID NO: 3017550 - RNA, 21 nt, Mycobacterium avium subsp. paratuberculosis
ggcaccgucaccgacggcugg

SEQ ID NO: 3017551 - RNA, 15 nt, Mycobacterium avium subsp. paratuberculosis
ggcaccgucgaccuc

SEQ ID NO: 3017552 - RNA, 12 nt, Mycobacterium avium subsp. paratuberculosis
ggcaccgucguc

SEQ ID NO: 3017553 - RNA, 13 nt, Mycobacterium avium subsp. paratuberculosis
ggcaccgucgucg

SEQ ID NO: 3017554 - RNA, 21 nt, Mycobacterium avium subsp. paratuberculosis
ggcaccgucgucgcaccggca

SEQ ID NO: 3017555 - RNA, 18 nt, Mycobacterium avium subsp. paratuberculosis
ggcaccgugccgcgcggc

SEQ ID NO: 3017556 - RNA, 19 nt, Mycobacterium avium subsp. paratuberculosis
ggcaccgugccgcgcggcg

SEQ ID NO: 3017557 - RNA, 20 nt, Mycobacterium avium subsp. paratuberculosis
ggcaccgugccgcgcggcgg

SEQ ID NO: 3017558 - RNA, 23 nt, Mycobacterium avium subsp. paratuberculosis
ggcaccgugccgcgcggcgguga

SEQ ID NO: 3017559 - RNA, 15 nt, Mycobacterium avium subsp. paratuberculosis
ggcaccucgaagggc

SEQ ID NO: 3017560 - RNA, 21 nt, Mycobacterium avium subsp. paratuberculosis
ggcaccucgaagggcgccagc

SEQ ID NO: 3017561 - RNA, 22 nt, Mycobacterium avium subsp. paratuberculosis
ggcaccucgaagggcgccagcc

SEQ ID NO: 3017562 - RNA, 14 nt, Mycobacterium avium subsp. paratuberculosis
ggcaccucgaucac

SEQ ID NO: 3017563 - RNA, 21 nt, Mycobacterium avium subsp. paratuberculosis
ggcaccucgaugccgugccgg

SEQ ID NO: 3017564 - RNA, 23 nt, Mycobacterium avium subsp. paratuberculosis
ggcaccucgaugccgugccggug

SEQ ID NO: 3017565 - RNA, 16 nt, Mycobacterium avium subsp. paratuberculosis
ggcaccucggccaggu

SEQ ID NO: 3017566 - RNA, 22 nt, Mycobacterium avium subsp. paratuberculosis
ggcaccucggccuugaccacgg

SEQ ID NO: 3017567 - RNA, 13 nt, Mycobacterium avium subsp. paratuberculosis
ggcaccucggcgu

SEQ ID NO: 3017568 - RNA, 15 nt, Mycobacterium avium subsp. paratuberculosis
ggcaccucggcgucg

SEQ ID NO: 3017569 - RNA, 17 nt, Mycobacterium avium subsp. paratuberculosis
ggcaccucggcgucggc

SEQ ID NO: 3017570 - RNA, 15 nt, Mycobacterium avium subsp. paratuberculosis
ggcaccuggccgucg

SEQ ID NO: 3017571 - RNA, 16 nt, Mycobacterium avium subsp. paratuberculosis
ggcaccuggccgucgg

SEQ ID NO: 3017572 - RNA, 17 nt, Mycobacterium avium subsp. paratuberculosis
ggcaccuggccgucggu

SEQ ID NO: 3017573 - RNA, 19 nt, Mycobacterium avium subsp. paratuberculosis
ggcaccuggccgucggugg

SEQ ID NO: 3017574 - RNA, 21 nt, Mycobacterium avium subsp. paratuberculosis
ggcaccuggccgucgguggcc

SEQ ID NO: 3017575 - RNA, 16 nt, Mycobacterium avium subsp. paratuberculosis
ggcaccuucaccgacc

SEQ ID NO: 3017576 - RNA, 19 nt, Mycobacterium avium subsp. paratuberculosis
ggcaccuucaccgaccagc

SEQ ID NO: 3017577 - RNA, 19 nt, Mycobacterium avium subsp. paratuberculosis
ggcaccuuggugagcaccg

SEQ ID NO: 3017578 - RNA, 20 nt, Mycobacterium avium subsp. paratuberculosis
ggcaccuuggugagcaccgc

SEQ ID NO: 3017579 - RNA, 21 nt, Mycobacterium avium subsp. paratuberculosis
ggcacgaacgcgacgaucagc

SEQ ID NO: 3017580 - RNA, 19 nt, Mycobacterium avium subsp. paratuberculosis
ggcacgaauucgguggcga

SEQ ID NO: 3017581 - RNA, 22 nt, Mycobacterium avium subsp. paratuberculosis
ggcacgaauucgguggcgaugg

SEQ ID NO: 3017582 - RNA, 18 nt, Mycobacterium avium subsp. paratuberculosis
ggcacgacgccgccgagg

SEQ ID NO: 3017583 - RNA, 19 nt, Mycobacterium avium subsp. paratuberculosis
ggcacgacggucagcacgc

SEQ ID NO: 3017584 - RNA, 19 nt, Mycobacterium avium subsp. paratuberculosis
ggcacgaucggcagcgcca

SEQ ID NO: 3017585 - RNA, 19 nt, Mycobacterium avium subsp. paratuberculosis
ggcacgaugaacuccucga

SEQ ID NO: 3017586 - RNA, 18 nt, Mycobacterium avium subsp. paratuberculosis
ggcacgauggacgcccaa

SEQ ID NO: 3017587 - RNA, 15 nt, Mycobacterium avium subsp. paratuberculosis
ggcacgauggcgcgg

SEQ ID NO: 3017588 - RNA, 19 nt, Mycobacterium avium subsp. paratuberculosis
ggcacgauggcgcggcgca

SEQ ID NO: 3017589 - RNA, 14 nt, Mycobacterium avium subsp. paratuberculosis
ggcacgcagcggcg

SEQ ID NO: 3017590 - RNA, 16 nt, Mycobacterium avium subsp. paratuberculosis
ggcacgcagcggcguc

SEQ ID NO: 3017591 - RNA, 17 nt, Mycobacterium avium subsp. paratuberculosis
ggcacgccacucgucga

SEQ ID NO: 3017592 - RNA, 21 nt, Mycobacterium avium subsp. paratuberculosis
ggcacgccacucgucgacguu

SEQ ID NO: 3017593 - RNA, 14 nt, Mycobacterium avium subsp. paratuberculosis
ggcacgcccguucg

SEQ ID NO: 3017594 - RNA, 22 nt, Mycobacterium avium subsp. paratuberculosis
ggcacgccgaccacccccagcc

SEQ ID NO: 3017595 - RNA, 21 nt, Mycobacterium avium subsp. paratuberculosis
ggcacgccgcagcgcagcguc

SEQ ID NO: 3017596 - RNA, 17 nt, Mycobacterium avium subsp. paratuberculosis
ggcacgccgcucgucgg

SEQ ID NO: 3017597 - RNA, 14 nt, Mycobacterium avium subsp. paratuberculosis
ggcacgcgagacga

SEQ ID NO: 3017598 - RNA, 19 nt, Mycobacterium avium subsp. paratuberculosis
ggcacgcgagacgagccgc

SEQ ID NO: 3017599 - RNA, 12 nt, Mycobacterium avium subsp. paratuberculosis
ggcacgcgcgcc

SEQ ID NO: 3017600 - RNA, 16 nt, Mycobacterium avium subsp. paratuberculosis
ggcacgcgcgcccggc

SEQ ID NO: 3017601 - RNA, 17 nt, Mycobacterium avium subsp. paratuberculosis
ggcacgcgcgcccggca

SEQ ID NO: 3017602 - RNA, 14 nt, Mycobacterium avium subsp. paratuberculosis
ggcacgcgcgccgg

SEQ ID NO: 3017603 - RNA, 14 nt, Mycobacterium avium subsp. paratuberculosis
ggcacggcaccgcg

SEQ ID NO: 3017604 - RNA, 15 nt, Mycobacterium avium subsp. paratuberculosis
ggcacggcccgcucg

SEQ ID NO: 3017605 - RNA, 13 nt, Mycobacterium avium subsp. paratuberculosis
ggcacggccggcc

SEQ ID NO: 3017606 - RNA, 15 nt, Mycobacterium avium subsp. paratuberculosis
ggcacggccggccgg

SEQ ID NO: 3017607 - RNA, 17 nt, Mycobacterium avium subsp. paratuberculosis
ggcacggccggccggcc

SEQ ID NO: 3017608 - RNA, 22 nt, Mycobacterium avium subsp. paratuberculosis
ggcacggccggccggccgagcc

SEQ ID NO: 3017609 - RNA, 13 nt, Mycobacterium avium subsp. paratuberculosis
ggcacggcgaugu

SEQ ID NO: 3017610 - RNA, 21 nt, Mycobacterium avium subsp. paratuberculosis
ggcacggcuaccuaggcgucg

SEQ ID NO: 3017611 - RNA, 16 nt, Mycobacterium avium subsp. paratuberculosis
ggcacgggcccgcggg

SEQ ID NO: 3017612 - RNA, 12 nt, Mycobacterium avium subsp. paratuberculosis
ggcacgggccgu

SEQ ID NO: 3017613 - RNA, 21 nt, Mycobacterium avium subsp. paratuberculosis
ggcacggugcacacgccgagg

SEQ ID NO: 3017614 - RNA, 19 nt, Mycobacterium avium subsp. paratuberculosis
ggcacggugcgggugccga

SEQ ID NO: 3017615 - RNA, 18 nt, Mycobacterium avium subsp. paratuberculosis
ggcacggugggacggcgg

SEQ ID NO: 3017616 - RNA, 22 nt, Mycobacterium avium subsp. paratuberculosis
ggcacggugggacggcgggugg

SEQ ID NO: 3017617 - RNA, 21 nt, Mycobacterium avium subsp. paratuberculosis
ggcacgguguagcugcggguc

SEQ ID NO: 3017618 - RNA, 19 nt, Mycobacterium avium subsp. paratuberculosis
ggcacguccagcccgcgcc

SEQ ID NO: 3017619 - RNA, 20 nt, Mycobacterium avium subsp. paratuberculosis
ggcacguccagcccgcgcca

SEQ ID NO: 3017620 - RNA, 18 nt, Mycobacterium avium subsp. paratuberculosis
ggcacguccccgugcagc

SEQ ID NO: 3017621 - RNA, 21 nt, Mycobacterium avium subsp. paratuberculosis
ggcacguccccgugcagccgg

SEQ ID NO: 3017622 - RNA, 13 nt, Mycobacterium avium subsp. paratuberculosis
ggcacgucgacgc

SEQ ID NO: 3017623 - RNA, 19 nt, Mycobacterium avium subsp. paratuberculosis
ggcacgucgacgcccugcc

SEQ ID NO: 3017624 - RNA, 13 nt, Mycobacterium avium subsp. paratuberculosis
ggcacgucgagcu

SEQ ID NO: 3017625 - RNA, 20 nt, Mycobacterium avium subsp. paratuberculosis
ggcacgucgagcuccucggc

SEQ ID NO: 3017626 - RNA, 13 nt, Mycobacterium avium subsp. paratuberculosis
ggcacgucgccgu

SEQ ID NO: 3017627 - RNA, 15 nt, Mycobacterium avium subsp. paratuberculosis
ggcacgucggccacg

SEQ ID NO: 3017628 - RNA, 15 nt, Mycobacterium avium subsp. paratuberculosis
ggcacgucggccagg

SEQ ID NO: 3017629 - RNA, 23 nt, Mycobacterium avium subsp. paratuberculosis
ggcacgugcggguuggcgccggu

SEQ ID NO: 3017630 - RNA, 16 nt, Mycobacterium avium subsp. paratuberculosis
ggcacguugacguaga

SEQ ID NO: 3017631 - RNA, 16 nt, Mycobacterium avium subsp. paratuberculosis
ggcacuaccgccucgc

SEQ ID NO: 3017632 - RNA, 13 nt, Mycobacterium avium subsp. paratuberculosis
ggcacucgagcgu

SEQ ID NO: 3017633 - RNA, 14 nt, Mycobacterium avium subsp. paratuberculosis
ggcacucgcccagg

SEQ ID NO: 3017634 - RNA, 22 nt, Mycobacterium avium subsp. paratuberculosis
ggcacucgcccagggcgugcgc

SEQ ID NO: 3017635 - RNA, 13 nt, Mycobacterium avium subsp. paratuberculosis
ggcacucgucgug

SEQ ID NO: 3017636 - RNA, 16 nt, Mycobacterium avium subsp. paratuberculosis
ggcacucgucguggcg

SEQ ID NO: 3017637 - RNA, 20 nt, Mycobacterium avium subsp. paratuberculosis
ggcacucgucguggcggugc

SEQ ID NO: 3017638 - RNA, 22 nt, Mycobacterium avium subsp. paratuberculosis
ggcacugcccgcaucgcacaga

SEQ ID NO: 3017639 - RNA, 15 nt, Mycobacterium avium subsp. paratuberculosis
ggcacugcugcccgc

SEQ ID NO: 3017640 - RNA, 16 nt, Mycobacterium avium subsp. paratuberculosis
ggcacugcugcccgcg

SEQ ID NO: 3017641 - RNA, 15 nt, Mycobacterium avium subsp. paratuberculosis
ggcacuggcgcugcg

SEQ ID NO: 3017642 - RNA, 18 nt, Mycobacterium avium subsp. paratuberculosis
ggcacuuaacaccucgcc

SEQ ID NO: 3017643 - RNA, 15 nt, Mycobacterium avium subsp. paratuberculosis
ggcagaccaggacca

SEQ ID NO: 3017644 - RNA, 17 nt, Mycobacterium avium subsp. paratuberculosis
ggcagaccaggaccagg

SEQ ID NO: 3017645 - RNA, 21 nt, Mycobacterium avium subsp. paratuberculosis
ggcagaccaggaccagguugg

SEQ ID NO: 3017646 - RNA, 13 nt, Mycobacterium avium subsp. paratuberculosis
ggcagacccagca

SEQ ID NO: 3017647 - RNA, 22 nt, Mycobacterium avium subsp. paratuberculosis
ggcagacccagcagcggccggc

SEQ ID NO: 3017648 - RNA, 23 nt, Mycobacterium avium subsp. paratuberculosis
ggcagacccagcagcggccggcg

SEQ ID NO: 3017649 - RNA, 15 nt, Mycobacterium avium subsp. paratuberculosis
ggcagacccccagca

SEQ ID NO: 3017650 - RNA, 19 nt, Mycobacterium avium subsp. paratuberculosis
ggcagacccccagcagcgg

SEQ ID NO: 3017651 - RNA, 17 nt, Mycobacterium avium subsp. paratuberculosis
ggcagacccgcgucgau

SEQ ID NO: 3017652 - RNA, 16 nt, Mycobacterium avium subsp. paratuberculosis
ggcagaccggugagca

SEQ ID NO: 3017653 - RNA, 22 nt, Mycobacterium avium subsp. paratuberculosis
ggcagaccgugugccagcccgu

SEQ ID NO: 3017654 - RNA, 22 nt, Mycobacterium avium subsp. paratuberculosis
ggcagauaggcggcgacggcgu

SEQ ID NO: 3017655 - RNA, 14 nt, Mycobacterium avium subsp. paratuberculosis
ggcagaucgcggcc

SEQ ID NO: 3017656 - RNA, 15 nt, Mycobacterium avium subsp. paratuberculosis
ggcagaucgcggccc

SEQ ID NO: 3017657 - RNA, 15 nt, Mycobacterium avium subsp. paratuberculosis
ggcagaucgucggca

SEQ ID NO: 3017658 - RNA, 16 nt, Mycobacterium avium subsp. paratuberculosis
ggcagaucgucggcac

SEQ ID NO: 3017659 - RNA, 18 nt, Mycobacterium avium subsp. paratuberculosis
ggcagaugcccgcugaca

SEQ ID NO: 3017660 - RNA, 18 nt, Mycobacterium avium subsp. paratuberculosis
ggcagauggucgccgacg

SEQ ID NO: 3017661 - RNA, 23 nt, Mycobacterium avium subsp. paratuberculosis
ggcagauggugaaguugccgguc

SEQ ID NO: 3017662 - RNA, 14 nt, Mycobacterium avium subsp. paratuberculosis
ggcagcaaccggcg

SEQ ID NO: 3017663 - RNA, 18 nt, Mycobacterium avium subsp. paratuberculosis
ggcagcaaccggcggcug

SEQ ID NO: 3017664 - RNA, 20 nt, Mycobacterium avium subsp. paratuberculosis
ggcagcaaccggcggcuggg

SEQ ID NO: 3017665 - RNA, 22 nt, Mycobacterium avium subsp. paratuberculosis
ggcagcaaccggcggcugggca

SEQ ID NO: 3017666 - RNA, 14 nt, Mycobacterium avium subsp. paratuberculosis
ggcagcaccagcgg

SEQ ID NO: 3017667 - RNA, 15 nt, Mycobacterium avium subsp. paratuberculosis
ggcagcaccagcggc

SEQ ID NO: 3017668 - RNA, 17 nt, Mycobacterium avium subsp. paratuberculosis
ggcagcaccagcggcac

SEQ ID NO: 3017669 - RNA, 22 nt, Mycobacterium avium subsp. paratuberculosis
ggcagcaccagcggcaccaggu

SEQ ID NO: 3017670 - RNA, 11 nt, Mycobacterium avium subsp. paratuberculosis
ggcagcacccg

SEQ ID NO: 3017671 - RNA, 12 nt, Mycobacterium avium subsp. paratuberculosis
ggcagcaccgcc

SEQ ID NO: 3017672 - RNA, 15 nt, Mycobacterium avium subsp. paratuberculosis
ggcagcaccgccgac

SEQ ID NO: 3017673 - RNA, 16 nt, Mycobacterium avium subsp. paratuberculosis
ggcagcaccgccgagc

SEQ ID NO: 3017674 - RNA, 17 nt, Mycobacterium avium subsp. paratuberculosis
ggcagcaccgccgagcc

SEQ ID NO: 3017675 - RNA, 18 nt, Mycobacterium avium subsp. paratuberculosis
ggcagcaccgccgagccg

SEQ ID NO: 3017676 - RNA, 12 nt, Mycobacterium avium subsp. paratuberculosis
ggcagcaccggc

SEQ ID NO: 3017677 - RNA, 15 nt, Mycobacterium avium subsp. paratuberculosis
ggcagcaccggcagc

SEQ ID NO: 3017678 - RNA, 17 nt, Mycobacterium avium subsp. paratuberculosis
ggcagcaccggccggau

SEQ ID NO: 3017679 - RNA, 16 nt, Mycobacterium avium subsp. paratuberculosis
ggcagcaccucgcgcg

SEQ ID NO: 3017680 - RNA, 22 nt, Mycobacterium avium subsp. paratuberculosis
ggcagcaccucgcgcgcgagcc

SEQ ID NO: 3017681 - RNA, 23 nt, Mycobacterium avium subsp. paratuberculosis
ggcagcacgggggaguagcgcgc

SEQ ID NO: 3017682 - RNA, 12 nt, Mycobacterium avium subsp. paratuberculosis
ggcagcagcacc

SEQ ID NO: 3017683 - RNA, 16 nt, Mycobacterium avium subsp. paratuberculosis
ggcagcagcaccagcg

SEQ ID NO: 3017684 - RNA, 19 nt, Mycobacterium avium subsp. paratuberculosis
ggcagcagcaccagcgccg

SEQ ID NO: 3017685 - RNA, 14 nt, Mycobacterium avium subsp. paratuberculosis
ggcagcagcaucgg

SEQ ID NO: 3017686 - RNA, 15 nt, Mycobacterium avium subsp. paratuberculosis
ggcagcagcaucggu

SEQ ID NO: 3017687 - RNA, 18 nt, Mycobacterium avium subsp. paratuberculosis
ggcagcagcaucgguccc

SEQ ID NO: 3017688 - RNA, 23 nt, Mycobacterium avium subsp. paratuberculosis
ggcagcagcccgucccggcccau

SEQ ID NO: 3017689 - RNA, 12 nt, Mycobacterium avium subsp. paratuberculosis
ggcagcagccgg

SEQ ID NO: 3017690 - RNA, 13 nt, Mycobacterium avium subsp. paratuberculosis
ggcagcagcgccc

SEQ ID NO: 3017691 - RNA, 14 nt, Mycobacterium avium subsp. paratuberculosis
ggcagcagcgccca

SEQ ID NO: 3017692 - RNA, 17 nt, Mycobacterium avium subsp. paratuberculosis
ggcagcagcgcccaccg

SEQ ID NO: 3017693 - RNA, 12 nt, Mycobacterium avium subsp. paratuberculosis
ggcagcagcgcg

SEQ ID NO: 3017694 - RNA, 13 nt, Mycobacterium avium subsp. paratuberculosis
ggcagcagcgcgu

SEQ ID NO: 3017695 - RNA, 15 nt, Mycobacterium avium subsp. paratuberculosis
ggcagcagcgcgucg

SEQ ID NO: 3017696 - RNA, 13 nt, Mycobacterium avium subsp. paratuberculosis
ggcagcagcucca

SEQ ID NO: 3017697 - RNA, 18 nt, Mycobacterium avium subsp. paratuberculosis
ggcagcagcuuggcgaag

SEQ ID NO: 3017698 - RNA, 16 nt, Mycobacterium avium subsp. paratuberculosis
ggcagcagggugccgc

SEQ ID NO: 3017699 - RNA, 18 nt, Mycobacterium avium subsp. paratuberculosis
ggcagcagggugccgccg

SEQ ID NO: 3017700 - RNA, 12 nt, Mycobacterium avium subsp. paratuberculosis
ggcagcaggugc

SEQ ID NO: 3017701 - RNA, 18 nt, Mycobacterium avium subsp. paratuberculosis
ggcagcaggugcaccacc

SEQ ID NO: 3017702 - RNA, 23 nt, Mycobacterium avium subsp. paratuberculosis
ggcagcaggugcaucgaccggcg

SEQ ID NO: 3017703 - RNA, 24 nt, Mycobacterium avium subsp. paratuberculosis
ggcagcaggugcaucgaccggcgg

SEQ ID NO: 3017704 - RNA, 16 nt, Mycobacterium avium subsp. paratuberculosis
ggcagccaaccgccgg

SEQ ID NO: 3017705 - RNA, 16 nt, Mycobacterium avium subsp. paratuberculosis
ggcagccacgcgcaac

SEQ ID NO: 3017706 - RNA, 15 nt, Mycobacterium avium subsp. paratuberculosis
ggcagccacggcagc

SEQ ID NO: 3017707 - RNA, 13 nt, Mycobacterium avium subsp. paratuberculosis
ggcagccagcccg

SEQ ID NO: 3017708 - RNA, 14 nt, Mycobacterium avium subsp. paratuberculosis
ggcagccagcccgc

SEQ ID NO: 3017709 - RNA, 12 nt, Mycobacterium avium subsp. paratuberculosis
ggcagccagccu

SEQ ID NO: 3017710 - RNA, 13 nt, Mycobacterium avium subsp. paratuberculosis
ggcagccaggcgu

SEQ ID NO: 3017711 - RNA, 18 nt, Mycobacterium avium subsp. paratuberculosis
ggcagcccagguaaucga

SEQ ID NO: 3017712 - RNA, 22 nt, Mycobacterium avium subsp. paratuberculosis
ggcagcccagguaaucgaaggc

SEQ ID NO: 3017713 - RNA, 12 nt, Mycobacterium avium subsp. paratuberculosis
ggcagccccagc

SEQ ID NO: 3017714 - RNA, 16 nt, Mycobacterium avium subsp. paratuberculosis
ggcagccccagcgagc

SEQ ID NO: 3017715 - RNA, 24 nt, Mycobacterium avium subsp. paratuberculosis
ggcagccccgucggucccgacgcg

SEQ ID NO: 3017716 - RNA, 15 nt, Mycobacterium avium subsp. paratuberculosis
ggcagcccgaacagc

SEQ ID NO: 3017717 - RNA, 16 nt, Mycobacterium avium subsp. paratuberculosis
ggcagcccgaacagcc

SEQ ID NO: 3017718 - RNA, 15 nt, Mycobacterium avium subsp. paratuberculosis
ggcagcccgacgucc

SEQ ID NO: 3017719 - RNA, 12 nt, Mycobacterium avium subsp. paratuberculosis
ggcagcccgccg

SEQ ID NO: 3017720 - RNA, 14 nt, Mycobacterium avium subsp. paratuberculosis
ggcagcccgccgac

SEQ ID NO: 3017721 - RNA, 18 nt, Mycobacterium avium subsp. paratuberculosis
ggcagcccgccgaccacc

SEQ ID NO: 3017722 - RNA, 19 nt, Mycobacterium avium subsp. paratuberculosis
ggcagcccgccgaccaccu

SEQ ID NO: 3017723 - RNA, 13 nt, Mycobacterium avium subsp. paratuberculosis
ggcagcccgccgc

SEQ ID NO: 3017724 - RNA, 20 nt, Mycobacterium avium subsp. paratuberculosis
ggcagcccgccgcggaucgg

SEQ ID NO: 3017725 - RNA, 14 nt, Mycobacterium avium subsp. paratuberculosis
ggcagcccggcugc

SEQ ID NO: 3017726 - RNA, 21 nt, Mycobacterium avium subsp. paratuberculosis
ggcagccgcacaccgcggcgg

SEQ ID NO: 3017727 - RNA, 14 nt, Mycobacterium avium subsp. paratuberculosis
ggcagccgcagcga

SEQ ID NO: 3017728 - RNA, 16 nt, Mycobacterium avium subsp. paratuberculosis
ggcagccgcagcgaca

SEQ ID NO: 3017729 - RNA, 23 nt, Mycobacterium avium subsp. paratuberculosis
ggcagccgcgcccacccgcgcac

SEQ ID NO: 3017730 - RNA, 21 nt, Mycobacterium avium subsp. paratuberculosis
ggcagccgcgcgugcagccgg

SEQ ID NO: 3017731 - RNA, 20 nt, Mycobacterium avium subsp. paratuberculosis
ggcagccgcuccggcccgag

SEQ ID NO: 3017732 - RNA, 15 nt, Mycobacterium avium subsp. paratuberculosis
ggcagccgcucggau

SEQ ID NO: 3017733 - RNA, 14 nt, Mycobacterium avium subsp. paratuberculosis
ggcagccgcuuggc

SEQ ID NO: 3017734 - RNA, 13 nt, Mycobacterium avium subsp. paratuberculosis
ggcagccggccac

SEQ ID NO: 3017735 - RNA, 15 nt, Mycobacterium avium subsp. paratuberculosis
ggcagccggccaccu

SEQ ID NO: 3017736 - RNA, 13 nt, Mycobacterium avium subsp. paratuberculosis
ggcagccggccgg

SEQ ID NO: 3017737 - RNA, 14 nt, Mycobacterium avium subsp. paratuberculosis
ggcagccggccggc

SEQ ID NO: 3017738 - RNA, 15 nt, Mycobacterium avium subsp. paratuberculosis
ggcagccggccggca

SEQ ID NO: 3017739 - RNA, 16 nt, Mycobacterium avium subsp. paratuberculosis
ggcagccggccggcag

SEQ ID NO: 3017740 - RNA, 17 nt, Mycobacterium avium subsp. paratuberculosis
ggcagccggccggcagg

SEQ ID NO: 3017741 - RNA, 12 nt, Mycobacterium avium subsp. paratuberculosis
ggcagccggcgc

SEQ ID NO: 3017742 - RNA, 13 nt, Mycobacterium avium subsp. paratuberculosis
ggcagccggcgcc

SEQ ID NO: 3017743 - RNA, 14 nt, Mycobacterium avium subsp. paratuberculosis
ggcagccggcgccc

SEQ ID NO: 3017744 - RNA, 19 nt, Mycobacterium avium subsp. paratuberculosis
ggcagccggcgcccgcagg

SEQ ID NO: 3017745 - RNA, 20 nt, Mycobacterium avium subsp. paratuberculosis
ggcagccggcgcccgcaggc

SEQ ID NO: 3017746 - RNA, 12 nt, Mycobacterium avium subsp. paratuberculosis
ggcagccggcgu

SEQ ID NO: 3017747 - RNA, 24 nt, Mycobacterium avium subsp. paratuberculosis
ggcagccggcguacucgcacagcc

SEQ ID NO: 3017748 - RNA, 20 nt, Mycobacterium avium subsp. paratuberculosis
ggcagccggcugagcagcca

SEQ ID NO: 3017749 - RNA, 22 nt, Mycobacterium avium subsp. paratuberculosis
ggcagccggcugagcagccagu

SEQ ID NO: 3017750 - RNA, 14 nt, Mycobacterium avium subsp. paratuberculosis
ggcagccggggugc

SEQ ID NO: 3017751 - RNA, 14 nt, Mycobacterium avium subsp. paratuberculosis
ggcagccgucgaug

SEQ ID NO: 3017752 - RNA, 23 nt, Mycobacterium avium subsp. paratuberculosis
ggcagccgucgaugccggcgacg

SEQ ID NO: 3017753 - RNA, 17 nt, Mycobacterium avium subsp. paratuberculosis
ggcagcgaacugccggc

SEQ ID NO: 3017754 - RNA, 20 nt, Mycobacterium avium subsp. paratuberculosis
ggcagcgaauacaccgucca

SEQ ID NO: 3017755 - RNA, 14 nt, Mycobacterium avium subsp. paratuberculosis
ggcagcgaaucggg

SEQ ID NO: 3017756 - RNA, 17 nt, Mycobacterium avium subsp. paratuberculosis
ggcagcgaaucgggguc

SEQ ID NO: 3017757 - RNA, 18 nt, Mycobacterium avium subsp. paratuberculosis
ggcagcgaaucggggucg

SEQ ID NO: 3017758 - RNA, 19 nt, Mycobacterium avium subsp. paratuberculosis
ggcagcgaaucggggucga

SEQ ID NO: 3017759 - RNA, 17 nt, Mycobacterium avium subsp. paratuberculosis
ggcagcgacagcgcguc

SEQ ID NO: 3017760 - RNA, 18 nt, Mycobacterium avium subsp. paratuberculosis
ggcagcgacgcggugagc

SEQ ID NO: 3017761 - RNA, 22 nt, Mycobacterium avium subsp. paratuberculosis
ggcagcgacucgggcaggaugg

SEQ ID NO: 3017762 - RNA, 15 nt, Mycobacterium avium subsp. paratuberculosis
ggcagcgagcacagc

SEQ ID NO: 3017763 - RNA, 20 nt, Mycobacterium avium subsp. paratuberculosis
ggcagcgagcacagcggcgg

SEQ ID NO: 3017764 - RNA, 15 nt, Mycobacterium avium subsp. paratuberculosis
ggcagcgaggcgcgc

SEQ ID NO: 3017765 - RNA, 16 nt, Mycobacterium avium subsp. paratuberculosis
ggcagcgaggcgcgca

SEQ ID NO: 3017766 - RNA, 20 nt, Mycobacterium avium subsp. paratuberculosis
ggcagcgccaacauggcgca

SEQ ID NO: 3017767 - RNA, 12 nt, Mycobacterium avium subsp. paratuberculosis
ggcagcgccacc

SEQ ID NO: 3017768 - RNA, 13 nt, Mycobacterium avium subsp. paratuberculosis
ggcagcgccacca

SEQ ID NO: 3017769 - RNA, 13 nt, Mycobacterium avium subsp. paratuberculosis
ggcagcgccagcg

SEQ ID NO: 3017770 - RNA, 15 nt, Mycobacterium avium subsp. paratuberculosis
ggcagcgccagcggg

SEQ ID NO: 3017771 - RNA, 23 nt, Mycobacterium avium subsp. paratuberculosis
ggcagcgccagcgggauacccau

SEQ ID NO: 3017772 - RNA, 13 nt, Mycobacterium avium subsp. paratuberculosis
ggcagcgccccgg

SEQ ID NO: 3017773 - RNA, 15 nt, Mycobacterium avium subsp. paratuberculosis
ggcagcgccucggcg

SEQ ID NO: 3017774 - RNA, 17 nt, Mycobacterium avium subsp. paratuberculosis
ggcagcgccucggcggg

SEQ ID NO: 3017775 - RNA, 18 nt, Mycobacterium avium subsp. paratuberculosis
ggcagcgccucggcgggc

SEQ ID NO: 3017776 - RNA, 20 nt, Mycobacterium avium subsp. paratuberculosis
ggcagcgccucggcgggccg

SEQ ID NO: 3017777 - RNA, 23 nt, Mycobacterium avium subsp. paratuberculosis
ggcagcgccucggcgggccgccc

SEQ ID NO: 3017778 - RNA, 17 nt, Mycobacterium avium subsp. paratuberculosis
ggcagcgcgacaccgga

SEQ ID NO: 3017779 - RNA, 16 nt, Mycobacterium avium subsp. paratuberculosis
ggcagcgcgaccagcc

SEQ ID NO: 3017780 - RNA, 15 nt, Mycobacterium avium subsp. paratuberculosis
ggcagcgcgacuggg

SEQ ID NO: 3017781 - RNA, 21 nt, Mycobacterium avium subsp. paratuberculosis
ggcagcgcgauccgcgcgucg

SEQ ID NO: 3017782 - RNA, 16 nt, Mycobacterium avium subsp. paratuberculosis
ggcagcgcgauccggg

SEQ ID NO: 3017783 - RNA, 21 nt, Mycobacterium avium subsp. paratuberculosis
ggcagcgcgauccggggggcg

SEQ ID NO: 3017784 - RNA, 15 nt, Mycobacterium avium subsp. paratuberculosis
ggcagcgcggccagc

SEQ ID NO: 3017785 - RNA, 23 nt, Mycobacterium avium subsp. paratuberculosis
ggcagcgcggccagcacggucag

SEQ ID NO: 3017786 - RNA, 17 nt, Mycobacterium avium subsp. paratuberculosis
ggcagcgcuaaccgcgg

SEQ ID NO: 3017787 - RNA, 20 nt, Mycobacterium avium subsp. paratuberculosis
ggcagcgcuaaccgcgggca

SEQ ID NO: 3017788 - RNA, 17 nt, Mycobacterium avium subsp. paratuberculosis
ggcagcgcuccugcagc

SEQ ID NO: 3017789 - RNA, 20 nt, Mycobacterium avium subsp. paratuberculosis
ggcagcgcuccugcagcgcg

SEQ ID NO: 3017790 - RNA, 20 nt, Mycobacterium avium subsp. paratuberculosis
ggcagcgcucgucgucggag

SEQ ID NO: 3017791 - RNA, 22 nt, Mycobacterium avium subsp. paratuberculosis
ggcagcggacccggucggccgc

SEQ ID NO: 3017792 - RNA, 19 nt, Mycobacterium avium subsp. paratuberculosis
ggcagcggccccacguuga

SEQ ID NO: 3017793 - RNA, 22 nt, Mycobacterium avium subsp. paratuberculosis
ggcagcggcugcugcagcgccc

SEQ ID NO: 3017794 - RNA, 15 nt, Mycobacterium avium subsp. paratuberculosis
ggcagcggucggcgg

SEQ ID NO: 3017795 - RNA, 23 nt, Mycobacterium avium subsp. paratuberculosis
ggcagcggucggcggcugaggca

SEQ ID NO: 3017796 - RNA, 19 nt, Mycobacterium avium subsp. paratuberculosis
ggcagcggugccgcccgga

SEQ ID NO: 3017797 - RNA, 12 nt, Mycobacterium avium subsp. paratuberculosis
ggcagcgguguc

SEQ ID NO: 3017798 - RNA, 17 nt, Mycobacterium avium subsp. paratuberculosis
ggcagcggugucaccga

SEQ ID NO: 3017799 - RNA, 24 nt, Mycobacterium avium subsp. paratuberculosis
ggcagcggugucaccgacgccagc

SEQ ID NO: 3017800 - RNA, 16 nt, Mycobacterium avium subsp. paratuberculosis
ggcagcgucccgucgg

SEQ ID NO: 3017801 - RNA, 17 nt, Mycobacterium avium subsp. paratuberculosis
ggcagcgucccgucggc

SEQ ID NO: 3017802 - RNA, 18 nt, Mycobacterium avium subsp. paratuberculosis
ggcagcgucccgucggcc

SEQ ID NO: 3017803 - RNA, 21 nt, Mycobacterium avium subsp. paratuberculosis
ggcagcgucccgucggccagu

SEQ ID NO: 3017804 - RNA, 13 nt, Mycobacterium avium subsp. paratuberculosis
ggcagcgucgcca

SEQ ID NO: 3017805 - RNA, 17 nt, Mycobacterium avium subsp. paratuberculosis
ggcagcgucgccagccg

SEQ ID NO: 3017806 - RNA, 18 nt, Mycobacterium avium subsp. paratuberculosis
ggcagcgucgccagccgc

SEQ ID NO: 3017807 - RNA, 21 nt, Mycobacterium avium subsp. paratuberculosis
ggcagcgucgccagccgccgg

SEQ ID NO: 3017808 - RNA, 16 nt, Mycobacterium avium subsp. paratuberculosis
ggcagcgugucccggu

SEQ ID NO: 3017809 - RNA, 13 nt, Mycobacterium avium subsp. paratuberculosis
ggcagcucggcgg

SEQ ID NO: 3017810 - RNA, 14 nt, Mycobacterium avium subsp. paratuberculosis
ggcagcucggcggc

SEQ ID NO: 3017811 - RNA, 16 nt, Mycobacterium avium subsp. paratuberculosis
ggcagcucggcggccc

SEQ ID NO: 3017812 - RNA, 18 nt, Mycobacterium avium subsp. paratuberculosis
ggcagcucggcggcccgc

SEQ ID NO: 3017813 - RNA, 20 nt, Mycobacterium avium subsp. paratuberculosis
ggcagcucggcggcccgccg

SEQ ID NO: 3017814 - RNA, 15 nt, Mycobacterium avium subsp. paratuberculosis
ggcagcucgggcagc

SEQ ID NO: 3017815 - RNA, 15 nt, Mycobacterium avium subsp. paratuberculosis
ggcagcucgguggcc

SEQ ID NO: 3017816 - RNA, 18 nt, Mycobacterium avium subsp. paratuberculosis
ggcagcucgguggccggu

SEQ ID NO: 3017817 - RNA, 16 nt, Mycobacterium avium subsp. paratuberculosis
ggcagcucgucgacgu

SEQ ID NO: 3017818 - RNA, 23 nt, Mycobacterium avium subsp. paratuberculosis
ggcagcucgucgacguccucgcc

SEQ ID NO: 3017819 - RNA, 13 nt, Mycobacterium avium subsp. paratuberculosis
ggcagcucgucgg

SEQ ID NO: 3017820 - RNA, 15 nt, Mycobacterium avium subsp. paratuberculosis
ggcagcucgucggcg

SEQ ID NO: 3017821 - RNA, 18 nt, Mycobacterium avium subsp. paratuberculosis
ggcagcucgucggcgcgc

SEQ ID NO: 3017822 - RNA, 19 nt, Mycobacterium avium subsp. paratuberculosis
ggcagcucgucggcgcgcc

SEQ ID NO: 3017823 - RNA, 22 nt, Mycobacterium avium subsp. paratuberculosis
ggcagcucgucggcgcgccacc

SEQ ID NO: 3017824 - RNA, 15 nt, Mycobacterium avium subsp. paratuberculosis
ggcagcugaagugca

SEQ ID NO: 3017825 - RNA, 19 nt, Mycobacterium avium subsp. paratuberculosis
ggcagcugauagcccgccg

SEQ ID NO: 3017826 - RNA, 20 nt, Mycobacterium avium subsp. paratuberculosis
ggcagcugauagcccgccgc

SEQ ID NO: 3017827 - RNA, 15 nt, Mycobacterium avium subsp. paratuberculosis
ggcagcugcccgucg

SEQ ID NO: 3017828 - RNA, 21 nt, Mycobacterium avium subsp. paratuberculosis
ggcagcugcugggacgggucg

SEQ ID NO: 3017829 - RNA, 19 nt, Mycobacterium avium subsp. paratuberculosis
ggcagcuuccgccucggcg

SEQ ID NO: 3017830 - RNA, 18 nt, Mycobacterium avium subsp. paratuberculosis
ggcagcuugaugcuggca

SEQ ID NO: 3017831 - RNA, 23 nt, Mycobacterium avium subsp. paratuberculosis
ggcaggaaccgggucagcaccac

SEQ ID NO: 3017832 - RNA, 19 nt, Mycobacterium avium subsp. paratuberculosis
ggcaggaauuccagcgaca

SEQ ID NO: 3017833 - RNA, 20 nt, Mycobacterium avium subsp. paratuberculosis
ggcaggacgggggccggugc

SEQ ID NO: 3017834 - RNA, 20 nt, Mycobacterium avium subsp. paratuberculosis
ggcaggauccggucgaucac

SEQ ID NO: 3017835 - RNA, 15 nt, Mycobacterium avium subsp. paratuberculosis
ggcaggaugccgcgu

SEQ ID NO: 3017836 - RNA, 15 nt, Mycobacterium avium subsp. paratuberculosis
ggcaggauggucagc

SEQ ID NO: 3017837 - RNA, 14 nt, Mycobacterium avium subsp. paratuberculosis
ggcaggcacgagcg

SEQ ID NO: 3017838 - RNA, 18 nt, Mycobacterium avium subsp. paratuberculosis
ggcaggccaucagcccgg

SEQ ID NO: 3017839 - RNA, 20 nt, Mycobacterium avium subsp. paratuberculosis
ggcaggccaucagcccggcg

SEQ ID NO: 3017840 - RNA, 20 nt, Mycobacterium avium subsp. paratuberculosis
ggcaggccccuccagcugga

SEQ ID NO: 3017841 - RNA, 18 nt, Mycobacterium avium subsp. paratuberculosis
ggcaggcccgagcccgac

SEQ ID NO: 3017842 - RNA, 20 nt, Mycobacterium avium subsp. paratuberculosis
ggcaggcccgagcccgacgg

SEQ ID NO: 3017843 - RNA, 20 nt, Mycobacterium avium subsp. paratuberculosis
ggcaggccgaagaacucagc

SEQ ID NO: 3017844 - RNA, 21 nt, Mycobacterium avium subsp. paratuberculosis
ggcaggccgaagaacucagcc

SEQ ID NO: 3017845 - RNA, 12 nt, Mycobacterium avium subsp. paratuberculosis
ggcaggccgccc

SEQ ID NO: 3017846 - RNA, 16 nt, Mycobacterium avium subsp. paratuberculosis
ggcaggccgcggccgu

SEQ ID NO: 3017847 - RNA, 22 nt, Mycobacterium avium subsp. paratuberculosis
ggcaggccgcggccgucgucgu

SEQ ID NO: 3017848 - RNA, 15 nt, Mycobacterium avium subsp. paratuberculosis
ggcaggccggcagcc

SEQ ID NO: 3017849 - RNA, 16 nt, Mycobacterium avium subsp. paratuberculosis
ggcaggccggcagccg

SEQ ID NO: 3017850 - RNA, 18 nt, Mycobacterium avium subsp. paratuberculosis
ggcaggccggcagccggc

SEQ ID NO: 3017851 - RNA, 16 nt, Mycobacterium avium subsp. paratuberculosis
ggcaggcgauggcguc

SEQ ID NO: 3017852 - RNA, 21 nt, Mycobacterium avium subsp. paratuberculosis
ggcaggcgauggcgucggcca

SEQ ID NO: 3017853 - RNA, 21 nt, Mycobacterium avium subsp. paratuberculosis
ggcaggcgauggugccggcca

SEQ ID NO: 3017854 - RNA, 13 nt, Mycobacterium avium subsp. paratuberculosis
ggcaggcgaugug

SEQ ID NO: 3017855 - RNA, 14 nt, Mycobacterium avium subsp. paratuberculosis
ggcaggcgccccag

SEQ ID NO: 3017856 - RNA, 16 nt, Mycobacterium avium subsp. paratuberculosis
ggcaggcggccagggc

SEQ ID NO: 3017857 - RNA, 12 nt, Mycobacterium avium subsp. paratuberculosis
ggcaggcggccc

SEQ ID NO: 3017858 - RNA, 14 nt, Mycobacterium avium subsp. paratuberculosis
ggcaggcggcccgc

SEQ ID NO: 3017859 - RNA, 14 nt, Mycobacterium avium subsp. paratuberculosis
ggcaggcggcgcgc

SEQ ID NO: 3017860 - RNA, 16 nt, Mycobacterium avium subsp. paratuberculosis
ggcaggcucagcagca

SEQ ID NO: 3017861 - RNA, 17 nt, Mycobacterium avium subsp. paratuberculosis
ggcaggcucagcagcac

SEQ ID NO: 3017862 - RNA, 16 nt, Mycobacterium avium subsp. paratuberculosis
ggcaggcucagguagg

SEQ ID NO: 3017863 - RNA, 23 nt, Mycobacterium avium subsp. paratuberculosis
ggcagggaauucagccugccucc

SEQ ID NO: 3017864 - RNA, 14 nt, Mycobacterium avium subsp. paratuberculosis
ggcagggcauccgg

SEQ ID NO: 3017865 - RNA, 21 nt, Mycobacterium avium subsp. paratuberculosis
ggcagggcauccgggaggcca

SEQ ID NO: 3017866 - RNA, 14 nt, Mycobacterium avium subsp. paratuberculosis
ggcagggccaccgu

SEQ ID NO: 3017867 - RNA, 14 nt, Mycobacterium avium subsp. paratuberculosis
ggcagggccagcac

SEQ ID NO: 3017868 - RNA, 17 nt, Mycobacterium avium subsp. paratuberculosis
ggcagggccagcagccc

SEQ ID NO: 3017869 - RNA, 12 nt, Mycobacterium avium subsp. paratuberculosis
ggcagggccagg

SEQ ID NO: 3017870 - RNA, 16 nt, Mycobacterium avium subsp. paratuberculosis
ggcagggccaggccgu

SEQ ID NO: 3017871 - RNA, 19 nt, Mycobacterium avium subsp. paratuberculosis
ggcagggucgcggagcggg

SEQ ID NO: 3017872 - RNA, 22 nt, Mycobacterium avium subsp. paratuberculosis
ggcagggugaccgaggccgccc

SEQ ID NO: 3017873 - RNA, 18 nt, Mycobacterium avium subsp. paratuberculosis
ggcaggguuuucacgucg

SEQ ID NO: 3017874 - RNA, 20 nt, Mycobacterium avium subsp. paratuberculosis
ggcaggguuuucacgucgag

SEQ ID NO: 3017875 - RNA, 22 nt, Mycobacterium avium subsp. paratuberculosis
ggcaggguuuucacgucgagcg

SEQ ID NO: 3017876 - RNA, 23 nt, Mycobacterium avium subsp. paratuberculosis
ggcaggguuuucacgucgagcgg

SEQ ID NO: 3017877 - RNA, 22 nt, Mycobacterium avium subsp. paratuberculosis
ggcagguacugcuugccgccgg

SEQ ID NO: 3017878 - RNA, 21 nt, Mycobacterium avium subsp. paratuberculosis
ggcaggucgaggccggccagc

SEQ ID NO: 3017879 - RNA, 22 nt, Mycobacterium avium subsp. paratuberculosis
ggcaggucgaggccggccagcg

SEQ ID NO: 3017880 - RNA, 12 nt, Mycobacterium avium subsp. paratuberculosis
ggcaggucgcgc

SEQ ID NO: 3017881 - RNA, 15 nt, Mycobacterium avium subsp. paratuberculosis
ggcaggucggccagc

SEQ ID NO: 3017882 - RNA, 16 nt, Mycobacterium avium subsp. paratuberculosis
ggcaggucggccagcg

SEQ ID NO: 3017883 - RNA, 19 nt, Mycobacterium avium subsp. paratuberculosis
ggcaggucggccagcgccg

SEQ ID NO: 3017884 - RNA, 17 nt, Mycobacterium avium subsp. paratuberculosis
ggcaggucgggcucgcg

SEQ ID NO: 3017885 - RNA, 13 nt, Mycobacterium avium subsp. paratuberculosis
ggcaggucggugc

SEQ ID NO: 3017886 - RNA, 21 nt, Mycobacterium avium subsp. paratuberculosis
ggcaggucggugcgcggggug

SEQ ID NO: 3017887 - RNA, 13 nt, Mycobacterium avium subsp. paratuberculosis
ggcaggucgucga

SEQ ID NO: 3017888 - RNA, 15 nt, Mycobacterium avium subsp. paratuberculosis
ggcaggucgucgacg

SEQ ID NO: 3017889 - RNA, 18 nt, Mycobacterium avium subsp. paratuberculosis
ggcaggucgucgacgucg

SEQ ID NO: 3017890 - RNA, 18 nt, Mycobacterium avium subsp. paratuberculosis
ggcaggucgucgucgccg

SEQ ID NO: 3017891 - RNA, 19 nt, Mycobacterium avium subsp. paratuberculosis
ggcaggucgucgucgccgc

SEQ ID NO: 3017892 - RNA, 13 nt, Mycobacterium avium subsp. paratuberculosis
ggcaggugagccg

SEQ ID NO: 3017893 - RNA, 21 nt, Mycobacterium avium subsp. paratuberculosis
ggcagguggauugucggccgc

SEQ ID NO: 3017894 - RNA, 12 nt, Mycobacterium avium subsp. paratuberculosis
ggcagguggcgu

SEQ ID NO: 3017895 - RNA, 13 nt, Mycobacterium avium subsp. paratuberculosis
ggcagguggcgua

SEQ ID NO: 3017896 - RNA, 20 nt, Mycobacterium avium subsp. paratuberculosis
ggcagguggcguagucggug

SEQ ID NO: 3017897 - RNA, 16 nt, Mycobacterium avium subsp. paratuberculosis
ggcagguggucggcga

SEQ ID NO: 3017898 - RNA, 16 nt, Mycobacterium avium subsp. paratuberculosis
ggcagguggucgguga

SEQ ID NO: 3017899 - RNA, 20 nt, Mycobacterium avium subsp. paratuberculosis
ggcagguuggggacggcgag

SEQ ID NO: 3017900 - RNA, 15 nt, Mycobacterium avium subsp. paratuberculosis
ggcagguuguugacg

SEQ ID NO: 3017901 - RNA, 21 nt, Mycobacterium avium subsp. paratuberculosis
ggcaguagccgaucuccaccg

SEQ ID NO: 3017902 - RNA, 15 nt, Mycobacterium avium subsp. paratuberculosis
ggcaguagcgcaccg

SEQ ID NO: 3017903 - RNA, 22 nt, Mycobacterium avium subsp. paratuberculosis
ggcaguagcgcaccggucagcg

SEQ ID NO: 3017904 - RNA, 22 nt, Mycobacterium avium subsp. paratuberculosis
ggcaguagugguccaccgccgc

SEQ ID NO: 3017905 - RNA, 19 nt, Mycobacterium avium subsp. paratuberculosis
ggcaguaucuuguucgccg

SEQ ID NO: 3017906 - RNA, 22 nt, Mycobacterium avium subsp. paratuberculosis
ggcaguaucuuguucgccgaca

SEQ ID NO: 3017907 - RNA, 23 nt, Mycobacterium avium subsp. paratuberculosis
ggcaguaucuuguucgccgacac

SEQ ID NO: 3017908 - RNA, 22 nt, Mycobacterium avium subsp. paratuberculosis
ggcaguccgccggagaccagca

SEQ ID NO: 3017909 - RNA, 15 nt, Mycobacterium avium subsp. paratuberculosis
ggcaguccgcgccgg

SEQ ID NO: 3017910 - RNA, 18 nt, Mycobacterium avium subsp. paratuberculosis
ggcaguccgcgccggucc

SEQ ID NO: 3017911 - RNA, 13 nt, Mycobacterium avium subsp. paratuberculosis
ggcaguccggaca

SEQ ID NO: 3017912 - RNA, 22 nt, Mycobacterium avium subsp. paratuberculosis
ggcaguccggacacggccagcg

SEQ ID NO: 3017913 - RNA, 13 nt, Mycobacterium avium subsp. paratuberculosis
ggcagucgcagca

SEQ ID NO: 3017914 - RNA, 16 nt, Mycobacterium avium subsp. paratuberculosis
ggcagucgcagcagca

SEQ ID NO: 3017915 - RNA, 22 nt, Mycobacterium avium subsp. paratuberculosis
ggcagugagggaacgccgauca

SEQ ID NO: 3017916 - RNA, 15 nt, Mycobacterium avium subsp. paratuberculosis
ggcagugaucggcgg

SEQ ID NO: 3017917 - RNA, 16 nt, Mycobacterium avium subsp. paratuberculosis
ggcagugaucggcgga

SEQ ID NO: 3017918 - RNA, 20 nt, Mycobacterium avium subsp. paratuberculosis
ggcagugcacgacgaccgcg

SEQ ID NO: 3017919 - RNA, 17 nt, Mycobacterium avium subsp. paratuberculosis
ggcagugcgccgucccg

SEQ ID NO: 3017920 - RNA, 12 nt, Mycobacterium avium subsp. paratuberculosis
ggcagugcgcgg

SEQ ID NO: 3017921 - RNA, 14 nt, Mycobacterium avium subsp. paratuberculosis
ggcagugcgcggcg

SEQ ID NO: 3017922 - RNA, 21 nt, Mycobacterium avium subsp. paratuberculosis
ggcagugugauucgggucaga

SEQ ID NO: 3017923 - RNA, 16 nt, Mycobacterium avium subsp. paratuberculosis
ggcaguuccaugucga

SEQ ID NO: 3017924 - RNA, 20 nt, Mycobacterium avium subsp. paratuberculosis
ggcaguuccaugucgacgac

SEQ ID NO: 3017925 - RNA, 16 nt, Mycobacterium avium subsp. paratuberculosis
ggcaguuccucgccgg

SEQ ID NO: 3017926 - RNA, 18 nt, Mycobacterium avium subsp. paratuberculosis
ggcaguuccucgccggag

SEQ ID NO: 3017927 - RNA, 21 nt, Mycobacterium avium subsp. paratuberculosis
ggcaguuccuugcgcagcacc

SEQ ID NO: 3017928 - RNA, 22 nt, Mycobacterium avium subsp. paratuberculosis
ggcaguuccuugcgcagcaccu

SEQ ID NO: 3017929 - RNA, 15 nt, Mycobacterium avium subsp. paratuberculosis
ggcaguucgaugccg

SEQ ID NO: 3017930 - RNA, 15 nt, Mycobacterium avium subsp. paratuberculosis
ggcaguugccggcca

SEQ ID NO: 3017931 - RNA, 22 nt, Mycobacterium avium subsp. paratuberculosis
ggcaguugccggccaucugcug

SEQ ID NO: 3017932 - RNA, 15 nt, Mycobacterium avium subsp. paratuberculosis
ggcauaccgucugcu

SEQ ID NO: 3017933 - RNA, 20 nt, Mycobacterium avium subsp. paratuberculosis
ggcauagcgccgcucggccg

SEQ ID NO: 3017934 - RNA, 14 nt, Mycobacterium avium subsp. paratuberculosis
ggcauaggccagca

SEQ ID NO: 3017935 - RNA, 17 nt, Mycobacterium avium subsp. paratuberculosis
ggcauaggccagcacca

SEQ ID NO: 3017936 - RNA, 19 nt, Mycobacterium avium subsp. paratuberculosis
ggcauaggccagcaccagc

SEQ ID NO: 3017937 - RNA, 18 nt, Mycobacterium avium subsp. paratuberculosis
ggcauaguccagcucgcg

SEQ ID NO: 3017938 - RNA, 18 nt, Mycobacterium avium subsp. paratuberculosis
ggcaucaucgcuacaccc

SEQ ID NO: 3017939 - RNA, 19 nt, Mycobacterium avium subsp. paratuberculosis
ggcaucaucggcacgccgg

SEQ ID NO: 3017940 - RNA, 12 nt, Mycobacterium avium subsp. paratuberculosis
ggcauccagcac

SEQ ID NO: 3017941 - RNA, 16 nt, Mycobacterium avium subsp. paratuberculosis
ggcauccccagcuggg

SEQ ID NO: 3017942 - RNA, 12 nt, Mycobacterium avium subsp. paratuberculosis
ggcaucccgccg

SEQ ID NO: 3017943 - RNA, 13 nt, Mycobacterium avium subsp. paratuberculosis
ggcaucccgccga

SEQ ID NO: 3017944 - RNA, 14 nt, Mycobacterium avium subsp. paratuberculosis
ggcaucccgcgccu

SEQ ID NO: 3017945 - RNA, 17 nt, Mycobacterium avium subsp. paratuberculosis
ggcaucccgcgccugcc

SEQ ID NO: 3017946 - RNA, 20 nt, Mycobacterium avium subsp. paratuberculosis
ggcaucccgcuucuggcggg

SEQ ID NO: 3017947 - RNA, 22 nt, Mycobacterium avium subsp. paratuberculosis
ggcaucccugacacgaccgccu

SEQ ID NO: 3017948 - RNA, 21 nt, Mycobacterium avium subsp. paratuberculosis
ggcaucccuuccugggacagc

SEQ ID NO: 3017949 - RNA, 14 nt, Mycobacterium avium subsp. paratuberculosis
ggcauccgcucgcc

SEQ ID NO: 3017950 - RNA, 15 nt, Mycobacterium avium subsp. paratuberculosis
ggcauccgcucgccg

SEQ ID NO: 3017951 - RNA, 17 nt, Mycobacterium avium subsp. paratuberculosis
ggcauccgcucgccgcg

SEQ ID NO: 3017952 - RNA, 18 nt, Mycobacterium avium subsp. paratuberculosis
ggcauccgcucgccgcgg

SEQ ID NO: 3017953 - RNA, 17 nt, Mycobacterium avium subsp. paratuberculosis
ggcauccgggaggccag

SEQ ID NO: 3017954 - RNA, 19 nt, Mycobacterium avium subsp. paratuberculosis
ggcaucgacaugcccggcg

SEQ ID NO: 3017955 - RNA, 23 nt, Mycobacterium avium subsp. paratuberculosis
ggcaucgacaugcccggcgacgg

SEQ ID NO: 3017956 - RNA, 13 nt, Mycobacterium avium subsp. paratuberculosis
ggcaucgaccgcc

SEQ ID NO: 3017957 - RNA, 19 nt, Mycobacterium avium subsp. paratuberculosis
ggcaucgaggaccggcgcc

SEQ ID NO: 3017958 - RNA, 20 nt, Mycobacterium avium subsp. paratuberculosis
ggcaucgaggaccggcgccg

SEQ ID NO: 3017959 - RNA, 22 nt, Mycobacterium avium subsp. paratuberculosis
ggcaucgaggaccggcgccggc

SEQ ID NO: 3017960 - RNA, 15 nt, Mycobacterium avium subsp. paratuberculosis
ggcaucgauggcggg

SEQ ID NO: 3017961 - RNA, 21 nt, Mycobacterium avium subsp. paratuberculosis
ggcaucgauggcgggcgcgcc

SEQ ID NO: 3017962 - RNA, 16 nt, Mycobacterium avium subsp. paratuberculosis
ggcaucgcagcgcgcg

SEQ ID NO: 3017963 - RNA, 22 nt, Mycobacterium avium subsp. paratuberculosis
ggcaucgcagcgcgcggcgcag

SEQ ID NO: 3017964 - RNA, 16 nt, Mycobacterium avium subsp. paratuberculosis
ggcaucgccgucaugg

SEQ ID NO: 3017965 - RNA, 14 nt, Mycobacterium avium subsp. paratuberculosis
ggcaucgcgccgca

SEQ ID NO: 3017966 - RNA, 20 nt, Mycobacterium avium subsp. paratuberculosis
ggcaucgcgcgcggcgacgg

SEQ ID NO: 3017967 - RNA, 23 nt, Mycobacterium avium subsp. paratuberculosis
ggcaucgcgcgcggcggccaccg

SEQ ID NO: 3017968 - RNA, 16 nt, Mycobacterium avium subsp. paratuberculosis
ggcaucgcugguggcc

SEQ ID NO: 3017969 - RNA, 21 nt, Mycobacterium avium subsp. paratuberculosis
ggcaucgcugguggccgacgu

SEQ ID NO: 3017970 - RNA, 16 nt, Mycobacterium avium subsp. paratuberculosis
ggcaucggcgacggcg

SEQ ID NO: 3017971 - RNA, 22 nt, Mycobacterium avium subsp. paratuberculosis
ggcaucggcgcccucgccgacc

SEQ ID NO: 3017972 - RNA, 17 nt, Mycobacterium avium subsp. paratuberculosis
ggcaucggcucguagcg

SEQ ID NO: 3017973 - RNA, 16 nt, Mycobacterium avium subsp. paratuberculosis
ggcaucggcuggucgg

SEQ ID NO: 3017974 - RNA, 18 nt, Mycobacterium avium subsp. paratuberculosis
ggcaucggcuggucggcg

SEQ ID NO: 3017975 - RNA, 19 nt, Mycobacterium avium subsp. paratuberculosis
ggcaucggcuggucggcgg

SEQ ID NO: 3017976 - RNA, 15 nt, Mycobacterium avium subsp. paratuberculosis
ggcaucgguggcacc

SEQ ID NO: 3017977 - RNA, 15 nt, Mycobacterium avium subsp. paratuberculosis
ggcaucgucggcgcc

SEQ ID NO: 3017978 - RNA, 16 nt, Mycobacterium avium subsp. paratuberculosis
ggcaucgucggcgccg

SEQ ID NO: 3017979 - RNA, 21 nt, Mycobacterium avium subsp. paratuberculosis
ggcaucgucggggacgaagac

SEQ ID NO: 3017980 - RNA, 17 nt, Mycobacterium avium subsp. paratuberculosis
ggcaugaaccaggccgc

SEQ ID NO: 3017981 - RNA, 15 nt, Mycobacterium avium subsp. paratuberculosis
ggcaugaccggccag

SEQ ID NO: 3017982 - RNA, 21 nt, Mycobacterium avium subsp. paratuberculosis
ggcaugcccguagaugccggu

SEQ ID NO: 3017983 - RNA, 14 nt, Mycobacterium avium subsp. paratuberculosis
ggcaugccgcccgg

SEQ ID NO: 3017984 - RNA, 13 nt, Mycobacterium avium subsp. paratuberculosis
ggcaugccggccg

SEQ ID NO: 3017985 - RNA, 14 nt, Mycobacterium avium subsp. paratuberculosis
ggcaugccggccgg

SEQ ID NO: 3017986 - RNA, 16 nt, Mycobacterium avium subsp. paratuberculosis
ggcaugccggccggca

SEQ ID NO: 3017987 - RNA, 18 nt, Mycobacterium avium subsp. paratuberculosis
ggcaugccgggccagccg

SEQ ID NO: 3017988 - RNA, 19 nt, Mycobacterium avium subsp. paratuberculosis
ggcaugccgggccagccgg

SEQ ID NO: 3017989 - RNA, 16 nt, Mycobacterium avium subsp. paratuberculosis
ggcaugccgucggcgc

SEQ ID NO: 3017990 - RNA, 17 nt, Mycobacterium avium subsp. paratuberculosis
ggcaugccgucggcgcc

SEQ ID NO: 3017991 - RNA, 21 nt, Mycobacterium avium subsp. paratuberculosis
ggcaugccguucagcgcggcc

SEQ ID NO: 3017992 - RNA, 22 nt, Mycobacterium avium subsp. paratuberculosis
ggcaugccguucagcgcggcca

SEQ ID NO: 3017993 - RNA, 23 nt, Mycobacterium avium subsp. paratuberculosis
ggcaugccguucagcgcggccac

SEQ ID NO: 3017994 - RNA, 12 nt, Mycobacterium avium subsp. paratuberculosis
ggcauggcugga

SEQ ID NO: 3017995 - RNA, 14 nt, Mycobacterium avium subsp. paratuberculosis
ggcaugggaucagc

SEQ ID NO: 3017996 - RNA, 15 nt, Mycobacterium avium subsp. paratuberculosis
ggcaugggaucagca

SEQ ID NO: 3017997 - RNA, 20 nt, Mycobacterium avium subsp. paratuberculosis
ggcauggucaccggagagca

SEQ ID NO: 3017998 - RNA, 20 nt, Mycobacterium avium subsp. paratuberculosis
ggcauggugucaggaucgcc

SEQ ID NO: 3017999 - RNA, 22 nt, Mycobacterium avium subsp. paratuberculosis
ggcaugucgguggacagcgcga

SEQ ID NO: 3018000 - RNA, 18 nt, Mycobacterium avium subsp. paratuberculosis
ggcauuccaccgcgcggc

SEQ ID NO: 3018001 - RNA, 22 nt, Mycobacterium avium subsp. paratuberculosis
ggcauuccaccgcgcggcgcag

SEQ ID NO: 3018002 - RNA, 14 nt, Mycobacterium avium subsp. paratuberculosis
ggcauuccagugcu

SEQ ID NO: 3018003 - RNA, 16 nt, Mycobacterium avium subsp. paratuberculosis
ggcauuccagugcucu

SEQ ID NO: 3018004 - RNA, 15 nt, Mycobacterium avium subsp. paratuberculosis
ggcauucguguggcg

SEQ ID NO: 3018005 - RNA, 19 nt, Mycobacterium avium subsp. paratuberculosis
ggcauucguguggcgcacg

SEQ ID NO: 3018006 - RNA, 21 nt, Mycobacterium avium subsp. paratuberculosis
ggcauugcccaucgccacgcc

SEQ ID NO: 3018007 - RNA, 23 nt, Mycobacterium avium subsp. paratuberculosis
ggcauuuugggggacuuucgcgu

SEQ ID NO: 3018008 - RNA, 23 nt, Mycobacterium avium subsp. paratuberculosis
ggccaaaucgcuugcgccgcagc

SEQ ID NO: 3018009 - RNA, 17 nt, Mycobacterium avium subsp. paratuberculosis
ggccaacagcagcagaa

SEQ ID NO: 3018010 - RNA, 20 nt, Mycobacterium avium subsp. paratuberculosis
ggccaacagcagcagaacca

SEQ ID NO: 3018011 - RNA, 22 nt, Mycobacterium avium subsp. paratuberculosis
ggccaacagcagcagaaccagc

SEQ ID NO: 3018012 - RNA, 19 nt, Mycobacterium avium subsp. paratuberculosis
ggccaacagcagcgccgcg

SEQ ID NO: 3018013 - RNA, 21 nt, Mycobacterium avium subsp. paratuberculosis
ggccaacagcagcgccgcggc

SEQ ID NO: 3018014 - RNA, 18 nt, Mycobacterium avium subsp. paratuberculosis
ggccaacagugcgcaggc

SEQ ID NO: 3018015 - RNA, 20 nt, Mycobacterium avium subsp. paratuberculosis
ggccaacagugcgcaggcgg

SEQ ID NO: 3018016 - RNA, 21 nt, Mycobacterium avium subsp. paratuberculosis
ggccaacagugcgcaggcggc

SEQ ID NO: 3018017 - RNA, 22 nt, Mycobacterium avium subsp. paratuberculosis
ggccaacagugcgcaggcggcg

SEQ ID NO: 3018018 - RNA, 17 nt, Mycobacterium avium subsp. paratuberculosis
ggccaacccgggcgcca

SEQ ID NO: 3018019 - RNA, 15 nt, Mycobacterium avium subsp. paratuberculosis
ggccaaccgcccggc

SEQ ID NO: 3018020 - RNA, 18 nt, Mycobacterium avium subsp. paratuberculosis
ggccaaccgcccggcgcc

SEQ ID NO: 3018021 - RNA, 19 nt, Mycobacterium avium subsp. paratuberculosis
ggccaaccgcccggcgccg

SEQ ID NO: 3018022 - RNA, 22 nt, Mycobacterium avium subsp. paratuberculosis
ggccaaccgcccggcgccgauc

SEQ ID NO: 3018023 - RNA, 15 nt, Mycobacterium avium subsp. paratuberculosis
ggccaacgagcgcgc

SEQ ID NO: 3018024 - RNA, 16 nt, Mycobacterium avium subsp. paratuberculosis
ggccaacgagcgcgcc

SEQ ID NO: 3018025 - RNA, 18 nt, Mycobacterium avium subsp. paratuberculosis
ggccaacgagcgcgccga

SEQ ID NO: 3018026 - RNA, 20 nt, Mycobacterium avium subsp. paratuberculosis
ggccaacgagcgcgccgagg

SEQ ID NO: 3018027 - RNA, 19 nt, Mycobacterium avium subsp. paratuberculosis
ggccaacgccucgucgacc

SEQ ID NO: 3018028 - RNA, 22 nt, Mycobacterium avium subsp. paratuberculosis
ggccaacgccucgucgaccgcg

SEQ ID NO: 3018029 - RNA, 23 nt, Mycobacterium avium subsp. paratuberculosis
ggccaacgcgacgaagccggugc

SEQ ID NO: 3018030 - RNA, 21 nt, Mycobacterium avium subsp. paratuberculosis
ggccaacgcgauucucgcugc

SEQ ID NO: 3018031 - RNA, 20 nt, Mycobacterium avium subsp. paratuberculosis
ggccaacgcguucuccucga

SEQ ID NO: 3018032 - RNA, 22 nt, Mycobacterium avium subsp. paratuberculosis
ggccaacgcguucuccucgaac

SEQ ID NO: 3018033 - RNA, 23 nt, Mycobacterium avium subsp. paratuberculosis
ggccaacgggaagagcggcguga

SEQ ID NO: 3018034 - RNA, 15 nt, Mycobacterium avium subsp. paratuberculosis
ggccaacgguucggc

SEQ ID NO: 3018035 - RNA, 16 nt, Mycobacterium avium subsp. paratuberculosis
ggccaacgguucggcc

SEQ ID NO: 3018036 - RNA, 19 nt, Mycobacterium avium subsp. paratuberculosis
ggccaacgguucggccgcu

SEQ ID NO: 3018037 - RNA, 23 nt, Mycobacterium avium subsp. paratuberculosis
ggccaacgguucggccgcucggg

SEQ ID NO: 3018038 - RNA, 16 nt, Mycobacterium avium subsp. paratuberculosis
ggccaacuccggcggc

SEQ ID NO: 3018039 - RNA, 17 nt, Mycobacterium avium subsp. paratuberculosis
ggccaacuccggcggca

SEQ ID NO: 3018040 - RNA, 19 nt, Mycobacterium avium subsp. paratuberculosis
gcucaacacguccuggcgc

SEQ ID NO: 3018041 - RNA, 14 nt, Mycobacterium avium subsp. paratuberculosis
gcucaacaggcgag

SEQ ID NO: 3018042 - RNA, 16 nt, Mycobacterium avium subsp. paratuberculosis
gcucaacccgucgcgg

SEQ ID NO: 3018043 - RNA, 17 nt, Mycobacterium avium subsp. paratuberculosis
gcucaacgauuuccggu

SEQ ID NO: 3018044 - RNA, 23 nt, Mycobacterium avium subsp. paratuberculosis
gcucaacgauuuccgguuccucg

SEQ ID NO: 3018045 - RNA, 14 nt, Mycobacterium avium subsp. paratuberculosis
gcucaacggccggc

SEQ ID NO: 3018046 - RNA, 15 nt, Mycobacterium avium subsp. paratuberculosis
gcucaacggccggcg

SEQ ID NO: 3018047 - RNA, 18 nt, Mycobacterium avium subsp. paratuberculosis
gcucaacggccggcgccg

SEQ ID NO: 3018048 - RNA, 20 nt, Mycobacterium avium subsp. paratuberculosis
gcucaacggccggcgccgcc

SEQ ID NO: 3018049 - RNA, 20 nt, Mycobacterium avium subsp. paratuberculosis
gcucaacgugauacgccgac

SEQ ID NO: 3018050 - RNA, 19 nt, Mycobacterium avium subsp. paratuberculosis
gcucaacuugaucagcucg

SEQ ID NO: 3018051 - RNA, 18 nt, Mycobacterium avium subsp. paratuberculosis
gcucaaguccucgguggc

SEQ ID NO: 3018052 - RNA, 21 nt, Mycobacterium avium subsp. paratuberculosis
gcucaaugccuuugccguggc

SEQ ID NO: 3018053 - RNA, 22 nt, Mycobacterium avium subsp. paratuberculosis
gcucaaugccuuugccguggcg

SEQ ID NO: 3018054 - RNA, 14 nt, Mycobacterium avium subsp. paratuberculosis
gcucacagcgcggc

SEQ ID NO: 3018055 - RNA, 15 nt, Mycobacterium avium subsp. paratuberculosis
gcucacagcgcggcg

SEQ ID NO: 3018056 - RNA, 18 nt, Mycobacterium avium subsp. paratuberculosis
gcucacagcgcggcggug

SEQ ID NO: 3018057 - RNA, 18 nt, Mycobacterium avium subsp. paratuberculosis
gcucacaugggcgcguug

SEQ ID NO: 3018058 - RNA, 22 nt, Mycobacterium avium subsp. paratuberculosis
gcucacccaaaaaggcgcgggu

SEQ ID NO: 3018059 - RNA, 18 nt, Mycobacterium avium subsp. paratuberculosis
gcucacccagcgagaccg

SEQ ID NO: 3018060 - RNA, 15 nt, Mycobacterium avium subsp. paratuberculosis
gcucaccccggccag

SEQ ID NO: 3018061 - RNA, 17 nt, Mycobacterium avium subsp. paratuberculosis
gcucacccggcccaccg

SEQ ID NO: 3018062 - RNA, 20 nt, Mycobacterium avium subsp. paratuberculosis
gcucacccggcccaccggcc

SEQ ID NO: 3018063 - RNA, 24 nt, Mycobacterium avium subsp. paratuberculosis
gcucacccggcccaccggcccggc

SEQ ID NO: 3018064 - RNA, 20 nt, Mycobacterium avium subsp. paratuberculosis
gcucaccgagcugggccggc

SEQ ID NO: 3018065 - RNA, 22 nt, Mycobacterium avium subsp. paratuberculosis
gcucaccgagcugggccggcgc

SEQ ID NO: 3018066 - RNA, 21 nt, Mycobacterium avium subsp. paratuberculosis
gcucaccgcaucgaaccgccg

SEQ ID NO: 3018067 - RNA, 15 nt, Mycobacterium avium subsp. paratuberculosis
gcucaccgccgagcc

SEQ ID NO: 3018068 - RNA, 16 nt, Mycobacterium avium subsp. paratuberculosis
gcucaccgccgagccg

SEQ ID NO: 3018069 - RNA, 17 nt, Mycobacterium avium subsp. paratuberculosis
gcucaccgccgagccgc

SEQ ID NO: 3018070 - RNA, 23 nt, Mycobacterium avium subsp. paratuberculosis
gcucaccgccgagccgcuccacc

SEQ ID NO: 3018071 - RNA, 15 nt, Mycobacterium avium subsp. paratuberculosis
gcucaccgccgauga

SEQ ID NO: 3018072 - RNA, 15 nt, Mycobacterium avium subsp. paratuberculosis
gcucaccgcggggug

SEQ ID NO: 3018073 - RNA, 17 nt, Mycobacterium avium subsp. paratuberculosis
gcucaccggccagggcc

SEQ ID NO: 3018074 - RNA, 23 nt, Mycobacterium avium subsp. paratuberculosis
gcucaccggccagggccgccgca

SEQ ID NO: 3018075 - RNA, 14 nt, Mycobacterium avium subsp. paratuberculosis
gcucaccugcggcc

SEQ ID NO: 3018076 - RNA, 15 nt, Mycobacterium avium subsp. paratuberculosis
gcucaccugcggccc

SEQ ID NO: 3018077 - RNA, 17 nt, Mycobacterium avium subsp. paratuberculosis
gcucacgacuccuggcc

SEQ ID NO: 3018078 - RNA, 21 nt, Mycobacterium avium subsp. paratuberculosis
gcucacgcucggccaggguga

SEQ ID NO: 3018079 - RNA, 11 nt, Mycobacterium avium subsp. paratuberculosis
gcucacggugu

SEQ ID NO: 3018080 - RNA, 21 nt, Mycobacterium avium subsp. paratuberculosis
gcucacguagucgaccgggau

SEQ ID NO: 3018081 - RNA, 21 nt, Mycobacterium avium subsp. paratuberculosis
gcucacucgucuugcagccgg

SEQ ID NO: 3018082 - RNA, 23 nt, Mycobacterium avium subsp. paratuberculosis
gcucacucgucuugcagccgggg

SEQ ID NO: 3018083 - RNA, 18 nt, Mycobacterium avium subsp. paratuberculosis
gcucagacugccgagcau

SEQ ID NO: 3018084 - RNA, 17 nt, Mycobacterium avium subsp. paratuberculosis
gcucagagcugcaccgg

SEQ ID NO: 3018085 - RNA, 20 nt, Mycobacterium avium subsp. paratuberculosis
gcucagcaacccgccgagcg

SEQ ID NO: 3018086 - RNA, 21 nt, Mycobacterium avium subsp. paratuberculosis
gcucagcaacccgccgagcgu

SEQ ID NO: 3018087 - RNA, 22 nt, Mycobacterium avium subsp. paratuberculosis
gcucagcaacccgccgagcgug

SEQ ID NO: 3018088 - RNA, 23 nt, Mycobacterium avium subsp. paratuberculosis
gcucagcacgcggaucgcgcuga

SEQ ID NO: 3018089 - RNA, 14 nt, Mycobacterium avium subsp. paratuberculosis
gcucagcagcaccg

SEQ ID NO: 3018090 - RNA, 15 nt, Mycobacterium avium subsp. paratuberculosis
gcucagcagcaccgc

SEQ ID NO: 3018091 - RNA, 16 nt, Mycobacterium avium subsp. paratuberculosis
gcucagcagcaccgca

SEQ ID NO: 3018092 - RNA, 16 nt, Mycobacterium avium subsp. paratuberculosis
gcucagccacgccggc

SEQ ID NO: 3018093 - RNA, 13 nt, Mycobacterium avium subsp. paratuberculosis
gcucagccccagc

SEQ ID NO: 3018094 - RNA, 16 nt, Mycobacterium avium subsp. paratuberculosis
gcucagcccgauucag

SEQ ID NO: 3018095 - RNA, 21 nt, Mycobacterium avium subsp. paratuberculosis
gcucagcccgauucagccggc

SEQ ID NO: 3018096 - RNA, 22 nt, Mycobacterium avium subsp. paratuberculosis
gcucagcccggaaaaccccacc

SEQ ID NO: 3018097 - RNA, 14 nt, Mycobacterium avium subsp. paratuberculosis
gcucagcccggcgc

SEQ ID NO: 3018098 - RNA, 22 nt, Mycobacterium avium subsp. paratuberculosis
gcucagcccggcgcucaccgcg

SEQ ID NO: 3018099 - RNA, 17 nt, Mycobacterium avium subsp. paratuberculosis
gcucagccgaagccggc

SEQ ID NO: 3018100 - RNA, 15 nt, Mycobacterium avium subsp. paratuberculosis
gcucagccgccuggc

SEQ ID NO: 3018101 - RNA, 16 nt, Mycobacterium avium subsp. paratuberculosis
gcucagccgccuggcg

SEQ ID NO: 3018102 - RNA, 23 nt, Mycobacterium avium subsp. paratuberculosis
gcucagccguucgcugcccucgg

SEQ ID NO: 3018103 - RNA, 21 nt, Mycobacterium avium subsp. paratuberculosis
gcucagccuagccuuggccgc

SEQ ID NO: 3018104 - RNA, 20 nt, Mycobacterium avium subsp. paratuberculosis
gcucagcgauugcggccgcc

SEQ ID NO: 3018105 - RNA, 22 nt, Mycobacterium avium subsp. paratuberculosis
gcucagcgauugcggccgccgg

SEQ ID NO: 3018106 - RNA, 24 nt, Mycobacterium avium subsp. paratuberculosis
gcucagcgauugcggccgccggcc

SEQ ID NO: 3018107 - RNA, 14 nt, Mycobacterium avium subsp. paratuberculosis
gcucagcgcaccgc

SEQ ID NO: 3018108 - RNA, 15 nt, Mycobacterium avium subsp. paratuberculosis
gcucagcgcaccgcc

SEQ ID NO: 3018109 - RNA, 16 nt, Mycobacterium avium subsp. paratuberculosis
gcucagcgcaccgccg

SEQ ID NO: 3018110 - RNA, 18 nt, Mycobacterium avium subsp. paratuberculosis
gcucagcgcgacgugccg

SEQ ID NO: 3018111 - RNA, 23 nt, Mycobacterium avium subsp. paratuberculosis
gcucagcgcgacgugccggcgau

SEQ ID NO: 3018112 - RNA, 13 nt, Mycobacterium avium subsp. paratuberculosis
gcucagcgcggcg

SEQ ID NO: 3018113 - RNA, 16 nt, Mycobacterium avium subsp. paratuberculosis
gcucagcgcggcgggc

SEQ ID NO: 3018114 - RNA, 20 nt, Mycobacterium avium subsp. paratuberculosis
gcucagcggaaccgacaccu

SEQ ID NO: 3018115 - RNA, 23 nt, Mycobacterium avium subsp. paratuberculosis
gcucagcggaaccgacaccucgc

SEQ ID NO: 3018116 - RNA, 11 nt, Mycobacterium avium subsp. paratuberculosis
gcucagcggca

SEQ ID NO: 3018117 - RNA, 17 nt, Mycobacterium avium subsp. paratuberculosis
gcucagcggcaacugca

SEQ ID NO: 3018118 - RNA, 19 nt, Mycobacterium avium subsp. paratuberculosis
gcucagcggcagcgucgcc

SEQ ID NO: 3018119 - RNA, 15 nt, Mycobacterium avium subsp. paratuberculosis
gcucagcggccaucg

SEQ ID NO: 3018120 - RNA, 15 nt, Mycobacterium avium subsp. paratuberculosis
gcucagcgggcggcc

SEQ ID NO: 3018121 - RNA, 18 nt, Mycobacterium avium subsp. paratuberculosis
gcucagcgggcggccagc

SEQ ID NO: 3018122 - RNA, 21 nt, Mycobacterium avium subsp. paratuberculosis
gcucagcgggcggccagccgc

SEQ ID NO: 3018123 - RNA, 22 nt, Mycobacterium avium subsp. paratuberculosis
gcucagcgggcggccagccgcu

SEQ ID NO: 3018124 - RNA, 19 nt, Mycobacterium avium subsp. paratuberculosis
gcucagcucccgagcaucg

SEQ ID NO: 3018125 - RNA, 20 nt, Mycobacterium avium subsp. paratuberculosis
gcucagcucccgagcaucgc

SEQ ID NO: 3018126 - RNA, 22 nt, Mycobacterium avium subsp. paratuberculosis
gcucagcucccgagcaucgccg

SEQ ID NO: 3018127 - RNA, 17 nt, Mycobacterium avium subsp. paratuberculosis
gcucagcugcugcgcgg

SEQ ID NO: 3018128 - RNA, 19 nt, Mycobacterium avium subsp. paratuberculosis
gcucagcugcugcgcggcg

SEQ ID NO: 3018129 - RNA, 17 nt, Mycobacterium avium subsp. paratuberculosis
gcucaggaacggccgga

SEQ ID NO: 3018130 - RNA, 23 nt, Mycobacterium avium subsp. paratuberculosis
gcucaggaacggccggauggcca

SEQ ID NO: 3018131 - RNA, 16 nt, Mycobacterium avium subsp. paratuberculosis
gcucaggacgaacgcu

SEQ ID NO: 3018132 - RNA, 16 nt, Mycobacterium avium subsp. paratuberculosis
gcucaggaucagcagc

SEQ ID NO: 3018133 - RNA, 20 nt, Mycobacterium avium subsp. paratuberculosis
gcucaggaugauuucggcgu

SEQ ID NO: 3018134 - RNA, 21 nt, Mycobacterium avium subsp. paratuberculosis
gcucaggaugauuucggcgug

SEQ ID NO: 3018135 - RNA, 15 nt, Mycobacterium avium subsp. paratuberculosis
gcucaggccgguggc

SEQ ID NO: 3018136 - RNA, 15 nt, Mycobacterium avium subsp. paratuberculosis
gcucaggcguccagc

SEQ ID NO: 3018137 - RNA, 18 nt, Mycobacterium avium subsp. paratuberculosis
gcucaggcguccagccag

SEQ ID NO: 3018138 - RNA, 19 nt, Mycobacterium avium subsp. paratuberculosis
gcucaggcguccagccagc

SEQ ID NO: 3018139 - RNA, 17 nt, Mycobacterium avium subsp. paratuberculosis
gcucagggugcgcuggc

SEQ ID NO: 3018140 - RNA, 13 nt, Mycobacterium avium subsp. paratuberculosis
gcucagguaggcg

SEQ ID NO: 3018141 - RNA, 19 nt, Mycobacterium avium subsp. paratuberculosis
gcucaggucggccgcggcc

SEQ ID NO: 3018142 - RNA, 17 nt, Mycobacterium avium subsp. paratuberculosis
gcucaggugcgacgccc

SEQ ID NO: 3018143 - RNA, 12 nt, Mycobacterium avium subsp. paratuberculosis
gcucagguugcg

SEQ ID NO: 3018144 - RNA, 11 nt, Mycobacterium avium subsp. paratuberculosis
gcucagugcac

SEQ ID NO: 3018145 - RNA, 18 nt, Mycobacterium avium subsp. paratuberculosis
gcucagugcacgcucggc

SEQ ID NO: 3018146 - RNA, 19 nt, Mycobacterium avium subsp. paratuberculosis
gcucagugcacgcucggcg

SEQ ID NO: 3018147 - RNA, 21 nt, Mycobacterium avium subsp. paratuberculosis
gcucagugucacugcgguaga

SEQ ID NO: 3018148 - RNA, 16 nt, Mycobacterium avium subsp. paratuberculosis
gcucauacagcggcgc

SEQ ID NO: 3018149 - RNA, 22 nt, Mycobacterium avium subsp. paratuberculosis
gcucauacagcggcgcgcgccg

SEQ ID NO: 3018150 - RNA, 15 nt, Mycobacterium avium subsp. paratuberculosis
gcucauacggcggcu

SEQ ID NO: 3018151 - RNA, 16 nt, Mycobacterium avium subsp. paratuberculosis
gcucauacggcggcuc

SEQ ID NO: 3018152 - RNA, 17 nt, Mycobacterium avium subsp. paratuberculosis
gcucauacggcggcucg

SEQ ID NO: 3018153 - RNA, 13 nt, Mycobacterium avium subsp. paratuberculosis
gcucaucaccggc

SEQ ID NO: 3018154 - RNA, 18 nt, Mycobacterium avium subsp. paratuberculosis
gcucaucaccggcgcgcc

SEQ ID NO: 3018155 - RNA, 20 nt, Mycobacterium avium subsp. paratuberculosis
gcucaucaccggcgcgccgu

SEQ ID NO: 3018156 - RNA, 15 nt, Mycobacterium avium subsp. paratuberculosis
gcucaucaggcggcc

SEQ ID NO: 3018157 - RNA, 19 nt, Mycobacterium avium subsp. paratuberculosis
gcucaucccuagcgugccg

SEQ ID NO: 3018158 - RNA, 21 nt, Mycobacterium avium subsp. paratuberculosis
gcucaucgaggucgaaccacg

SEQ ID NO: 3018159 - RNA, 22 nt, Mycobacterium avium subsp. paratuberculosis
gcucaucgaggucgaaccacgc

SEQ ID NO: 3018160 - RNA, 13 nt, Mycobacterium avium subsp. paratuberculosis
gcucaucgucguu

SEQ ID NO: 3018161 - RNA, 18 nt, Mycobacterium avium subsp. paratuberculosis
gcucaucguguccagcau

SEQ ID NO: 3018162 - RNA, 19 nt, Mycobacterium avium subsp. paratuberculosis
gcucaucguguccagcaug

SEQ ID NO: 3018163 - RNA, 17 nt, Mycobacterium avium subsp. paratuberculosis
gcucaugagcccuccag

SEQ ID NO: 3018164 - RNA, 14 nt, Mycobacterium avium subsp. paratuberculosis
gcucaugcccgcca

SEQ ID NO: 3018165 - RNA, 18 nt, Mycobacterium avium subsp. paratuberculosis
gcucaugcccgccacggc

SEQ ID NO: 3018166 - RNA, 21 nt, Mycobacterium avium subsp. paratuberculosis
gcucaugucaaugccgcagcc

SEQ ID NO: 3018167 - RNA, 22 nt, Mycobacterium avium subsp. paratuberculosis
gcucaugucaaugccgcagccg

SEQ ID NO: 3018168 - RNA, 20 nt, Mycobacterium avium subsp. paratuberculosis
gcucaugucguacgggcgca

SEQ ID NO: 3018169 - RNA, 22 nt, Mycobacterium avium subsp. paratuberculosis
gcucaugucguacgggcgcagc

SEQ ID NO: 3018170 - RNA, 17 nt, Mycobacterium avium subsp. paratuberculosis
gcucauguggggggucg

SEQ ID NO: 3018171 - RNA, 22 nt, Mycobacterium avium subsp. paratuberculosis
gcucauguugugcaggcagccg

SEQ ID NO: 3018172 - RNA, 15 nt, Mycobacterium avium subsp. paratuberculosis
gcuccaacagccggu

SEQ ID NO: 3018173 - RNA, 16 nt, Mycobacterium avium subsp. paratuberculosis
gcuccaaugcggccga

SEQ ID NO: 3018174 - RNA, 17 nt, Mycobacterium avium subsp. paratuberculosis
gcuccacaucugccggc

SEQ ID NO: 3018175 - RNA, 19 nt, Mycobacterium avium subsp. paratuberculosis
gcuccacaucugccggcag

SEQ ID NO: 3018176 - RNA, 13 nt, Mycobacterium avium subsp. paratuberculosis
gcuccaccagcgc

SEQ ID NO: 3018177 - RNA, 18 nt, Mycobacterium avium subsp. paratuberculosis
gcuccaccagcgcgguga

SEQ ID NO: 3018178 - RNA, 15 nt, Mycobacterium avium subsp. paratuberculosis
gcuccaccagguucg

SEQ ID NO: 3018179 - RNA, 21 nt, Mycobacterium avium subsp. paratuberculosis
gcuccaccagguucgcgcagc

SEQ ID NO: 3018180 - RNA, 22 nt, Mycobacterium avium subsp. paratuberculosis
gcuccaccagguucgcgcagcu

SEQ ID NO: 3018181 - RNA, 16 nt, Mycobacterium avium subsp. paratuberculosis
gcuccaccgaaaagcc

SEQ ID NO: 3018182 - RNA, 22 nt, Mycobacterium avium subsp. paratuberculosis
gcuccaccgaaaagcccgccgc

SEQ ID NO: 3018183 - RNA, 13 nt, Mycobacterium avium subsp. paratuberculosis
gcuccaccgcgcc

SEQ ID NO: 3018184 - RNA, 16 nt, Mycobacterium avium subsp. paratuberculosis
gcuccaccgcgccggc

SEQ ID NO: 3018185 - RNA, 22 nt, Mycobacterium avium subsp. paratuberculosis
gcuccaccgcgccggcggcggc

SEQ ID NO: 3018186 - RNA, 14 nt, Mycobacterium avium subsp. paratuberculosis
gcuccaccgcgucc

SEQ ID NO: 3018187 - RNA, 13 nt, Mycobacterium avium subsp. paratuberculosis
gcuccaccugcgg

SEQ ID NO: 3018188 - RNA, 14 nt, Mycobacterium avium subsp. paratuberculosis
gcuccaccugcggc

SEQ ID NO: 3018189 - RNA, 13 nt, Mycobacterium avium subsp. paratuberculosis
gcuccacgccgcc

SEQ ID NO: 3018190 - RNA, 14 nt, Mycobacterium avium subsp. paratuberculosis
gcuccacgccgccg

SEQ ID NO: 3018191 - RNA, 15 nt, Mycobacterium avium subsp. paratuberculosis
gcuccacgccgccgg

SEQ ID NO: 3018192 - RNA, 20 nt, Mycobacterium avium subsp. paratuberculosis
gcuccacgccgccgggaaca

SEQ ID NO: 3018193 - RNA, 16 nt, Mycobacterium avium subsp. paratuberculosis
gcuccagaugcggugg

SEQ ID NO: 3018194 - RNA, 18 nt, Mycobacterium avium subsp. paratuberculosis
gcuccagaugcgguggug

SEQ ID NO: 3018195 - RNA, 15 nt, Mycobacterium avium subsp. paratuberculosis
gcuccagcagcccgg

SEQ ID NO: 3018196 - RNA, 16 nt, Mycobacterium avium subsp. paratuberculosis
gcuccagcagcccggg

SEQ ID NO: 3018197 - RNA, 12 nt, Mycobacterium avium subsp. paratuberculosis
gcuccagcagcg

SEQ ID NO: 3018198 - RNA, 14 nt, Mycobacterium avium subsp. paratuberculosis
gcuccagcagcggc

SEQ ID NO: 3018199 - RNA, 14 nt, Mycobacterium avium subsp. paratuberculosis
gcuccagcaggcgc

SEQ ID NO: 3018200 - RNA, 18 nt, Mycobacterium avium subsp. paratuberculosis
gcuccagccacuccacca

SEQ ID NO: 3018201 - RNA, 18 nt, Mycobacterium avium subsp. paratuberculosis
gcuccagcgaguuggcca

SEQ ID NO: 3018202 - RNA, 12 nt, Mycobacterium avium subsp. paratuberculosis
gcuccagcgccc

SEQ ID NO: 3018203 - RNA, 15 nt, Mycobacterium avium subsp. paratuberculosis
gcuccagcgcccgcc

SEQ ID NO: 3018204 - RNA, 14 nt, Mycobacterium avium subsp. paratuberculosis
gcuccagcggccac

SEQ ID NO: 3018205 - RNA, 15 nt, Mycobacterium avium subsp. paratuberculosis
gcuccagcggccaca

SEQ ID NO: 3018206 - RNA, 18 nt, Mycobacterium avium subsp. paratuberculosis
gcuccagcggccacaccg

SEQ ID NO: 3018207 - RNA, 17 nt, Mycobacterium avium subsp. paratuberculosis
gcuccagcgggcggcgg

SEQ ID NO: 3018208 - RNA, 18 nt, Mycobacterium avium subsp. paratuberculosis
gcuccagcgggcggcggu

SEQ ID NO: 3018209 - RNA, 19 nt, Mycobacterium avium subsp. paratuberculosis
gcuccagcgggcggcggug

SEQ ID NO: 3018210 - RNA, 21 nt, Mycobacterium avium subsp. paratuberculosis
gcuccagcgggcggcgguggc

SEQ ID NO: 3018211 - RNA, 22 nt, Mycobacterium avium subsp. paratuberculosis
gcuccagcggguccagccgccg

SEQ ID NO: 3018212 - RNA, 23 nt, Mycobacterium avium subsp. paratuberculosis
gcuccagcggguccagccgccgg

SEQ ID NO: 3018213 - RNA, 20 nt, Mycobacterium avium subsp. paratuberculosis
gcuccagcuaggagccugcu

SEQ ID NO: 3018214 - RNA, 15 nt, Mycobacterium avium subsp. paratuberculosis
gcuccaugaaccggu

SEQ ID NO: 3018215 - RNA, 19 nt, Mycobacterium avium subsp. paratuberculosis
gcuccaugaaccggucguu

SEQ ID NO: 3018216 - RNA, 14 nt, Mycobacterium avium subsp. paratuberculosis
gcuccauggcggcg

SEQ ID NO: 3018217 - RNA, 15 nt, Mycobacterium avium subsp. paratuberculosis
gcuccauggcggcga

SEQ ID NO: 3018218 - RNA, 16 nt, Mycobacterium avium subsp. paratuberculosis
gcuccauggcggcgac

SEQ ID NO: 3018219 - RNA, 17 nt, Mycobacterium avium subsp. paratuberculosis
gcuccauguucggggcg

SEQ ID NO: 3018220 - RNA, 21 nt, Mycobacterium avium subsp. paratuberculosis
gcucccagcucagacugccga

SEQ ID NO: 3018221 - RNA, 18 nt, Mycobacterium avium subsp. paratuberculosis
gcucccaggacgcgguga

SEQ ID NO: 3018222 - RNA, 19 nt, Mycobacterium avium subsp. paratuberculosis
gcucccaggacggcgcggu

SEQ ID NO: 3018223 - RNA, 22 nt, Mycobacterium avium subsp. paratuberculosis
gcucccaggacggcgcgguggc

SEQ ID NO: 3018224 - RNA, 14 nt, Mycobacterium avium subsp. paratuberculosis
gcucccaggcgucg

SEQ ID NO: 3018225 - RNA, 17 nt, Mycobacterium avium subsp. paratuberculosis
gcucccaggcgucgucg

SEQ ID NO: 3018226 - RNA, 20 nt, Mycobacterium avium subsp. paratuberculosis
gcucccauccggaagcgggg

SEQ ID NO: 3018227 - RNA, 15 nt, Mycobacterium avium subsp. paratuberculosis
gcucccccgacaccg

SEQ ID NO: 3018228 - RNA, 16 nt, Mycobacterium avium subsp. paratuberculosis
gcucccccgacaccgc

SEQ ID NO: 3018229 - RNA, 18 nt, Mycobacterium avium subsp. paratuberculosis
gcucccccgacaccgcca

SEQ ID NO: 3018230 - RNA, 23 nt, Mycobacterium avium subsp. paratuberculosis
gcucccccgacaccgccagcagc

SEQ ID NO: 3018231 - RNA, 23 nt, Mycobacterium avium subsp. paratuberculosis
gcucccccggaccugccggcgau

SEQ ID NO: 3018232 - RNA, 13 nt, Mycobacterium avium subsp. paratuberculosis
gcucccccggcgu

SEQ ID NO: 3018233 - RNA, 17 nt, Mycobacterium avium subsp. paratuberculosis
gcucccccggcgugagc

SEQ ID NO: 3018234 - RNA, 14 nt, Mycobacterium avium subsp. paratuberculosis
gcucccccgucggg

SEQ ID NO: 3018235 - RNA, 16 nt, Mycobacterium avium subsp. paratuberculosis
gcucccccgucgggcc

SEQ ID NO: 3018236 - RNA, 19 nt, Mycobacterium avium subsp. paratuberculosis
gcuccccgaccacaccggc

SEQ ID NO: 3018237 - RNA, 20 nt, Mycobacterium avium subsp. paratuberculosis
gcuccccgaccacaccggcg

SEQ ID NO: 3018238 - RNA, 21 nt, Mycobacterium avium subsp. paratuberculosis
gcuccccgagcacgucgagca

SEQ ID NO: 3018239 - RNA, 17 nt, Mycobacterium avium subsp. paratuberculosis
gcuccccguugaucuug

SEQ ID NO: 3018240 - RNA, 14 nt, Mycobacterium avium subsp. paratuberculosis
gcucccgagcaucg

SEQ ID NO: 3018241 - RNA, 22 nt, Mycobacterium avium subsp. paratuberculosis
gcucccgauggcucgcgggggc

SEQ ID NO: 3018242 - RNA, 23 nt, Mycobacterium avium subsp. paratuberculosis
gcucccgauggcucgcgggggcc

SEQ ID NO: 3018243 - RNA, 16 nt, Mycobacterium avium subsp. paratuberculosis
gcucccgcagcggggc

SEQ ID NO: 3018244 - RNA, 19 nt, Mycobacterium avium subsp. paratuberculosis
gcucccgcagcggggcgcu

SEQ ID NO: 3018245 - RNA, 14 nt, Mycobacterium avium subsp. paratuberculosis
gcucccgccgagau

SEQ ID NO: 3018246 - RNA, 13 nt, Mycobacterium avium subsp. paratuberculosis
gcucccgcucgcc

SEQ ID NO: 3018247 - RNA, 20 nt, Mycobacterium avium subsp. paratuberculosis
gcucccgcucgccaugcgac

SEQ ID NO: 3018248 - RNA, 20 nt, Mycobacterium avium subsp. paratuberculosis
gcucccggcagaucgcggcc

SEQ ID NO: 3018249 - RNA, 21 nt, Mycobacterium avium subsp. paratuberculosis
gcucccggcagaucgcggccc

SEQ ID NO: 3018250 - RNA, 22 nt, Mycobacterium avium subsp. paratuberculosis
gcucccggcagaucgcggcccg

SEQ ID NO: 3018251 - RNA, 15 nt, Mycobacterium avium subsp. paratuberculosis
gcucccggcgcagca

SEQ ID NO: 3018252 - RNA, 13 nt, Mycobacterium avium subsp. paratuberculosis
gcucccggcgccg

SEQ ID NO: 3018253 - RNA, 16 nt, Mycobacterium avium subsp. paratuberculosis
gcucccggcgccgccg

SEQ ID NO: 3018254 - RNA, 18 nt, Mycobacterium avium subsp. paratuberculosis
gcucccgggacagcccga

SEQ ID NO: 3018255 - RNA, 12 nt, Mycobacterium avium subsp. paratuberculosis
gcucccgggcgg

SEQ ID NO: 3018256 - RNA, 14 nt, Mycobacterium avium subsp. paratuberculosis
gcucccgggcggcg

SEQ ID NO: 3018257 - RNA, 16 nt, Mycobacterium avium subsp. paratuberculosis
gcucccgggcggcgcc

SEQ ID NO: 3018258 - RNA, 22 nt, Mycobacterium avium subsp. paratuberculosis
gcucccggucguagucggcccg

SEQ ID NO: 3018259 - RNA, 14 nt, Mycobacterium avium subsp. paratuberculosis
gcuccgacgcggug

SEQ ID NO: 3018260 - RNA, 19 nt, Mycobacterium avium subsp. paratuberculosis
gcuccgacgcgguggcgug

SEQ ID NO: 3018261 - RNA, 14 nt, Mycobacterium avium subsp. paratuberculosis
gcuccgaucuccug

SEQ ID NO: 3018262 - RNA, 17 nt, Mycobacterium avium subsp. paratuberculosis
gcuccgaucuccuggug

SEQ ID NO: 3018263 - RNA, 21 nt, Mycobacterium avium subsp. paratuberculosis
gcuccgaucuccuggugucgu

SEQ ID NO: 3018264 - RNA, 15 nt, Mycobacterium avium subsp. paratuberculosis
gcuccgcaugcccgg

SEQ ID NO: 3018265 - RNA, 18 nt, Mycobacterium avium subsp. paratuberculosis
gcuccgcaugcccgggcg

SEQ ID NO: 3018266 - RNA, 12 nt, Mycobacterium avium subsp. paratuberculosis
gcuccgccaccc

SEQ ID NO: 3018267 - RNA, 21 nt, Mycobacterium avium subsp. paratuberculosis
gcuccgccacccugcgcaccg

SEQ ID NO: 3018268 - RNA, 22 nt, Mycobacterium avium subsp. paratuberculosis
gcuccgccacccugcgcaccgc

SEQ ID NO: 3018269 - RNA, 13 nt, Mycobacterium avium subsp. paratuberculosis
gcuccgccgacac

SEQ ID NO: 3018270 - RNA, 15 nt, Mycobacterium avium subsp. paratuberculosis
gcuccgccgacacca

SEQ ID NO: 3018271 - RNA, 20 nt, Mycobacterium avium subsp. paratuberculosis
gcuccgcgcugaccagcgug

SEQ ID NO: 3018272 - RNA, 13 nt, Mycobacterium avium subsp. paratuberculosis
gcuccgcggccag

SEQ ID NO: 3018273 - RNA, 14 nt, Mycobacterium avium subsp. paratuberculosis
gcuccgcggccagc

SEQ ID NO: 3018274 - RNA, 15 nt, Mycobacterium avium subsp. paratuberculosis
gcuccgcggccagcu

SEQ ID NO: 3018275 - RNA, 17 nt, Mycobacterium avium subsp. paratuberculosis
gcuccgcggccagcucg

SEQ ID NO: 3018276 - RNA, 14 nt, Mycobacterium avium subsp. paratuberculosis
gcuccgcgggcagc

SEQ ID NO: 3018277 - RNA, 16 nt, Mycobacterium avium subsp. paratuberculosis
gcuccgcgggcagcga

SEQ ID NO: 3018278 - RNA, 21 nt, Mycobacterium avium subsp. paratuberculosis
gcuccgcguucgaccuccacg

SEQ ID NO: 3018279 - RNA, 20 nt, Mycobacterium avium subsp. paratuberculosis
gcuccggcccgagcaccacc

SEQ ID NO: 3018280 - RNA, 17 nt, Mycobacterium avium subsp. paratuberculosis
gcuccggccgcgccggc

SEQ ID NO: 3018281 - RNA, 18 nt, Mycobacterium avium subsp. paratuberculosis
gcuccggccgcgccggcc

SEQ ID NO: 3018282 - RNA, 15 nt, Mycobacterium avium subsp. paratuberculosis
gcuccggcggaccca

SEQ ID NO: 3018283 - RNA, 19 nt, Mycobacterium avium subsp. paratuberculosis
gcuccggcggacccagcuc

SEQ ID NO: 3018284 - RNA, 21 nt, Mycobacterium avium subsp. paratuberculosis
gcuccggcggacccagcuccu

SEQ ID NO: 3018285 - RNA, 13 nt, Mycobacterium avium subsp. paratuberculosis
gcuccggcgucga

SEQ ID NO: 3018286 - RNA, 15 nt, Mycobacterium avium subsp. paratuberculosis
gcuccgggguggccu

SEQ ID NO: 3018287 - RNA, 16 nt, Mycobacterium avium subsp. paratuberculosis
gcuccgggucgaccgc

SEQ ID NO: 3018288 - RNA, 19 nt, Mycobacterium avium subsp. paratuberculosis
gcuccggucgcgucgugcg

SEQ ID NO: 3018289 - RNA, 14 nt, Mycobacterium avium subsp. paratuberculosis
gcuccggucggcgc

SEQ ID NO: 3018290 - RNA, 15 nt, Mycobacterium avium subsp. paratuberculosis
gcuccggucggcgcu

SEQ ID NO: 3018291 - RNA, 18 nt, Mycobacterium avium subsp. paratuberculosis
gcuccggucggcgcucgc

SEQ ID NO: 3018292 - RNA, 18 nt, Mycobacterium avium subsp. paratuberculosis
gcuccggugauucgugca

SEQ ID NO: 3018293 - RNA, 15 nt, Mycobacterium avium subsp. paratuberculosis
gcuccguccaccggc

SEQ ID NO: 3018294 - RNA, 17 nt, Mycobacterium avium subsp. paratuberculosis
gcuccguccaccggcac

SEQ ID NO: 3018295 - RNA, 22 nt, Mycobacterium avium subsp. paratuberculosis
gcuccguugggucucaucccgc

SEQ ID NO: 3018296 - RNA, 16 nt, Mycobacterium avium subsp. paratuberculosis
gcuccuaugucggugc

SEQ ID NO: 3018297 - RNA, 21 nt, Mycobacterium avium subsp. paratuberculosis
gcuccuccggguccccgccgc

SEQ ID NO: 3018298 - RNA, 16 nt, Mycobacterium avium subsp. paratuberculosis
gcuccuccucgcgccg

SEQ ID NO: 3018299 - RNA, 18 nt, Mycobacterium avium subsp. paratuberculosis
gcuccuccucgcgccgcc

SEQ ID NO: 3018300 - RNA, 22 nt, Mycobacterium avium subsp. paratuberculosis
gcuccuccucgcgccgccacgc

SEQ ID NO: 3018301 - RNA, 19 nt, Mycobacterium avium subsp. paratuberculosis
gcuccucgaaccucgcggc

SEQ ID NO: 3018302 - RNA, 22 nt, Mycobacterium avium subsp. paratuberculosis
gcuccucgaaccucgcggcggc

SEQ ID NO: 3018303 - RNA, 18 nt, Mycobacterium avium subsp. paratuberculosis
gcuccucgaccacgcaca

SEQ ID NO: 3018304 - RNA, 19 nt, Mycobacterium avium subsp. paratuberculosis
gcuccucgcggaacugcuc

SEQ ID NO: 3018305 - RNA, 12 nt, Mycobacterium avium subsp. paratuberculosis
gcuccucggcca

SEQ ID NO: 3018306 - RNA, 13 nt, Mycobacterium avium subsp. paratuberculosis
gcuccucggccag

SEQ ID NO: 3018307 - RNA, 15 nt, Mycobacterium avium subsp. paratuberculosis
gcuccucggccagca

SEQ ID NO: 3018308 - RNA, 17 nt, Mycobacterium avium subsp. paratuberculosis
gcuccucggccagcacc

SEQ ID NO: 3018309 - RNA, 18 nt, Mycobacterium avium subsp. paratuberculosis
gcuccucggccagcacca

SEQ ID NO: 3018310 - RNA, 19 nt, Mycobacterium avium subsp. paratuberculosis
gcuccucggccagcaccag

SEQ ID NO: 3018311 - RNA, 23 nt, Mycobacterium avium subsp. paratuberculosis
gcuccucggccagcaccagcagc

SEQ ID NO: 3018312 - RNA, 24 nt, Mycobacterium avium subsp. paratuberculosis
gcuccucggccagcaccagcagcc

SEQ ID NO: 3018313 - RNA, 15 nt, Mycobacterium avium subsp. paratuberculosis
gcuccucggccagcg

SEQ ID NO: 3018314 - RNA, 12 nt, Mycobacterium avium subsp. paratuberculosis
gcuccucggccc

SEQ ID NO: 3018315 - RNA, 13 nt, Mycobacterium avium subsp. paratuberculosis
gcuccucggcggc

SEQ ID NO: 3018316 - RNA, 16 nt, Mycobacterium avium subsp. paratuberculosis
gcuccucggcggccuc

SEQ ID NO: 3018317 - RNA, 17 nt, Mycobacterium avium subsp. paratuberculosis
gcuccucggucagcggc

SEQ ID NO: 3018318 - RNA, 18 nt, Mycobacterium avium subsp. paratuberculosis
gcuccucggucagcggcg

SEQ ID NO: 3018319 - RNA, 11 nt, Mycobacterium avium subsp. paratuberculosis
gcuccucggug

SEQ ID NO: 3018320 - RNA, 11 nt, Mycobacterium avium subsp. paratuberculosis
gcuccugcagc

SEQ ID NO: 3018321 - RNA, 23 nt, Mycobacterium avium subsp. paratuberculosis
gcuccugcaggccgagccgccgg

SEQ ID NO: 3018322 - RNA, 15 nt, Mycobacterium avium subsp. paratuberculosis
gcuccugccagcggc

SEQ ID NO: 3018323 - RNA, 15 nt, Mycobacterium avium subsp. paratuberculosis
gcuccugccguucgg

SEQ ID NO: 3018324 - RNA, 15 nt, Mycobacterium avium subsp. paratuberculosis
gcuccuggccggacg

SEQ ID NO: 3018325 - RNA, 17 nt, Mycobacterium avium subsp. paratuberculosis
gcuccuugagccgccgc

SEQ ID NO: 3018326 - RNA, 21 nt, Mycobacterium avium subsp. paratuberculosis
gcucgaaaugccuuggcggcg

SEQ ID NO: 3018327 - RNA, 22 nt, Mycobacterium avium subsp. paratuberculosis
gcucgaaaugccuuggcggcgu

SEQ ID NO: 3018328 - RNA, 16 nt, Mycobacterium avium subsp. paratuberculosis
gcucgaacaacccggc

SEQ ID NO: 3018329 - RNA, 22 nt, Mycobacterium avium subsp. paratuberculosis
gcucgaacaacccggccgcgau

SEQ ID NO: 3018330 - RNA, 16 nt, Mycobacterium avium subsp. paratuberculosis
gcgucgggcuugcgca

SEQ ID NO: 3018331 - RNA, 22 nt, Mycobacterium avium subsp. paratuberculosis
gcgucgggcuugcgcaacagcg

SEQ ID NO: 3018332 - RNA, 12 nt, Mycobacterium avium subsp. paratuberculosis
gcgucgggggug

SEQ ID NO: 3018333 - RNA, 16 nt, Mycobacterium avium subsp. paratuberculosis
gcgucgggggugccgc

SEQ ID NO: 3018334 - RNA, 22 nt, Mycobacterium avium subsp. paratuberculosis
gcgucggguacaccgagccggg

SEQ ID NO: 3018335 - RNA, 18 nt, Mycobacterium avium subsp. paratuberculosis
gcgucggguagggcgccg

SEQ ID NO: 3018336 - RNA, 23 nt, Mycobacterium avium subsp. paratuberculosis
gcgucggguagggcgccgucggc

SEQ ID NO: 3018337 - RNA, 22 nt, Mycobacterium avium subsp. paratuberculosis
gcgucgguaaucggcgguggug

SEQ ID NO: 3018338 - RNA, 17 nt, Mycobacterium avium subsp. paratuberculosis
gcgucgguaggugucga

SEQ ID NO: 3018339 - RNA, 20 nt, Mycobacterium avium subsp. paratuberculosis
gcgucgguaggugucgauga

SEQ ID NO: 3018340 - RNA, 12 nt, Mycobacterium avium subsp. paratuberculosis
gcgucggucagc

SEQ ID NO: 3018341 - RNA, 13 nt, Mycobacterium avium subsp. paratuberculosis
gcgucggucagca

SEQ ID NO: 3018342 - RNA, 24 nt, Mycobacterium avium subsp. paratuberculosis
gcgucggucagcaggcgccgcagc

SEQ ID NO: 3018343 - RNA, 16 nt, Mycobacterium avium subsp. paratuberculosis
gcgucggucagcggcg

SEQ ID NO: 3018344 - RNA, 17 nt, Mycobacterium avium subsp. paratuberculosis
gcgucggucagcggcgu

SEQ ID NO: 3018345 - RNA, 18 nt, Mycobacterium avium subsp. paratuberculosis
gcgucggucagcggcguc

SEQ ID NO: 3018346 - RNA, 20 nt, Mycobacterium avium subsp. paratuberculosis
gcgucggucagcggcgucag

SEQ ID NO: 3018347 - RNA, 23 nt, Mycobacterium avium subsp. paratuberculosis
gcgucgguccaaaacaucccgga

SEQ ID NO: 3018348 - RNA, 13 nt, Mycobacterium avium subsp. paratuberculosis
gcgucggucucga

SEQ ID NO: 3018349 - RNA, 18 nt, Mycobacterium avium subsp. paratuberculosis
gcgucggucucgacguug

SEQ ID NO: 3018350 - RNA, 18 nt, Mycobacterium avium subsp. paratuberculosis
gcgucggugaugccggac

SEQ ID NO: 3018351 - RNA, 16 nt, Mycobacterium avium subsp. paratuberculosis
gcgucggugaugucgg

SEQ ID NO: 3018352 - RNA, 16 nt, Mycobacterium avium subsp. paratuberculosis
gcgucggugucccgcg

SEQ ID NO: 3018353 - RNA, 17 nt, Mycobacterium avium subsp. paratuberculosis
gcgucguacaccucggu

SEQ ID NO: 3018354 - RNA, 19 nt, Mycobacterium avium subsp. paratuberculosis
gcgucguacaccucggucg

SEQ ID NO: 3018355 - RNA, 15 nt, Mycobacterium avium subsp. paratuberculosis
gcgucguacagcagc

SEQ ID NO: 3018356 - RNA, 16 nt, Mycobacterium avium subsp. paratuberculosis
gcgucguacagcagcc

SEQ ID NO: 3018357 - RNA, 17 nt, Mycobacterium avium subsp. paratuberculosis
gcgucguacagcagccc

SEQ ID NO: 3018358 - RNA, 18 nt, Mycobacterium avium subsp. paratuberculosis
gcgucguacagcagcccc

SEQ ID NO: 3018359 - RNA, 19 nt, Mycobacterium avium subsp. paratuberculosis
gcgucguagacgcugccgc

SEQ ID NO: 3018360 - RNA, 17 nt, Mycobacterium avium subsp. paratuberculosis
gcgucguagagcugacg

SEQ ID NO: 3018361 - RNA, 18 nt, Mycobacterium avium subsp. paratuberculosis
gcgucguagagcugacgg

SEQ ID NO: 3018362 - RNA, 23 nt, Mycobacterium avium subsp. paratuberculosis
gcgucguagagcugacgggaccg

SEQ ID NO: 3018363 - RNA, 19 nt, Mycobacterium avium subsp. paratuberculosis
gcgucguagccggcacgca

SEQ ID NO: 3018364 - RNA, 19 nt, Mycobacterium avium subsp. paratuberculosis
gcgucguaguaacgcgaga

SEQ ID NO: 3018365 - RNA, 17 nt, Mycobacterium avium subsp. paratuberculosis
gcgucguagucgcucgg

SEQ ID NO: 3018366 - RNA, 18 nt, Mycobacterium avium subsp. paratuberculosis
gcgucguagucgcucggc

SEQ ID NO: 3018367 - RNA, 19 nt, Mycobacterium avium subsp. paratuberculosis
gcgucguagucgcucggcg

SEQ ID NO: 3018368 - RNA, 21 nt, Mycobacterium avium subsp. paratuberculosis
gcgucguagucgcucggcggc

SEQ ID NO: 3018369 - RNA, 22 nt, Mycobacterium avium subsp. paratuberculosis
gcgucguagucgcucggcggcg

SEQ ID NO: 3018370 - RNA, 21 nt, Mycobacterium avium subsp. paratuberculosis
gcgucugcucgccggcuaccg

SEQ ID NO: 3018371 - RNA, 16 nt, Mycobacterium avium subsp. paratuberculosis
gcgucugcucgccguc

SEQ ID NO: 3018372 - RNA, 14 nt, Mycobacterium avium subsp. paratuberculosis
gcgucugcucgcgg

SEQ ID NO: 3018373 - RNA, 14 nt, Mycobacterium avium subsp. paratuberculosis
gcgucugcucggcg

SEQ ID NO: 3018374 - RNA, 17 nt, Mycobacterium avium subsp. paratuberculosis
gcgucugcucggcggcu

SEQ ID NO: 3018375 - RNA, 14 nt, Mycobacterium avium subsp. paratuberculosis
gcgucugcugcgcc

SEQ ID NO: 3018376 - RNA, 15 nt, Mycobacterium avium subsp. paratuberculosis
gcgucugcugcgcca

SEQ ID NO: 3018377 - RNA, 21 nt, Mycobacterium avium subsp. paratuberculosis
gcgucugcuggauggucucgc

SEQ ID NO: 3018378 - RNA, 16 nt, Mycobacterium avium subsp. paratuberculosis
gcgucuggcagccggc

SEQ ID NO: 3018379 - RNA, 19 nt, Mycobacterium avium subsp. paratuberculosis
gcgucuggcagccggccgg

SEQ ID NO: 3018380 - RNA, 23 nt, Mycobacterium avium subsp. paratuberculosis
gcgucuggccggagcggugcggc

SEQ ID NO: 3018381 - RNA, 18 nt, Mycobacterium avium subsp. paratuberculosis
gcgucuucuucucgccgu

SEQ ID NO: 3018382 - RNA, 21 nt, Mycobacterium avium subsp. paratuberculosis
gcgucuucuucucgccguccc

SEQ ID NO: 3018383 - RNA, 15 nt, Mycobacterium avium subsp. paratuberculosis
gcgucuugacgaacu

SEQ ID NO: 3018384 - RNA, 20 nt, Mycobacterium avium subsp. paratuberculosis
gcgucuugacgaacuccugc

SEQ ID NO: 3018385 - RNA, 16 nt, Mycobacterium avium subsp. paratuberculosis
gcgucuuggaaagcgc

SEQ ID NO: 3018386 - RNA, 16 nt, Mycobacterium avium subsp. paratuberculosis
gcgucuuggacgcccg

SEQ ID NO: 3018387 - RNA, 17 nt, Mycobacterium avium subsp. paratuberculosis
gcgucuuggacgcccgc

SEQ ID NO: 3018388 - RNA, 19 nt, Mycobacterium avium subsp. paratuberculosis
gcgucuuguuggcgaaguc

SEQ ID NO: 3018389 - RNA, 17 nt, Mycobacterium avium subsp. paratuberculosis
gcgucuuuucccacacg

SEQ ID NO: 3018390 - RNA, 22 nt, Mycobacterium avium subsp. paratuberculosis
gcgucuuuucccacacgcucgg

SEQ ID NO: 3018391 - RNA, 20 nt, Mycobacterium avium subsp. paratuberculosis
gcgugaaacuagcuucacgc

SEQ ID NO: 3018392 - RNA, 24 nt, Mycobacterium avium subsp. paratuberculosis
gcgugaaacuagcuucacgcucgg

SEQ ID NO: 3018393 - RNA, 16 nt, Mycobacterium avium subsp. paratuberculosis
gcgugaaaucguggcu

SEQ ID NO: 3018394 - RNA, 18 nt, Mycobacterium avium subsp. paratuberculosis
gcgugaacagcgcccggc

SEQ ID NO: 3018395 - RNA, 20 nt, Mycobacterium avium subsp. paratuberculosis
gcgugaacgugugggugagc

SEQ ID NO: 3018396 - RNA, 24 nt, Mycobacterium avium subsp. paratuberculosis
gcgugaagcuagcuucacgcucgg

SEQ ID NO: 3018397 - RNA, 20 nt, Mycobacterium avium subsp. paratuberculosis
gcgugaauccucagcacggc

SEQ ID NO: 3018398 - RNA, 21 nt, Mycobacterium avium subsp. paratuberculosis
gcgugaaucuuggccagcagc

SEQ ID NO: 3018399 - RNA, 15 nt, Mycobacterium avium subsp. paratuberculosis
gcgugacaagccggc

SEQ ID NO: 3018400 - RNA, 17 nt, Mycobacterium avium subsp. paratuberculosis
gcgugacaagccggcgu

SEQ ID NO: 3018401 - RNA, 19 nt, Mycobacterium avium subsp. paratuberculosis
gcgugacacuacgguagcc

SEQ ID NO: 3018402 - RNA, 13 nt, Mycobacterium avium subsp. paratuberculosis
gcgugacacucgg

SEQ ID NO: 3018403 - RNA, 16 nt, Mycobacterium avium subsp. paratuberculosis
gcgugacacucgguca

SEQ ID NO: 3018404 - RNA, 21 nt, Mycobacterium avium subsp. paratuberculosis
gcgugacacucggucaccggu

SEQ ID NO: 3018405 - RNA, 22 nt, Mycobacterium avium subsp. paratuberculosis
gcgugacacucggucaccggug

SEQ ID NO: 3018406 - RNA, 19 nt, Mycobacterium avium subsp. paratuberculosis
gcgugacaggggcagcagc

SEQ ID NO: 3018407 - RNA, 18 nt, Mycobacterium avium subsp. paratuberculosis
gcgugacagucgaccucg

SEQ ID NO: 3018408 - RNA, 20 nt, Mycobacterium avium subsp. paratuberculosis
gcgugacagucgaccucgcg

SEQ ID NO: 3018409 - RNA, 21 nt, Mycobacterium avium subsp. paratuberculosis
gcgugacagucgaccucgcgc

SEQ ID NO: 3018410 - RNA, 23 nt, Mycobacterium avium subsp. paratuberculosis
gcgugacccugccgucaccggcc

SEQ ID NO: 3018411 - RNA, 13 nt, Mycobacterium avium subsp. paratuberculosis
gcgugaccggcgg

SEQ ID NO: 3018412 - RNA, 14 nt, Mycobacterium avium subsp. paratuberculosis
gcgugaccggcggu

SEQ ID NO: 3018413 - RNA, 20 nt, Mycobacterium avium subsp. paratuberculosis
gcgugaccggcugcucgcgc

SEQ ID NO: 3018414 - RNA, 14 nt, Mycobacterium avium subsp. paratuberculosis
gcgugaccucgacg

SEQ ID NO: 3018415 - RNA, 19 nt, Mycobacterium avium subsp. paratuberculosis
gcgugaccucgacggugcu

SEQ ID NO: 3018416 - RNA, 15 nt, Mycobacterium avium subsp. paratuberculosis
gcgugaccugcuggg

SEQ ID NO: 3018417 - RNA, 17 nt, Mycobacterium avium subsp. paratuberculosis
gcgugaccugcugggcg

SEQ ID NO: 3018418 - RNA, 15 nt, Mycobacterium avium subsp. paratuberculosis
gcgugacgcccggcg

SEQ ID NO: 3018419 - RNA, 22 nt, Mycobacterium avium subsp. paratuberculosis
gcgugacgccgcugcgugcccg

SEQ ID NO: 3018420 - RNA, 14 nt, Mycobacterium avium subsp. paratuberculosis
gcgugacgccgggc

SEQ ID NO: 3018421 - RNA, 16 nt, Mycobacterium avium subsp. paratuberculosis
gcgugacgccgggccg

SEQ ID NO: 3018422 - RNA, 17 nt, Mycobacterium avium subsp. paratuberculosis
gcgugacgccgggccgc

SEQ ID NO: 3018423 - RNA, 13 nt, Mycobacterium avium subsp. paratuberculosis
gcgugacgcgcgu

SEQ ID NO: 3018424 - RNA, 17 nt, Mycobacterium avium subsp. paratuberculosis
gcgugacgcgcgugacg

SEQ ID NO: 3018425 - RNA, 21 nt, Mycobacterium avium subsp. paratuberculosis
gcgugacgcgcgugacggcgg

SEQ ID NO: 3018426 - RNA, 13 nt, Mycobacterium avium subsp. paratuberculosis
gcgugacgcucga

SEQ ID NO: 3018427 - RNA, 15 nt, Mycobacterium avium subsp. paratuberculosis
gcgugacgcucgacg

SEQ ID NO: 3018428 - RNA, 21 nt, Mycobacterium avium subsp. paratuberculosis
gcgugacgcucgacggccggc

SEQ ID NO: 3018429 - RNA, 17 nt, Mycobacterium avium subsp. paratuberculosis
gcgugacgcucgaggcc

SEQ ID NO: 3018430 - RNA, 21 nt, Mycobacterium avium subsp. paratuberculosis
gcgugacgcucgaggccccgc

SEQ ID NO: 3018431 - RNA, 17 nt, Mycobacterium avium subsp. paratuberculosis
gcgugacgcucgccggc

SEQ ID NO: 3018432 - RNA, 15 nt, Mycobacterium avium subsp. paratuberculosis
gcgugacgcucgcgu

SEQ ID NO: 3018433 - RNA, 13 nt, Mycobacterium avium subsp. paratuberculosis
gcgugacgcucgg

SEQ ID NO: 3018434 - RNA, 14 nt, Mycobacterium avium subsp. paratuberculosis
gcgugacgcucggc

SEQ ID NO: 3018435 - RNA, 22 nt, Mycobacterium avium subsp. paratuberculosis
gcgugacgcucggccguggccg

SEQ ID NO: 3018436 - RNA, 18 nt, Mycobacterium avium subsp. paratuberculosis
gcgugacgcucggcgccg

SEQ ID NO: 3018437 - RNA, 21 nt, Mycobacterium avium subsp. paratuberculosis
gcgugacgcucggcgccgcgg

SEQ ID NO: 3018438 - RNA, 19 nt, Mycobacterium avium subsp. paratuberculosis
gcgugacgcucggcgccgg

SEQ ID NO: 3018439 - RNA, 20 nt, Mycobacterium avium subsp. paratuberculosis
gcgugacgcucggcgccggc

SEQ ID NO: 3018440 - RNA, 23 nt, Mycobacterium avium subsp. paratuberculosis
gcgugacgcucggcgcgucgucc

SEQ ID NO: 3018441 - RNA, 21 nt, Mycobacterium avium subsp. paratuberculosis
gcgugacgcucgggcuucggc

SEQ ID NO: 3018442 - RNA, 20 nt, Mycobacterium avium subsp. paratuberculosis
gcgugacggaugugacgcgg

SEQ ID NO: 3018443 - RNA, 23 nt, Mycobacterium avium subsp. paratuberculosis
gcgugacggaugugacgcgggac

SEQ ID NO: 3018444 - RNA, 13 nt, Mycobacterium avium subsp. paratuberculosis
gcgugacggccgc

SEQ ID NO: 3018445 - RNA, 17 nt, Mycobacterium avium subsp. paratuberculosis
gcgugacggccgcggcg

SEQ ID NO: 3018446 - RNA, 15 nt, Mycobacterium avium subsp. paratuberculosis
gcgugacgucgacgu

SEQ ID NO: 3018447 - RNA, 13 nt, Mycobacterium avium subsp. paratuberculosis
gcgugacguucgg

SEQ ID NO: 3018448 - RNA, 14 nt, Mycobacterium avium subsp. paratuberculosis
gcgugacguucggc

SEQ ID NO: 3018449 - RNA, 16 nt, Mycobacterium avium subsp. paratuberculosis
gcgugacguucggcca

SEQ ID NO: 3018450 - RNA, 14 nt, Mycobacterium avium subsp. paratuberculosis
gcgugacguucguc

SEQ ID NO: 3018451 - RNA, 18 nt, Mycobacterium avium subsp. paratuberculosis
gcgugacuugucgggccg

SEQ ID NO: 3018452 - RNA, 20 nt, Mycobacterium avium subsp. paratuberculosis
gcgugacuugucgggccgca

SEQ ID NO: 3018453 - RNA, 21 nt, Mycobacterium avium subsp. paratuberculosis
gcgugacuugucgggccgcac

SEQ ID NO: 3018454 - RNA, 15 nt, Mycobacterium avium subsp. paratuberculosis
gcgugcggccgcagc

SEQ ID NO: 3018455 - RNA, 15 nt, Mycobacterium avium subsp. paratuberculosis
gcgugcggggugugc

SEQ ID NO: 3018456 - RNA, 15 nt, Mycobacterium avium subsp. paratuberculosis
gcgugcgggucgcgc

SEQ ID NO: 3018457 - RNA, 18 nt, Mycobacterium avium subsp. paratuberculosis
gcgugcgggucgcgcggc

SEQ ID NO: 3018458 - RNA, 15 nt, Mycobacterium avium subsp. paratuberculosis
gcgugcggguggccg

SEQ ID NO: 3018459 - RNA, 17 nt, Mycobacterium avium subsp. paratuberculosis
gcgugcgguuggcccgc

SEQ ID NO: 3018460 - RNA, 23 nt, Mycobacterium avium subsp. paratuberculosis
gcgugcgguuggcccgcggcgcc

SEQ ID NO: 3018461 - RNA, 20 nt, Mycobacterium avium subsp. paratuberculosis
gcgugcgucacgcuggugac

SEQ ID NO: 3018462 - RNA, 13 nt, Mycobacterium avium subsp. paratuberculosis
gcgugcuccagca

SEQ ID NO: 3018463 - RNA, 15 nt, Mycobacterium avium subsp. paratuberculosis
gcgugcuccagcagg

SEQ ID NO: 3018464 - RNA, 16 nt, Mycobacterium avium subsp. paratuberculosis
gcgugcuccagcaggc

SEQ ID NO: 3018465 - RNA, 20 nt, Mycobacterium avium subsp. paratuberculosis
gcgugcuccagcaggcgcgc

SEQ ID NO: 3018466 - RNA, 13 nt, Mycobacterium avium subsp. paratuberculosis
gcgugcucgauga

SEQ ID NO: 3018467 - RNA, 14 nt, Mycobacterium avium subsp. paratuberculosis
gcgugcucggccac

SEQ ID NO: 3018468 - RNA, 19 nt, Mycobacterium avium subsp. paratuberculosis
gcgugcucggccacgacgc

SEQ ID NO: 3018469 - RNA, 21 nt, Mycobacterium avium subsp. paratuberculosis
gcgugcucggccacgacgcgc

SEQ ID NO: 3018470 - RNA, 16 nt, Mycobacterium avium subsp. paratuberculosis
gcgugcucgucgcgga

SEQ ID NO: 3018471 - RNA, 19 nt, Mycobacterium avium subsp. paratuberculosis
gcgugcucgucgcggagga

SEQ ID NO: 3018472 - RNA, 19 nt, Mycobacterium avium subsp. paratuberculosis
gcgugcugacgucgucgcc

SEQ ID NO: 3018473 - RNA, 18 nt, Mycobacterium avium subsp. paratuberculosis
gcgugcugaugcuguucg

SEQ ID NO: 3018474 - RNA, 21 nt, Mycobacterium avium subsp. paratuberculosis
gcgugcugccggacaccccgg

SEQ ID NO: 3018475 - RNA, 15 nt, Mycobacterium avium subsp. paratuberculosis
gcgugcugcgcagca

SEQ ID NO: 3018476 - RNA, 15 nt, Mycobacterium avium subsp. paratuberculosis
gcgugcugggcaccg

SEQ ID NO: 3018477 - RNA, 19 nt, Mycobacterium avium subsp. paratuberculosis
gcgugcugggcaccgucga

SEQ ID NO: 3018478 - RNA, 15 nt, Mycobacterium avium subsp. paratuberculosis
gcgugcugggccacg

SEQ ID NO: 3018479 - RNA, 23 nt, Mycobacterium avium subsp. paratuberculosis
gcgugcuggggguggcgucgacg

SEQ ID NO: 3018480 - RNA, 13 nt, Mycobacterium avium subsp. paratuberculosis
gcgugcuugaacg

SEQ ID NO: 3018481 - RNA, 19 nt, Mycobacterium avium subsp. paratuberculosis
gcgugcuugaacgccgccc

SEQ ID NO: 3018482 - RNA, 23 nt, Mycobacterium avium subsp. paratuberculosis
gcgugcuugaacgccgcccccgc

SEQ ID NO: 3018483 - RNA, 14 nt, Mycobacterium avium subsp. paratuberculosis
gcgugcuugccgau

SEQ ID NO: 3018484 - RNA, 16 nt, Mycobacterium avium subsp. paratuberculosis
gcguggaacgcgucgc

SEQ ID NO: 3018485 - RNA, 18 nt, Mycobacterium avium subsp. paratuberculosis
gcguggaacgcgucgcgc

SEQ ID NO: 3018486 - RNA, 22 nt, Mycobacterium avium subsp. paratuberculosis
gcguggaacgcgucgcgccagc

SEQ ID NO: 3018487 - RNA, 14 nt, Mycobacterium avium subsp. paratuberculosis
gcguggauggccgg

SEQ ID NO: 3018488 - RNA, 17 nt, Mycobacterium avium subsp. paratuberculosis
gcguggauggccggccg

SEQ ID NO: 3018489 - RNA, 18 nt, Mycobacterium avium subsp. paratuberculosis
gcguggauggccggccgg

SEQ ID NO: 3018490 - RNA, 20 nt, Mycobacterium avium subsp. paratuberculosis
gcguggauggccggccgggu

SEQ ID NO: 3018491 - RNA, 13 nt, Mycobacterium avium subsp. paratuberculosis
gcguggcacccgg

SEQ ID NO: 3018492 - RNA, 15 nt, Mycobacterium avium subsp. paratuberculosis
gcguggcacccgggc

SEQ ID NO: 3018493 - RNA, 21 nt, Mycobacterium avium subsp. paratuberculosis
gcguggcagcggucggcggcu

SEQ ID NO: 3018494 - RNA, 16 nt, Mycobacterium avium subsp. paratuberculosis
gcguggcaggccauca

SEQ ID NO: 3018495 - RNA, 22 nt, Mycobacterium avium subsp. paratuberculosis
gcguggcaggccaucagcccgg

SEQ ID NO: 3018496 - RNA, 12 nt, Mycobacterium avium subsp. paratuberculosis
gcguggcaggcg

SEQ ID NO: 3018497 - RNA, 12 nt, Mycobacterium avium subsp. paratuberculosis
gcguggccagca

SEQ ID NO: 3018498 - RNA, 17 nt, Mycobacterium avium subsp. paratuberculosis
gcguggcccagccggug

SEQ ID NO: 3018499 - RNA, 19 nt, Mycobacterium avium subsp. paratuberculosis
gcguggcccagccggugcg

SEQ ID NO: 3018500 - RNA, 13 nt, Mycobacterium avium subsp. paratuberculosis
gcguggccgccag

SEQ ID NO: 3018501 - RNA, 22 nt, Mycobacterium avium subsp. paratuberculosis
gcguggccguccgaaucguuga

SEQ ID NO: 3018502 - RNA, 15 nt, Mycobacterium avium subsp. paratuberculosis
gcguggccugggcga

SEQ ID NO: 3018503 - RNA, 16 nt, Mycobacterium avium subsp. paratuberculosis
gcguggcgcacagcgu

SEQ ID NO: 3018504 - RNA, 15 nt, Mycobacterium avium subsp. paratuberculosis
gcguggcgccggcgc

SEQ ID NO: 3018505 - RNA, 16 nt, Mycobacterium avium subsp. paratuberculosis
gcguggcgccggcgcg

SEQ ID NO: 3018506 - RNA, 17 nt, Mycobacterium avium subsp. paratuberculosis
gcguggcgccggcgcgc

SEQ ID NO: 3018507 - RNA, 13 nt, Mycobacterium avium subsp. paratuberculosis
gcguggcgcgccc

SEQ ID NO: 3018508 - RNA, 17 nt, Mycobacterium avium subsp. paratuberculosis
gcguggcgcgccccggc

SEQ ID NO: 3018509 - RNA, 19 nt, Mycobacterium avium subsp. paratuberculosis
gcguggcgggccaggcgga

SEQ ID NO: 3018510 - RNA, 13 nt, Mycobacterium avium subsp. paratuberculosis
gcguggcggucgg

SEQ ID NO: 3018511 - RNA, 17 nt, Mycobacterium avium subsp. paratuberculosis
gcguggcgguggcggcg

SEQ ID NO: 3018512 - RNA, 13 nt, Mycobacterium avium subsp. paratuberculosis
gcguggcgucggc

SEQ ID NO: 3018513 - RNA, 14 nt, Mycobacterium avium subsp. paratuberculosis
gcguggcgucggcg

SEQ ID NO: 3018514 - RNA, 17 nt, Mycobacterium avium subsp. paratuberculosis
gcguggcgucggcgcgc

SEQ ID NO: 3018515 - RNA, 20 nt, Mycobacterium avium subsp. paratuberculosis
gcguggcgucggugaacucg

SEQ ID NO: 3018516 - RNA, 16 nt, Mycobacterium avium subsp. paratuberculosis
gcguggcucggcccgc

SEQ ID NO: 3018517 - RNA, 21 nt, Mycobacterium avium subsp. paratuberculosis
gcguggcucggcccgccgggc

SEQ ID NO: 3018518 - RNA, 16 nt, Mycobacterium avium subsp. paratuberculosis
gcguggcucucguccu

SEQ ID NO: 3018519 - RNA, 17 nt, Mycobacterium avium subsp. paratuberculosis
gcgugggauccgagggu

SEQ ID NO: 3018520 - RNA, 12 nt, Mycobacterium avium subsp. paratuberculosis
gcgugggccgca

SEQ ID NO: 3018521 - RNA, 14 nt, Mycobacterium avium subsp. paratuberculosis
gcgugggccgcagc

SEQ ID NO: 3018522 - RNA, 19 nt, Mycobacterium avium subsp. paratuberculosis
gcgugggccgcagcgcggc

SEQ ID NO: 3018523 - RNA, 18 nt, Mycobacterium avium subsp. paratuberculosis
gcguggggcgucgccgcc

SEQ ID NO: 3018524 - RNA, 15 nt, Mycobacterium avium subsp. paratuberculosis
gcgugggggccaugu

SEQ ID NO: 3018525 - RNA, 19 nt, Mycobacterium avium subsp. paratuberculosis
gcgugggguucccggccgg

SEQ ID NO: 3018526 - RNA, 16 nt, Mycobacterium avium subsp. paratuberculosis
gcguggguguccuugc

SEQ ID NO: 3018527 - RNA, 14 nt, Mycobacterium avium subsp. paratuberculosis
gcguggucacccgc

SEQ ID NO: 3018528 - RNA, 20 nt, Mycobacterium avium subsp. paratuberculosis
gcguggucacccgcagcccg

SEQ ID NO: 3018529 - RNA, 16 nt, Mycobacterium avium subsp. paratuberculosis
gcguggucagcgucuc

SEQ ID NO: 3018530 - RNA, 20 nt, Mycobacterium avium subsp. paratuberculosis
gcguggucagcgucucgccg

SEQ ID NO: 3018531 - RNA, 12 nt, Mycobacterium avium subsp. paratuberculosis
gcguggucccac

SEQ ID NO: 3018532 - RNA, 14 nt, Mycobacterium avium subsp. paratuberculosis
gcguggucgccguu

SEQ ID NO: 3018533 - RNA, 13 nt, Mycobacterium avium subsp. paratuberculosis
gcguggucgcgca

SEQ ID NO: 3018534 - RNA, 15 nt, Mycobacterium avium subsp. paratuberculosis
gcguggucgcgcagc

SEQ ID NO: 3018535 - RNA, 14 nt, Mycobacterium avium subsp. paratuberculosis
gcguggucggcgaa

SEQ ID NO: 3018536 - RNA, 13 nt, Mycobacterium avium subsp. paratuberculosis
gcguggucggcgc

SEQ ID NO: 3018537 - RNA, 19 nt, Mycobacterium avium subsp. paratuberculosis
gcguggucuccuggccgcc

SEQ ID NO: 3018538 - RNA, 23 nt, Mycobacterium avium subsp. paratuberculosis
gcguggucuccuggccgccgugc

SEQ ID NO: 3018539 - RNA, 14 nt, Mycobacterium avium subsp. paratuberculosis
gcgggcgaacgcgg

SEQ ID NO: 3018540 - RNA, 22 nt, Mycobacterium avium subsp. paratuberculosis
gcgggcgaaguagccggcgauc

SEQ ID NO: 3018541 - RNA, 13 nt, Mycobacterium avium subsp. paratuberculosis
gcgggcgacccgc

SEQ ID NO: 3018542 - RNA, 18 nt, Mycobacterium avium subsp. paratuberculosis
gcgggcgaccugcgggcc

SEQ ID NO: 3018543 - RNA, 18 nt, Mycobacterium avium subsp. paratuberculosis
gcgggcgacgucgggguc

SEQ ID NO: 3018544 - RNA, 13 nt, Mycobacterium avium subsp. paratuberculosis
gcgggcgacuucu

SEQ ID NO: 3018545 - RNA, 19 nt, Mycobacterium avium subsp. paratuberculosis
gcgggcgacuucuucgccg

SEQ ID NO: 3018546 - RNA, 16 nt, Mycobacterium avium subsp. paratuberculosis
gcgggcgagcagcgcc

SEQ ID NO: 3018547 - RNA, 17 nt, Mycobacterium avium subsp. paratuberculosis
gcgggcgagcagcgccc

SEQ ID NO: 3018548 - RNA, 20 nt, Mycobacterium avium subsp. paratuberculosis
gcgggcgagcagcgcccggg

SEQ ID NO: 3018549 - RNA, 20 nt, Mycobacterium avium subsp. paratuberculosis
gcgggcgagccgaagcgggu

SEQ ID NO: 3018550 - RNA, 15 nt, Mycobacterium avium subsp. paratuberculosis
gcgggcgaucuccag

SEQ ID NO: 3018551 - RNA, 16 nt, Mycobacterium avium subsp. paratuberculosis
gcgggcgaucuccagc

SEQ ID NO: 3018552 - RNA, 19 nt, Mycobacterium avium subsp. paratuberculosis
gcgggcgaucuccagcggc

SEQ ID NO: 3018553 - RNA, 21 nt, Mycobacterium avium subsp. paratuberculosis
gcgggcgaucuccagcggccg

SEQ ID NO: 3018554 - RNA, 23 nt, Mycobacterium avium subsp. paratuberculosis
gcgggcgaucucgauggccacgc

SEQ ID NO: 3018555 - RNA, 16 nt, Mycobacterium avium subsp. paratuberculosis
gcgggcgaugcggccc

SEQ ID NO: 3018556 - RNA, 17 nt, Mycobacterium avium subsp. paratuberculosis
gcgggcgaugcggcccg

SEQ ID NO: 3018557 - RNA, 22 nt, Mycobacterium avium subsp. paratuberculosis
gcgggcgaugcggcccggccac

SEQ ID NO: 3018558 - RNA, 13 nt, Mycobacterium avium subsp. paratuberculosis
gcgggcgauggcg

SEQ ID NO: 3018559 - RNA, 16 nt, Mycobacterium avium subsp. paratuberculosis
gcgggcgauggcgggc

SEQ ID NO: 3018560 - RNA, 18 nt, Mycobacterium avium subsp. paratuberculosis
gcgggcgauggcgggccg

SEQ ID NO: 3018561 - RNA, 20 nt, Mycobacterium avium subsp. paratuberculosis
gcgggcgauucccggaugcu

SEQ ID NO: 3018562 - RNA, 18 nt, Mycobacterium avium subsp. paratuberculosis
gcgggcgauuucgucggc

SEQ ID NO: 3018563 - RNA, 19 nt, Mycobacterium avium subsp. paratuberculosis
gcgggcgauuucgucggcg

SEQ ID NO: 3018564 - RNA, 20 nt, Mycobacterium avium subsp. paratuberculosis
gcgggcgauuucgucggcgg

SEQ ID NO: 3018565 - RNA, 21 nt, Mycobacterium avium subsp. paratuberculosis
gcgggcgauuucgucggcggu

SEQ ID NO: 3018566 - RNA, 22 nt, Mycobacterium avium subsp. paratuberculosis
gcgggcgauuucgucggcggug

SEQ ID NO: 3018567 - RNA, 13 nt, Mycobacterium avium subsp. paratuberculosis
gcgggcgcagcuc

SEQ ID NO: 3018568 - RNA, 14 nt, Mycobacterium avium subsp. paratuberculosis
gcgggcgcagcucg

SEQ ID NO: 3018569 - RNA, 17 nt, Mycobacterium avium subsp. paratuberculosis
gcgggcgcaggugggcg

SEQ ID NO: 3018570 - RNA, 13 nt, Mycobacterium avium subsp. paratuberculosis
gcgggcgcccagc

SEQ ID NO: 3018571 - RNA, 14 nt, Mycobacterium avium subsp. paratuberculosis
gcgggcgcccagca

SEQ ID NO: 3018572 - RNA, 16 nt, Mycobacterium avium subsp. paratuberculosis
gcgggcgcccuccacg

SEQ ID NO: 3018573 - RNA, 20 nt, Mycobacterium avium subsp. paratuberculosis
gcgggcgccgaacgucgagc

SEQ ID NO: 3018574 - RNA, 14 nt, Mycobacterium avium subsp. paratuberculosis
gcgggcgccgaaga

SEQ ID NO: 3018575 - RNA, 23 nt, Mycobacterium avium subsp. paratuberculosis
gcgggcgccgaagauggccagga

SEQ ID NO: 3018576 - RNA, 13 nt, Mycobacterium avium subsp. paratuberculosis
gcgggcgccggcu

SEQ ID NO: 3018577 - RNA, 15 nt, Mycobacterium avium subsp. paratuberculosis
gcgggcgccggcugc

SEQ ID NO: 3018578 - RNA, 14 nt, Mycobacterium avium subsp. paratuberculosis
gcgggcgccggucg

SEQ ID NO: 3018579 - RNA, 16 nt, Mycobacterium avium subsp. paratuberculosis
gcgggcgccggucggc

SEQ ID NO: 3018580 - RNA, 20 nt, Mycobacterium avium subsp. paratuberculosis
gcgggcgccguaggccgcgc

SEQ ID NO: 3018581 - RNA, 19 nt, Mycobacterium avium subsp. paratuberculosis
gcgggcgccuucuuggccg

SEQ ID NO: 3018582 - RNA, 13 nt, Mycobacterium avium subsp. paratuberculosis
gcgggcgcgccgg

SEQ ID NO: 3018583 - RNA, 14 nt, Mycobacterium avium subsp. paratuberculosis
gcgggcgcgccggc

SEQ ID NO: 3018584 - RNA, 16 nt, Mycobacterium avium subsp. paratuberculosis
gcgggcgcgccggcgc

SEQ ID NO: 3018585 - RNA, 17 nt, Mycobacterium avium subsp. paratuberculosis
gcgggcgcgccggcgcg

SEQ ID NO: 3018586 - RNA, 18 nt, Mycobacterium avium subsp. paratuberculosis
gcgggcgcgccggcgcgc

SEQ ID NO: 3018587 - RNA, 19 nt, Mycobacterium avium subsp. paratuberculosis
gcgggcgcgccggcgcgca

SEQ ID NO: 3018588 - RNA, 16 nt, Mycobacterium avium subsp. paratuberculosis
gcgggcgcgccguccc

SEQ ID NO: 3018589 - RNA, 23 nt, Mycobacterium avium subsp. paratuberculosis
gcgggcgcgccgucccagccgga

SEQ ID NO: 3018590 - RNA, 13 nt, Mycobacterium avium subsp. paratuberculosis
gcgggcgcgcgcc

SEQ ID NO: 3018591 - RNA, 14 nt, Mycobacterium avium subsp. paratuberculosis
gcgggcgcgcgccg

SEQ ID NO: 3018592 - RNA, 16 nt, Mycobacterium avium subsp. paratuberculosis
gcgggcgcgcgccgcc

SEQ ID NO: 3018593 - RNA, 17 nt, Mycobacterium avium subsp. paratuberculosis
gcgggcgcgcgccgccc

SEQ ID NO: 3018594 - RNA, 18 nt, Mycobacterium avium subsp. paratuberculosis
gcgggcgcggccagcgcg

SEQ ID NO: 3018595 - RNA, 15 nt, Mycobacterium avium subsp. paratuberculosis
gcgggcgcgucgagg

SEQ ID NO: 3018596 - RNA, 22 nt, Mycobacterium avium subsp. paratuberculosis
gcgggcgcguugaugccgugcg

SEQ ID NO: 3018597 - RNA, 17 nt, Mycobacterium avium subsp. paratuberculosis
gcgggcggcaggucggc

SEQ ID NO: 3018598 - RNA, 19 nt, Mycobacterium avium subsp. paratuberculosis
gcgggcggcaucgcgccgc

SEQ ID NO: 3018599 - RNA, 23 nt, Mycobacterium avium subsp. paratuberculosis
gcgggcggcaucgcgccgcauga

SEQ ID NO: 3018600 - RNA, 12 nt, Mycobacterium avium subsp. paratuberculosis
gcgggcggccag

SEQ ID NO: 3018601 - RNA, 14 nt, Mycobacterium avium subsp. paratuberculosis
gcgggcggccagcc

SEQ ID NO: 3018602 - RNA, 16 nt, Mycobacterium avium subsp. paratuberculosis
gcgggcggccagccgc

SEQ ID NO: 3018603 - RNA, 18 nt, Mycobacterium avium subsp. paratuberculosis
gcgggcggccagccgcuc

SEQ ID NO: 3018604 - RNA, 23 nt, Mycobacterium avium subsp. paratuberculosis
gcgggcggccagccgcucccggc

SEQ ID NO: 3018605 - RNA, 13 nt, Mycobacterium avium subsp. paratuberculosis
gcgggcggccccg

SEQ ID NO: 3018606 - RNA, 17 nt, Mycobacterium avium subsp. paratuberculosis
gcgggcggccccgggcg

SEQ ID NO: 3018607 - RNA, 14 nt, Mycobacterium avium subsp. paratuberculosis
gcgggcggcccgca

SEQ ID NO: 3018608 - RNA, 16 nt, Mycobacterium avium subsp. paratuberculosis
gcgggcggcccgcacg

SEQ ID NO: 3018609 - RNA, 22 nt, Mycobacterium avium subsp. paratuberculosis
gcgggcggcccgcacggccgcc

SEQ ID NO: 3018610 - RNA, 13 nt, Mycobacterium avium subsp. paratuberculosis
gcgggcggcgaac

SEQ ID NO: 3018611 - RNA, 16 nt, Mycobacterium avium subsp. paratuberculosis
gcgggcggcgcagucg

SEQ ID NO: 3018612 - RNA, 22 nt, Mycobacterium avium subsp. paratuberculosis
gcgggcggcgcagucggccgga

SEQ ID NO: 3018613 - RNA, 12 nt, Mycobacterium avium subsp. paratuberculosis
gcgggcggcgcg

SEQ ID NO: 3018614 - RNA, 15 nt, Mycobacterium avium subsp. paratuberculosis
gcgggcggcgcggcg

SEQ ID NO: 3018615 - RNA, 17 nt, Mycobacterium avium subsp. paratuberculosis
gcgggcggcgcggcgca

SEQ ID NO: 3018616 - RNA, 17 nt, Mycobacterium avium subsp. paratuberculosis
gcgggcggcgcgguuga

SEQ ID NO: 3018617 - RNA, 20 nt, Mycobacterium avium subsp. paratuberculosis
gcgggcggcggcguuggccg

SEQ ID NO: 3018618 - RNA, 15 nt, Mycobacterium avium subsp. paratuberculosis
gcgggcggcggcugg

SEQ ID NO: 3018619 - RNA, 16 nt, Mycobacterium avium subsp. paratuberculosis
gcgggcggcggcuggg

SEQ ID NO: 3018620 - RNA, 17 nt, Mycobacterium avium subsp. paratuberculosis
gcgggcggcgguggccu

SEQ ID NO: 3018621 - RNA, 12 nt, Mycobacterium avium subsp. paratuberculosis
gcgggcgggcgg

SEQ ID NO: 3018622 - RNA, 16 nt, Mycobacterium avium subsp. paratuberculosis
gcgggcgggcggggga

SEQ ID NO: 3018623 - RNA, 13 nt, Mycobacterium avium subsp. paratuberculosis
gcgggcggggccc

SEQ ID NO: 3018624 - RNA, 16 nt, Mycobacterium avium subsp. paratuberculosis
gcggggcgcguucggg

SEQ ID NO: 3018625 - RNA, 20 nt, Mycobacterium avium subsp. paratuberculosis
gcggggcggccgccgggccg

SEQ ID NO: 3018626 - RNA, 21 nt, Mycobacterium avium subsp. paratuberculosis
gcggggcggccgccgggccgg

SEQ ID NO: 3018627 - RNA, 13 nt, Mycobacterium avium subsp. paratuberculosis
gcggggcggcggc

SEQ ID NO: 3018628 - RNA, 17 nt, Mycobacterium avium subsp. paratuberculosis
gcggggcggcggcgccg

SEQ ID NO: 3018629 - RNA, 14 nt, Mycobacterium avium subsp. paratuberculosis
gcggggcggcggga

SEQ ID NO: 3018630 - RNA, 20 nt, Mycobacterium avium subsp. paratuberculosis
gcggggcgggggcguuggug

SEQ ID NO: 3018631 - RNA, 16 nt, Mycobacterium avium subsp. paratuberculosis
gcggggcguccagcga

SEQ ID NO: 3018632 - RNA, 19 nt, Mycobacterium avium subsp. paratuberculosis
gcggggcgucgaugcguga

SEQ ID NO: 3018633 - RNA, 19 nt, Mycobacterium avium subsp. paratuberculosis
gcggggcgucgcccgccga

SEQ ID NO: 3018634 - RNA, 20 nt, Mycobacterium avium subsp. paratuberculosis
gcggggcgugcccggcgccg

SEQ ID NO: 3018635 - RNA, 17 nt, Mycobacterium avium subsp. paratuberculosis
gcggggcguugcccguc

SEQ ID NO: 3018636 - RNA, 16 nt, Mycobacterium avium subsp. paratuberculosis
gcgggggagccgugca

SEQ ID NO: 3018637 - RNA, 21 nt, Mycobacterium avium subsp. paratuberculosis
gcgggggagccgugcagcgcc

SEQ ID NO: 3018638 - RNA, 19 nt, Mycobacterium avium subsp. paratuberculosis
gcgggggauccgccugcgc

SEQ ID NO: 3018639 - RNA, 21 nt, Mycobacterium avium subsp. paratuberculosis
gcgggggauccgccugcgcgg

SEQ ID NO: 3018640 - RNA, 24 nt, Mycobacterium avium subsp. paratuberculosis
gcgggggauccgccugcgcgggcg

SEQ ID NO: 3018641 - RNA, 12 nt, Mycobacterium avium subsp. paratuberculosis
gcgggggccgcc

SEQ ID NO: 3018642 - RNA, 13 nt, Mycobacterium avium subsp. paratuberculosis
gcgggggccgccg

SEQ ID NO: 3018643 - RNA, 15 nt, Mycobacterium avium subsp. paratuberculosis
gcgggggccgccgcg

SEQ ID NO: 3018644 - RNA, 16 nt, Mycobacterium avium subsp. paratuberculosis
gcgggggcgcguccgc

SEQ ID NO: 3018645 - RNA, 13 nt, Mycobacterium avium subsp. paratuberculosis
gcgggggcggccg

SEQ ID NO: 3018646 - RNA, 16 nt, Mycobacterium avium subsp. paratuberculosis
gcgggggcggccgggc

SEQ ID NO: 3018647 - RNA, 22 nt, Mycobacterium avium subsp. paratuberculosis
gcggggggagggucgguggccc

SEQ ID NO: 3018648 - RNA, 20 nt, Mycobacterium avium subsp. paratuberculosis
gcggggguucguugcgccgc

SEQ ID NO: 3018649 - RNA, 23 nt, Mycobacterium avium subsp. paratuberculosis
gcggggguucguugcgccgccag

SEQ ID NO: 3018650 - RNA, 22 nt, Mycobacterium avium subsp. paratuberculosis
gcgggguaguucuugacgccga

SEQ ID NO: 3018651 - RNA, 18 nt, Mycobacterium avium subsp. paratuberculosis
gcggggucaagcggcaga

SEQ ID NO: 3018652 - RNA, 21 nt, Mycobacterium avium subsp. paratuberculosis
gcggggucccaauccucgccg

SEQ ID NO: 3018653 - RNA, 13 nt, Mycobacterium avium subsp. paratuberculosis
gcggggucggcca

SEQ ID NO: 3018654 - RNA, 15 nt, Mycobacterium avium subsp. paratuberculosis
gcggggucgggauca

SEQ ID NO: 3018655 - RNA, 12 nt, Mycobacterium avium subsp. paratuberculosis
gcggggucgggc

SEQ ID NO: 3018656 - RNA, 14 nt, Mycobacterium avium subsp. paratuberculosis
gcggggucgggccg

SEQ ID NO: 3018657 - RNA, 16 nt, Mycobacterium avium subsp. paratuberculosis
gcggggucgggccgga

SEQ ID NO: 3018658 - RNA, 15 nt, Mycobacterium avium subsp. paratuberculosis
gcggggugacgcccg

SEQ ID NO: 3018659 - RNA, 16 nt, Mycobacterium avium subsp. paratuberculosis
gcgggguggcgccggc

SEQ ID NO: 3018660 - RNA, 15 nt, Mycobacterium avium subsp. paratuberculosis
gcggggugggcaccu

SEQ ID NO: 3018661 - RNA, 16 nt, Mycobacterium avium subsp. paratuberculosis
gcggggugggcaccug

SEQ ID NO: 3018662 - RNA, 19 nt, Mycobacterium avium subsp. paratuberculosis
gcggggugggcaccuggcc

SEQ ID NO: 3018663 - RNA, 15 nt, Mycobacterium avium subsp. paratuberculosis
gcggggugucgaccc

SEQ ID NO: 3018664 - RNA, 16 nt, Mycobacterium avium subsp. paratuberculosis
gcggggugucgaccca

SEQ ID NO: 3018665 - RNA, 21 nt, Mycobacterium avium subsp. paratuberculosis
gcggggugucgacccaggucg

SEQ ID NO: 3018666 - RNA, 15 nt, Mycobacterium avium subsp. paratuberculosis
gcggggugucgcggc

SEQ ID NO: 3018667 - RNA, 16 nt, Mycobacterium avium subsp. paratuberculosis
gcggggugugcucggc

SEQ ID NO: 3018668 - RNA, 17 nt, Mycobacterium avium subsp. paratuberculosis
gcggggugugcucggcg

SEQ ID NO: 3018669 - RNA, 21 nt, Mycobacterium avium subsp. paratuberculosis
gcgggguguggcugucgggga

SEQ ID NO: 3018670 - RNA, 21 nt, Mycobacterium avium subsp. paratuberculosis
gcgggguguucaccgcgccgg

SEQ ID NO: 3018671 - RNA, 23 nt, Mycobacterium avium subsp. paratuberculosis
gcgggguguucaccgcgccgggc

SEQ ID NO: 3018672 - RNA, 18 nt, Mycobacterium avium subsp. paratuberculosis
gcggguaaccgcagccgg

SEQ ID NO: 3018673 - RNA, 23 nt, Mycobacterium avium subsp. paratuberculosis
gcggguaaccgcagccgggugcg

SEQ ID NO: 3018674 - RNA, 15 nt, Mycobacterium avium subsp. paratuberculosis
gcggguacagccgca

SEQ ID NO: 3018675 - RNA, 22 nt, Mycobacterium avium subsp. paratuberculosis
gcggguaccacuugaaggaggc

SEQ ID NO: 3018676 - RNA, 16 nt, Mycobacterium avium subsp. paratuberculosis
gcggguacgcguacgg

SEQ ID NO: 3018677 - RNA, 13 nt, Mycobacterium avium subsp. paratuberculosis
gcggguacggcgg

SEQ ID NO: 3018678 - RNA, 16 nt, Mycobacterium avium subsp. paratuberculosis
gcggguacggcggccg

SEQ ID NO: 3018679 - RNA, 19 nt, Mycobacterium avium subsp. paratuberculosis
gcggguacggcggccgcgg

SEQ ID NO: 3018680 - RNA, 20 nt, Mycobacterium avium subsp. paratuberculosis
gcggguacggcggccgcgga

SEQ ID NO: 3018681 - RNA, 17 nt, Mycobacterium avium subsp. paratuberculosis
gcggguacggucggccg

SEQ ID NO: 3018682 - RNA, 20 nt, Mycobacterium avium subsp. paratuberculosis
gcggguagaaccagcccggc

SEQ ID NO: 3018683 - RNA, 22 nt, Mycobacterium avium subsp. paratuberculosis
gcggguagaaccagcccggccc

SEQ ID NO: 3018684 - RNA, 22 nt, Mycobacterium avium subsp. paratuberculosis
gcggguagacguucuccccgcc

SEQ ID NO: 3018685 - RNA, 18 nt, Mycobacterium avium subsp. paratuberculosis
gcggguagcccgucgacg

SEQ ID NO: 3018686 - RNA, 19 nt, Mycobacterium avium subsp. paratuberculosis
gcggguagcccgucgacgg

SEQ ID NO: 3018687 - RNA, 16 nt, Mycobacterium avium subsp. paratuberculosis
gcggguaggcgucgcg

SEQ ID NO: 3018688 - RNA, 17 nt, Mycobacterium avium subsp. paratuberculosis
gcggguaggcgucgcgc

SEQ ID NO: 3018689 - RNA, 18 nt, Mycobacterium avium subsp. paratuberculosis
gcggguaggcgucgcgca

SEQ ID NO: 3018690 - RNA, 20 nt, Mycobacterium avium subsp. paratuberculosis
gcggguaguucuucgucagg

SEQ ID NO: 3018691 - RNA, 20 nt, Mycobacterium avium subsp. paratuberculosis
gcggguauccgugaccccgg

SEQ ID NO: 3018692 - RNA, 17 nt, Mycobacterium avium subsp. paratuberculosis
gcggguaugucggcgac

SEQ ID NO: 3018693 - RNA, 19 nt, Mycobacterium avium subsp. paratuberculosis
gcgggucacacccucggcc

SEQ ID NO: 3018694 - RNA, 20 nt, Mycobacterium avium subsp. paratuberculosis
gcgggucacacccucggccc

SEQ ID NO: 3018695 - RNA, 17 nt, Mycobacterium avium subsp. paratuberculosis
gcgggucacggucaggc

SEQ ID NO: 3018696 - RNA, 13 nt, Mycobacterium avium subsp. paratuberculosis
gcgggucagcagc

SEQ ID NO: 3018697 - RNA, 23 nt, Mycobacterium avium subsp. paratuberculosis
gcgggucagcagcgucugcgcca

SEQ ID NO: 3018698 - RNA, 15 nt, Mycobacterium avium subsp. paratuberculosis
gcggguccagccgcc

SEQ ID NO: 3018699 - RNA, 19 nt, Mycobacterium avium subsp. paratuberculosis
gcggguccagccgccggcg

SEQ ID NO: 3018700 - RNA, 14 nt, Mycobacterium avium subsp. paratuberculosis
gcggguccaucgcc

SEQ ID NO: 3018701 - RNA, 17 nt, Mycobacterium avium subsp. paratuberculosis
gcggguccaucgccucg

SEQ ID NO: 3018702 - RNA, 21 nt, Mycobacterium avium subsp. paratuberculosis
gcggguccaucgccucgacca

SEQ ID NO: 3018703 - RNA, 23 nt, Mycobacterium avium subsp. paratuberculosis
gcggguccaucgccucgaccagc

SEQ ID NO: 3018704 - RNA, 16 nt, Mycobacterium avium subsp. paratuberculosis
gcggguccugcaaccg

SEQ ID NO: 3018705 - RNA, 20 nt, Mycobacterium avium subsp. paratuberculosis
gcgggucgauaugcugcaac

SEQ ID NO: 3018706 - RNA, 16 nt, Mycobacterium avium subsp. paratuberculosis
gcgggucgauggcgac

SEQ ID NO: 3018707 - RNA, 15 nt, Mycobacterium avium subsp. paratuberculosis
gcgggucgccgggca

SEQ ID NO: 3018708 - RNA, 23 nt, Mycobacterium avium subsp. paratuberculosis
gcggguggaucuugacggcgacg

SEQ ID NO: 3018709 - RNA, 15 nt, Mycobacterium avium subsp. paratuberculosis
gcggguggccggguc

SEQ ID NO: 3018710 - RNA, 20 nt, Mycobacterium avium subsp. paratuberculosis
gcggguggccuucaucaccg

SEQ ID NO: 3018711 - RNA, 21 nt, Mycobacterium avium subsp. paratuberculosis
gcggguggccuucaucaccgc

SEQ ID NO: 3018712 - RNA, 19 nt, Mycobacterium avium subsp. paratuberculosis
gcggguggcgccacagccg

SEQ ID NO: 3018713 - RNA, 20 nt, Mycobacterium avium subsp. paratuberculosis
gcggguggggaagacgugca

SEQ ID NO: 3018714 - RNA, 13 nt, Mycobacterium avium subsp. paratuberculosis
gcggguggggauc

SEQ ID NO: 3018715 - RNA, 19 nt, Mycobacterium avium subsp. paratuberculosis
gcgggugguguggcgucgg

SEQ ID NO: 3018716 - RNA, 21 nt, Mycobacterium avium subsp. paratuberculosis
gcgggugguguggcgucggcc

SEQ ID NO: 3018717 - RNA, 22 nt, Mycobacterium avium subsp. paratuberculosis
gcgggugguguggcgucggccg

SEQ ID NO: 3018718 - RNA, 15 nt, Mycobacterium avium subsp. paratuberculosis
gcggguguccgagcg

SEQ ID NO: 3018719 - RNA, 20 nt, Mycobacterium avium subsp. paratuberculosis
gcggguguccgagcgggccg

SEQ ID NO: 3018720 - RNA, 14 nt, Mycobacterium avium subsp. paratuberculosis
gcgggugucgccgg

SEQ ID NO: 3018721 - RNA, 16 nt, Mycobacterium avium subsp. paratuberculosis
gcgggugucgccggug

SEQ ID NO: 3018722 - RNA, 13 nt, Mycobacterium avium subsp. paratuberculosis
gcggguguucagc

SEQ ID NO: 3018723 - RNA, 16 nt, Mycobacterium avium subsp. paratuberculosis
gcggguguugaccuug

SEQ ID NO: 3018724 - RNA, 18 nt, Mycobacterium avium subsp. paratuberculosis
gcggguguugaccuuguc

SEQ ID NO: 3018725 - RNA, 19 nt, Mycobacterium avium subsp. paratuberculosis
gcggguguuucggucggcg

SEQ ID NO: 3018726 - RNA, 18 nt, Mycobacterium avium subsp. paratuberculosis
gcggguucacccuggcga

SEQ ID NO: 3018727 - RNA, 14 nt, Mycobacterium avium subsp. paratuberculosis
gcggguucuggccg

SEQ ID NO: 3018728 - RNA, 23 nt, Mycobacterium avium subsp. paratuberculosis
gcggguucuggccguggucggcg

SEQ ID NO: 3018729 - RNA, 21 nt, Mycobacterium avium subsp. paratuberculosis
gcggguucuucagggcggugc

SEQ ID NO: 3018730 - RNA, 17 nt, Mycobacterium avium subsp. paratuberculosis
gcggguugccgcuggcg

SEQ ID NO: 3018731 - RNA, 18 nt, Mycobacterium avium subsp. paratuberculosis
gcggguugcgguccccgg

SEQ ID NO: 3018732 - RNA, 20 nt, Mycobacterium avium subsp. paratuberculosis
gcggguugcugagccgccga

SEQ ID NO: 3018733 - RNA, 15 nt, Mycobacterium avium subsp. paratuberculosis
gcggguuggucccga

SEQ ID NO: 3018734 - RNA, 22 nt, Mycobacterium avium subsp. paratuberculosis
gcggguuggucccgaucaccuu

SEQ ID NO: 3018735 - RNA, 21 nt, Mycobacterium avium subsp. paratuberculosis
gcggguugucgucgucggcga

SEQ ID NO: 3018736 - RNA, 15 nt, Mycobacterium avium subsp. paratuberculosis
gcggguuuggccgcg

SEQ ID NO: 3018737 - RNA, 16 nt, Mycobacterium avium subsp. paratuberculosis
gcggguuuggccgcgg

SEQ ID NO: 3018738 - RNA, 20 nt, Mycobacterium avium subsp. paratuberculosis
gcgguaaagucuucggcgau

SEQ ID NO: 3018739 - RNA, 22 nt, Mycobacterium avium subsp. paratuberculosis
gcgguaaagucuucggcgaugc

SEQ ID NO: 3018740 - RNA, 16 nt, Mycobacterium avium subsp. paratuberculosis
gcgguacaucccgccg

SEQ ID NO: 3018741 - RNA, 19 nt, Mycobacterium avium subsp. paratuberculosis
gcgguacaucccgccgggc

SEQ ID NO: 3018742 - RNA, 22 nt, Mycobacterium avium subsp. paratuberculosis
gcgguaccgaacgacgagccgu

SEQ ID NO: 3018743 - RNA, 16 nt, Mycobacterium avium subsp. paratuberculosis
gcgguaccgaugacca

SEQ ID NO: 3018744 - RNA, 19 nt, Mycobacterium avium subsp. paratuberculosis
gcgguaccgaugaccaccg

SEQ ID NO: 3018745 - RNA, 12 nt, Mycobacterium avium subsp. paratuberculosis
gcgguaccgccg

SEQ ID NO: 3018746 - RNA, 13 nt, Mycobacterium avium subsp. paratuberculosis
gcgguaccgccga

SEQ ID NO: 3018747 - RNA, 20 nt, Mycobacterium avium subsp. paratuberculosis
gcgguaccgccgaucgugac

SEQ ID NO: 3018748 - RNA, 16 nt, Mycobacterium avium subsp. paratuberculosis
gcgguacgcgccgcgc

SEQ ID NO: 3018749 - RNA, 23 nt, Mycobacterium avium subsp. paratuberculosis
gcgguagaaccaacgcggcgccg

SEQ ID NO: 3018750 - RNA, 24 nt, Mycobacterium avium subsp. paratuberculosis
gcgguagaaccaacgcggcgccgg

SEQ ID NO: 3018751 - RNA, 16 nt, Mycobacterium avium subsp. paratuberculosis
gcgguagacaccgccg

SEQ ID NO: 3018752 - RNA, 16 nt, Mycobacterium avium subsp. paratuberculosis
gcgguagaggcgggcg

SEQ ID NO: 3018753 - RNA, 17 nt, Mycobacterium avium subsp. paratuberculosis
gcgguagaucgacaggg

SEQ ID NO: 3018754 - RNA, 16 nt, Mycobacterium avium subsp. paratuberculosis
gcgguagaugucgggu

SEQ ID NO: 3018755 - RNA, 17 nt, Mycobacterium avium subsp. paratuberculosis
gcgguagaugucggguc

SEQ ID NO: 3018756 - RNA, 19 nt, Mycobacterium avium subsp. paratuberculosis
gcgguagaugucggguccg

SEQ ID NO: 3018757 - RNA, 20 nt, Mycobacterium avium subsp. paratuberculosis
gcgguagaugucggguccgc

SEQ ID NO: 3018758 - RNA, 22 nt, Mycobacterium avium subsp. paratuberculosis
gcgguagggcagauaggcggcg

SEQ ID NO: 3018759 - RNA, 18 nt, Mycobacterium avium subsp. paratuberculosis
gcgguagucgggauaggg

SEQ ID NO: 3018760 - RNA, 17 nt, Mycobacterium avium subsp. paratuberculosis
gcgguauccgaucauca

SEQ ID NO: 3018761 - RNA, 18 nt, Mycobacterium avium subsp. paratuberculosis
gcgguaucgguggauccg

SEQ ID NO: 3018762 - RNA, 17 nt, Mycobacterium avium subsp. paratuberculosis
gcgguaugcccgggccg

SEQ ID NO: 3018763 - RNA, 20 nt, Mycobacterium avium subsp. paratuberculosis
gcgguaugcccgggccguca

SEQ ID NO: 3018764 - RNA, 22 nt, Mycobacterium avium subsp. paratuberculosis
gcgguaugcccgggccgucauc

SEQ ID NO: 3018765 - RNA, 15 nt, Mycobacterium avium subsp. paratuberculosis
gcggucaacaccggg

SEQ ID NO: 3018766 - RNA, 22 nt, Mycobacterium avium subsp. paratuberculosis
gcggucaacaccgggauccggc

SEQ ID NO: 3018767 - RNA, 23 nt, Mycobacterium avium subsp. paratuberculosis
gcggucaacaccgggauccggcg

SEQ ID NO: 3018768 - RNA, 12 nt, Mycobacterium avium subsp. paratuberculosis
gcggucaacacg

SEQ ID NO: 3018769 - RNA, 14 nt, Mycobacterium avium subsp. paratuberculosis
gcggucaacacgaa

SEQ ID NO: 3018770 - RNA, 16 nt, Mycobacterium avium subsp. paratuberculosis
gcggucaacacgaagc

SEQ ID NO: 3018771 - RNA, 23 nt, Mycobacterium avium subsp. paratuberculosis
gcggucaacacgaagccgguguc

SEQ ID NO: 3018772 - RNA, 15 nt, Mycobacterium avium subsp. paratuberculosis
gcggucaccaaggcg

SEQ ID NO: 3018773 - RNA, 16 nt, Mycobacterium avium subsp. paratuberculosis
gcggucaccaaggcga

SEQ ID NO: 3018774 - RNA, 13 nt, Mycobacterium avium subsp. paratuberculosis
gcggucaccggcu

SEQ ID NO: 3018775 - RNA, 12 nt, Mycobacterium avium subsp. paratuberculosis
gcggucaccggu

SEQ ID NO: 3018776 - RNA, 14 nt, Mycobacterium avium subsp. paratuberculosis
gcggucaccggucg

SEQ ID NO: 3018777 - RNA, 19 nt, Mycobacterium avium subsp. paratuberculosis
gcggucaccggucggugcc

SEQ ID NO: 3018778 - RNA, 13 nt, Mycobacterium avium subsp. paratuberculosis
gcggucacgcccg

SEQ ID NO: 3018779 - RNA, 15 nt, Mycobacterium avium subsp. paratuberculosis
gcggucagcaccguc

SEQ ID NO: 3018780 - RNA, 21 nt, Mycobacterium avium subsp. paratuberculosis
gcggucagcaccgucaccgcc

SEQ ID NO: 3018781 - RNA, 19 nt, Mycobacterium avium subsp. paratuberculosis
gcggucagcauggcgauga

SEQ ID NO: 3018782 - RNA, 20 nt, Mycobacterium avium subsp. paratuberculosis
gcggucagcauggcgaugac

SEQ ID NO: 3018783 - RNA, 21 nt, Mycobacterium avium subsp. paratuberculosis
gcggucagcauggcgaugacg

SEQ ID NO: 3018784 - RNA, 22 nt, Mycobacterium avium subsp. paratuberculosis
gcggucagcccgcccuuggccg

SEQ ID NO: 3018785 - RNA, 17 nt, Mycobacterium avium subsp. paratuberculosis
gcggucagccggcucgg

SEQ ID NO: 3018786 - RNA, 18 nt, Mycobacterium avium subsp. paratuberculosis
gcggucagccggcucggu

SEQ ID NO: 3018787 - RNA, 17 nt, Mycobacterium avium subsp. paratuberculosis
gcggucagcgcguccag

SEQ ID NO: 3018788 - RNA, 15 nt, Mycobacterium avium subsp. paratuberculosis
gcggucagcucccgc

SEQ ID NO: 3018789 - RNA, 18 nt, Mycobacterium avium subsp. paratuberculosis
gcggucagcucccgcagc

SEQ ID NO: 3018790 - RNA, 20 nt, Mycobacterium avium subsp. paratuberculosis
gcggucagcucgaucgccgc

SEQ ID NO: 3018791 - RNA, 12 nt, Mycobacterium avium subsp. paratuberculosis
gcggucaggccg

SEQ ID NO: 3018792 - RNA, 18 nt, Mycobacterium avium subsp. paratuberculosis
gcggucaggccgucucga

SEQ ID NO: 3018793 - RNA, 15 nt, Mycobacterium avium subsp. paratuberculosis
gcggucagggucagc

SEQ ID NO: 3018794 - RNA, 13 nt, Mycobacterium avium subsp. paratuberculosis
gcggucagguucg

SEQ ID NO: 3018795 - RNA, 18 nt, Mycobacterium avium subsp. paratuberculosis
gcggucagguucgccacg

SEQ ID NO: 3018796 - RNA, 16 nt, Mycobacterium avium subsp. paratuberculosis
gcggucaucgagccgg

SEQ ID NO: 3018797 - RNA, 18 nt, Mycobacterium avium subsp. paratuberculosis
gcggucaugcgcgggcaa

SEQ ID NO: 3018798 - RNA, 21 nt, Mycobacterium avium subsp. paratuberculosis
gcggucauugaucuccgcggc

SEQ ID NO: 3018799 - RNA, 21 nt, Mycobacterium avium subsp. paratuberculosis
gcgguccaacgggcucagcac

SEQ ID NO: 3018800 - RNA, 22 nt, Mycobacterium avium subsp. paratuberculosis
gcgguccaacgggcucagcacc

SEQ ID NO: 3018801 - RNA, 19 nt, Mycobacterium avium subsp. paratuberculosis
gcgguccaccaauggcggc

SEQ ID NO: 3018802 - RNA, 14 nt, Mycobacterium avium subsp. paratuberculosis
gcgguccaccacca

SEQ ID NO: 3018803 - RNA, 21 nt, Mycobacterium avium subsp. paratuberculosis
gcgguccaccaccacacccgc

SEQ ID NO: 3018804 - RNA, 22 nt, Mycobacterium avium subsp. paratuberculosis
gcgguccaccaccacacccgcg

SEQ ID NO: 3018805 - RNA, 14 nt, Mycobacterium avium subsp. paratuberculosis
gcgguccacccgaa

SEQ ID NO: 3018806 - RNA, 14 nt, Mycobacterium avium subsp. paratuberculosis
gcgguccaccgacg

SEQ ID NO: 3018807 - RNA, 15 nt, Mycobacterium avium subsp. paratuberculosis
gcgguccaccgacgc

SEQ ID NO: 3018808 - RNA, 20 nt, Mycobacterium avium subsp. paratuberculosis
gcgguccaccgacgccacgu

SEQ ID NO: 3018809 - RNA, 23 nt, Mycobacterium avium subsp. paratuberculosis
gcgguccaccgacgccacgucgu

SEQ ID NO: 3018810 - RNA, 16 nt, Mycobacterium avium subsp. paratuberculosis
gcgguccacgccggcg

SEQ ID NO: 3018811 - RNA, 16 nt, Mycobacterium avium subsp. paratuberculosis
gcgguccacggucagc

SEQ ID NO: 3018812 - RNA, 20 nt, Mycobacterium avium subsp. paratuberculosis
gcgguccacggucagcgcgu

SEQ ID NO: 3018813 - RNA, 16 nt, Mycobacterium avium subsp. paratuberculosis
gcgguccacgguggcg

SEQ ID NO: 3018814 - RNA, 20 nt, Mycobacterium avium subsp. paratuberculosis
gcgguccacgguggcgccga

SEQ ID NO: 3018815 - RNA, 12 nt, Mycobacterium avium subsp. paratuberculosis
gcgguccagcgu

SEQ ID NO: 3018816 - RNA, 17 nt, Mycobacterium avium subsp. paratuberculosis
gcgguccagcgugaacg

SEQ ID NO: 3018817 - RNA, 13 nt, Mycobacterium avium subsp. paratuberculosis
gcgguccagcuug

SEQ ID NO: 3018818 - RNA, 20 nt, Mycobacterium avium subsp. paratuberculosis
gcgguccagcuugucguagc

SEQ ID NO: 3018819 - RNA, 22 nt, Mycobacterium avium subsp. paratuberculosis
gcgguccagcuugucguagcgg

SEQ ID NO: 3018820 - RNA, 11 nt, Mycobacterium avium subsp. paratuberculosis
gcgguccagga

SEQ ID NO: 3018821 - RNA, 19 nt, Mycobacterium avium subsp. paratuberculosis
gcgguccaggauccgcacc

SEQ ID NO: 3018822 - RNA, 22 nt, Mycobacterium avium subsp. paratuberculosis
gcgguccaggauccgcaccggg

SEQ ID NO: 3018823 - RNA, 20 nt, Mycobacterium avium subsp. paratuberculosis
gcgguccaggaucugcagca

SEQ ID NO: 3018824 - RNA, 19 nt, Mycobacterium avium subsp. paratuberculosis
gcgguccaguacaccgcga

SEQ ID NO: 3018825 - RNA, 20 nt, Mycobacterium avium subsp. paratuberculosis
gcgguccaguacaccgcgag

SEQ ID NO: 3018826 - RNA, 17 nt, Mycobacterium avium subsp. paratuberculosis
gcgguccauccagcgcc

SEQ ID NO: 3018827 - RNA, 16 nt, Mycobacterium avium subsp. paratuberculosis
gcgguccaucuccagc

SEQ ID NO: 3018828 - RNA, 19 nt, Mycobacterium avium subsp. paratuberculosis
gcggucccgcauguccggg

SEQ ID NO: 3018829 - RNA, 13 nt, Mycobacterium avium subsp. paratuberculosis
gcggucccgcggg

SEQ ID NO: 3018830 - RNA, 13 nt, Mycobacterium avium subsp. paratuberculosis
gcggucccggcgg

SEQ ID NO: 3018831 - RNA, 14 nt, Mycobacterium avium subsp. paratuberculosis
gcggucccggcgga

SEQ ID NO: 3018832 - RNA, 14 nt, Mycobacterium avium subsp. paratuberculosis
gcggucccggucga

SEQ ID NO: 3018833 - RNA, 15 nt, Mycobacterium avium subsp. paratuberculosis
gcggucccgugcgcc

SEQ ID NO: 3018834 - RNA, 16 nt, Mycobacterium avium subsp. paratuberculosis
gcggucccgugcgccg

SEQ ID NO: 3018835 - RNA, 12 nt, Mycobacterium avium subsp. paratuberculosis
gcgguccgacac

SEQ ID NO: 3018836 - RNA, 14 nt, Mycobacterium avium subsp. paratuberculosis
gcgguccgacaccg

SEQ ID NO: 3018837 - RNA, 16 nt, Mycobacterium avium subsp. paratuberculosis
gcgguccgcccggacc

SEQ ID NO: 3018838 - RNA, 19 nt, Mycobacterium avium subsp. paratuberculosis
gcgguccgccgcagcggcg

SEQ ID NO: 3018839 - RNA, 16 nt, Mycobacterium avium subsp. paratuberculosis
gcgguccgcuccacca

SEQ ID NO: 3018840 - RNA, 18 nt, Mycobacterium avium subsp. paratuberculosis
gcgguccgcuccaccagc

SEQ ID NO: 3018841 - RNA, 21 nt, Mycobacterium avium subsp. paratuberculosis
gcgguccgcuccaccagcgcg

SEQ ID NO: 3018842 - RNA, 14 nt, Mycobacterium avium subsp. paratuberculosis
gcgguccguucggc

SEQ ID NO: 3018843 - RNA, 15 nt, Mycobacterium avium subsp. paratuberculosis
gcgguccguucggcg

SEQ ID NO: 3018844 - RNA, 16 nt, Mycobacterium avium subsp. paratuberculosis
gcgguccucgagcugg

SEQ ID NO: 3018845 - RNA, 17 nt, Mycobacterium avium subsp. paratuberculosis
gcgguccucgagcuggc

SEQ ID NO: 3018846 - RNA, 15 nt, Mycobacterium avium subsp. paratuberculosis
gcgguccugcggcga

SEQ ID NO: 3018847 - RNA, 20 nt, Mycobacterium avium subsp. paratuberculosis
gcgguccugcggcgacaacg

SEQ ID NO: 3018848 - RNA, 16 nt, Mycobacterium avium subsp. paratuberculosis
gcggucgaaaaaugcg

SEQ ID NO: 3018849 - RNA, 23 nt, Mycobacterium avium subsp. paratuberculosis
gcggucgaacaacgcggugaccg

SEQ ID NO: 3018850 - RNA, 14 nt, Mycobacterium avium subsp. paratuberculosis
gcggucgaacgcgg

SEQ ID NO: 3018851 - RNA, 20 nt, Mycobacterium avium subsp. paratuberculosis
gcggucgaacgcggcgccga

SEQ ID NO: 3018852 - RNA, 14 nt, Mycobacterium avium subsp. paratuberculosis
gcggucgacacgau

SEQ ID NO: 3018853 - RNA, 17 nt, Mycobacterium avium subsp. paratuberculosis
gcggucgacacgaucgg

SEQ ID NO: 3018854 - RNA, 23 nt, Mycobacterium avium subsp. paratuberculosis
gcggucgacacgaucggcaugac

SEQ ID NO: 3018855 - RNA, 22 nt, Mycobacterium avium subsp. paratuberculosis
gcggucgaccaagacggugggc

SEQ ID NO: 3018856 - RNA, 16 nt, Mycobacterium avium subsp. paratuberculosis
gcggucgacgggaaga

SEQ ID NO: 3018857 - RNA, 18 nt, Mycobacterium avium subsp. paratuberculosis
gcggucgaucaacaccaa

SEQ ID NO: 3018858 - RNA, 16 nt, Mycobacterium avium subsp. paratuberculosis
gcggucgaugacgccg

SEQ ID NO: 3018859 - RNA, 23 nt, Mycobacterium avium subsp. paratuberculosis
gcggucgaugacgccgcgccgcc

SEQ ID NO: 3018860 - RNA, 16 nt, Mycobacterium avium subsp. paratuberculosis
gcggucgaugagcugg

SEQ ID NO: 3018861 - RNA, 16 nt, Mycobacterium avium subsp. paratuberculosis
gcggucgcaggccgcc

SEQ ID NO: 3018862 - RNA, 17 nt, Mycobacterium avium subsp. paratuberculosis
gcggucgcaggccgccc

SEQ ID NO: 3018863 - RNA, 18 nt, Mycobacterium avium subsp. paratuberculosis
gcggucgcaggcgagccg

SEQ ID NO: 3018864 - RNA, 19 nt, Mycobacterium avium subsp. paratuberculosis
gcggucgcaggcgagccgg

SEQ ID NO: 3018865 - RNA, 22 nt, Mycobacterium avium subsp. paratuberculosis
gcggucgccaccaccagcgggc

SEQ ID NO: 3018866 - RNA, 16 nt, Mycobacterium avium subsp. paratuberculosis
gcggucgccagcgcca

SEQ ID NO: 3018867 - RNA, 18 nt, Mycobacterium avium subsp. paratuberculosis
gcggucgccagcgccacg

SEQ ID NO: 3018868 - RNA, 21 nt, Mycobacterium avium subsp. paratuberculosis
gcggucgccagcgccacgcuc

SEQ ID NO: 3018869 - RNA, 13 nt, Mycobacterium avium subsp. paratuberculosis
gcggucgccccag

SEQ ID NO: 3018870 - RNA, 16 nt, Mycobacterium avium subsp. paratuberculosis
gcggucgccccggccg

SEQ ID NO: 3018871 - RNA, 17 nt, Mycobacterium avium subsp. paratuberculosis
gcggucgccccggccgc

SEQ ID NO: 3018872 - RNA, 21 nt, Mycobacterium avium subsp. paratuberculosis
gcggucgccccggccgcggug

SEQ ID NO: 3018873 - RNA, 22 nt, Mycobacterium avium subsp. paratuberculosis
gcggucgccccggccgcgguga

SEQ ID NO: 3018874 - RNA, 13 nt, Mycobacterium avium subsp. paratuberculosis
gcggucgccgccc

SEQ ID NO: 3018875 - RNA, 18 nt, Mycobacterium avium subsp. paratuberculosis
gcggucgccgcccacgcc

SEQ ID NO: 3018876 - RNA, 14 nt, Mycobacterium avium subsp. paratuberculosis
gcggucgcgcagcc

SEQ ID NO: 3018877 - RNA, 15 nt, Mycobacterium avium subsp. paratuberculosis
gcggugaccacgccg

SEQ ID NO: 3018878 - RNA, 19 nt, Mycobacterium avium subsp. paratuberculosis
gcggugaccacgccgugcc

SEQ ID NO: 3018879 - RNA, 20 nt, Mycobacterium avium subsp. paratuberculosis
gcggugaccacgccgugccc

SEQ ID NO: 3018880 - RNA, 23 nt, Mycobacterium avium subsp. paratuberculosis
gcggugaccacgccgugcccggc

SEQ ID NO: 3018881 - RNA, 14 nt, Mycobacterium avium subsp. paratuberculosis
gcggugaccgcccg

SEQ ID NO: 3018882 - RNA, 17 nt, Mycobacterium avium subsp. paratuberculosis
gcggugaccgcccgcuc

SEQ ID NO: 3018883 - RNA, 18 nt, Mycobacterium avium subsp. paratuberculosis
gcggugaccgcccgcucg

SEQ ID NO: 3018884 - RNA, 21 nt, Mycobacterium avium subsp. paratuberculosis
gcggugaccgcccgcucgacg

SEQ ID NO: 3018885 - RNA, 22 nt, Mycobacterium avium subsp. paratuberculosis
gcggugaccgcccgcucgacgg

SEQ ID NO: 3018886 - RNA, 13 nt, Mycobacterium avium subsp. paratuberculosis
gcggugaccgccg

SEQ ID NO: 3018887 - RNA, 13 nt, Mycobacterium avium subsp. paratuberculosis
gcggugaccgcgc

SEQ ID NO: 3018888 - RNA, 15 nt, Mycobacterium avium subsp. paratuberculosis
gcggugaccgcgccg

SEQ ID NO: 3018889 - RNA, 18 nt, Mycobacterium avium subsp. paratuberculosis
gcggugaccgcgccgcgg

SEQ ID NO: 3018890 - RNA, 14 nt, Mycobacterium avium subsp. paratuberculosis
gcggugaccgcggc

SEQ ID NO: 3018891 - RNA, 16 nt, Mycobacterium avium subsp. paratuberculosis
gcggugaccgcggccu

SEQ ID NO: 3018892 - RNA, 17 nt, Mycobacterium avium subsp. paratuberculosis
gcggugaccgcggccuc

SEQ ID NO: 3018893 - RNA, 19 nt, Mycobacterium avium subsp. paratuberculosis
gcggugaccgcggccucgu

SEQ ID NO: 3018894 - RNA, 20 nt, Mycobacterium avium subsp. paratuberculosis
gcggugaccggaucggccag

SEQ ID NO: 3018895 - RNA, 21 nt, Mycobacterium avium subsp. paratuberculosis
gcggugaccggaucggccagc

SEQ ID NO: 3018896 - RNA, 21 nt, Mycobacterium avium subsp. paratuberculosis
gcggugaccucgagcaccggc

SEQ ID NO: 3018897 - RNA, 22 nt, Mycobacterium avium subsp. paratuberculosis
gcggugaccuugcgggcgguca

SEQ ID NO: 3018898 - RNA, 21 nt, Mycobacterium avium subsp. paratuberculosis
gcggugacgaacccgccgcgg

SEQ ID NO: 3018899 - RNA, 19 nt, Mycobacterium avium subsp. paratuberculosis
gcggugacgaugaugucgg

SEQ ID NO: 3018900 - RNA, 12 nt, Mycobacterium avium subsp. paratuberculosis
gcggugacgcgc

SEQ ID NO: 3018901 - RNA, 19 nt, Mycobacterium avium subsp. paratuberculosis
gcggugacgcgccggccca

SEQ ID NO: 3018902 - RNA, 18 nt, Mycobacterium avium subsp. paratuberculosis
gcggugagcaccggaucg

SEQ ID NO: 3018903 - RNA, 15 nt, Mycobacterium avium subsp. paratuberculosis
gcggugagcagcaug

SEQ ID NO: 3018904 - RNA, 22 nt, Mycobacterium avium subsp. paratuberculosis
gcggugagcagcaugccgagca

SEQ ID NO: 3018905 - RNA, 18 nt, Mycobacterium avium subsp. paratuberculosis
gcggugagccgccacagc

SEQ ID NO: 3018906 - RNA, 17 nt, Mycobacterium avium subsp. paratuberculosis
gcggugagcgcgccggc

SEQ ID NO: 3018907 - RNA, 21 nt, Mycobacterium avium subsp. paratuberculosis
gcggugagcgcgccggcccga

SEQ ID NO: 3018908 - RNA, 14 nt, Mycobacterium avium subsp. paratuberculosis
gcggugagcgcguc

SEQ ID NO: 3018909 - RNA, 15 nt, Mycobacterium avium subsp. paratuberculosis
gcggugagcggccgc

SEQ ID NO: 3018910 - RNA, 18 nt, Mycobacterium avium subsp. paratuberculosis
gcggugagcggccgcagc

SEQ ID NO: 3018911 - RNA, 16 nt, Mycobacterium avium subsp. paratuberculosis
gcggugagcguagccc

SEQ ID NO: 3018912 - RNA, 21 nt, Mycobacterium avium subsp. paratuberculosis
gcggugagcugaucgcgucga

SEQ ID NO: 3018913 - RNA, 20 nt, Mycobacterium avium subsp. paratuberculosis
gcggugaguucaucgacguc

SEQ ID NO: 3018914 - RNA, 17 nt, Mycobacterium avium subsp. paratuberculosis
gcggugauccgcccggc

SEQ ID NO: 3018915 - RNA, 14 nt, Mycobacterium avium subsp. paratuberculosis
gcggugaucgcguc

SEQ ID NO: 3018916 - RNA, 23 nt, Mycobacterium avium subsp. paratuberculosis
gcggugaucgcgucaaccaccgg

SEQ ID NO: 3018917 - RNA, 16 nt, Mycobacterium avium subsp. paratuberculosis
gcggugaucucgucgg

SEQ ID NO: 3018918 - RNA, 17 nt, Mycobacterium avium subsp. paratuberculosis
gcggugaucucgucggc

SEQ ID NO: 3018919 - RNA, 21 nt, Mycobacterium avium subsp. paratuberculosis
gcggugaucucgucggcggcg

SEQ ID NO: 3018920 - RNA, 22 nt, Mycobacterium avium subsp. paratuberculosis
gcggugaucucgucggcggcgg

SEQ ID NO: 3018921 - RNA, 18 nt, Mycobacterium avium subsp. paratuberculosis
gcggugaugccgaguucc

SEQ ID NO: 3018922 - RNA, 15 nt, Mycobacterium avium subsp. paratuberculosis
gcggugaugcgcgcc

SEQ ID NO: 3018923 - RNA, 14 nt, Mycobacterium avium subsp. paratuberculosis
gcggugaugcgcgg

SEQ ID NO: 3018924 - RNA, 23 nt, Mycobacterium avium subsp. paratuberculosis
gcggugcaacgccgccgacagca

SEQ ID NO: 3018925 - RNA, 13 nt, Mycobacterium avium subsp. paratuberculosis
gcggugcaccacc

SEQ ID NO: 3018926 - RNA, 15 nt, Mycobacterium avium subsp. paratuberculosis
gcggugcaccaccgu

SEQ ID NO: 3018927 - RNA, 23 nt, Mycobacterium avium subsp. paratuberculosis
gcggugcaccaccgugccgucgc

SEQ ID NO: 3018928 - RNA, 13 nt, Mycobacterium avium subsp. paratuberculosis
gcggugcaccgcg

SEQ ID NO: 3018929 - RNA, 16 nt, Mycobacterium avium subsp. paratuberculosis
gcggugcaccgcggcg

SEQ ID NO: 3018930 - RNA, 17 nt, Mycobacterium avium subsp. paratuberculosis
gcggugcaccgcggcgc

SEQ ID NO: 3018931 - RNA, 19 nt, Mycobacterium avium subsp. paratuberculosis
gcggugcaccgcggcgcgc

SEQ ID NO: 3018932 - RNA, 20 nt, Mycobacterium avium subsp. paratuberculosis
gcggugcaccgcggcgcgca

SEQ ID NO: 3018933 - RNA, 22 nt, Mycobacterium avium subsp. paratuberculosis
gcggugcaccgcggcgcgcauc

SEQ ID NO: 3018934 - RNA, 14 nt, Mycobacterium avium subsp. paratuberculosis
gcggugcagcagga

SEQ ID NO: 3018935 - RNA, 14 nt, Mycobacterium avium subsp. paratuberculosis
gcggugcagccccg

SEQ ID NO: 3018936 - RNA, 15 nt, Mycobacterium avium subsp. paratuberculosis
gcggugcagccccgc

SEQ ID NO: 3018937 - RNA, 14 nt, Mycobacterium avium subsp. paratuberculosis
gcggugcagccggg

SEQ ID NO: 3018938 - RNA, 18 nt, Mycobacterium avium subsp. paratuberculosis
gcggugcagccgggggcg

SEQ ID NO: 3018939 - RNA, 15 nt, Mycobacterium avium subsp. paratuberculosis
gcggugcagccgggu

SEQ ID NO: 3018940 - RNA, 21 nt, Mycobacterium avium subsp. paratuberculosis
gcggugcagccgggugcggug

SEQ ID NO: 3018941 - RNA, 23 nt, Mycobacterium avium subsp. paratuberculosis
gcggugcagccgggugcggugca

SEQ ID NO: 3018942 - RNA, 19 nt, Mycobacterium avium subsp. paratuberculosis
gcggugcagucggucgguc

SEQ ID NO: 3018943 - RNA, 13 nt, Mycobacterium avium subsp. paratuberculosis
gcggugcaucguc

SEQ ID NO: 3018944 - RNA, 15 nt, Mycobacterium avium subsp. paratuberculosis
gcggugcaucgucgc

SEQ ID NO: 3018945 - RNA, 20 nt, Mycobacterium avium subsp. paratuberculosis
gcggugcaucgucgcggcgg

SEQ ID NO: 3018946 - RNA, 17 nt, Mycobacterium avium subsp. paratuberculosis
gcggugcccagccaggc

SEQ ID NO: 3018947 - RNA, 21 nt, Mycobacterium avium subsp. paratuberculosis
gcggugcccagccaggccgcc

SEQ ID NO: 3018948 - RNA, 22 nt, Mycobacterium avium subsp. paratuberculosis
gcggugcccagccgcaggugca

SEQ ID NO: 3018949 - RNA, 23 nt, Mycobacterium avium subsp. paratuberculosis
gcggugccgaaccggaucuggcc

SEQ ID NO: 3018950 - RNA, 13 nt, Mycobacterium avium subsp. paratuberculosis
gcggugccgaccu

SEQ ID NO: 3018951 - RNA, 18 nt, Mycobacterium avium subsp. paratuberculosis
gcggugccgaccugggcg

SEQ ID NO: 3018952 - RNA, 21 nt, Mycobacterium avium subsp. paratuberculosis
gcggugccgaccugggcggcc

SEQ ID NO: 3018953 - RNA, 22 nt, Mycobacterium avium subsp. paratuberculosis
gcggugccgaccugggcggcca

SEQ ID NO: 3018954 - RNA, 19 nt, Mycobacterium avium subsp. paratuberculosis
gcggugccgagcccgccgg

SEQ ID NO: 3018955 - RNA, 13 nt, Mycobacterium avium subsp. paratuberculosis
gcggugccgcagc

SEQ ID NO: 3018956 - RNA, 14 nt, Mycobacterium avium subsp. paratuberculosis
gcggugccgcagcu

SEQ ID NO: 3018957 - RNA, 15 nt, Mycobacterium avium subsp. paratuberculosis
gcggugccgcagcuc

SEQ ID NO: 3018958 - RNA, 20 nt, Mycobacterium avium subsp. paratuberculosis
gcggugccgcagcucgauca

SEQ ID NO: 3018959 - RNA, 14 nt, Mycobacterium avium subsp. paratuberculosis
gcggugccgcccgg

SEQ ID NO: 3018960 - RNA, 14 nt, Mycobacterium avium subsp. paratuberculosis
gcggugccgcggcg

SEQ ID NO: 3018961 - RNA, 14 nt, Mycobacterium avium subsp. paratuberculosis
gcggugggcggcgg

SEQ ID NO: 3018962 - RNA, 15 nt, Mycobacterium avium subsp. paratuberculosis
gcggugggcucggcg

SEQ ID NO: 3018963 - RNA, 17 nt, Mycobacterium avium subsp. paratuberculosis
gcggugggcucggcgcc

SEQ ID NO: 3018964 - RNA, 16 nt, Mycobacterium avium subsp. paratuberculosis
gcggugggcucgucga

SEQ ID NO: 3018965 - RNA, 16 nt, Mycobacterium avium subsp. paratuberculosis
gcgguggggccgaagc

SEQ ID NO: 3018966 - RNA, 19 nt, Mycobacterium avium subsp. paratuberculosis
gcgguggggccgaagccga

SEQ ID NO: 3018967 - RNA, 13 nt, Mycobacterium avium subsp. paratuberculosis
gcgguggguccgc

SEQ ID NO: 3018968 - RNA, 16 nt, Mycobacterium avium subsp. paratuberculosis
gcgguggguccgccgg

SEQ ID NO: 3018969 - RNA, 18 nt, Mycobacterium avium subsp. paratuberculosis
gcgguggguccgccgggc

SEQ ID NO: 3018970 - RNA, 19 nt, Mycobacterium avium subsp. paratuberculosis
gcgguggucagcaccggcg

SEQ ID NO: 3018971 - RNA, 16 nt, Mycobacterium avium subsp. paratuberculosis
gcgguggucagcggcg

SEQ ID NO: 3018972 - RNA, 22 nt, Mycobacterium avium subsp. paratuberculosis
gcgguggucagcggcgccaccg

SEQ ID NO: 3018973 - RNA, 14 nt, Mycobacterium avium subsp. paratuberculosis
gcggugguccgcgc

SEQ ID NO: 3018974 - RNA, 19 nt, Mycobacterium avium subsp. paratuberculosis
gcggugguccgcgcgacca

SEQ ID NO: 3018975 - RNA, 14 nt, Mycobacterium avium subsp. paratuberculosis
gcgguggucgaaca

SEQ ID NO: 3018976 - RNA, 19 nt, Mycobacterium avium subsp. paratuberculosis
gcgguggucgaacacggcg

SEQ ID NO: 3018977 - RNA, 13 nt, Mycobacterium avium subsp. paratuberculosis
gcgguggucggcg

SEQ ID NO: 3018978 - RNA, 12 nt, Mycobacterium avium subsp. paratuberculosis
gcgguggucggg

SEQ ID NO: 3018979 - RNA, 13 nt, Mycobacterium avium subsp. paratuberculosis
gcgguggucgggg

SEQ ID NO: 3018980 - RNA, 16 nt, Mycobacterium avium subsp. paratuberculosis
gcgguggucggggucg

SEQ ID NO: 3018981 - RNA, 17 nt, Mycobacterium avium subsp. paratuberculosis
gcgguggucggggucga

SEQ ID NO: 3018982 - RNA, 22 nt, Mycobacterium avium subsp. paratuberculosis
gcgguggugaacgcgucgguca

SEQ ID NO: 3018983 - RNA, 17 nt, Mycobacterium avium subsp. paratuberculosis
gcgguggugauggacgg

SEQ ID NO: 3018984 - RNA, 21 nt, Mycobacterium avium subsp. paratuberculosis
gcgguggugauggacggggcg

SEQ ID NO: 3018985 - RNA, 16 nt, Mycobacterium avium subsp. paratuberculosis
gcgguggugccgccgu

SEQ ID NO: 3018986 - RNA, 15 nt, Mycobacterium avium subsp. paratuberculosis
gcgguggugcucgcc

SEQ ID NO: 3018987 - RNA, 23 nt, Mycobacterium avium subsp. paratuberculosis
gcgguggugcucgccccgcccga

SEQ ID NO: 3018988 - RNA, 11 nt, Mycobacterium avium subsp. paratuberculosis
gcggugguggg

SEQ ID NO: 3018989 - RNA, 13 nt, Mycobacterium avium subsp. paratuberculosis
gcgguggugggcg

SEQ ID NO: 3018990 - RNA, 16 nt, Mycobacterium avium subsp. paratuberculosis
gcggugguuaccagcu

SEQ ID NO: 3018991 - RNA, 17 nt, Mycobacterium avium subsp. paratuberculosis
gcggugguuaccagcuc

SEQ ID NO: 3018992 - RNA, 13 nt, Mycobacterium avium subsp. paratuberculosis
gcggugguugggg

SEQ ID NO: 3018993 - RNA, 14 nt, Mycobacterium avium subsp. paratuberculosis
gcggugguuggggu

SEQ ID NO: 3018994 - RNA, 19 nt, Mycobacterium avium subsp. paratuberculosis
gcgguguaaccguggcagg

SEQ ID NO: 3018995 - RNA, 21 nt, Mycobacterium avium subsp. paratuberculosis
gcgguguaaccguggcaggcg

SEQ ID NO: 3018996 - RNA, 19 nt, Mycobacterium avium subsp. paratuberculosis
gcgguguacagcgcgccgc

SEQ ID NO: 3018997 - RNA, 21 nt, Mycobacterium avium subsp. paratuberculosis
gcgguguacagcgcgccgcgg

SEQ ID NO: 3018998 - RNA, 14 nt, Mycobacterium avium subsp. paratuberculosis
gcggugucaccgac

SEQ ID NO: 3018999 - RNA, 21 nt, Mycobacterium avium subsp. paratuberculosis
gcggugucaccgacgccagcg

SEQ ID NO: 3019000 - RNA, 19 nt, Mycobacterium avium subsp. paratuberculosis
gcggugucgaaggccgggg

SEQ ID NO: 3019001 - RNA, 21 nt, Mycobacterium avium subsp. paratuberculosis
gcggugucgaaggccggggug

SEQ ID NO: 3019002 - RNA, 13 nt, Mycobacterium avium subsp. paratuberculosis
gcggugucgccca

SEQ ID NO: 3019003 - RNA, 13 nt, Mycobacterium avium subsp. paratuberculosis
gcggugucggcgc

SEQ ID NO: 3019004 - RNA, 18 nt, Mycobacterium avium subsp. paratuberculosis
gcggugucggcgccccgg

SEQ ID NO: 3019005 - RNA, 20 nt, Mycobacterium avium subsp. paratuberculosis
gcggugucggcgccccggcg

SEQ ID NO: 3019006 - RNA, 16 nt, Mycobacterium avium subsp. paratuberculosis
gcggugucggcggcaa

SEQ ID NO: 3019007 - RNA, 13 nt, Mycobacterium avium subsp. paratuberculosis
gcggugucggcgu

SEQ ID NO: 3019008 - RNA, 15 nt, Mycobacterium avium subsp. paratuberculosis
gcggugucggugccg

SEQ ID NO: 3019009 - RNA, 19 nt, Mycobacterium avium subsp. paratuberculosis
gcggugucggugccgagca

SEQ ID NO: 3019010 - RNA, 23 nt, Mycobacterium avium subsp. paratuberculosis
gcggugucggugccgagcacgcg

SEQ ID NO: 3019011 - RNA, 21 nt, Mycobacterium avium subsp. paratuberculosis
gcggugucguaguugcgcgcc

SEQ ID NO: 3019012 - RNA, 16 nt, Mycobacterium avium subsp. paratuberculosis
gcggugugcggcggcu

SEQ ID NO: 3019013 - RNA, 17 nt, Mycobacterium avium subsp. paratuberculosis
gcggugugcuggccagc

SEQ ID NO: 3019014 - RNA, 18 nt, Mycobacterium avium subsp. paratuberculosis
gcggugugcuggccagca

SEQ ID NO: 3019015 - RNA, 21 nt, Mycobacterium avium subsp. paratuberculosis
gcggugugcuggccagcacca

SEQ ID NO: 3019016 - RNA, 23 nt, Mycobacterium avium subsp. paratuberculosis
gcggugugcuggccagcaccagc

SEQ ID NO: 3019017 - RNA, 14 nt, Mycobacterium avium subsp. paratuberculosis
gcgguguggccgcg

SEQ ID NO: 3019018 - RNA, 16 nt, Mycobacterium avium subsp. paratuberculosis
gcggugugggcgaugg

SEQ ID NO: 3019019 - RNA, 21 nt, Mycobacterium avium subsp. paratuberculosis
gcggugugggcggacugcccg

SEQ ID NO: 3019020 - RNA, 16 nt, Mycobacterium avium subsp. paratuberculosis
gcgguguucgagggcg

SEQ ID NO: 3019021 - RNA, 17 nt, Mycobacterium avium subsp. paratuberculosis
gcgguguucgagggcgc

SEQ ID NO: 3019022 - RNA, 22 nt, Mycobacterium avium subsp. paratuberculosis
gcgguguucgagggcgcggcgu

SEQ ID NO: 3019023 - RNA, 17 nt, Mycobacterium avium subsp. paratuberculosis
gcgguguucgauaucgc

SEQ ID NO: 3019024 - RNA, 21 nt, Mycobacterium avium subsp. paratuberculosis
gcgguguugagcgcguugcgg

SEQ ID NO: 3019025 - RNA, 15 nt, Mycobacterium avium subsp. paratuberculosis
gcgguguuggcggcg

SEQ ID NO: 3019026 - RNA, 16 nt, Mycobacterium avium subsp. paratuberculosis
gcgguguuuggccgcg

SEQ ID NO: 3019027 - RNA, 17 nt, Mycobacterium avium subsp. paratuberculosis
gcgguguuuggccgcgc

SEQ ID NO: 3019028 - RNA, 18 nt, Mycobacterium avium subsp. paratuberculosis
gcgguguuuggccgcgca

SEQ ID NO: 3019029 - RNA, 20 nt, Mycobacterium avium subsp. paratuberculosis
gcgguguuuggccgcgcagc

SEQ ID NO: 3019030 - RNA, 16 nt, Mycobacterium avium subsp. paratuberculosis
gcgguucacgcggcug

SEQ ID NO: 3019031 - RNA, 18 nt, Mycobacterium avium subsp. paratuberculosis
gcgguucacgcggcuggc

SEQ ID NO: 3019032 - RNA, 16 nt, Mycobacterium avium subsp. paratuberculosis
gcgguuccagaccggc

SEQ ID NO: 3019033 - RNA, 19 nt, Mycobacterium avium subsp. paratuberculosis
gcgguuccagaccggcggc

SEQ ID NO: 3019034 - RNA, 22 nt, Mycobacterium avium subsp. paratuberculosis
gcgguuccugcgcuaccaggcg

SEQ ID NO: 3019035 - RNA, 23 nt, Mycobacterium avium subsp. paratuberculosis
gcgguucgauaccguccgcgccc

SEQ ID NO: 3019036 - RNA, 23 nt, Mycobacterium avium subsp. paratuberculosis
gcgguucggaguccaccggcgga

SEQ ID NO: 3019037 - RNA, 14 nt, Mycobacterium avium subsp. paratuberculosis
gcgguucggcgacg

SEQ ID NO: 3019038 - RNA, 18 nt, Mycobacterium avium subsp. paratuberculosis
gcgguucggcgacgcugg

SEQ ID NO: 3019039 - RNA, 19 nt, Mycobacterium avium subsp. paratuberculosis
gcgguucggcgacgcuggu

SEQ ID NO: 3019040 - RNA, 14 nt, Mycobacterium avium subsp. paratuberculosis
gcgguucggcgggc

SEQ ID NO: 3019041 - RNA, 15 nt, Mycobacterium avium subsp. paratuberculosis
gcgguucgggcccca

SEQ ID NO: 3019042 - RNA, 15 nt, Mycobacterium avium subsp. paratuberculosis
gcgguucgucgcggc

SEQ ID NO: 3019043 - RNA, 15 nt, Mycobacterium avium subsp. paratuberculosis
gcgguugaacaggcu

SEQ ID NO: 3019044 - RNA, 12 nt, Mycobacterium avium subsp. paratuberculosis
gcgguugaccgc

SEQ ID NO: 3019045 - RNA, 14 nt, Mycobacterium avium subsp. paratuberculosis
gcgguugaccgccg

SEQ ID NO: 3019046 - RNA, 16 nt, Mycobacterium avium subsp. paratuberculosis
gcguaggacagcagcc

SEQ ID NO: 3019047 - RNA, 13 nt, Mycobacterium avium subsp. paratuberculosis
gcguaggccagga

SEQ ID NO: 3019048 - RNA, 15 nt, Mycobacterium avium subsp. paratuberculosis
gcguagggcagcccg

SEQ ID NO: 3019049 - RNA, 16 nt, Mycobacterium avium subsp. paratuberculosis
gcguagggcagcccga

SEQ ID NO: 3019050 - RNA, 18 nt, Mycobacterium avium subsp. paratuberculosis
gcguaggugggcagcgcg

SEQ ID NO: 3019051 - RNA, 21 nt, Mycobacterium avium subsp. paratuberculosis
gcguaggugggcagcgcggcc

SEQ ID NO: 3019052 - RNA, 23 nt, Mycobacterium avium subsp. paratuberculosis
gcguaggugggcagcgcggccag

SEQ ID NO: 3019053 - RNA, 14 nt, Mycobacterium avium subsp. paratuberculosis
gcguaguccagcac

SEQ ID NO: 3019054 - RNA, 17 nt, Mycobacterium avium subsp. paratuberculosis
gcguaguccagcacggc

SEQ ID NO: 3019055 - RNA, 20 nt, Mycobacterium avium subsp. paratuberculosis
gcguaguccagcacggcgaa

SEQ ID NO: 3019056 - RNA, 22 nt, Mycobacterium avium subsp. paratuberculosis
gcguagucgauggccucgucgc

SEQ ID NO: 3019057 - RNA, 19 nt, Mycobacterium avium subsp. paratuberculosis
gcguagucggcgcagcgca

SEQ ID NO: 3019058 - RNA, 20 nt, Mycobacterium avium subsp. paratuberculosis
gcguagucggcgcagcgcac

SEQ ID NO: 3019059 - RNA, 17 nt, Mycobacterium avium subsp. paratuberculosis
gcguagucggcgucggc

SEQ ID NO: 3019060 - RNA, 21 nt, Mycobacterium avium subsp. paratuberculosis
gcguagucggcgucggccacc

SEQ ID NO: 3019061 - RNA, 15 nt, Mycobacterium avium subsp. paratuberculosis
gcguagucggugcag

SEQ ID NO: 3019062 - RNA, 15 nt, Mycobacterium avium subsp. paratuberculosis
gcguagugcgcccag

SEQ ID NO: 3019063 - RNA, 19 nt, Mycobacterium avium subsp. paratuberculosis
gcguaucaacugagcgccc

SEQ ID NO: 3019064 - RNA, 16 nt, Mycobacterium avium subsp. paratuberculosis
gcguauccggccagcc

SEQ ID NO: 3019065 - RNA, 17 nt, Mycobacterium avium subsp. paratuberculosis
gcguauccggccagccg

SEQ ID NO: 3019066 - RNA, 20 nt, Mycobacterium avium subsp. paratuberculosis
gcguauccggccagccgggg

SEQ ID NO: 3019067 - RNA, 14 nt, Mycobacterium avium subsp. paratuberculosis
gcguaugccggugg

SEQ ID NO: 3019068 - RNA, 16 nt, Mycobacterium avium subsp. paratuberculosis
gcguaugccgguggcg

SEQ ID NO: 3019069 - RNA, 15 nt, Mycobacterium avium subsp. paratuberculosis
gcguaugccuccucg

SEQ ID NO: 3019070 - RNA, 13 nt, Mycobacterium avium subsp. paratuberculosis
gcguauuccagcg

SEQ ID NO: 3019071 - RNA, 15 nt, Mycobacterium avium subsp. paratuberculosis
gcguauuccagcgcc

SEQ ID NO: 3019072 - RNA, 18 nt, Mycobacterium avium subsp. paratuberculosis
gcguauugcacggcggcg

SEQ ID NO: 3019073 - RNA, 15 nt, Mycobacterium avium subsp. paratuberculosis
gcgucaaccaccggc

SEQ ID NO: 3019074 - RNA, 20 nt, Mycobacterium avium subsp. paratuberculosis
gcgucaaccaccggcaucgg

SEQ ID NO: 3019075 - RNA, 21 nt, Mycobacterium avium subsp. paratuberculosis
gcgucaaccaccggcaucggu

SEQ ID NO: 3019076 - RNA, 12 nt, Mycobacterium avium subsp. paratuberculosis
gcgucaacccgu

SEQ ID NO: 3019077 - RNA, 14 nt, Mycobacterium avium subsp. paratuberculosis
gcgucaacucgucg

SEQ ID NO: 3019078 - RNA, 15 nt, Mycobacterium avium subsp. paratuberculosis
gcgucaacucgucgg

SEQ ID NO: 3019079 - RNA, 21 nt, Mycobacterium avium subsp. paratuberculosis
gcgucaauugccaacugcagc

SEQ ID NO: 3019080 - RNA, 22 nt, Mycobacterium avium subsp. paratuberculosis
gcgucaauugccaacugcagca

SEQ ID NO: 3019081 - RNA, 18 nt, Mycobacterium avium subsp. paratuberculosis
gcgucacauccgucacgc

SEQ ID NO: 3019082 - RNA, 20 nt, Mycobacterium avium subsp. paratuberculosis
gcgucacauccgucacgccc

SEQ ID NO: 3019083 - RNA, 18 nt, Mycobacterium avium subsp. paratuberculosis
gcgucaccaaugcgccgg

SEQ ID NO: 3019084 - RNA, 19 nt, Mycobacterium avium subsp. paratuberculosis
gcgucaccaaugcgccggc

SEQ ID NO: 3019085 - RNA, 20 nt, Mycobacterium avium subsp. paratuberculosis
gcgucaccaaugcgccggcg

SEQ ID NO: 3019086 - RNA, 14 nt, Mycobacterium avium subsp. paratuberculosis
gcgucaccaggcug

SEQ ID NO: 3019087 - RNA, 22 nt, Mycobacterium avium subsp. paratuberculosis
gcgucaccaggcugcucggcgg

SEQ ID NO: 3019088 - RNA, 20 nt, Mycobacterium avium subsp. paratuberculosis
gcgucaccccaccgagcagc

SEQ ID NO: 3019089 - RNA, 23 nt, Mycobacterium avium subsp. paratuberculosis
gcgucaccccaccgagcagcugc

SEQ ID NO: 3019090 - RNA, 15 nt, Mycobacterium avium subsp. paratuberculosis
gcgucaccuucacca

SEQ ID NO: 3019091 - RNA, 22 nt, Mycobacterium avium subsp. paratuberculosis
gcgucacgcaucagggccagcc

SEQ ID NO: 3019092 - RNA, 13 nt, Mycobacterium avium subsp. paratuberculosis
gcgucacgccagc

SEQ ID NO: 3019093 - RNA, 20 nt, Mycobacterium avium subsp. paratuberculosis
gcgucacgccagcgugacgc

SEQ ID NO: 3019094 - RNA, 21 nt, Mycobacterium avium subsp. paratuberculosis
gcgucacgccaguguggccgc

SEQ ID NO: 3019095 - RNA, 13 nt, Mycobacterium avium subsp. paratuberculosis
gcgucacgccgcg

SEQ ID NO: 3019096 - RNA, 14 nt, Mycobacterium avium subsp. paratuberculosis
gcgucacgccgcgc

SEQ ID NO: 3019097 - RNA, 20 nt, Mycobacterium avium subsp. paratuberculosis
gcgucacgcuagcgugacag

SEQ ID NO: 3019098 - RNA, 11 nt, Mycobacterium avium subsp. paratuberculosis
gcgucacgcug

SEQ ID NO: 3019099 - RNA, 17 nt, Mycobacterium avium subsp. paratuberculosis
gcgucacgcugcgcgcc

SEQ ID NO: 3019100 - RNA, 14 nt, Mycobacterium avium subsp. paratuberculosis
gcgucacgcuggcg

SEQ ID NO: 3019101 - RNA, 15 nt, Mycobacterium avium subsp. paratuberculosis
gcgucacgcuggcgu

SEQ ID NO: 3019102 - RNA, 16 nt, Mycobacterium avium subsp. paratuberculosis
gcgucacgcuggcgug

SEQ ID NO: 3019103 - RNA, 20 nt, Mycobacterium avium subsp. paratuberculosis
gcgucacgcuggcgugacag

SEQ ID NO: 3019104 - RNA, 20 nt, Mycobacterium avium subsp. paratuberculosis
gcgucacgcuggcgugacgg

SEQ ID NO: 3019105 - RNA, 22 nt, Mycobacterium avium subsp. paratuberculosis
gcgucacgcuggcgugacgguc

SEQ ID NO: 3019106 - RNA, 18 nt, Mycobacterium avium subsp. paratuberculosis
gcgucacgcuggcguggc

SEQ ID NO: 3019107 - RNA, 23 nt, Mycobacterium avium subsp. paratuberculosis
gcgucacgcuggcguggcacccg

SEQ ID NO: 3019108 - RNA, 19 nt, Mycobacterium avium subsp. paratuberculosis
gcgucacgcuggcguggcg

SEQ ID NO: 3019109 - RNA, 20 nt, Mycobacterium avium subsp. paratuberculosis
gcgucacgcuggcguggcgc

SEQ ID NO: 3019110 - RNA, 22 nt, Mycobacterium avium subsp. paratuberculosis
gcgucacgcuggcguggcgccg

SEQ ID NO: 3019111 - RNA, 15 nt, Mycobacterium avium subsp. paratuberculosis
gcgucacgcugguga

SEQ ID NO: 3019112 - RNA, 16 nt, Mycobacterium avium subsp. paratuberculosis
gcgucacgucgacggc

SEQ ID NO: 3019113 - RNA, 17 nt, Mycobacterium avium subsp. paratuberculosis
gcgucacuccucgaucu

SEQ ID NO: 3019114 - RNA, 16 nt, Mycobacterium avium subsp. paratuberculosis
gcgucacucuggcgug

SEQ ID NO: 3019115 - RNA, 17 nt, Mycobacterium avium subsp. paratuberculosis
gcgucacucuggcguga

SEQ ID NO: 3019116 - RNA, 20 nt, Mycobacterium avium subsp. paratuberculosis
gcgucacucuggcgugacgu

SEQ ID NO: 3019117 - RNA, 15 nt, Mycobacterium avium subsp. paratuberculosis
gcgucagaaccgggg

SEQ ID NO: 3019118 - RNA, 16 nt, Mycobacterium avium subsp. paratuberculosis
gcgucagaaccggggc

SEQ ID NO: 3019119 - RNA, 18 nt, Mycobacterium avium subsp. paratuberculosis
gcgucagaaccggggcca

SEQ ID NO: 3019120 - RNA, 21 nt, Mycobacterium avium subsp. paratuberculosis
gcgucagaaccggggccagca

SEQ ID NO: 3019121 - RNA, 22 nt, Mycobacterium avium subsp. paratuberculosis
gcgucagaaccggggccagcac

SEQ ID NO: 3019122 - RNA, 20 nt, Mycobacterium avium subsp. paratuberculosis
gcgucagagguuggcgaagc

SEQ ID NO: 3019123 - RNA, 16 nt, Mycobacterium avium subsp. paratuberculosis
gcgucagcaccgcgac

SEQ ID NO: 3019124 - RNA, 18 nt, Mycobacterium avium subsp. paratuberculosis
gcgucagcaccgcgacgg

SEQ ID NO: 3019125 - RNA, 12 nt, Mycobacterium avium subsp. paratuberculosis
gcgucagcagcg

SEQ ID NO: 3019126 - RNA, 16 nt, Mycobacterium avium subsp. paratuberculosis
gcgucagcagcgcgac

SEQ ID NO: 3019127 - RNA, 17 nt, Mycobacterium avium subsp. paratuberculosis
gcgucagcagcgcgacg

SEQ ID NO: 3019128 - RNA, 18 nt, Mycobacterium avium subsp. paratuberculosis
gcgucagcagcgcgacgc

SEQ ID NO: 3019129 - RNA, 12 nt, Mycobacterium avium subsp. paratuberculosis
gcgucagcaucg

SEQ ID NO: 3019130 - RNA, 16 nt, Mycobacterium avium subsp. paratuberculosis
gcgucagcaucgccgu

SEQ ID NO: 3019131 - RNA, 17 nt, Mycobacterium avium subsp. paratuberculosis
gcgucccggcgucucgg

SEQ ID NO: 3019132 - RNA, 13 nt, Mycobacterium avium subsp. paratuberculosis
gcgucccgggccu

SEQ ID NO: 3019133 - RNA, 17 nt, Mycobacterium avium subsp. paratuberculosis
gcgucccgggccuuggc

SEQ ID NO: 3019134 - RNA, 17 nt, Mycobacterium avium subsp. paratuberculosis
gcgucccguccugggcc

SEQ ID NO: 3019135 - RNA, 13 nt, Mycobacterium avium subsp. paratuberculosis
gcgucccgucggc

SEQ ID NO: 3019136 - RNA, 16 nt, Mycobacterium avium subsp. paratuberculosis
gcgucccgucggccag

SEQ ID NO: 3019137 - RNA, 17 nt, Mycobacterium avium subsp. paratuberculosis
gcgucccgucggccagu

SEQ ID NO: 3019138 - RNA, 19 nt, Mycobacterium avium subsp. paratuberculosis
gcgucccguuggcgccggu

SEQ ID NO: 3019139 - RNA, 21 nt, Mycobacterium avium subsp. paratuberculosis
gcgucccguuggcgccggucg

SEQ ID NO: 3019140 - RNA, 14 nt, Mycobacterium avium subsp. paratuberculosis
gcgucccuggcgau

SEQ ID NO: 3019141 - RNA, 16 nt, Mycobacterium avium subsp. paratuberculosis
gcgucccuggcgauga

SEQ ID NO: 3019142 - RNA, 22 nt, Mycobacterium avium subsp. paratuberculosis
gcgucccuggcgaugaucaaca

SEQ ID NO: 3019143 - RNA, 17 nt, Mycobacterium avium subsp. paratuberculosis
gcguccgacggcugggu

SEQ ID NO: 3019144 - RNA, 21 nt, Mycobacterium avium subsp. paratuberculosis
gcguccgacggcuggguggcg

SEQ ID NO: 3019145 - RNA, 16 nt, Mycobacterium avium subsp. paratuberculosis
gcguccgagcagcagc

SEQ ID NO: 3019146 - RNA, 18 nt, Mycobacterium avium subsp. paratuberculosis
gcguccgagcagcagccg

SEQ ID NO: 3019147 - RNA, 19 nt, Mycobacterium avium subsp. paratuberculosis
gcguccgagcagcagccgc

SEQ ID NO: 3019148 - RNA, 16 nt, Mycobacterium avium subsp. paratuberculosis
gcguccgaggcgguuc

SEQ ID NO: 3019149 - RNA, 18 nt, Mycobacterium avium subsp. paratuberculosis
gcguccgaggcgguuccg

SEQ ID NO: 3019150 - RNA, 17 nt, Mycobacterium avium subsp. paratuberculosis
gcguccgauaccagccg

SEQ ID NO: 3019151 - RNA, 20 nt, Mycobacterium avium subsp. paratuberculosis
gcguccgauaccagccgcgg

SEQ ID NO: 3019152 - RNA, 15 nt, Mycobacterium avium subsp. paratuberculosis
gcguccgcaagcacc

SEQ ID NO: 3019153 - RNA, 20 nt, Mycobacterium avium subsp. paratuberculosis
gcguccgcaagcaccucgcg

SEQ ID NO: 3019154 - RNA, 12 nt, Mycobacterium avium subsp. paratuberculosis
gcguccgccggc

SEQ ID NO: 3019155 - RNA, 13 nt, Mycobacterium avium subsp. paratuberculosis
gcguccgccggcg

SEQ ID NO: 3019156 - RNA, 15 nt, Mycobacterium avium subsp. paratuberculosis
gcguccgccggcggu

SEQ ID NO: 3019157 - RNA, 14 nt, Mycobacterium avium subsp. paratuberculosis
gcguccgcggccgc

SEQ ID NO: 3019158 - RNA, 14 nt, Mycobacterium avium subsp. paratuberculosis
gcguccgcggcgga

SEQ ID NO: 3019159 - RNA, 13 nt, Mycobacterium avium subsp. paratuberculosis
gcguccgcgggcg

SEQ ID NO: 3019160 - RNA, 21 nt, Mycobacterium avium subsp. paratuberculosis
gcguccgcgggcggggccugc

SEQ ID NO: 3019161 - RNA, 17 nt, Mycobacterium avium subsp. paratuberculosis
gcguccgcgucgucgag

SEQ ID NO: 3019162 - RNA, 22 nt, Mycobacterium avium subsp. paratuberculosis
gcguccgcgucgucgaggcgga

SEQ ID NO: 3019163 - RNA, 19 nt, Mycobacterium avium subsp. paratuberculosis
gcguccggagaaccgcucg

SEQ ID NO: 3019164 - RNA, 19 nt, Mycobacterium avium subsp. paratuberculosis
gcguccggaggugccggcc

SEQ ID NO: 3019165 - RNA, 20 nt, Mycobacterium avium subsp. paratuberculosis
gcguccggaggugccggccg

SEQ ID NO: 3019166 - RNA, 14 nt, Mycobacterium avium subsp. paratuberculosis
gcguccggcccggc

SEQ ID NO: 3019167 - RNA, 15 nt, Mycobacterium avium subsp. paratuberculosis
gcguccggcccggcg

SEQ ID NO: 3019168 - RNA, 17 nt, Mycobacterium avium subsp. paratuberculosis
gcguccggcccggcguc

SEQ ID NO: 3019169 - RNA, 20 nt, Mycobacterium avium subsp. paratuberculosis
gcguccggcgcuacgccggc

SEQ ID NO: 3019170 - RNA, 23 nt, Mycobacterium avium subsp. paratuberculosis
gcguccgggcgcugcgcgguggc

SEQ ID NO: 3019171 - RNA, 15 nt, Mycobacterium avium subsp. paratuberculosis
gcguccggucugcuc

SEQ ID NO: 3019172 - RNA, 17 nt, Mycobacterium avium subsp. paratuberculosis
gcguccggucugcuccg

SEQ ID NO: 3019173 - RNA, 20 nt, Mycobacterium avium subsp. paratuberculosis
gcguccguagugcucggcgu

SEQ ID NO: 3019174 - RNA, 12 nt, Mycobacterium avium subsp. paratuberculosis
gcguccgugccg

SEQ ID NO: 3019175 - RNA, 20 nt, Mycobacterium avium subsp. paratuberculosis
gcguccgugccguccggccg

SEQ ID NO: 3019176 - RNA, 12 nt, Mycobacterium avium subsp. paratuberculosis
gcguccuccucg

SEQ ID NO: 3019177 - RNA, 21 nt, Mycobacterium avium subsp. paratuberculosis
gcguccuccucguccgcggcg

SEQ ID NO: 3019178 - RNA, 23 nt, Mycobacterium avium subsp. paratuberculosis
gcguccuccucguccgcggcggc

SEQ ID NO: 3019179 - RNA, 13 nt, Mycobacterium avium subsp. paratuberculosis
gcguccucgacca

SEQ ID NO: 3019180 - RNA, 22 nt, Mycobacterium avium subsp. paratuberculosis
gcguccucgaccacccgcuggu

SEQ ID NO: 3019181 - RNA, 23 nt, Mycobacterium avium subsp. paratuberculosis
gcguccucgaccacccgcugguc

SEQ ID NO: 3019182 - RNA, 12 nt, Mycobacterium avium subsp. paratuberculosis
gcguccucgacg

SEQ ID NO: 3019183 - RNA, 14 nt, Mycobacterium avium subsp. paratuberculosis
gcguccucgacgcc

SEQ ID NO: 3019184 - RNA, 15 nt, Mycobacterium avium subsp. paratuberculosis
gcguccucgacgccg

SEQ ID NO: 3019185 - RNA, 16 nt, Mycobacterium avium subsp. paratuberculosis
gcguccucgacgccgc

SEQ ID NO: 3019186 - RNA, 18 nt, Mycobacterium avium subsp. paratuberculosis
gcguccucgacgccgcgc

SEQ ID NO: 3019187 - RNA, 19 nt, Mycobacterium avium subsp. paratuberculosis
gcguccucgacgguggagc

SEQ ID NO: 3019188 - RNA, 14 nt, Mycobacterium avium subsp. paratuberculosis
gcguccucgaugac

SEQ ID NO: 3019189 - RNA, 15 nt, Mycobacterium avium subsp. paratuberculosis
gcguccucgaugacg

SEQ ID NO: 3019190 - RNA, 16 nt, Mycobacterium avium subsp. paratuberculosis
gcguccucgaugacgc

SEQ ID NO: 3019191 - RNA, 21 nt, Mycobacterium avium subsp. paratuberculosis
gcguccucgaugacgccggac

SEQ ID NO: 3019192 - RNA, 18 nt, Mycobacterium avium subsp. paratuberculosis
gcguccucgucgaugccg

SEQ ID NO: 3019193 - RNA, 14 nt, Mycobacterium avium subsp. paratuberculosis
gcguccucgucggc

SEQ ID NO: 3019194 - RNA, 15 nt, Mycobacterium avium subsp. paratuberculosis
gcguccugcagcagc

SEQ ID NO: 3019195 - RNA, 18 nt, Mycobacterium avium subsp. paratuberculosis
gcguccugcagcagccgg

SEQ ID NO: 3019196 - RNA, 19 nt, Mycobacterium avium subsp. paratuberculosis
gcguccugcagcagccgga

SEQ ID NO: 3019197 - RNA, 14 nt, Mycobacterium avium subsp. paratuberculosis
gcguccugcagcgc

SEQ ID NO: 3019198 - RNA, 19 nt, Mycobacterium avium subsp. paratuberculosis
gcguccugcagcgccgucc

SEQ ID NO: 3019199 - RNA, 15 nt, Mycobacterium avium subsp. paratuberculosis
gcguccugcaggcag

SEQ ID NO: 3019200 - RNA, 16 nt, Mycobacterium avium subsp. paratuberculosis
gcguccugcaggcagg

SEQ ID NO: 3019201 - RNA, 21 nt, Mycobacterium avium subsp. paratuberculosis
gcguccugcaggcaggccggc

SEQ ID NO: 3019202 - RNA, 15 nt, Mycobacterium avium subsp. paratuberculosis
gcguccugcggggag

SEQ ID NO: 3019203 - RNA, 19 nt, Mycobacterium avium subsp. paratuberculosis
gcguccuucuccgccgggc

SEQ ID NO: 3019204 - RNA, 20 nt, Mycobacterium avium subsp. paratuberculosis
gcguccuucuccgccgggcu

SEQ ID NO: 3019205 - RNA, 23 nt, Mycobacterium avium subsp. paratuberculosis
gcguccuugaacuucagcugcuc

SEQ ID NO: 3019206 - RNA, 17 nt, Mycobacterium avium subsp. paratuberculosis
gcguccuugaccagcug

SEQ ID NO: 3019207 - RNA, 21 nt, Mycobacterium avium subsp. paratuberculosis
gcguccuugauccgggcgcca

SEQ ID NO: 3019208 - RNA, 17 nt, Mycobacterium avium subsp. paratuberculosis
gcguccuugcccgaggu

SEQ ID NO: 3019209 - RNA, 22 nt, Mycobacterium avium subsp. paratuberculosis
gcguccuugccgaucagcguca

SEQ ID NO: 3019210 - RNA, 18 nt, Mycobacterium avium subsp. paratuberculosis
gcgucgaaauagcggcgc

SEQ ID NO: 3019211 - RNA, 18 nt, Mycobacterium avium subsp. paratuberculosis
gcgucgaacagccgggcc

SEQ ID NO: 3019212 - RNA, 19 nt, Mycobacterium avium subsp. paratuberculosis
gcgucgaacagccgggccg

SEQ ID NO: 3019213 - RNA, 20 nt, Mycobacterium avium subsp. paratuberculosis
gcgucgaacagccgggccgc

SEQ ID NO: 3019214 - RNA, 22 nt, Mycobacterium avium subsp. paratuberculosis
gcgucgaacagccgggccgccc

SEQ ID NO: 3019215 - RNA, 21 nt, Mycobacterium avium subsp. paratuberculosis
gcgucgaacggcgucuggccg

SEQ ID NO: 3019216 - RNA, 18 nt, Mycobacterium avium subsp. paratuberculosis
gcgucgcccaucaccagc

SEQ ID NO: 3019217 - RNA, 19 nt, Mycobacterium avium subsp. paratuberculosis
gcgucgcccaucaccagca

SEQ ID NO: 3019218 - RNA, 14 nt, Mycobacterium avium subsp. paratuberculosis
gcgucgcccgccga

SEQ ID NO: 3019219 - RNA, 16 nt, Mycobacterium avium subsp. paratuberculosis
gcgucgcccgccgacg

SEQ ID NO: 3019220 - RNA, 12 nt, Mycobacterium avium subsp. paratuberculosis
gcgucgccgacc

SEQ ID NO: 3019221 - RNA, 13 nt, Mycobacterium avium subsp. paratuberculosis
gcgucgccgacca

SEQ ID NO: 3019222 - RNA, 17 nt, Mycobacterium avium subsp. paratuberculosis
gcgucgccgaccagcag

SEQ ID NO: 3019223 - RNA, 15 nt, Mycobacterium avium subsp. paratuberculosis
gcgucgccgacgggc

SEQ ID NO: 3019224 - RNA, 16 nt, Mycobacterium avium subsp. paratuberculosis
gcgucgccgacgggcc

SEQ ID NO: 3019225 - RNA, 17 nt, Mycobacterium avium subsp. paratuberculosis
gcgucgccgagccgcgc

SEQ ID NO: 3019226 - RNA, 18 nt, Mycobacterium avium subsp. paratuberculosis
gcgucgccgagccgcgcc

SEQ ID NO: 3019227 - RNA, 16 nt, Mycobacterium avium subsp. paratuberculosis
gcgucgccgagcucgu

SEQ ID NO: 3019228 - RNA, 12 nt, Mycobacterium avium subsp. paratuberculosis
gcgucgccgccc

SEQ ID NO: 3019229 - RNA, 13 nt, Mycobacterium avium subsp. paratuberculosis
gcgucgccgcccc

SEQ ID NO: 3019230 - RNA, 13 nt, Mycobacterium avium subsp. paratuberculosis
gcgucgccgccgg

SEQ ID NO: 3019231 - RNA, 15 nt, Mycobacterium avium subsp. paratuberculosis
gcgucgccgccgggc

SEQ ID NO: 3019232 - RNA, 16 nt, Mycobacterium avium subsp. paratuberculosis
gcgucgccgccgggcg

SEQ ID NO: 3019233 - RNA, 15 nt, Mycobacterium avium subsp. paratuberculosis
gcgucgccgccggug

SEQ ID NO: 3019234 - RNA, 15 nt, Mycobacterium avium subsp. paratuberculosis
gcgucgccgcuggug

SEQ ID NO: 3019235 - RNA, 20 nt, Mycobacterium avium subsp. paratuberculosis
gcgucgccuuccugcgcgug

SEQ ID NO: 3019236 - RNA, 12 nt, Mycobacterium avium subsp. paratuberculosis
gcgucgcgcagc

SEQ ID NO: 3019237 - RNA, 17 nt, Mycobacterium avium subsp. paratuberculosis
gcgucgcgcagcagcgg

SEQ ID NO: 3019238 - RNA, 13 nt, Mycobacterium avium subsp. paratuberculosis
gcgucgcgccagc

SEQ ID NO: 3019239 - RNA, 21 nt, Mycobacterium avium subsp. paratuberculosis
gcgucgcgccagcgguccagc

SEQ ID NO: 3019240 - RNA, 14 nt, Mycobacterium avium subsp. paratuberculosis
gcgucgcgcccggc

SEQ ID NO: 3019241 - RNA, 17 nt, Mycobacterium avium subsp. paratuberculosis
gcgucgcgcccggcguc

SEQ ID NO: 3019242 - RNA, 14 nt, Mycobacterium avium subsp. paratuberculosis
gcgucgcgccgcca

SEQ ID NO: 3019243 - RNA, 16 nt, Mycobacterium avium subsp. paratuberculosis
gcgucgcgcgguuccg

SEQ ID NO: 3019244 - RNA, 22 nt, Mycobacterium avium subsp. paratuberculosis
gcgucgcgcgguuccggcgugc

SEQ ID NO: 3019245 - RNA, 15 nt, Mycobacterium avium subsp. paratuberculosis
gcgucgcggccggga

SEQ ID NO: 3019246 - RNA, 13 nt, Mycobacterium avium subsp. paratuberculosis
gcgucgcggcggc

SEQ ID NO: 3019247 - RNA, 14 nt, Mycobacterium avium subsp. paratuberculosis
gcgucgcggcggcg

SEQ ID NO: 3019248 - RNA, 15 nt, Mycobacterium avium subsp. paratuberculosis
gcgucgcggcggcgc

SEQ ID NO: 3019249 - RNA, 11 nt, Mycobacterium avium subsp. paratuberculosis
gcgucgcggug

SEQ ID NO: 3019250 - RNA, 21 nt, Mycobacterium avium subsp. paratuberculosis
gcgucgcggugaaguugccgc

SEQ ID NO: 3019251 - RNA, 15 nt, Mycobacterium avium subsp. paratuberculosis
gcgucgcgguggagc

SEQ ID NO: 3019252 - RNA, 13 nt, Mycobacterium avium subsp. paratuberculosis
gcgucgcugaacg

SEQ ID NO: 3019253 - RNA, 14 nt, Mycobacterium avium subsp. paratuberculosis
gcgucgcugcccag

SEQ ID NO: 3019254 - RNA, 20 nt, Mycobacterium avium subsp. paratuberculosis
gcgucgcugccguagcgcug

SEQ ID NO: 3019255 - RNA, 15 nt, Mycobacterium avium subsp. paratuberculosis
gcgucgcugggcagc

SEQ ID NO: 3019256 - RNA, 19 nt, Mycobacterium avium subsp. paratuberculosis
gcgucgcugucggcgaaac

SEQ ID NO: 3019257 - RNA, 18 nt, Mycobacterium avium subsp. paratuberculosis
gcgucggaauacagcagc

SEQ ID NO: 3019258 - RNA, 19 nt, Mycobacterium avium subsp. paratuberculosis
gcgucggaauacagcagcu

SEQ ID NO: 3019259 - RNA, 14 nt, Mycobacterium avium subsp. paratuberculosis
gcgucggacaugcc

SEQ ID NO: 3019260 - RNA, 21 nt, Mycobacterium avium subsp. paratuberculosis
gcgucggacaugccggcgccg

SEQ ID NO: 3019261 - RNA, 14 nt, Mycobacterium avium subsp. paratuberculosis
gcgucggacgccag

SEQ ID NO: 3019262 - RNA, 17 nt, Mycobacterium avium subsp. paratuberculosis
gcgucggagaucaccgg

SEQ ID NO: 3019263 - RNA, 18 nt, Mycobacterium avium subsp. paratuberculosis
gcgucggagaucaccggc

SEQ ID NO: 3019264 - RNA, 18 nt, Mycobacterium avium subsp. paratuberculosis
gcgucggagaugcgggcc

SEQ ID NO: 3019265 - RNA, 22 nt, Mycobacterium avium subsp. paratuberculosis
gcgucggagaugcgggccaccg

SEQ ID NO: 3019266 - RNA, 15 nt, Mycobacterium avium subsp. paratuberculosis
gcgucggaggcggcg

SEQ ID NO: 3019267 - RNA, 17 nt, Mycobacterium avium subsp. paratuberculosis
gcgucggaggcggcgua

SEQ ID NO: 3019268 - RNA, 21 nt, Mycobacterium avium subsp. paratuberculosis
gcgucggagucgcuguuggcg

SEQ ID NO: 3019269 - RNA, 22 nt, Mycobacterium avium subsp. paratuberculosis
gcgucggagucgcuguuggcga

SEQ ID NO: 3019270 - RNA, 14 nt, Mycobacterium avium subsp. paratuberculosis
gcgucggcaccagc

SEQ ID NO: 3019271 - RNA, 17 nt, Mycobacterium avium subsp. paratuberculosis
gcgucggcaccagcggc

SEQ ID NO: 3019272 - RNA, 13 nt, Mycobacterium avium subsp. paratuberculosis
gcgucggccaacg

SEQ ID NO: 3019273 - RNA, 14 nt, Mycobacterium avium subsp. paratuberculosis
gcgucggccaccgc

SEQ ID NO: 3019274 - RNA, 12 nt, Mycobacterium avium subsp. paratuberculosis
gcgucggccagc

SEQ ID NO: 3019275 - RNA, 13 nt, Mycobacterium avium subsp. paratuberculosis
gcgucggccagca

SEQ ID NO: 3019276 - RNA, 15 nt, Mycobacterium avium subsp. paratuberculosis
gcgucggccagcacc

SEQ ID NO: 3019277 - RNA, 16 nt, Mycobacterium avium subsp. paratuberculosis
gcgucggccagcacca

SEQ ID NO: 3019278 - RNA, 13 nt, Mycobacterium avium subsp. paratuberculosis
gcgucggccagcg

SEQ ID NO: 3019279 - RNA, 16 nt, Mycobacterium avium subsp. paratuberculosis
gcgucggccagcgcgc

SEQ ID NO: 3019280 - RNA, 18 nt, Mycobacterium avium subsp. paratuberculosis
gcgucggccagcgcgcgg

SEQ ID NO: 3019281 - RNA, 16 nt, Mycobacterium avium subsp. paratuberculosis
gcgucggccagcggca

SEQ ID NO: 3019282 - RNA, 12 nt, Mycobacterium avium subsp. paratuberculosis
gcgucggccgca

SEQ ID NO: 3019283 - RNA, 13 nt, Mycobacterium avium subsp. paratuberculosis
gcgucggccgcac

SEQ ID NO: 3019284 - RNA, 12 nt, Mycobacterium avium subsp. paratuberculosis
gcgucggccggg

SEQ ID NO: 3019285 - RNA, 19 nt, Mycobacterium avium subsp. paratuberculosis
gcgucggccgggcugccca

SEQ ID NO: 3019286 - RNA, 23 nt, Mycobacterium avium subsp. paratuberculosis
gcgucggccgggcugcccaccac

SEQ ID NO: 3019287 - RNA, 13 nt, Mycobacterium avium subsp. paratuberculosis
gcgucggccgggg

SEQ ID NO: 3019288 - RNA, 22 nt, Mycobacterium avium subsp. paratuberculosis
gcgucggccgggggcgcgggcg

SEQ ID NO: 3019289 - RNA, 12 nt, Mycobacterium avium subsp. paratuberculosis
gcgucggccugc

SEQ ID NO: 3019290 - RNA, 11 nt, Mycobacterium avium subsp. paratuberculosis
gcgucggcgac

SEQ ID NO: 3019291 - RNA, 20 nt, Mycobacterium avium subsp. paratuberculosis
gcgucggcgaccgcgcgcgg

SEQ ID NO: 3019292 - RNA, 21 nt, Mycobacterium avium subsp. paratuberculosis
gcgucggcgaccgcgcgcggc

SEQ ID NO: 3019293 - RNA, 14 nt, Mycobacterium avium subsp. paratuberculosis
gcgucggcgacggc

SEQ ID NO: 3019294 - RNA, 16 nt, Mycobacterium avium subsp. paratuberculosis
gcgucggcgacggcgu

SEQ ID NO: 3019295 - RNA, 19 nt, Mycobacterium avium subsp. paratuberculosis
gcgucggcgacggcgucca

SEQ ID NO: 3019296 - RNA, 15 nt, Mycobacterium avium subsp. paratuberculosis
gcgucggcgagcggu

SEQ ID NO: 3019297 - RNA, 13 nt, Mycobacterium avium subsp. paratuberculosis
gcgucggcgaucu

SEQ ID NO: 3019298 - RNA, 18 nt, Mycobacterium avium subsp. paratuberculosis
gcgucggcgaucucgguc

SEQ ID NO: 3019299 - RNA, 23 nt, Mycobacterium avium subsp. paratuberculosis
gcgucggcgauguccuugucgcu

SEQ ID NO: 3019300 - RNA, 16 nt, Mycobacterium avium subsp. paratuberculosis
gcgucggcgccggauc

SEQ ID NO: 3019301 - RNA, 14 nt, Mycobacterium avium subsp. paratuberculosis
gcgucggcgccggc

SEQ ID NO: 3019302 - RNA, 20 nt, Mycobacterium avium subsp. paratuberculosis
gcgcggauuccagcgcgacc

SEQ ID NO: 3019303 - RNA, 22 nt, Mycobacterium avium subsp. paratuberculosis
gcgcggauuucucagcggcgcu

SEQ ID NO: 3019304 - RNA, 13 nt, Mycobacterium avium subsp. paratuberculosis
gcgcggcaccacc

SEQ ID NO: 3019305 - RNA, 17 nt, Mycobacterium avium subsp. paratuberculosis
gcgcggcaccaccagcg

SEQ ID NO: 3019306 - RNA, 17 nt, Mycobacterium avium subsp. paratuberculosis
gcgcggcacgguggcca

SEQ ID NO: 3019307 - RNA, 21 nt, Mycobacterium avium subsp. paratuberculosis
gcgcggcaggaauuccagcga

SEQ ID NO: 3019308 - RNA, 14 nt, Mycobacterium avium subsp. paratuberculosis
gcgcggcagggcca

SEQ ID NO: 3019309 - RNA, 18 nt, Mycobacterium avium subsp. paratuberculosis
gcgcggcagggccaggcc

SEQ ID NO: 3019310 - RNA, 22 nt, Mycobacterium avium subsp. paratuberculosis
gcgcggcagguugcgcuggaug

SEQ ID NO: 3019311 - RNA, 20 nt, Mycobacterium avium subsp. paratuberculosis
gcgcggcaguccgccggaga

SEQ ID NO: 3019312 - RNA, 19 nt, Mycobacterium avium subsp. paratuberculosis
gcgcggcaucggcgacggc

SEQ ID NO: 3019313 - RNA, 13 nt, Mycobacterium avium subsp. paratuberculosis
gcgcggcaucguc

SEQ ID NO: 3019314 - RNA, 20 nt, Mycobacterium avium subsp. paratuberculosis
gcgcggcaugccgcccgggc

SEQ ID NO: 3019315 - RNA, 21 nt, Mycobacterium avium subsp. paratuberculosis
gcgcggcaugccgcccgggcc

SEQ ID NO: 3019316 - RNA, 16 nt, Mycobacterium avium subsp. paratuberculosis
gcgcggcauggcuggc

SEQ ID NO: 3019317 - RNA, 21 nt, Mycobacterium avium subsp. paratuberculosis
gcgcggcauggcuggcggcaa

SEQ ID NO: 3019318 - RNA, 23 nt, Mycobacterium avium subsp. paratuberculosis
gcgcggcauggcuggcggcaacg

SEQ ID NO: 3019319 - RNA, 18 nt, Mycobacterium avium subsp. paratuberculosis
gcgcggccacaccgauca

SEQ ID NO: 3019320 - RNA, 21 nt, Mycobacterium avium subsp. paratuberculosis
gcgcggccacaccgaucagca

SEQ ID NO: 3019321 - RNA, 14 nt, Mycobacterium avium subsp. paratuberculosis
gcgcggccaccacc

SEQ ID NO: 3019322 - RNA, 18 nt, Mycobacterium avium subsp. paratuberculosis
gcgcggccaccaccacgg

SEQ ID NO: 3019323 - RNA, 15 nt, Mycobacterium avium subsp. paratuberculosis
gcgcggccaccacga

SEQ ID NO: 3019324 - RNA, 15 nt, Mycobacterium avium subsp. paratuberculosis
gcgcggccaccucca

SEQ ID NO: 3019325 - RNA, 20 nt, Mycobacterium avium subsp. paratuberculosis
gcgcggccaccuccagcccg

SEQ ID NO: 3019326 - RNA, 22 nt, Mycobacterium avium subsp. paratuberculosis
gcgcggccaccuccagcccgga

SEQ ID NO: 3019327 - RNA, 23 nt, Mycobacterium avium subsp. paratuberculosis
gcgcggccaccuccagcccggaa

SEQ ID NO: 3019328 - RNA, 11 nt, Mycobacterium avium subsp. paratuberculosis
gcgcggccagc

SEQ ID NO: 3019329 - RNA, 12 nt, Mycobacterium avium subsp. paratuberculosis
gcgcggccagca

SEQ ID NO: 3019330 - RNA, 13 nt, Mycobacterium avium subsp. paratuberculosis
gcgcggccagccc

SEQ ID NO: 3019331 - RNA, 19 nt, Mycobacterium avium subsp. paratuberculosis
gcgcggccagccccgggaa

SEQ ID NO: 3019332 - RNA, 20 nt, Mycobacterium avium subsp. paratuberculosis
gcgcggccagccccgggaac

SEQ ID NO: 3019333 - RNA, 12 nt, Mycobacterium avium subsp. paratuberculosis
gcgcggccagcg

SEQ ID NO: 3019334 - RNA, 13 nt, Mycobacterium avium subsp. paratuberculosis
gcgcggccagcgc

SEQ ID NO: 3019335 - RNA, 15 nt, Mycobacterium avium subsp. paratuberculosis
gcgcggccagcgcga

SEQ ID NO: 3019336 - RNA, 14 nt, Mycobacterium avium subsp. paratuberculosis
gcgcggccagcggc

SEQ ID NO: 3019337 - RNA, 15 nt, Mycobacterium avium subsp. paratuberculosis
gcgcggccagcggcg

SEQ ID NO: 3019338 - RNA, 12 nt, Mycobacterium avium subsp. paratuberculosis
gcgcggcccagg

SEQ ID NO: 3019339 - RNA, 15 nt, Mycobacterium avium subsp. paratuberculosis
gcgcggcccaguucg

SEQ ID NO: 3019340 - RNA, 13 nt, Mycobacterium avium subsp. paratuberculosis
gcgcggcccgccg

SEQ ID NO: 3019341 - RNA, 14 nt, Mycobacterium avium subsp. paratuberculosis
gcgcggcccgccga

SEQ ID NO: 3019342 - RNA, 15 nt, Mycobacterium avium subsp. paratuberculosis
gcgcggcccgccgaa

SEQ ID NO: 3019343 - RNA, 13 nt, Mycobacterium avium subsp. paratuberculosis
gcgcggcccgcga

SEQ ID NO: 3019344 - RNA, 24 nt, Mycobacterium avium subsp. paratuberculosis
gcgcggcccgcgacgucggagauc

SEQ ID NO: 3019345 - RNA, 12 nt, Mycobacterium avium subsp. paratuberculosis
gcgcggcccggc

SEQ ID NO: 3019346 - RNA, 13 nt, Mycobacterium avium subsp. paratuberculosis
gcgcggcccggcc

SEQ ID NO: 3019347 - RNA, 16 nt, Mycobacterium avium subsp. paratuberculosis
gcgcggcccguacucg

SEQ ID NO: 3019348 - RNA, 14 nt, Mycobacterium avium subsp. paratuberculosis
gcgcggcccguuga

SEQ ID NO: 3019349 - RNA, 21 nt, Mycobacterium avium subsp. paratuberculosis
gcgcggcccguugagcaccgc

SEQ ID NO: 3019350 - RNA, 23 nt, Mycobacterium avium subsp. paratuberculosis
gcgcggcccguugagcaccgcga

SEQ ID NO: 3019351 - RNA, 20 nt, Mycobacterium avium subsp. paratuberculosis
gcgcggccgauucggcgccg

SEQ ID NO: 3019352 - RNA, 12 nt, Mycobacterium avium subsp. paratuberculosis
gcgcggccgcca

SEQ ID NO: 3019353 - RNA, 13 nt, Mycobacterium avium subsp. paratuberculosis
gcgcggccgccag

SEQ ID NO: 3019354 - RNA, 14 nt, Mycobacterium avium subsp. paratuberculosis
gcgcggccgcccag

SEQ ID NO: 3019355 - RNA, 15 nt, Mycobacterium avium subsp. paratuberculosis
gcgcggccgcccagc

SEQ ID NO: 3019356 - RNA, 15 nt, Mycobacterium avium subsp. paratuberculosis
gcgcggccgcccguc

SEQ ID NO: 3019357 - RNA, 22 nt, Mycobacterium avium subsp. paratuberculosis
gcgcggccgcccgucggggccc

SEQ ID NO: 3019358 - RNA, 13 nt, Mycobacterium avium subsp. paratuberculosis
gcgcggccgcgac

SEQ ID NO: 3019359 - RNA, 14 nt, Mycobacterium avium subsp. paratuberculosis
gcgcggccgcgacu

SEQ ID NO: 3019360 - RNA, 21 nt, Mycobacterium avium subsp. paratuberculosis
gcgcggccgcgacugcaggug

SEQ ID NO: 3019361 - RNA, 12 nt, Mycobacterium avium subsp. paratuberculosis
gcgcggccgcgu

SEQ ID NO: 3019362 - RNA, 16 nt, Mycobacterium avium subsp. paratuberculosis
gcgcggccgcgucggc

SEQ ID NO: 3019363 - RNA, 12 nt, Mycobacterium avium subsp. paratuberculosis
gcgcggccggcc

SEQ ID NO: 3019364 - RNA, 15 nt, Mycobacterium avium subsp. paratuberculosis
gcgcggccggccacg

SEQ ID NO: 3019365 - RNA, 14 nt, Mycobacterium avium subsp. paratuberculosis
gcgcggccggccga

SEQ ID NO: 3019366 - RNA, 22 nt, Mycobacterium avium subsp. paratuberculosis
gcgcggccggccgacaccccga

SEQ ID NO: 3019367 - RNA, 13 nt, Mycobacterium avium subsp. paratuberculosis
gcgcggccggcgu

SEQ ID NO: 3019368 - RNA, 14 nt, Mycobacterium avium subsp. paratuberculosis
gcgcggccggcgug

SEQ ID NO: 3019369 - RNA, 13 nt, Mycobacterium avium subsp. paratuberculosis
gcgcggccgggcg

SEQ ID NO: 3019370 - RNA, 13 nt, Mycobacterium avium subsp. paratuberculosis
gcgcggccgggcu

SEQ ID NO: 3019371 - RNA, 17 nt, Mycobacterium avium subsp. paratuberculosis
gcgcggccggugcgcgu

SEQ ID NO: 3019372 - RNA, 21 nt, Mycobacterium avium subsp. paratuberculosis
gcgcggccggugcgcgucagc

SEQ ID NO: 3019373 - RNA, 22 nt, Mycobacterium avium subsp. paratuberculosis
gcgcggccggugcgcgucagcc

SEQ ID NO: 3019374 - RNA, 15 nt, Mycobacterium avium subsp. paratuberculosis
gcgcggccuccagcc

SEQ ID NO: 3019375 - RNA, 23 nt, Mycobacterium avium subsp. paratuberculosis
gcgcggccuccagccgcgcggcc

SEQ ID NO: 3019376 - RNA, 19 nt, Mycobacterium avium subsp. paratuberculosis
gcgcggccugcagcaccga

SEQ ID NO: 3019377 - RNA, 23 nt, Mycobacterium avium subsp. paratuberculosis
gcgcggcgaacccgagcaccccg

SEQ ID NO: 3019378 - RNA, 15 nt, Mycobacterium avium subsp. paratuberculosis
gcgcggcgaccaccu

SEQ ID NO: 3019379 - RNA, 20 nt, Mycobacterium avium subsp. paratuberculosis
gcgcggcgaccaccucggcg

SEQ ID NO: 3019380 - RNA, 16 nt, Mycobacterium avium subsp. paratuberculosis
gcgcggcgacgaucac

SEQ ID NO: 3019381 - RNA, 12 nt, Mycobacterium avium subsp. paratuberculosis
gcgcggcgacgg

SEQ ID NO: 3019382 - RNA, 14 nt, Mycobacterium avium subsp. paratuberculosis
gcgcggcgacggcg

SEQ ID NO: 3019383 - RNA, 18 nt, Mycobacterium avium subsp. paratuberculosis
gcgcggcgacggcgaacg

SEQ ID NO: 3019384 - RNA, 14 nt, Mycobacterium avium subsp. paratuberculosis
gcgcggcgacggug

SEQ ID NO: 3019385 - RNA, 17 nt, Mycobacterium avium subsp. paratuberculosis
gcgcggcgacgguggcg

SEQ ID NO: 3019386 - RNA, 18 nt, Mycobacterium avium subsp. paratuberculosis
gcgcggcgacgguggcgg

SEQ ID NO: 3019387 - RNA, 19 nt, Mycobacterium avium subsp. paratuberculosis
gcgcgggaacgaucggcuc

SEQ ID NO: 3019388 - RNA, 19 nt, Mycobacterium avium subsp. paratuberculosis
gcgcgggagcgcuggucgg

SEQ ID NO: 3019389 - RNA, 18 nt, Mycobacterium avium subsp. paratuberculosis
gcgcgggaucggugccga

SEQ ID NO: 3019390 - RNA, 23 nt, Mycobacterium avium subsp. paratuberculosis
gcgcgggaucggugccgacggug

SEQ ID NO: 3019391 - RNA, 17 nt, Mycobacterium avium subsp. paratuberculosis
gcgcgggcaaucgcugc

SEQ ID NO: 3019392 - RNA, 18 nt, Mycobacterium avium subsp. paratuberculosis
gcgcgggcaaucgcugcg

SEQ ID NO: 3019393 - RNA, 14 nt, Mycobacterium avium subsp. paratuberculosis
gcgcgggcaccguc

SEQ ID NO: 3019394 - RNA, 12 nt, Mycobacterium avium subsp. paratuberculosis
gcgcgggcagcc

SEQ ID NO: 3019395 - RNA, 22 nt, Mycobacterium avium subsp. paratuberculosis
gcgcgggcaugaaccaggccgc

SEQ ID NO: 3019396 - RNA, 13 nt, Mycobacterium avium subsp. paratuberculosis
gcgcgggccagca

SEQ ID NO: 3019397 - RNA, 15 nt, Mycobacterium avium subsp. paratuberculosis
gcgcgggccagcagc

SEQ ID NO: 3019398 - RNA, 15 nt, Mycobacterium avium subsp. paratuberculosis
gcgcgggccagcagu

SEQ ID NO: 3019399 - RNA, 15 nt, Mycobacterium avium subsp. paratuberculosis
gcgcgggccagcgcc

SEQ ID NO: 3019400 - RNA, 14 nt, Mycobacterium avium subsp. paratuberculosis
gcgcgggccagcgu

SEQ ID NO: 3019401 - RNA, 12 nt, Mycobacterium avium subsp. paratuberculosis
gcgcgggccgca

SEQ ID NO: 3019402 - RNA, 21 nt, Mycobacterium avium subsp. paratuberculosis
gcgcgggccgccgacgucgug

SEQ ID NO: 3019403 - RNA, 22 nt, Mycobacterium avium subsp. paratuberculosis
gcgcgggccgccgacgucgugg

SEQ ID NO: 3019404 - RNA, 23 nt, Mycobacterium avium subsp. paratuberculosis
gcgcgggccuaggaccccggcug

SEQ ID NO: 3019405 - RNA, 14 nt, Mycobacterium avium subsp. paratuberculosis
gcgcgggcgcccuc

SEQ ID NO: 3019406 - RNA, 15 nt, Mycobacterium avium subsp. paratuberculosis
gcgcgggcgcccucc

SEQ ID NO: 3019407 - RNA, 14 nt, Mycobacterium avium subsp. paratuberculosis
gcgcgggcgcgcgc

SEQ ID NO: 3019408 - RNA, 14 nt, Mycobacterium avium subsp. paratuberculosis
gcgcgggcgcggcc

SEQ ID NO: 3019409 - RNA, 21 nt, Mycobacterium avium subsp. paratuberculosis
gcgcgggcggcaggucggcgg

SEQ ID NO: 3019410 - RNA, 16 nt, Mycobacterium avium subsp. paratuberculosis
gcgcgggcggcgcggu

SEQ ID NO: 3019411 - RNA, 16 nt, Mycobacterium avium subsp. paratuberculosis
gcgcgggcguccacga

SEQ ID NO: 3019412 - RNA, 20 nt, Mycobacterium avium subsp. paratuberculosis
gcgcgggcguccucgucggc

SEQ ID NO: 3019413 - RNA, 18 nt, Mycobacterium avium subsp. paratuberculosis
gcgcgggcugcagggccg

SEQ ID NO: 3019414 - RNA, 15 nt, Mycobacterium avium subsp. paratuberculosis
gcgcggggccaccag

SEQ ID NO: 3019415 - RNA, 19 nt, Mycobacterium avium subsp. paratuberculosis
gcgcggggccaccaggcgc

SEQ ID NO: 3019416 - RNA, 21 nt, Mycobacterium avium subsp. paratuberculosis
gcgcggggccaccaggcgccg

SEQ ID NO: 3019417 - RNA, 13 nt, Mycobacterium avium subsp. paratuberculosis
gcgcggggccggc

SEQ ID NO: 3019418 - RNA, 14 nt, Mycobacterium avium subsp. paratuberculosis
gcgcggggccggcg

SEQ ID NO: 3019419 - RNA, 15 nt, Mycobacterium avium subsp. paratuberculosis
gcgcggggccggcgc

SEQ ID NO: 3019420 - RNA, 16 nt, Mycobacterium avium subsp. paratuberculosis
gcgcggggccggcgcg

SEQ ID NO: 3019421 - RNA, 18 nt, Mycobacterium avium subsp. paratuberculosis
gcgcggggccggcgcggu

SEQ ID NO: 3019422 - RNA, 20 nt, Mycobacterium avium subsp. paratuberculosis
gcgcggggccggcgcggugc

SEQ ID NO: 3019423 - RNA, 18 nt, Mycobacterium avium subsp. paratuberculosis
gcgcggggcgcgaggcgc

SEQ ID NO: 3019424 - RNA, 13 nt, Mycobacterium avium subsp. paratuberculosis
gcgcggggcggcc

SEQ ID NO: 3019425 - RNA, 16 nt, Mycobacterium avium subsp. paratuberculosis
gcgcggggcggccgcc

SEQ ID NO: 3019426 - RNA, 20 nt, Mycobacterium avium subsp. paratuberculosis
gcgcggggcggccgccgggc

SEQ ID NO: 3019427 - RNA, 19 nt, Mycobacterium avium subsp. paratuberculosis
gcgcgggggccgccgcgau

SEQ ID NO: 3019428 - RNA, 16 nt, Mycobacterium avium subsp. paratuberculosis
gcgcgggggcggccug

SEQ ID NO: 3019429 - RNA, 14 nt, Mycobacterium avium subsp. paratuberculosis
gcgcggggucggcc

SEQ ID NO: 3019430 - RNA, 16 nt, Mycobacterium avium subsp. paratuberculosis
gcgcggggucggccag

SEQ ID NO: 3019431 - RNA, 14 nt, Mycobacterium avium subsp. paratuberculosis
gcgcggggucgggc

SEQ ID NO: 3019432 - RNA, 16 nt, Mycobacterium avium subsp. paratuberculosis
gcgcgggguggcgccg

SEQ ID NO: 3019433 - RNA, 21 nt, Mycobacterium avium subsp. paratuberculosis
gcgcgggguggcgccggccag

SEQ ID NO: 3019434 - RNA, 22 nt, Mycobacterium avium subsp. paratuberculosis
gcgcgggguggcgccggccagc

SEQ ID NO: 3019435 - RNA, 23 nt, Mycobacterium avium subsp. paratuberculosis
gcgcgggguggcgccggccagca

SEQ ID NO: 3019436 - RNA, 18 nt, Mycobacterium avium subsp. paratuberculosis
gcgcggggugucgcggcu

SEQ ID NO: 3019437 - RNA, 19 nt, Mycobacterium avium subsp. paratuberculosis
gcgcggggugucgcggcug

SEQ ID NO: 3019438 - RNA, 21 nt, Mycobacterium avium subsp. paratuberculosis
gcgcggggugucgcggcugcg

SEQ ID NO: 3019439 - RNA, 23 nt, Mycobacterium avium subsp. paratuberculosis
gcgcggggugucgcggcugcgca

SEQ ID NO: 3019440 - RNA, 17 nt, Mycobacterium avium subsp. paratuberculosis
gcgcggguacggcggcc

SEQ ID NO: 3019441 - RNA, 17 nt, Mycobacterium avium subsp. paratuberculosis
gcgcgggucgagcagca

SEQ ID NO: 3019442 - RNA, 13 nt, Mycobacterium avium subsp. paratuberculosis
gcgcgggucgccg

SEQ ID NO: 3019443 - RNA, 14 nt, Mycobacterium avium subsp. paratuberculosis
gcgcgggucgccgg

SEQ ID NO: 3019444 - RNA, 14 nt, Mycobacterium avium subsp. paratuberculosis
gcgcgggucgcggu

SEQ ID NO: 3019445 - RNA, 17 nt, Mycobacterium avium subsp. paratuberculosis
gcgcgggucgcuggccg

SEQ ID NO: 3019446 - RNA, 14 nt, Mycobacterium avium subsp. paratuberculosis
gcgcgggucggcgc

SEQ ID NO: 3019447 - RNA, 16 nt, Mycobacterium avium subsp. paratuberculosis
gcgcgggucggcgccg

SEQ ID NO: 3019448 - RNA, 22 nt, Mycobacterium avium subsp. paratuberculosis
gcgcgggucggcgccggccagc

SEQ ID NO: 3019449 - RNA, 17 nt, Mycobacterium avium subsp. paratuberculosis
gcgcgggucgucggccu

SEQ ID NO: 3019450 - RNA, 19 nt, Mycobacterium avium subsp. paratuberculosis
gcgcggguucacccuggcg

SEQ ID NO: 3019451 - RNA, 20 nt, Mycobacterium avium subsp. paratuberculosis
gcgcggguucacccuggcga

SEQ ID NO: 3019452 - RNA, 23 nt, Mycobacterium avium subsp. paratuberculosis
gcgcgguaaagucuucggcgaug

SEQ ID NO: 3019453 - RNA, 12 nt, Mycobacterium avium subsp. paratuberculosis
gcgcggucaaca

SEQ ID NO: 3019454 - RNA, 18 nt, Mycobacterium avium subsp. paratuberculosis
gcgcggucaacaccggga

SEQ ID NO: 3019455 - RNA, 12 nt, Mycobacterium avium subsp. paratuberculosis
gcgcggucagcg

SEQ ID NO: 3019456 - RNA, 13 nt, Mycobacterium avium subsp. paratuberculosis
gcgcggucagcgc

SEQ ID NO: 3019457 - RNA, 17 nt, Mycobacterium avium subsp. paratuberculosis
gcgcggucagcgcgucc

SEQ ID NO: 3019458 - RNA, 15 nt, Mycobacterium avium subsp. paratuberculosis
gcgcggucaucguca

SEQ ID NO: 3019459 - RNA, 18 nt, Mycobacterium avium subsp. paratuberculosis
gcgcgguccacgguggcg

SEQ ID NO: 3019460 - RNA, 14 nt, Mycobacterium avium subsp. paratuberculosis
gcgcggucgcaggc

SEQ ID NO: 3019461 - RNA, 15 nt, Mycobacterium avium subsp. paratuberculosis
gcgcggucgcaggcc

SEQ ID NO: 3019462 - RNA, 22 nt, Mycobacterium avium subsp. paratuberculosis
gcgcggucgccaccaccagcgg

SEQ ID NO: 3019463 - RNA, 13 nt, Mycobacterium avium subsp. paratuberculosis
gcgcggucggugg

SEQ ID NO: 3019464 - RNA, 16 nt, Mycobacterium avium subsp. paratuberculosis
gcgcggucgguggcgg

SEQ ID NO: 3019465 - RNA, 13 nt, Mycobacterium avium subsp. paratuberculosis
gcgcggucgucgc

SEQ ID NO: 3019466 - RNA, 23 nt, Mycobacterium avium subsp. paratuberculosis
gcgcggucgucgcccgucucggc

SEQ ID NO: 3019467 - RNA, 21 nt, Mycobacterium avium subsp. paratuberculosis
gcgcggucgucuucuuggccg

SEQ ID NO: 3019468 - RNA, 20 nt, Mycobacterium avium subsp. paratuberculosis
gcgcggucucgaucugcacc

SEQ ID NO: 3019469 - RNA, 17 nt, Mycobacterium avium subsp. paratuberculosis
gcgcggugaagucggug

SEQ ID NO: 3019470 - RNA, 18 nt, Mycobacterium avium subsp. paratuberculosis
gcgcggugaagucggugc

SEQ ID NO: 3019471 - RNA, 19 nt, Mycobacterium avium subsp. paratuberculosis
gcgcggugaagucggugcc

SEQ ID NO: 3019472 - RNA, 18 nt, Mycobacterium avium subsp. paratuberculosis
gcgcgucgggggugccgc

SEQ ID NO: 3019473 - RNA, 20 nt, Mycobacterium avium subsp. paratuberculosis
gcgcgucgguaaucggcggu

SEQ ID NO: 3019474 - RNA, 21 nt, Mycobacterium avium subsp. paratuberculosis
gcgcgucgguaaucggcggug

SEQ ID NO: 3019475 - RNA, 22 nt, Mycobacterium avium subsp. paratuberculosis
gcgcgucgguaaucggcggugg

SEQ ID NO: 3019476 - RNA, 13 nt, Mycobacterium avium subsp. paratuberculosis
gcgcgucggugau

SEQ ID NO: 3019477 - RNA, 20 nt, Mycobacterium avium subsp. paratuberculosis
gcgcgucguagucgcucggc

SEQ ID NO: 3019478 - RNA, 19 nt, Mycobacterium avium subsp. paratuberculosis
gcgcgucguccgacaccac

SEQ ID NO: 3019479 - RNA, 20 nt, Mycobacterium avium subsp. paratuberculosis
gcgcgucguccgacaccacc

SEQ ID NO: 3019480 - RNA, 21 nt, Mycobacterium avium subsp. paratuberculosis
gcgcgucguccgacaccaccu

SEQ ID NO: 3019481 - RNA, 16 nt, Mycobacterium avium subsp. paratuberculosis
gcgcgucgucgauggc

SEQ ID NO: 3019482 - RNA, 12 nt, Mycobacterium avium subsp. paratuberculosis
gcgcgucgucgc

SEQ ID NO: 3019483 - RNA, 13 nt, Mycobacterium avium subsp. paratuberculosis
gcgcgucgucgcc

SEQ ID NO: 3019484 - RNA, 14 nt, Mycobacterium avium subsp. paratuberculosis
gcgcgucgucgccg

SEQ ID NO: 3019485 - RNA, 15 nt, Mycobacterium avium subsp. paratuberculosis
gcgcgucgucgccga

SEQ ID NO: 3019486 - RNA, 15 nt, Mycobacterium avium subsp. paratuberculosis
gcgcgucucccccga

SEQ ID NO: 3019487 - RNA, 12 nt, Mycobacterium avium subsp. paratuberculosis
gcgcgugacccc

SEQ ID NO: 3019488 - RNA, 15 nt, Mycobacterium avium subsp. paratuberculosis
gcgcgugaccccggc

SEQ ID NO: 3019489 - RNA, 16 nt, Mycobacterium avium subsp. paratuberculosis
gcgcgugaccccggcg

SEQ ID NO: 3019490 - RNA, 19 nt, Mycobacterium avium subsp. paratuberculosis
gcgcgugaccccggcgacc

SEQ ID NO: 3019491 - RNA, 20 nt, Mycobacterium avium subsp. paratuberculosis
gcgcgugaccccggcgacca

SEQ ID NO: 3019492 - RNA, 13 nt, Mycobacterium avium subsp. paratuberculosis
gcgcgugacgcgc

SEQ ID NO: 3019493 - RNA, 15 nt, Mycobacterium avium subsp. paratuberculosis
gcgcgugacgcgcgu

SEQ ID NO: 3019494 - RNA, 15 nt, Mycobacterium avium subsp. paratuberculosis
gcgcgugacggcggg

SEQ ID NO: 3019495 - RNA, 16 nt, Mycobacterium avium subsp. paratuberculosis
gcgcgugaucggugcc

SEQ ID NO: 3019496 - RNA, 21 nt, Mycobacterium avium subsp. paratuberculosis
gcgcgugaucggugcccgcgg

SEQ ID NO: 3019497 - RNA, 22 nt, Mycobacterium avium subsp. paratuberculosis
gcgcgugaugggugggcagcuc

SEQ ID NO: 3019498 - RNA, 16 nt, Mycobacterium avium subsp. paratuberculosis
gcgcgugcacaccggc

SEQ ID NO: 3019499 - RNA, 16 nt, Mycobacterium avium subsp. paratuberculosis
gcgcgugcacgaacgc

SEQ ID NO: 3019500 - RNA, 16 nt, Mycobacterium avium subsp. paratuberculosis
gcgcgugcagccgggc

SEQ ID NO: 3019501 - RNA, 18 nt, Mycobacterium avium subsp. paratuberculosis
gcgcgugcagccgggcgg

SEQ ID NO: 3019502 - RNA, 20 nt, Mycobacterium avium subsp. paratuberculosis
gcgcgugcagccgggcggcg

SEQ ID NO: 3019503 - RNA, 21 nt, Mycobacterium avium subsp. paratuberculosis
gcgcgugcagccgggcggcgc

SEQ ID NO: 3019504 - RNA, 14 nt, Mycobacterium avium subsp. paratuberculosis
gcgcgugcccgcgg

SEQ ID NO: 3019505 - RNA, 20 nt, Mycobacterium avium subsp. paratuberculosis
gcgcgugcccgcggucaugc

SEQ ID NO: 3019506 - RNA, 13 nt, Mycobacterium avium subsp. paratuberculosis
gcgcgugcgccgc

SEQ ID NO: 3019507 - RNA, 14 nt, Mycobacterium avium subsp. paratuberculosis
gcgcgugcgccgcg

SEQ ID NO: 3019508 - RNA, 15 nt, Mycobacterium avium subsp. paratuberculosis
gcgcgugcgccgcgg

SEQ ID NO: 3019509 - RNA, 15 nt, Mycobacterium avium subsp. paratuberculosis
gcgcgugcgcgacga

SEQ ID NO: 3019510 - RNA, 14 nt, Mycobacterium avium subsp. paratuberculosis
gcgcgugcggggug

SEQ ID NO: 3019511 - RNA, 19 nt, Mycobacterium avium subsp. paratuberculosis
gcgcgugcuguugcaggug

SEQ ID NO: 3019512 - RNA, 22 nt, Mycobacterium avium subsp. paratuberculosis
gcgcgugcuguugcaggugcgc

SEQ ID NO: 3019513 - RNA, 14 nt, Mycobacterium avium subsp. paratuberculosis
gcgcgugcuugccg

SEQ ID NO: 3019514 - RNA, 13 nt, Mycobacterium avium subsp. paratuberculosis
gcgcgugggccaa

SEQ ID NO: 3019515 - RNA, 15 nt, Mycobacterium avium subsp. paratuberculosis
gcgcgugggccaacg

SEQ ID NO: 3019516 - RNA, 18 nt, Mycobacterium avium subsp. paratuberculosis
gcgcgugggccaacgcga

SEQ ID NO: 3019517 - RNA, 19 nt, Mycobacterium avium subsp. paratuberculosis
gcgcgugggccaacgcgau

SEQ ID NO: 3019518 - RNA, 16 nt, Mycobacterium avium subsp. paratuberculosis
gcgcguggggcgucgc

SEQ ID NO: 3019519 - RNA, 19 nt, Mycobacterium avium subsp. paratuberculosis
gcgcguggggcgucgccgc

SEQ ID NO: 3019520 - RNA, 21 nt, Mycobacterium avium subsp. paratuberculosis
gcgcguggggcgucgccgccc

SEQ ID NO: 3019521 - RNA, 16 nt, Mycobacterium avium subsp. paratuberculosis
gcgcguggucccacac

SEQ ID NO: 3019522 - RNA, 17 nt, Mycobacterium avium subsp. paratuberculosis
gcgcguguccagaacuc

SEQ ID NO: 3019523 - RNA, 23 nt, Mycobacterium avium subsp. paratuberculosis
gcgcguguccagaacucggcggc

SEQ ID NO: 3019524 - RNA, 15 nt, Mycobacterium avium subsp. paratuberculosis
gcgcguucagggugc

SEQ ID NO: 3019525 - RNA, 14 nt, Mycobacterium avium subsp. paratuberculosis
gcgcguuccagcac

SEQ ID NO: 3019526 - RNA, 21 nt, Mycobacterium avium subsp. paratuberculosis
gcgcguuccagcacgcccaga

SEQ ID NO: 3019527 - RNA, 15 nt, Mycobacterium avium subsp. paratuberculosis
gcgcguuccaucagc

SEQ ID NO: 3019528 - RNA, 18 nt, Mycobacterium avium subsp. paratuberculosis
gcgcguuccaucagcgcc

SEQ ID NO: 3019529 - RNA, 19 nt, Mycobacterium avium subsp. paratuberculosis
gcgcguuccaucagcgccc

SEQ ID NO: 3019530 - RNA, 23 nt, Mycobacterium avium subsp. paratuberculosis
gcgcguuccaucagcgcccgcgc

SEQ ID NO: 3019531 - RNA, 14 nt, Mycobacterium avium subsp. paratuberculosis
gcgcguucggcgcc

SEQ ID NO: 3019532 - RNA, 15 nt, Mycobacterium avium subsp. paratuberculosis
gcgcguucggcgcca

SEQ ID NO: 3019533 - RNA, 17 nt, Mycobacterium avium subsp. paratuberculosis
gcgcguucggcgccacc

SEQ ID NO: 3019534 - RNA, 11 nt, Mycobacterium avium subsp. paratuberculosis
gcgcguucggg

SEQ ID NO: 3019535 - RNA, 19 nt, Mycobacterium avium subsp. paratuberculosis
gcgcguucuccaccgcgcg

SEQ ID NO: 3019536 - RNA, 16 nt, Mycobacterium avium subsp. paratuberculosis
gcgcguugaagcugac

SEQ ID NO: 3019537 - RNA, 17 nt, Mycobacterium avium subsp. paratuberculosis
gcgcguugaagcugacg

SEQ ID NO: 3019538 - RNA, 19 nt, Mycobacterium avium subsp. paratuberculosis
gcgcguugaugccgugcgc

SEQ ID NO: 3019539 - RNA, 23 nt, Mycobacterium avium subsp. paratuberculosis
gcgcguuggccagguugcgccgu

SEQ ID NO: 3019540 - RNA, 18 nt, Mycobacterium avium subsp. paratuberculosis
gcgcguuggccgaggggu

SEQ ID NO: 3019541 - RNA, 14 nt, Mycobacterium avium subsp. paratuberculosis
gcgcguuggccggc

SEQ ID NO: 3019542 - RNA, 15 nt, Mycobacterium avium subsp. paratuberculosis
gcgcguuggucauca

SEQ ID NO: 3019543 - RNA, 18 nt, Mycobacterium avium subsp. paratuberculosis
gcgcguuggucaucaccc

SEQ ID NO: 3019544 - RNA, 18 nt, Mycobacterium avium subsp. paratuberculosis
gcgcguuguccagcagcg

SEQ ID NO: 3019545 - RNA, 19 nt, Mycobacterium avium subsp. paratuberculosis
gcgcguuguccagcagcgc

SEQ ID NO: 3019546 - RNA, 22 nt, Mycobacterium avium subsp. paratuberculosis
gcgcguuguccagcagcgccgg

SEQ ID NO: 3019547 - RNA, 23 nt, Mycobacterium avium subsp. paratuberculosis
gcgcguuguccagcagcgccggc

SEQ ID NO: 3019548 - RNA, 20 nt, Mycobacterium avium subsp. paratuberculosis
gcgcguuuugaaauccgggc

SEQ ID NO: 3019549 - RNA, 22 nt, Mycobacterium avium subsp. paratuberculosis
gcgcguuuugaaauccgggcgc

SEQ ID NO: 3019550 - RNA, 23 nt, Mycobacterium avium subsp. paratuberculosis
gcgcguuuugaaauccgggcgcg

SEQ ID NO: 3019551 - RNA, 17 nt, Mycobacterium avium subsp. paratuberculosis
gcgcuaaagccaccagc

SEQ ID NO: 3019552 - RNA, 18 nt, Mycobacterium avium subsp. paratuberculosis
gcgcuaaagccaccagcg

SEQ ID NO: 3019553 - RNA, 19 nt, Mycobacterium avium subsp. paratuberculosis
gcgcuaaagccaccagcgu

SEQ ID NO: 3019554 - RNA, 17 nt, Mycobacterium avium subsp. paratuberculosis
gcgcuaaggccgcugcc

SEQ ID NO: 3019555 - RNA, 13 nt, Mycobacterium avium subsp. paratuberculosis
gcgcuaccaggcg

SEQ ID NO: 3019556 - RNA, 21 nt, Mycobacterium avium subsp. paratuberculosis
gcgcuaccaggcgugcacccg

SEQ ID NO: 3019557 - RNA, 20 nt, Mycobacterium avium subsp. paratuberculosis
gcgcucguccaggguggcca

SEQ ID NO: 3019558 - RNA, 22 nt, Mycobacterium avium subsp. paratuberculosis
gcgcucguccaggguggccagc

SEQ ID NO: 3019559 - RNA, 15 nt, Mycobacterium avium subsp. paratuberculosis
gcgcucgucgaugcg

SEQ ID NO: 3019560 - RNA, 17 nt, Mycobacterium avium subsp. paratuberculosis
gcgcucgucgaugcgcg

SEQ ID NO: 3019561 - RNA, 23 nt, Mycobacterium avium subsp. paratuberculosis
gcgcucgucgaugcgcggaaacu

SEQ ID NO: 3019562 - RNA, 20 nt, Mycobacterium avium subsp. paratuberculosis
gcgcucgucguagucgaggc

SEQ ID NO: 3019563 - RNA, 17 nt, Mycobacterium avium subsp. paratuberculosis
gcgcucgucgucgccga

SEQ ID NO: 3019564 - RNA, 14 nt, Mycobacterium avium subsp. paratuberculosis
gcgcucgucgucgg

SEQ ID NO: 3019565 - RNA, 16 nt, Mycobacterium avium subsp. paratuberculosis
gcgcucgucgucggag

SEQ ID NO: 3019566 - RNA, 16 nt, Mycobacterium avium subsp. paratuberculosis
gcgcucgugaccggcg

SEQ ID NO: 3019567 - RNA, 17 nt, Mycobacterium avium subsp. paratuberculosis
gcgcucgugaccggcgg

SEQ ID NO: 3019568 - RNA, 18 nt, Mycobacterium avium subsp. paratuberculosis
gcgcucgugaccggcggu

SEQ ID NO: 3019569 - RNA, 22 nt, Mycobacterium avium subsp. paratuberculosis
gcgcucuaacuccgcucgggcc

SEQ ID NO: 3019570 - RNA, 14 nt, Mycobacterium avium subsp. paratuberculosis
gcgcucuggaagau

SEQ ID NO: 3019571 - RNA, 16 nt, Mycobacterium avium subsp. paratuberculosis
gcgcucuucgggcugc

SEQ ID NO: 3019572 - RNA, 17 nt, Mycobacterium avium subsp. paratuberculosis
gcgcucuugggcggccg

SEQ ID NO: 3019573 - RNA, 18 nt, Mycobacterium avium subsp. paratuberculosis
gcgcucuugggcggccgg

SEQ ID NO: 3019574 - RNA, 16 nt, Mycobacterium avium subsp. paratuberculosis
gcgcugaacgcggugg

SEQ ID NO: 3019575 - RNA, 23 nt, Mycobacterium avium subsp. paratuberculosis
gcgcugaacgcggugggcaccag

SEQ ID NO: 3019576 - RNA, 14 nt, Mycobacterium avium subsp. paratuberculosis
gcgcugaagcgcga

SEQ ID NO: 3019577 - RNA, 19 nt, Mycobacterium avium subsp. paratuberculosis
gcgcugaagcgcgaccccu

SEQ ID NO: 3019578 - RNA, 18 nt, Mycobacterium avium subsp. paratuberculosis
gcgcugaagugcagcgca

SEQ ID NO: 3019579 - RNA, 22 nt, Mycobacterium avium subsp. paratuberculosis
gcgcugaauucuguugucggcu

SEQ ID NO: 3019580 - RNA, 22 nt, Mycobacterium avium subsp. paratuberculosis
gcgcugaccagcgugaccucga

SEQ ID NO: 3019581 - RNA, 15 nt, Mycobacterium avium subsp. paratuberculosis
gcgcugaccaggccg

SEQ ID NO: 3019582 - RNA, 14 nt, Mycobacterium avium subsp. paratuberculosis
gcgcugacccccgu

SEQ ID NO: 3019583 - RNA, 16 nt, Mycobacterium avium subsp. paratuberculosis
gcgcugagcacggugg

SEQ ID NO: 3019584 - RNA, 22 nt, Mycobacterium avium subsp. paratuberculosis
gcgcugagcgacauggucgggc

SEQ ID NO: 3019585 - RNA, 23 nt, Mycobacterium avium subsp. paratuberculosis
gcgcugagcgacauggucgggcg

SEQ ID NO: 3019586 - RNA, 22 nt, Mycobacterium avium subsp. paratuberculosis
gcgcugagcggguaaccgcagc

SEQ ID NO: 3019587 - RNA, 22 nt, Mycobacterium avium subsp. paratuberculosis
gcgcugaucgaguccucgcggu

SEQ ID NO: 3019588 - RNA, 16 nt, Mycobacterium avium subsp. paratuberculosis
gcgcugaugccguccu

SEQ ID NO: 3019589 - RNA, 19 nt, Mycobacterium avium subsp. paratuberculosis
gcgcugcaaccgguccgcc

SEQ ID NO: 3019590 - RNA, 23 nt, Mycobacterium avium subsp. paratuberculosis
gcgcugcaagggcuugggcgcga

SEQ ID NO: 3019591 - RNA, 14 nt, Mycobacterium avium subsp. paratuberculosis
gcgcugcagcagcc

SEQ ID NO: 3019592 - RNA, 18 nt, Mycobacterium avium subsp. paratuberculosis
gcgcugcagcagcccgau

SEQ ID NO: 3019593 - RNA, 23 nt, Mycobacterium avium subsp. paratuberculosis
gcgcugcagcauccagguggcgc

SEQ ID NO: 3019594 - RNA, 14 nt, Mycobacterium avium subsp. paratuberculosis
gcgcugcagcaugg

SEQ ID NO: 3019595 - RNA, 17 nt, Mycobacterium avium subsp. paratuberculosis
gcgcugcaggcccgggu

SEQ ID NO: 3019596 - RNA, 18 nt, Mycobacterium avium subsp. paratuberculosis
gcgcugcaugccgguguc

SEQ ID NO: 3019597 - RNA, 13 nt, Mycobacterium avium subsp. paratuberculosis
gcgcugccagggc

SEQ ID NO: 3019598 - RNA, 15 nt, Mycobacterium avium subsp. paratuberculosis
gcgcugccagggccg

SEQ ID NO: 3019599 - RNA, 17 nt, Mycobacterium avium subsp. paratuberculosis
gcgcugccagggccggg

SEQ ID NO: 3019600 - RNA, 18 nt, Mycobacterium avium subsp. paratuberculosis
gcgcugccagggccgggc

SEQ ID NO: 3019601 - RNA, 19 nt, Mycobacterium avium subsp. paratuberculosis
gcgcugccagggccgggcg

SEQ ID NO: 3019602 - RNA, 14 nt, Mycobacterium avium subsp. paratuberculosis
gcgcugcccagcgc

SEQ ID NO: 3019603 - RNA, 16 nt, Mycobacterium avium subsp. paratuberculosis
gcgcugcccagcgcgg

SEQ ID NO: 3019604 - RNA, 22 nt, Mycobacterium avium subsp. paratuberculosis
gcgcugcccagcgcggucgcca

SEQ ID NO: 3019605 - RNA, 13 nt, Mycobacterium avium subsp. paratuberculosis
gcgcugccccagc

SEQ ID NO: 3019606 - RNA, 16 nt, Mycobacterium avium subsp. paratuberculosis
gcgcugccccagccac

SEQ ID NO: 3019607 - RNA, 14 nt, Mycobacterium avium subsp. paratuberculosis
gcgcugcccgaugg

SEQ ID NO: 3019608 - RNA, 16 nt, Mycobacterium avium subsp. paratuberculosis
gcgcugcccgauggug

SEQ ID NO: 3019609 - RNA, 12 nt, Mycobacterium avium subsp. paratuberculosis
gcgcugcccgcc

SEQ ID NO: 3019610 - RNA, 16 nt, Mycobacterium avium subsp. paratuberculosis
gcgcugcccgccgcgg

SEQ ID NO: 3019611 - RNA, 18 nt, Mycobacterium avium subsp. paratuberculosis
gcgcugcccgccgcggug

SEQ ID NO: 3019612 - RNA, 13 nt, Mycobacterium avium subsp. paratuberculosis
gcgcugcccgcga

SEQ ID NO: 3019613 - RNA, 22 nt, Mycobacterium avium subsp. paratuberculosis
gcgcugcccgcgaucgccagcg

SEQ ID NO: 3019614 - RNA, 16 nt, Mycobacterium avium subsp. paratuberculosis
gcgcugcccgucgacc

SEQ ID NO: 3019615 - RNA, 23 nt, Mycobacterium avium subsp. paratuberculosis
gcgcugcccgucgaccuccucga

SEQ ID NO: 3019616 - RNA, 12 nt, Mycobacterium avium subsp. paratuberculosis
gcgcugccgacg

SEQ ID NO: 3019617 - RNA, 16 nt, Mycobacterium avium subsp. paratuberculosis
gcgcugccgagcaccu

SEQ ID NO: 3019618 - RNA, 19 nt, Mycobacterium avium subsp. paratuberculosis
gcgcugccgagcaccucgu

SEQ ID NO: 3019619 - RNA, 20 nt, Mycobacterium avium subsp. paratuberculosis
gcgcugccgagcaccucguc

SEQ ID NO: 3019620 - RNA, 22 nt, Mycobacterium avium subsp. paratuberculosis
gcgcugccgagcaccucgucgc

SEQ ID NO: 3019621 - RNA, 16 nt, Mycobacterium avium subsp. paratuberculosis
gcgcugccgccggccu

SEQ ID NO: 3019622 - RNA, 22 nt, Mycobacterium avium subsp. paratuberculosis
gcgcugccgcgccccgagcagc

SEQ ID NO: 3019623 - RNA, 13 nt, Mycobacterium avium subsp. paratuberculosis
gcgcugccggccc

SEQ ID NO: 3019624 - RNA, 15 nt, Mycobacterium avium subsp. paratuberculosis
gcgcugccggcccga

SEQ ID NO: 3019625 - RNA, 14 nt, Mycobacterium avium subsp. paratuberculosis
gcgcugccggugcu

SEQ ID NO: 3019626 - RNA, 20 nt, Mycobacterium avium subsp. paratuberculosis
gcgcugccggugcugcucga

SEQ ID NO: 3019627 - RNA, 19 nt, Mycobacterium avium subsp. paratuberculosis
gcgcugccguccuucucga

SEQ ID NO: 3019628 - RNA, 17 nt, Mycobacterium avium subsp. paratuberculosis
gcgcugcgcccggucag

SEQ ID NO: 3019629 - RNA, 16 nt, Mycobacterium avium subsp. paratuberculosis
gcgcugcgccgggugg

SEQ ID NO: 3019630 - RNA, 12 nt, Mycobacterium avium subsp. paratuberculosis
gcgcugcgccgu

SEQ ID NO: 3019631 - RNA, 11 nt, Mycobacterium avium subsp. paratuberculosis
gcgcugcgcga

SEQ ID NO: 3019632 - RNA, 16 nt, Mycobacterium avium subsp. paratuberculosis
gcgcugcgcgacaccu

SEQ ID NO: 3019633 - RNA, 18 nt, Mycobacterium avium subsp. paratuberculosis
gcgcugcgcgacaccugc

SEQ ID NO: 3019634 - RNA, 19 nt, Mycobacterium avium subsp. paratuberculosis
gcgcugcgcgacaccugcu

SEQ ID NO: 3019635 - RNA, 21 nt, Mycobacterium avium subsp. paratuberculosis
gcgcugcgcgccgcccucgcc

SEQ ID NO: 3019636 - RNA, 14 nt, Mycobacterium avium subsp. paratuberculosis
gcgcugcgcggugg

SEQ ID NO: 3019637 - RNA, 15 nt, Mycobacterium avium subsp. paratuberculosis
gcgcugcgcgguggc

SEQ ID NO: 3019638 - RNA, 17 nt, Mycobacterium avium subsp. paratuberculosis
gcgcugcgcuucgagca

SEQ ID NO: 3019639 - RNA, 22 nt, Mycobacterium avium subsp. paratuberculosis
gcgcugcucggaggaaccgugc

SEQ ID NO: 3019640 - RNA, 23 nt, Mycobacterium avium subsp. paratuberculosis
gcgcugcuuagccccucccacca

SEQ ID NO: 3019641 - RNA, 14 nt, Mycobacterium avium subsp. paratuberculosis
gcgcuggaucugcc

SEQ ID NO: 3019642 - RNA, 17 nt, Mycobacterium avium subsp. paratuberculosis
gcgcuuucgcuggucgc

SEQ ID NO: 3019643 - RNA, 18 nt, Mycobacterium avium subsp. paratuberculosis
gcgcuuucgcuggucgcg

SEQ ID NO: 3019644 - RNA, 14 nt, Mycobacterium avium subsp. paratuberculosis
gcgcuuugaucagc

SEQ ID NO: 3019645 - RNA, 16 nt, Mycobacterium avium subsp. paratuberculosis
gcgcuuugccgucccc

SEQ ID NO: 3019646 - RNA, 20 nt, Mycobacterium avium subsp. paratuberculosis
gcgcuuuggaccagggcggu

SEQ ID NO: 3019647 - RNA, 16 nt, Mycobacterium avium subsp. paratuberculosis
gcggaaacgacgucgc

SEQ ID NO: 3019648 - RNA, 21 nt, Mycobacterium avium subsp. paratuberculosis
gcggaaacgacgucgccacca

SEQ ID NO: 3019649 - RNA, 23 nt, Mycobacterium avium subsp. paratuberculosis
gcggaaacgacgucgccaccaga

SEQ ID NO: 3019650 - RNA, 15 nt, Mycobacterium avium subsp. paratuberculosis
gcggaaaugcccgcg

SEQ ID NO: 3019651 - RNA, 12 nt, Mycobacterium avium subsp. paratuberculosis
gcggaacaccgc

SEQ ID NO: 3019652 - RNA, 22 nt, Mycobacterium avium subsp. paratuberculosis
gcggaacaccgccuugcccggc

SEQ ID NO: 3019653 - RNA, 23 nt, Mycobacterium avium subsp. paratuberculosis
gcggaacaccgccuugcccggcu

SEQ ID NO: 3019654 - RNA, 14 nt, Mycobacterium avium subsp. paratuberculosis
gcggaacagccggc

SEQ ID NO: 3019655 - RNA, 19 nt, Mycobacterium avium subsp. paratuberculosis
gcggaacagccggcucagg

SEQ ID NO: 3019656 - RNA, 16 nt, Mycobacterium avium subsp. paratuberculosis
gcggaacccacgugcg

SEQ ID NO: 3019657 - RNA, 18 nt, Mycobacterium avium subsp. paratuberculosis
gcggaacccacgugcggc

SEQ ID NO: 3019658 - RNA, 21 nt, Mycobacterium avium subsp. paratuberculosis
gcggaacccacgugcggcgcc

SEQ ID NO: 3019659 - RNA, 23 nt, Mycobacterium avium subsp. paratuberculosis
gcggaacccacgugcggcgcccu

SEQ ID NO: 3019660 - RNA, 16 nt, Mycobacterium avium subsp. paratuberculosis
gcggaacccggguggc

SEQ ID NO: 3019661 - RNA, 19 nt, Mycobacterium avium subsp. paratuberculosis
gcggaacccggguggcccg

SEQ ID NO: 3019662 - RNA, 22 nt, Mycobacterium avium subsp. paratuberculosis
gcggaacccguugcgcccuuga

SEQ ID NO: 3019663 - RNA, 18 nt, Mycobacterium avium subsp. paratuberculosis
gcggaaccgacaccucgc

SEQ ID NO: 3019664 - RNA, 14 nt, Mycobacterium avium subsp. paratuberculosis
gcggaaccggccgg

SEQ ID NO: 3019665 - RNA, 18 nt, Mycobacterium avium subsp. paratuberculosis
gcggaaccggccggggcg

SEQ ID NO: 3019666 - RNA, 20 nt, Mycobacterium avium subsp. paratuberculosis
gcggaaccggccggggcgcc

SEQ ID NO: 3019667 - RNA, 14 nt, Mycobacterium avium subsp. paratuberculosis
gcggaaccgggccg

SEQ ID NO: 3019668 - RNA, 16 nt, Mycobacterium avium subsp. paratuberculosis
gcggaaccgggccgcu

SEQ ID NO: 3019669 - RNA, 21 nt, Mycobacterium avium subsp. paratuberculosis
gcggaaccgggccgcuggccg

SEQ ID NO: 3019670 - RNA, 20 nt, Mycobacterium avium subsp. paratuberculosis
gcggaaccguagaccaccuc

SEQ ID NO: 3019671 - RNA, 21 nt, Mycobacterium avium subsp. paratuberculosis
gcggaaccguagaccaccucg

SEQ ID NO: 3019672 - RNA, 20 nt, Mycobacterium avium subsp. paratuberculosis
gcggaaccguugcagcacag

SEQ ID NO: 3019673 - RNA, 21 nt, Mycobacterium avium subsp. paratuberculosis
gcggaagaacaguuccucggc

SEQ ID NO: 3019674 - RNA, 15 nt, Mycobacterium avium subsp. paratuberculosis
gcggaagccccaggc

SEQ ID NO: 3019675 - RNA, 12 nt, Mycobacterium avium subsp. paratuberculosis
gcggaagcgcgu

SEQ ID NO: 3019676 - RNA, 22 nt, Mycobacterium avium subsp. paratuberculosis
gcggaagcgcguucagggugca

SEQ ID NO: 3019677 - RNA, 15 nt, Mycobacterium avium subsp. paratuberculosis
gcggaaggccagcuc

SEQ ID NO: 3019678 - RNA, 16 nt, Mycobacterium avium subsp. paratuberculosis
gcggaaggccgcgcgg

SEQ ID NO: 3019679 - RNA, 16 nt, Mycobacterium avium subsp. paratuberculosis
gcggaaguagcccgga

SEQ ID NO: 3019680 - RNA, 22 nt, Mycobacterium avium subsp. paratuberculosis
gcggaaugaacgcggccagggu

SEQ ID NO: 3019681 - RNA, 19 nt, Mycobacterium avium subsp. paratuberculosis
gcggaaugcaggaucgcgg

SEQ ID NO: 3019682 - RNA, 16 nt, Mycobacterium avium subsp. paratuberculosis
gcggaauucgcgggug

SEQ ID NO: 3019683 - RNA, 18 nt, Mycobacterium avium subsp. paratuberculosis
gcggacacgaacgacgcg

SEQ ID NO: 3019684 - RNA, 19 nt, Mycobacterium avium subsp. paratuberculosis
gcggacacgaacgacgcgg

SEQ ID NO: 3019685 - RNA, 15 nt, Mycobacterium avium subsp. paratuberculosis
gcggacacgcggacc

SEQ ID NO: 3019686 - RNA, 19 nt, Mycobacterium avium subsp. paratuberculosis
gcggacacgcggacccgua

SEQ ID NO: 3019687 - RNA, 13 nt, Mycobacterium avium subsp. paratuberculosis
gcggacagcacgu

SEQ ID NO: 3019688 - RNA, 16 nt, Mycobacterium avium subsp. paratuberculosis
gcggacagccccgagc

SEQ ID NO: 3019689 - RNA, 18 nt, Mycobacterium avium subsp. paratuberculosis
gcggacagccccgagccg

SEQ ID NO: 3019690 - RNA, 19 nt, Mycobacterium avium subsp. paratuberculosis
gcggacagccccgagccgc

SEQ ID NO: 3019691 - RNA, 13 nt, Mycobacterium avium subsp. paratuberculosis
gcggacagcgcgg

SEQ ID NO: 3019692 - RNA, 15 nt, Mycobacterium avium subsp. paratuberculosis
gcggacagcucgccg

SEQ ID NO: 3019693 - RNA, 16 nt, Mycobacterium avium subsp. paratuberculosis
gcggacagcucgccgg

SEQ ID NO: 3019694 - RNA, 17 nt, Mycobacterium avium subsp. paratuberculosis
gcggacagcugcgcggg

SEQ ID NO: 3019695 - RNA, 14 nt, Mycobacterium avium subsp. paratuberculosis
gcggacagggcggc

SEQ ID NO: 3019696 - RNA, 16 nt, Mycobacterium avium subsp. paratuberculosis
gcggacagggcggcga

SEQ ID NO: 3019697 - RNA, 21 nt, Mycobacterium avium subsp. paratuberculosis
gcggacauucugcacgacgaa

SEQ ID NO: 3019698 - RNA, 18 nt, Mycobacterium avium subsp. paratuberculosis
gcggaccaccgcgugcga

SEQ ID NO: 3019699 - RNA, 22 nt, Mycobacterium avium subsp. paratuberculosis
gcggaccaccgcgugcgagccg

SEQ ID NO: 3019700 - RNA, 21 nt, Mycobacterium avium subsp. paratuberculosis
gcggaccaucuacgaccucga

SEQ ID NO: 3019701 - RNA, 22 nt, Mycobacterium avium subsp. paratuberculosis
gcggaccaucuacgaccucgaa

SEQ ID NO: 3019702 - RNA, 15 nt, Mycobacterium avium subsp. paratuberculosis
gcggacccagcuccu

SEQ ID NO: 3019703 - RNA, 23 nt, Mycobacterium avium subsp. paratuberculosis
gcggacccagcuccucggccagc

SEQ ID NO: 3019704 - RNA, 15 nt, Mycobacterium avium subsp. paratuberculosis
gcggaccccagcgug

SEQ ID NO: 3019705 - RNA, 18 nt, Mycobacterium avium subsp. paratuberculosis
gcggacccgacggucggg

SEQ ID NO: 3019706 - RNA, 20 nt, Mycobacterium avium subsp. paratuberculosis
gcggacccgacggucgggcc

SEQ ID NO: 3019707 - RNA, 15 nt, Mycobacterium avium subsp. paratuberculosis
gcggacccggaggcg

SEQ ID NO: 3019708 - RNA, 16 nt, Mycobacterium avium subsp. paratuberculosis
gcggacccggucggcc

SEQ ID NO: 3019709 - RNA, 17 nt, Mycobacterium avium subsp. paratuberculosis
gcggacccggucggccg

SEQ ID NO: 3019710 - RNA, 18 nt, Mycobacterium avium subsp. paratuberculosis
gcggacccggucggccgc

SEQ ID NO: 3019711 - RNA, 19 nt, Mycobacterium avium subsp. paratuberculosis
gcggacccggucggccgcg

SEQ ID NO: 3019712 - RNA, 15 nt, Mycobacterium avium subsp. paratuberculosis
gcggacccguugggc

SEQ ID NO: 3019713 - RNA, 14 nt, Mycobacterium avium subsp. paratuberculosis
gcggacccuggcca

SEQ ID NO: 3019714 - RNA, 16 nt, Mycobacterium avium subsp. paratuberculosis
gcggacccuggccagc

SEQ ID NO: 3019715 - RNA, 18 nt, Mycobacterium avium subsp. paratuberculosis
gcggacccuggccagcac

SEQ ID NO: 3019716 - RNA, 18 nt, Mycobacterium avium subsp. paratuberculosis
gcggacccuucagccaga

SEQ ID NO: 3019717 - RNA, 13 nt, Mycobacterium avium subsp. paratuberculosis
gcggaccggcgau

SEQ ID NO: 3019718 - RNA, 15 nt, Mycobacterium avium subsp. paratuberculosis
gcggaccggcggccg

SEQ ID NO: 3019719 - RNA, 19 nt, Mycobacterium avium subsp. paratuberculosis
gcggaccggcggccgccau

SEQ ID NO: 3019720 - RNA, 21 nt, Mycobacterium avium subsp. paratuberculosis
gcggaccgucggugucgaaga

SEQ ID NO: 3019721 - RNA, 12 nt, Mycobacterium avium subsp. paratuberculosis
gcggaccugggu

SEQ ID NO: 3019722 - RNA, 20 nt, Mycobacterium avium subsp. paratuberculosis
gcggaccuuggugucggcga

SEQ ID NO: 3019723 - RNA, 16 nt, Mycobacterium avium subsp. paratuberculosis
gcggacgacggccagc

SEQ ID NO: 3019724 - RNA, 16 nt, Mycobacterium avium subsp. paratuberculosis
gcggacgauguccgcc

SEQ ID NO: 3019725 - RNA, 18 nt, Mycobacterium avium subsp. paratuberculosis
gcggacgauguccgccgg

SEQ ID NO: 3019726 - RNA, 14 nt, Mycobacterium avium subsp. paratuberculosis
gcggauccgggccg

SEQ ID NO: 3019727 - RNA, 15 nt, Mycobacterium avium subsp. paratuberculosis
gcggauccgggccgc

SEQ ID NO: 3019728 - RNA, 21 nt, Mycobacterium avium subsp. paratuberculosis
gcggauccgggccggcgucgc

SEQ ID NO: 3019729 - RNA, 23 nt, Mycobacterium avium subsp. paratuberculosis
gcggauccucaguccgccccgau

SEQ ID NO: 3019730 - RNA, 20 nt, Mycobacterium avium subsp. paratuberculosis
gcggaucgaacagggcggcg

SEQ ID NO: 3019731 - RNA, 21 nt, Mycobacterium avium subsp. paratuberculosis
gcggaucgaacagggcggcgg

SEQ ID NO: 3019732 - RNA, 22 nt, Mycobacterium avium subsp. paratuberculosis
gcggaucgagguagcgugcgcc

SEQ ID NO: 3019733 - RNA, 14 nt, Mycobacterium avium subsp. paratuberculosis
gcggaucgcaucgg

SEQ ID NO: 3019734 - RNA, 16 nt, Mycobacterium avium subsp. paratuberculosis
gcggaucgcgcugacc

SEQ ID NO: 3019735 - RNA, 20 nt, Mycobacterium avium subsp. paratuberculosis
gcggaucgcgcugaccaggc

SEQ ID NO: 3019736 - RNA, 14 nt, Mycobacterium avium subsp. paratuberculosis
gcggaucgcgggcg

SEQ ID NO: 3019737 - RNA, 21 nt, Mycobacterium avium subsp. paratuberculosis
gcggaucgcgggcgacccgcu

SEQ ID NO: 3019738 - RNA, 24 nt, Mycobacterium avium subsp. paratuberculosis
gcggaucggcccgaucucgcgcgg

SEQ ID NO: 3019739 - RNA, 21 nt, Mycobacterium avium subsp. paratuberculosis
gcggaucggccuggggggcgc

SEQ ID NO: 3019740 - RNA, 14 nt, Mycobacterium avium subsp. paratuberculosis
gcggaucggcggcg

SEQ ID NO: 3019741 - RNA, 19 nt, Mycobacterium avium subsp. paratuberculosis
gcggaucggcggcgacggc

SEQ ID NO: 3019742 - RNA, 20 nt, Mycobacterium avium subsp. paratuberculosis
gcggaucggcggcgacggcg

SEQ ID NO: 3019743 - RNA, 16 nt, Mycobacterium avium subsp. paratuberculosis
gcggaucggcgguccc

SEQ ID NO: 3019744 - RNA, 17 nt, Mycobacterium avium subsp. paratuberculosis
gcggaucgggcguggcg

SEQ ID NO: 3019745 - RNA, 15 nt, Mycobacterium avium subsp. paratuberculosis
gcggaucggugcagg

SEQ ID NO: 3019746 - RNA, 19 nt, Mycobacterium avium subsp. paratuberculosis
gcggaucggugcaggccgc

SEQ ID NO: 3019747 - RNA, 21 nt, Mycobacterium avium subsp. paratuberculosis
gcggaucggugcaggccgcga

SEQ ID NO: 3019748 - RNA, 24 nt, Mycobacterium avium subsp. paratuberculosis
gcggaucggugcaggccgcgacgg

SEQ ID NO: 3019749 - RNA, 19 nt, Mycobacterium avium subsp. paratuberculosis
gcggaucgguuucuccacc

SEQ ID NO: 3019750 - RNA, 16 nt, Mycobacterium avium subsp. paratuberculosis
gcggaucgucaccgac

SEQ ID NO: 3019751 - RNA, 17 nt, Mycobacterium avium subsp. paratuberculosis
gcggaucgucaccgacc

SEQ ID NO: 3019752 - RNA, 13 nt, Mycobacterium avium subsp. paratuberculosis
gcggaucucgacc

SEQ ID NO: 3019753 - RNA, 18 nt, Mycobacterium avium subsp. paratuberculosis
gcggaucucgaccucguc

SEQ ID NO: 3019754 - RNA, 20 nt, Mycobacterium avium subsp. paratuberculosis
gcggaucucggugagcagaa

SEQ ID NO: 3019755 - RNA, 15 nt, Mycobacterium avium subsp. paratuberculosis
gcggaucucggugcc

SEQ ID NO: 3019756 - RNA, 16 nt, Mycobacterium avium subsp. paratuberculosis
gcggaucucgucgggc

SEQ ID NO: 3019757 - RNA, 18 nt, Mycobacterium avium subsp. paratuberculosis
gcggaucucgucgggcca

SEQ ID NO: 3019758 - RNA, 16 nt, Mycobacterium avium subsp. paratuberculosis
gcggaucuucuccgcc

SEQ ID NO: 3019759 - RNA, 21 nt, Mycobacterium avium subsp. paratuberculosis
gcggaucuucuccgccacauc

SEQ ID NO: 3019760 - RNA, 21 nt, Mycobacterium avium subsp. paratuberculosis
gcggaucuucucgcugcucug

SEQ ID NO: 3019761 - RNA, 20 nt, Mycobacterium avium subsp. paratuberculosis
gcggaucuugguguccagcg

SEQ ID NO: 3019762 - RNA, 14 nt, Mycobacterium avium subsp. paratuberculosis
gcggaugaccaggu

SEQ ID NO: 3019763 - RNA, 16 nt, Mycobacterium avium subsp. paratuberculosis
gcggaugaccaggucg

SEQ ID NO: 3019764 - RNA, 18 nt, Mycobacterium avium subsp. paratuberculosis
gcggaugaccaggucgcc

SEQ ID NO: 3019765 - RNA, 19 nt, Mycobacterium avium subsp. paratuberculosis
gcggaugaccaggucgccg

SEQ ID NO: 3019766 - RNA, 20 nt, Mycobacterium avium subsp. paratuberculosis
gcggaugaccaggucgccgg

SEQ ID NO: 3019767 - RNA, 21 nt, Mycobacterium avium subsp. paratuberculosis
gcggaugaccaggucgccggc

SEQ ID NO: 3019768 - RNA, 23 nt, Mycobacterium avium subsp. paratuberculosis
gcggaugacgggugcucagguug

SEQ ID NO: 3019769 - RNA, 19 nt, Mycobacterium avium subsp. paratuberculosis
gcggaugacgugcaccacc

SEQ ID NO: 3019770 - RNA, 19 nt, Mycobacterium avium subsp. paratuberculosis
gcggaugaugguggccagu

SEQ ID NO: 3019771 - RNA, 16 nt, Mycobacterium avium subsp. paratuberculosis
gcggaugcccaggccg

SEQ ID NO: 3019772 - RNA, 14 nt, Mycobacterium avium subsp. paratuberculosis
gcggaugcccgccg

SEQ ID NO: 3019773 - RNA, 16 nt, Mycobacterium avium subsp. paratuberculosis
gcggaugcccgccggc

SEQ ID NO: 3019774 - RNA, 17 nt, Mycobacterium avium subsp. paratuberculosis
gcggaugcccgccggcg

SEQ ID NO: 3019775 - RNA, 18 nt, Mycobacterium avium subsp. paratuberculosis
gcggaugcccgccggcgu

SEQ ID NO: 3019776 - RNA, 17 nt, Mycobacterium avium subsp. paratuberculosis
gcggaugccggaggcgc

SEQ ID NO: 3019777 - RNA, 18 nt, Mycobacterium avium subsp. paratuberculosis
gcggaugccggaggcgcc

SEQ ID NO: 3019778 - RNA, 15 nt, Mycobacterium avium subsp. paratuberculosis
gcggauggccccggc

SEQ ID NO: 3019779 - RNA, 17 nt, Mycobacterium avium subsp. paratuberculosis
gcggauggccccggcga

SEQ ID NO: 3019780 - RNA, 16 nt, Mycobacterium avium subsp. paratuberculosis
gcggauggccucggcg

SEQ ID NO: 3019781 - RNA, 17 nt, Mycobacterium avium subsp. paratuberculosis
gcggauggccucggcga

SEQ ID NO: 3019782 - RNA, 20 nt, Mycobacterium avium subsp. paratuberculosis
gcggauggccucggcgaugc

SEQ ID NO: 3019783 - RNA, 15 nt, Mycobacterium avium subsp. paratuberculosis
gcggauggcgacggc

SEQ ID NO: 3019784 - RNA, 14 nt, Mycobacterium avium subsp. paratuberculosis
gcggauggcgcccu

SEQ ID NO: 3019785 - RNA, 15 nt, Mycobacterium avium subsp. paratuberculosis
gcggauggcgccguc

SEQ ID NO: 3019786 - RNA, 15 nt, Mycobacterium avium subsp. paratuberculosis
gcggaugggugcggu

SEQ ID NO: 3019787 - RNA, 15 nt, Mycobacterium avium subsp. paratuberculosis
gcggauggugacggc

SEQ ID NO: 3019788 - RNA, 14 nt, Mycobacterium avium subsp. paratuberculosis
gcggauguccgacc

SEQ ID NO: 3019789 - RNA, 23 nt, Mycobacterium avium subsp. paratuberculosis
gcggaugucgguguggaccgcgc

SEQ ID NO: 3019790 - RNA, 13 nt, Mycobacterium avium subsp. paratuberculosis
gcggaugugccug

SEQ ID NO: 3019791 - RNA, 16 nt, Mycobacterium avium subsp. paratuberculosis
gcggauguggaggcga

SEQ ID NO: 3019792 - RNA, 23 nt, Mycobacterium avium subsp. paratuberculosis
gcggauuaccgugacggcaucgg

SEQ ID NO: 3019793 - RNA, 15 nt, Mycobacterium avium subsp. paratuberculosis
gcggauuccagcgcg

SEQ ID NO: 3019794 - RNA, 19 nt, Mycobacterium avium subsp. paratuberculosis
gcggauuccagcgcgaccg

SEQ ID NO: 3019795 - RNA, 16 nt, Mycobacterium avium subsp. paratuberculosis
gcggauuccagcgcgu

SEQ ID NO: 3019796 - RNA, 23 nt, Mycobacterium avium subsp. paratuberculosis
gcggauucucgcucugccgggcc

SEQ ID NO: 3019797 - RNA, 14 nt, Mycobacterium avium subsp. paratuberculosis
gcggauugaccagc

SEQ ID NO: 3019798 - RNA, 15 nt, Mycobacterium avium subsp. paratuberculosis
gcggauugaccagca

SEQ ID NO: 3019799 - RNA, 18 nt, Mycobacterium avium subsp. paratuberculosis
gcggauugaccagcacgu

SEQ ID NO: 3019800 - RNA, 15 nt, Mycobacterium avium subsp. paratuberculosis
gcggauuggucgggc

SEQ ID NO: 3019801 - RNA, 18 nt, Mycobacterium avium subsp. paratuberculosis
gcggauuggucgggcaca

SEQ ID NO: 3019802 - RNA, 20 nt, Mycobacterium avium subsp. paratuberculosis
gcggauuggucgggcacagc

SEQ ID NO: 3019803 - RNA, 17 nt, Mycobacterium avium subsp. paratuberculosis
gcggauuucucagcggc

SEQ ID NO: 3019804 - RNA, 18 nt, Mycobacterium avium subsp. paratuberculosis
gcggauuucucagcggcg

SEQ ID NO: 3019805 - RNA, 19 nt, Mycobacterium avium subsp. paratuberculosis
gcggauuucucagcggcgc

SEQ ID NO: 3019806 - RNA, 17 nt, Mycobacterium avium subsp. paratuberculosis
gcggcaaaacgcugggc

SEQ ID NO: 3019807 - RNA, 21 nt, Mycobacterium avium subsp. paratuberculosis
gcggcaaaacgcugggcgccg

SEQ ID NO: 3019808 - RNA, 18 nt, Mycobacterium avium subsp. paratuberculosis
gcggcaaagcguugccgc

SEQ ID NO: 3019809 - RNA, 17 nt, Mycobacterium avium subsp. paratuberculosis
gcggcaaagggcuaggu

SEQ ID NO: 3019810 - RNA, 17 nt, Mycobacterium avium subsp. paratuberculosis
gcggcaccuucaccgac

SEQ ID NO: 3019811 - RNA, 20 nt, Mycobacterium avium subsp. paratuberculosis
gcggcaccuucaccgaccag

SEQ ID NO: 3019812 - RNA, 22 nt, Mycobacterium avium subsp. paratuberculosis
gcggcaccuucaccgaccagcu

SEQ ID NO: 3019813 - RNA, 15 nt, Mycobacterium avium subsp. paratuberculosis
gcggcacgaucggca

SEQ ID NO: 3019814 - RNA, 16 nt, Mycobacterium avium subsp. paratuberculosis
gcggcacgaucggcag

SEQ ID NO: 3019815 - RNA, 19 nt, Mycobacterium avium subsp. paratuberculosis
gcggcacgaucggcagcgc

SEQ ID NO: 3019816 - RNA, 21 nt, Mycobacterium avium subsp. paratuberculosis
gcggcacgaucggcagcgcca

SEQ ID NO: 3019817 - RNA, 19 nt, Mycobacterium avium subsp. paratuberculosis
gcggcacgaucucgaccag

SEQ ID NO: 3019818 - RNA, 15 nt, Mycobacterium avium subsp. paratuberculosis
gcggcacgauggacg

SEQ ID NO: 3019819 - RNA, 12 nt, Mycobacterium avium subsp. paratuberculosis
gcggcacgccga

SEQ ID NO: 3019820 - RNA, 14 nt, Mycobacterium avium subsp. paratuberculosis
gcggcacgccgacc

SEQ ID NO: 3019821 - RNA, 15 nt, Mycobacterium avium subsp. paratuberculosis
gcggcacgccgacca

SEQ ID NO: 3019822 - RNA, 18 nt, Mycobacterium avium subsp. paratuberculosis
gcggcacgccgaccaccc

SEQ ID NO: 3019823 - RNA, 19 nt, Mycobacterium avium subsp. paratuberculosis
gcggcacgccgaccacccc

SEQ ID NO: 3019824 - RNA, 22 nt, Mycobacterium avium subsp. paratuberculosis
gcggcacgccgaccacccccag

SEQ ID NO: 3019825 - RNA, 16 nt, Mycobacterium avium subsp. paratuberculosis
gcggcacgcgucaccg

SEQ ID NO: 3019826 - RNA, 17 nt, Mycobacterium avium subsp. paratuberculosis
gcggcacgcgucaccgg

SEQ ID NO: 3019827 - RNA, 15 nt, Mycobacterium avium subsp. paratuberculosis
gcggcacgcugcgcc

SEQ ID NO: 3019828 - RNA, 17 nt, Mycobacterium avium subsp. paratuberculosis
gcggcacgcugcgccag

SEQ ID NO: 3019829 - RNA, 18 nt, Mycobacterium avium subsp. paratuberculosis
gcggcacgcugcgccagc

SEQ ID NO: 3019830 - RNA, 14 nt, Mycobacterium avium subsp. paratuberculosis
gcggcacggcgagg

SEQ ID NO: 3019831 - RNA, 20 nt, Mycobacterium avium subsp. paratuberculosis
gcggcacggcgaggucggga

SEQ ID NO: 3019832 - RNA, 20 nt, Mycobacterium avium subsp. paratuberculosis
gcggcacgggcaccgacgag

SEQ ID NO: 3019833 - RNA, 16 nt, Mycobacterium avium subsp. paratuberculosis
gcggcacgggccguuc

SEQ ID NO: 3019834 - RNA, 18 nt, Mycobacterium avium subsp. paratuberculosis
gcggcacggugcgggugc

SEQ ID NO: 3019835 - RNA, 20 nt, Mycobacterium avium subsp. paratuberculosis
gcggcacgguuggccggccc

SEQ ID NO: 3019836 - RNA, 16 nt, Mycobacterium avium subsp. paratuberculosis
gcggcagaccgguggc

SEQ ID NO: 3019837 - RNA, 17 nt, Mycobacterium avium subsp. paratuberculosis
gcggcagaccgguggcg

SEQ ID NO: 3019838 - RNA, 13 nt, Mycobacterium avium subsp. paratuberculosis
gcggcagaccguc

SEQ ID NO: 3019839 - RNA, 17 nt, Mycobacterium avium subsp. paratuberculosis
gcggcagaccguccggu

SEQ ID NO: 3019840 - RNA, 17 nt, Mycobacterium avium subsp. paratuberculosis
gcggcagauagaucagc

SEQ ID NO: 3019841 - RNA, 20 nt, Mycobacterium avium subsp. paratuberculosis
gcggcagauggucucgaucu

SEQ ID NO: 3019842 - RNA, 14 nt, Mycobacterium avium subsp. paratuberculosis
gcggcagcacaccu

SEQ ID NO: 3019843 - RNA, 15 nt, Mycobacterium avium subsp. paratuberculosis
gcggcagcacccgca

SEQ ID NO: 3019844 - RNA, 12 nt, Mycobacterium avium subsp. paratuberculosis
gcggcagcacgu

SEQ ID NO: 3019845 - RNA, 18 nt, Mycobacterium avium subsp. paratuberculosis
gcggcagcacguccccgg

SEQ ID NO: 3019846 - RNA, 12 nt, Mycobacterium avium subsp. paratuberculosis
gcggcagcagca

SEQ ID NO: 3019847 - RNA, 18 nt, Mycobacterium avium subsp. paratuberculosis
gcggcagcagcaccagcg

SEQ ID NO: 3019848 - RNA, 19 nt, Mycobacterium avium subsp. paratuberculosis
gcggcagcagcaccagcgu

SEQ ID NO: 3019849 - RNA, 20 nt, Mycobacterium avium subsp. paratuberculosis
gcggcagcagcaccagcgug

SEQ ID NO: 3019850 - RNA, 22 nt, Mycobacterium avium subsp. paratuberculosis
gcggcagcagcaccagcguggc

SEQ ID NO: 3019851 - RNA, 12 nt, Mycobacterium avium subsp. paratuberculosis
gcggcagcagcu

SEQ ID NO: 3019852 - RNA, 15 nt, Mycobacterium avium subsp. paratuberculosis
gcggcagccacggca

SEQ ID NO: 3019853 - RNA, 20 nt, Mycobacterium avium subsp. paratuberculosis
gcggcagccagccuggcggc

SEQ ID NO: 3019854 - RNA, 21 nt, Mycobacterium avium subsp. paratuberculosis
gcggcagccagccuggcggcg

SEQ ID NO: 3019855 - RNA, 16 nt, Mycobacterium avium subsp. paratuberculosis
gcggcagccaggcguu

SEQ ID NO: 3019856 - RNA, 11 nt, Mycobacterium avium subsp. paratuberculosis
gcggcagccgg

SEQ ID NO: 3019857 - RNA, 18 nt, Mycobacterium avium subsp. paratuberculosis
gcggcagccgggcgauca

SEQ ID NO: 3019858 - RNA, 19 nt, Mycobacterium avium subsp. paratuberculosis
gcggcagccuuuccacauc

SEQ ID NO: 3019859 - RNA, 18 nt, Mycobacterium avium subsp. paratuberculosis
gcggcagcgaacugccgg

SEQ ID NO: 3019860 - RNA, 23 nt, Mycobacterium avium subsp. paratuberculosis
gcggcagcgaacugccggcauag

SEQ ID NO: 3019861 - RNA, 23 nt, Mycobacterium avium subsp. paratuberculosis
gcggcagcgacagcgcgucggcc

SEQ ID NO: 3019862 - RNA, 14 nt, Mycobacterium avium subsp. paratuberculosis
gcggcagcgaggcg

SEQ ID NO: 3019863 - RNA, 18 nt, Mycobacterium avium subsp. paratuberculosis
gcggcagcgaggcgcgca

SEQ ID NO: 3019864 - RNA, 21 nt, Mycobacterium avium subsp. paratuberculosis
gcggcagcgaggcgcgcaggu

SEQ ID NO: 3019865 - RNA, 14 nt, Mycobacterium avium subsp. paratuberculosis
gcggcagcgccagc

SEQ ID NO: 3019866 - RNA, 12 nt, Mycobacterium avium subsp. paratuberculosis
gcggcagcgcgg

SEQ ID NO: 3019867 - RNA, 16 nt, Mycobacterium avium subsp. paratuberculosis
gcggcagcgcggcguu

SEQ ID NO: 3019868 - RNA, 16 nt, Mycobacterium avium subsp. paratuberculosis
gcggcagcggcgucgu

SEQ ID NO: 3019869 - RNA, 18 nt, Mycobacterium avium subsp. paratuberculosis
gcggcagcggcgucgucg

SEQ ID NO: 3019870 - RNA, 17 nt, Mycobacterium avium subsp. paratuberculosis
gcggcagcgucgccagc

SEQ ID NO: 3019871 - RNA, 21 nt, Mycobacterium avium subsp. paratuberculosis
gcggcagcgucgccagccgcc

SEQ ID NO: 3019872 - RNA, 14 nt, Mycobacterium avium subsp. paratuberculosis
gcggcagcucggcg

SEQ ID NO: 3019873 - RNA, 16 nt, Mycobacterium avium subsp. paratuberculosis
gcggcagcucggcggc

SEQ ID NO: 3019874 - RNA, 17 nt, Mycobacterium avium subsp. paratuberculosis
gcggcagcucggcggcc

SEQ ID NO: 3019875 - RNA, 18 nt, Mycobacterium avium subsp. paratuberculosis
gcggcagcucggcggccc

SEQ ID NO: 3019876 - RNA, 19 nt, Mycobacterium avium subsp. paratuberculosis
gcggcagcucggcggcccg

SEQ ID NO: 3019877 - RNA, 21 nt, Mycobacterium avium subsp. paratuberculosis
gcggcagcucggcggcccgcc

SEQ ID NO: 3019878 - RNA, 23 nt, Mycobacterium avium subsp. paratuberculosis
gcggcaggaaccgggucagcacc

SEQ ID NO: 3019879 - RNA, 20 nt, Mycobacterium avium subsp. paratuberculosis
gcggcaggaauuccagcgac

SEQ ID NO: 3019880 - RNA, 22 nt, Mycobacterium avium subsp. paratuberculosis
gcggcaggaauuccagcgacaa

SEQ ID NO: 3019881 - RNA, 17 nt, Mycobacterium avium subsp. paratuberculosis
gcggcaggcgacccgca

SEQ ID NO: 3019882 - RNA, 13 nt, Mycobacterium avium subsp. paratuberculosis
gcggcagggccac

SEQ ID NO: 3019883 - RNA, 14 nt, Mycobacterium avium subsp. paratuberculosis
gcggcagggccacc

SEQ ID NO: 3019884 - RNA, 16 nt, Mycobacterium avium subsp. paratuberculosis
gcggcagggccaccgu

SEQ ID NO: 3019885 - RNA, 15 nt, Mycobacterium avium subsp. paratuberculosis
gcggcagggccagca

SEQ ID NO: 3019886 - RNA, 14 nt, Mycobacterium avium subsp. paratuberculosis
gcggcagggccagg

SEQ ID NO: 3019887 - RNA, 14 nt, Mycobacterium avium subsp. paratuberculosis
gcggcagguaggcg

SEQ ID NO: 3019888 - RNA, 18 nt, Mycobacterium avium subsp. paratuberculosis
gcggcagguaggcgccgc

SEQ ID NO: 3019889 - RNA, 21 nt, Mycobacterium avium subsp. paratuberculosis
gcggcagguaggcgccgcucg

SEQ ID NO: 3019890 - RNA, 23 nt, Mycobacterium avium subsp. paratuberculosis
gcggcagguaggcgccgcucgac

SEQ ID NO: 3019891 - RNA, 22 nt, Mycobacterium avium subsp. paratuberculosis
gcggcaggucccaggccaggau

SEQ ID NO: 3019892 - RNA, 23 nt, Mycobacterium avium subsp. paratuberculosis
gcggcaggucccaggccaggauc

SEQ ID NO: 3019893 - RNA, 14 nt, Mycobacterium avium subsp. paratuberculosis
gcggcaggucggcc

SEQ ID NO: 3019894 - RNA, 16 nt, Mycobacterium avium subsp. paratuberculosis
gcggcaggucggccag

SEQ ID NO: 3019895 - RNA, 15 nt, Mycobacterium avium subsp. paratuberculosis
gcggccaccaccgca

SEQ ID NO: 3019896 - RNA, 18 nt, Mycobacterium avium subsp. paratuberculosis
gcggccaccaccgcauca

SEQ ID NO: 3019897 - RNA, 15 nt, Mycobacterium avium subsp. paratuberculosis
gcggccaccaccgcc

SEQ ID NO: 3019898 - RNA, 13 nt, Mycobacterium avium subsp. paratuberculosis
gcggccaccacga

SEQ ID NO: 3019899 - RNA, 22 nt, Mycobacterium avium subsp. paratuberculosis
gcggccaccacgacgccgggcg

SEQ ID NO: 3019900 - RNA, 16 nt, Mycobacterium avium subsp. paratuberculosis
gcggccaccagccggc

SEQ ID NO: 3019901 - RNA, 20 nt, Mycobacterium avium subsp. paratuberculosis
gcggccaccagccggccggc

SEQ ID NO: 3019902 - RNA, 13 nt, Mycobacterium avium subsp. paratuberculosis
gcggccaccagcg

SEQ ID NO: 3019903 - RNA, 16 nt, Mycobacterium avium subsp. paratuberculosis
gcggccaccagcgcgg

SEQ ID NO: 3019904 - RNA, 20 nt, Mycobacterium avium subsp. paratuberculosis
gcggccaccagcgcggccac

SEQ ID NO: 3019905 - RNA, 21 nt, Mycobacterium avium subsp. paratuberculosis
gcggccaccagcgcggccacc

SEQ ID NO: 3019906 - RNA, 22 nt, Mycobacterium avium subsp. paratuberculosis
gcggccaccagcgcggccacca

SEQ ID NO: 3019907 - RNA, 20 nt, Mycobacterium avium subsp. paratuberculosis
gcggccaccaucuccgcggc

SEQ ID NO: 3019908 - RNA, 14 nt, Mycobacterium avium subsp. paratuberculosis
gcggccaccaugcc

SEQ ID NO: 3019909 - RNA, 17 nt, Mycobacterium avium subsp. paratuberculosis
gcggccaccaugccggc

SEQ ID NO: 3019910 - RNA, 18 nt, Mycobacterium avium subsp. paratuberculosis
gcggccaccaugccggcg

SEQ ID NO: 3019911 - RNA, 20 nt, Mycobacterium avium subsp. paratuberculosis
gcggccaccaugccggcguc

SEQ ID NO: 3019912 - RNA, 21 nt, Mycobacterium avium subsp. paratuberculosis
gcggccaccaugggcgggacg

SEQ ID NO: 3019913 - RNA, 18 nt, Mycobacterium avium subsp. paratuberculosis
gcggccaccccggugacc

SEQ ID NO: 3019914 - RNA, 12 nt, Mycobacterium avium subsp. paratuberculosis
gcggccaccgcg

SEQ ID NO: 3019915 - RNA, 14 nt, Mycobacterium avium subsp. paratuberculosis
gcggccaccgcgcc

SEQ ID NO: 3019916 - RNA, 17 nt, Mycobacterium avium subsp. paratuberculosis
gcggccaccgcgccccg

SEQ ID NO: 3019917 - RNA, 19 nt, Mycobacterium avium subsp. paratuberculosis
gcggccaccgcgccccggc

SEQ ID NO: 3019918 - RNA, 15 nt, Mycobacterium avium subsp. paratuberculosis
gcggccaccgcgccg

SEQ ID NO: 3019919 - RNA, 17 nt, Mycobacterium avium subsp. paratuberculosis
gcggccaccgcgcgcug

SEQ ID NO: 3019920 - RNA, 13 nt, Mycobacterium avium subsp. paratuberculosis
gcggccaccgcgg

SEQ ID NO: 3019921 - RNA, 15 nt, Mycobacterium avium subsp. paratuberculosis
gcggccaccgcggcc

SEQ ID NO: 3019922 - RNA, 17 nt, Mycobacterium avium subsp. paratuberculosis
gcggccaccgcggccag

SEQ ID NO: 3019923 - RNA, 13 nt, Mycobacterium avium subsp. paratuberculosis
gcggccaccggga

SEQ ID NO: 3019924 - RNA, 16 nt, Mycobacterium avium subsp. paratuberculosis
gcggccaccgggaccg

SEQ ID NO: 3019925 - RNA, 17 nt, Mycobacterium avium subsp. paratuberculosis
gcggccaccgggucguc

SEQ ID NO: 3019926 - RNA, 12 nt, Mycobacterium avium subsp. paratuberculosis
gcggccaccucg

SEQ ID NO: 3019927 - RNA, 14 nt, Mycobacterium avium subsp. paratuberculosis
gcggccaccucgcc

SEQ ID NO: 3019928 - RNA, 15 nt, Mycobacterium avium subsp. paratuberculosis
gcggccaccucgccg

SEQ ID NO: 3019929 - RNA, 16 nt, Mycobacterium avium subsp. paratuberculosis
gcggccaccucgccgc

SEQ ID NO: 3019930 - RNA, 18 nt, Mycobacterium avium subsp. paratuberculosis
gcggccaccucgccgcag

SEQ ID NO: 3019931 - RNA, 14 nt, Mycobacterium avium subsp. paratuberculosis
gcggccaccucggc

SEQ ID NO: 3019932 - RNA, 17 nt, Mycobacterium avium subsp. paratuberculosis
gcggccaccucggcggc

SEQ ID NO: 3019933 - RNA, 21 nt, Mycobacterium avium subsp. paratuberculosis
gcggccaccucggcggcaccg

SEQ ID NO: 3019934 - RNA, 12 nt, Mycobacterium avium subsp. paratuberculosis
gcggccaccugg

SEQ ID NO: 3019935 - RNA, 14 nt, Mycobacterium avium subsp. paratuberculosis
gcggccaccugggc

SEQ ID NO: 3019936 - RNA, 19 nt, Mycobacterium avium subsp. paratuberculosis
gcggccaccugggcggggc

SEQ ID NO: 3019937 - RNA, 15 nt, Mycobacterium avium subsp. paratuberculosis
gcggccacgacggcg

SEQ ID NO: 3019938 - RNA, 21 nt, Mycobacterium avium subsp. paratuberculosis
gcggccacgaucgcgaucgcc

SEQ ID NO: 3019939 - RNA, 22 nt, Mycobacterium avium subsp. paratuberculosis
gcggccacgaucgcgaucgccg

SEQ ID NO: 3019940 - RNA, 21 nt, Mycobacterium avium subsp. paratuberculosis
gcggccacgaucgcggccagc

SEQ ID NO: 3019941 - RNA, 17 nt, Mycobacterium avium subsp. paratuberculosis
gcggccacgcccuggcc

SEQ ID NO: 3019942 - RNA, 18 nt, Mycobacterium avium subsp. paratuberculosis
gcggccacgcccuggccg

SEQ ID NO: 3019943 - RNA, 22 nt, Mycobacterium avium subsp. paratuberculosis
gcggccacgcccuggccgccgg

SEQ ID NO: 3019944 - RNA, 14 nt, Mycobacterium avium subsp. paratuberculosis
gcggccacgcuagc

SEQ ID NO: 3019945 - RNA, 14 nt, Mycobacterium avium subsp. paratuberculosis
gcggccacgcucgg

SEQ ID NO: 3019946 - RNA, 19 nt, Mycobacterium avium subsp. paratuberculosis
gcggccacgcucgggccgg

SEQ ID NO: 3019947 - RNA, 20 nt, Mycobacterium avium subsp. paratuberculosis
gcggccacgcucgggccggc

SEQ ID NO: 3019948 - RNA, 13 nt, Mycobacterium avium subsp. paratuberculosis
gcggccagcagca

SEQ ID NO: 3019949 - RNA, 17 nt, Mycobacterium avium subsp. paratuberculosis
gcggccagcagcaccag

SEQ ID NO: 3019950 - RNA, 18 nt, Mycobacterium avium subsp. paratuberculosis
gcggccagcagcaccaga

SEQ ID NO: 3019951 - RNA, 19 nt, Mycobacterium avium subsp. paratuberculosis
gcggccagcaucggaugcc

SEQ ID NO: 3019952 - RNA, 12 nt, Mycobacterium avium subsp. paratuberculosis
gcggccagccca

SEQ ID NO: 3019953 - RNA, 14 nt, Mycobacterium avium subsp. paratuberculosis
gcggccagccccgg

SEQ ID NO: 3019954 - RNA, 20 nt, Mycobacterium avium subsp. paratuberculosis
gcggccagccccgggaacca

SEQ ID NO: 3019955 - RNA, 19 nt, Mycobacterium avium subsp. paratuberculosis
gcggccagcccgcggcagc

SEQ ID NO: 3019956 - RNA, 21 nt, Mycobacterium avium subsp. paratuberculosis
gcggccagcccgcggcagcca

SEQ ID NO: 3019957 - RNA, 22 nt, Mycobacterium avium subsp. paratuberculosis
gcggccagcccgcggcagccag

SEQ ID NO: 3019958 - RNA, 23 nt, Mycobacterium avium subsp. paratuberculosis
gcggccagcccgcggcagccagc

SEQ ID NO: 3019959 - RNA, 15 nt, Mycobacterium avium subsp. paratuberculosis
gcggccagccgcgcg

SEQ ID NO: 3019960 - RNA, 16 nt, Mycobacterium avium subsp. paratuberculosis
gcggccagccgcgcgg

SEQ ID NO: 3019961 - RNA, 17 nt, Mycobacterium avium subsp. paratuberculosis
gcggccagccgcgcggc

SEQ ID NO: 3019962 - RNA, 18 nt, Mycobacterium avium subsp. paratuberculosis
gcggccagccgcgcggcg

SEQ ID NO: 3019963 - RNA, 21 nt, Mycobacterium avium subsp. paratuberculosis
gcggccagccgcgcggcgucg

SEQ ID NO: 3019964 - RNA, 13 nt, Mycobacterium avium subsp. paratuberculosis
gcggccagccgcu

SEQ ID NO: 3019965 - RNA, 18 nt, Mycobacterium avium subsp. paratuberculosis
gcggccagccgcucccgg

SEQ ID NO: 3019966 - RNA, 12 nt, Mycobacterium avium subsp. paratuberculosis
gcggccagccgg

SEQ ID NO: 3019967 - RNA, 15 nt, Mycobacterium avium subsp. paratuberculosis
gcggccagccggucg

SEQ ID NO: 3019968 - RNA, 16 nt, Mycobacterium avium subsp. paratuberculosis
gcggccagccggucgu

SEQ ID NO: 3019969 - RNA, 20 nt, Mycobacterium avium subsp. paratuberculosis
gcggccagccgguugcggug

SEQ ID NO: 3019970 - RNA, 23 nt, Mycobacterium avium subsp. paratuberculosis
gcggccagccgguugcgguggcc

SEQ ID NO: 3019971 - RNA, 13 nt, Mycobacterium avium subsp. paratuberculosis
gcggccagcgagg

SEQ ID NO: 3019972 - RNA, 19 nt, Mycobacterium avium subsp. paratuberculosis
gcggccagcgagucgauga

SEQ ID NO: 3019973 - RNA, 16 nt, Mycobacterium avium subsp. paratuberculosis
gcggccagcgccccgc

SEQ ID NO: 3019974 - RNA, 19 nt, Mycobacterium avium subsp. paratuberculosis
gcggccagcgccccgccgg

SEQ ID NO: 3019975 - RNA, 20 nt, Mycobacterium avium subsp. paratuberculosis
gcggccagcgcccgcgggug

SEQ ID NO: 3019976 - RNA, 14 nt, Mycobacterium avium subsp. paratuberculosis
gcggccagcgccuu

SEQ ID NO: 3019977 - RNA, 21 nt, Mycobacterium avium subsp. paratuberculosis
gcggccagcgccuucuccagc

SEQ ID NO: 3019978 - RNA, 17 nt, Mycobacterium avium subsp. paratuberculosis
gcggccagcgcgacgcg

SEQ ID NO: 3019979 - RNA, 16 nt, Mycobacterium avium subsp. paratuberculosis
gcggccagcgcgccgc

SEQ ID NO: 3019980 - RNA, 16 nt, Mycobacterium avium subsp. paratuberculosis
gcggccccgguggaug

SEQ ID NO: 3019981 - RNA, 17 nt, Mycobacterium avium subsp. paratuberculosis
gcggccccgguggaugg

SEQ ID NO: 3019982 - RNA, 19 nt, Mycobacterium avium subsp. paratuberculosis
gcggccccugcgggguguc

SEQ ID NO: 3019983 - RNA, 22 nt, Mycobacterium avium subsp. paratuberculosis
gcggccccuucgaugucgccgg

SEQ ID NO: 3019984 - RNA, 20 nt, Mycobacterium avium subsp. paratuberculosis
gcggcccgaaaacgcccggg

SEQ ID NO: 3019985 - RNA, 18 nt, Mycobacterium avium subsp. paratuberculosis
gcggcccgaacacccaga

SEQ ID NO: 3019986 - RNA, 22 nt, Mycobacterium avium subsp. paratuberculosis
gcggcccgaacacccagaugcc

SEQ ID NO: 3019987 - RNA, 15 nt, Mycobacterium avium subsp. paratuberculosis
gcggcccgaccagcg

SEQ ID NO: 3019988 - RNA, 16 nt, Mycobacterium avium subsp. paratuberculosis
gcggcccgaccagcgg

SEQ ID NO: 3019989 - RNA, 18 nt, Mycobacterium avium subsp. paratuberculosis
gcggcccgaccagcgggc

SEQ ID NO: 3019990 - RNA, 19 nt, Mycobacterium avium subsp. paratuberculosis
gcggcccgaucaccaggcc

SEQ ID NO: 3019991 - RNA, 17 nt, Mycobacterium avium subsp. paratuberculosis
gcggcccgaucaccgcc

SEQ ID NO: 3019992 - RNA, 13 nt, Mycobacterium avium subsp. paratuberculosis
gcggcccgcaccg

SEQ ID NO: 3019993 - RNA, 14 nt, Mycobacterium avium subsp. paratuberculosis
gcggcccgcaccga

SEQ ID NO: 3019994 - RNA, 13 nt, Mycobacterium avium subsp. paratuberculosis
gcggcccgcacgg

SEQ ID NO: 3019995 - RNA, 15 nt, Mycobacterium avium subsp. paratuberculosis
gcggcccgcacggcc

SEQ ID NO: 3019996 - RNA, 16 nt, Mycobacterium avium subsp. paratuberculosis
gcggcccgcacggccg

SEQ ID NO: 3019997 - RNA, 22 nt, Mycobacterium avium subsp. paratuberculosis
gcggcccgcacggccgccaggg

SEQ ID NO: 3019998 - RNA, 13 nt, Mycobacterium avium subsp. paratuberculosis
gcggcccgcagga

SEQ ID NO: 3019999 - RNA, 20 nt, Mycobacterium avium subsp. paratuberculosis
gcggcccgcaggaucgagcc

SEQ ID NO: 3020000 - RNA, 21 nt, Mycobacterium avium subsp. paratuberculosis
gcggcccgccgaacgccuccg

SEQ ID NO: 3020001 - RNA, 22 nt, Mycobacterium avium subsp. paratuberculosis
gcggcccgccgaacgccuccgc

SEQ ID NO: 3020002 - RNA, 13 nt, Mycobacterium avium subsp. paratuberculosis
gcggcccgccgcg

SEQ ID NO: 3020003 - RNA, 16 nt, Mycobacterium avium subsp. paratuberculosis
gcggcccgccgcgccc

SEQ ID NO: 3020004 - RNA, 15 nt, Mycobacterium avium subsp. paratuberculosis
gcggcccgccgcuca

SEQ ID NO: 3020005 - RNA, 23 nt, Mycobacterium avium subsp. paratuberculosis
gcggcccgccgcucaccgccgag

SEQ ID NO: 3020006 - RNA, 13 nt, Mycobacterium avium subsp. paratuberculosis
gcggcccgccgga

SEQ ID NO: 3020007 - RNA, 22 nt, Mycobacterium avium subsp. paratuberculosis
gcggcccgccggaacucggccg

SEQ ID NO: 3020008 - RNA, 14 nt, Mycobacterium avium subsp. paratuberculosis
gcggcccgccgggc

SEQ ID NO: 3020009 - RNA, 15 nt, Mycobacterium avium subsp. paratuberculosis
gcggcccgccgggcg

SEQ ID NO: 3020010 - RNA, 18 nt, Mycobacterium avium subsp. paratuberculosis
gcggcccgccgggcgucg

SEQ ID NO: 3020011 - RNA, 20 nt, Mycobacterium avium subsp. paratuberculosis
gcggcccgccgggcgucgcg

SEQ ID NO: 3020012 - RNA, 21 nt, Mycobacterium avium subsp. paratuberculosis
gcggcccgccgggcgucgcgc

SEQ ID NO: 3020013 - RNA, 16 nt, Mycobacterium avium subsp. paratuberculosis
gcggcccgccucggcg

SEQ ID NO: 3020014 - RNA, 17 nt, Mycobacterium avium subsp. paratuberculosis
gcggcccgccucggcgg

SEQ ID NO: 3020015 - RNA, 19 nt, Mycobacterium avium subsp. paratuberculosis
gcggcccgccucggcggcc

SEQ ID NO: 3020016 - RNA, 14 nt, Mycobacterium avium subsp. paratuberculosis
gcggcccgcgccgg

SEQ ID NO: 3020017 - RNA, 15 nt, Mycobacterium avium subsp. paratuberculosis
gcggcccgcgccggc

SEQ ID NO: 3020018 - RNA, 13 nt, Mycobacterium avium subsp. paratuberculosis
gcggcccgcggcg

SEQ ID NO: 3020019 - RNA, 12 nt, Mycobacterium avium subsp. paratuberculosis
gcggcccgcggg

SEQ ID NO: 3020020 - RNA, 14 nt, Mycobacterium avium subsp. paratuberculosis
gcggcccgcggggc

SEQ ID NO: 3020021 - RNA, 15 nt, Mycobacterium avium subsp. paratuberculosis
gcggcccgcggggcg

SEQ ID NO: 3020022 - RNA, 17 nt, Mycobacterium avium subsp. paratuberculosis
gcggcccgcucgauguc

SEQ ID NO: 3020023 - RNA, 18 nt, Mycobacterium avium subsp. paratuberculosis
gcggcccgcuugccgacg

SEQ ID NO: 3020024 - RNA, 14 nt, Mycobacterium avium subsp. paratuberculosis
gcggcccggcacug

SEQ ID NO: 3020025 - RNA, 14 nt, Mycobacterium avium subsp. paratuberculosis
gcggcccggccacc

SEQ ID NO: 3020026 - RNA, 15 nt, Mycobacterium avium subsp. paratuberculosis
gcggcccggccacca

SEQ ID NO: 3020027 - RNA, 16 nt, Mycobacterium avium subsp. paratuberculosis
gcggcccggccaccag

SEQ ID NO: 3020028 - RNA, 14 nt, Mycobacterium avium subsp. paratuberculosis
gcggcccggccacu

SEQ ID NO: 3020029 - RNA, 17 nt, Mycobacterium avium subsp. paratuberculosis
gcggcccggccacucgc

SEQ ID NO: 3020030 - RNA, 12 nt, Mycobacterium avium subsp. paratuberculosis
gcggcccggccc

SEQ ID NO: 3020031 - RNA, 15 nt, Mycobacterium avium subsp. paratuberculosis
gcggcccggcccgcu

SEQ ID NO: 3020032 - RNA, 17 nt, Mycobacterium avium subsp. paratuberculosis
gcggcccggcccgcugg

SEQ ID NO: 3020033 - RNA, 13 nt, Mycobacterium avium subsp. paratuberculosis
gcggcccggcucg

SEQ ID NO: 3020034 - RNA, 15 nt, Mycobacterium avium subsp. paratuberculosis
gcggcccggcucgga

SEQ ID NO: 3020035 - RNA, 13 nt, Mycobacterium avium subsp. paratuberculosis
gcggcccguccgc

SEQ ID NO: 3020036 - RNA, 18 nt, Mycobacterium avium subsp. paratuberculosis
gcggcccguccgccccgc

SEQ ID NO: 3020037 - RNA, 19 nt, Mycobacterium avium subsp. paratuberculosis
gcggcccguccgccccgcu

SEQ ID NO: 3020038 - RNA, 13 nt, Mycobacterium avium subsp. paratuberculosis
gcggcccgucgcc

SEQ ID NO: 3020039 - RNA, 14 nt, Mycobacterium avium subsp. paratuberculosis
gcggcccgucgcca

SEQ ID NO: 3020040 - RNA, 15 nt, Mycobacterium avium subsp. paratuberculosis
gcggcccgucgccac

SEQ ID NO: 3020041 - RNA, 16 nt, Mycobacterium avium subsp. paratuberculosis
gcggcccgucgccacc

SEQ ID NO: 3020042 - RNA, 17 nt, Mycobacterium avium subsp. paratuberculosis
gcggcccgucgccacca

SEQ ID NO: 3020043 - RNA, 20 nt, Mycobacterium avium subsp. paratuberculosis
gcggcccgucgccaccacgg

SEQ ID NO: 3020044 - RNA, 14 nt, Mycobacterium avium subsp. paratuberculosis
gcggcccgucgccg

SEQ ID NO: 3020045 - RNA, 19 nt, Mycobacterium avium subsp. paratuberculosis
gcggcccgucgccgaucag

SEQ ID NO: 3020046 - RNA, 22 nt, Mycobacterium avium subsp. paratuberculosis
gcggcccgucgccgaucagcac

SEQ ID NO: 3020047 - RNA, 20 nt, Mycobacterium avium subsp. paratuberculosis
gcggcccguugagcaccgcg

SEQ ID NO: 3020048 - RNA, 21 nt, Mycobacterium avium subsp. paratuberculosis
gcggcccguugagcaccgcga

SEQ ID NO: 3020049 - RNA, 14 nt, Mycobacterium avium subsp. paratuberculosis
gcggcccugcagcg

SEQ ID NO: 3020050 - RNA, 16 nt, Mycobacterium avium subsp. paratuberculosis
gcggcccugcagcgcc

SEQ ID NO: 3020051 - RNA, 13 nt, Mycobacterium avium subsp. paratuberculosis
gcggcccugcgcg

SEQ ID NO: 3020052 - RNA, 14 nt, Mycobacterium avium subsp. paratuberculosis
gcggcccugcgcgg

SEQ ID NO: 3020053 - RNA, 16 nt, Mycobacterium avium subsp. paratuberculosis
gcggcccugcgcggcc

SEQ ID NO: 3020054 - RNA, 20 nt, Mycobacterium avium subsp. paratuberculosis
gcggcccugcgcggccugca

SEQ ID NO: 3020055 - RNA, 15 nt, Mycobacterium avium subsp. paratuberculosis
gcggcccuggauguc

SEQ ID NO: 3020056 - RNA, 12 nt, Mycobacterium avium subsp. paratuberculosis
gcggcccuggcg

SEQ ID NO: 3020057 - RNA, 20 nt, Mycobacterium avium subsp. paratuberculosis
gcggcccuggcgggcggccc

SEQ ID NO: 3020058 - RNA, 21 nt, Mycobacterium avium subsp. paratuberculosis
gcggcccuggcgggcggcccg

SEQ ID NO: 3020059 - RNA, 22 nt, Mycobacterium avium subsp. paratuberculosis
gcggcccuggcgggcggcccgc

SEQ ID NO: 3020060 - RNA, 21 nt, Mycobacterium avium subsp. paratuberculosis
gcggcccugguugagcaccgc

SEQ ID NO: 3020061 - RNA, 22 nt, Mycobacterium avium subsp. paratuberculosis
gcggcccugguugagcaccgcg

SEQ ID NO: 3020062 - RNA, 19 nt, Mycobacterium avium subsp. paratuberculosis
gcggcccuguucgccgucg

SEQ ID NO: 3020063 - RNA, 19 nt, Mycobacterium avium subsp. paratuberculosis
gcggcccuguuugcaggcg

SEQ ID NO: 3020064 - RNA, 17 nt, Mycobacterium avium subsp. paratuberculosis
gcggcccuucucggacg

SEQ ID NO: 3020065 - RNA, 23 nt, Mycobacterium avium subsp. paratuberculosis
gcggccgcggaauucgcgggugc

SEQ ID NO: 3020066 - RNA, 16 nt, Mycobacterium avium subsp. paratuberculosis
gcggccgcggacccga

SEQ ID NO: 3020067 - RNA, 18 nt, Mycobacterium avium subsp. paratuberculosis
gcggccgcggcgcgcauc

SEQ ID NO: 3020068 - RNA, 15 nt, Mycobacterium avium subsp. paratuberculosis
gcggccgcggcgggc

SEQ ID NO: 3020069 - RNA, 16 nt, Mycobacterium avium subsp. paratuberculosis
gcggccgcggcgggcg

SEQ ID NO: 3020070 - RNA, 22 nt, Mycobacterium avium subsp. paratuberculosis
gcggccgcguccucgccguacg

SEQ ID NO: 3020071 - RNA, 15 nt, Mycobacterium avium subsp. paratuberculosis
gcggccgcgucgccg

SEQ ID NO: 3020072 - RNA, 16 nt, Mycobacterium avium subsp. paratuberculosis
gcggccgcgucgccga

SEQ ID NO: 3020073 - RNA, 13 nt, Mycobacterium avium subsp. paratuberculosis
gcggccgcgucgg

SEQ ID NO: 3020074 - RNA, 14 nt, Mycobacterium avium subsp. paratuberculosis
gcggccgcgucggc

SEQ ID NO: 3020075 - RNA, 17 nt, Mycobacterium avium subsp. paratuberculosis
gcggccgcgucggcggc

SEQ ID NO: 3020076 - RNA, 18 nt, Mycobacterium avium subsp. paratuberculosis
gcggccgcgucggcggcg

SEQ ID NO: 3020077 - RNA, 19 nt, Mycobacterium avium subsp. paratuberculosis
gcggccgcgucggcggcgg

SEQ ID NO: 3020078 - RNA, 18 nt, Mycobacterium avium subsp. paratuberculosis
gcggccgcguugucgacc

SEQ ID NO: 3020079 - RNA, 22 nt, Mycobacterium avium subsp. paratuberculosis
gcggccgcguugucgaccacca

SEQ ID NO: 3020080 - RNA, 17 nt, Mycobacterium avium subsp. paratuberculosis
gcggccgcugcgcccag

SEQ ID NO: 3020081 - RNA, 18 nt, Mycobacterium avium subsp. paratuberculosis
gcggccgcugcgcccagc

SEQ ID NO: 3020082 - RNA, 13 nt, Mycobacterium avium subsp. paratuberculosis
gcggccgcuggcg

SEQ ID NO: 3020083 - RNA, 20 nt, Mycobacterium avium subsp. paratuberculosis
gcggccgcuucccacccggu

SEQ ID NO: 3020084 - RNA, 22 nt, Mycobacterium avium subsp. paratuberculosis
gcggccggaagaccguugacga

SEQ ID NO: 3020085 - RNA, 23 nt, Mycobacterium avium subsp. paratuberculosis
gcggccggaucgaauccggcggc

SEQ ID NO: 3020086 - RNA, 23 nt, Mycobacterium avium subsp. paratuberculosis
gcggccggcacuaccgccucgcc

SEQ ID NO: 3020087 - RNA, 10 nt, Mycobacterium avium subsp. paratuberculosis
gcggccggcc

SEQ ID NO: 3020088 - RNA, 21 nt, Mycobacterium avium subsp. paratuberculosis
gcggccggccacgcucggcgg

SEQ ID NO: 3020089 - RNA, 13 nt, Mycobacterium avium subsp. paratuberculosis
gcggccggccagc

SEQ ID NO: 3020090 - RNA, 14 nt, Mycobacterium avium subsp. paratuberculosis
gcggccggccagca

SEQ ID NO: 3020091 - RNA, 18 nt, Mycobacterium avium subsp. paratuberculosis
gcggccggccagcagccg

SEQ ID NO: 3020092 - RNA, 18 nt, Mycobacterium avium subsp. paratuberculosis
gcggccggccagcgcgcg

SEQ ID NO: 3020093 - RNA, 21 nt, Mycobacterium avium subsp. paratuberculosis
gcggccggccagcgcgcggcc

SEQ ID NO: 3020094 - RNA, 13 nt, Mycobacterium avium subsp. paratuberculosis
gcggccggccaug

SEQ ID NO: 3020095 - RNA, 13 nt, Mycobacterium avium subsp. paratuberculosis
gcggccggcccag

SEQ ID NO: 3020096 - RNA, 16 nt, Mycobacterium avium subsp. paratuberculosis
gcggccggccccggcc

SEQ ID NO: 3020097 - RNA, 20 nt, Mycobacterium avium subsp. paratuberculosis
gcggccggccccggccgggc

SEQ ID NO: 3020098 - RNA, 21 nt, Mycobacterium avium subsp. paratuberculosis
gcggccggccccggccgggcg

SEQ ID NO: 3020099 - RNA, 12 nt, Mycobacterium avium subsp. paratuberculosis
gcggccggcccg

SEQ ID NO: 3020100 - RNA, 14 nt, Mycobacterium avium subsp. paratuberculosis
gcggccggcccggc

SEQ ID NO: 3020101 - RNA, 20 nt, Mycobacterium avium subsp. paratuberculosis
gcggccggcccggcccgacg

SEQ ID NO: 3020102 - RNA, 13 nt, Mycobacterium avium subsp. paratuberculosis
gcggccggccgac

SEQ ID NO: 3020103 - RNA, 14 nt, Mycobacterium avium subsp. paratuberculosis
gcggccggccgaca

SEQ ID NO: 3020104 - RNA, 17 nt, Mycobacterium avium subsp. paratuberculosis
gcggccggccgacaccc

SEQ ID NO: 3020105 - RNA, 12 nt, Mycobacterium avium subsp. paratuberculosis
gcggccggccgc

SEQ ID NO: 3020106 - RNA, 13 nt, Mycobacterium avium subsp. paratuberculosis
gcggccggccgcg

SEQ ID NO: 3020107 - RNA, 14 nt, Mycobacterium avium subsp. paratuberculosis
gcggccggccgcgc

SEQ ID NO: 3020108 - RNA, 15 nt, Mycobacterium avium subsp. paratuberculosis
gcggccggccgcgcc

SEQ ID NO: 3020109 - RNA, 18 nt, Mycobacterium avium subsp. paratuberculosis
gcggccggccgcgcccau

SEQ ID NO: 3020110 - RNA, 16 nt, Mycobacterium avium subsp. paratuberculosis
gcggccggccgcgcgc

SEQ ID NO: 3020111 - RNA, 20 nt, Mycobacterium avium subsp. paratuberculosis
gcggccggccgcgcgcggcg

SEQ ID NO: 3020112 - RNA, 14 nt, Mycobacterium avium subsp. paratuberculosis
gcggccggccggcc

SEQ ID NO: 3020113 - RNA, 15 nt, Mycobacterium avium subsp. paratuberculosis
gcggccggccggccu

SEQ ID NO: 3020114 - RNA, 18 nt, Mycobacterium avium subsp. paratuberculosis
gcggccggccggccuggu

SEQ ID NO: 3020115 - RNA, 12 nt, Mycobacterium avium subsp. paratuberculosis
gcggccggcgca

SEQ ID NO: 3020116 - RNA, 13 nt, Mycobacterium avium subsp. paratuberculosis
gcggccggcgccg

SEQ ID NO: 3020117 - RNA, 16 nt, Mycobacterium avium subsp. paratuberculosis
gcggccggcgccgacc

SEQ ID NO: 3020118 - RNA, 14 nt, Mycobacterium avium subsp. paratuberculosis
gcggccggcgccgg

SEQ ID NO: 3020119 - RNA, 16 nt, Mycobacterium avium subsp. paratuberculosis
gcggccggcgccggcg

SEQ ID NO: 3020120 - RNA, 18 nt, Mycobacterium avium subsp. paratuberculosis
gcggccggcgccggcggu

SEQ ID NO: 3020121 - RNA, 13 nt, Mycobacterium avium subsp. paratuberculosis
gcggccggcggca

SEQ ID NO: 3020122 - RNA, 15 nt, Mycobacterium avium subsp. paratuberculosis
gcggccggcggcagu

SEQ ID NO: 3020123 - RNA, 20 nt, Mycobacterium avium subsp. paratuberculosis
gcggccggcggcaguccggc

SEQ ID NO: 3020124 - RNA, 14 nt, Mycobacterium avium subsp. paratuberculosis
gcggccggcggcgu

SEQ ID NO: 3020125 - RNA, 15 nt, Mycobacterium avium subsp. paratuberculosis
gcggccggcggcguc

SEQ ID NO: 3020126 - RNA, 21 nt, Mycobacterium avium subsp. paratuberculosis
gcggccggcggcgucgugacc

SEQ ID NO: 3020127 - RNA, 22 nt, Mycobacterium avium subsp. paratuberculosis
gcggccggcggcgucgugaccg

SEQ ID NO: 3020128 - RNA, 12 nt, Mycobacterium avium subsp. paratuberculosis
gcggccggcggg

SEQ ID NO: 3020129 - RNA, 15 nt, Mycobacterium avium subsp. paratuberculosis
gcggccggcgguguc

SEQ ID NO: 3020130 - RNA, 18 nt, Mycobacterium avium subsp. paratuberculosis
gcggccgggaucuggccg

SEQ ID NO: 3020131 - RNA, 19 nt, Mycobacterium avium subsp. paratuberculosis
gcggccgggaucuggccgg

SEQ ID NO: 3020132 - RNA, 16 nt, Mycobacterium avium subsp. paratuberculosis
gcggccgggaugccgc

SEQ ID NO: 3020133 - RNA, 13 nt, Mycobacterium avium subsp. paratuberculosis
gcggccgggccgc

SEQ ID NO: 3020134 - RNA, 16 nt, Mycobacterium avium subsp. paratuberculosis
gcggccgggccgcggc

SEQ ID NO: 3020135 - RNA, 14 nt, Mycobacterium avium subsp. paratuberculosis
gcggccgggccgga

SEQ ID NO: 3020136 - RNA, 15 nt, Mycobacterium avium subsp. paratuberculosis
gcggccgggcgcccc

SEQ ID NO: 3020137 - RNA, 16 nt, Mycobacterium avium subsp. paratuberculosis
gcggccgggcgccccg

SEQ ID NO: 3020138 - RNA, 17 nt, Mycobacterium avium subsp. paratuberculosis
gcggccgggcgccccga

SEQ ID NO: 3020139 - RNA, 14 nt, Mycobacterium avium subsp. paratuberculosis
gcggccgggcggcc

SEQ ID NO: 3020140 - RNA, 16 nt, Mycobacterium avium subsp. paratuberculosis
gcggccgggcggccgg

SEQ ID NO: 3020141 - RNA, 10 nt, Mycobacterium avium subsp. paratuberculosis
gcggccgggg

SEQ ID NO: 3020142 - RNA, 15 nt, Mycobacterium avium subsp. paratuberculosis
gcggccggggggagg

SEQ ID NO: 3020143 - RNA, 19 nt, Mycobacterium avium subsp. paratuberculosis
gcggccggggugacuucga

SEQ ID NO: 3020144 - RNA, 13 nt, Mycobacterium avium subsp. paratuberculosis
gcggccggugcca

SEQ ID NO: 3020145 - RNA, 22 nt, Mycobacterium avium subsp. paratuberculosis
gcggccggugccacggucaggc

SEQ ID NO: 3020146 - RNA, 13 nt, Mycobacterium avium subsp. paratuberculosis
gcggccgguugcc

SEQ ID NO: 3020147 - RNA, 16 nt, Mycobacterium avium subsp. paratuberculosis
gcggccguagccggac

SEQ ID NO: 3020148 - RNA, 21 nt, Mycobacterium avium subsp. paratuberculosis
gcggccguagcguugccggcc

SEQ ID NO: 3020149 - RNA, 22 nt, Mycobacterium avium subsp. paratuberculosis
gcggccguagcguugccggccg

SEQ ID NO: 3020150 - RNA, 18 nt, Mycobacterium avium subsp. paratuberculosis
gcggccguccaccaccaa

SEQ ID NO: 3020151 - RNA, 13 nt, Mycobacterium avium subsp. paratuberculosis
gcggccguccagc

SEQ ID NO: 3020152 - RNA, 16 nt, Mycobacterium avium subsp. paratuberculosis
gcggccguccagcguc

SEQ ID NO: 3020153 - RNA, 19 nt, Mycobacterium avium subsp. paratuberculosis
gcggccguccagcgucugg

SEQ ID NO: 3020154 - RNA, 13 nt, Mycobacterium avium subsp. paratuberculosis
gcggccgucgccg

SEQ ID NO: 3020155 - RNA, 21 nt, Mycobacterium avium subsp. paratuberculosis
gcggccgucgccgggcggggu

SEQ ID NO: 3020156 - RNA, 15 nt, Mycobacterium avium subsp. paratuberculosis
gcggccgucgcgcac

SEQ ID NO: 3020157 - RNA, 14 nt, Mycobacterium avium subsp. paratuberculosis
gcggccgucgcggc

SEQ ID NO: 3020158 - RNA, 23 nt, Mycobacterium avium subsp. paratuberculosis
gcggccgucgcggcgaucgcgag

SEQ ID NO: 3020159 - RNA, 14 nt, Mycobacterium avium subsp. paratuberculosis
gcggccgucgucgu

SEQ ID NO: 3020160 - RNA, 22 nt, Mycobacterium avium subsp. paratuberculosis
gcggccgucgucgugcaccacg

SEQ ID NO: 3020161 - RNA, 23 nt, Mycobacterium avium subsp. paratuberculosis
gcggccgucgucgugcaccacga

SEQ ID NO: 3020162 - RNA, 18 nt, Mycobacterium avium subsp. paratuberculosis
gcggccgucuugcccggc

SEQ ID NO: 3020163 - RNA, 19 nt, Mycobacterium avium subsp. paratuberculosis
gcggccgucuugcccggcg

SEQ ID NO: 3020164 - RNA, 21 nt, Mycobacterium avium subsp. paratuberculosis
gcggccgucuugcccggcgag

SEQ ID NO: 3020165 - RNA, 22 nt, Mycobacterium avium subsp. paratuberculosis
gcggccgucuugcccggcgagc

SEQ ID NO: 3020166 - RNA, 17 nt, Mycobacterium avium subsp. paratuberculosis
gcggccguggucgauga

SEQ ID NO: 3020167 - RNA, 16 nt, Mycobacterium avium subsp. paratuberculosis
gcggccuaggacgccg

SEQ ID NO: 3020168 - RNA, 17 nt, Mycobacterium avium subsp. paratuberculosis
gcggccuaugcgcccgg

SEQ ID NO: 3020169 - RNA, 13 nt, Mycobacterium avium subsp. paratuberculosis
gcggccucaccgc

SEQ ID NO: 3020170 - RNA, 14 nt, Mycobacterium avium subsp. paratuberculosis
gcggccucaccgcg

SEQ ID NO: 3020171 - RNA, 16 nt, Mycobacterium avium subsp. paratuberculosis
gcggccuccagccgcg

SEQ ID NO: 3020172 - RNA, 17 nt, Mycobacterium avium subsp. paratuberculosis
gcggccuccagccgcgc

SEQ ID NO: 3020173 - RNA, 20 nt, Mycobacterium avium subsp. paratuberculosis
gcggccuccagccgcgcggc

SEQ ID NO: 3020174 - RNA, 16 nt, Mycobacterium avium subsp. paratuberculosis
gcggccuccagccgcu

SEQ ID NO: 3020175 - RNA, 22 nt, Mycobacterium avium subsp. paratuberculosis
gcggccuccagccgcuccgcgg

SEQ ID NO: 3020176 - RNA, 23 nt, Mycobacterium avium subsp. paratuberculosis
gcggccuccagccgcuccgcggc

SEQ ID NO: 3020177 - RNA, 18 nt, Mycobacterium avium subsp. paratuberculosis
gcggccuccgagcggcgc

SEQ ID NO: 3020178 - RNA, 19 nt, Mycobacterium avium subsp. paratuberculosis
gcggccuccgagcggcgca

SEQ ID NO: 3020179 - RNA, 21 nt, Mycobacterium avium subsp. paratuberculosis
gcggccuccgagcggcgcagg

SEQ ID NO: 3020180 - RNA, 23 nt, Mycobacterium avium subsp. paratuberculosis
gcggccuccgagcggcgcaggcc

SEQ ID NO: 3020181 - RNA, 21 nt, Mycobacterium avium subsp. paratuberculosis
gcggccuccgccaccuccucc

SEQ ID NO: 3020182 - RNA, 22 nt, Mycobacterium avium subsp. paratuberculosis
gcggccuccggauggcggucgc

SEQ ID NO: 3020183 - RNA, 16 nt, Mycobacterium avium subsp. paratuberculosis
gcggccucgacgauug

SEQ ID NO: 3020184 - RNA, 17 nt, Mycobacterium avium subsp. paratuberculosis
gcggccucgccgucgaa

SEQ ID NO: 3020185 - RNA, 20 nt, Mycobacterium avium subsp. paratuberculosis
gcggccucgccgucgaaggc

SEQ ID NO: 3020186 - RNA, 21 nt, Mycobacterium avium subsp. paratuberculosis
gcggccucgccgucgaaggcc

SEQ ID NO: 3020187 - RNA, 22 nt, Mycobacterium avium subsp. paratuberculosis
gcggccucgccgucgaaggccg

SEQ ID NO: 3020188 - RNA, 13 nt, Mycobacterium avium subsp. paratuberculosis
gcggccucggcac

SEQ ID NO: 3020189 - RNA, 17 nt, Mycobacterium avium subsp. paratuberculosis
gcggccucggcaccgug

SEQ ID NO: 3020190 - RNA, 21 nt, Mycobacterium avium subsp. paratuberculosis
gcggccucggcaccgugccgc

SEQ ID NO: 3020191 - RNA, 13 nt, Mycobacterium avium subsp. paratuberculosis
gcggccucggcgu

SEQ ID NO: 3020192 - RNA, 22 nt, Mycobacterium avium subsp. paratuberculosis
gcggccucggcguccgcggcgg

SEQ ID NO: 3020193 - RNA, 18 nt, Mycobacterium avium subsp. paratuberculosis
gcggccucggugcucauc

SEQ ID NO: 3020194 - RNA, 15 nt, Mycobacterium avium subsp. paratuberculosis
gcggccucggugguc

SEQ ID NO: 3020195 - RNA, 16 nt, Mycobacterium avium subsp. paratuberculosis
gcggccucgguggucg

SEQ ID NO: 3020196 - RNA, 15 nt, Mycobacterium avium subsp. paratuberculosis
gcggccucguugacc

SEQ ID NO: 3020197 - RNA, 23 nt, Mycobacterium avium subsp. paratuberculosis
gcggccucguugaccgggucgcc

SEQ ID NO: 3020198 - RNA, 12 nt, Mycobacterium avium subsp. paratuberculosis
gcggccugagcc

SEQ ID NO: 3020199 - RNA, 16 nt, Mycobacterium avium subsp. paratuberculosis
gcggccugagccgccg

SEQ ID NO: 3020200 - RNA, 19 nt, Mycobacterium avium subsp. paratuberculosis
gcggccugagccgccgggg

SEQ ID NO: 3020201 - RNA, 16 nt, Mycobacterium avium subsp. paratuberculosis
gcggccugcacagggg

SEQ ID NO: 3020202 - RNA, 18 nt, Mycobacterium avium subsp. paratuberculosis
gcggccugcacaggggcg

SEQ ID NO: 3020203 - RNA, 12 nt, Mycobacterium avium subsp. paratuberculosis
gcggccugcacc

SEQ ID NO: 3020204 - RNA, 13 nt, Mycobacterium avium subsp. paratuberculosis
gcggccugcaccc

SEQ ID NO: 3020205 - RNA, 13 nt, Mycobacterium avium subsp. paratuberculosis
gcggccugcagca

SEQ ID NO: 3020206 - RNA, 14 nt, Mycobacterium avium subsp. paratuberculosis
gcggccugcagcac

SEQ ID NO: 3020207 - RNA, 14 nt, Mycobacterium avium subsp. paratuberculosis
gcggccugccggcc

SEQ ID NO: 3020208 - RNA, 15 nt, Mycobacterium avium subsp. paratuberculosis
gcggccugccggccg

SEQ ID NO: 3020209 - RNA, 15 nt, Mycobacterium avium subsp. paratuberculosis
gcggccugcgccagg

SEQ ID NO: 3020210 - RNA, 13 nt, Mycobacterium avium subsp. paratuberculosis
gcggccugcgcgu

SEQ ID NO: 3020211 - RNA, 14 nt, Mycobacterium avium subsp. paratuberculosis
gcggccugcgcguc

SEQ ID NO: 3020212 - RNA, 20 nt, Mycobacterium avium subsp. paratuberculosis
gcggccugcgcgucgucgcc

SEQ ID NO: 3020213 - RNA, 14 nt, Mycobacterium avium subsp. paratuberculosis
gcggccugcggcgg

SEQ ID NO: 3020214 - RNA, 15 nt, Mycobacterium avium subsp. paratuberculosis
gcggccugcggcggc

SEQ ID NO: 3020215 - RNA, 17 nt, Mycobacterium avium subsp. paratuberculosis
gcggccugcggcggcaa

SEQ ID NO: 3020216 - RNA, 19 nt, Mycobacterium avium subsp. paratuberculosis
gcggccugcggcggcaacg

SEQ ID NO: 3020217 - RNA, 16 nt, Mycobacterium avium subsp. paratuberculosis
gcggccugcgggcgcc

SEQ ID NO: 3020218 - RNA, 17 nt, Mycobacterium avium subsp. paratuberculosis
gcggccugcgggcgccg

SEQ ID NO: 3020219 - RNA, 21 nt, Mycobacterium avium subsp. paratuberculosis
gcggccugcgggcgccggcug

SEQ ID NO: 3020220 - RNA, 23 nt, Mycobacterium avium subsp. paratuberculosis
gcggccugcgggcgccggcugcc

SEQ ID NO: 3020221 - RNA, 19 nt, Mycobacterium avium subsp. paratuberculosis
gcggccugcuugaccgcca

SEQ ID NO: 3020222 - RNA, 20 nt, Mycobacterium avium subsp. paratuberculosis
gcggccugcuugaccgccag

SEQ ID NO: 3020223 - RNA, 22 nt, Mycobacterium avium subsp. paratuberculosis
gcggccugcuugaccgccagac

SEQ ID NO: 3020224 - RNA, 23 nt, Mycobacterium avium subsp. paratuberculosis
gcggccugcuugaccgccagacu

SEQ ID NO: 3020225 - RNA, 20 nt, Mycobacterium avium subsp. paratuberculosis
gcggccugggugaccgaguc

SEQ ID NO: 3020226 - RNA, 19 nt, Mycobacterium avium subsp. paratuberculosis
gcggccuucuuggccggag

SEQ ID NO: 3020227 - RNA, 20 nt, Mycobacterium avium subsp. paratuberculosis
gcggccuucuuggccggagc

SEQ ID NO: 3020228 - RNA, 24 nt, Mycobacterium avium subsp. paratuberculosis
gcggccuucuuggccggagccuuc

SEQ ID NO: 3020229 - RNA, 21 nt, Mycobacterium avium subsp. paratuberculosis
gcggccuugaacgcguccgac

SEQ ID NO: 3020230 - RNA, 14 nt, Mycobacterium avium subsp. paratuberculosis
gcggccuugcgagc

SEQ ID NO: 3020231 - RNA, 17 nt, Mycobacterium avium subsp. paratuberculosis
gcggccuugcgagccgg

SEQ ID NO: 3020232 - RNA, 19 nt, Mycobacterium avium subsp. paratuberculosis
gcggccuugcgggccggag

SEQ ID NO: 3020233 - RNA, 17 nt, Mycobacterium avium subsp. paratuberculosis
gcggccuuuuccggcga

SEQ ID NO: 3020234 - RNA, 18 nt, Mycobacterium avium subsp. paratuberculosis
gcggccuuuuccggcgac

SEQ ID NO: 3020235 - RNA, 13 nt, Mycobacterium avium subsp. paratuberculosis
gcggcgcaccugg

SEQ ID NO: 3020236 - RNA, 15 nt, Mycobacterium avium subsp. paratuberculosis
gcggcgcaccuggcg

SEQ ID NO: 3020237 - RNA, 13 nt, Mycobacterium avium subsp. paratuberculosis
gcggcgcacgcag

SEQ ID NO: 3020238 - RNA, 17 nt, Mycobacterium avium subsp. paratuberculosis
gcggcgcacuccaucac

SEQ ID NO: 3020239 - RNA, 19 nt, Mycobacterium avium subsp. paratuberculosis
gcggcgcagaugaccggcc

SEQ ID NO: 3020240 - RNA, 22 nt, Mycobacterium avium subsp. paratuberculosis
gcggcgcagaugaccggccugc

SEQ ID NO: 3020241 - RNA, 23 nt, Mycobacterium avium subsp. paratuberculosis
gcggcgcagaugaccggccugca

SEQ ID NO: 3020242 - RNA, 12 nt, Mycobacterium avium subsp. paratuberculosis
gcggcgcagcac

SEQ ID NO: 3020243 - RNA, 18 nt, Mycobacterium avium subsp. paratuberculosis
gcggcgcagcacggccac

SEQ ID NO: 3020244 - RNA, 14 nt, Mycobacterium avium subsp. paratuberculosis
gcggcgcagccagc

SEQ ID NO: 3020245 - RNA, 16 nt, Mycobacterium avium subsp. paratuberculosis
gcggcgcagccagcuc

SEQ ID NO: 3020246 - RNA, 18 nt, Mycobacterium avium subsp. paratuberculosis
gcggcgcagccagcucgg

SEQ ID NO: 3020247 - RNA, 20 nt, Mycobacterium avium subsp. paratuberculosis
gcggcgcagccagcucggcg

SEQ ID NO: 3020248 - RNA, 15 nt, Mycobacterium avium subsp. paratuberculosis
gcggcgcagcgucuc

SEQ ID NO: 3020249 - RNA, 19 nt, Mycobacterium avium subsp. paratuberculosis
gcggcgcagcgucucgauc

SEQ ID NO: 3020250 - RNA, 23 nt, Mycobacterium avium subsp. paratuberculosis
gcggcgcagcgucucgaucgacg

SEQ ID NO: 3020251 - RNA, 12 nt, Mycobacterium avium subsp. paratuberculosis
gcggcgcagcuc

SEQ ID NO: 3020252 - RNA, 20 nt, Mycobacterium avium subsp. paratuberculosis
gcggcgcagcucgcgcagcu

SEQ ID NO: 3020253 - RNA, 13 nt, Mycobacterium avium subsp. paratuberculosis
gcggcgcaggccg

SEQ ID NO: 3020254 - RNA, 17 nt, Mycobacterium avium subsp. paratuberculosis
gcggcgcaggccgguca

SEQ ID NO: 3020255 - RNA, 15 nt, Mycobacterium avium subsp. paratuberculosis
gcggcgcaggcgcgc

SEQ ID NO: 3020256 - RNA, 21 nt, Mycobacterium avium subsp. paratuberculosis
gcggcgcagggcggccggcca

SEQ ID NO: 3020257 - RNA, 21 nt, Mycobacterium avium subsp. paratuberculosis
gcggcgcagguccggcagcgc

SEQ ID NO: 3020258 - RNA, 20 nt, Mycobacterium avium subsp. paratuberculosis
gcggcgcaguucgaccggca

SEQ ID NO: 3020259 - RNA, 23 nt, Mycobacterium avium subsp. paratuberculosis
gcggcgcaugaccgauccgccgg

SEQ ID NO: 3020260 - RNA, 19 nt, Mycobacterium avium subsp. paratuberculosis
gcggcgcaugaucgcccgc

SEQ ID NO: 3020261 - RNA, 14 nt, Mycobacterium avium subsp. paratuberculosis
gcggcgccaccggc

SEQ ID NO: 3020262 - RNA, 17 nt, Mycobacterium avium subsp. paratuberculosis
gcggcgccaccggcugg

SEQ ID NO: 3020263 - RNA, 19 nt, Mycobacterium avium subsp. paratuberculosis
gcggcgccaccggcuggcc

SEQ ID NO: 3020264 - RNA, 20 nt, Mycobacterium avium subsp. paratuberculosis
gcggcgccaccggcuggccg

SEQ ID NO: 3020265 - RNA, 22 nt, Mycobacterium avium subsp. paratuberculosis
gcggcgccaccgggaccugcug

SEQ ID NO: 3020266 - RNA, 15 nt, Mycobacterium avium subsp. paratuberculosis
gcggcgccacguggu

SEQ ID NO: 3020267 - RNA, 17 nt, Mycobacterium avium subsp. paratuberculosis
gcggcgccacguggucg

SEQ ID NO: 3020268 - RNA, 20 nt, Mycobacterium avium subsp. paratuberculosis
gcggcgccagcggccgauca

SEQ ID NO: 3020269 - RNA, 18 nt, Mycobacterium avium subsp. paratuberculosis
gcggcgccaugaacggcg

SEQ ID NO: 3020270 - RNA, 14 nt, Mycobacterium avium subsp. paratuberculosis
gcggcgcccacagc

SEQ ID NO: 3020271 - RNA, 18 nt, Mycobacterium avium subsp. paratuberculosis
gcggcgcccacggccacc

SEQ ID NO: 3020272 - RNA, 19 nt, Mycobacterium avium subsp. paratuberculosis
gcggcgcccacggccacca

SEQ ID NO: 3020273 - RNA, 20 nt, Mycobacterium avium subsp. paratuberculosis
gcggcgcccacggccaccac

SEQ ID NO: 3020274 - RNA, 21 nt, Mycobacterium avium subsp. paratuberculosis
gcggcgcccccgcgacgucca

SEQ ID NO: 3020275 - RNA, 17 nt, Mycobacterium avium subsp. paratuberculosis
gcggcgcccgcggccuc

SEQ ID NO: 3020276 - RNA, 21 nt, Mycobacterium avium subsp. paratuberculosis
gcggcgcccgcggccuccagc

SEQ ID NO: 3020277 - RNA, 16 nt, Mycobacterium avium subsp. paratuberculosis
gcggcgcccucgccgg

SEQ ID NO: 3020278 - RNA, 13 nt, Mycobacterium avium subsp. paratuberculosis
gcggcgcccugcg

SEQ ID NO: 3020279 - RNA, 21 nt, Mycobacterium avium subsp. paratuberculosis
gcggcgcccuucccggucggc

SEQ ID NO: 3020280 - RNA, 21 nt, Mycobacterium avium subsp. paratuberculosis
gcggcgccgaaaaacgcgacg

SEQ ID NO: 3020281 - RNA, 14 nt, Mycobacterium avium subsp. paratuberculosis
gcggcgccgaaccg

SEQ ID NO: 3020282 - RNA, 18 nt, Mycobacterium avium subsp. paratuberculosis
gcggcgccgaaccgggug

SEQ ID NO: 3020283 - RNA, 18 nt, Mycobacterium avium subsp. paratuberculosis
gcggcgccgacgggcccg

SEQ ID NO: 3020284 - RNA, 19 nt, Mycobacterium avium subsp. paratuberculosis
gcggcgccgacgggcccgc

SEQ ID NO: 3020285 - RNA, 15 nt, Mycobacterium avium subsp. paratuberculosis
gcggcgccgacgucc

SEQ ID NO: 3020286 - RNA, 13 nt, Mycobacterium avium subsp. paratuberculosis
gcggcgccgaugg

SEQ ID NO: 3020287 - RNA, 13 nt, Mycobacterium avium subsp. paratuberculosis
gcggcgccgcagc

SEQ ID NO: 3020288 - RNA, 14 nt, Mycobacterium avium subsp. paratuberculosis
gcggcgccgcagca

SEQ ID NO: 3020289 - RNA, 15 nt, Mycobacterium avium subsp. paratuberculosis
gcggcgccgcagcuc

SEQ ID NO: 3020290 - RNA, 14 nt, Mycobacterium avium subsp. paratuberculosis
gcggcgccgccacg

SEQ ID NO: 3020291 - RNA, 13 nt, Mycobacterium avium subsp. paratuberculosis
gcggcgccgcccg

SEQ ID NO: 3020292 - RNA, 17 nt, Mycobacterium avium subsp. paratuberculosis
gcggcgccgcggcccug

SEQ ID NO: 3020293 - RNA, 14 nt, Mycobacterium avium subsp. paratuberculosis
gcggcgccgcggcg

SEQ ID NO: 3020294 - RNA, 15 nt, Mycobacterium avium subsp. paratuberculosis
gcggcgccgcggcgg

SEQ ID NO: 3020295 - RNA, 16 nt, Mycobacterium avium subsp. paratuberculosis
gcggcgccgcggcggc

SEQ ID NO: 3020296 - RNA, 18 nt, Mycobacterium avium subsp. paratuberculosis
gcggcgccggaggccagc

SEQ ID NO: 3020297 - RNA, 17 nt, Mycobacterium avium subsp. paratuberculosis
gcggcgccggaugggcg

SEQ ID NO: 3020298 - RNA, 11 nt, Mycobacterium avium subsp. paratuberculosis
gcggcgccggc

SEQ ID NO: 3020299 - RNA, 13 nt, Mycobacterium avium subsp. paratuberculosis
gcggcgccggccg

SEQ ID NO: 3020300 - RNA, 14 nt, Mycobacterium avium subsp. paratuberculosis
gcggcgccggccgg

SEQ ID NO: 3020301 - RNA, 15 nt, Mycobacterium avium subsp. paratuberculosis
gcggcgccggccggg

SEQ ID NO: 3020302 - RNA, 16 nt, Mycobacterium avium subsp. paratuberculosis
gcggcgccggccgggc

SEQ ID NO: 3020303 - RNA, 18 nt, Mycobacterium avium subsp. paratuberculosis
gcggcgccgggaucggca

SEQ ID NO: 3020304 - RNA, 14 nt, Mycobacterium avium subsp. paratuberculosis
gcggcgccgggcgg

SEQ ID NO: 3020305 - RNA, 18 nt, Mycobacterium avium subsp. paratuberculosis
gcggcgccgggcggcccg

SEQ ID NO: 3020306 - RNA, 18 nt, Mycobacterium avium subsp. paratuberculosis
gcggcgccgggucaccgg

SEQ ID NO: 3020307 - RNA, 19 nt, Mycobacterium avium subsp. paratuberculosis
gcggcgccguagguggcca

SEQ ID NO: 3020308 - RNA, 22 nt, Mycobacterium avium subsp. paratuberculosis
gcggcgccguagguggccauga

SEQ ID NO: 3020309 - RNA, 12 nt, Mycobacterium avium subsp. paratuberculosis
gcggcgccgucg

SEQ ID NO: 3020310 - RNA, 14 nt, Mycobacterium avium subsp. paratuberculosis
gcggcgccgucgac

SEQ ID NO: 3020311 - RNA, 18 nt, Mycobacterium avium subsp. paratuberculosis
gcggcgccgucgaccagc

SEQ ID NO: 3020312 - RNA, 15 nt, Mycobacterium avium subsp. paratuberculosis
gcggcgccgucgccg

SEQ ID NO: 3020313 - RNA, 16 nt, Mycobacterium avium subsp. paratuberculosis
gcggcgccgucgccga

SEQ ID NO: 3020314 - RNA, 20 nt, Mycobacterium avium subsp. paratuberculosis
gcggcgccgucgccgaucac

SEQ ID NO: 3020315 - RNA, 12 nt, Mycobacterium avium subsp. paratuberculosis
gcggcgccguug

SEQ ID NO: 3020316 - RNA, 21 nt, Mycobacterium avium subsp. paratuberculosis
gcggcgccguugaccggccgg

SEQ ID NO: 3020317 - RNA, 19 nt, Mycobacterium avium subsp. paratuberculosis
gcggcgccguuucggacga

SEQ ID NO: 3020318 - RNA, 16 nt, Mycobacterium avium subsp. paratuberculosis
gcggcgccugcacgca

SEQ ID NO: 3020319 - RNA, 22 nt, Mycobacterium avium subsp. paratuberculosis
gcggcgccugcacgcaggccuc

SEQ ID NO: 3020320 - RNA, 21 nt, Mycobacterium avium subsp. paratuberculosis
gcggcgcuucgggugcgggug

SEQ ID NO: 3020321 - RNA, 15 nt, Mycobacterium avium subsp. paratuberculosis
gcggcgcuugaccuc

SEQ ID NO: 3020322 - RNA, 22 nt, Mycobacterium avium subsp. paratuberculosis
gcggcgcuugaccucgccgagc

SEQ ID NO: 3020323 - RNA, 23 nt, Mycobacterium avium subsp. paratuberculosis
gcggcgcuugaccucgccgagca

SEQ ID NO: 3020324 - RNA, 21 nt, Mycobacterium avium subsp. paratuberculosis
gcggcgcuugacgaacgccac

SEQ ID NO: 3020325 - RNA, 23 nt, Mycobacterium avium subsp. paratuberculosis
gcggcgcuugacgaacgccacca

SEQ ID NO: 3020326 - RNA, 13 nt, Mycobacterium avium subsp. paratuberculosis
gcggcggaacucg

SEQ ID NO: 3020327 - RNA, 19 nt, Mycobacterium avium subsp. paratuberculosis
gcggcggaacucgaugauc

SEQ ID NO: 3020328 - RNA, 14 nt, Mycobacterium avium subsp. paratuberculosis
gcggcggaaucgca

SEQ ID NO: 3020329 - RNA, 18 nt, Mycobacterium avium subsp. paratuberculosis
gcggcggaaucgcaacca

SEQ ID NO: 3020330 - RNA, 13 nt, Mycobacterium avium subsp. paratuberculosis
gcggcggacagca

SEQ ID NO: 3020331 - RNA, 15 nt, Mycobacterium avium subsp. paratuberculosis
gcggcggacagcacg

SEQ ID NO: 3020332 - RNA, 13 nt, Mycobacterium avium subsp. paratuberculosis
gcggcggaccguc

SEQ ID NO: 3020333 - RNA, 16 nt, Mycobacterium avium subsp. paratuberculosis
gcggcggaccgucggu

SEQ ID NO: 3020334 - RNA, 19 nt, Mycobacterium avium subsp. paratuberculosis
gcggcggaccgucgguguc

SEQ ID NO: 3020335 - RNA, 21 nt, Mycobacterium avium subsp. paratuberculosis
gcggcggaccgucggugucga

SEQ ID NO: 3020336 - RNA, 22 nt, Mycobacterium avium subsp. paratuberculosis
gcggcggacgauguccgccggc

SEQ ID NO: 3020337 - RNA, 23 nt, Mycobacterium avium subsp. paratuberculosis
gcggcggacgauguccgccggcc

SEQ ID NO: 3020338 - RNA, 16 nt, Mycobacterium avium subsp. paratuberculosis
gcggcggaggccugcg

SEQ ID NO: 3020339 - RNA, 17 nt, Mycobacterium avium subsp. paratuberculosis
gcggcggaggccugcgc

SEQ ID NO: 3020340 - RNA, 20 nt, Mycobacterium avium subsp. paratuberculosis
gcggcggaggccugcgcggc

SEQ ID NO: 3020341 - RNA, 22 nt, Mycobacterium avium subsp. paratuberculosis
gcggcggaucagcaccgacgcg

SEQ ID NO: 3020342 - RNA, 16 nt, Mycobacterium avium subsp. paratuberculosis
gcggcggauccagcac

SEQ ID NO: 3020343 - RNA, 19 nt, Mycobacterium avium subsp. paratuberculosis
gcggcggauccagcaccgc

SEQ ID NO: 3020344 - RNA, 21 nt, Mycobacterium avium subsp. paratuberculosis
gcggcggauccagcaccgcca

SEQ ID NO: 3020345 - RNA, 18 nt, Mycobacterium avium subsp. paratuberculosis
gcggcggaugggugcggu

SEQ ID NO: 3020346 - RNA, 21 nt, Mycobacterium avium subsp. paratuberculosis
gcggcggaugggugcgguuga

SEQ ID NO: 3020347 - RNA, 13 nt, Mycobacterium avium subsp. paratuberculosis
gcggcggaugucc

SEQ ID NO: 3020348 - RNA, 18 nt, Mycobacterium avium subsp. paratuberculosis
gcggcggcaaccagcucc

SEQ ID NO: 3020349 - RNA, 12 nt, Mycobacterium avium subsp. paratuberculosis
gcggcggcaccc

SEQ ID NO: 3020350 - RNA, 14 nt, Mycobacterium avium subsp. paratuberculosis
gcggcggcacccag

SEQ ID NO: 3020351 - RNA, 22 nt, Mycobacterium avium subsp. paratuberculosis
gcggcggcagcacccgcaucaa

SEQ ID NO: 3020352 - RNA, 12 nt, Mycobacterium avium subsp. paratuberculosis
gcggcggcaggu

SEQ ID NO: 3020353 - RNA, 15 nt, Mycobacterium avium subsp. paratuberculosis
gcggcggcagucgca

SEQ ID NO: 3020354 - RNA, 17 nt, Mycobacterium avium subsp. paratuberculosis
gcggcggcagucgcagc

SEQ ID NO: 3020355 - RNA, 18 nt, Mycobacterium avium subsp. paratuberculosis
gcggcggcagucgcagca

SEQ ID NO: 3020356 - RNA, 19 nt, Mycobacterium avium subsp. paratuberculosis
gcggcggccaaucgcugug

SEQ ID NO: 3020357 - RNA, 13 nt, Mycobacterium avium subsp. paratuberculosis
gcggcggccaccg

SEQ ID NO: 3020358 - RNA, 15 nt, Mycobacterium avium subsp. paratuberculosis
gcggcggccaccgcg

SEQ ID NO: 3020359 - RNA, 14 nt, Mycobacterium avium subsp. paratuberculosis
gcggcggccaccuc

SEQ ID NO: 3020360 - RNA, 16 nt, Mycobacterium avium subsp. paratuberculosis
gcggcggccaccucgc

SEQ ID NO: 3020361 - RNA, 17 nt, Mycobacterium avium subsp. paratuberculosis
gcggcggccaccucgcc

SEQ ID NO: 3020362 - RNA, 18 nt, Mycobacterium avium subsp. paratuberculosis
gcggcggccaccucgccg

SEQ ID NO: 3020363 - RNA, 21 nt, Mycobacterium avium subsp. paratuberculosis
gcggcggccaccucgccgcag

SEQ ID NO: 3020364 - RNA, 14 nt, Mycobacterium avium subsp. paratuberculosis
gcggcggccagcuc

SEQ ID NO: 3020365 - RNA, 19 nt, Mycobacterium avium subsp. paratuberculosis
gcggcggccagcucggccc

SEQ ID NO: 3020366 - RNA, 20 nt, Mycobacterium avium subsp. paratuberculosis
gcggcggccagcucggcccg

SEQ ID NO: 3020367 - RNA, 21 nt, Mycobacterium avium subsp. paratuberculosis
gcggcggccagcucggcccgc

SEQ ID NO: 3020368 - RNA, 12 nt, Mycobacterium avium subsp. paratuberculosis
gcggcggccagg

SEQ ID NO: 3020369 - RNA, 13 nt, Mycobacterium avium subsp. paratuberculosis
gcggcggccaggg

SEQ ID NO: 3020370 - RNA, 13 nt, Mycobacterium avium subsp. paratuberculosis
gcggcggccaucu

SEQ ID NO: 3020371 - RNA, 13 nt, Mycobacterium avium subsp. paratuberculosis
gcggcggcccgcc

SEQ ID NO: 3020372 - RNA, 15 nt, Mycobacterium avium subsp. paratuberculosis
gcggcggcccgccgc

SEQ ID NO: 3020373 - RNA, 21 nt, Mycobacterium avium subsp. paratuberculosis
gcggcggcccgccgcgcccgg

SEQ ID NO: 3020374 - RNA, 23 nt, Mycobacterium avium subsp. paratuberculosis
gcggcggcccgccgcgcccggcu

SEQ ID NO: 3020375 - RNA, 14 nt, Mycobacterium avium subsp. paratuberculosis
gcggcggcccgcgc

SEQ ID NO: 3020376 - RNA, 14 nt, Mycobacterium avium subsp. paratuberculosis
gcggcggcccggcg

SEQ ID NO: 3020377 - RNA, 13 nt, Mycobacterium avium subsp. paratuberculosis
gcggcggcccguc

SEQ ID NO: 3020378 - RNA, 18 nt, Mycobacterium avium subsp. paratuberculosis
gcggcggcccguccgccc

SEQ ID NO: 3020379 - RNA, 21 nt, Mycobacterium avium subsp. paratuberculosis
gcggcggcccguccgccccgc

SEQ ID NO: 3020380 - RNA, 14 nt, Mycobacterium avium subsp. paratuberculosis
gcggcggcccgucg

SEQ ID NO: 3020381 - RNA, 20 nt, Mycobacterium avium subsp. paratuberculosis
gcggcggcccuucucggacg

SEQ ID NO: 3020382 - RNA, 20 nt, Mycobacterium avium subsp. paratuberculosis
gcggcggccgacagcgcguc

SEQ ID NO: 3020383 - RNA, 12 nt, Mycobacterium avium subsp. paratuberculosis
gcggcggccggc

SEQ ID NO: 3020384 - RNA, 14 nt, Mycobacterium avium subsp. paratuberculosis
gcggcggccggcca

SEQ ID NO: 3020385 - RNA, 15 nt, Mycobacterium avium subsp. paratuberculosis
gcggcggccggccag

SEQ ID NO: 3020386 - RNA, 16 nt, Mycobacterium avium subsp. paratuberculosis
gcggcggccggccagc

SEQ ID NO: 3020387 - RNA, 17 nt, Mycobacterium avium subsp. paratuberculosis
gcggcggccggccagca

SEQ ID NO: 3020388 - RNA, 19 nt, Mycobacterium avium subsp. paratuberculosis
gcggcggccggccagcagc

SEQ ID NO: 3020389 - RNA, 13 nt, Mycobacterium avium subsp. paratuberculosis
gcggcggccggcg

SEQ ID NO: 3020390 - RNA, 14 nt, Mycobacterium avium subsp. paratuberculosis
gcggcggccggcga

SEQ ID NO: 3020391 - RNA, 14 nt, Mycobacterium avium subsp. paratuberculosis
gcggcggccggcgc

SEQ ID NO: 3020392 - RNA, 17 nt, Mycobacterium avium subsp. paratuberculosis
gcggcggccggcgccga

SEQ ID NO: 3020393 - RNA, 22 nt, Mycobacterium avium subsp. paratuberculosis
gcggcggccugcaccucgggau

SEQ ID NO: 3020394 - RNA, 15 nt, Mycobacterium avium subsp. paratuberculosis
gcggcggccugcgcg

SEQ ID NO: 3020395 - RNA, 16 nt, Mycobacterium avium subsp. paratuberculosis
gcggcggccugcgcgu

SEQ ID NO: 3020396 - RNA, 15 nt, Mycobacterium avium subsp. paratuberculosis
gcggcggccuggccg

SEQ ID NO: 3020397 - RNA, 19 nt, Mycobacterium avium subsp. paratuberculosis
gcggcggccuggccgucgc

SEQ ID NO: 3020398 - RNA, 15 nt, Mycobacterium avium subsp. paratuberculosis
gcggcggcgacgucg

SEQ ID NO: 3020399 - RNA, 12 nt, Mycobacterium avium subsp. paratuberculosis
gcggcggcgccg

SEQ ID NO: 3020400 - RNA, 15 nt, Mycobacterium avium subsp. paratuberculosis
gcggcggcgccgcag

SEQ ID NO: 3020401 - RNA, 14 nt, Mycobacterium avium subsp. paratuberculosis
gcggcggcgccgcg

SEQ ID NO: 3020402 - RNA, 15 nt, Mycobacterium avium subsp. paratuberculosis
gcggcggcgccgggg

SEQ ID NO: 3020403 - RNA, 13 nt, Mycobacterium avium subsp. paratuberculosis
gcggcggcgcgcc

SEQ ID NO: 3020404 - RNA, 14 nt, Mycobacterium avium subsp. paratuberculosis
gcggcggcgcgccg

SEQ ID NO: 3020405 - RNA, 17 nt, Mycobacterium avium subsp. paratuberculosis
gcggcggugaucgccgg

SEQ ID NO: 3020406 - RNA, 15 nt, Mycobacterium avium subsp. paratuberculosis
gcggcggugaucucg

SEQ ID NO: 3020407 - RNA, 19 nt, Mycobacterium avium subsp. paratuberculosis
gcggcggugaucucgucgg

SEQ ID NO: 3020408 - RNA, 20 nt, Mycobacterium avium subsp. paratuberculosis
gcggcggugccgcaggcgaa

SEQ ID NO: 3020409 - RNA, 15 nt, Mycobacterium avium subsp. paratuberculosis
gcggcggugccggug

SEQ ID NO: 3020410 - RNA, 14 nt, Mycobacterium avium subsp. paratuberculosis
gcggcggugcgcag

SEQ ID NO: 3020411 - RNA, 19 nt, Mycobacterium avium subsp. paratuberculosis
gcggcggugcgcagccgcu

SEQ ID NO: 3020412 - RNA, 14 nt, Mycobacterium avium subsp. paratuberculosis
gcggcggugcgucg

SEQ ID NO: 3020413 - RNA, 17 nt, Mycobacterium avium subsp. paratuberculosis
gcggcggugcgucgggc

SEQ ID NO: 3020414 - RNA, 18 nt, Mycobacterium avium subsp. paratuberculosis
gcggcggugcgucgggcg

SEQ ID NO: 3020415 - RNA, 21 nt, Mycobacterium avium subsp. paratuberculosis
gcggcggugcgucgggcgccg

SEQ ID NO: 3020416 - RNA, 17 nt, Mycobacterium avium subsp. paratuberculosis
gcggcggugcucgcgcc

SEQ ID NO: 3020417 - RNA, 18 nt, Mycobacterium avium subsp. paratuberculosis
gcggcggugcucgcgccg

SEQ ID NO: 3020418 - RNA, 19 nt, Mycobacterium avium subsp. paratuberculosis
gcggcggugcucgcgccgg

SEQ ID NO: 3020419 - RNA, 21 nt, Mycobacterium avium subsp. paratuberculosis
gcggcggugcucgcgccgggc

SEQ ID NO: 3020420 - RNA, 13 nt, Mycobacterium avium subsp. paratuberculosis
gcggcgguggccu

SEQ ID NO: 3020421 - RNA, 15 nt, Mycobacterium avium subsp. paratuberculosis
gcggcgguggccugc

SEQ ID NO: 3020422 - RNA, 22 nt, Mycobacterium avium subsp. paratuberculosis
gcggcgguggccuggucgaaca

SEQ ID NO: 3020423 - RNA, 12 nt, Mycobacterium avium subsp. paratuberculosis
gcggcggugggc

SEQ ID NO: 3020424 - RNA, 16 nt, Mycobacterium avium subsp. paratuberculosis
gcggcggugggcuggg

SEQ ID NO: 3020425 - RNA, 17 nt, Mycobacterium avium subsp. paratuberculosis
gcggcggugggcugggc

SEQ ID NO: 3020426 - RNA, 18 nt, Mycobacterium avium subsp. paratuberculosis
gcggcggugggcugggcg

SEQ ID NO: 3020427 - RNA, 20 nt, Mycobacterium avium subsp. paratuberculosis
gcggcggugguuaccagcuc

SEQ ID NO: 3020428 - RNA, 14 nt, Mycobacterium avium subsp. paratuberculosis
gcggcggugucgcc

SEQ ID NO: 3020429 - RNA, 16 nt, Mycobacterium avium subsp. paratuberculosis
gcggcggugucgccca

SEQ ID NO: 3020430 - RNA, 18 nt, Mycobacterium avium subsp. paratuberculosis
gcggcggugucgcccagc

SEQ ID NO: 3020431 - RNA, 13 nt, Mycobacterium avium subsp. paratuberculosis
gcggcggugucgg

SEQ ID NO: 3020432 - RNA, 20 nt, Mycobacterium avium subsp. paratuberculosis
gcggcggugucggcgccccg

SEQ ID NO: 3020433 - RNA, 21 nt, Mycobacterium avium subsp. paratuberculosis
gcggcggugucggcgccccgg

SEQ ID NO: 3020434 - RNA, 22 nt, Mycobacterium avium subsp. paratuberculosis
gcggcggugucggcgccccggc

SEQ ID NO: 3020435 - RNA, 16 nt, Mycobacterium avium subsp. paratuberculosis
gcggcggugucggugc

SEQ ID NO: 3020436 - RNA, 17 nt, Mycobacterium avium subsp. paratuberculosis
gcggcgguugcucgucg

SEQ ID NO: 3020437 - RNA, 18 nt, Mycobacterium avium subsp. paratuberculosis
gcggcgguugcucgucgg

SEQ ID NO: 3020438 - RNA, 23 nt, Mycobacterium avium subsp. paratuberculosis
gcggcgguugcucgucggccgac

SEQ ID NO: 3020439 - RNA, 17 nt, Mycobacterium avium subsp. paratuberculosis
gcggcguaccgcggcgg

SEQ ID NO: 3020440 - RNA, 23 nt, Mycobacterium avium subsp. paratuberculosis
gcggcguaccgcggcggcgucga

SEQ ID NO: 3020441 - RNA, 18 nt, Mycobacterium avium subsp. paratuberculosis
gcggcguacgcgauggcg

SEQ ID NO: 3020442 - RNA, 22 nt, Mycobacterium avium subsp. paratuberculosis
gcggcguagccgccgguugauc

SEQ ID NO: 3020443 - RNA, 16 nt, Mycobacterium avium subsp. paratuberculosis
gcggcguaggcggcca

SEQ ID NO: 3020444 - RNA, 17 nt, Mycobacterium avium subsp. paratuberculosis
gcggcguaggcggccau

SEQ ID NO: 3020445 - RNA, 15 nt, Mycobacterium avium subsp. paratuberculosis
gcggcguaggugggc

SEQ ID NO: 3020446 - RNA, 19 nt, Mycobacterium avium subsp. paratuberculosis
gcggcguagucgccggugu

SEQ ID NO: 3020447 - RNA, 16 nt, Mycobacterium avium subsp. paratuberculosis
gcggcguauucccggg

SEQ ID NO: 3020448 - RNA, 14 nt, Mycobacterium avium subsp. paratuberculosis
gcggcgucacccug

SEQ ID NO: 3020449 - RNA, 18 nt, Mycobacterium avium subsp. paratuberculosis
gcggcgucaucccccgca

SEQ ID NO: 3020450 - RNA, 15 nt, Mycobacterium avium subsp. paratuberculosis
gcggcguccaccagc

SEQ ID NO: 3020451 - RNA, 16 nt, Mycobacterium avium subsp. paratuberculosis
gcggcgucccacgugg

SEQ ID NO: 3020452 - RNA, 21 nt, Mycobacterium avium subsp. paratuberculosis
gcggcguccgcggccgcggcg

SEQ ID NO: 3020453 - RNA, 18 nt, Mycobacterium avium subsp. paratuberculosis
gcggcguccucgaccacc

SEQ ID NO: 3020454 - RNA, 20 nt, Mycobacterium avium subsp. paratuberculosis
gcggcguccucgaccacccg

SEQ ID NO: 3020455 - RNA, 22 nt, Mycobacterium avium subsp. paratuberculosis
gcggcguccucgaugacgccgg

SEQ ID NO: 3020456 - RNA, 14 nt, Mycobacterium avium subsp. paratuberculosis
gcggcgucgaccgc

SEQ ID NO: 3020457 - RNA, 20 nt, Mycobacterium avium subsp. paratuberculosis
gcggcgucgaccgccccgcc

SEQ ID NO: 3020458 - RNA, 22 nt, Mycobacterium avium subsp. paratuberculosis
gcggcgucgaccgccccgccgg

SEQ ID NO: 3020459 - RNA, 17 nt, Mycobacterium avium subsp. paratuberculosis
gcggcgucgagcaccuc

SEQ ID NO: 3020460 - RNA, 21 nt, Mycobacterium avium subsp. paratuberculosis
gcggcgucgaguucgccgucg

SEQ ID NO: 3020461 - RNA, 22 nt, Mycobacterium avium subsp. paratuberculosis
gcggcgucgaugucgcccggcg

SEQ ID NO: 3020462 - RNA, 12 nt, Mycobacterium avium subsp. paratuberculosis
gcggcgucggcc

SEQ ID NO: 3020463 - RNA, 13 nt, Mycobacterium avium subsp. paratuberculosis
gcggcgucggccg

SEQ ID NO: 3020464 - RNA, 15 nt, Mycobacterium avium subsp. paratuberculosis
gcggcgucggccggg

SEQ ID NO: 3020465 - RNA, 16 nt, Mycobacterium avium subsp. paratuberculosis
gcggcgucggccgggc

SEQ ID NO: 3020466 - RNA, 13 nt, Mycobacterium avium subsp. paratuberculosis
gcggcgucggccu

SEQ ID NO: 3020467 - RNA, 14 nt, Mycobacterium avium subsp. paratuberculosis
gcggcgucggccug

SEQ ID NO: 3020468 - RNA, 15 nt, Mycobacterium avium subsp. paratuberculosis
gcggcgucggccugc

SEQ ID NO: 3020469 - RNA, 16 nt, Mycobacterium avium subsp. paratuberculosis
gcggcgucggccugcc

SEQ ID NO: 3020470 - RNA, 21 nt, Mycobacterium avium subsp. paratuberculosis
gcggcgucggccugcccgcgg

SEQ ID NO: 3020471 - RNA, 14 nt, Mycobacterium avium subsp. paratuberculosis
gcggcgucggcgac

SEQ ID NO: 3020472 - RNA, 17 nt, Mycobacterium avium subsp. paratuberculosis
gcggcgucggcgacggc

SEQ ID NO: 3020473 - RNA, 18 nt, Mycobacterium avium subsp. paratuberculosis
gcggcgucggcgacggcg

SEQ ID NO: 3020474 - RNA, 13 nt, Mycobacterium avium subsp. paratuberculosis
gcggcgucggcgu

SEQ ID NO: 3020475 - RNA, 16 nt, Mycobacterium avium subsp. paratuberculosis
gcggcgucggcgucca

SEQ ID NO: 3020476 - RNA, 21 nt, Mycobacterium avium subsp. paratuberculosis
gcggcgucgggauggucgauc

SEQ ID NO: 3020477 - RNA, 22 nt, Mycobacterium avium subsp. paratuberculosis
gcggcgucgggauggucgaucc

SEQ ID NO: 3020478 - RNA, 23 nt, Mycobacterium avium subsp. paratuberculosis
gcggcgucgggauggucgaucca

SEQ ID NO: 3020479 - RNA, 13 nt, Mycobacterium avium subsp. paratuberculosis
gcggcgucgggcg

SEQ ID NO: 3020480 - RNA, 14 nt, Mycobacterium avium subsp. paratuberculosis
gcggcgucgggcgg

SEQ ID NO: 3020481 - RNA, 17 nt, Mycobacterium avium subsp. paratuberculosis
gcggcgucgggcgggug

SEQ ID NO: 3020482 - RNA, 21 nt, Mycobacterium avium subsp. paratuberculosis
gcggcgucguaguugcggccg

SEQ ID NO: 3020483 - RNA, 15 nt, Mycobacterium avium subsp. paratuberculosis
gcggcgucgucgccg

SEQ ID NO: 3020484 - RNA, 14 nt, Mycobacterium avium subsp. paratuberculosis
gcggcgucgugacc

SEQ ID NO: 3020485 - RNA, 14 nt, Mycobacterium avium subsp. paratuberculosis
gcggcgugaccggg

SEQ ID NO: 3020486 - RNA, 19 nt, Mycobacterium avium subsp. paratuberculosis
gcggcgugcaacugcgugg

SEQ ID NO: 3020487 - RNA, 22 nt, Mycobacterium avium subsp. paratuberculosis
gcggcgugcaacugcguggccg

SEQ ID NO: 3020488 - RNA, 17 nt, Mycobacterium avium subsp. paratuberculosis
gcggcgugcaccgcccg

SEQ ID NO: 3020489 - RNA, 18 nt, Mycobacterium avium subsp. paratuberculosis
gcggcgugcaccgcccgc

SEQ ID NO: 3020490 - RNA, 16 nt, Mycobacterium avium subsp. paratuberculosis
gcggcugcagcagaug

SEQ ID NO: 3020491 - RNA, 14 nt, Mycobacterium avium subsp. paratuberculosis
gcggcugcccagga

SEQ ID NO: 3020492 - RNA, 23 nt, Mycobacterium avium subsp. paratuberculosis
gcggcugcccaggaucaccggga

SEQ ID NO: 3020493 - RNA, 21 nt, Mycobacterium avium subsp. paratuberculosis
gcggcugccggccaaggcaag

SEQ ID NO: 3020494 - RNA, 15 nt, Mycobacterium avium subsp. paratuberculosis
gcggcugccucgacg

SEQ ID NO: 3020495 - RNA, 19 nt, Mycobacterium avium subsp. paratuberculosis
gcggcugcgcacguagccc

SEQ ID NO: 3020496 - RNA, 15 nt, Mycobacterium avium subsp. paratuberculosis
gcggcugcgcguucg

SEQ ID NO: 3020497 - RNA, 18 nt, Mycobacterium avium subsp. paratuberculosis
gcggcugcgcguucggcg

SEQ ID NO: 3020498 - RNA, 20 nt, Mycobacterium avium subsp. paratuberculosis
gcggcugcgcguucggcgcc

SEQ ID NO: 3020499 - RNA, 22 nt, Mycobacterium avium subsp. paratuberculosis
gcggcugcgcguucggcgccac

SEQ ID NO: 3020500 - RNA, 16 nt, Mycobacterium avium subsp. paratuberculosis
gcggcugcucgaaccg

SEQ ID NO: 3020501 - RNA, 18 nt, Mycobacterium avium subsp. paratuberculosis
gcggcugcucgaaccgcg

SEQ ID NO: 3020502 - RNA, 18 nt, Mycobacterium avium subsp. paratuberculosis
gcggcugcugcagcgccc

SEQ ID NO: 3020503 - RNA, 23 nt, Mycobacterium avium subsp. paratuberculosis
gcggcugcugcagcgcccgggcc

SEQ ID NO: 3020504 - RNA, 19 nt, Mycobacterium avium subsp. paratuberculosis
gcggcugcuggucgacguc

SEQ ID NO: 3020505 - RNA, 15 nt, Mycobacterium avium subsp. paratuberculosis
gcggcuggcccggcg

SEQ ID NO: 3020506 - RNA, 16 nt, Mycobacterium avium subsp. paratuberculosis
gcggcuggcccggcgc

SEQ ID NO: 3020507 - RNA, 20 nt, Mycobacterium avium subsp. paratuberculosis
gcggcuggcccggcgcggcg

SEQ ID NO: 3020508 - RNA, 21 nt, Mycobacterium avium subsp. paratuberculosis
gcggcuggcccggcgcggcgg

SEQ ID NO: 3020509 - RNA, 23 nt, Mycobacterium avium subsp. paratuberculosis
gcggcuggccgcggcgaucggcg

SEQ ID NO: 3020510 - RNA, 17 nt, Mycobacterium avium subsp. paratuberculosis
gcggcugggccgcggcg

SEQ ID NO: 3020511 - RNA, 18 nt, Mycobacterium avium subsp. paratuberculosis
gcggcugggccgcggcgc

SEQ ID NO: 3020512 - RNA, 19 nt, Mycobacterium avium subsp. paratuberculosis
gcggcugggucggucccga

SEQ ID NO: 3020513 - RNA, 23 nt, Mycobacterium avium subsp. paratuberculosis
gcggcuggguggacaccuuggcg

SEQ ID NO: 3020514 - RNA, 17 nt, Mycobacterium avium subsp. paratuberculosis
gcggcuggugccgccgg

SEQ ID NO: 3020515 - RNA, 18 nt, Mycobacterium avium subsp. paratuberculosis
gcggcuggugccgccggc

SEQ ID NO: 3020516 - RNA, 19 nt, Mycobacterium avium subsp. paratuberculosis
gcggcuggugccgccggcg

SEQ ID NO: 3020517 - RNA, 15 nt, Mycobacterium avium subsp. paratuberculosis
gcggcuguagcaccc

SEQ ID NO: 3020518 - RNA, 20 nt, Mycobacterium avium subsp. paratuberculosis
gcggcuguagcacccggccg

SEQ ID NO: 3020519 - RNA, 21 nt, Mycobacterium avium subsp. paratuberculosis
gcggcuguagcacccggccgg

SEQ ID NO: 3020520 - RNA, 23 nt, Mycobacterium avium subsp. paratuberculosis
gcggcuguagcacccggccggcg

SEQ ID NO: 3020521 - RNA, 12 nt, Mycobacterium avium subsp. paratuberculosis
gcggcugucgua

SEQ ID NO: 3020522 - RNA, 19 nt, Mycobacterium avium subsp. paratuberculosis
gcggcugugaucgcugacg

SEQ ID NO: 3020523 - RNA, 20 nt, Mycobacterium avium subsp. paratuberculosis
gcggcuucauaugacgccgg

SEQ ID NO: 3020524 - RNA, 21 nt, Mycobacterium avium subsp. paratuberculosis
gcggcuucauaugacgccggc

SEQ ID NO: 3020525 - RNA, 22 nt, Mycobacterium avium subsp. paratuberculosis
gcggcuucauaugacgccggcc

SEQ ID NO: 3020526 - RNA, 23 nt, Mycobacterium avium subsp. paratuberculosis
gcggcuucauaugacgccggccu

SEQ ID NO: 3020527 - RNA, 15 nt, Mycobacterium avium subsp. paratuberculosis
gcggcuugagccgga

SEQ ID NO: 3020528 - RNA, 19 nt, Mycobacterium avium subsp. paratuberculosis
gcggcuugagcgccagcgc

SEQ ID NO: 3020529 - RNA, 21 nt, Mycobacterium avium subsp. paratuberculosis
gcggcuugagcgccagcgcgg

SEQ ID NO: 3020530 - RNA, 13 nt, Mycobacterium avium subsp. paratuberculosis
gcggcuugcccgu

SEQ ID NO: 3020531 - RNA, 16 nt, Mycobacterium avium subsp. paratuberculosis
gcggcuugcccguucg

SEQ ID NO: 3020532 - RNA, 16 nt, Mycobacterium avium subsp. paratuberculosis
gcggcuugccgccgca

SEQ ID NO: 3020533 - RNA, 18 nt, Mycobacterium avium subsp. paratuberculosis
gcggcuugccgccgcagc

SEQ ID NO: 3020534 - RNA, 14 nt, Mycobacterium avium subsp. paratuberculosis
gcggcuugccguug

SEQ ID NO: 3020535 - RNA, 13 nt, Mycobacterium avium subsp. paratuberculosis
gcggcuuggccac

SEQ ID NO: 3020536 - RNA, 15 nt, Mycobacterium avium subsp. paratuberculosis
gcggcuuggccacca

SEQ ID NO: 3020537 - RNA, 12 nt, Mycobacterium avium subsp. paratuberculosis
gcggcuuggccg

SEQ ID NO: 3020538 - RNA, 17 nt, Mycobacterium avium subsp. paratuberculosis
gcggcuuggucaccagc

SEQ ID NO: 3020539 - RNA, 19 nt, Mycobacterium avium subsp. paratuberculosis
gcggcuuggucaccagcuc

SEQ ID NO: 3020540 - RNA, 22 nt, Mycobacterium avium subsp. paratuberculosis
gcggcuuggucaccagcucgcc

SEQ ID NO: 3020541 - RNA, 17 nt, Mycobacterium avium subsp. paratuberculosis
gcggcuuuuggcgucgu

SEQ ID NO: 3020542 - RNA, 22 nt, Mycobacterium avium subsp. paratuberculosis
gcgggaacaccacgucguccag

SEQ ID NO: 3020543 - RNA, 23 nt, Mycobacterium avium subsp. paratuberculosis
gcgggaacaccacgucguccagc

SEQ ID NO: 3020544 - RNA, 22 nt, Mycobacterium avium subsp. paratuberculosis
gcgggaacgguugacgcucugu

SEQ ID NO: 3020545 - RNA, 17 nt, Mycobacterium avium subsp. paratuberculosis
gcgggaagcccaccgcg

SEQ ID NO: 3020546 - RNA, 12 nt, Mycobacterium avium subsp. paratuberculosis
gcgggaagccga

SEQ ID NO: 3020547 - RNA, 20 nt, Mycobacterium avium subsp. paratuberculosis
gcgggaagccgaggucgccg

SEQ ID NO: 3020548 - RNA, 15 nt, Mycobacterium avium subsp. paratuberculosis
gcgggaagccgaguu

SEQ ID NO: 3020549 - RNA, 15 nt, Mycobacterium avium subsp. paratuberculosis
gcgggaagccgccgc

SEQ ID NO: 3020550 - RNA, 20 nt, Mycobacterium avium subsp. paratuberculosis
gcgggaagccgccgcccugc

SEQ ID NO: 3020551 - RNA, 22 nt, Mycobacterium avium subsp. paratuberculosis
gcgggaagggcccgggaugggc

SEQ ID NO: 3020552 - RNA, 24 nt, Mycobacterium avium subsp. paratuberculosis
gcgggaagggcccgggaugggccu

SEQ ID NO: 3020553 - RNA, 23 nt, Mycobacterium avium subsp. paratuberculosis
gcgggaaguagugcaucggcagu

SEQ ID NO: 3020554 - RNA, 17 nt, Mycobacterium avium subsp. paratuberculosis
gcgggaauggccgcgcc

SEQ ID NO: 3020555 - RNA, 23 nt, Mycobacterium avium subsp. paratuberculosis
gcgggaauggccgcgccguagcg

SEQ ID NO: 3020556 - RNA, 16 nt, Mycobacterium avium subsp. paratuberculosis
gcgggaauuggcaccg

SEQ ID NO: 3020557 - RNA, 17 nt, Mycobacterium avium subsp. paratuberculosis
gcgggacaacacgaucg

SEQ ID NO: 3020558 - RNA, 13 nt, Mycobacterium avium subsp. paratuberculosis
gcgggacacggcg

SEQ ID NO: 3020559 - RNA, 16 nt, Mycobacterium avium subsp. paratuberculosis
gcgggacacggcggcg

SEQ ID NO: 3020560 - RNA, 20 nt, Mycobacterium avium subsp. paratuberculosis
gcgggacacggcggcgcggg

SEQ ID NO: 3020561 - RNA, 16 nt, Mycobacterium avium subsp. paratuberculosis
gcgggacagcaccacc

SEQ ID NO: 3020562 - RNA, 18 nt, Mycobacterium avium subsp. paratuberculosis
gcgggaccagcgccucgg

SEQ ID NO: 3020563 - RNA, 13 nt, Mycobacterium avium subsp. paratuberculosis
gcgggacccgcga

SEQ ID NO: 3020564 - RNA, 16 nt, Mycobacterium avium subsp. paratuberculosis
gcgggaccgaggugcc

SEQ ID NO: 3020565 - RNA, 20 nt, Mycobacterium avium subsp. paratuberculosis
gcgggaccgaggugccgcgg

SEQ ID NO: 3020566 - RNA, 22 nt, Mycobacterium avium subsp. paratuberculosis
gcgggaccgaggugccgcgggu

SEQ ID NO: 3020567 - RNA, 23 nt, Mycobacterium avium subsp. paratuberculosis
gcgggaccgaggugccgcggguc

SEQ ID NO: 3020568 - RNA, 15 nt, Mycobacterium avium subsp. paratuberculosis
gcgggaccgggcccg

SEQ ID NO: 3020569 - RNA, 19 nt, Mycobacterium avium subsp. paratuberculosis
gcgggaccgggcccggcgc

SEQ ID NO: 3020570 - RNA, 22 nt, Mycobacterium avium subsp. paratuberculosis
gcgggacgaucugcgucaugga

SEQ ID NO: 3020571 - RNA, 15 nt, Mycobacterium avium subsp. paratuberculosis
gcgggacgccguuga

SEQ ID NO: 3020572 - RNA, 20 nt, Mycobacterium avium subsp. paratuberculosis
gcgggacgcgcagaucgucg

SEQ ID NO: 3020573 - RNA, 22 nt, Mycobacterium avium subsp. paratuberculosis
gcgggacguggcucagcggcag

SEQ ID NO: 3020574 - RNA, 22 nt, Mycobacterium avium subsp. paratuberculosis
gcgggccagcguuuccagcgcc

SEQ ID NO: 3020575 - RNA, 14 nt, Mycobacterium avium subsp. paratuberculosis
gcgggccagcucga

SEQ ID NO: 3020576 - RNA, 23 nt, Mycobacterium avium subsp. paratuberculosis
gcgggccagcucgaacaccgucg

SEQ ID NO: 3020577 - RNA, 24 nt, Mycobacterium avium subsp. paratuberculosis
gcgggccagcucgaacaccgucga

SEQ ID NO: 3020578 - RNA, 20 nt, Mycobacterium avium subsp. paratuberculosis
gcgggccagcucgaaccugg

SEQ ID NO: 3020579 - RNA, 21 nt, Mycobacterium avium subsp. paratuberculosis
gcgggccagcucgaaccugga

SEQ ID NO: 3020580 - RNA, 20 nt, Mycobacterium avium subsp. paratuberculosis
gcgggccagcucgucgagcc

SEQ ID NO: 3020581 - RNA, 21 nt, Mycobacterium avium subsp. paratuberculosis
gcgggccagcucgucgagccg

SEQ ID NO: 3020582 - RNA, 17 nt, Mycobacterium avium subsp. paratuberculosis
gcgggccaggcacggcc

SEQ ID NO: 3020583 - RNA, 18 nt, Mycobacterium avium subsp. paratuberculosis
gcgggccaggcccaccgu

SEQ ID NO: 3020584 - RNA, 19 nt, Mycobacterium avium subsp. paratuberculosis
gcgggccaggcccaccguc

SEQ ID NO: 3020585 - RNA, 22 nt, Mycobacterium avium subsp. paratuberculosis
gcgggccaggcccaccgucgcc

SEQ ID NO: 3020586 - RNA, 19 nt, Mycobacterium avium subsp. paratuberculosis
gcgggccaucgacuccagc

SEQ ID NO: 3020587 - RNA, 21 nt, Mycobacterium avium subsp. paratuberculosis
gcgggccaucgacuccagcac

SEQ ID NO: 3020588 - RNA, 13 nt, Mycobacterium avium subsp. paratuberculosis
gcgggcccaccgc

SEQ ID NO: 3020589 - RNA, 14 nt, Mycobacterium avium subsp. paratuberculosis
gcgggcccaccgcg

SEQ ID NO: 3020590 - RNA, 17 nt, Mycobacterium avium subsp. paratuberculosis
gcgggcccaccgcgcgc

SEQ ID NO: 3020591 - RNA, 13 nt, Mycobacterium avium subsp. paratuberculosis
gcgggcccagcag

SEQ ID NO: 3020592 - RNA, 15 nt, Mycobacterium avium subsp. paratuberculosis
gcgggcccagcucgg

SEQ ID NO: 3020593 - RNA, 17 nt, Mycobacterium avium subsp. paratuberculosis
gcgggcccagcucggug

SEQ ID NO: 3020594 - RNA, 22 nt, Mycobacterium avium subsp. paratuberculosis
gcgggcccgcaacuguucgcgg

SEQ ID NO: 3020595 - RNA, 12 nt, Mycobacterium avium subsp. paratuberculosis
gcgggcccgccg

SEQ ID NO: 3020596 - RNA, 13 nt, Mycobacterium avium subsp. paratuberculosis
gcgggcccgccgu

SEQ ID NO: 3020597 - RNA, 15 nt, Mycobacterium avium subsp. paratuberculosis
gcgggcccgcgccgc

SEQ ID NO: 3020598 - RNA, 13 nt, Mycobacterium avium subsp. paratuberculosis
gcgggcccgcgcg

SEQ ID NO: 3020599 - RNA, 14 nt, Mycobacterium avium subsp. paratuberculosis
gcgggcccgcgcgg

SEQ ID NO: 3020600 - RNA, 16 nt, Mycobacterium avium subsp. paratuberculosis
gcgggcccgcgcggcg

SEQ ID NO: 3020601 - RNA, 13 nt, Mycobacterium avium subsp. paratuberculosis
gcgggcccgcgua

SEQ ID NO: 3020602 - RNA, 12 nt, Mycobacterium avium subsp. paratuberculosis
gcgggcccggcg

SEQ ID NO: 3020603 - RNA, 14 nt, Mycobacterium avium subsp. paratuberculosis
gcgggcccggcgau

SEQ ID NO: 3020604 - RNA, 14 nt, Mycobacterium avium subsp. paratuberculosis
gcgggcccgggcca

SEQ ID NO: 3020605 - RNA, 18 nt, Mycobacterium avium subsp. paratuberculosis
gcgggcccgggccacccg

SEQ ID NO: 3020606 - RNA, 19 nt, Mycobacterium avium subsp. paratuberculosis
gcgggcccgggccacccgc

SEQ ID NO: 3020607 - RNA, 20 nt, Mycobacterium avium subsp. paratuberculosis
gcgggcccgggccacccgcg

SEQ ID NO: 3020608 - RNA, 21 nt, Mycobacterium avium subsp. paratuberculosis
gcgggcccgggccacccgcga

SEQ ID NO: 3020609 - RNA, 15 nt, Mycobacterium avium subsp. paratuberculosis
gcgggcccgggcgcu

SEQ ID NO: 3020610 - RNA, 15 nt, Mycobacterium avium subsp. paratuberculosis
gcgggcccgggcugc

SEQ ID NO: 3020611 - RNA, 15 nt, Mycobacterium avium subsp. paratuberculosis
gcgggcccgucgccg

SEQ ID NO: 3020612 - RNA, 18 nt, Mycobacterium avium subsp. paratuberculosis
gcgaucaccgcggccacc

SEQ ID NO: 3020613 - RNA, 22 nt, Mycobacterium avium subsp. paratuberculosis
gcgaucaccgcggccaccaccg

SEQ ID NO: 3020614 - RNA, 21 nt, Mycobacterium avium subsp. paratuberculosis
gcgaucaccgcguucucggcg

SEQ ID NO: 3020615 - RNA, 19 nt, Mycobacterium avium subsp. paratuberculosis
gcgaucaccuugcggccgg

SEQ ID NO: 3020616 - RNA, 20 nt, Mycobacterium avium subsp. paratuberculosis
gcgaucaccuugcggccggc

SEQ ID NO: 3020617 - RNA, 21 nt, Mycobacterium avium subsp. paratuberculosis
gcgaucaccuugcggccggcg

SEQ ID NO: 3020618 - RNA, 22 nt, Mycobacterium avium subsp. paratuberculosis
gcgaucaccuugcggccggcgg

SEQ ID NO: 3020619 - RNA, 24 nt, Mycobacterium avium subsp. paratuberculosis
gcgaucaccuugcggccggcggcg

SEQ ID NO: 3020620 - RNA, 17 nt, Mycobacterium avium subsp. paratuberculosis
gcgaucacgaagaacuu

SEQ ID NO: 3020621 - RNA, 13 nt, Mycobacterium avium subsp. paratuberculosis
gcgaucacguucu

SEQ ID NO: 3020622 - RNA, 18 nt, Mycobacterium avium subsp. paratuberculosis
gcgaucacguucucggcg

SEQ ID NO: 3020623 - RNA, 15 nt, Mycobacterium avium subsp. paratuberculosis
gcgaucagaugcucg

SEQ ID NO: 3020624 - RNA, 13 nt, Mycobacterium avium subsp. paratuberculosis
gcgaucagcagca

SEQ ID NO: 3020625 - RNA, 14 nt, Mycobacterium avium subsp. paratuberculosis
gcgaucagcagcac

SEQ ID NO: 3020626 - RNA, 18 nt, Mycobacterium avium subsp. paratuberculosis
gcgaucagcagcacccgg

SEQ ID NO: 3020627 - RNA, 23 nt, Mycobacterium avium subsp. paratuberculosis
gcgaucagcagcacccgggccug

SEQ ID NO: 3020628 - RNA, 14 nt, Mycobacterium avium subsp. paratuberculosis
gcgaucagccccag

SEQ ID NO: 3020629 - RNA, 18 nt, Mycobacterium avium subsp. paratuberculosis
gcgaucagccccagggug

SEQ ID NO: 3020630 - RNA, 21 nt, Mycobacterium avium subsp. paratuberculosis
gcgaucagccccagggugcgc

SEQ ID NO: 3020631 - RNA, 13 nt, Mycobacterium avium subsp. paratuberculosis
gcgaucagcccgc

SEQ ID NO: 3020632 - RNA, 15 nt, Mycobacterium avium subsp. paratuberculosis
gcgaucagcccgccc

SEQ ID NO: 3020633 - RNA, 19 nt, Mycobacterium avium subsp. paratuberculosis
gcgaucagcccgcccacca

SEQ ID NO: 3020634 - RNA, 14 nt, Mycobacterium avium subsp. paratuberculosis
gcgaucagcccggc

SEQ ID NO: 3020635 - RNA, 16 nt, Mycobacterium avium subsp. paratuberculosis
gcgaucagcccggccc

SEQ ID NO: 3020636 - RNA, 17 nt, Mycobacterium avium subsp. paratuberculosis
gcgaucagcccggcccg

SEQ ID NO: 3020637 - RNA, 15 nt, Mycobacterium avium subsp. paratuberculosis
gcgaucagcgcgcac

SEQ ID NO: 3020638 - RNA, 21 nt, Mycobacterium avium subsp. paratuberculosis
gcgaucagcgcgcacagcgcc

SEQ ID NO: 3020639 - RNA, 18 nt, Mycobacterium avium subsp. paratuberculosis
gcgaucagcucguggcgg

SEQ ID NO: 3020640 - RNA, 14 nt, Mycobacterium avium subsp. paratuberculosis
gcgaucagcugcuc

SEQ ID NO: 3020641 - RNA, 14 nt, Mycobacterium avium subsp. paratuberculosis
gcgaucagcuggau

SEQ ID NO: 3020642 - RNA, 23 nt, Mycobacterium avium subsp. paratuberculosis
gcgaucagcuggaucaucucgua

SEQ ID NO: 3020643 - RNA, 14 nt, Mycobacterium avium subsp. paratuberculosis
gcgaucaggccggc

SEQ ID NO: 3020644 - RNA, 15 nt, Mycobacterium avium subsp. paratuberculosis
gcgaucaggccggcc

SEQ ID NO: 3020645 - RNA, 19 nt, Mycobacterium avium subsp. paratuberculosis
gcgaucaggccggccacca

SEQ ID NO: 3020646 - RNA, 22 nt, Mycobacterium avium subsp. paratuberculosis
gcgaucaggccggccaccaggu

SEQ ID NO: 3020647 - RNA, 22 nt, Mycobacterium avium subsp. paratuberculosis
gcgaucagggcccacagcagcc

SEQ ID NO: 3020648 - RNA, 23 nt, Mycobacterium avium subsp. paratuberculosis
gcgaucagggcccacagcagccg

SEQ ID NO: 3020649 - RNA, 17 nt, Mycobacterium avium subsp. paratuberculosis
gcgaucagggccgcggc

SEQ ID NO: 3020650 - RNA, 19 nt, Mycobacterium avium subsp. paratuberculosis
gcgaucagggccgcggccg

SEQ ID NO: 3020651 - RNA, 20 nt, Mycobacterium avium subsp. paratuberculosis
gcgaucagggccgcggccgc

SEQ ID NO: 3020652 - RNA, 14 nt, Mycobacterium avium subsp. paratuberculosis
gcgaucagggcggc

SEQ ID NO: 3020653 - RNA, 15 nt, Mycobacterium avium subsp. paratuberculosis
gcgaucagguccgga

SEQ ID NO: 3020654 - RNA, 18 nt, Mycobacterium avium subsp. paratuberculosis
gcgaucaucgccccggag

SEQ ID NO: 3020655 - RNA, 16 nt, Mycobacterium avium subsp. paratuberculosis
gcgaucauuccgccga

SEQ ID NO: 3020656 - RNA, 17 nt, Mycobacterium avium subsp. paratuberculosis
gcgaucauuccgccgaa

SEQ ID NO: 3020657 - RNA, 21 nt, Mycobacterium avium subsp. paratuberculosis
gcgauccacuccgaggucagc

SEQ ID NO: 3020658 - RNA, 22 nt, Mycobacterium avium subsp. paratuberculosis
gcgauccacuccgaggucagcg

SEQ ID NO: 3020659 - RNA, 17 nt, Mycobacterium avium subsp. paratuberculosis
gcgauccagcgcuggcc

SEQ ID NO: 3020660 - RNA, 20 nt, Mycobacterium avium subsp. paratuberculosis
gcgauccagcgcuggccggc

SEQ ID NO: 3020661 - RNA, 13 nt, Mycobacterium avium subsp. paratuberculosis
gcgauccgcgcgg

SEQ ID NO: 3020662 - RNA, 14 nt, Mycobacterium avium subsp. paratuberculosis
gcgauccgcgcggc

SEQ ID NO: 3020663 - RNA, 15 nt, Mycobacterium avium subsp. paratuberculosis
gcgauccgcgcggcg

SEQ ID NO: 3020664 - RNA, 12 nt, Mycobacterium avium subsp. paratuberculosis
gcgauccggccg

SEQ ID NO: 3020665 - RNA, 13 nt, Mycobacterium avium subsp. paratuberculosis
gcgauccggccgg

SEQ ID NO: 3020666 - RNA, 16 nt, Mycobacterium avium subsp. paratuberculosis
gcgauccggccggcgg

SEQ ID NO: 3020667 - RNA, 18 nt, Mycobacterium avium subsp. paratuberculosis
gcgauccggccggcggcg

SEQ ID NO: 3020668 - RNA, 14 nt, Mycobacterium avium subsp. paratuberculosis
gcgauccgggcacg

SEQ ID NO: 3020669 - RNA, 16 nt, Mycobacterium avium subsp. paratuberculosis
gcgauccgggcacgca

SEQ ID NO: 3020670 - RNA, 13 nt, Mycobacterium avium subsp. paratuberculosis
gcgauccgggcau

SEQ ID NO: 3020671 - RNA, 23 nt, Mycobacterium avium subsp. paratuberculosis
gcgauccgggcauggucaccgga

SEQ ID NO: 3020672 - RNA, 15 nt, Mycobacterium avium subsp. paratuberculosis
gcgauccgggcgccg

SEQ ID NO: 3020673 - RNA, 17 nt, Mycobacterium avium subsp. paratuberculosis
gcgauccgggcgccggc

SEQ ID NO: 3020674 - RNA, 18 nt, Mycobacterium avium subsp. paratuberculosis
gcgauccgggcgccggcc

SEQ ID NO: 3020675 - RNA, 19 nt, Mycobacterium avium subsp. paratuberculosis
gcgauccgggcgccggccg

SEQ ID NO: 3020676 - RNA, 17 nt, Mycobacterium avium subsp. paratuberculosis
gcgaucgacaccagcgu

SEQ ID NO: 3020677 - RNA, 16 nt, Mycobacterium avium subsp. paratuberculosis
gcgaucgacagcucca

SEQ ID NO: 3020678 - RNA, 22 nt, Mycobacterium avium subsp. paratuberculosis
gcgaucgacagcuccaacagcc

SEQ ID NO: 3020679 - RNA, 14 nt, Mycobacterium avium subsp. paratuberculosis
gcgaucgaggaucu

SEQ ID NO: 3020680 - RNA, 21 nt, Mycobacterium avium subsp. paratuberculosis
gcgaucgaggaucucccgggu

SEQ ID NO: 3020681 - RNA, 16 nt, Mycobacterium avium subsp. paratuberculosis
gcgaucgaugcccagc

SEQ ID NO: 3020682 - RNA, 19 nt, Mycobacterium avium subsp. paratuberculosis
gcgaucgaugcccagcgcg

SEQ ID NO: 3020683 - RNA, 21 nt, Mycobacterium avium subsp. paratuberculosis
gcgaucgaugcccagcgcgcg

SEQ ID NO: 3020684 - RNA, 22 nt, Mycobacterium avium subsp. paratuberculosis
gcgaucgaugcccagcgcgcgg

SEQ ID NO: 3020685 - RNA, 15 nt, Mycobacterium avium subsp. paratuberculosis
gcgaucgccaacgcg

SEQ ID NO: 3020686 - RNA, 16 nt, Mycobacterium avium subsp. paratuberculosis
gcgaucgccagcacgg

SEQ ID NO: 3020687 - RNA, 15 nt, Mycobacterium avium subsp. paratuberculosis
gcgaucgccagcgcg

SEQ ID NO: 3020688 - RNA, 16 nt, Mycobacterium avium subsp. paratuberculosis
gcgaucgccagcgcgg

SEQ ID NO: 3020689 - RNA, 18 nt, Mycobacterium avium subsp. paratuberculosis
gcgaucgccagcgcggug

SEQ ID NO: 3020690 - RNA, 14 nt, Mycobacterium avium subsp. paratuberculosis
gcgaucgccgacgc

SEQ ID NO: 3020691 - RNA, 14 nt, Mycobacterium avium subsp. paratuberculosis
gcgaucgccgacgu

SEQ ID NO: 3020692 - RNA, 15 nt, Mycobacterium avium subsp. paratuberculosis
gcgaucgccgacguc

SEQ ID NO: 3020693 - RNA, 12 nt, Mycobacterium avium subsp. paratuberculosis
gcgaucgccgcg

SEQ ID NO: 3020694 - RNA, 19 nt, Mycobacterium avium subsp. paratuberculosis
gcgaucgccggaucggucu

SEQ ID NO: 3020695 - RNA, 16 nt, Mycobacterium avium subsp. paratuberculosis
gcgaucgccggggauc

SEQ ID NO: 3020696 - RNA, 21 nt, Mycobacterium avium subsp. paratuberculosis
gcgaucgccggugcggccgcg

SEQ ID NO: 3020697 - RNA, 14 nt, Mycobacterium avium subsp. paratuberculosis
gcgaugcaacaccg

SEQ ID NO: 3020698 - RNA, 22 nt, Mycobacterium avium subsp. paratuberculosis
gcgaugcaacaccgaacgccga

SEQ ID NO: 3020699 - RNA, 16 nt, Mycobacterium avium subsp. paratuberculosis
gcgaugcagaacagcc

SEQ ID NO: 3020700 - RNA, 24 nt, Mycobacterium avium subsp. paratuberculosis
gcgaugcagaacagccgguccgac

SEQ ID NO: 3020701 - RNA, 19 nt, Mycobacterium avium subsp. paratuberculosis
gcgaugcagaucaccacgg

SEQ ID NO: 3020702 - RNA, 21 nt, Mycobacterium avium subsp. paratuberculosis
gcgaugccagcgcaccgggcc

SEQ ID NO: 3020703 - RNA, 17 nt, Mycobacterium avium subsp. paratuberculosis
gcgaugcccaagccggc

SEQ ID NO: 3020704 - RNA, 15 nt, Mycobacterium avium subsp. paratuberculosis
gcgaugcccacagcc

SEQ ID NO: 3020705 - RNA, 20 nt, Mycobacterium avium subsp. paratuberculosis
gcgaugcccacagccaggug

SEQ ID NO: 3020706 - RNA, 15 nt, Mycobacterium avium subsp. paratuberculosis
gcgaugcccgccggc

SEQ ID NO: 3020707 - RNA, 16 nt, Mycobacterium avium subsp. paratuberculosis
gcgaugcccgccggcc

SEQ ID NO: 3020708 - RNA, 19 nt, Mycobacterium avium subsp. paratuberculosis
gcgaugcccgugaucgcca

SEQ ID NO: 3020709 - RNA, 20 nt, Mycobacterium avium subsp. paratuberculosis
gcgaugcccgugaucgccac

SEQ ID NO: 3020710 - RNA, 15 nt, Mycobacterium avium subsp. paratuberculosis
gcgaugccgacaccc

SEQ ID NO: 3020711 - RNA, 18 nt, Mycobacterium avium subsp. paratuberculosis
gcgaugccgacaccccac

SEQ ID NO: 3020712 - RNA, 14 nt, Mycobacterium avium subsp. paratuberculosis
gcgaugccgccgac

SEQ ID NO: 3020713 - RNA, 16 nt, Mycobacterium avium subsp. paratuberculosis
gcgaugccgccgacga

SEQ ID NO: 3020714 - RNA, 20 nt, Mycobacterium avium subsp. paratuberculosis
gcgaugccggaaaaguucgg

SEQ ID NO: 3020715 - RNA, 22 nt, Mycobacterium avium subsp. paratuberculosis
gcgaugccggaaaaguucggcg

SEQ ID NO: 3020716 - RNA, 14 nt, Mycobacterium avium subsp. paratuberculosis
gcgaugccggccag

SEQ ID NO: 3020717 - RNA, 20 nt, Mycobacterium avium subsp. paratuberculosis
gcgaugccgugcugggcgga

SEQ ID NO: 3020718 - RNA, 16 nt, Mycobacterium avium subsp. paratuberculosis
gcgaugccuuccucgg

SEQ ID NO: 3020719 - RNA, 19 nt, Mycobacterium avium subsp. paratuberculosis
gcgaugccuuccucggcgc

SEQ ID NO: 3020720 - RNA, 20 nt, Mycobacterium avium subsp. paratuberculosis
gcgaugccuuccucggcgcu

SEQ ID NO: 3020721 - RNA, 16 nt, Mycobacterium avium subsp. paratuberculosis
gcgaugcgcaccauca

SEQ ID NO: 3020722 - RNA, 21 nt, Mycobacterium avium subsp. paratuberculosis
gcgaugcgcaccaucaccugu

SEQ ID NO: 3020723 - RNA, 14 nt, Mycobacterium avium subsp. paratuberculosis
gcgaugcgcacguc

SEQ ID NO: 3020724 - RNA, 16 nt, Mycobacterium avium subsp. paratuberculosis
gcgaugcgcacgucgg

SEQ ID NO: 3020725 - RNA, 20 nt, Mycobacterium avium subsp. paratuberculosis
gcgaugcgcacgucggccgc

SEQ ID NO: 3020726 - RNA, 14 nt, Mycobacterium avium subsp. paratuberculosis
gcgaugcgccgucu

SEQ ID NO: 3020727 - RNA, 17 nt, Mycobacterium avium subsp. paratuberculosis
gcgaugcgcgccuccga

SEQ ID NO: 3020728 - RNA, 18 nt, Mycobacterium avium subsp. paratuberculosis
gcgaugcgcgccuccgac

SEQ ID NO: 3020729 - RNA, 15 nt, Mycobacterium avium subsp. paratuberculosis
gcgaugcgcggcccg

SEQ ID NO: 3020730 - RNA, 18 nt, Mycobacterium avium subsp. paratuberculosis
gcgaugcgcuccagcagg

SEQ ID NO: 3020731 - RNA, 19 nt, Mycobacterium avium subsp. paratuberculosis
gcgaugcgcuccagcaggc

SEQ ID NO: 3020732 - RNA, 15 nt, Mycobacterium avium subsp. paratuberculosis
gcgaugcggcccggc

SEQ ID NO: 3020733 - RNA, 19 nt, Mycobacterium avium subsp. paratuberculosis
gcgaugcggcccggccacu

SEQ ID NO: 3020734 - RNA, 16 nt, Mycobacterium avium subsp. paratuberculosis
gcgaugcggcucacca

SEQ ID NO: 3020735 - RNA, 22 nt, Mycobacterium avium subsp. paratuberculosis
gcgaugcggcucaccagguccu

SEQ ID NO: 3020736 - RNA, 14 nt, Mycobacterium avium subsp. paratuberculosis
gcgaugcgggcgcc

SEQ ID NO: 3020737 - RNA, 18 nt, Mycobacterium avium subsp. paratuberculosis
gcgaugcgggcgccgaac

SEQ ID NO: 3020738 - RNA, 21 nt, Mycobacterium avium subsp. paratuberculosis
gcgaugcgggcgccgaacguc

SEQ ID NO: 3020739 - RNA, 22 nt, Mycobacterium avium subsp. paratuberculosis
gcgaugcgggucacggucaggc

SEQ ID NO: 3020740 - RNA, 14 nt, Mycobacterium avium subsp. paratuberculosis
gcgaugcggugguc

SEQ ID NO: 3020741 - RNA, 21 nt, Mycobacterium avium subsp. paratuberculosis
gcgaugcgguggucgaacacg

SEQ ID NO: 3020742 - RNA, 18 nt, Mycobacterium avium subsp. paratuberculosis
gcgaugcuauucgggcca

SEQ ID NO: 3020743 - RNA, 17 nt, Mycobacterium avium subsp. paratuberculosis
gcgauggaagcgcccgc

SEQ ID NO: 3020744 - RNA, 18 nt, Mycobacterium avium subsp. paratuberculosis
gcgauggaagcgcccgcg

SEQ ID NO: 3020745 - RNA, 20 nt, Mycobacterium avium subsp. paratuberculosis
gcgauggaagcgcccgcgcg

SEQ ID NO: 3020746 - RNA, 13 nt, Mycobacterium avium subsp. paratuberculosis
gcgauggacagca

SEQ ID NO: 3020747 - RNA, 17 nt, Mycobacterium avium subsp. paratuberculosis
gcgauggcaacgccggu

SEQ ID NO: 3020748 - RNA, 17 nt, Mycobacterium avium subsp. paratuberculosis
gcgauggccauggccag

SEQ ID NO: 3020749 - RNA, 20 nt, Mycobacterium avium subsp. paratuberculosis
gcgauggccauggccaggaa

SEQ ID NO: 3020750 - RNA, 14 nt, Mycobacterium avium subsp. paratuberculosis
gcgauggcccgcgc

SEQ ID NO: 3020751 - RNA, 16 nt, Mycobacterium avium subsp. paratuberculosis
gcgauggcccgcgcga

SEQ ID NO: 3020752 - RNA, 16 nt, Mycobacterium avium subsp. paratuberculosis
gcgauggccugcucgc

SEQ ID NO: 3020753 - RNA, 14 nt, Mycobacterium avium subsp. paratuberculosis
gcgauggcgcggcc

SEQ ID NO: 3020754 - RNA, 15 nt, Mycobacterium avium subsp. paratuberculosis
gcgauggcgcggccg

SEQ ID NO: 3020755 - RNA, 17 nt, Mycobacterium avium subsp. paratuberculosis
gcgauggcgcggccggc

SEQ ID NO: 3020756 - RNA, 15 nt, Mycobacterium avium subsp. paratuberculosis
gcgauggcgcuggcc

SEQ ID NO: 3020757 - RNA, 12 nt, Mycobacterium avium subsp. paratuberculosis
gcgauggcggcg

SEQ ID NO: 3020758 - RNA, 13 nt, Mycobacterium avium subsp. paratuberculosis
gcgauggcggcgu

SEQ ID NO: 3020759 - RNA, 16 nt, Mycobacterium avium subsp. paratuberculosis
gcgauggcggcgucga

SEQ ID NO: 3020760 - RNA, 17 nt, Mycobacterium avium subsp. paratuberculosis
gcgauggcggcgucgag

SEQ ID NO: 3020761 - RNA, 13 nt, Mycobacterium avium subsp. paratuberculosis
gcgauggcgucgg

SEQ ID NO: 3020762 - RNA, 16 nt, Mycobacterium avium subsp. paratuberculosis
gcgauggcgucggcca

SEQ ID NO: 3020763 - RNA, 20 nt, Mycobacterium avium subsp. paratuberculosis
gcgauggcgucggccagcgg

SEQ ID NO: 3020764 - RNA, 17 nt, Mycobacterium avium subsp. paratuberculosis
gcgauggcgugccggcg

SEQ ID NO: 3020765 - RNA, 18 nt, Mycobacterium avium subsp. paratuberculosis
gcgauggcgugccggcgc

SEQ ID NO: 3020766 - RNA, 20 nt, Mycobacterium avium subsp. paratuberculosis
gcgaugggcaauaccggcag

SEQ ID NO: 3020767 - RNA, 15 nt, Mycobacterium avium subsp. paratuberculosis
gcgaugggugaucgc

SEQ ID NO: 3020768 - RNA, 21 nt, Mycobacterium avium subsp. paratuberculosis
gcgaugggugaucgcggcccg

SEQ ID NO: 3020769 - RNA, 16 nt, Mycobacterium avium subsp. paratuberculosis
gcgauggugccgccgg

SEQ ID NO: 3020770 - RNA, 16 nt, Mycobacterium avium subsp. paratuberculosis
gcgauggugccggcca

SEQ ID NO: 3020771 - RNA, 17 nt, Mycobacterium avium subsp. paratuberculosis
gcgauggugccggccau

SEQ ID NO: 3020772 - RNA, 14 nt, Mycobacterium avium subsp. paratuberculosis
gcgauggugcugcc

SEQ ID NO: 3020773 - RNA, 12 nt, Mycobacterium avium subsp. paratuberculosis
gcgaugguggcg

SEQ ID NO: 3020774 - RNA, 14 nt, Mycobacterium avium subsp. paratuberculosis
gcgaugguggucgc

SEQ ID NO: 3020775 - RNA, 17 nt, Mycobacterium avium subsp. paratuberculosis
gcgaugguggucgccgu

SEQ ID NO: 3020776 - RNA, 18 nt, Mycobacterium avium subsp. paratuberculosis
gcgaugguggucgccguc

SEQ ID NO: 3020777 - RNA, 15 nt, Mycobacterium avium subsp. paratuberculosis
gcgauguaggugcgc

SEQ ID NO: 3020778 - RNA, 20 nt, Mycobacterium avium subsp. paratuberculosis
gcgauguccgacagcccgcc

SEQ ID NO: 3020779 - RNA, 21 nt, Mycobacterium avium subsp. paratuberculosis
gcgauguccgacagcccgccc

SEQ ID NO: 3020780 - RNA, 14 nt, Mycobacterium avium subsp. paratuberculosis
gcgaugucgacgga

SEQ ID NO: 3020781 - RNA, 17 nt, Mycobacterium avium subsp. paratuberculosis
gcgaugucgacggacgg

SEQ ID NO: 3020782 - RNA, 20 nt, Mycobacterium avium subsp. paratuberculosis
gcgcaccgggaccagcgcgg

SEQ ID NO: 3020783 - RNA, 21 nt, Mycobacterium avium subsp. paratuberculosis
gcgcaccgggaccagcgcggu

SEQ ID NO: 3020784 - RNA, 24 nt, Mycobacterium avium subsp. paratuberculosis
gcgcaccgggaccagcgcggugcc

SEQ ID NO: 3020785 - RNA, 14 nt, Mycobacterium avium subsp. paratuberculosis
gcgcaccgggacgg

SEQ ID NO: 3020786 - RNA, 21 nt, Mycobacterium avium subsp. paratuberculosis
gcgcaccgggacgggucggug

SEQ ID NO: 3020787 - RNA, 14 nt, Mycobacterium avium subsp. paratuberculosis
gcgcaccgggcccg

SEQ ID NO: 3020788 - RNA, 16 nt, Mycobacterium avium subsp. paratuberculosis
gcgcaccgggcccgcc

SEQ ID NO: 3020789 - RNA, 19 nt, Mycobacterium avium subsp. paratuberculosis
gcgcaccgggcccgcccgc

SEQ ID NO: 3020790 - RNA, 22 nt, Mycobacterium avium subsp. paratuberculosis
gcgcaccgguuugucggcgccc

SEQ ID NO: 3020791 - RNA, 23 nt, Mycobacterium avium subsp. paratuberculosis
gcgcaccgguuugucggcgcccu

SEQ ID NO: 3020792 - RNA, 15 nt, Mycobacterium avium subsp. paratuberculosis
gcgcaccgucaucgc

SEQ ID NO: 3020793 - RNA, 16 nt, Mycobacterium avium subsp. paratuberculosis
gcgcaccgugccgccc

SEQ ID NO: 3020794 - RNA, 20 nt, Mycobacterium avium subsp. paratuberculosis
gcgcaccgugccgcccgucg

SEQ ID NO: 3020795 - RNA, 17 nt, Mycobacterium avium subsp. paratuberculosis
gcgcaccgugucgucgc

SEQ ID NO: 3020796 - RNA, 14 nt, Mycobacterium avium subsp. paratuberculosis
gcgcaccugcggcc

SEQ ID NO: 3020797 - RNA, 16 nt, Mycobacterium avium subsp. paratuberculosis
gcgcaccugcggcccc

SEQ ID NO: 3020798 - RNA, 20 nt, Mycobacterium avium subsp. paratuberculosis
gcgcaccuggcgcagcaccg

SEQ ID NO: 3020799 - RNA, 15 nt, Mycobacterium avium subsp. paratuberculosis
gcgcaccuggucggu

SEQ ID NO: 3020800 - RNA, 17 nt, Mycobacterium avium subsp. paratuberculosis
gcgcaccuggucgguca

SEQ ID NO: 3020801 - RNA, 15 nt, Mycobacterium avium subsp. paratuberculosis
gcgcaccuucccggc

SEQ ID NO: 3020802 - RNA, 18 nt, Mycobacterium avium subsp. paratuberculosis
gcgcaccuucccggccgc

SEQ ID NO: 3020803 - RNA, 20 nt, Mycobacterium avium subsp. paratuberculosis
gcgcacgaacggcgcgaacc

SEQ ID NO: 3020804 - RNA, 14 nt, Mycobacterium avium subsp. paratuberculosis
gcgcacgaucgggc

SEQ ID NO: 3020805 - RNA, 24 nt, Mycobacterium avium subsp. paratuberculosis
gcgcacgaucugcaggccgaggcu

SEQ ID NO: 3020806 - RNA, 21 nt, Mycobacterium avium subsp. paratuberculosis
gcgcacgcagugccgcaccag

SEQ ID NO: 3020807 - RNA, 23 nt, Mycobacterium avium subsp. paratuberculosis
gcgcacgcagugccgcaccagca

SEQ ID NO: 3020808 - RNA, 17 nt, Mycobacterium avium subsp. paratuberculosis
gcgcacgccaucgccuc

SEQ ID NO: 3020809 - RNA, 15 nt, Mycobacterium avium subsp. paratuberculosis
gcgacggcgacggcg

SEQ ID NO: 3020810 - RNA, 19 nt, Mycobacterium avium subsp. paratuberculosis
gcgacggcgagccgggccg

SEQ ID NO: 3020811 - RNA, 14 nt, Mycobacterium avium subsp. paratuberculosis
gcgacggcgcccgc

SEQ ID NO: 3020812 - RNA, 15 nt, Mycobacterium avium subsp. paratuberculosis
gcgacggcgcccgcc

SEQ ID NO: 3020813 - RNA, 16 nt, Mycobacterium avium subsp. paratuberculosis
gcgacggcgcccgccc

SEQ ID NO: 3020814 - RNA, 13 nt, Mycobacterium avium subsp. paratuberculosis
gcgacggcgccug

SEQ ID NO: 3020815 - RNA, 23 nt, Mycobacterium avium subsp. paratuberculosis
gcgacggcgccugauccgcgguc

SEQ ID NO: 3020816 - RNA, 14 nt, Mycobacterium avium subsp. paratuberculosis
gcgacggcgcguga

SEQ ID NO: 3020817 - RNA, 16 nt, Mycobacterium avium subsp. paratuberculosis
gcgacggcggcgaaga

SEQ ID NO: 3020818 - RNA, 22 nt, Mycobacterium avium subsp. paratuberculosis
gcgacggcggcgaagacgucgg

SEQ ID NO: 3020819 - RNA, 18 nt, Mycobacterium avium subsp. paratuberculosis
gcgacggcggcgacguga

SEQ ID NO: 3020820 - RNA, 13 nt, Mycobacterium avium subsp. paratuberculosis
gcgacggcggggu

SEQ ID NO: 3020821 - RNA, 18 nt, Mycobacterium avium subsp. paratuberculosis
gcgacggcggggugcgcg

SEQ ID NO: 3020822 - RNA, 18 nt, Mycobacterium avium subsp. paratuberculosis
gcgacggcgggucgauga

SEQ ID NO: 3020823 - RNA, 22 nt, Mycobacterium avium subsp. paratuberculosis
gcgacggcggugggcucggcca

SEQ ID NO: 3020824 - RNA, 23 nt, Mycobacterium avium subsp. paratuberculosis
gcgacggcggugggcucggccau

SEQ ID NO: 3020825 - RNA, 17 nt, Mycobacterium avium subsp. paratuberculosis
gcgacggcguccagcug

SEQ ID NO: 3020826 - RNA, 18 nt, Mycobacterium avium subsp. paratuberculosis
gcgacggcguccagcugc

SEQ ID NO: 3020827 - RNA, 16 nt, Mycobacterium avium subsp. paratuberculosis
gcgacggcguccgggc

SEQ ID NO: 3020828 - RNA, 17 nt, Mycobacterium avium subsp. paratuberculosis
gcgacggcguccgggcg

SEQ ID NO: 3020829 - RNA, 13 nt, Mycobacterium avium subsp. paratuberculosis
gcgacggcgucgg

SEQ ID NO: 3020830 - RNA, 14 nt, Mycobacterium avium subsp. paratuberculosis
gcgacggcgucggc

SEQ ID NO: 3020831 - RNA, 16 nt, Mycobacterium avium subsp. paratuberculosis
gcgacggcgucggcga

SEQ ID NO: 3020832 - RNA, 21 nt, Mycobacterium avium subsp. paratuberculosis
gcgacggcgucggcggccugc

SEQ ID NO: 3020833 - RNA, 22 nt, Mycobacterium avium subsp. paratuberculosis
gcgacggcgucggcggccugcu

SEQ ID NO: 3020834 - RNA, 16 nt, Mycobacterium avium subsp. paratuberculosis
gcgacgggcacccgcg

SEQ ID NO: 3020835 - RNA, 18 nt, Mycobacterium avium subsp. paratuberculosis
gcgacgggcacccgcgcg

SEQ ID NO: 3020836 - RNA, 21 nt, Mycobacterium avium subsp. paratuberculosis
gcgacgggcacccgcgcgucg

SEQ ID NO: 3020837 - RNA, 22 nt, Mycobacterium avium subsp. paratuberculosis
gcgacgggcacccgcgcgucgc

SEQ ID NO: 3020838 - RNA, 22 nt, Mycobacterium avium subsp. paratuberculosis
gcgacgggcaugccgucggcgc

SEQ ID NO: 3020839 - RNA, 12 nt, Mycobacterium avium subsp. paratuberculosis
gcgacgggccga

SEQ ID NO: 3020840 - RNA, 13 nt, Mycobacterium avium subsp. paratuberculosis
gcgacgggccgau

SEQ ID NO: 3020841 - RNA, 17 nt, Mycobacterium avium subsp. paratuberculosis
gcgacgggccgggcacg

SEQ ID NO: 3020842 - RNA, 18 nt, Mycobacterium avium subsp. paratuberculosis
gcgacgggccgggcacgu

SEQ ID NO: 3020843 - RNA, 19 nt, Mycobacterium avium subsp. paratuberculosis
gcgacgggcugucccggcc

SEQ ID NO: 3020844 - RNA, 20 nt, Mycobacterium avium subsp. paratuberculosis
gcgacggggugguucguccg

SEQ ID NO: 3020845 - RNA, 17 nt, Mycobacterium avium subsp. paratuberculosis
gcgacggguugcggauc

SEQ ID NO: 3020846 - RNA, 19 nt, Mycobacterium avium subsp. paratuberculosis
gcgacggguugcggaucgg

SEQ ID NO: 3020847 - RNA, 18 nt, Mycobacterium avium subsp. paratuberculosis
gcgacggucacgcuggcg

SEQ ID NO: 3020848 - RNA, 21 nt, Mycobacterium avium subsp. paratuberculosis
gcgacggucacgcuggcguga

SEQ ID NO: 3020849 - RNA, 18 nt, Mycobacterium avium subsp. paratuberculosis
gcgacggucaguccgggu

SEQ ID NO: 3020850 - RNA, 17 nt, Mycobacterium avium subsp. paratuberculosis
gcgacggucgugcuggg

SEQ ID NO: 3020851 - RNA, 19 nt, Mycobacterium avium subsp. paratuberculosis
gcgacggucgugcugggcc

SEQ ID NO: 3020852 - RNA, 20 nt, Mycobacterium avium subsp. paratuberculosis
gcgacggucgugcugggccg

SEQ ID NO: 3020853 - RNA, 15 nt, Mycobacterium avium subsp. paratuberculosis
gcgacggucugccgg

SEQ ID NO: 3020854 - RNA, 12 nt, Mycobacterium avium subsp. paratuberculosis
gcgacggugagc

SEQ ID NO: 3020855 - RNA, 13 nt, Mycobacterium avium subsp. paratuberculosis
gcgacggugagca

SEQ ID NO: 3020856 - RNA, 16 nt, Mycobacterium avium subsp. paratuberculosis
gcgacggugcaugcgc

SEQ ID NO: 3020857 - RNA, 21 nt, Mycobacterium avium subsp. paratuberculosis
gcgacggugcaugcgcuggcg

SEQ ID NO: 3020858 - RNA, 22 nt, Mycobacterium avium subsp. paratuberculosis
gcgacggugcaugcgcuggcga

SEQ ID NO: 3020859 - RNA, 17 nt, Mycobacterium avium subsp. paratuberculosis
gcgacgguggcgcccag

SEQ ID NO: 3020860 - RNA, 16 nt, Mycobacterium avium subsp. paratuberculosis
gcgacgguggcggcga

SEQ ID NO: 3020861 - RNA, 19 nt, Mycobacterium avium subsp. paratuberculosis
gcgacgguggcggcgaugu

SEQ ID NO: 3020862 - RNA, 20 nt, Mycobacterium avium subsp. paratuberculosis
gcgacgguggcggcgauguc

SEQ ID NO: 3020863 - RNA, 23 nt, Mycobacterium avium subsp. paratuberculosis
gcgacgguggcggcgaugucguc

SEQ ID NO: 3020864 - RNA, 17 nt, Mycobacterium avium subsp. paratuberculosis
gcgacgguggcgggccg

SEQ ID NO: 3020865 - RNA, 19 nt, Mycobacterium avium subsp. paratuberculosis
gcgacgguggcgggccgcc

SEQ ID NO: 3020866 - RNA, 21 nt, Mycobacterium avium subsp. paratuberculosis
gcgacgguggcgggccgccgg

SEQ ID NO: 3020867 - RNA, 23 nt, Mycobacterium avium subsp. paratuberculosis
gcgacgguggcgggccgccgggu

SEQ ID NO: 3020868 - RNA, 22 nt, Mycobacterium avium subsp. paratuberculosis
gcgacgguguccgcggcgucgg

SEQ ID NO: 3020869 - RNA, 23 nt, Mycobacterium avium subsp. paratuberculosis
gcgacgguguccgcggcgucggg

SEQ ID NO: 3020870 - RNA, 16 nt, Mycobacterium avium subsp. paratuberculosis
gcgacgguuguucagc

SEQ ID NO: 3020871 - RNA, 21 nt, Mycobacterium avium subsp. paratuberculosis
gcgacgguuguucagcccggu

SEQ ID NO: 3020872 - RNA, 15 nt, Mycobacterium avium subsp. paratuberculosis
gcgacguacagcgag

SEQ ID NO: 3020873 - RNA, 22 nt, Mycobacterium avium subsp. paratuberculosis
gcgacguacagcgagccgucga

SEQ ID NO: 3020874 - RNA, 24 nt, Mycobacterium avium subsp. paratuberculosis
gcgacgucaggucgaccggcucgc

SEQ ID NO: 3020875 - RNA, 17 nt, Mycobacterium avium subsp. paratuberculosis
gcgacguccaucgggac

SEQ ID NO: 3020876 - RNA, 19 nt, Mycobacterium avium subsp. paratuberculosis
gcgacguccaucgggaccg

SEQ ID NO: 3020877 - RNA, 22 nt, Mycobacterium avium subsp. paratuberculosis
gcgacguccaucgggaccgcgg

SEQ ID NO: 3020878 - RNA, 18 nt, Mycobacterium avium subsp. paratuberculosis
gcgacguccuugaucagc

SEQ ID NO: 3020879 - RNA, 16 nt, Mycobacterium avium subsp. paratuberculosis
gcgacgucgaacgcgu

SEQ ID NO: 3020880 - RNA, 12 nt, Mycobacterium avium subsp. paratuberculosis
gcgacgucgacc

SEQ ID NO: 3020881 - RNA, 16 nt, Mycobacterium avium subsp. paratuberculosis
gcgacgucgaccgcga

SEQ ID NO: 3020882 - RNA, 19 nt, Mycobacterium avium subsp. paratuberculosis
gcgacgucgaccgcgacga

SEQ ID NO: 3020883 - RNA, 14 nt, Mycobacterium avium subsp. paratuberculosis
gcgacgucgacggc

SEQ ID NO: 3020884 - RNA, 16 nt, Mycobacterium avium subsp. paratuberculosis
gcgacgucgacggcag

SEQ ID NO: 3020885 - RNA, 17 nt, Mycobacterium avium subsp. paratuberculosis
gcgacgucgacggcagc

SEQ ID NO: 3020886 - RNA, 14 nt, Mycobacterium avium subsp. paratuberculosis
gcgacgucgccggc

SEQ ID NO: 3020887 - RNA, 15 nt, Mycobacterium avium subsp. paratuberculosis
gcgacgucgccggcc

SEQ ID NO: 3020888 - RNA, 19 nt, Mycobacterium avium subsp. paratuberculosis
gcgacgucggagaucaggg

SEQ ID NO: 3020889 - RNA, 23 nt, Mycobacterium avium subsp. paratuberculosis
gcgacgucggggucgucgcgguc

SEQ ID NO: 3020890 - RNA, 15 nt, Mycobacterium avium subsp. paratuberculosis
gcgacgucggucggc

SEQ ID NO: 3020891 - RNA, 23 nt, Mycobacterium avium subsp. paratuberculosis
gcgacgucgguguagucggcgau

SEQ ID NO: 3020892 - RNA, 13 nt, Mycobacterium avium subsp. paratuberculosis
gcgacgucgucga

SEQ ID NO: 3020893 - RNA, 19 nt, Mycobacterium avium subsp. paratuberculosis
gcgagauuggccucggcgc

SEQ ID NO: 3020894 - RNA, 17 nt, Mycobacterium avium subsp. paratuberculosis
gcgagcaaggcgagcac

SEQ ID NO: 3020895 - RNA, 23 nt, Mycobacterium avium subsp. paratuberculosis
gcgagcacacccucaccccgccc

SEQ ID NO: 3020896 - RNA, 15 nt, Mycobacterium avium subsp. paratuberculosis
gcgagcacagcggcg

SEQ ID NO: 3020897 - RNA, 15 nt, Mycobacterium avium subsp. paratuberculosis
gcgagcaccgcgauc

SEQ ID NO: 3020898 - RNA, 19 nt, Mycobacterium avium subsp. paratuberculosis
gcgagcaccgcgaucgccg

SEQ ID NO: 3020899 - RNA, 22 nt, Mycobacterium avium subsp. paratuberculosis
gcgagcaccgcgaucgccgacg

SEQ ID NO: 3020900 - RNA, 15 nt, Mycobacterium avium subsp. paratuberculosis
gcgagcaccgugccg

SEQ ID NO: 3020901 - RNA, 19 nt, Mycobacterium avium subsp. paratuberculosis
gcgagcaccgugccgucgg

SEQ ID NO: 3020902 - RNA, 22 nt, Mycobacterium avium subsp. paratuberculosis
gcgagcaccgugccgucggcgu

SEQ ID NO: 3020903 - RNA, 15 nt, Mycobacterium avium subsp. paratuberculosis
gcgagcacgacgucg

SEQ ID NO: 3020904 - RNA, 16 nt, Mycobacterium avium subsp. paratuberculosis
gcgagcacgacgucga

SEQ ID NO: 3020905 - RNA, 14 nt, Mycobacterium avium subsp. paratuberculosis
gcgagcacgccgcc

SEQ ID NO: 3020906 - RNA, 14 nt, Mycobacterium avium subsp. paratuberculosis
gcgagcacggcacg

SEQ ID NO: 3020907 - RNA, 21 nt, Mycobacterium avium subsp. paratuberculosis
gcgagcacggcacgcccguuc

SEQ ID NO: 3020908 - RNA, 18 nt, Mycobacterium avium subsp. paratuberculosis
gcgagcagacacaaaagc

SEQ ID NO: 3020909 - RNA, 20 nt, Mycobacterium avium subsp. paratuberculosis
gcgagcagacacaaaagcac

SEQ ID NO: 3020910 - RNA, 20 nt, Mycobacterium avium subsp. paratuberculosis
gcgagcagacacaaaagcgc

SEQ ID NO: 3020911 - RNA, 18 nt, Mycobacterium avium subsp. paratuberculosis
gcgagcagacgcgaaagc

SEQ ID NO: 3020912 - RNA, 16 nt, Mycobacterium avium subsp. paratuberculosis
gcgagcagaucgcgga

SEQ ID NO: 3020913 - RNA, 17 nt, Mycobacterium avium subsp. paratuberculosis
gcgagcagcagcgcggu

SEQ ID NO: 3020914 - RNA, 21 nt, Mycobacterium avium subsp. paratuberculosis
gcgagcagcagcgcggugccg

SEQ ID NO: 3020915 - RNA, 23 nt, Mycobacterium avium subsp. paratuberculosis
gcgagcagcagcgcggugccgac

SEQ ID NO: 3020916 - RNA, 13 nt, Mycobacterium avium subsp. paratuberculosis
gcgagcagcccgg

SEQ ID NO: 3020917 - RNA, 14 nt, Mycobacterium avium subsp. paratuberculosis
gcgagcagcccggc

SEQ ID NO: 3020918 - RNA, 16 nt, Mycobacterium avium subsp. paratuberculosis
gcgagcagcccggcga

SEQ ID NO: 3020919 - RNA, 16 nt, Mycobacterium avium subsp. paratuberculosis
gcgagcagccgcgccg

SEQ ID NO: 3020920 - RNA, 17 nt, Mycobacterium avium subsp. paratuberculosis
gcgagcagccgcgccgg

SEQ ID NO: 3020921 - RNA, 18 nt, Mycobacterium avium subsp. paratuberculosis
gcgagcagccgcgccggg

SEQ ID NO: 3020922 - RNA, 19 nt, Mycobacterium avium subsp. paratuberculosis
gcgagcagccgcgccgggc

SEQ ID NO: 3020923 - RNA, 15 nt, Mycobacterium avium subsp. paratuberculosis
gcgagcagccgggug

SEQ ID NO: 3020924 - RNA, 13 nt, Mycobacterium avium subsp. paratuberculosis
gcgagcagcgccc

SEQ ID NO: 3020925 - RNA, 15 nt, Mycobacterium avium subsp. paratuberculosis
gcgagcagcgcgaug

SEQ ID NO: 3020926 - RNA, 18 nt, Mycobacterium avium subsp. paratuberculosis
gcgagcagcgcgaugccg

SEQ ID NO: 3020927 - RNA, 21 nt, Mycobacterium avium subsp. paratuberculosis
gcgagcagcgcgaugccggcc

SEQ ID NO: 3020928 - RNA, 22 nt, Mycobacterium avium subsp. paratuberculosis
gcgagcagcgcgaugccggcca

SEQ ID NO: 3020929 - RNA, 14 nt, Mycobacterium avium subsp. paratuberculosis
gcgagcagcugcag

SEQ ID NO: 3020930 - RNA, 15 nt, Mycobacterium avium subsp. paratuberculosis
gcgagcagcugcagc

SEQ ID NO: 3020931 - RNA, 21 nt, Mycobacterium avium subsp. paratuberculosis
gcgagcagcugcagcgucggg

SEQ ID NO: 3020932 - RNA, 16 nt, Mycobacterium avium subsp. paratuberculosis
gcgagcaggccgaggc

SEQ ID NO: 3020933 - RNA, 22 nt, Mycobacterium avium subsp. paratuberculosis
gcgagcaucaccgucaucucgg

SEQ ID NO: 3020934 - RNA, 13 nt, Mycobacterium avium subsp. paratuberculosis
gcgagccaccucg

SEQ ID NO: 3020935 - RNA, 20 nt, Mycobacterium avium subsp. paratuberculosis
gcgagccaccucgaucagcg

SEQ ID NO: 3020936 - RNA, 13 nt, Mycobacterium avium subsp. paratuberculosis
gcgagcccagcug

SEQ ID NO: 3020937 - RNA, 21 nt, Mycobacterium avium subsp. paratuberculosis
gcgagcccgcaaaucagccga

SEQ ID NO: 3020938 - RNA, 12 nt, Mycobacterium avium subsp. paratuberculosis
gcgagcccggcc

SEQ ID NO: 3020939 - RNA, 13 nt, Mycobacterium avium subsp. paratuberculosis
gcgagcccggcca

SEQ ID NO: 3020940 - RNA, 15 nt, Mycobacterium avium subsp. paratuberculosis
gcgagcccggccagu

SEQ ID NO: 3020941 - RNA, 22 nt, Mycobacterium avium subsp. paratuberculosis
gcgagcccggccaguccggcag

SEQ ID NO: 3020942 - RNA, 23 nt, Mycobacterium avium subsp. paratuberculosis
gcgagcccggccaguccggcagc

SEQ ID NO: 3020943 - RNA, 13 nt, Mycobacterium avium subsp. paratuberculosis
gcgagcccggcga

SEQ ID NO: 3020944 - RNA, 18 nt, Mycobacterium avium subsp. paratuberculosis
gcgagcccggcgacgucg

SEQ ID NO: 3020945 - RNA, 21 nt, Mycobacterium avium subsp. paratuberculosis
gcgagccgaaacggugcccgc

SEQ ID NO: 3020946 - RNA, 22 nt, Mycobacterium avium subsp. paratuberculosis
gcgagccgacagucgcgggcgg

SEQ ID NO: 3020947 - RNA, 12 nt, Mycobacterium avium subsp. paratuberculosis
gcgagccgagca

SEQ ID NO: 3020948 - RNA, 19 nt, Mycobacterium avium subsp. paratuberculosis
gcgagccgagcacgcagcc

SEQ ID NO: 3020949 - RNA, 14 nt, Mycobacterium avium subsp. paratuberculosis
gcgagccgagccgg

SEQ ID NO: 3020950 - RNA, 20 nt, Mycobacterium avium subsp. paratuberculosis
gcgagccgagccgguccgac

SEQ ID NO: 3020951 - RNA, 23 nt, Mycobacterium avium subsp. paratuberculosis
gcgagccgagccgguccgaccag

SEQ ID NO: 3020952 - RNA, 15 nt, Mycobacterium avium subsp. paratuberculosis
gcgagccgcccaggc

SEQ ID NO: 3020953 - RNA, 20 nt, Mycobacterium avium subsp. paratuberculosis
gcgagccggcacgcgcgccg

SEQ ID NO: 3020954 - RNA, 23 nt, Mycobacterium avium subsp. paratuberculosis
gcgagccggcacgcgcgccggag

SEQ ID NO: 3020955 - RNA, 16 nt, Mycobacterium avium subsp. paratuberculosis
gcgagccggcccgggg

SEQ ID NO: 3020956 - RNA, 21 nt, Mycobacterium avium subsp. paratuberculosis
gcgagccggcccggggugugc

SEQ ID NO: 3020957 - RNA, 12 nt, Mycobacterium avium subsp. paratuberculosis
gcgagccggccg

SEQ ID NO: 3020958 - RNA, 13 nt, Mycobacterium avium subsp. paratuberculosis
gcgagccggccgu

SEQ ID NO: 3020959 - RNA, 23 nt, Mycobacterium avium subsp. paratuberculosis
gcgagcgacgccacggggcugcg

SEQ ID NO: 3020960 - RNA, 18 nt, Mycobacterium avium subsp. paratuberculosis
gcgagcgaggccaucauc

SEQ ID NO: 3020961 - RNA, 12 nt, Mycobacterium avium subsp. paratuberculosis
gcgagcgcacca

SEQ ID NO: 3020962 - RNA, 15 nt, Mycobacterium avium subsp. paratuberculosis
gcgagcgcaccagau

SEQ ID NO: 3020963 - RNA, 23 nt, Mycobacterium avium subsp. paratuberculosis
gcgagcgcaccagauucaccagc

SEQ ID NO: 3020964 - RNA, 13 nt, Mycobacterium avium subsp. paratuberculosis
gcgagcgcagcag

SEQ ID NO: 3020965 - RNA, 16 nt, Mycobacterium avium subsp. paratuberculosis
gcgagcgcagcgccag

SEQ ID NO: 3020966 - RNA, 18 nt, Mycobacterium avium subsp. paratuberculosis
gcgagcgcagcgccaggc

SEQ ID NO: 3020967 - RNA, 21 nt, Mycobacterium avium subsp. paratuberculosis
gcgagcgcagcgccaggcaga

SEQ ID NO: 3020968 - RNA, 21 nt, Mycobacterium avium subsp. paratuberculosis
gcgagcgcgcggugaugaccu

SEQ ID NO: 3020969 - RNA, 12 nt, Mycobacterium avium subsp. paratuberculosis
gcgagcgcgcug

SEQ ID NO: 3020970 - RNA, 13 nt, Mycobacterium avium subsp. paratuberculosis
gcgagcgcgcugu

SEQ ID NO: 3020971 - RNA, 16 nt, Mycobacterium avium subsp. paratuberculosis
gcgagcgcgcuguagg

SEQ ID NO: 3020972 - RNA, 18 nt, Mycobacterium avium subsp. paratuberculosis
gcgagcgcguucuccacc

SEQ ID NO: 3020973 - RNA, 21 nt, Mycobacterium avium subsp. paratuberculosis
gcgagcgcguucuccaccgcg

SEQ ID NO: 3020974 - RNA, 14 nt, Mycobacterium avium subsp. paratuberculosis
gcgagcgcuaccgc

SEQ ID NO: 3020975 - RNA, 16 nt, Mycobacterium avium subsp. paratuberculosis
gcgagcgcuaccgcgc

SEQ ID NO: 3020976 - RNA, 22 nt, Mycobacterium avium subsp. paratuberculosis
gcgagcgcuaccgcgcucaccg

SEQ ID NO: 3020977 - RNA, 16 nt, Mycobacterium avium subsp. paratuberculosis
gcgagcggcaccuugg

SEQ ID NO: 3020978 - RNA, 18 nt, Mycobacterium avium subsp. paratuberculosis
gcgaguaaggccgaggcg

SEQ ID NO: 3020979 - RNA, 19 nt, Mycobacterium avium subsp. paratuberculosis
gcgaguaaggccgaggcga

SEQ ID NO: 3020980 - RNA, 15 nt, Mycobacterium avium subsp. paratuberculosis
gcgaguacccgccgc

SEQ ID NO: 3020981 - RNA, 17 nt, Mycobacterium avium subsp. paratuberculosis
gcgaguacccgccgcac

SEQ ID NO: 3020982 - RNA, 20 nt, Mycobacterium avium subsp. paratuberculosis
gcgaguacccgccgcaccuc

SEQ ID NO: 3020983 - RNA, 13 nt, Mycobacterium avium subsp. paratuberculosis
gcgaguagcugcc

SEQ ID NO: 3020984 - RNA, 13 nt, Mycobacterium avium subsp. paratuberculosis
gcgagucaccggc

SEQ ID NO: 3020985 - RNA, 14 nt, Mycobacterium avium subsp. paratuberculosis
gcgagucaccggcu

SEQ ID NO: 3020986 - RNA, 18 nt, Mycobacterium avium subsp. paratuberculosis
gcgagucaccggcucgcg

SEQ ID NO: 3020987 - RNA, 19 nt, Mycobacterium avium subsp. paratuberculosis
gcgagucaccggcucgcgg

SEQ ID NO: 3020988 - RNA, 14 nt, Mycobacterium avium subsp. paratuberculosis
gcgagucaucgcca

SEQ ID NO: 3020989 - RNA, 18 nt, Mycobacterium avium subsp. paratuberculosis
gcgagucaucgccacccg

SEQ ID NO: 3020990 - RNA, 19 nt, Mycobacterium avium subsp. paratuberculosis
gcgagucaucgccacccgc

SEQ ID NO: 3020991 - RNA, 23 nt, Mycobacterium avium subsp. paratuberculosis
gcgagucaucgccacccgcaccu

SEQ ID NO: 3020992 - RNA, 15 nt, Mycobacterium avium subsp. paratuberculosis
gcgaguccagccagc

SEQ ID NO: 3020993 - RNA, 20 nt, Mycobacterium avium subsp. paratuberculosis
gcgaguccagccagccgcgc

SEQ ID NO: 3020994 - RNA, 22 nt, Mycobacterium avium subsp. paratuberculosis
gcgaguccagccagccgcgccg

SEQ ID NO: 3020995 - RNA, 14 nt, Mycobacterium avium subsp. paratuberculosis
gcgagucccggcgc

SEQ ID NO: 3020996 - RNA, 18 nt, Mycobacterium avium subsp. paratuberculosis
gcgagucccggcgcacca

SEQ ID NO: 3020997 - RNA, 21 nt, Mycobacterium avium subsp. paratuberculosis
gcgagucccggcgcaccaggc

SEQ ID NO: 3020998 - RNA, 17 nt, Mycobacterium avium subsp. paratuberculosis
gcgaguccgcggaggcg

SEQ ID NO: 3020999 - RNA, 18 nt, Mycobacterium avium subsp. paratuberculosis
gcgaguccggccaggucg

SEQ ID NO: 3021000 - RNA, 18 nt, Mycobacterium avium subsp. paratuberculosis
gcgagucgaagccgucca

SEQ ID NO: 3021001 - RNA, 19 nt, Mycobacterium avium subsp. paratuberculosis
gcgagucgaagccguccag

SEQ ID NO: 3021002 - RNA, 22 nt, Mycobacterium avium subsp. paratuberculosis
gcgagucgaagccguccaggcc

SEQ ID NO: 3021003 - RNA, 21 nt, Mycobacterium avium subsp. paratuberculosis
gcgacagcacccgcugcagcc

SEQ ID NO: 3021004 - RNA, 16 nt, Mycobacterium avium subsp. paratuberculosis
gcgacagcagcguggu

SEQ ID NO: 3021005 - RNA, 18 nt, Mycobacterium avium subsp. paratuberculosis
gcgacagccgggaaucga

SEQ ID NO: 3021006 - RNA, 22 nt, Mycobacterium avium subsp. paratuberculosis
gcgacagccgggaaucgagggc

SEQ ID NO: 3021007 - RNA, 15 nt, Mycobacterium avium subsp. paratuberculosis
gcgacagcgcgucgg

SEQ ID NO: 3021008 - RNA, 17 nt, Mycobacterium avium subsp. paratuberculosis
gcgacagcgcgucggcc

SEQ ID NO: 3021009 - RNA, 18 nt, Mycobacterium avium subsp. paratuberculosis
gcgacagcgcgucggcca

SEQ ID NO: 3021010 - RNA, 17 nt, Mycobacterium avium subsp. paratuberculosis
gcgacaggaaccugguc

SEQ ID NO: 3021011 - RNA, 21 nt, Mycobacterium avium subsp. paratuberculosis
gcgacaggaaccuggucgggg

SEQ ID NO: 3021012 - RNA, 13 nt, Mycobacterium avium subsp. paratuberculosis
gcgacaggucggc

SEQ ID NO: 3021013 - RNA, 14 nt, Mycobacterium avium subsp. paratuberculosis
gcgacaggucggcg

SEQ ID NO: 3021014 - RNA, 18 nt, Mycobacterium avium subsp. paratuberculosis
gcgacaggucggcggucg

SEQ ID NO: 3021015 - RNA, 20 nt, Mycobacterium avium subsp. paratuberculosis
gcgacaggucggcggucgcg

SEQ ID NO: 3021016 - RNA, 21 nt, Mycobacterium avium subsp. paratuberculosis
gcgacaggucggcggucgcgg

SEQ ID NO: 3021017 - RNA, 23 nt, Mycobacterium avium subsp. paratuberculosis
gcgacaggucggcggucgcggug

SEQ ID NO: 3021018 - RNA, 18 nt, Mycobacterium avium subsp. paratuberculosis
gcgacaucaccgcgggcg

SEQ ID NO: 3021019 - RNA, 20 nt, Mycobacterium avium subsp. paratuberculosis
gcgacaucaccgcgggcgcg

SEQ ID NO: 3021020 - RNA, 23 nt, Mycobacterium avium subsp. paratuberculosis
gcgacaucaccgcgggcgcgccg

SEQ ID NO: 3021021 - RNA, 17 nt, Mycobacterium avium subsp. paratuberculosis
gcgacaucgccgcggcc

SEQ ID NO: 3021022 - RNA, 20 nt, Mycobacterium avium subsp. paratuberculosis
gcgacaucgccgcggccgga

SEQ ID NO: 3021023 - RNA, 14 nt, Mycobacterium avium subsp. paratuberculosis
gcgacaucgccggc

SEQ ID NO: 3021024 - RNA, 15 nt, Mycobacterium avium subsp. paratuberculosis
gcgacaucgccggcg

SEQ ID NO: 3021025 - RNA, 23 nt, Mycobacterium avium subsp. paratuberculosis
gccgguaggcggccagcgcccgc

SEQ ID NO: 3021026 - RNA, 16 nt, Mycobacterium avium subsp. paratuberculosis
gccgguagggccgguc

SEQ ID NO: 3021027 - RNA, 16 nt, Mycobacterium avium subsp. paratuberculosis
gccgguauacccccgg

SEQ ID NO: 3021028 - RNA, 17 nt, Mycobacterium avium subsp. paratuberculosis
gccgguauacccccggu

SEQ ID NO: 3021029 - RNA, 19 nt, Mycobacterium avium subsp. paratuberculosis
gccgguauacccccgguga

SEQ ID NO: 3021030 - RNA, 23 nt, Mycobacterium avium subsp. paratuberculosis
gccgguauacccccggugaaggu

SEQ ID NO: 3021031 - RNA, 19 nt, Mycobacterium avium subsp. paratuberculosis
gccgguaucgagcaccagc

SEQ ID NO: 3021032 - RNA, 20 nt, Mycobacterium avium subsp. paratuberculosis
gccgguaucgggucaccgug

SEQ ID NO: 3021033 - RNA, 24 nt, Mycobacterium avium subsp. paratuberculosis
gccgguaucgggucaccgugcggg

SEQ ID NO: 3021034 - RNA, 16 nt, Mycobacterium avium subsp. paratuberculosis
gccgguaugcgaucgc

SEQ ID NO: 3021035 - RNA, 21 nt, Mycobacterium avium subsp. paratuberculosis
gccgguaugcgaucgcgucga

SEQ ID NO: 3021036 - RNA, 22 nt, Mycobacterium avium subsp. paratuberculosis
gccgguauuggccacgcuggcg

SEQ ID NO: 3021037 - RNA, 14 nt, Mycobacterium avium subsp. paratuberculosis
gccggucaccgguc

SEQ ID NO: 3021038 - RNA, 16 nt, Mycobacterium avium subsp. paratuberculosis
gccggucaccggucgc

SEQ ID NO: 3021039 - RNA, 21 nt, Mycobacterium avium subsp. paratuberculosis
gccggucaccggucgcguuga

SEQ ID NO: 3021040 - RNA, 20 nt, Mycobacterium avium subsp. paratuberculosis
gccggucacgcugaucgacc

SEQ ID NO: 3021041 - RNA, 23 nt, Mycobacterium avium subsp. paratuberculosis
gccggucacgcugaucgaccggu

SEQ ID NO: 3021042 - RNA, 13 nt, Mycobacterium avium subsp. paratuberculosis
gccggucacggcg

SEQ ID NO: 3021043 - RNA, 20 nt, Mycobacterium avium subsp. paratuberculosis
gccggucacggcgucggcgu

SEQ ID NO: 3021044 - RNA, 13 nt, Mycobacterium avium subsp. paratuberculosis
gccggucagcacc

SEQ ID NO: 3021045 - RNA, 14 nt, Mycobacterium avium subsp. paratuberculosis
gccggucagcacca

SEQ ID NO: 3021046 - RNA, 18 nt, Mycobacterium avium subsp. paratuberculosis
gccggucagcacgucggu

SEQ ID NO: 3021047 - RNA, 20 nt, Mycobacterium avium subsp. paratuberculosis
gccggucagcacgucgguca

SEQ ID NO: 3021048 - RNA, 13 nt, Mycobacterium avium subsp. paratuberculosis
gccggucagcgcg

SEQ ID NO: 3021049 - RNA, 19 nt, Mycobacterium avium subsp. paratuberculosis
gccggucagcgcgacaucg

SEQ ID NO: 3021050 - RNA, 22 nt, Mycobacterium avium subsp. paratuberculosis
gccggucagcgcgacaucgccg

SEQ ID NO: 3021051 - RNA, 20 nt, Mycobacterium avium subsp. paratuberculosis
gccggucagcgcuccuggcc

SEQ ID NO: 3021052 - RNA, 21 nt, Mycobacterium avium subsp. paratuberculosis
gccggucagcgcuccuggccg

SEQ ID NO: 3021053 - RNA, 16 nt, Mycobacterium avium subsp. paratuberculosis
gccggucagcggcaac

SEQ ID NO: 3021054 - RNA, 21 nt, Mycobacterium avium subsp. paratuberculosis
gccggucagcggcaacacgcc

SEQ ID NO: 3021055 - RNA, 23 nt, Mycobacterium avium subsp. paratuberculosis
gccggucaggcauuccaccgcgc

SEQ ID NO: 3021056 - RNA, 17 nt, Mycobacterium avium subsp. paratuberculosis
gccggucauaggccgcg

SEQ ID NO: 3021057 - RNA, 20 nt, Mycobacterium avium subsp. paratuberculosis
gccggucauaggccgcgcag

SEQ ID NO: 3021058 - RNA, 21 nt, Mycobacterium avium subsp. paratuberculosis
gccggucauaggccgcgcaga

SEQ ID NO: 3021059 - RNA, 17 nt, Mycobacterium avium subsp. paratuberculosis
gccggucauccgggcca

SEQ ID NO: 3021060 - RNA, 22 nt, Mycobacterium avium subsp. paratuberculosis
gccggucauccgggccaccacc

SEQ ID NO: 3021061 - RNA, 14 nt, Mycobacterium avium subsp. paratuberculosis
gccgguccagccgc

SEQ ID NO: 3021062 - RNA, 15 nt, Mycobacterium avium subsp. paratuberculosis
gccgguccagccgcc

SEQ ID NO: 3021063 - RNA, 16 nt, Mycobacterium avium subsp. paratuberculosis
gccgguccagccgccg

SEQ ID NO: 3021064 - RNA, 19 nt, Mycobacterium avium subsp. paratuberculosis
gccgguccagccgccgcgu

SEQ ID NO: 3021065 - RNA, 16 nt, Mycobacterium avium subsp. paratuberculosis
gccgguccagugccgg

SEQ ID NO: 3021066 - RNA, 18 nt, Mycobacterium avium subsp. paratuberculosis
gccgguccagugccggcg

SEQ ID NO: 3021067 - RNA, 19 nt, Mycobacterium avium subsp. paratuberculosis
gccgguccagugccggcga

SEQ ID NO: 3021068 - RNA, 20 nt, Mycobacterium avium subsp. paratuberculosis
gccgguccaugugccgcauc

SEQ ID NO: 3021069 - RNA, 14 nt, Mycobacterium avium subsp. paratuberculosis
gccgguccccggcg

SEQ ID NO: 3021070 - RNA, 15 nt, Mycobacterium avium subsp. paratuberculosis
gccgguccccggcga

SEQ ID NO: 3021071 - RNA, 17 nt, Mycobacterium avium subsp. paratuberculosis
gccgguccccggcgacc

SEQ ID NO: 3021072 - RNA, 15 nt, Mycobacterium avium subsp. paratuberculosis
gccggucccgcggcg

SEQ ID NO: 3021073 - RNA, 18 nt, Mycobacterium avium subsp. paratuberculosis
gccggucccgcggcggcg

SEQ ID NO: 3021074 - RNA, 19 nt, Mycobacterium avium subsp. paratuberculosis
gccggucccgcggcggcgc

SEQ ID NO: 3021075 - RNA, 21 nt, Mycobacterium avium subsp. paratuberculosis
gccggucccgcggcggcgcca

SEQ ID NO: 3021076 - RNA, 19 nt, Mycobacterium avium subsp. paratuberculosis
gccggucccguugaucucg

SEQ ID NO: 3021077 - RNA, 16 nt, Mycobacterium avium subsp. paratuberculosis
gccgguccgaccagcg

SEQ ID NO: 3021078 - RNA, 17 nt, Mycobacterium avium subsp. paratuberculosis
gccgguccgaccagcgg

SEQ ID NO: 3021079 - RNA, 18 nt, Mycobacterium avium subsp. paratuberculosis
gccgguccgaccagcggc

SEQ ID NO: 3021080 - RNA, 19 nt, Mycobacterium avium subsp. paratuberculosis
gccgguccgaccagcggcc

SEQ ID NO: 3021081 - RNA, 21 nt, Mycobacterium avium subsp. paratuberculosis
gccgguccgaccagcggccca

SEQ ID NO: 3021082 - RNA, 15 nt, Mycobacterium avium subsp. paratuberculosis
gccgguccgaccgcc

SEQ ID NO: 3021083 - RNA, 16 nt, Mycobacterium avium subsp. paratuberculosis
gccgguccgaccgcca

SEQ ID NO: 3021084 - RNA, 18 nt, Mycobacterium avium subsp. paratuberculosis
gccgguccgaccgccacc

SEQ ID NO: 3021085 - RNA, 21 nt, Mycobacterium avium subsp. paratuberculosis
gccgguccgaccgccaccacc

SEQ ID NO: 3021086 - RNA, 14 nt, Mycobacterium avium subsp. paratuberculosis
gccgguccgacggc

SEQ ID NO: 3021087 - RNA, 16 nt, Mycobacterium avium subsp. paratuberculosis
gccgguccgacggcug

SEQ ID NO: 3021088 - RNA, 20 nt, Mycobacterium avium subsp. paratuberculosis
gccgguccgacggcugcggu

SEQ ID NO: 3021089 - RNA, 19 nt, Mycobacterium avium subsp. paratuberculosis
gccgguccgaucguccggc

SEQ ID NO: 3021090 - RNA, 20 nt, Mycobacterium avium subsp. paratuberculosis
gccgguccgaucguccggcg

SEQ ID NO: 3021091 - RNA, 23 nt, Mycobacterium avium subsp. paratuberculosis
gccgguccgaucguccggcgcca

SEQ ID NO: 3021092 - RNA, 12 nt, Mycobacterium avium subsp. paratuberculosis
gccgguccgccc

SEQ ID NO: 3021093 - RNA, 19 nt, Mycobacterium avium subsp. paratuberculosis
gccgguccgcccagacgcg

SEQ ID NO: 3021094 - RNA, 14 nt, Mycobacterium avium subsp. paratuberculosis
gccgguccggcggc

SEQ ID NO: 3021095 - RNA, 15 nt, Mycobacterium avium subsp. paratuberculosis
gccgguccggcggca

SEQ ID NO: 3021096 - RNA, 20 nt, Mycobacterium avium subsp. paratuberculosis
gccggcgaaacacagcagca

SEQ ID NO: 3021097 - RNA, 18 nt, Mycobacterium avium subsp. paratuberculosis
gccggcgaaccgccgcac

SEQ ID NO: 3021098 - RNA, 19 nt, Mycobacterium avium subsp. paratuberculosis
gccggcgaaccgccgcacc

SEQ ID NO: 3021099 - RNA, 16 nt, Mycobacterium avium subsp. paratuberculosis
gccggcgaacgacguc

SEQ ID NO: 3021100 - RNA, 17 nt, Mycobacterium avium subsp. paratuberculosis
gccggcgaacgacgucg

SEQ ID NO: 3021101 - RNA, 18 nt, Mycobacterium avium subsp. paratuberculosis
gccggcgaacgacgucga

SEQ ID NO: 3021102 - RNA, 11 nt, Mycobacterium avium subsp. paratuberculosis
gccggcgaacu

SEQ ID NO: 3021103 - RNA, 17 nt, Mycobacterium avium subsp. paratuberculosis
gccggcgaacucgcggc

SEQ ID NO: 3021104 - RNA, 18 nt, Mycobacterium avium subsp. paratuberculosis
gccggcgaacucgcggcg

SEQ ID NO: 3021105 - RNA, 22 nt, Mycobacterium avium subsp. paratuberculosis
gccggcgaacucgcggcggguc

SEQ ID NO: 3021106 - RNA, 17 nt, Mycobacterium avium subsp. paratuberculosis
gccggcgaagccgcuca

SEQ ID NO: 3021107 - RNA, 18 nt, Mycobacterium avium subsp. paratuberculosis
gccggcgaagcucgacga

SEQ ID NO: 3021108 - RNA, 19 nt, Mycobacterium avium subsp. paratuberculosis
gccggcgaagcucgacgau

SEQ ID NO: 3021109 - RNA, 19 nt, Mycobacterium avium subsp. paratuberculosis
gccggcgaaggacagccgg

SEQ ID NO: 3021110 - RNA, 22 nt, Mycobacterium avium subsp. paratuberculosis
gccggcgaaggacagccggacg

SEQ ID NO: 3021111 - RNA, 20 nt, Mycobacterium avium subsp. paratuberculosis
gccggcgaauguccuugacg

SEQ ID NO: 3021112 - RNA, 14 nt, Mycobacterium avium subsp. paratuberculosis
gccggcgaccagcc

SEQ ID NO: 3021113 - RNA, 22 nt, Mycobacterium avium subsp. paratuberculosis
gccggcgaccagccccucgacc

SEQ ID NO: 3021114 - RNA, 23 nt, Mycobacterium avium subsp. paratuberculosis
gccggcgaccagccccucgacca

SEQ ID NO: 3021115 - RNA, 19 nt, Mycobacterium avium subsp. paratuberculosis
gccggcgaccgccaccucg

SEQ ID NO: 3021116 - RNA, 16 nt, Mycobacterium avium subsp. paratuberculosis
gccggcgaccgccuug

SEQ ID NO: 3021117 - RNA, 22 nt, Mycobacterium avium subsp. paratuberculosis
gccggcgaccgccuugucggcg

SEQ ID NO: 3021118 - RNA, 23 nt, Mycobacterium avium subsp. paratuberculosis
gccggcgaccgccuugucggcga

SEQ ID NO: 3021119 - RNA, 20 nt, Mycobacterium avium subsp. paratuberculosis
gccggcgaccgugcccacca

SEQ ID NO: 3021120 - RNA, 15 nt, Mycobacterium avium subsp. paratuberculosis
gccggcgacgaccgc

SEQ ID NO: 3021121 - RNA, 16 nt, Mycobacterium avium subsp. paratuberculosis
gccggcgacgaccgca

SEQ ID NO: 3021122 - RNA, 18 nt, Mycobacterium avium subsp. paratuberculosis
gccggcgacgaccgcacc

SEQ ID NO: 3021123 - RNA, 22 nt, Mycobacterium avium subsp. paratuberculosis
gccggcgacgauaucggccgcg

SEQ ID NO: 3021124 - RNA, 16 nt, Mycobacterium avium subsp. paratuberculosis
gccggcgacgccgcgc

SEQ ID NO: 3021125 - RNA, 19 nt, Mycobacterium avium subsp. paratuberculosis
gccggcgacgccgcgcugg

SEQ ID NO: 3021126 - RNA, 14 nt, Mycobacterium avium subsp. paratuberculosis
gccggcgacgccgg

SEQ ID NO: 3021127 - RNA, 19 nt, Mycobacterium avium subsp. paratuberculosis
gccggcgacgccggcgagg

SEQ ID NO: 3021128 - RNA, 17 nt, Mycobacterium avium subsp. paratuberculosis
gccggcgacggccagcg

SEQ ID NO: 3021129 - RNA, 18 nt, Mycobacterium avium subsp. paratuberculosis
gccggcgacggccagcgc

SEQ ID NO: 3021130 - RNA, 22 nt, Mycobacterium avium subsp. paratuberculosis
gccggcgacggccagcgcggcg

SEQ ID NO: 3021131 - RNA, 13 nt, Mycobacterium avium subsp. paratuberculosis
gccggcgacggcg

SEQ ID NO: 3021132 - RNA, 17 nt, Mycobacterium avium subsp. paratuberculosis
gccggcgacggcgaguu

SEQ ID NO: 3021133 - RNA, 16 nt, Mycobacterium avium subsp. paratuberculosis
gccggcgacgguggcg

SEQ ID NO: 3021134 - RNA, 18 nt, Mycobacterium avium subsp. paratuberculosis
gccggcgacgguggcgcc

SEQ ID NO: 3021135 - RNA, 16 nt, Mycobacterium avium subsp. paratuberculosis
gccggcgagcgcgcug

SEQ ID NO: 3021136 - RNA, 16 nt, Mycobacterium avium subsp. paratuberculosis
gccggcgagcucgcgg

SEQ ID NO: 3021137 - RNA, 17 nt, Mycobacterium avium subsp. paratuberculosis
gccggcgagcucgcggc

SEQ ID NO: 3021138 - RNA, 19 nt, Mycobacterium avium subsp. paratuberculosis
gccggcgagcucgcggccg

SEQ ID NO: 3021139 - RNA, 20 nt, Mycobacterium avium subsp. paratuberculosis
gccggcgagcucgcggccgu

SEQ ID NO: 3021140 - RNA, 19 nt, Mycobacterium avium subsp. paratuberculosis
gccggcgaggcggucggcg

SEQ ID NO: 3021141 - RNA, 14 nt, Mycobacterium avium subsp. paratuberculosis
gccggcgagucgcg

SEQ ID NO: 3021142 - RNA, 17 nt, Mycobacterium avium subsp. paratuberculosis
gccggcgauaggcggcc

SEQ ID NO: 3021143 - RNA, 20 nt, Mycobacterium avium subsp. paratuberculosis
gccggcgauaggcggccagc

SEQ ID NO: 3021144 - RNA, 21 nt, Mycobacterium avium subsp. paratuberculosis
gccggcgauaggcggccagcu

SEQ ID NO: 3021145 - RNA, 12 nt, Mycobacterium avium subsp. paratuberculosis
gccggcgaucac

SEQ ID NO: 3021146 - RNA, 14 nt, Mycobacterium avium subsp. paratuberculosis
gccggcgauccgcg

SEQ ID NO: 3021147 - RNA, 16 nt, Mycobacterium avium subsp. paratuberculosis
gccggcgauccgcgcg

SEQ ID NO: 3021148 - RNA, 17 nt, Mycobacterium avium subsp. paratuberculosis
gccggcgauccgcgcgg

SEQ ID NO: 3021149 - RNA, 19 nt, Mycobacterium avium subsp. paratuberculosis
gccggcgauccgcgcggcg

SEQ ID NO: 3021150 - RNA, 23 nt, Mycobacterium avium subsp. paratuberculosis
gccggcgauccgcgcggcgacga

SEQ ID NO: 3021151 - RNA, 14 nt, Mycobacterium avium subsp. paratuberculosis
gccggcgaucgacg

SEQ ID NO: 3021152 - RNA, 15 nt, Mycobacterium avium subsp. paratuberculosis
gccggcgaucgacgu

SEQ ID NO: 3021153 - RNA, 16 nt, Mycobacterium avium subsp. paratuberculosis
gccggcgaucgacguc

SEQ ID NO: 3021154 - RNA, 17 nt, Mycobacterium avium subsp. paratuberculosis
gccggcgaucgacguca

SEQ ID NO: 3021155 - RNA, 15 nt, Mycobacterium avium subsp. paratuberculosis
gccggcgaucgucgc

SEQ ID NO: 3021156 - RNA, 17 nt, Mycobacterium avium subsp. paratuberculosis
gccggcgaucgucgccg

SEQ ID NO: 3021157 - RNA, 20 nt, Mycobacterium avium subsp. paratuberculosis
gccggcgaucucgucgcgca

SEQ ID NO: 3021158 - RNA, 22 nt, Mycobacterium avium subsp. paratuberculosis
gccggcgaucucgucgcgcagc

SEQ ID NO: 3021159 - RNA, 22 nt, Mycobacterium avium subsp. paratuberculosis
gccggcgaugaacacgccgaua

SEQ ID NO: 3021160 - RNA, 19 nt, Mycobacterium avium subsp. paratuberculosis
gccggcgaugcccgugauc

SEQ ID NO: 3021161 - RNA, 16 nt, Mycobacterium avium subsp. paratuberculosis
gccggcgaugcgcgcc

SEQ ID NO: 3021162 - RNA, 23 nt, Mycobacterium avium subsp. paratuberculosis
gccggcgaugcgcgccuccgacg

SEQ ID NO: 3021163 - RNA, 18 nt, Mycobacterium avium subsp. paratuberculosis
gccggcgauggcgcggcc

SEQ ID NO: 3021164 - RNA, 22 nt, Mycobacterium avium subsp. paratuberculosis
gccggcgauggcgcggccggcc

SEQ ID NO: 3021165 - RNA, 20 nt, Mycobacterium avium subsp. paratuberculosis
gccggcgcaacucguccagc

SEQ ID NO: 3021166 - RNA, 22 nt, Mycobacterium avium subsp. paratuberculosis
gccggcgcaacucguccagcgu

SEQ ID NO: 3021167 - RNA, 12 nt, Mycobacterium avium subsp. paratuberculosis
gccggcgcacca

SEQ ID NO: 3021168 - RNA, 12 nt, Mycobacterium avium subsp. paratuberculosis
gccggcgcaccc

SEQ ID NO: 3021169 - RNA, 14 nt, Mycobacterium avium subsp. paratuberculosis
gccggcgcacccgc

SEQ ID NO: 3021170 - RNA, 13 nt, Mycobacterium avium subsp. paratuberculosis
gccggcgcaccgc

SEQ ID NO: 3021171 - RNA, 15 nt, Mycobacterium avium subsp. paratuberculosis
gccggcgcaccgcgu

SEQ ID NO: 3021172 - RNA, 17 nt, Mycobacterium avium subsp. paratuberculosis
gccggcgcaccgcgucg

SEQ ID NO: 3021173 - RNA, 18 nt, Mycobacterium avium subsp. paratuberculosis
gccggcgcaccgcgucga

SEQ ID NO: 3021174 - RNA, 20 nt, Mycobacterium avium subsp. paratuberculosis
gccggcgcaccgcgucgacc

SEQ ID NO: 3021175 - RNA, 21 nt, Mycobacterium avium subsp. paratuberculosis
gccggcgcaccgcgucgacca

SEQ ID NO: 3021176 - RNA, 23 nt, Mycobacterium avium subsp. paratuberculosis
gccggcgcaccgcgucgaccacc

SEQ ID NO: 3021177 - RNA, 21 nt, Mycobacterium avium subsp. paratuberculosis
gccggcgcaccgcgucgaugc

SEQ ID NO: 3021178 - RNA, 16 nt, Mycobacterium avium subsp. paratuberculosis
gccggcgcacucccgc

SEQ ID NO: 3021179 - RNA, 18 nt, Mycobacterium avium subsp. paratuberculosis
gccggcgcacucccgcgu

SEQ ID NO: 3021180 - RNA, 19 nt, Mycobacterium avium subsp. paratuberculosis
gccugcggcaacagcacca

SEQ ID NO: 3021181 - RNA, 22 nt, Mycobacterium avium subsp. paratuberculosis
gccugcggcaacagcaccagca

SEQ ID NO: 3021182 - RNA, 22 nt, Mycobacterium avium subsp. paratuberculosis
gccugcggcagguaggcgccgc

SEQ ID NO: 3021183 - RNA, 21 nt, Mycobacterium avium subsp. paratuberculosis
gccugcggccugcacaggggc

SEQ ID NO: 3021184 - RNA, 15 nt, Mycobacterium avium subsp. paratuberculosis
gccugcggcgcggcc

SEQ ID NO: 3021185 - RNA, 22 nt, Mycobacterium avium subsp. paratuberculosis
gccugcggcgcggccaccccgg

SEQ ID NO: 3021186 - RNA, 12 nt, Mycobacterium avium subsp. paratuberculosis
gccugcggcggc

SEQ ID NO: 3021187 - RNA, 13 nt, Mycobacterium avium subsp. paratuberculosis
gccugcggcggca

SEQ ID NO: 3021188 - RNA, 18 nt, Mycobacterium avium subsp. paratuberculosis
gccugcggcggcaacggg

SEQ ID NO: 3021189 - RNA, 14 nt, Mycobacterium avium subsp. paratuberculosis
gccugcggcggccg

SEQ ID NO: 3021190 - RNA, 19 nt, Mycobacterium avium subsp. paratuberculosis
gccugcgggaaguugccca

SEQ ID NO: 3021191 - RNA, 19 nt, Mycobacterium avium subsp. paratuberculosis
gccugcgggacgccguuga

SEQ ID NO: 3021192 - RNA, 12 nt, Mycobacterium avium subsp. paratuberculosis
gccugcgggccc

SEQ ID NO: 3021193 - RNA, 13 nt, Mycobacterium avium subsp. paratuberculosis
gccugcgggccca

SEQ ID NO: 3021194 - RNA, 14 nt, Mycobacterium avium subsp. paratuberculosis
gccugcgggcccag

SEQ ID NO: 3021195 - RNA, 19 nt, Mycobacterium avium subsp. paratuberculosis
gccugcgggcccagcucgg

SEQ ID NO: 3021196 - RNA, 16 nt, Mycobacterium avium subsp. paratuberculosis
gccugcgggcgccggc

SEQ ID NO: 3021197 - RNA, 13 nt, Mycobacterium avium subsp. paratuberculosis
gccugcggugaug

SEQ ID NO: 3021198 - RNA, 15 nt, Mycobacterium avium subsp. paratuberculosis
gccugcggugaugcg

SEQ ID NO: 3021199 - RNA, 19 nt, Mycobacterium avium subsp. paratuberculosis
gccugcggugaugcgcggc

SEQ ID NO: 3021200 - RNA, 20 nt, Mycobacterium avium subsp. paratuberculosis
gccugcggugaugcgcggcg

SEQ ID NO: 3021201 - RNA, 16 nt, Mycobacterium avium subsp. paratuberculosis
gccugcuccagcgagu

SEQ ID NO: 3021202 - RNA, 23 nt, Mycobacterium avium subsp. paratuberculosis
gccugcuccagcgagucgaagcc

SEQ ID NO: 3021203 - RNA, 20 nt, Mycobacterium avium subsp. paratuberculosis
gccugcucgcagauggucgg

SEQ ID NO: 3021204 - RNA, 18 nt, Mycobacterium avium subsp. paratuberculosis
gccugcucgcuugccagc

SEQ ID NO: 3021205 - RNA, 22 nt, Mycobacterium avium subsp. paratuberculosis
gccugcucgcuugccagccggg

SEQ ID NO: 3021206 - RNA, 23 nt, Mycobacterium avium subsp. paratuberculosis
gccugcucgcuugccagccgggc

SEQ ID NO: 3021207 - RNA, 21 nt, Mycobacterium avium subsp. paratuberculosis
gccugcucgucggggcagccg

SEQ ID NO: 3021208 - RNA, 15 nt, Mycobacterium avium subsp. paratuberculosis
gccugcugcccaucc

SEQ ID NO: 3021209 - RNA, 23 nt, Mycobacterium avium subsp. paratuberculosis
gccugcuguuccucgaacaggcu

SEQ ID NO: 3021210 - RNA, 12 nt, Mycobacterium avium subsp. paratuberculosis
gccugcuucugg

SEQ ID NO: 3021211 - RNA, 18 nt, Mycobacterium avium subsp. paratuberculosis
gccugcuugaccgccaga

SEQ ID NO: 3021212 - RNA, 21 nt, Mycobacterium avium subsp. paratuberculosis
gccugcuugaugaugccggcc

SEQ ID NO: 3021213 - RNA, 19 nt, Mycobacterium avium subsp. paratuberculosis
gccugcuugggcagcagcu

SEQ ID NO: 3021214 - RNA, 20 nt, Mycobacterium avium subsp. paratuberculosis
gccugcuuggucgccugcac

SEQ ID NO: 3021215 - RNA, 17 nt, Mycobacterium avium subsp. paratuberculosis
gccugcuuuucggccga

SEQ ID NO: 3021216 - RNA, 19 nt, Mycobacterium avium subsp. paratuberculosis
gccuggaaaccccucagcc

SEQ ID NO: 3021217 - RNA, 20 nt, Mycobacterium avium subsp. paratuberculosis
gccuggaaaccccucagccg

SEQ ID NO: 3021218 - RNA, 21 nt, Mycobacterium avium subsp. paratuberculosis
gccuggaaaccccucagccgg

SEQ ID NO: 3021219 - RNA, 15 nt, Mycobacterium avium subsp. paratuberculosis
gccuggaaccggguc

SEQ ID NO: 3021220 - RNA, 21 nt, Mycobacterium avium subsp. paratuberculosis
gccuggacagggucguucagc

SEQ ID NO: 3021221 - RNA, 15 nt, Mycobacterium avium subsp. paratuberculosis
gccuggacgacgucg

SEQ ID NO: 3021222 - RNA, 16 nt, Mycobacterium avium subsp. paratuberculosis
gccuggaugccgcccu

SEQ ID NO: 3021223 - RNA, 18 nt, Mycobacterium avium subsp. paratuberculosis
gccuggcacgacgccgcc

SEQ ID NO: 3021224 - RNA, 12 nt, Mycobacterium avium subsp. paratuberculosis
gccuggccaccu

SEQ ID NO: 3021225 - RNA, 14 nt, Mycobacterium avium subsp. paratuberculosis
gccuggccaccucg

SEQ ID NO: 3021226 - RNA, 19 nt, Mycobacterium avium subsp. paratuberculosis
gccuggccaccucgacggc

SEQ ID NO: 3021227 - RNA, 12 nt, Mycobacterium avium subsp. paratuberculosis
gccuggccacgu

SEQ ID NO: 3021228 - RNA, 19 nt, Mycobacterium avium subsp. paratuberculosis
gccuggcccagacaggccg

SEQ ID NO: 3021229 - RNA, 21 nt, Mycobacterium avium subsp. paratuberculosis
gccuggcccagacaggccggc

SEQ ID NO: 3021230 - RNA, 17 nt, Mycobacterium avium subsp. paratuberculosis
gccuggcccagccgcgu

SEQ ID NO: 3021231 - RNA, 19 nt, Mycobacterium avium subsp. paratuberculosis
gccuggcccagccgcguca

SEQ ID NO: 3021232 - RNA, 13 nt, Mycobacterium avium subsp. paratuberculosis
gccuggccgucgc

SEQ ID NO: 3021233 - RNA, 13 nt, Mycobacterium avium subsp. paratuberculosis
gccuggcgaacuc

SEQ ID NO: 3021234 - RNA, 17 nt, Mycobacterium avium subsp. paratuberculosis
gccuggcgaacucgcgc

SEQ ID NO: 3021235 - RNA, 20 nt, Mycobacterium avium subsp. paratuberculosis
gccuggcgaacucgcgcaga

SEQ ID NO: 3021236 - RNA, 20 nt, Mycobacterium avium subsp. paratuberculosis
gccuggcgcagggcguucga

SEQ ID NO: 3021237 - RNA, 17 nt, Mycobacterium avium subsp. paratuberculosis
gccuggcgcuccagcca

SEQ ID NO: 3021238 - RNA, 19 nt, Mycobacterium avium subsp. paratuberculosis
gccuggcgcuccagccacu

SEQ ID NO: 3021239 - RNA, 19 nt, Mycobacterium avium subsp. paratuberculosis
gccuggcggaaggccgcgc

SEQ ID NO: 3021240 - RNA, 20 nt, Mycobacterium avium subsp. paratuberculosis
gccuggcggaaggccgcgcg

SEQ ID NO: 3021241 - RNA, 18 nt, Mycobacterium avium subsp. paratuberculosis
gccuggcggcgacccgga

SEQ ID NO: 3021242 - RNA, 15 nt, Mycobacterium avium subsp. paratuberculosis
gccuggcuccccggc

SEQ ID NO: 3021243 - RNA, 19 nt, Mycobacterium avium subsp. paratuberculosis
gccugggcaauggccgcga

SEQ ID NO: 3021244 - RNA, 21 nt, Mycobacterium avium subsp. paratuberculosis
gccugggcaauggccgcgacu

SEQ ID NO: 3021245 - RNA, 15 nt, Mycobacterium avium subsp. paratuberculosis
gccugggccucgucc

SEQ ID NO: 3021246 - RNA, 20 nt, Mycobacterium avium subsp. paratuberculosis
gccuggguacgaaccucguu

SEQ ID NO: 3021247 - RNA, 21 nt, Mycobacterium avium subsp. paratuberculosis
gccugggucaaaacaacgcgc

SEQ ID NO: 3021248 - RNA, 19 nt, Mycobacterium avium subsp. paratuberculosis
gccugggugcgcggcgccg

SEQ ID NO: 3021249 - RNA, 16 nt, Mycobacterium avium subsp. paratuberculosis
gccugguacagcaccg

SEQ ID NO: 3021250 - RNA, 20 nt, Mycobacterium avium subsp. paratuberculosis
gccugguacagcaccgccgc

SEQ ID NO: 3021251 - RNA, 21 nt, Mycobacterium avium subsp. paratuberculosis
gccugguacagcaccgccgcg

SEQ ID NO: 3021252 - RNA, 20 nt, Mycobacterium avium subsp. paratuberculosis
gccugguagcugagcagcag

SEQ ID NO: 3021253 - RNA, 21 nt, Mycobacterium avium subsp. paratuberculosis
gccugguagggguccuccagc

SEQ ID NO: 3021254 - RNA, 18 nt, Mycobacterium avium subsp. paratuberculosis
gccuggucaaggugcuga

SEQ ID NO: 3021255 - RNA, 14 nt, Mycobacterium avium subsp. paratuberculosis
gccugguccucccg

SEQ ID NO: 3021256 - RNA, 16 nt, Mycobacterium avium subsp. paratuberculosis
gccugguccucccggg

SEQ ID NO: 3021257 - RNA, 17 nt, Mycobacterium avium subsp. paratuberculosis
gccugguccucccgggu

SEQ ID NO: 3021258 - RNA, 20 nt, Mycobacterium avium subsp. paratuberculosis
gccugguccucccggguggg

SEQ ID NO: 3021259 - RNA, 22 nt, Mycobacterium avium subsp. paratuberculosis
gccugguccucccgggugggca

SEQ ID NO: 3021260 - RNA, 21 nt, Mycobacterium avium subsp. paratuberculosis
gccuggucgaacagcacgccg

SEQ ID NO: 3021261 - RNA, 22 nt, Mycobacterium avium subsp. paratuberculosis
gccuggucgaacagcacgccgg

SEQ ID NO: 3021262 - RNA, 15 nt, Mycobacterium avium subsp. paratuberculosis
gccuggucggccggc

SEQ ID NO: 3021263 - RNA, 16 nt, Mycobacterium avium subsp. paratuberculosis
gccuggucggccggca

SEQ ID NO: 3021264 - RNA, 13 nt, Mycobacterium avium subsp. paratuberculosis
gccuugucggcga

SEQ ID NO: 3021265 - RNA, 14 nt, Mycobacterium avium subsp. paratuberculosis
gccuugucguccuc

SEQ ID NO: 3021266 - RNA, 15 nt, Mycobacterium avium subsp. paratuberculosis
gccuugucgugucga

SEQ ID NO: 3021267 - RNA, 18 nt, Mycobacterium avium subsp. paratuberculosis
gccuuguggucgaucccg

SEQ ID NO: 3021268 - RNA, 18 nt, Mycobacterium avium subsp. paratuberculosis
gccuuuccgcgcggcggg

SEQ ID NO: 3021269 - RNA, 16 nt, Mycobacterium avium subsp. paratuberculosis
gcgaaaaccagcaccg

SEQ ID NO: 3021270 - RNA, 22 nt, Mycobacterium avium subsp. paratuberculosis
gcgaaaauaccgccggccgcgc

SEQ ID NO: 3021271 - RNA, 22 nt, Mycobacterium avium subsp. paratuberculosis
gcgaaaaucggugguguacuuc

SEQ ID NO: 3021272 - RNA, 16 nt, Mycobacterium avium subsp. paratuberculosis
gcgaaaauggcugccc

SEQ ID NO: 3021273 - RNA, 19 nt, Mycobacterium avium subsp. paratuberculosis
gcgaaaauggcugcccggc

SEQ ID NO: 3021274 - RNA, 22 nt, Mycobacterium avium subsp. paratuberculosis
gcgaaacaacgcaaugcgucgc

SEQ ID NO: 3021275 - RNA, 16 nt, Mycobacterium avium subsp. paratuberculosis
gcgaaacacagcagca

SEQ ID NO: 3021276 - RNA, 17 nt, Mycobacterium avium subsp. paratuberculosis
gcgaaacacagcagcac

SEQ ID NO: 3021277 - RNA, 18 nt, Mycobacterium avium subsp. paratuberculosis
gcgaaacacagcagcacg

SEQ ID NO: 3021278 - RNA, 21 nt, Mycobacterium avium subsp. paratuberculosis
gcgaaacacagcagcacgccc

SEQ ID NO: 3021279 - RNA, 19 nt, Mycobacterium avium subsp. paratuberculosis
gcgaaaccuccggagaucg

SEQ ID NO: 3021280 - RNA, 15 nt, Mycobacterium avium subsp. paratuberculosis
gcgaaacucaccgcg

SEQ ID NO: 3021281 - RNA, 12 nt, Mycobacterium avium subsp. paratuberculosis
gcgaaagcaccc

SEQ ID NO: 3021282 - RNA, 21 nt, Mycobacterium avium subsp. paratuberculosis
gcgaaagcccaggcccggcac

SEQ ID NO: 3021283 - RNA, 14 nt, Mycobacterium avium subsp. paratuberculosis
gcgaaagcgcgagg

SEQ ID NO: 3021284 - RNA, 23 nt, Mycobacterium avium subsp. paratuberculosis
gcgaaagcgcgagggcucaacag

SEQ ID NO: 3021285 - RNA, 17 nt, Mycobacterium avium subsp. paratuberculosis
gcgaaaggcccaccgcu

SEQ ID NO: 3021286 - RNA, 17 nt, Mycobacterium avium subsp. paratuberculosis
gcgaaauaacccacccc

SEQ ID NO: 3021287 - RNA, 17 nt, Mycobacterium avium subsp. paratuberculosis
gcgaaaucggugaagcc

SEQ ID NO: 3021288 - RNA, 22 nt, Mycobacterium avium subsp. paratuberculosis
gcgaacaauuccucugcgcgcc

SEQ ID NO: 3021289 - RNA, 23 nt, Mycobacterium avium subsp. paratuberculosis
gcgaacaauuccucugcgcgcca

SEQ ID NO: 3021290 - RNA, 13 nt, Mycobacterium avium subsp. paratuberculosis
gcgaacaccacgg

SEQ ID NO: 3021291 - RNA, 22 nt, Mycobacterium avium subsp. paratuberculosis
gcgaacaccacgguccccgcgc

SEQ ID NO: 3021292 - RNA, 23 nt, Mycobacterium avium subsp. paratuberculosis
gcgaacaccagaugccgcucggc

SEQ ID NO: 3021293 - RNA, 13 nt, Mycobacterium avium subsp. paratuberculosis
gcgaacaccagca

SEQ ID NO: 3021294 - RNA, 15 nt, Mycobacterium avium subsp. paratuberculosis
gcgaacaccagcacc

SEQ ID NO: 3021295 - RNA, 19 nt, Mycobacterium avium subsp. paratuberculosis
gcgaacaccagcacccagc

SEQ ID NO: 3021296 - RNA, 19 nt, Mycobacterium avium subsp. paratuberculosis
gcgaacaccagcccggccg

SEQ ID NO: 3021297 - RNA, 20 nt, Mycobacterium avium subsp. paratuberculosis
gcgaacaccagcccggccga

SEQ ID NO: 3021298 - RNA, 14 nt, Mycobacterium avium subsp. paratuberculosis
gcgaacaccucggc

SEQ ID NO: 3021299 - RNA, 15 nt, Mycobacterium avium subsp. paratuberculosis
gcgaacaccucggcg

SEQ ID NO: 3021300 - RNA, 17 nt, Mycobacterium avium subsp. paratuberculosis
gcgaacaccucggugau

SEQ ID NO: 3021301 - RNA, 15 nt, Mycobacterium avium subsp. paratuberculosis
gcgaacacgcgauga

SEQ ID NO: 3021302 - RNA, 15 nt, Mycobacterium avium subsp. paratuberculosis
gcgaacacgucggcc

SEQ ID NO: 3021303 - RNA, 21 nt, Mycobacterium avium subsp. paratuberculosis
gcgaacacgucggccagcgcg

SEQ ID NO: 3021304 - RNA, 16 nt, Mycobacterium avium subsp. paratuberculosis
gcgaacacgugcagcu

SEQ ID NO: 3021305 - RNA, 13 nt, Mycobacterium avium subsp. paratuberculosis
gcgaacagcacgu

SEQ ID NO: 3021306 - RNA, 12 nt, Mycobacterium avium subsp. paratuberculosis
gcgaacagcagc

SEQ ID NO: 3021307 - RNA, 18 nt, Mycobacterium avium subsp. paratuberculosis
gcgaacagcagcacccgg

SEQ ID NO: 3021308 - RNA, 14 nt, Mycobacterium avium subsp. paratuberculosis
gcgaacagccacgg

SEQ ID NO: 3021309 - RNA, 19 nt, Mycobacterium avium subsp. paratuberculosis
gcgaacagcgaagccacgg

SEQ ID NO: 3021310 - RNA, 13 nt, Mycobacterium avium subsp. paratuberculosis
gcgaacagcgccg

SEQ ID NO: 3021311 - RNA, 15 nt, Mycobacterium avium subsp. paratuberculosis
gcgaacagcgccgac

SEQ ID NO: 3021312 - RNA, 15 nt, Mycobacterium avium subsp. paratuberculosis
gcgaacagcgcggcc

SEQ ID NO: 3021313 - RNA, 19 nt, Mycobacterium avium subsp. paratuberculosis
gcgaacagcgcggccacca

SEQ ID NO: 3021314 - RNA, 21 nt, Mycobacterium avium subsp. paratuberculosis
gcgaacagcgcggccaccacg

SEQ ID NO: 3021315 - RNA, 11 nt, Mycobacterium avium subsp. paratuberculosis
gcgaacagcgg

SEQ ID NO: 3021316 - RNA, 19 nt, Mycobacterium avium subsp. paratuberculosis
gcgaacaggaugcggguga

SEQ ID NO: 3021317 - RNA, 14 nt, Mycobacterium avium subsp. paratuberculosis
gcgaacagguccuu

SEQ ID NO: 3021318 - RNA, 13 nt, Mycobacterium avium subsp. paratuberculosis
gcgaacagugcac

SEQ ID NO: 3021319 - RNA, 14 nt, Mycobacterium avium subsp. paratuberculosis
gcgaacaucgccag

SEQ ID NO: 3021320 - RNA, 18 nt, Mycobacterium avium subsp. paratuberculosis
gcgaacaucgccagcaac

SEQ ID NO: 3021321 - RNA, 20 nt, Mycobacterium avium subsp. paratuberculosis
gcgaacaucgccagcaacga

SEQ ID NO: 3021322 - RNA, 23 nt, Mycobacterium avium subsp. paratuberculosis
gcgaacaucuuggucagccgcgg

SEQ ID NO: 3021323 - RNA, 15 nt, Mycobacterium avium subsp. paratuberculosis
gcgaacauggcggcc

SEQ ID NO: 3021324 - RNA, 16 nt, Mycobacterium avium subsp. paratuberculosis
gcgaacauggcggcca

SEQ ID NO: 3021325 - RNA, 18 nt, Mycobacterium avium subsp. paratuberculosis
gcgaacauggcggccagc

SEQ ID NO: 3021326 - RNA, 17 nt, Mycobacterium avium subsp. paratuberculosis
gcgaacaugguggucga

SEQ ID NO: 3021327 - RNA, 22 nt, Mycobacterium avium subsp. paratuberculosis
gcgaacaugguggucgaacugg

SEQ ID NO: 3021328 - RNA, 11 nt, Mycobacterium avium subsp. paratuberculosis
gcgaaccacgg

SEQ ID NO: 3021329 - RNA, 18 nt, Mycobacterium avium subsp. paratuberculosis
gcgaaccagcaugcgcca

SEQ ID NO: 3021330 - RNA, 19 nt, Mycobacterium avium subsp. paratuberculosis
gcgaaccagcaugcgccag

SEQ ID NO: 3021331 - RNA, 23 nt, Mycobacterium avium subsp. paratuberculosis
gcgaaccagcaugcgccagagcg

SEQ ID NO: 3021332 - RNA, 14 nt, Mycobacterium avium subsp. paratuberculosis
gcgaaccagcgccc

SEQ ID NO: 3021333 - RNA, 16 nt, Mycobacterium avium subsp. paratuberculosis
gcgaaccagcgcccgc

SEQ ID NO: 3021334 - RNA, 19 nt, Mycobacterium avium subsp. paratuberculosis
gcgaaccagggcagccagc

SEQ ID NO: 3021335 - RNA, 12 nt, Mycobacterium avium subsp. paratuberculosis
gcgaacccacac

SEQ ID NO: 3021336 - RNA, 22 nt, Mycobacterium avium subsp. paratuberculosis
gcgaacccacacguugagcccg

SEQ ID NO: 3021337 - RNA, 14 nt, Mycobacterium avium subsp. paratuberculosis
gcgaacccgagcac

SEQ ID NO: 3021338 - RNA, 17 nt, Mycobacterium avium subsp. paratuberculosis
gcgaacccgagcacccc

SEQ ID NO: 3021339 - RNA, 15 nt, Mycobacterium avium subsp. paratuberculosis
gcgaaccgacauagg

SEQ ID NO: 3021340 - RNA, 18 nt, Mycobacterium avium subsp. paratuberculosis
gcgaaccgccgcacccag

SEQ ID NO: 3021341 - RNA, 17 nt, Mycobacterium avium subsp. paratuberculosis
gcgaaccgcggcggcag

SEQ ID NO: 3021342 - RNA, 21 nt, Mycobacterium avium subsp. paratuberculosis
gcgaaccgcggcggcagcagc

SEQ ID NO: 3021343 - RNA, 22 nt, Mycobacterium avium subsp. paratuberculosis
gcgaaccgggacagccgcgccg

SEQ ID NO: 3021344 - RNA, 14 nt, Mycobacterium avium subsp. paratuberculosis
gcgaaccgggccag

SEQ ID NO: 3021345 - RNA, 16 nt, Mycobacterium avium subsp. paratuberculosis
gcgaaccgggccagga

SEQ ID NO: 3021346 - RNA, 17 nt, Mycobacterium avium subsp. paratuberculosis
gcgaaccgggccaggau

SEQ ID NO: 3021347 - RNA, 22 nt, Mycobacterium avium subsp. paratuberculosis
gcgaaccgggccaggaugaccg

SEQ ID NO: 3021348 - RNA, 14 nt, Mycobacterium avium subsp. paratuberculosis
gcgaacgaccgggu

SEQ ID NO: 3021349 - RNA, 16 nt, Mycobacterium avium subsp. paratuberculosis
gcgaagguggcgucgg

SEQ ID NO: 3021350 - RNA, 22 nt, Mycobacterium avium subsp. paratuberculosis
gcgaaggugggcagcgccacca

SEQ ID NO: 3021351 - RNA, 21 nt, Mycobacterium avium subsp. paratuberculosis
gcgaaguagacgagcucaccg

SEQ ID NO: 3021352 - RNA, 20 nt, Mycobacterium avium subsp. paratuberculosis
gcgaaguagcgggcguuggc

SEQ ID NO: 3021353 - RNA, 21 nt, Mycobacterium avium subsp. paratuberculosis
gcgaagucaucaccggggauc

SEQ ID NO: 3021354 - RNA, 23 nt, Mycobacterium avium subsp. paratuberculosis
gcgaaguccgacgagucgacgcu

SEQ ID NO: 3021355 - RNA, 18 nt, Mycobacterium avium subsp. paratuberculosis
gcgaagucgccgcccggg

SEQ ID NO: 3021356 - RNA, 21 nt, Mycobacterium avium subsp. paratuberculosis
gcgaagucgccgcccgggccg

SEQ ID NO: 3021357 - RNA, 15 nt, Mycobacterium avium subsp. paratuberculosis
gcgaagucgccggcc

SEQ ID NO: 3021358 - RNA, 16 nt, Mycobacterium avium subsp. paratuberculosis
gcgaaguucggcaucc

SEQ ID NO: 3021359 - RNA, 16 nt, Mycobacterium avium subsp. paratuberculosis
gcgaaguugcgguuga

SEQ ID NO: 3021360 - RNA, 21 nt, Mycobacterium avium subsp. paratuberculosis
gcgaaguuggucaccaccaac

SEQ ID NO: 3021361 - RNA, 23 nt, Mycobacterium avium subsp. paratuberculosis
gcgaaguuggucaccaccaacgc

SEQ ID NO: 3021362 - RNA, 16 nt, Mycobacterium avium subsp. paratuberculosis
gcgaauaccagggcga

SEQ ID NO: 3021363 - RNA, 19 nt, Mycobacterium avium subsp. paratuberculosis
gcgaauaccagggcgagga

SEQ ID NO: 3021364 - RNA, 23 nt, Mycobacterium avium subsp. paratuberculosis
gcgaauaccaucaacccgagcac

SEQ ID NO: 3021365 - RNA, 14 nt, Mycobacterium avium subsp. paratuberculosis
gcgaauacccgccc

SEQ ID NO: 3021366 - RNA, 18 nt, Mycobacterium avium subsp. paratuberculosis
gcgaauauuucgccgauc

SEQ ID NO: 3021367 - RNA, 14 nt, Mycobacterium avium subsp. paratuberculosis
gcgaaucagcagcu

SEQ ID NO: 3021368 - RNA, 12 nt, Mycobacterium avium subsp. paratuberculosis
gcgaauccaagg

SEQ ID NO: 3021369 - RNA, 21 nt, Mycobacterium avium subsp. paratuberculosis
gccgucgguuucggucgcggu

SEQ ID NO: 3021370 - RNA, 17 nt, Mycobacterium avium subsp. paratuberculosis
gccgucguagccgcggg

SEQ ID NO: 3021371 - RNA, 19 nt, Mycobacterium avium subsp. paratuberculosis
gccgucguagccgcgggug

SEQ ID NO: 3021372 - RNA, 19 nt, Mycobacterium avium subsp. paratuberculosis
gccgucguauucgacggcg

SEQ ID NO: 3021373 - RNA, 23 nt, Mycobacterium avium subsp. paratuberculosis
gccgucguauucgacggcgacca

SEQ ID NO: 3021374 - RNA, 16 nt, Mycobacterium avium subsp. paratuberculosis
gccgucgucagccggg

SEQ ID NO: 3021375 - RNA, 18 nt, Mycobacterium avium subsp. paratuberculosis
gccgucgucagccgggcc

SEQ ID NO: 3021376 - RNA, 22 nt, Mycobacterium avium subsp. paratuberculosis
gccgucgucagccgggccagcc

SEQ ID NO: 3021377 - RNA, 13 nt, Mycobacterium avium subsp. paratuberculosis
gccgucgucgagg

SEQ ID NO: 3021378 - RNA, 12 nt, Mycobacterium avium subsp. paratuberculosis
gccgucgucguc

SEQ ID NO: 3021379 - RNA, 15 nt, Mycobacterium avium subsp. paratuberculosis
gccgucgucgucggc

SEQ ID NO: 3021380 - RNA, 17 nt, Mycobacterium avium subsp. paratuberculosis
gccgucgucgucggccg

SEQ ID NO: 3021381 - RNA, 21 nt, Mycobacterium avium subsp. paratuberculosis
gccgucgucgucggccgggcc

SEQ ID NO: 3021382 - RNA, 17 nt, Mycobacterium avium subsp. paratuberculosis
gccgucgucgugcacca

SEQ ID NO: 3021383 - RNA, 20 nt, Mycobacterium avium subsp. paratuberculosis
gccgucgucgugcaccacga

SEQ ID NO: 3021384 - RNA, 19 nt, Mycobacterium avium subsp. paratuberculosis
gccgucgugcucgagcauc

SEQ ID NO: 3021385 - RNA, 21 nt, Mycobacterium avium subsp. paratuberculosis
gccgucgugcucgagcaucuc

SEQ ID NO: 3021386 - RNA, 16 nt, Mycobacterium avium subsp. paratuberculosis
gccgucgugcucggcg

SEQ ID NO: 3021387 - RNA, 19 nt, Mycobacterium avium subsp. paratuberculosis
gccgucguggguauccgcc

SEQ ID NO: 3021388 - RNA, 21 nt, Mycobacterium avium subsp. paratuberculosis
gccgucguggguauccgccgc

SEQ ID NO: 3021389 - RNA, 22 nt, Mycobacterium avium subsp. paratuberculosis
gccgucguggguauccgccgcc

SEQ ID NO: 3021390 - RNA, 23 nt, Mycobacterium avium subsp. paratuberculosis
gccgucguggguauccgccgcca

SEQ ID NO: 3021391 - RNA, 16 nt, Mycobacterium avium subsp. paratuberculosis
gccgucgugguggccg

SEQ ID NO: 3021392 - RNA, 17 nt, Mycobacterium avium subsp. paratuberculosis
gccgucgugguggccgc

SEQ ID NO: 3021393 - RNA, 22 nt, Mycobacterium avium subsp. paratuberculosis
gccgucgugguggccgcgaaaa

SEQ ID NO: 3021394 - RNA, 22 nt, Mycobacterium avium subsp. paratuberculosis
gccgucguucuccauccgggcg

SEQ ID NO: 3021395 - RNA, 23 nt, Mycobacterium avium subsp. paratuberculosis
gccgucguucuccauccgggcgg

SEQ ID NO: 3021396 - RNA, 17 nt, Mycobacterium avium subsp. paratuberculosis
gccgucguugacgcccu

SEQ ID NO: 3021397 - RNA, 17 nt, Mycobacterium avium subsp. paratuberculosis
gccgucguugcgggcgg

SEQ ID NO: 3021398 - RNA, 20 nt, Mycobacterium avium subsp. paratuberculosis
gccgucguugcgggcggcgc

SEQ ID NO: 3021399 - RNA, 21 nt, Mycobacterium avium subsp. paratuberculosis
gccgucuccucgaccagcgcg

SEQ ID NO: 3021400 - RNA, 15 nt, Mycobacterium avium subsp. paratuberculosis
gccgucucgaccacc

SEQ ID NO: 3021401 - RNA, 18 nt, Mycobacterium avium subsp. paratuberculosis
gccgucucgaccacccgg

SEQ ID NO: 3021402 - RNA, 19 nt, Mycobacterium avium subsp. paratuberculosis
gccgucucgaccacccggc

SEQ ID NO: 3021403 - RNA, 18 nt, Mycobacterium avium subsp. paratuberculosis
gccgucucgacccgggcc

SEQ ID NO: 3021404 - RNA, 19 nt, Mycobacterium avium subsp. paratuberculosis
gccgucucgacccgggcca

SEQ ID NO: 3021405 - RNA, 20 nt, Mycobacterium avium subsp. paratuberculosis
gccgucucgacccgggccag

SEQ ID NO: 3021406 - RNA, 21 nt, Mycobacterium avium subsp. paratuberculosis
gccgucucgacccgggccagc

SEQ ID NO: 3021407 - RNA, 19 nt, Mycobacterium avium subsp. paratuberculosis
gccgucucgagccggcgca

SEQ ID NO: 3021408 - RNA, 20 nt, Mycobacterium avium subsp. paratuberculosis
gccgucucggagcggugucg

SEQ ID NO: 3021409 - RNA, 14 nt, Mycobacterium avium subsp. paratuberculosis
gccgucucgucggc

SEQ ID NO: 3021410 - RNA, 17 nt, Mycobacterium avium subsp. paratuberculosis
gccgucucgucggccgc

SEQ ID NO: 3021411 - RNA, 19 nt, Mycobacterium avium subsp. paratuberculosis
gccgucucgucggccgcga

SEQ ID NO: 3021412 - RNA, 21 nt, Mycobacterium avium subsp. paratuberculosis
gccgucucgucggccgcgacg

SEQ ID NO: 3021413 - RNA, 17 nt, Mycobacterium avium subsp. paratuberculosis
gccgucugguccaccgg

SEQ ID NO: 3021414 - RNA, 21 nt, Mycobacterium avium subsp. paratuberculosis
gccgucuucccagugccgcag

SEQ ID NO: 3021415 - RNA, 19 nt, Mycobacterium avium subsp. paratuberculosis
gccgucuuccgggccaccg

SEQ ID NO: 3021416 - RNA, 15 nt, Mycobacterium avium subsp. paratuberculosis
gccgucuugcccggc

SEQ ID NO: 3021417 - RNA, 17 nt, Mycobacterium avium subsp. paratuberculosis
gccgucuugcccggcga

SEQ ID NO: 3021418 - RNA, 22 nt, Mycobacterium avium subsp. paratuberculosis
gccgugaacugugcggugcggc

SEQ ID NO: 3021419 - RNA, 16 nt, Mycobacterium avium subsp. paratuberculosis
gccgugaagggcccgc

SEQ ID NO: 3021420 - RNA, 19 nt, Mycobacterium avium subsp. paratuberculosis
gccgugaagggcccgccgg

SEQ ID NO: 3021421 - RNA, 14 nt, Mycobacterium avium subsp. paratuberculosis
gccgugaccggcga

SEQ ID NO: 3021422 - RNA, 15 nt, Mycobacterium avium subsp. paratuberculosis
gccgugaccggcgau

SEQ ID NO: 3021423 - RNA, 16 nt, Mycobacterium avium subsp. paratuberculosis
gccgugacgccgaucc

SEQ ID NO: 3021424 - RNA, 14 nt, Mycobacterium avium subsp. paratuberculosis
gccgugagauccag

SEQ ID NO: 3021425 - RNA, 18 nt, Mycobacterium avium subsp. paratuberculosis
gccgugagauccagcagc

SEQ ID NO: 3021426 - RNA, 21 nt, Mycobacterium avium subsp. paratuberculosis
gccgugaguguugaagccgcg

SEQ ID NO: 3021427 - RNA, 22 nt, Mycobacterium avium subsp. paratuberculosis
gccgugaguguugaagccgcgg

SEQ ID NO: 3021428 - RNA, 23 nt, Mycobacterium avium subsp. paratuberculosis
gccgugaguguugaagccgcgga

SEQ ID NO: 3021429 - RNA, 13 nt, Mycobacterium avium subsp. paratuberculosis
gccgugaucggcc

SEQ ID NO: 3021430 - RNA, 19 nt, Mycobacterium avium subsp. paratuberculosis
gccgugaucggccagccac

SEQ ID NO: 3021431 - RNA, 23 nt, Mycobacterium avium subsp. paratuberculosis
gccgugaucucgugccgcacccg

SEQ ID NO: 3021432 - RNA, 13 nt, Mycobacterium avium subsp. paratuberculosis
gccgugaucuggu

SEQ ID NO: 3021433 - RNA, 15 nt, Mycobacterium avium subsp. paratuberculosis
gccgugaucuggugg

SEQ ID NO: 3021434 - RNA, 17 nt, Mycobacterium avium subsp. paratuberculosis
gccgugaucuucgugcu

SEQ ID NO: 3021435 - RNA, 15 nt, Mycobacterium avium subsp. paratuberculosis
gccgugaugccgggc

SEQ ID NO: 3021436 - RNA, 16 nt, Mycobacterium avium subsp. paratuberculosis
gccgugaugccgggca

SEQ ID NO: 3021437 - RNA, 23 nt, Mycobacterium avium subsp. paratuberculosis
gccgugaugcgcaagcaccggcu

SEQ ID NO: 3021438 - RNA, 13 nt, Mycobacterium avium subsp. paratuberculosis
gccgugaugcgcc

SEQ ID NO: 3021439 - RNA, 16 nt, Mycobacterium avium subsp. paratuberculosis
gccgugaugcgccggc

SEQ ID NO: 3021440 - RNA, 17 nt, Mycobacterium avium subsp. paratuberculosis
gccgugaugcgccggcg

SEQ ID NO: 3021441 - RNA, 19 nt, Mycobacterium avium subsp. paratuberculosis
gccgugaugggccgucagg

SEQ ID NO: 3021442 - RNA, 13 nt, Mycobacterium avium subsp. paratuberculosis
gccgugcaccguc

SEQ ID NO: 3021443 - RNA, 19 nt, Mycobacterium avium subsp. paratuberculosis
gccgugcaccgucgccggc

SEQ ID NO: 3021444 - RNA, 20 nt, Mycobacterium avium subsp. paratuberculosis
gccgugcaccgucgccggcg

SEQ ID NO: 3021445 - RNA, 16 nt, Mycobacterium avium subsp. paratuberculosis
gccgugcacgccgucg

SEQ ID NO: 3021446 - RNA, 19 nt, Mycobacterium avium subsp. paratuberculosis
gccgugcacgccgucgugc

SEQ ID NO: 3021447 - RNA, 23 nt, Mycobacterium avium subsp. paratuberculosis
gccgugcacgccgucgugcucgg

SEQ ID NO: 3021448 - RNA, 16 nt, Mycobacterium avium subsp. paratuberculosis
gccgugcagaacagca

SEQ ID NO: 3021449 - RNA, 18 nt, Mycobacterium avium subsp. paratuberculosis
gccgugcagaacagcacg

SEQ ID NO: 3021450 - RNA, 12 nt, Mycobacterium avium subsp. paratuberculosis
gccgugcagcac

SEQ ID NO: 3021451 - RNA, 14 nt, Mycobacterium avium subsp. paratuberculosis
gccgugcagcaccu

SEQ ID NO: 3021452 - RNA, 19 nt, Mycobacterium avium subsp. paratuberculosis
gccgugcagcaccucgaag

SEQ ID NO: 3021453 - RNA, 20 nt, Mycobacterium avium subsp. paratuberculosis
gccguucagcgcggccaccu

SEQ ID NO: 3021454 - RNA, 21 nt, Mycobacterium avium subsp. paratuberculosis
gccguucagcgggcgguugcc

SEQ ID NO: 3021455 - RNA, 14 nt, Mycobacterium avium subsp. paratuberculosis
gccguucaggucga

SEQ ID NO: 3021456 - RNA, 15 nt, Mycobacterium avium subsp. paratuberculosis
gccguuccagccggc

SEQ ID NO: 3021457 - RNA, 19 nt, Mycobacterium avium subsp. paratuberculosis
gccguuccagccggcccgc

SEQ ID NO: 3021458 - RNA, 23 nt, Mycobacterium avium subsp. paratuberculosis
gccguuccagggugucgacgaug

SEQ ID NO: 3021459 - RNA, 15 nt, Mycobacterium avium subsp. paratuberculosis
gccguuccaucgggc

SEQ ID NO: 3021460 - RNA, 15 nt, Mycobacterium avium subsp. paratuberculosis
gccguucccggcaga

SEQ ID NO: 3021461 - RNA, 19 nt, Mycobacterium avium subsp. paratuberculosis
gccguucccggcagaacga

SEQ ID NO: 3021462 - RNA, 14 nt, Mycobacterium avium subsp. paratuberculosis
gccguucgccggcc

SEQ ID NO: 3021463 - RNA, 17 nt, Mycobacterium avium subsp. paratuberculosis
gccguucgccggcgacg

SEQ ID NO: 3021464 - RNA, 19 nt, Mycobacterium avium subsp. paratuberculosis
gccguucgccggcgacggc

SEQ ID NO: 3021465 - RNA, 20 nt, Mycobacterium avium subsp. paratuberculosis
gccguucgccgguaccgccg

SEQ ID NO: 3021466 - RNA, 15 nt, Mycobacterium avium subsp. paratuberculosis
gccguucgcgcacgg

SEQ ID NO: 3021467 - RNA, 16 nt, Mycobacterium avium subsp. paratuberculosis
gccguucgcgcacggc

SEQ ID NO: 3021468 - RNA, 15 nt, Mycobacterium avium subsp. paratuberculosis
gccguucgcgccgag

SEQ ID NO: 3021469 - RNA, 19 nt, Mycobacterium avium subsp. paratuberculosis
gccguucgcgccguagcgg

SEQ ID NO: 3021470 - RNA, 19 nt, Mycobacterium avium subsp. paratuberculosis
gccguucgcugcccucggu

SEQ ID NO: 3021471 - RNA, 14 nt, Mycobacterium avium subsp. paratuberculosis
gccguucggccagc

SEQ ID NO: 3021472 - RNA, 17 nt, Mycobacterium avium subsp. paratuberculosis
gccguucggccagcgcc

SEQ ID NO: 3021473 - RNA, 21 nt, Mycobacterium avium subsp. paratuberculosis
gccguucggccagcgccgcca

SEQ ID NO: 3021474 - RNA, 20 nt, Mycobacterium avium subsp. paratuberculosis
gccguucguagggacugcgc

SEQ ID NO: 3021475 - RNA, 21 nt, Mycobacterium avium subsp. paratuberculosis
gccguucguagggacugcgcc

SEQ ID NO: 3021476 - RNA, 14 nt, Mycobacterium avium subsp. paratuberculosis
gccguucucgcgca

SEQ ID NO: 3021477 - RNA, 16 nt, Mycobacterium avium subsp. paratuberculosis
gccguucucgcgcagg

SEQ ID NO: 3021478 - RNA, 14 nt, Mycobacterium avium subsp. paratuberculosis
gccguucucguccu

SEQ ID NO: 3021479 - RNA, 20 nt, Mycobacterium avium subsp. paratuberculosis
gccguucucguccugggccg

SEQ ID NO: 3021480 - RNA, 21 nt, Mycobacterium avium subsp. paratuberculosis
gccguucucguccugggccgg

SEQ ID NO: 3021481 - RNA, 20 nt, Mycobacterium avium subsp. paratuberculosis
gccguucuucucacagguga

SEQ ID NO: 3021482 - RNA, 17 nt, Mycobacterium avium subsp. paratuberculosis
gccguucuugcggguga

SEQ ID NO: 3021483 - RNA, 19 nt, Mycobacterium avium subsp. paratuberculosis
gccguugaccccgacggcg

SEQ ID NO: 3021484 - RNA, 21 nt, Mycobacterium avium subsp. paratuberculosis
gccguugaccccgacggcgcc

SEQ ID NO: 3021485 - RNA, 16 nt, Mycobacterium avium subsp. paratuberculosis
gccguugaccgcggcg

SEQ ID NO: 3021486 - RNA, 16 nt, Mycobacterium avium subsp. paratuberculosis
gccguugaccggccgg

SEQ ID NO: 3021487 - RNA, 16 nt, Mycobacterium avium subsp. paratuberculosis
gccguugaccggugcg

SEQ ID NO: 3021488 - RNA, 17 nt, Mycobacterium avium subsp. paratuberculosis
gccguugaccggugcgc

SEQ ID NO: 3021489 - RNA, 21 nt, Mycobacterium avium subsp. paratuberculosis
gccguugaccggugcgcccgc

SEQ ID NO: 3021490 - RNA, 13 nt, Mycobacterium avium subsp. paratuberculosis
gccguugacggug

SEQ ID NO: 3021491 - RNA, 21 nt, Mycobacterium avium subsp. paratuberculosis
gccguugacuuugccguucca

SEQ ID NO: 3021492 - RNA, 15 nt, Mycobacterium avium subsp. paratuberculosis
gccguugagcgugga

SEQ ID NO: 3021493 - RNA, 23 nt, Mycobacterium avium subsp. paratuberculosis
gccguugagcguggacaccgcac

SEQ ID NO: 3021494 - RNA, 14 nt, Mycobacterium avium subsp. paratuberculosis
gccguugaucaggg

SEQ ID NO: 3021495 - RNA, 22 nt, Mycobacterium avium subsp. paratuberculosis
gccguugaucagggcggcgcgc

SEQ ID NO: 3021496 - RNA, 21 nt, Mycobacterium avium subsp. paratuberculosis
gccguugaucgagcaccgggc

SEQ ID NO: 3021497 - RNA, 18 nt, Mycobacterium avium subsp. paratuberculosis
gccguugaugcgcaccgc

SEQ ID NO: 3021498 - RNA, 18 nt, Mycobacterium avium subsp. paratuberculosis
gccguugauugaccaucc

SEQ ID NO: 3021499 - RNA, 18 nt, Mycobacterium avium subsp. paratuberculosis
gccguugauugcgcccgc

SEQ ID NO: 3021500 - RNA, 20 nt, Mycobacterium avium subsp. paratuberculosis
gccguugauugcgcccgccg

SEQ ID NO: 3021501 - RNA, 22 nt, Mycobacterium avium subsp. paratuberculosis
gccguugauugcgcccgccgaa

SEQ ID NO: 3021502 - RNA, 23 nt, Mycobacterium avium subsp. paratuberculosis
gccguugauugcgcccgccgaac

SEQ ID NO: 3021503 - RNA, 14 nt, Mycobacterium avium subsp. paratuberculosis
gccguugccaggcc

SEQ ID NO: 3021504 - RNA, 17 nt, Mycobacterium avium subsp. paratuberculosis
gccguugccaggccgcg

SEQ ID NO: 3021505 - RNA, 19 nt, Mycobacterium avium subsp. paratuberculosis
gccguugccaggccgcgag

SEQ ID NO: 3021506 - RNA, 20 nt, Mycobacterium avium subsp. paratuberculosis
gccguugccaggccgcgagc

SEQ ID NO: 3021507 - RNA, 12 nt, Mycobacterium avium subsp. paratuberculosis
gccguugccgcc

SEQ ID NO: 3021508 - RNA, 13 nt, Mycobacterium avium subsp. paratuberculosis
gccguugccgccg

SEQ ID NO: 3021509 - RNA, 15 nt, Mycobacterium avium subsp. paratuberculosis
gccguugccgccgcg

SEQ ID NO: 3021510 - RNA, 21 nt, Mycobacterium avium subsp. paratuberculosis
gccguugccgccgcgcgcggc

SEQ ID NO: 3021511 - RNA, 19 nt, Mycobacterium avium subsp. paratuberculosis
gccguugccggcccgcagc

SEQ ID NO: 3021512 - RNA, 20 nt, Mycobacterium avium subsp. paratuberculosis
gccguugccggcccgcagcg

SEQ ID NO: 3021513 - RNA, 14 nt, Mycobacterium avium subsp. paratuberculosis
gccguugcgccagc

SEQ ID NO: 3021514 - RNA, 13 nt, Mycobacterium avium subsp. paratuberculosis
gccguugcggccc

SEQ ID NO: 3021515 - RNA, 13 nt, Mycobacterium avium subsp. paratuberculosis
gccguugcgggug

SEQ ID NO: 3021516 - RNA, 21 nt, Mycobacterium avium subsp. paratuberculosis
gccguugcgggugucgccggu

SEQ ID NO: 3021517 - RNA, 12 nt, Mycobacterium avium subsp. paratuberculosis
gccguugcggug

SEQ ID NO: 3021518 - RNA, 17 nt, Mycobacterium avium subsp. paratuberculosis
gccguugcucucggccu

SEQ ID NO: 3021519 - RNA, 15 nt, Mycobacterium avium subsp. paratuberculosis
gccguuggccuggua

SEQ ID NO: 3021520 - RNA, 17 nt, Mycobacterium avium subsp. paratuberculosis
gccguugggcagcucgg

SEQ ID NO: 3021521 - RNA, 15 nt, Mycobacterium avium subsp. paratuberculosis
gccguugggccagcg

SEQ ID NO: 3021522 - RNA, 17 nt, Mycobacterium avium subsp. paratuberculosis
gccguugggccagcggc

SEQ ID NO: 3021523 - RNA, 18 nt, Mycobacterium avium subsp. paratuberculosis
gccguugggccagcggcg

SEQ ID NO: 3021524 - RNA, 21 nt, Mycobacterium avium subsp. paratuberculosis
gccguuggugacgcucacccg

SEQ ID NO: 3021525 - RNA, 22 nt, Mycobacterium avium subsp. paratuberculosis
gccguuggugacgcucacccgg

SEQ ID NO: 3021526 - RNA, 17 nt, Mycobacterium avium subsp. paratuberculosis
gccguuguaggccgcgc

SEQ ID NO: 3021527 - RNA, 21 nt, Mycobacterium avium subsp. paratuberculosis
gccguuguaggccgcgcggug

SEQ ID NO: 3021528 - RNA, 21 nt, Mycobacterium avium subsp. paratuberculosis
gccguugucgaagacggcgag

SEQ ID NO: 3021529 - RNA, 15 nt, Mycobacterium avium subsp. paratuberculosis
gccguuucagcagcg

SEQ ID NO: 3021530 - RNA, 18 nt, Mycobacterium avium subsp. paratuberculosis
gccguuugaugccguccg

SEQ ID NO: 3021531 - RNA, 16 nt, Mycobacterium avium subsp. paratuberculosis
gccguuuggcgccgcc

SEQ ID NO: 3021532 - RNA, 18 nt, Mycobacterium avium subsp. paratuberculosis
gccguuuggcgccgccca

SEQ ID NO: 3021533 - RNA, 16 nt, Mycobacterium avium subsp. paratuberculosis
gccguuuugccgccga

SEQ ID NO: 3021534 - RNA, 18 nt, Mycobacterium avium subsp. paratuberculosis
gccguuuugccgccgagc

SEQ ID NO: 3021535 - RNA, 17 nt, Mycobacterium avium subsp. paratuberculosis
gccuaauucguuguugg

SEQ ID NO: 3021536 - RNA, 23 nt, Mycobacterium avium subsp. paratuberculosis
gccuacacagcccccacgcucgg

SEQ ID NO: 3021537 - RNA, 21 nt, Mycobacterium avium subsp. paratuberculosis
gccuccggauggcggucgcgc

SEQ ID NO: 3021538 - RNA, 23 nt, Mycobacterium avium subsp. paratuberculosis
gccuccggauggcggucgcgcca

SEQ ID NO: 3021539 - RNA, 18 nt, Mycobacterium avium subsp. paratuberculosis
gccuccggcaguacgcgc

SEQ ID NO: 3021540 - RNA, 22 nt, Mycobacterium avium subsp. paratuberculosis
gccuccggcaguacgcgccggc

SEQ ID NO: 3021541 - RNA, 14 nt, Mycobacterium avium subsp. paratuberculosis
gccuccggcggcag

SEQ ID NO: 3021542 - RNA, 19 nt, Mycobacterium avium subsp. paratuberculosis
gccuccgggaaggcggccg

SEQ ID NO: 3021543 - RNA, 20 nt, Mycobacterium avium subsp. paratuberculosis
gccuccgggaaggcggccgc

SEQ ID NO: 3021544 - RNA, 15 nt, Mycobacterium avium subsp. paratuberculosis
gccuccgggcugccg

SEQ ID NO: 3021545 - RNA, 19 nt, Mycobacterium avium subsp. paratuberculosis
gccuccgguuugcgccggc

SEQ ID NO: 3021546 - RNA, 20 nt, Mycobacterium avium subsp. paratuberculosis
gccuccgguuugcgccggcu

SEQ ID NO: 3021547 - RNA, 15 nt, Mycobacterium avium subsp. paratuberculosis
gccuccgucagcgcc

SEQ ID NO: 3021548 - RNA, 16 nt, Mycobacterium avium subsp. paratuberculosis
gccuccgucagcgccg

SEQ ID NO: 3021549 - RNA, 18 nt, Mycobacterium avium subsp. paratuberculosis
gccuccgucagcgccgcc

SEQ ID NO: 3021550 - RNA, 19 nt, Mycobacterium avium subsp. paratuberculosis
gccuccgucagcgccgccc

SEQ ID NO: 3021551 - RNA, 15 nt, Mycobacterium avium subsp. paratuberculosis
gccuccgugcuggcc

SEQ ID NO: 3021552 - RNA, 16 nt, Mycobacterium avium subsp. paratuberculosis
gccuccgugcuggccg

SEQ ID NO: 3021553 - RNA, 17 nt, Mycobacterium avium subsp. paratuberculosis
gccuccgugcuggccgg

SEQ ID NO: 3021554 - RNA, 13 nt, Mycobacterium avium subsp. paratuberculosis
gccuccuccucgc

SEQ ID NO: 3021555 - RNA, 18 nt, Mycobacterium avium subsp. paratuberculosis
gccuccuccucgcugccg

SEQ ID NO: 3021556 - RNA, 20 nt, Mycobacterium avium subsp. paratuberculosis
gccuccuccucgcugccggc

SEQ ID NO: 3021557 - RNA, 23 nt, Mycobacterium avium subsp. paratuberculosis
gccuccuccucgcugccggccgg

SEQ ID NO: 3021558 - RNA, 15 nt, Mycobacterium avium subsp. paratuberculosis
gccuccucgaugucg

SEQ ID NO: 3021559 - RNA, 16 nt, Mycobacterium avium subsp. paratuberculosis
gccuccucgaugucgg

SEQ ID NO: 3021560 - RNA, 17 nt, Mycobacterium avium subsp. paratuberculosis
gccuccucggugaccuc

SEQ ID NO: 3021561 - RNA, 14 nt, Mycobacterium avium subsp. paratuberculosis
gccuccucggugag

SEQ ID NO: 3021562 - RNA, 19 nt, Mycobacterium avium subsp. paratuberculosis
gccuccugcuggcgcugcc

SEQ ID NO: 3021563 - RNA, 17 nt, Mycobacterium avium subsp. paratuberculosis
gccuccuguuggcccug

SEQ ID NO: 3021564 - RNA, 18 nt, Mycobacterium avium subsp. paratuberculosis
gccucgaacaucggcacg

SEQ ID NO: 3021565 - RNA, 19 nt, Mycobacterium avium subsp. paratuberculosis
gccucgaacaucggcacgu

SEQ ID NO: 3021566 - RNA, 14 nt, Mycobacterium avium subsp. paratuberculosis
gccucgaaggcgcc

SEQ ID NO: 3021567 - RNA, 16 nt, Mycobacterium avium subsp. paratuberculosis
gccucgaagucgccgg

SEQ ID NO: 3021568 - RNA, 14 nt, Mycobacterium avium subsp. paratuberculosis
gccucgaccaggcu

SEQ ID NO: 3021569 - RNA, 22 nt, Mycobacterium avium subsp. paratuberculosis
gccucgaccaggcuuggcccgc

SEQ ID NO: 3021570 - RNA, 22 nt, Mycobacterium avium subsp. paratuberculosis
gccucgacggugaccucgucgg

SEQ ID NO: 3021571 - RNA, 23 nt, Mycobacterium avium subsp. paratuberculosis
gccucgacggugaccucgucggg

SEQ ID NO: 3021572 - RNA, 15 nt, Mycobacterium avium subsp. paratuberculosis
gccucgagcaacggc

SEQ ID NO: 3021573 - RNA, 19 nt, Mycobacterium avium subsp. paratuberculosis
gccucgagcaacggccgca

SEQ ID NO: 3021574 - RNA, 21 nt, Mycobacterium avium subsp. paratuberculosis
gccucgagcaacggccgcagc

SEQ ID NO: 3021575 - RNA, 22 nt, Mycobacterium avium subsp. paratuberculosis
gccucgagcaacggccgcagcg

SEQ ID NO: 3021576 - RNA, 21 nt, Mycobacterium avium subsp. paratuberculosis
gccucgagcaccacggcccgc

SEQ ID NO: 3021577 - RNA, 15 nt, Mycobacterium avium subsp. paratuberculosis
gccucgagcgcccgg

SEQ ID NO: 3021578 - RNA, 16 nt, Mycobacterium avium subsp. paratuberculosis
gccucgagcgcccggg

SEQ ID NO: 3021579 - RNA, 18 nt, Mycobacterium avium subsp. paratuberculosis
gccucgaggaucgcggcc

SEQ ID NO: 3021580 - RNA, 19 nt, Mycobacterium avium subsp. paratuberculosis
gccucgaggaucgcggcca

SEQ ID NO: 3021581 - RNA, 21 nt, Mycobacterium avium subsp. paratuberculosis
gccucgaggaucgcggccacg

SEQ ID NO: 3021582 - RNA, 17 nt, Mycobacterium avium subsp. paratuberculosis
gccucgaucaacgccgg

SEQ ID NO: 3021583 - RNA, 18 nt, Mycobacterium avium subsp. paratuberculosis
gccucgaucaacgccggg

SEQ ID NO: 3021584 - RNA, 13 nt, Mycobacterium avium subsp. paratuberculosis
gccucgaucagag

SEQ ID NO: 3021585 - RNA, 16 nt, Mycobacterium avium subsp. paratuberculosis
gccucgaucagagcgg

SEQ ID NO: 3021586 - RNA, 19 nt, Mycobacterium avium subsp. paratuberculosis
gccucgaucagagcgggcc

SEQ ID NO: 3021587 - RNA, 15 nt, Mycobacterium avium subsp. paratuberculosis
gccucgaucagcgcg

SEQ ID NO: 3021588 - RNA, 16 nt, Mycobacterium avium subsp. paratuberculosis
gccucgaucagcgcga

SEQ ID NO: 3021589 - RNA, 19 nt, Mycobacterium avium subsp. paratuberculosis
gccucgaucaucaccaccg

SEQ ID NO: 3021590 - RNA, 22 nt, Mycobacterium avium subsp. paratuberculosis
gccucgaucaucaccaccgccg

SEQ ID NO: 3021591 - RNA, 22 nt, Mycobacterium avium subsp. paratuberculosis
gccucgaucugguucaccgcca

SEQ ID NO: 3021592 - RNA, 19 nt, Mycobacterium avium subsp. paratuberculosis
gccucgaugcggccgucgg

SEQ ID NO: 3021593 - RNA, 21 nt, Mycobacterium avium subsp. paratuberculosis
gccucgauggcccgcucgguc

SEQ ID NO: 3021594 - RNA, 19 nt, Mycobacterium avium subsp. paratuberculosis
gccucgccacugggcgucg

SEQ ID NO: 3021595 - RNA, 21 nt, Mycobacterium avium subsp. paratuberculosis
gccucgccacugggcgucggc

SEQ ID NO: 3021596 - RNA, 14 nt, Mycobacterium avium subsp. paratuberculosis
gccucgccagcccc

SEQ ID NO: 3021597 - RNA, 15 nt, Mycobacterium avium subsp. paratuberculosis
gccucgccagcccca

SEQ ID NO: 3021598 - RNA, 21 nt, Mycobacterium avium subsp. paratuberculosis
gccucgccagccccaccggcc

SEQ ID NO: 3021599 - RNA, 14 nt, Mycobacterium avium subsp. paratuberculosis
gccucgcccagcgc

SEQ ID NO: 3021600 - RNA, 16 nt, Mycobacterium avium subsp. paratuberculosis
gccucgcccagcgccg

SEQ ID NO: 3021601 - RNA, 17 nt, Mycobacterium avium subsp. paratuberculosis
gccucgcccagcgccgc

SEQ ID NO: 3021602 - RNA, 20 nt, Mycobacterium avium subsp. paratuberculosis
gccucgcccagcgccgcggc

SEQ ID NO: 3021603 - RNA, 21 nt, Mycobacterium avium subsp. paratuberculosis
gccucgcccagcgccgcggcg

SEQ ID NO: 3021604 - RNA, 22 nt, Mycobacterium avium subsp. paratuberculosis
gccucgcccagcgccgcggcga

SEQ ID NO: 3021605 - RNA, 15 nt, Mycobacterium avium subsp. paratuberculosis
gccucgcccucggug

SEQ ID NO: 3021606 - RNA, 17 nt, Mycobacterium avium subsp. paratuberculosis
gccucgccgaccuuggc

SEQ ID NO: 3021607 - RNA, 13 nt, Mycobacterium avium subsp. paratuberculosis
gccucgccggcgc

SEQ ID NO: 3021608 - RNA, 15 nt, Mycobacterium avium subsp. paratuberculosis
gccucgccgggcccg

SEQ ID NO: 3021609 - RNA, 21 nt, Mycobacterium avium subsp. paratuberculosis
gccucgccguugccggcccgc

SEQ ID NO: 3021610 - RNA, 17 nt, Mycobacterium avium subsp. paratuberculosis
gccucgccuacacagcc

SEQ ID NO: 3021611 - RNA, 18 nt, Mycobacterium avium subsp. paratuberculosis
gccucgcgcaaugccgcc

SEQ ID NO: 3021612 - RNA, 20 nt, Mycobacterium avium subsp. paratuberculosis
gccucgcgcaaugccgccgc

SEQ ID NO: 3021613 - RNA, 21 nt, Mycobacterium avium subsp. paratuberculosis
gccucgcgcaaugccgccgcg

SEQ ID NO: 3021614 - RNA, 16 nt, Mycobacterium avium subsp. paratuberculosis
gccucgcgcagcgcgu

SEQ ID NO: 3021615 - RNA, 19 nt, Mycobacterium avium subsp. paratuberculosis
gccucgcuaaucgccgcgc

SEQ ID NO: 3021616 - RNA, 20 nt, Mycobacterium avium subsp. paratuberculosis
gccucgcuaaucgccgcgcg

SEQ ID NO: 3021617 - RNA, 21 nt, Mycobacterium avium subsp. paratuberculosis
gccucgcuaaucgccgcgcgu

SEQ ID NO: 3021618 - RNA, 18 nt, Mycobacterium avium subsp. paratuberculosis
gccucggaggccaccgcg

SEQ ID NO: 3021619 - RNA, 20 nt, Mycobacterium avium subsp. paratuberculosis
gccucggaggccaccgcgcc

SEQ ID NO: 3021620 - RNA, 21 nt, Mycobacterium avium subsp. paratuberculosis
gccucggaggccaccgcgccg

SEQ ID NO: 3021621 - RNA, 21 nt, Mycobacterium avium subsp. paratuberculosis
gccucguugaccgggucgccg

SEQ ID NO: 3021622 - RNA, 15 nt, Mycobacterium avium subsp. paratuberculosis
gccucguuggccagc

SEQ ID NO: 3021623 - RNA, 16 nt, Mycobacterium avium subsp. paratuberculosis
gccucguuggccagcu

SEQ ID NO: 3021624 - RNA, 20 nt, Mycobacterium avium subsp. paratuberculosis
gccucguuggccagcucggc

SEQ ID NO: 3021625 - RNA, 12 nt, Mycobacterium avium subsp. paratuberculosis
gccucucgucga

SEQ ID NO: 3021626 - RNA, 14 nt, Mycobacterium avium subsp. paratuberculosis
gccucucgucgacg

SEQ ID NO: 3021627 - RNA, 14 nt, Mycobacterium avium subsp. paratuberculosis
gccucuucggcgcg

SEQ ID NO: 3021628 - RNA, 19 nt, Mycobacterium avium subsp. paratuberculosis
gccucuucggcgcgccggc

SEQ ID NO: 3021629 - RNA, 14 nt, Mycobacterium avium subsp. paratuberculosis
gccucuucgucggc

SEQ ID NO: 3021630 - RNA, 13 nt, Mycobacterium avium subsp. paratuberculosis
gccugaaccagcu

SEQ ID NO: 3021631 - RNA, 14 nt, Mycobacterium avium subsp. paratuberculosis
gccugaaccagcuc

SEQ ID NO: 3021632 - RNA, 22 nt, Mycobacterium avium subsp. paratuberculosis
gccugaccaaggacaagcuggu

SEQ ID NO: 3021633 - RNA, 15 nt, Mycobacterium avium subsp. paratuberculosis
gccugacccggccgu

SEQ ID NO: 3021634 - RNA, 19 nt, Mycobacterium avium subsp. paratuberculosis
gccugacccggccgugcgc

SEQ ID NO: 3021635 - RNA, 15 nt, Mycobacterium avium subsp. paratuberculosis
gccugaccgcgggug

SEQ ID NO: 3021636 - RNA, 17 nt, Mycobacterium avium subsp. paratuberculosis
gccugacuaagucacca

SEQ ID NO: 3021637 - RNA, 21 nt, Mycobacterium avium subsp. paratuberculosis
gccugacuucugaaccgaagg

SEQ ID NO: 3021638 - RNA, 22 nt, Mycobacterium avium subsp. paratuberculosis
gccugacuucugaaccgaaggg

SEQ ID NO: 3021639 - RNA, 13 nt, Mycobacterium avium subsp. paratuberculosis
gccggucgacgcg

SEQ ID NO: 3021640 - RNA, 17 nt, Mycobacterium avium subsp. paratuberculosis
gccggucgaggucgccg

SEQ ID NO: 3021641 - RNA, 18 nt, Mycobacterium avium subsp. paratuberculosis
gccggucgaggucgccga

SEQ ID NO: 3021642 - RNA, 19 nt, Mycobacterium avium subsp. paratuberculosis
gccggucgaggucgccgac

SEQ ID NO: 3021643 - RNA, 17 nt, Mycobacterium avium subsp. paratuberculosis
gccggucgaugucggcg

SEQ ID NO: 3021644 - RNA, 20 nt, Mycobacterium avium subsp. paratuberculosis
gccggucgaugucggcgaac

SEQ ID NO: 3021645 - RNA, 18 nt, Mycobacterium avium subsp. paratuberculosis
gccggucgcccccucggc

SEQ ID NO: 3021646 - RNA, 21 nt, Mycobacterium avium subsp. paratuberculosis
gccggucgcccccucggccgg

SEQ ID NO: 3021647 - RNA, 23 nt, Mycobacterium avium subsp. paratuberculosis
gccggucgcccccucggccgguc

SEQ ID NO: 3021648 - RNA, 14 nt, Mycobacterium avium subsp. paratuberculosis
gccggucgccgaug

SEQ ID NO: 3021649 - RNA, 21 nt, Mycobacterium avium subsp. paratuberculosis
gccggucgccgggccggccgg

SEQ ID NO: 3021650 - RNA, 12 nt, Mycobacterium avium subsp. paratuberculosis
gccggucgcgca

SEQ ID NO: 3021651 - RNA, 14 nt, Mycobacterium avium subsp. paratuberculosis
gccggucgcgcauc

SEQ ID NO: 3021652 - RNA, 22 nt, Mycobacterium avium subsp. paratuberculosis
gccggucgcgcaucgccucggc

SEQ ID NO: 3021653 - RNA, 23 nt, Mycobacterium avium subsp. paratuberculosis
gccggucgcgcaucgccucggcg

SEQ ID NO: 3021654 - RNA, 14 nt, Mycobacterium avium subsp. paratuberculosis
gccggucggcggaa

SEQ ID NO: 3021655 - RNA, 13 nt, Mycobacterium avium subsp. paratuberculosis
gccggucgggauc

SEQ ID NO: 3021656 - RNA, 16 nt, Mycobacterium avium subsp. paratuberculosis
gccggucgggauggcg

SEQ ID NO: 3021657 - RNA, 17 nt, Mycobacterium avium subsp. paratuberculosis
gccggucggucagucgc

SEQ ID NO: 3021658 - RNA, 19 nt, Mycobacterium avium subsp. paratuberculosis
gccggucggucagucgcgc

SEQ ID NO: 3021659 - RNA, 22 nt, Mycobacterium avium subsp. paratuberculosis
gccggucggucagucgcgccgc

SEQ ID NO: 3021660 - RNA, 14 nt, Mycobacterium avium subsp. paratuberculosis
gccggucggucggc

SEQ ID NO: 3021661 - RNA, 15 nt, Mycobacterium avium subsp. paratuberculosis
gccggucggucggcc

SEQ ID NO: 3021662 - RNA, 18 nt, Mycobacterium avium subsp. paratuberculosis
gccggucggucggccgca

SEQ ID NO: 3021663 - RNA, 20 nt, Mycobacterium avium subsp. paratuberculosis
gccggucggucggccgcacg

SEQ ID NO: 3021664 - RNA, 21 nt, Mycobacterium avium subsp. paratuberculosis
gccggucggucggccgcacgu

SEQ ID NO: 3021665 - RNA, 19 nt, Mycobacterium avium subsp. paratuberculosis
gccggucgucggggcaucg

SEQ ID NO: 3021666 - RNA, 21 nt, Mycobacterium avium subsp. paratuberculosis
gccggucgugcgacuccuggg

SEQ ID NO: 3021667 - RNA, 22 nt, Mycobacterium avium subsp. paratuberculosis
gccggucuccaugucgucggcg

SEQ ID NO: 3021668 - RNA, 23 nt, Mycobacterium avium subsp. paratuberculosis
gccggucucgaaacggaugggcg

SEQ ID NO: 3021669 - RNA, 20 nt, Mycobacterium avium subsp. paratuberculosis
gccggucugggcgaccaugc

SEQ ID NO: 3021670 - RNA, 24 nt, Mycobacterium avium subsp. paratuberculosis
gccggucugggcgaccaugccgcg

SEQ ID NO: 3021671 - RNA, 22 nt, Mycobacterium avium subsp. paratuberculosis
gccggucugguacccgauggug

SEQ ID NO: 3021672 - RNA, 17 nt, Mycobacterium avium subsp. paratuberculosis
gccggucuuggacagca

SEQ ID NO: 3021673 - RNA, 23 nt, Mycobacterium avium subsp. paratuberculosis
gccggucuuggacagcagcagcu

SEQ ID NO: 3021674 - RNA, 20 nt, Mycobacterium avium subsp. paratuberculosis
gccggucuugggcucggcgc

SEQ ID NO: 3021675 - RNA, 20 nt, Mycobacterium avium subsp. paratuberculosis
gccggucuuguagucgacca

SEQ ID NO: 3021676 - RNA, 16 nt, Mycobacterium avium subsp. paratuberculosis
gccggugaaaccggcg

SEQ ID NO: 3021677 - RNA, 19 nt, Mycobacterium avium subsp. paratuberculosis
gccggugaaaccggcgccg

SEQ ID NO: 3021678 - RNA, 20 nt, Mycobacterium avium subsp. paratuberculosis
gccggugaaaccggcgccga

SEQ ID NO: 3021679 - RNA, 23 nt, Mycobacterium avium subsp. paratuberculosis
gccggugaaaccggcgccgaagc

SEQ ID NO: 3021680 - RNA, 19 nt, Mycobacterium avium subsp. paratuberculosis
gccggugaacacgaacggc

SEQ ID NO: 3021681 - RNA, 19 nt, Mycobacterium avium subsp. paratuberculosis
gccggugaagaucagcgcg

SEQ ID NO: 3021682 - RNA, 20 nt, Mycobacterium avium subsp. paratuberculosis
gccggugaagaucagcgcgu

SEQ ID NO: 3021683 - RNA, 19 nt, Mycobacterium avium subsp. paratuberculosis
gccggugaagaucgcccgc

SEQ ID NO: 3021684 - RNA, 20 nt, Mycobacterium avium subsp. paratuberculosis
gccggugaagaucgcccgcc

SEQ ID NO: 3021685 - RNA, 22 nt, Mycobacterium avium subsp. paratuberculosis
gccggugaagaucgcccgccgc

SEQ ID NO: 3021686 - RNA, 14 nt, Mycobacterium avium subsp. paratuberculosis
gccggugaccacgc

SEQ ID NO: 3021687 - RNA, 13 nt, Mycobacterium avium subsp. paratuberculosis
gccggugaccgcg

SEQ ID NO: 3021688 - RNA, 19 nt, Mycobacterium avium subsp. paratuberculosis
gccggugaccugcagcgcc

SEQ ID NO: 3021689 - RNA, 23 nt, Mycobacterium avium subsp. paratuberculosis
gccggugaccugcagcgccuugg

SEQ ID NO: 3021690 - RNA, 13 nt, Mycobacterium avium subsp. paratuberculosis
gccggugacgguc

SEQ ID NO: 3021691 - RNA, 14 nt, Mycobacterium avium subsp. paratuberculosis
gccggugacgguca

SEQ ID NO: 3021692 - RNA, 22 nt, Mycobacterium avium subsp. paratuberculosis
gccggugacggucaggguguug

SEQ ID NO: 3021693 - RNA, 19 nt, Mycobacterium avium subsp. paratuberculosis
gccggugacuccuccucgg

SEQ ID NO: 3021694 - RNA, 19 nt, Mycobacterium avium subsp. paratuberculosis
gccggugagcacgaccgcc

SEQ ID NO: 3021695 - RNA, 19 nt, Mycobacterium avium subsp. paratuberculosis
gccggugauccacuccagc

SEQ ID NO: 3021696 - RNA, 15 nt, Mycobacterium avium subsp. paratuberculosis
gccggugaucgcggc

SEQ ID NO: 3021697 - RNA, 19 nt, Mycobacterium avium subsp. paratuberculosis
gccggugaucgcggcgcug

SEQ ID NO: 3021698 - RNA, 16 nt, Mycobacterium avium subsp. paratuberculosis
gccggugaucggucug

SEQ ID NO: 3021699 - RNA, 23 nt, Mycobacterium avium subsp. paratuberculosis
gccggugaucucccgugcggucc

SEQ ID NO: 3021700 - RNA, 11 nt, Mycobacterium avium subsp. paratuberculosis
gccggugauga

SEQ ID NO: 3021701 - RNA, 23 nt, Mycobacterium avium subsp. paratuberculosis
gccggugaugaacgcgccgucgu

SEQ ID NO: 3021702 - RNA, 17 nt, Mycobacterium avium subsp. paratuberculosis
gccggugaugacgucgc

SEQ ID NO: 3021703 - RNA, 19 nt, Mycobacterium avium subsp. paratuberculosis
gccggugaugacgucgccc

SEQ ID NO: 3021704 - RNA, 20 nt, Mycobacterium avium subsp. paratuberculosis
gccggugaugacgucgccca

SEQ ID NO: 3021705 - RNA, 23 nt, Mycobacterium avium subsp. paratuberculosis
gccggugaugacgucgcccaccc

SEQ ID NO: 3021706 - RNA, 20 nt, Mycobacterium avium subsp. paratuberculosis
gccggugauggugaucucgc

SEQ ID NO: 3021707 - RNA, 23 nt, Mycobacterium avium subsp. paratuberculosis
gccggugauggugaucucgccgc

SEQ ID NO: 3021708 - RNA, 15 nt, Mycobacterium avium subsp. paratuberculosis
gccggugcaccacga

SEQ ID NO: 3021709 - RNA, 13 nt, Mycobacterium avium subsp. paratuberculosis
gccggugcagcac

SEQ ID NO: 3021710 - RNA, 14 nt, Mycobacterium avium subsp. paratuberculosis
gccggugcagcacc

SEQ ID NO: 3021711 - RNA, 17 nt, Mycobacterium avium subsp. paratuberculosis
gccggugcagcaccucg

SEQ ID NO: 3021712 - RNA, 15 nt, Mycobacterium avium subsp. paratuberculosis
gccggugcagcacgu

SEQ ID NO: 3021713 - RNA, 18 nt, Mycobacterium avium subsp. paratuberculosis
gccggugcagcacgugcg

SEQ ID NO: 3021714 - RNA, 21 nt, Mycobacterium avium subsp. paratuberculosis
gccggugcagcacgugcgcgg

SEQ ID NO: 3021715 - RNA, 16 nt, Mycobacterium avium subsp. paratuberculosis
gccggugccagcaaca

SEQ ID NO: 3021716 - RNA, 12 nt, Mycobacterium avium subsp. paratuberculosis
gccggugccgca

SEQ ID NO: 3021717 - RNA, 20 nt, Mycobacterium avium subsp. paratuberculosis
gccggugccgcagccguccc

SEQ ID NO: 3021718 - RNA, 12 nt, Mycobacterium avium subsp. paratuberculosis
gccggugccgcc

SEQ ID NO: 3021719 - RNA, 13 nt, Mycobacterium avium subsp. paratuberculosis
gccggugccgccg

SEQ ID NO: 3021720 - RNA, 16 nt, Mycobacterium avium subsp. paratuberculosis
gccggugccgccggcg

SEQ ID NO: 3021721 - RNA, 17 nt, Mycobacterium avium subsp. paratuberculosis
gccggugccgccggcgc

SEQ ID NO: 3021722 - RNA, 18 nt, Mycobacterium avium subsp. paratuberculosis
gccggugccgccggcgca

SEQ ID NO: 3021723 - RNA, 20 nt, Mycobacterium avium subsp. paratuberculosis
gccggugccgccggcgcauc

SEQ ID NO: 3021724 - RNA, 14 nt, Mycobacterium avium subsp. paratuberculosis
gccggugccguuga

SEQ ID NO: 3021725 - RNA, 16 nt, Mycobacterium avium subsp. paratuberculosis
gccggugcgagccgcu

SEQ ID NO: 3021726 - RNA, 13 nt, Mycobacterium avium subsp. paratuberculosis
gccggugcgcagc

SEQ ID NO: 3021727 - RNA, 15 nt, Mycobacterium avium subsp. paratuberculosis
gccggugcgccgacc

SEQ ID NO: 3021728 - RNA, 18 nt, Mycobacterium avium subsp. paratuberculosis
gccggugcgccgaccgcg

SEQ ID NO: 3021729 - RNA, 22 nt, Mycobacterium avium subsp. paratuberculosis
gccggugcgccgaccgcgaucg

SEQ ID NO: 3021730 - RNA, 14 nt, Mycobacterium avium subsp. paratuberculosis
gccggugcgcguca

SEQ ID NO: 3021731 - RNA, 13 nt, Mycobacterium avium subsp. paratuberculosis
gccggugcggccg

SEQ ID NO: 3021732 - RNA, 14 nt, Mycobacterium avium subsp. paratuberculosis
gccggugcggccgc

SEQ ID NO: 3021733 - RNA, 15 nt, Mycobacterium avium subsp. paratuberculosis
gccggugcggccgcg

SEQ ID NO: 3021734 - RNA, 16 nt, Mycobacterium avium subsp. paratuberculosis
gccggugcggccgcga

SEQ ID NO: 3021735 - RNA, 13 nt, Mycobacterium avium subsp. paratuberculosis
gccggugcggucg

SEQ ID NO: 3021736 - RNA, 16 nt, Mycobacterium avium subsp. paratuberculosis
gccggugcggucggcg

SEQ ID NO: 3021737 - RNA, 20 nt, Mycobacterium avium subsp. paratuberculosis
gccggugcggucggcgucgu

SEQ ID NO: 3021738 - RNA, 15 nt, Mycobacterium avium subsp. paratuberculosis
gccggugcguccgcc

SEQ ID NO: 3021739 - RNA, 18 nt, Mycobacterium avium subsp. paratuberculosis
gccggugcguccgccggc

SEQ ID NO: 3021740 - RNA, 20 nt, Mycobacterium avium subsp. paratuberculosis
gccggugcguccgccggcgg

SEQ ID NO: 3021741 - RNA, 20 nt, Mycobacterium avium subsp. paratuberculosis
gccggugcgugaugaccagg

SEQ ID NO: 3021742 - RNA, 13 nt, Mycobacterium avium subsp. paratuberculosis
gccggugcugacc

SEQ ID NO: 3021743 - RNA, 15 nt, Mycobacterium avium subsp. paratuberculosis
gccggugcugacccg

SEQ ID NO: 3021744 - RNA, 21 nt, Mycobacterium avium subsp. paratuberculosis
gccggugcugacccggucgcg

SEQ ID NO: 3021745 - RNA, 15 nt, Mycobacterium avium subsp. paratuberculosis
gccggugcugcucga

SEQ ID NO: 3021746 - RNA, 19 nt, Mycobacterium avium subsp. paratuberculosis
gccggugcugcucgagggc

SEQ ID NO: 3021747 - RNA, 23 nt, Mycobacterium avium subsp. paratuberculosis
gccggugcuggucaugccgucga

SEQ ID NO: 3021748 - RNA, 14 nt, Mycobacterium avium subsp. paratuberculosis
gccggugcugucca

SEQ ID NO: 3021749 - RNA, 21 nt, Mycobacterium avium subsp. paratuberculosis
gccgguggaauucuggccgac

SEQ ID NO: 3021750 - RNA, 22 nt, Mycobacterium avium subsp. paratuberculosis
gccgguggacaggugcauccag

SEQ ID NO: 3021751 - RNA, 23 nt, Mycobacterium avium subsp. paratuberculosis
gccgguggacaggugcauccagu

SEQ ID NO: 3021752 - RNA, 20 nt, Mycobacterium avium subsp. paratuberculosis
gccgguggagauggccagca

SEQ ID NO: 3021753 - RNA, 13 nt, Mycobacterium avium subsp. paratuberculosis
gccgguggccgcc

SEQ ID NO: 3021754 - RNA, 14 nt, Mycobacterium avium subsp. paratuberculosis
gccgguggccgccg

SEQ ID NO: 3021755 - RNA, 14 nt, Mycobacterium avium subsp. paratuberculosis
gccgguggccgcga

SEQ ID NO: 3021756 - RNA, 15 nt, Mycobacterium avium subsp. paratuberculosis
gccgguggccgcgaa

SEQ ID NO: 3021757 - RNA, 19 nt, Mycobacterium avium subsp. paratuberculosis
gccgguggccgcgaacggg

SEQ ID NO: 3021758 - RNA, 14 nt, Mycobacterium avium subsp. paratuberculosis
gccgguggccgcgc

SEQ ID NO: 3021759 - RNA, 17 nt, Mycobacterium avium subsp. paratuberculosis
gccgguggccgcgcugg

SEQ ID NO: 3021760 - RNA, 16 nt, Mycobacterium avium subsp. paratuberculosis
gccgguggcgacaaca

SEQ ID NO: 3021761 - RNA, 13 nt, Mycobacterium avium subsp. paratuberculosis
gccgguggcggcg

SEQ ID NO: 3021762 - RNA, 14 nt, Mycobacterium avium subsp. paratuberculosis
gccgguggcggcga

SEQ ID NO: 3021763 - RNA, 16 nt, Mycobacterium avium subsp. paratuberculosis
gccgguggcggcgaca

SEQ ID NO: 3021764 - RNA, 19 nt, Mycobacterium avium subsp. paratuberculosis
gccgguggcggcgacaucg

SEQ ID NO: 3021765 - RNA, 16 nt, Mycobacterium avium subsp. paratuberculosis
gccgguggcggcgagg

SEQ ID NO: 3021766 - RNA, 17 nt, Mycobacterium avium subsp. paratuberculosis
gccgguggcggcgagga

SEQ ID NO: 3021767 - RNA, 16 nt, Mycobacterium avium subsp. paratuberculosis
gccgguggcgucggug

SEQ ID NO: 3021768 - RNA, 17 nt, Mycobacterium avium subsp. paratuberculosis
gccgguggcgucgguga

SEQ ID NO: 3021769 - RNA, 17 nt, Mycobacterium avium subsp. paratuberculosis
gccggugggcggcgccc

SEQ ID NO: 3021770 - RNA, 18 nt, Mycobacterium avium subsp. paratuberculosis
gccggugggcggcgcccg

SEQ ID NO: 3021771 - RNA, 19 nt, Mycobacterium avium subsp. paratuberculosis
gccggugggcggcgcccga

SEQ ID NO: 3021772 - RNA, 11 nt, Mycobacterium avium subsp. paratuberculosis
gccggugguca

SEQ ID NO: 3021773 - RNA, 20 nt, Mycobacterium avium subsp. paratuberculosis
gccgguggucaacgcgcaca

SEQ ID NO: 3021774 - RNA, 20 nt, Mycobacterium avium subsp. paratuberculosis
gccgguggucccggucagcg

SEQ ID NO: 3021775 - RNA, 14 nt, Mycobacterium avium subsp. paratuberculosis
gccgguggugucga

SEQ ID NO: 3021776 - RNA, 18 nt, Mycobacterium avium subsp. paratuberculosis
gccgguggugucgacggu

SEQ ID NO: 3021777 - RNA, 21 nt, Mycobacterium avium subsp. paratuberculosis
gccggugguuuugcggcccug

SEQ ID NO: 3021778 - RNA, 23 nt, Mycobacterium avium subsp. paratuberculosis
gccgguguaucccaucagugcgg

SEQ ID NO: 3021779 - RNA, 19 nt, Mycobacterium avium subsp. paratuberculosis
gccggugucauaccagccg

SEQ ID NO: 3021780 - RNA, 19 nt, Mycobacterium avium subsp. paratuberculosis
gccggugucggggucgucg

SEQ ID NO: 3021781 - RNA, 20 nt, Mycobacterium avium subsp. paratuberculosis
gccggugucggggucgucga

SEQ ID NO: 3021782 - RNA, 23 nt, Mycobacterium avium subsp. paratuberculosis
gccggugucggggucgucgacgg

SEQ ID NO: 3021783 - RNA, 15 nt, Mycobacterium avium subsp. paratuberculosis
gccggugugaucgag

SEQ ID NO: 3021784 - RNA, 20 nt, Mycobacterium avium subsp. paratuberculosis
gccggugugaucgagcacca

SEQ ID NO: 3021785 - RNA, 22 nt, Mycobacterium avium subsp. paratuberculosis
gccggugugaucgagcaccagc

SEQ ID NO: 3021786 - RNA, 15 nt, Mycobacterium avium subsp. paratuberculosis
gccggugugcagcca

SEQ ID NO: 3021787 - RNA, 19 nt, Mycobacterium avium subsp. paratuberculosis
gccggugugcagccacccg

SEQ ID NO: 3021788 - RNA, 18 nt, Mycobacterium avium subsp. paratuberculosis
gccgguguucaagccggc

SEQ ID NO: 3021789 - RNA, 19 nt, Mycobacterium avium subsp. paratuberculosis
gccgguguucaagccggcg

SEQ ID NO: 3021790 - RNA, 20 nt, Mycobacterium avium subsp. paratuberculosis
gccgguguucaagccggcgu

SEQ ID NO: 3021791 - RNA, 23 nt, Mycobacterium avium subsp. paratuberculosis
gccgguguucaagccggcgugga

SEQ ID NO: 3021792 - RNA, 13 nt, Mycobacterium avium subsp. paratuberculosis
gccgguguucggc

SEQ ID NO: 3021793 - RNA, 18 nt, Mycobacterium avium subsp. paratuberculosis
gccgucacccagaucgcc

SEQ ID NO: 3021794 - RNA, 21 nt, Mycobacterium avium subsp. paratuberculosis
gccgucacccagaucgcccgg

SEQ ID NO: 3021795 - RNA, 16 nt, Mycobacterium avium subsp. paratuberculosis
gccgucaccgccagga

SEQ ID NO: 3021796 - RNA, 19 nt, Mycobacterium avium subsp. paratuberculosis
gccgucaccggccauccgc

SEQ ID NO: 3021797 - RNA, 15 nt, Mycobacterium avium subsp. paratuberculosis
gccgucaccggcugc

SEQ ID NO: 3021798 - RNA, 12 nt, Mycobacterium avium subsp. paratuberculosis
gccgucaccucg

SEQ ID NO: 3021799 - RNA, 14 nt, Mycobacterium avium subsp. paratuberculosis
gccgucaccucgag

SEQ ID NO: 3021800 - RNA, 13 nt, Mycobacterium avium subsp. paratuberculosis
gccgucacgcugg

SEQ ID NO: 3021801 - RNA, 15 nt, Mycobacterium avium subsp. paratuberculosis
gccgucacgcuggcg

SEQ ID NO: 3021802 - RNA, 20 nt, Mycobacterium avium subsp. paratuberculosis
gccgucacgcuggcgugacg

SEQ ID NO: 3021803 - RNA, 20 nt, Mycobacterium avium subsp. paratuberculosis
gccgucacggaucgcccacc

SEQ ID NO: 3021804 - RNA, 22 nt, Mycobacterium avium subsp. paratuberculosis
gccgucacggaucgcccacccg

SEQ ID NO: 3021805 - RNA, 23 nt, Mycobacterium avium subsp. paratuberculosis
gccgucacggaucgcccacccgc

SEQ ID NO: 3021806 - RNA, 20 nt, Mycobacterium avium subsp. paratuberculosis
gccgucacguagcgcggccg

SEQ ID NO: 3021807 - RNA, 21 nt, Mycobacterium avium subsp. paratuberculosis
gccgucacguagcgcggccgc

SEQ ID NO: 3021808 - RNA, 16 nt, Mycobacterium avium subsp. paratuberculosis
gccgucacugcacgca

SEQ ID NO: 3021809 - RNA, 20 nt, Mycobacterium avium subsp. paratuberculosis
gccgucacugcacgcacggc

SEQ ID NO: 3021810 - RNA, 17 nt, Mycobacterium avium subsp. paratuberculosis
gccgucacugucggcgc

SEQ ID NO: 3021811 - RNA, 22 nt, Mycobacterium avium subsp. paratuberculosis
gccgucacugucggcgcggacg

SEQ ID NO: 3021812 - RNA, 19 nt, Mycobacterium avium subsp. paratuberculosis
gccgucaggaacgccggcu

SEQ ID NO: 3021813 - RNA, 21 nt, Mycobacterium avium subsp. paratuberculosis
gccgucaggagugcucggcgu

SEQ ID NO: 3021814 - RNA, 20 nt, Mycobacterium avium subsp. paratuberculosis
gccgucagugcgcauucggc

SEQ ID NO: 3021815 - RNA, 15 nt, Mycobacterium avium subsp. paratuberculosis
gccgucaucaccgcc

SEQ ID NO: 3021816 - RNA, 16 nt, Mycobacterium avium subsp. paratuberculosis
gccgucaucaccgccg

SEQ ID NO: 3021817 - RNA, 20 nt, Mycobacterium avium subsp. paratuberculosis
gccgucaucaccgccgaggg

SEQ ID NO: 3021818 - RNA, 22 nt, Mycobacterium avium subsp. paratuberculosis
gccgucaucaccgccgagggcc

SEQ ID NO: 3021819 - RNA, 14 nt, Mycobacterium avium subsp. paratuberculosis
gccgucauccccau

SEQ ID NO: 3021820 - RNA, 17 nt, Mycobacterium avium subsp. paratuberculosis
gccgucaucgacaccga

SEQ ID NO: 3021821 - RNA, 18 nt, Mycobacterium avium subsp. paratuberculosis
gccgucaucgacaccgaa

SEQ ID NO: 3021822 - RNA, 15 nt, Mycobacterium avium subsp. paratuberculosis
gccgucaucgccgac

SEQ ID NO: 3021823 - RNA, 16 nt, Mycobacterium avium subsp. paratuberculosis
gccgucaucgccgacg

SEQ ID NO: 3021824 - RNA, 19 nt, Mycobacterium avium subsp. paratuberculosis
gccgucaucgccgacggug

SEQ ID NO: 3021825 - RNA, 13 nt, Mycobacterium avium subsp. paratuberculosis
gccguccaccacc

SEQ ID NO: 3021826 - RNA, 19 nt, Mycobacterium avium subsp. paratuberculosis
gccguccaccagaucgccc

SEQ ID NO: 3021827 - RNA, 22 nt, Mycobacterium avium subsp. paratuberculosis
gccguccaccagaucgccccgc

SEQ ID NO: 3021828 - RNA, 13 nt, Mycobacterium avium subsp. paratuberculosis
gccguccacccgg

SEQ ID NO: 3021829 - RNA, 15 nt, Mycobacterium avium subsp. paratuberculosis
gccguccacccggcc

SEQ ID NO: 3021830 - RNA, 21 nt, Mycobacterium avium subsp. paratuberculosis
gccguccacccggcccaccac

SEQ ID NO: 3021831 - RNA, 14 nt, Mycobacterium avium subsp. paratuberculosis
gccguccacggcgg

SEQ ID NO: 3021832 - RNA, 16 nt, Mycobacterium avium subsp. paratuberculosis
gccguccacggcggug

SEQ ID NO: 3021833 - RNA, 16 nt, Mycobacterium avium subsp. paratuberculosis
gccguccagcaacgcc

SEQ ID NO: 3021834 - RNA, 20 nt, Mycobacterium avium subsp. paratuberculosis
gccguccagcagcagcgcgc

SEQ ID NO: 3021835 - RNA, 21 nt, Mycobacterium avium subsp. paratuberculosis
gccguccagcagcagcgcgcg

SEQ ID NO: 3021836 - RNA, 22 nt, Mycobacterium avium subsp. paratuberculosis
gccguccagcagcagcgcgcgg

SEQ ID NO: 3021837 - RNA, 23 nt, Mycobacterium avium subsp. paratuberculosis
gccguccagcagcagcgcgcggu

SEQ ID NO: 3021838 - RNA, 18 nt, Mycobacterium avium subsp. paratuberculosis
gccguccagccgugcggc

SEQ ID NO: 3021839 - RNA, 15 nt, Mycobacterium avium subsp. paratuberculosis
gccguccagcgucac

SEQ ID NO: 3021840 - RNA, 17 nt, Mycobacterium avium subsp. paratuberculosis
gccguccagcgucaccu

SEQ ID NO: 3021841 - RNA, 14 nt, Mycobacterium avium subsp. paratuberculosis
gccguccagcuccg

SEQ ID NO: 3021842 - RNA, 18 nt, Mycobacterium avium subsp. paratuberculosis
gccguccagcuccgccga

SEQ ID NO: 3021843 - RNA, 19 nt, Mycobacterium avium subsp. paratuberculosis
gccguccagcuccgccgac

SEQ ID NO: 3021844 - RNA, 19 nt, Mycobacterium avium subsp. paratuberculosis
gccguccagcucgcguucg

SEQ ID NO: 3021845 - RNA, 21 nt, Mycobacterium avium subsp. paratuberculosis
gccguccagcucgcguucggg

SEQ ID NO: 3021846 - RNA, 14 nt, Mycobacterium avium subsp. paratuberculosis
gccguccaggccgc

SEQ ID NO: 3021847 - RNA, 16 nt, Mycobacterium avium subsp. paratuberculosis
gccguccaggccgcug

SEQ ID NO: 3021848 - RNA, 19 nt, Mycobacterium avium subsp. paratuberculosis
gccguccaugaaccacugc

SEQ ID NO: 3021849 - RNA, 20 nt, Mycobacterium avium subsp. paratuberculosis
gccguccaugaaccacugcg

SEQ ID NO: 3021850 - RNA, 13 nt, Mycobacterium avium subsp. paratuberculosis
gccgucccaccgg

SEQ ID NO: 3021851 - RNA, 15 nt, Mycobacterium avium subsp. paratuberculosis
gccgucccagccgga

SEQ ID NO: 3021852 - RNA, 16 nt, Mycobacterium avium subsp. paratuberculosis
gccgucccagccggac

SEQ ID NO: 3021853 - RNA, 21 nt, Mycobacterium avium subsp. paratuberculosis
gccgucccagccggacagcgg

SEQ ID NO: 3021854 - RNA, 18 nt, Mycobacterium avium subsp. paratuberculosis
gccgucccccgagcgggc

SEQ ID NO: 3021855 - RNA, 13 nt, Mycobacterium avium subsp. paratuberculosis
gccguccccgcgc

SEQ ID NO: 3021856 - RNA, 15 nt, Mycobacterium avium subsp. paratuberculosis
gccguccccgcgcgg

SEQ ID NO: 3021857 - RNA, 16 nt, Mycobacterium avium subsp. paratuberculosis
gccguccccgcgcggc

SEQ ID NO: 3021858 - RNA, 20 nt, Mycobacterium avium subsp. paratuberculosis
gccguccccgcgcggcucgc

SEQ ID NO: 3021859 - RNA, 14 nt, Mycobacterium avium subsp. paratuberculosis
gccgucccgccguc

SEQ ID NO: 3021860 - RNA, 13 nt, Mycobacterium avium subsp. paratuberculosis
gccgucccggacg

SEQ ID NO: 3021861 - RNA, 17 nt, Mycobacterium avium subsp. paratuberculosis
gccgucccggacgcugc

SEQ ID NO: 3021862 - RNA, 15 nt, Mycobacterium avium subsp. paratuberculosis
gccgucccgucacgg

SEQ ID NO: 3021863 - RNA, 18 nt, Mycobacterium avium subsp. paratuberculosis
gccgucccgucacggcug

SEQ ID NO: 3021864 - RNA, 20 nt, Mycobacterium avium subsp. paratuberculosis
gccgucccgucacggcugcc

SEQ ID NO: 3021865 - RNA, 21 nt, Mycobacterium avium subsp. paratuberculosis
gccgucccgucacggcugccg

SEQ ID NO: 3021866 - RNA, 14 nt, Mycobacterium avium subsp. paratuberculosis
gccgucccguccga

SEQ ID NO: 3021867 - RNA, 17 nt, Mycobacterium avium subsp. paratuberculosis
gccgucccguccgacgg

SEQ ID NO: 3021868 - RNA, 18 nt, Mycobacterium avium subsp. paratuberculosis
gccgucccuguucgcgcc

SEQ ID NO: 3021869 - RNA, 19 nt, Mycobacterium avium subsp. paratuberculosis
gccgucccuguucgcgccg

SEQ ID NO: 3021870 - RNA, 21 nt, Mycobacterium avium subsp. paratuberculosis
gccgucccuguucgcgccggu

SEQ ID NO: 3021871 - RNA, 22 nt, Mycobacterium avium subsp. paratuberculosis
gccgucccuguucgcgccggua

SEQ ID NO: 3021872 - RNA, 15 nt, Mycobacterium avium subsp. paratuberculosis
gccguccgcaccgcg

SEQ ID NO: 3021873 - RNA, 14 nt, Mycobacterium avium subsp. paratuberculosis
gccguccgccggcu

SEQ ID NO: 3021874 - RNA, 15 nt, Mycobacterium avium subsp. paratuberculosis
gccguccgcggcggc

SEQ ID NO: 3021875 - RNA, 17 nt, Mycobacterium avium subsp. paratuberculosis
gccguccgcggcggcca

SEQ ID NO: 3021876 - RNA, 22 nt, Mycobacterium avium subsp. paratuberculosis
gccguccggauagccgucggcg

SEQ ID NO: 3021877 - RNA, 17 nt, Mycobacterium avium subsp. paratuberculosis
gccgucgccgcacgccc

SEQ ID NO: 3021878 - RNA, 23 nt, Mycobacterium avium subsp. paratuberculosis
gccgucgccgcacgcccacagcu

SEQ ID NO: 3021879 - RNA, 12 nt, Mycobacterium avium subsp. paratuberculosis
gccgucgccgcc

SEQ ID NO: 3021880 - RNA, 13 nt, Mycobacterium avium subsp. paratuberculosis
gccgucgccgccg

SEQ ID NO: 3021881 - RNA, 15 nt, Mycobacterium avium subsp. paratuberculosis
gccgucgccgccgug

SEQ ID NO: 3021882 - RNA, 16 nt, Mycobacterium avium subsp. paratuberculosis
gccgucgccgcgcccg

SEQ ID NO: 3021883 - RNA, 20 nt, Mycobacterium avium subsp. paratuberculosis
gccgucgccgcgcccgccgg

SEQ ID NO: 3021884 - RNA, 11 nt, Mycobacterium avium subsp. paratuberculosis
gccgucgccgg

SEQ ID NO: 3021885 - RNA, 14 nt, Mycobacterium avium subsp. paratuberculosis
gccgucgccggacu

SEQ ID NO: 3021886 - RNA, 13 nt, Mycobacterium avium subsp. paratuberculosis
gccgucgccgggc

SEQ ID NO: 3021887 - RNA, 20 nt, Mycobacterium avium subsp. paratuberculosis
gccgucgccgggcggggugg

SEQ ID NO: 3021888 - RNA, 20 nt, Mycobacterium avium subsp. paratuberculosis
gccgucgccucgcccucggu

SEQ ID NO: 3021889 - RNA, 14 nt, Mycobacterium avium subsp. paratuberculosis
gccgucgcgaucgc

SEQ ID NO: 3021890 - RNA, 15 nt, Mycobacterium avium subsp. paratuberculosis
gccgucgcgaucgcg

SEQ ID NO: 3021891 - RNA, 19 nt, Mycobacterium avium subsp. paratuberculosis
gccgucgcgaucgcggucc

SEQ ID NO: 3021892 - RNA, 12 nt, Mycobacterium avium subsp. paratuberculosis
gccgucgcgcac

SEQ ID NO: 3021893 - RNA, 20 nt, Mycobacterium avium subsp. paratuberculosis
gccggcgcaucaucucggcg

SEQ ID NO: 3021894 - RNA, 15 nt, Mycobacterium avium subsp. paratuberculosis
gccggcgcccagcgg

SEQ ID NO: 3021895 - RNA, 19 nt, Mycobacterium avium subsp. paratuberculosis
gccggcgcccagcggcgau

SEQ ID NO: 3021896 - RNA, 21 nt, Mycobacterium avium subsp. paratuberculosis
gccggcgcccagcggcgaugc

SEQ ID NO: 3021897 - RNA, 12 nt, Mycobacterium avium subsp. paratuberculosis
gccggcgcccgc

SEQ ID NO: 3021898 - RNA, 15 nt, Mycobacterium avium subsp. paratuberculosis
gccggcgcccgcagg

SEQ ID NO: 3021899 - RNA, 19 nt, Mycobacterium avium subsp. paratuberculosis
gccggcgcccgcaggccgc

SEQ ID NO: 3021900 - RNA, 21 nt, Mycobacterium avium subsp. paratuberculosis
gccggcgcccgcaggccgcga

SEQ ID NO: 3021901 - RNA, 12 nt, Mycobacterium avium subsp. paratuberculosis
gccggcgcccgu

SEQ ID NO: 3021902 - RNA, 19 nt, Mycobacterium avium subsp. paratuberculosis
gccggcgcccgucacgcug

SEQ ID NO: 3021903 - RNA, 21 nt, Mycobacterium avium subsp. paratuberculosis
gccggcgcccgucacgcuggc

SEQ ID NO: 3021904 - RNA, 18 nt, Mycobacterium avium subsp. paratuberculosis
gccggcgcccugcgcgcc

SEQ ID NO: 3021905 - RNA, 19 nt, Mycobacterium avium subsp. paratuberculosis
gccggcgcccugcgcgccc

SEQ ID NO: 3021906 - RNA, 22 nt, Mycobacterium avium subsp. paratuberculosis
gccggcgcccugcgcgcccugc

SEQ ID NO: 3021907 - RNA, 17 nt, Mycobacterium avium subsp. paratuberculosis
gccggcgccgaagccgu

SEQ ID NO: 3021908 - RNA, 12 nt, Mycobacterium avium subsp. paratuberculosis
gccggcgccgac

SEQ ID NO: 3021909 - RNA, 15 nt, Mycobacterium avium subsp. paratuberculosis
gccggcgccgaccga

SEQ ID NO: 3021910 - RNA, 17 nt, Mycobacterium avium subsp. paratuberculosis
gccggcgccgaccgagg

SEQ ID NO: 3021911 - RNA, 13 nt, Mycobacterium avium subsp. paratuberculosis
gccggcgccgacg

SEQ ID NO: 3021912 - RNA, 14 nt, Mycobacterium avium subsp. paratuberculosis
gccggcgccgacga

SEQ ID NO: 3021913 - RNA, 15 nt, Mycobacterium avium subsp. paratuberculosis
gccggcgccgacgac

SEQ ID NO: 3021914 - RNA, 14 nt, Mycobacterium avium subsp. paratuberculosis
gccggcgccgauuc

SEQ ID NO: 3021915 - RNA, 14 nt, Mycobacterium avium subsp. paratuberculosis
gccggcgccgccgg

SEQ ID NO: 3021916 - RNA, 22 nt, Mycobacterium avium subsp. paratuberculosis
gccggcgccgccggggcgucgg

SEQ ID NO: 3021917 - RNA, 16 nt, Mycobacterium avium subsp. paratuberculosis
gccggcgccgcgggug

SEQ ID NO: 3021918 - RNA, 15 nt, Mycobacterium avium subsp. paratuberculosis
gccggcgccggaggg

SEQ ID NO: 3021919 - RNA, 14 nt, Mycobacterium avium subsp. paratuberculosis
gccggcgccggcgg

SEQ ID NO: 3021920 - RNA, 15 nt, Mycobacterium avium subsp. paratuberculosis
gccggcgccggcggu

SEQ ID NO: 3021921 - RNA, 16 nt, Mycobacterium avium subsp. paratuberculosis
gccggcgccggcgguc

SEQ ID NO: 3021922 - RNA, 17 nt, Mycobacterium avium subsp. paratuberculosis
gccggcgccggcgguca

SEQ ID NO: 3021923 - RNA, 23 nt, Mycobacterium avium subsp. paratuberculosis
gccggcgccgggaaaguuguagc

SEQ ID NO: 3021924 - RNA, 14 nt, Mycobacterium avium subsp. paratuberculosis
gccggcgccgggcg

SEQ ID NO: 3021925 - RNA, 15 nt, Mycobacterium avium subsp. paratuberculosis
gccggcgccgggcgg

SEQ ID NO: 3021926 - RNA, 17 nt, Mycobacterium avium subsp. paratuberculosis
gccggcgccgggcgggc

SEQ ID NO: 3021927 - RNA, 16 nt, Mycobacterium avium subsp. paratuberculosis
gccggcgccggugccg

SEQ ID NO: 3021928 - RNA, 23 nt, Mycobacterium avium subsp. paratuberculosis
gccggcgccgucgauccacccac

SEQ ID NO: 3021929 - RNA, 13 nt, Mycobacterium avium subsp. paratuberculosis
gccggcgcgacca

SEQ ID NO: 3021930 - RNA, 16 nt, Mycobacterium avium subsp. paratuberculosis
gccggcgcgaccagcg

SEQ ID NO: 3021931 - RNA, 17 nt, Mycobacterium avium subsp. paratuberculosis
gccggcgcgaccagcgg

SEQ ID NO: 3021932 - RNA, 18 nt, Mycobacterium avium subsp. paratuberculosis
gccggcgcgaccagcggc

SEQ ID NO: 3021933 - RNA, 16 nt, Mycobacterium avium subsp. paratuberculosis
gccggcgcgcaccccg

SEQ ID NO: 3021934 - RNA, 17 nt, Mycobacterium avium subsp. paratuberculosis
gccggcgcgcaccccgg

SEQ ID NO: 3021935 - RNA, 18 nt, Mycobacterium avium subsp. paratuberculosis
gccggcgcgcaccccggc

SEQ ID NO: 3021936 - RNA, 15 nt, Mycobacterium avium subsp. paratuberculosis
gccggcgcgcacggc

SEQ ID NO: 3021937 - RNA, 21 nt, Mycobacterium avium subsp. paratuberculosis
gccggcgcgcacggcagcccg

SEQ ID NO: 3021938 - RNA, 13 nt, Mycobacterium avium subsp. paratuberculosis
gccggcgcgcagc

SEQ ID NO: 3021939 - RNA, 14 nt, Mycobacterium avium subsp. paratuberculosis
gccggcgcgcagcc

SEQ ID NO: 3021940 - RNA, 20 nt, Mycobacterium avium subsp. paratuberculosis
gccggcgcgcagccagucgc

SEQ ID NO: 3021941 - RNA, 15 nt, Mycobacterium avium subsp. paratuberculosis
gccggcgcgcagcgu

SEQ ID NO: 3021942 - RNA, 12 nt, Mycobacterium avium subsp. paratuberculosis
gccggcgcgcga

SEQ ID NO: 3021943 - RNA, 16 nt, Mycobacterium avium subsp. paratuberculosis
gccggcgcgcgguggu

SEQ ID NO: 3021944 - RNA, 20 nt, Mycobacterium avium subsp. paratuberculosis
gccggcgcgcugaagcgcga

SEQ ID NO: 3021945 - RNA, 17 nt, Mycobacterium avium subsp. paratuberculosis
gccggcgcggcagggcc

SEQ ID NO: 3021946 - RNA, 16 nt, Mycobacterium avium subsp. paratuberculosis
gccggcgcggccagcu

SEQ ID NO: 3021947 - RNA, 15 nt, Mycobacterium avium subsp. paratuberculosis
gccggcgcggcggcg

SEQ ID NO: 3021948 - RNA, 19 nt, Mycobacterium avium subsp. paratuberculosis
gccggcgcggcggcgacgu

SEQ ID NO: 3021949 - RNA, 21 nt, Mycobacterium avium subsp. paratuberculosis
gccggcgcggcggcgacgucg

SEQ ID NO: 3021950 - RNA, 22 nt, Mycobacterium avium subsp. paratuberculosis
gccggcgcggcggcgacgucga

SEQ ID NO: 3021951 - RNA, 22 nt, Mycobacterium avium subsp. paratuberculosis
gccggcgcgggccgcagcgcgc

SEQ ID NO: 3021952 - RNA, 14 nt, Mycobacterium avium subsp. paratuberculosis
gccggcgcgggggc

SEQ ID NO: 3021953 - RNA, 18 nt, Mycobacterium avium subsp. paratuberculosis
gccggcgcgggggcggcc

SEQ ID NO: 3021954 - RNA, 16 nt, Mycobacterium avium subsp. paratuberculosis
gccggcgcggugggcg

SEQ ID NO: 3021955 - RNA, 17 nt, Mycobacterium avium subsp. paratuberculosis
gccggcgcguccggagg

SEQ ID NO: 3021956 - RNA, 20 nt, Mycobacterium avium subsp. paratuberculosis
gccggcgcguccggaggugc

SEQ ID NO: 3021957 - RNA, 22 nt, Mycobacterium avium subsp. paratuberculosis
gccggcgcguccggaggugccg

SEQ ID NO: 3021958 - RNA, 14 nt, Mycobacterium avium subsp. paratuberculosis
gccggcgcgugcgc

SEQ ID NO: 3021959 - RNA, 16 nt, Mycobacterium avium subsp. paratuberculosis
gccggcgcgugcgcga

SEQ ID NO: 3021960 - RNA, 18 nt, Mycobacterium avium subsp. paratuberculosis
gccggcgcgugcgcgacg

SEQ ID NO: 3021961 - RNA, 15 nt, Mycobacterium avium subsp. paratuberculosis
gccggcgcucgucgu

SEQ ID NO: 3021962 - RNA, 23 nt, Mycobacterium avium subsp. paratuberculosis
gccggcgcucgucgucgccgaug

SEQ ID NO: 3021963 - RNA, 20 nt, Mycobacterium avium subsp. paratuberculosis
gccggcgcugcccgucgacc

SEQ ID NO: 3021964 - RNA, 21 nt, Mycobacterium avium subsp. paratuberculosis
gccggcgcugcccgucgaccu

SEQ ID NO: 3021965 - RNA, 13 nt, Mycobacterium avium subsp. paratuberculosis
gccggcgcuggcg

SEQ ID NO: 3021966 - RNA, 16 nt, Mycobacterium avium subsp. paratuberculosis
gccggcgcuggcgcgc

SEQ ID NO: 3021967 - RNA, 18 nt, Mycobacterium avium subsp. paratuberculosis
gccggcggugcgucgaau

SEQ ID NO: 3021968 - RNA, 21 nt, Mycobacterium avium subsp. paratuberculosis
gccggcggugcgucgaaucac

SEQ ID NO: 3021969 - RNA, 14 nt, Mycobacterium avium subsp. paratuberculosis
gccggcgguggcca

SEQ ID NO: 3021970 - RNA, 12 nt, Mycobacterium avium subsp. paratuberculosis
gccggcgguggu

SEQ ID NO: 3021971 - RNA, 13 nt, Mycobacterium avium subsp. paratuberculosis
gccggcgguggug

SEQ ID NO: 3021972 - RNA, 16 nt, Mycobacterium avium subsp. paratuberculosis
gccggcgguggugccg

SEQ ID NO: 3021973 - RNA, 19 nt, Mycobacterium avium subsp. paratuberculosis
gccggcgguggugccgccg

SEQ ID NO: 3021974 - RNA, 23 nt, Mycobacterium avium subsp. paratuberculosis
gccggcgguggugccgccgucga

SEQ ID NO: 3021975 - RNA, 12 nt, Mycobacterium avium subsp. paratuberculosis
gccggcgguguc

SEQ ID NO: 3021976 - RNA, 14 nt, Mycobacterium avium subsp. paratuberculosis
gccggcggugucca

SEQ ID NO: 3021977 - RNA, 14 nt, Mycobacterium avium subsp. paratuberculosis
gccggcggugucga

SEQ ID NO: 3021978 - RNA, 19 nt, Mycobacterium avium subsp. paratuberculosis
gccggcggugucguaguug

SEQ ID NO: 3021979 - RNA, 20 nt, Mycobacterium avium subsp. paratuberculosis
gccggcgguucggcgggccu

SEQ ID NO: 3021980 - RNA, 18 nt, Mycobacterium avium subsp. paratuberculosis
gccggcguacucgcacag

SEQ ID NO: 3021981 - RNA, 19 nt, Mycobacterium avium subsp. paratuberculosis
gccggcguacucgcacagc

SEQ ID NO: 3021982 - RNA, 24 nt, Mycobacterium avium subsp. paratuberculosis
gccggcguacucgcacagccggcg

SEQ ID NO: 3021983 - RNA, 18 nt, Mycobacterium avium subsp. paratuberculosis
gccggcguagaccagcga

SEQ ID NO: 3021984 - RNA, 15 nt, Mycobacterium avium subsp. paratuberculosis
gccggcguagcaguc

SEQ ID NO: 3021985 - RNA, 15 nt, Mycobacterium avium subsp. paratuberculosis
gccggcgucacucug

SEQ ID NO: 3021986 - RNA, 21 nt, Mycobacterium avium subsp. paratuberculosis
gccggcgucacucuggcguga

SEQ ID NO: 3021987 - RNA, 18 nt, Mycobacterium avium subsp. paratuberculosis
gccggcguccagcgccgc

SEQ ID NO: 3021988 - RNA, 22 nt, Mycobacterium avium subsp. paratuberculosis
gccggcguccaggcgcaccgcc

SEQ ID NO: 3021989 - RNA, 23 nt, Mycobacterium avium subsp. paratuberculosis
gccggcguccaggcgcaccgcca

SEQ ID NO: 3021990 - RNA, 18 nt, Mycobacterium avium subsp. paratuberculosis
gccggcguccaguucggc

SEQ ID NO: 3021991 - RNA, 22 nt, Mycobacterium avium subsp. paratuberculosis
gccggcguccaguucggccagc

SEQ ID NO: 3021992 - RNA, 14 nt, Mycobacterium avium subsp. paratuberculosis
gccggcgucgacgu

SEQ ID NO: 3021993 - RNA, 16 nt, Mycobacterium avium subsp. paratuberculosis
gccggcgucgacgucg

SEQ ID NO: 3021994 - RNA, 15 nt, Mycobacterium avium subsp. paratuberculosis
gccggcgucgaugau

SEQ ID NO: 3021995 - RNA, 18 nt, Mycobacterium avium subsp. paratuberculosis
gccggcgucgaugaugcc

SEQ ID NO: 3021996 - RNA, 19 nt, Mycobacterium avium subsp. paratuberculosis
gccggcgucgaugaugccg

SEQ ID NO: 3021997 - RNA, 15 nt, Mycobacterium avium subsp. paratuberculosis
gccggcgucgccgcu

SEQ ID NO: 3021998 - RNA, 16 nt, Mycobacterium avium subsp. paratuberculosis
gccggcgucgccgcuc

SEQ ID NO: 3021999 - RNA, 17 nt, Mycobacterium avium subsp. paratuberculosis
gccggcgucgccgcugg

SEQ ID NO: 3022000 - RNA, 14 nt, Mycobacterium avium subsp. paratuberculosis
gccggcgucggugu

SEQ ID NO: 3022001 - RNA, 15 nt, Mycobacterium avium subsp. paratuberculosis
gccggcgucgguguc

SEQ ID NO: 3022002 - RNA, 21 nt, Mycobacterium avium subsp. paratuberculosis
gccggcgucggugucccgcgc

SEQ ID NO: 3022003 - RNA, 22 nt, Mycobacterium avium subsp. paratuberculosis
gccggcgucggugucccgcgcc

SEQ ID NO: 3022004 - RNA, 13 nt, Mycobacterium avium subsp. paratuberculosis
gccggcgucgucg

SEQ ID NO: 3022005 - RNA, 14 nt, Mycobacterium avium subsp. paratuberculosis
gccggcgucgucga

SEQ ID NO: 3022006 - RNA, 17 nt, Mycobacterium avium subsp. paratuberculosis
gccggcgucgucgucgc

SEQ ID NO: 3022007 - RNA, 23 nt, Mycobacterium avium subsp. paratuberculosis
gccggcgucuugaucucggcggc

SEQ ID NO: 3022008 - RNA, 18 nt, Mycobacterium avium subsp. paratuberculosis
gccggcgugcacaggccg

SEQ ID NO: 3022009 - RNA, 19 nt, Mycobacterium avium subsp. paratuberculosis
gccggcgugcacaggccgc

SEQ ID NO: 3022010 - RNA, 16 nt, Mycobacterium avium subsp. paratuberculosis
gccggcgugcugggcc

SEQ ID NO: 3022011 - RNA, 20 nt, Mycobacterium avium subsp. paratuberculosis
gccggcgugcugggccacga

SEQ ID NO: 3022012 - RNA, 21 nt, Mycobacterium avium subsp. paratuberculosis
gccggcgugcugggccacgau

SEQ ID NO: 3022013 - RNA, 22 nt, Mycobacterium avium subsp. paratuberculosis
gccggcguguaguacugcucga

SEQ ID NO: 3022014 - RNA, 19 nt, Mycobacterium avium subsp. paratuberculosis
gccggcgugucggcgccac

SEQ ID NO: 3022015 - RNA, 21 nt, Mycobacterium avium subsp. paratuberculosis
gccggcguuauuugugcgcug

SEQ ID NO: 3022016 - RNA, 13 nt, Mycobacterium avium subsp. paratuberculosis
gccggcguugacg

SEQ ID NO: 3022017 - RNA, 22 nt, Mycobacterium avium subsp. paratuberculosis
gccggcguugacgaugacgcgg

SEQ ID NO: 3022018 - RNA, 16 nt, Mycobacterium avium subsp. paratuberculosis
gccggcguuguccagg

SEQ ID NO: 3022019 - RNA, 15 nt, Mycobacterium avium subsp. paratuberculosis
gccggcuaccgcgcg

SEQ ID NO: 3022020 - RNA, 17 nt, Mycobacterium avium subsp. paratuberculosis
gccggcuaccgcgcgga

SEQ ID NO: 3022021 - RNA, 18 nt, Mycobacterium avium subsp. paratuberculosis
gccggcuaccgcgcggag

SEQ ID NO: 3022022 - RNA, 15 nt, Mycobacterium avium subsp. paratuberculosis
gccggcuaccggcgc

SEQ ID NO: 3022023 - RNA, 17 nt, Mycobacterium avium subsp. paratuberculosis
gccggcuaccggcgcug

SEQ ID NO: 3022024 - RNA, 19 nt, Mycobacterium avium subsp. paratuberculosis
gccggcuaccggcgcugga

SEQ ID NO: 3022025 - RNA, 14 nt, Mycobacterium avium subsp. paratuberculosis
gccggcucagcggc

SEQ ID NO: 3022026 - RNA, 15 nt, Mycobacterium avium subsp. paratuberculosis
gccggcucagcggca

SEQ ID NO: 3022027 - RNA, 17 nt, Mycobacterium avium subsp. paratuberculosis
gccggcucagggugcgc

SEQ ID NO: 3022028 - RNA, 23 nt, Mycobacterium avium subsp. paratuberculosis
gccggcucagggugcgcuggccg

SEQ ID NO: 3022029 - RNA, 14 nt, Mycobacterium avium subsp. paratuberculosis
gccggcuccaccgc

SEQ ID NO: 3022030 - RNA, 15 nt, Mycobacterium avium subsp. paratuberculosis
gccggcuccaccgcg

SEQ ID NO: 3022031 - RNA, 16 nt, Mycobacterium avium subsp. paratuberculosis
gccggcuccaccgcgc

SEQ ID NO: 3022032 - RNA, 19 nt, Mycobacterium avium subsp. paratuberculosis
gccggcuccaccgcgccgg

SEQ ID NO: 3022033 - RNA, 21 nt, Mycobacterium avium subsp. paratuberculosis
gccggcuccaccgcgccggcg

SEQ ID NO: 3022034 - RNA, 20 nt, Mycobacterium avium subsp. paratuberculosis
gccggcuccauguccggagc

SEQ ID NO: 3022035 - RNA, 20 nt, Mycobacterium avium subsp. paratuberculosis
gccggcuccgcaugcccggg

SEQ ID NO: 3022036 - RNA, 21 nt, Mycobacterium avium subsp. paratuberculosis
gccggcucgaccucaccccgc

SEQ ID NO: 3022037 - RNA, 14 nt, Mycobacterium avium subsp. paratuberculosis
gccggcucggcggc

SEQ ID NO: 3022038 - RNA, 15 nt, Mycobacterium avium subsp. paratuberculosis
gccggcucggcggcu

SEQ ID NO: 3022039 - RNA, 22 nt, Mycobacterium avium subsp. paratuberculosis
gccggcucgguaugcggcgacg

SEQ ID NO: 3022040 - RNA, 19 nt, Mycobacterium avium subsp. paratuberculosis
gccggcucggucuccucca

SEQ ID NO: 3022041 - RNA, 22 nt, Mycobacterium avium subsp. paratuberculosis
gccggcucggucuccuccagga

SEQ ID NO: 3022042 - RNA, 17 nt, Mycobacterium avium subsp. paratuberculosis
gccggcugaaccugcug

SEQ ID NO: 3022043 - RNA, 18 nt, Mycobacterium avium subsp. paratuberculosis
gccggcugaaccugcugg

SEQ ID NO: 3022044 - RNA, 19 nt, Mycobacterium avium subsp. paratuberculosis
gccggcugaaccugcuggg

SEQ ID NO: 3022045 - RNA, 22 nt, Mycobacterium avium subsp. paratuberculosis
gccggcugaaccugcugggcgg

SEQ ID NO: 3022046 - RNA, 18 nt, Mycobacterium avium subsp. paratuberculosis
gccggcugacugccggcg

SEQ ID NO: 3022047 - RNA, 19 nt, Mycobacterium avium subsp. paratuberculosis
gccggcugacugccggcga

SEQ ID NO: 3022048 - RNA, 15 nt, Mycobacterium avium subsp. paratuberculosis
gccggcugagcagcc

SEQ ID NO: 3022049 - RNA, 12 nt, Mycobacterium avium subsp. paratuberculosis
gccggcugcagc

SEQ ID NO: 3022050 - RNA, 15 nt, Mycobacterium avium subsp. paratuberculosis
gccggcugcagccgg

SEQ ID NO: 3022051 - RNA, 22 nt, Mycobacterium avium subsp. paratuberculosis
gccgggcaugccguucagcgcg

SEQ ID NO: 3022052 - RNA, 23 nt, Mycobacterium avium subsp. paratuberculosis
gccgggccaauuacgcugcggcg

SEQ ID NO: 3022053 - RNA, 12 nt, Mycobacterium avium subsp. paratuberculosis
gccgggccagca

SEQ ID NO: 3022054 - RNA, 17 nt, Mycobacterium avium subsp. paratuberculosis
gccgggccagcaacagc

SEQ ID NO: 3022055 - RNA, 19 nt, Mycobacterium avium subsp. paratuberculosis
gccgggccagcaacagcag

SEQ ID NO: 3022056 - RNA, 21 nt, Mycobacterium avium subsp. paratuberculosis
gccgggccagcaacagcagcg

SEQ ID NO: 3022057 - RNA, 14 nt, Mycobacterium avium subsp. paratuberculosis
gccgggccagcagc

SEQ ID NO: 3022058 - RNA, 16 nt, Mycobacterium avium subsp. paratuberculosis
gccgggccagcagcuu

SEQ ID NO: 3022059 - RNA, 18 nt, Mycobacterium avium subsp. paratuberculosis
gccgggccagcccgggaa

SEQ ID NO: 3022060 - RNA, 13 nt, Mycobacterium avium subsp. paratuberculosis
gccgggccagccg

SEQ ID NO: 3022061 - RNA, 15 nt, Mycobacterium avium subsp. paratuberculosis
gccgggccagccggc

SEQ ID NO: 3022062 - RNA, 23 nt, Mycobacterium avium subsp. paratuberculosis
gccgggccagccggcccuccagg

SEQ ID NO: 3022063 - RNA, 13 nt, Mycobacterium avium subsp. paratuberculosis
gccgggccagguc

SEQ ID NO: 3022064 - RNA, 16 nt, Mycobacterium avium subsp. paratuberculosis
gccgggccaggugugc

SEQ ID NO: 3022065 - RNA, 20 nt, Mycobacterium avium subsp. paratuberculosis
gccgggccaggugugcccgc

SEQ ID NO: 3022066 - RNA, 20 nt, Mycobacterium avium subsp. paratuberculosis
gccgggcccgcucaccugcg

SEQ ID NO: 3022067 - RNA, 15 nt, Mycobacterium avium subsp. paratuberculosis
gccgggcccgguccc

SEQ ID NO: 3022068 - RNA, 16 nt, Mycobacterium avium subsp. paratuberculosis
gccgggcccggucccg

SEQ ID NO: 3022069 - RNA, 17 nt, Mycobacterium avium subsp. paratuberculosis
gccgggcccucggacgg

SEQ ID NO: 3022070 - RNA, 13 nt, Mycobacterium avium subsp. paratuberculosis
gccgggccgagcg

SEQ ID NO: 3022071 - RNA, 16 nt, Mycobacterium avium subsp. paratuberculosis
gccgggccgagcgcgc

SEQ ID NO: 3022072 - RNA, 17 nt, Mycobacterium avium subsp. paratuberculosis
gccgggccgcauccagc

SEQ ID NO: 3022073 - RNA, 13 nt, Mycobacterium avium subsp. paratuberculosis
gccgggccgcccg

SEQ ID NO: 3022074 - RNA, 14 nt, Mycobacterium avium subsp. paratuberculosis
gccgggccgcccgc

SEQ ID NO: 3022075 - RNA, 18 nt, Mycobacterium avium subsp. paratuberculosis
gccgggccgcccgcgcgu

SEQ ID NO: 3022076 - RNA, 17 nt, Mycobacterium avium subsp. paratuberculosis
gccgggccgccgaugcg

SEQ ID NO: 3022077 - RNA, 22 nt, Mycobacterium avium subsp. paratuberculosis
gccgggccgccgaugcgcccgc

SEQ ID NO: 3022078 - RNA, 23 nt, Mycobacterium avium subsp. paratuberculosis
gccgggccgccgaugcgcccgcu

SEQ ID NO: 3022079 - RNA, 13 nt, Mycobacterium avium subsp. paratuberculosis
gccgggccgccgc

SEQ ID NO: 3022080 - RNA, 22 nt, Mycobacterium avium subsp. paratuberculosis
gccgggccgccgcggccacacu

SEQ ID NO: 3022081 - RNA, 20 nt, Mycobacterium avium subsp. paratuberculosis
gccgggccggaacgcccgau

SEQ ID NO: 3022082 - RNA, 14 nt, Mycobacterium avium subsp. paratuberculosis
gccgggccggaucg

SEQ ID NO: 3022083 - RNA, 15 nt, Mycobacterium avium subsp. paratuberculosis
gccgggccggccggu

SEQ ID NO: 3022084 - RNA, 13 nt, Mycobacterium avium subsp. paratuberculosis
gccgggccggcgg

SEQ ID NO: 3022085 - RNA, 16 nt, Mycobacterium avium subsp. paratuberculosis
gccgggccggcggcca

SEQ ID NO: 3022086 - RNA, 19 nt, Mycobacterium avium subsp. paratuberculosis
gccgggccugcagcaacuc

SEQ ID NO: 3022087 - RNA, 15 nt, Mycobacterium avium subsp. paratuberculosis
gccgggccugcggcg

SEQ ID NO: 3022088 - RNA, 18 nt, Mycobacterium avium subsp. paratuberculosis
gccgggccugcggcgcgg

SEQ ID NO: 3022089 - RNA, 20 nt, Mycobacterium avium subsp. paratuberculosis
gccgggcgaagucgccggcc

SEQ ID NO: 3022090 - RNA, 21 nt, Mycobacterium avium subsp. paratuberculosis
gccgggcgaagucgccggcca

SEQ ID NO: 3022091 - RNA, 23 nt, Mycobacterium avium subsp. paratuberculosis
gccgggcgaagucgccggccagg

SEQ ID NO: 3022092 - RNA, 18 nt, Mycobacterium avium subsp. paratuberculosis
gccgggcgaucauccagg

SEQ ID NO: 3022093 - RNA, 23 nt, Mycobacterium avium subsp. paratuberculosis
gccgggcgaucucuucgaugccg

SEQ ID NO: 3022094 - RNA, 14 nt, Mycobacterium avium subsp. paratuberculosis
gccgggcgccaccc

SEQ ID NO: 3022095 - RNA, 19 nt, Mycobacterium avium subsp. paratuberculosis
gccgggcgccacccgcaug

SEQ ID NO: 3022096 - RNA, 18 nt, Mycobacterium avium subsp. paratuberculosis
gccgggcgccacgcuggc

SEQ ID NO: 3022097 - RNA, 19 nt, Mycobacterium avium subsp. paratuberculosis
gccgggcgccacgcuggcg

SEQ ID NO: 3022098 - RNA, 12 nt, Mycobacterium avium subsp. paratuberculosis
gccgggcgcccc

SEQ ID NO: 3022099 - RNA, 13 nt, Mycobacterium avium subsp. paratuberculosis
gccgggcgcccga

SEQ ID NO: 3022100 - RNA, 15 nt, Mycobacterium avium subsp. paratuberculosis
gccgggcgcccgagc

SEQ ID NO: 3022101 - RNA, 13 nt, Mycobacterium avium subsp. paratuberculosis
gccgggcgcccgc

SEQ ID NO: 3022102 - RNA, 15 nt, Mycobacterium avium subsp. paratuberculosis
gccgggcgcccgcgg

SEQ ID NO: 3022103 - RNA, 23 nt, Mycobacterium avium subsp. paratuberculosis
gccgggcgcgaauuccucagcgc

SEQ ID NO: 3022104 - RNA, 16 nt, Mycobacterium avium subsp. paratuberculosis
gccgggcgcgggcgcc

SEQ ID NO: 3022105 - RNA, 22 nt, Mycobacterium avium subsp. paratuberculosis
gccgggcggacggcaccgacgg

SEQ ID NO: 3022106 - RNA, 14 nt, Mycobacterium avium subsp. paratuberculosis
gccgggcggcagca

SEQ ID NO: 3022107 - RNA, 12 nt, Mycobacterium avium subsp. paratuberculosis
gccgggcggcca

SEQ ID NO: 3022108 - RNA, 16 nt, Mycobacterium avium subsp. paratuberculosis
gccgggcggccagcgu

SEQ ID NO: 3022109 - RNA, 14 nt, Mycobacterium avium subsp. paratuberculosis
gccgggcggccagg

SEQ ID NO: 3022110 - RNA, 13 nt, Mycobacterium avium subsp. paratuberculosis
gccgggcggcccg

SEQ ID NO: 3022111 - RNA, 18 nt, Mycobacterium avium subsp. paratuberculosis
gccgggcggcccgccucg

SEQ ID NO: 3022112 - RNA, 12 nt, Mycobacterium avium subsp. paratuberculosis
gccgggcggccg

SEQ ID NO: 3022113 - RNA, 14 nt, Mycobacterium avium subsp. paratuberculosis
gccgggcggccgga

SEQ ID NO: 3022114 - RNA, 17 nt, Mycobacterium avium subsp. paratuberculosis
gccgggcggccgggccg

SEQ ID NO: 3022115 - RNA, 22 nt, Mycobacterium avium subsp. paratuberculosis
gccgggcggccucggcguccgc

SEQ ID NO: 3022116 - RNA, 17 nt, Mycobacterium avium subsp. paratuberculosis
gccgggcggcgacgucg

SEQ ID NO: 3022117 - RNA, 18 nt, Mycobacterium avium subsp. paratuberculosis
gccgggcggcgacgucgu

SEQ ID NO: 3022118 - RNA, 20 nt, Mycobacterium avium subsp. paratuberculosis
gccgggcggcgccgaaccgg

SEQ ID NO: 3022119 - RNA, 21 nt, Mycobacterium avium subsp. paratuberculosis
gccgggcggcgccgaaccggg

SEQ ID NO: 3022120 - RNA, 12 nt, Mycobacterium avium subsp. paratuberculosis
gccgggcggcgu

SEQ ID NO: 3022121 - RNA, 13 nt, Mycobacterium avium subsp. paratuberculosis
gccgggcggcguc

SEQ ID NO: 3022122 - RNA, 14 nt, Mycobacterium avium subsp. paratuberculosis
gccgggcggcgucc

SEQ ID NO: 3022123 - RNA, 13 nt, Mycobacterium avium subsp. paratuberculosis
gccgggcgggcac

SEQ ID NO: 3022124 - RNA, 17 nt, Mycobacterium avium subsp. paratuberculosis
gccgggcgggccgcagc

SEQ ID NO: 3022125 - RNA, 21 nt, Mycobacterium avium subsp. paratuberculosis
gccgggcgggccgcagcacca

SEQ ID NO: 3022126 - RNA, 19 nt, Mycobacterium avium subsp. paratuberculosis
gccgggcgggggcugucca

SEQ ID NO: 3022127 - RNA, 13 nt, Mycobacterium avium subsp. paratuberculosis
gccgggcggggug

SEQ ID NO: 3022128 - RNA, 17 nt, Mycobacterium avium subsp. paratuberculosis
gccgggcgguacgcgcc

SEQ ID NO: 3022129 - RNA, 18 nt, Mycobacterium avium subsp. paratuberculosis
gccgggcgguacgcgccg

SEQ ID NO: 3022130 - RNA, 19 nt, Mycobacterium avium subsp. paratuberculosis
gccgggcgucacgccagcg

SEQ ID NO: 3022131 - RNA, 20 nt, Mycobacterium avium subsp. paratuberculosis
gccgggcgucacgccagcgu

SEQ ID NO: 3022132 - RNA, 22 nt, Mycobacterium avium subsp. paratuberculosis
gccgggcgucacgccagcguga

SEQ ID NO: 3022133 - RNA, 17 nt, Mycobacterium avium subsp. paratuberculosis
gccgggcgucacucugg

SEQ ID NO: 3022134 - RNA, 20 nt, Mycobacterium avium subsp. paratuberculosis
gccgggcgucacucuggcgu

SEQ ID NO: 3022135 - RNA, 22 nt, Mycobacterium avium subsp. paratuberculosis
gccgggcgucacucuggcguga

SEQ ID NO: 3022136 - RNA, 15 nt, Mycobacterium avium subsp. paratuberculosis
gccggggucgacagc

SEQ ID NO: 3022137 - RNA, 19 nt, Mycobacterium avium subsp. paratuberculosis
gccggggucgacagccuga

SEQ ID NO: 3022138 - RNA, 13 nt, Mycobacterium avium subsp. paratuberculosis
gccggggucgcgc

SEQ ID NO: 3022139 - RNA, 15 nt, Mycobacterium avium subsp. paratuberculosis
gccggggucgcgcgc

SEQ ID NO: 3022140 - RNA, 17 nt, Mycobacterium avium subsp. paratuberculosis
gccggggugcagcacca

SEQ ID NO: 3022141 - RNA, 20 nt, Mycobacterium avium subsp. paratuberculosis
gccggggugcagcaccacga

SEQ ID NO: 3022142 - RNA, 18 nt, Mycobacterium avium subsp. paratuberculosis
gccggggugggccaucgg

SEQ ID NO: 3022143 - RNA, 13 nt, Mycobacterium avium subsp. paratuberculosis
gccggggugugca

SEQ ID NO: 3022144 - RNA, 17 nt, Mycobacterium avium subsp. paratuberculosis
gccgggguuuucguggu

SEQ ID NO: 3022145 - RNA, 20 nt, Mycobacterium avium subsp. paratuberculosis
gccgggucacgugcacccac

SEQ ID NO: 3022146 - RNA, 22 nt, Mycobacterium avium subsp. paratuberculosis
gccgggucaggaacaccgagcc

SEQ ID NO: 3022147 - RNA, 18 nt, Mycobacterium avium subsp. paratuberculosis
gccgggucaguucgcggc

SEQ ID NO: 3022148 - RNA, 19 nt, Mycobacterium avium subsp. paratuberculosis
gccgggucaguucgcggcg

SEQ ID NO: 3022149 - RNA, 17 nt, Mycobacterium avium subsp. paratuberculosis
gccgggucauccagccg

SEQ ID NO: 3022150 - RNA, 19 nt, Mycobacterium avium subsp. paratuberculosis
gccgggucauccagccgug

SEQ ID NO: 3022151 - RNA, 13 nt, Mycobacterium avium subsp. paratuberculosis
gccggguccagcc

SEQ ID NO: 3022152 - RNA, 20 nt, Mycobacterium avium subsp. paratuberculosis
gccggguccagccgcgguuc

SEQ ID NO: 3022153 - RNA, 16 nt, Mycobacterium avium subsp. paratuberculosis
gccgggucccagugcc

SEQ ID NO: 3022154 - RNA, 21 nt, Mycobacterium avium subsp. paratuberculosis
gccgggucccuuugcuguucg

SEQ ID NO: 3022155 - RNA, 23 nt, Mycobacterium avium subsp. paratuberculosis
gccgggucccuuugcuguucguc

SEQ ID NO: 3022156 - RNA, 16 nt, Mycobacterium avium subsp. paratuberculosis
gccggguccgcacccg

SEQ ID NO: 3022157 - RNA, 17 nt, Mycobacterium avium subsp. paratuberculosis
gccggguccgcacccgg

SEQ ID NO: 3022158 - RNA, 18 nt, Mycobacterium avium subsp. paratuberculosis
gccggguccuggaaggcg

SEQ ID NO: 3022159 - RNA, 13 nt, Mycobacterium avium subsp. paratuberculosis
gccggguccuugc

SEQ ID NO: 3022160 - RNA, 15 nt, Mycobacterium avium subsp. paratuberculosis
gccggguccuugcgc

SEQ ID NO: 3022161 - RNA, 21 nt, Mycobacterium avium subsp. paratuberculosis
gccggguccuugcgccccggc

SEQ ID NO: 3022162 - RNA, 23 nt, Mycobacterium avium subsp. paratuberculosis
gccggguccuugcgccccggcgg

SEQ ID NO: 3022163 - RNA, 13 nt, Mycobacterium avium subsp. paratuberculosis
gccgggucgaacg

SEQ ID NO: 3022164 - RNA, 20 nt, Mycobacterium avium subsp. paratuberculosis
gccgggucgaacggcaaccu

SEQ ID NO: 3022165 - RNA, 16 nt, Mycobacterium avium subsp. paratuberculosis
gccgggucgacgccga

SEQ ID NO: 3022166 - RNA, 14 nt, Mycobacterium avium subsp. paratuberculosis
gccgggucgcacgc

SEQ ID NO: 3022167 - RNA, 16 nt, Mycobacterium avium subsp. paratuberculosis
gccgggucgcacgccg

SEQ ID NO: 3022168 - RNA, 15 nt, Mycobacterium avium subsp. paratuberculosis
gccgggucgccgucg

SEQ ID NO: 3022169 - RNA, 16 nt, Mycobacterium avium subsp. paratuberculosis
gccgggucgccgucga

SEQ ID NO: 3022170 - RNA, 18 nt, Mycobacterium avium subsp. paratuberculosis
gccgggucgccgucgagg

SEQ ID NO: 3022171 - RNA, 13 nt, Mycobacterium avium subsp. paratuberculosis
gccgggucgcggu

SEQ ID NO: 3022172 - RNA, 14 nt, Mycobacterium avium subsp. paratuberculosis
gccgggucgcggug

SEQ ID NO: 3022173 - RNA, 22 nt, Mycobacterium avium subsp. paratuberculosis
gccgggucgggaccgaugccgc

SEQ ID NO: 3022174 - RNA, 19 nt, Mycobacterium avium subsp. paratuberculosis
gccgggucuuccacgccgg

SEQ ID NO: 3022175 - RNA, 17 nt, Mycobacterium avium subsp. paratuberculosis
gccgggugaacccgacg

SEQ ID NO: 3022176 - RNA, 12 nt, Mycobacterium avium subsp. paratuberculosis
gccgggugaugc

SEQ ID NO: 3022177 - RNA, 15 nt, Mycobacterium avium subsp. paratuberculosis
gccgggugaugcagu

SEQ ID NO: 3022178 - RNA, 17 nt, Mycobacterium avium subsp. paratuberculosis
gccgggugcccaucugc

SEQ ID NO: 3022179 - RNA, 15 nt, Mycobacterium avium subsp. paratuberculosis
gccgggugcccgcgu

SEQ ID NO: 3022180 - RNA, 14 nt, Mycobacterium avium subsp. paratuberculosis
gccgggugcgggcc

SEQ ID NO: 3022181 - RNA, 17 nt, Mycobacterium avium subsp. paratuberculosis
gccgggugcgggccagc

SEQ ID NO: 3022182 - RNA, 22 nt, Mycobacterium avium subsp. paratuberculosis
gccgggugcgggccagcagccg

SEQ ID NO: 3022183 - RNA, 14 nt, Mycobacterium avium subsp. paratuberculosis
gccgggugcggugc

SEQ ID NO: 3022184 - RNA, 15 nt, Mycobacterium avium subsp. paratuberculosis
gccgggugcggugca

SEQ ID NO: 3022185 - RNA, 23 nt, Mycobacterium avium subsp. paratuberculosis
gccgggugcugaacgccugccgg

SEQ ID NO: 3022186 - RNA, 14 nt, Mycobacterium avium subsp. paratuberculosis
gccggguggcccgc

SEQ ID NO: 3022187 - RNA, 15 nt, Mycobacterium avium subsp. paratuberculosis
gccggguggcccgcc

SEQ ID NO: 3022188 - RNA, 16 nt, Mycobacterium avium subsp. paratuberculosis
gccggguggcccgccc

SEQ ID NO: 3022189 - RNA, 17 nt, Mycobacterium avium subsp. paratuberculosis
gccggguggcccgcccg

SEQ ID NO: 3022190 - RNA, 20 nt, Mycobacterium avium subsp. paratuberculosis
gccggguggccggggccauc

SEQ ID NO: 3022191 - RNA, 17 nt, Mycobacterium avium subsp. paratuberculosis
gccggguggcggggcgu

SEQ ID NO: 3022192 - RNA, 17 nt, Mycobacterium avium subsp. paratuberculosis
gccgggugggcagcccc

SEQ ID NO: 3022193 - RNA, 18 nt, Mycobacterium avium subsp. paratuberculosis
gccgggugggcagcccca

SEQ ID NO: 3022194 - RNA, 15 nt, Mycobacterium avium subsp. paratuberculosis
gccgggugggcggca

SEQ ID NO: 3022195 - RNA, 22 nt, Mycobacterium avium subsp. paratuberculosis
gccgggugggcggcacaccgcg

SEQ ID NO: 3022196 - RNA, 18 nt, Mycobacterium avium subsp. paratuberculosis
gccggguguagcugggcc

SEQ ID NO: 3022197 - RNA, 18 nt, Mycobacterium avium subsp. paratuberculosis
gccggguuggcauccagg

SEQ ID NO: 3022198 - RNA, 14 nt, Mycobacterium avium subsp. paratuberculosis
gccggguugggcgg

SEQ ID NO: 3022199 - RNA, 19 nt, Mycobacterium avium subsp. paratuberculosis
gccggguugggcggcggcc

SEQ ID NO: 3022200 - RNA, 21 nt, Mycobacterium avium subsp. paratuberculosis
gccggguugggcggcggccac

SEQ ID NO: 3022201 - RNA, 21 nt, Mycobacterium avium subsp. paratuberculosis
gccggguuguagcaggcggug

SEQ ID NO: 3022202 - RNA, 22 nt, Mycobacterium avium subsp. paratuberculosis
gccggguuguagcaggcggugg

SEQ ID NO: 3022203 - RNA, 20 nt, Mycobacterium avium subsp. paratuberculosis
gccggguuguccuggcccuu

SEQ ID NO: 3022204 - RNA, 14 nt, Mycobacterium avium subsp. paratuberculosis
gccggguuucggcc

SEQ ID NO: 3022205 - RNA, 15 nt, Mycobacterium avium subsp. paratuberculosis
gccggguuucggccc

SEQ ID NO: 3022206 - RNA, 19 nt, Mycobacterium avium subsp. paratuberculosis
gccggguuucggcccggcu

SEQ ID NO: 3022207 - RNA, 21 nt, Mycobacterium avium subsp. paratuberculosis
gccggguuuucgggccgguca

SEQ ID NO: 3022208 - RNA, 19 nt, Mycobacterium avium subsp. paratuberculosis
gccgguaaaacuggccagc

SEQ ID NO: 3022209 - RNA, 20 nt, Mycobacterium avium subsp. paratuberculosis
gccgguaaaacuggccagca

SEQ ID NO: 3022210 - RNA, 19 nt, Mycobacterium avium subsp. paratuberculosis
gccgguaaugggcgaucga

SEQ ID NO: 3022211 - RNA, 15 nt, Mycobacterium avium subsp. paratuberculosis
gccgguaccgccggc

SEQ ID NO: 3022212 - RNA, 16 nt, Mycobacterium avium subsp. paratuberculosis
gccgguaccgccggcc

SEQ ID NO: 3022213 - RNA, 17 nt, Mycobacterium avium subsp. paratuberculosis
gccgguaccgccggcca

SEQ ID NO: 3022214 - RNA, 17 nt, Mycobacterium avium subsp. paratuberculosis
gccgguacggaucgccg

SEQ ID NO: 3022215 - RNA, 22 nt, Mycobacterium avium subsp. paratuberculosis
gccgguacggccgacgcccagc

SEQ ID NO: 3022216 - RNA, 14 nt, Mycobacterium avium subsp. paratuberculosis
gccgguagagcgcc

SEQ ID NO: 3022217 - RNA, 16 nt, Mycobacterium avium subsp. paratuberculosis
gccgguagagcgccag

SEQ ID NO: 3022218 - RNA, 17 nt, Mycobacterium avium subsp. paratuberculosis
gccgguagaucagcgcc

SEQ ID NO: 3022219 - RNA, 18 nt, Mycobacterium avium subsp. paratuberculosis
gccgguagccgcucgccc

SEQ ID NO: 3022220 - RNA, 21 nt, Mycobacterium avium subsp. paratuberculosis
gccgguagccgcucgcccagc

SEQ ID NO: 3022221 - RNA, 18 nt, Mycobacterium avium subsp. paratuberculosis
gccagcgcccgcgcgugg

SEQ ID NO: 3022222 - RNA, 15 nt, Mycobacterium avium subsp. paratuberculosis
gccagcgcccgcggg

SEQ ID NO: 3022223 - RNA, 21 nt, Mycobacterium avium subsp. paratuberculosis
gccagcgcccgcgggugcagc

SEQ ID NO: 3022224 - RNA, 16 nt, Mycobacterium avium subsp. paratuberculosis
gccagcgcccgcugcg

SEQ ID NO: 3022225 - RNA, 18 nt, Mycobacterium avium subsp. paratuberculosis
gccagcgcccgcugcgcg

SEQ ID NO: 3022226 - RNA, 19 nt, Mycobacterium avium subsp. paratuberculosis
gccagcgcccgcugcgcgg

SEQ ID NO: 3022227 - RNA, 15 nt, Mycobacterium avium subsp. paratuberculosis
gccagcgcccggcga

SEQ ID NO: 3022228 - RNA, 19 nt, Mycobacterium avium subsp. paratuberculosis
gccagcgccgagaucgcgg

SEQ ID NO: 3022229 - RNA, 12 nt, Mycobacterium avium subsp. paratuberculosis
gccagcgccgca

SEQ ID NO: 3022230 - RNA, 13 nt, Mycobacterium avium subsp. paratuberculosis
gccagcgccgcaa

SEQ ID NO: 3022231 - RNA, 14 nt, Mycobacterium avium subsp. paratuberculosis
gccagcgccgcaac

SEQ ID NO: 3022232 - RNA, 21 nt, Mycobacterium avium subsp. paratuberculosis
gccagcgccgcaacggcuccc

SEQ ID NO: 3022233 - RNA, 14 nt, Mycobacterium avium subsp. paratuberculosis
gccagcgccgcacu

SEQ ID NO: 3022234 - RNA, 12 nt, Mycobacterium avium subsp. paratuberculosis
gccagcgccgcc

SEQ ID NO: 3022235 - RNA, 13 nt, Mycobacterium avium subsp. paratuberculosis
gccagcgccgcca

SEQ ID NO: 3022236 - RNA, 16 nt, Mycobacterium avium subsp. paratuberculosis
gccagcgccgccagcc

SEQ ID NO: 3022237 - RNA, 21 nt, Mycobacterium avium subsp. paratuberculosis
gccagcgccgccagccgcagc

SEQ ID NO: 3022238 - RNA, 13 nt, Mycobacterium avium subsp. paratuberculosis
gccagcgccgccc

SEQ ID NO: 3022239 - RNA, 16 nt, Mycobacterium avium subsp. paratuberculosis
gccagcgccgcccggg

SEQ ID NO: 3022240 - RNA, 20 nt, Mycobacterium avium subsp. paratuberculosis
gccagcgccgcccgggcggc

SEQ ID NO: 3022241 - RNA, 14 nt, Mycobacterium avium subsp. paratuberculosis
gccagcgccgcgcg

SEQ ID NO: 3022242 - RNA, 15 nt, Mycobacterium avium subsp. paratuberculosis
gccagcgccgcgcgc

SEQ ID NO: 3022243 - RNA, 17 nt, Mycobacterium avium subsp. paratuberculosis
gccagcgccgcgcgcgc

SEQ ID NO: 3022244 - RNA, 14 nt, Mycobacterium avium subsp. paratuberculosis
gccagcgccggcag

SEQ ID NO: 3022245 - RNA, 12 nt, Mycobacterium avium subsp. paratuberculosis
gccagcgccggg

SEQ ID NO: 3022246 - RNA, 12 nt, Mycobacterium avium subsp. paratuberculosis
gccagcgccguc

SEQ ID NO: 3022247 - RNA, 13 nt, Mycobacterium avium subsp. paratuberculosis
gccagcgccguca

SEQ ID NO: 3022248 - RNA, 19 nt, Mycobacterium avium subsp. paratuberculosis
gccagcgccgucaucaccg

SEQ ID NO: 3022249 - RNA, 13 nt, Mycobacterium avium subsp. paratuberculosis
gccagcgccucca

SEQ ID NO: 3022250 - RNA, 17 nt, Mycobacterium avium subsp. paratuberculosis
gccagcgccuccagccg

SEQ ID NO: 3022251 - RNA, 19 nt, Mycobacterium avium subsp. paratuberculosis
gccagcgccuccagccgcu

SEQ ID NO: 3022252 - RNA, 12 nt, Mycobacterium avium subsp. paratuberculosis
gccagcgccucg

SEQ ID NO: 3022253 - RNA, 14 nt, Mycobacterium avium subsp. paratuberculosis
gccagcgccucggc

SEQ ID NO: 3022254 - RNA, 15 nt, Mycobacterium avium subsp. paratuberculosis
gccagcgccucggcg

SEQ ID NO: 3022255 - RNA, 16 nt, Mycobacterium avium subsp. paratuberculosis
gccagcgccucggcgu

SEQ ID NO: 3022256 - RNA, 23 nt, Mycobacterium avium subsp. paratuberculosis
gccagcgccucggcgucaccgcg

SEQ ID NO: 3022257 - RNA, 15 nt, Mycobacterium avium subsp. paratuberculosis
gccagcgccuucggc

SEQ ID NO: 3022258 - RNA, 18 nt, Mycobacterium avium subsp. paratuberculosis
gccagcgccuucggcgcc

SEQ ID NO: 3022259 - RNA, 21 nt, Mycobacterium avium subsp. paratuberculosis
gccagcgccuucggcgccagc

SEQ ID NO: 3022260 - RNA, 22 nt, Mycobacterium avium subsp. paratuberculosis
gccagcgccuucggcgccagcc

SEQ ID NO: 3022261 - RNA, 21 nt, Mycobacterium avium subsp. paratuberculosis
gccagcgcgaaagcagcaacg

SEQ ID NO: 3022262 - RNA, 21 nt, Mycobacterium avium subsp. paratuberculosis
gccagcgcgacccgcucgacg

SEQ ID NO: 3022263 - RNA, 19 nt, Mycobacterium avium subsp. paratuberculosis
gccagcgcgacgcgcaugc

SEQ ID NO: 3022264 - RNA, 14 nt, Mycobacterium avium subsp. paratuberculosis
gccagcgcgacggc

SEQ ID NO: 3022265 - RNA, 12 nt, Mycobacterium avium subsp. paratuberculosis
gccagcgcgauc

SEQ ID NO: 3022266 - RNA, 20 nt, Mycobacterium avium subsp. paratuberculosis
gccagcgcgaucgccgggau

SEQ ID NO: 3022267 - RNA, 18 nt, Mycobacterium avium subsp. paratuberculosis
gccagcgcgcccgccauc

SEQ ID NO: 3022268 - RNA, 20 nt, Mycobacterium avium subsp. paratuberculosis
gccagcgcgcccgccaucug

SEQ ID NO: 3022269 - RNA, 22 nt, Mycobacterium avium subsp. paratuberculosis
gccagcgcgccgaucgcccagu

SEQ ID NO: 3022270 - RNA, 15 nt, Mycobacterium avium subsp. paratuberculosis
gccagcgcgccgcac

SEQ ID NO: 3022271 - RNA, 18 nt, Mycobacterium avium subsp. paratuberculosis
gccagcgcgccgcacagc

SEQ ID NO: 3022272 - RNA, 23 nt, Mycobacterium avium subsp. paratuberculosis
gccagcgcgccgcacagccggcg

SEQ ID NO: 3022273 - RNA, 17 nt, Mycobacterium avium subsp. paratuberculosis
gccagcgcgccgccgau

SEQ ID NO: 3022274 - RNA, 18 nt, Mycobacterium avium subsp. paratuberculosis
gccagcgcgccgccgaug

SEQ ID NO: 3022275 - RNA, 11 nt, Mycobacterium avium subsp. paratuberculosis
gccagcgcgcg

SEQ ID NO: 3022276 - RNA, 21 nt, Mycobacterium avium subsp. paratuberculosis
gccagcgcgcgaucagcgccg

SEQ ID NO: 3022277 - RNA, 14 nt, Mycobacterium avium subsp. paratuberculosis
gccagcgcgcgcag

SEQ ID NO: 3022278 - RNA, 13 nt, Mycobacterium avium subsp. paratuberculosis
gccagcgcgcggc

SEQ ID NO: 3022279 - RNA, 14 nt, Mycobacterium avium subsp. paratuberculosis
gccagcgcgcggcc

SEQ ID NO: 3022280 - RNA, 15 nt, Mycobacterium avium subsp. paratuberculosis
gccagcgcgcgggcg

SEQ ID NO: 3022281 - RNA, 17 nt, Mycobacterium avium subsp. paratuberculosis
gccagcgcgcgggcgcg

SEQ ID NO: 3022282 - RNA, 18 nt, Mycobacterium avium subsp. paratuberculosis
gccagcgcgcgggcgucc

SEQ ID NO: 3022283 - RNA, 12 nt, Mycobacterium avium subsp. paratuberculosis
gccagcgcggcg

SEQ ID NO: 3022284 - RNA, 14 nt, Mycobacterium avium subsp. paratuberculosis
gccagcgcggcgau

SEQ ID NO: 3022285 - RNA, 16 nt, Mycobacterium avium subsp. paratuberculosis
gccagcgcggcgauca

SEQ ID NO: 3022286 - RNA, 19 nt, Mycobacterium avium subsp. paratuberculosis
gccagcgcggcgaucagca

SEQ ID NO: 3022287 - RNA, 21 nt, Mycobacterium avium subsp. paratuberculosis
gccagcgcggcgaucagcagc

SEQ ID NO: 3022288 - RNA, 13 nt, Mycobacterium avium subsp. paratuberculosis
gccagcgcggcgg

SEQ ID NO: 3022289 - RNA, 14 nt, Mycobacterium avium subsp. paratuberculosis
gccagcgcggcggc

SEQ ID NO: 3022290 - RNA, 17 nt, Mycobacterium avium subsp. paratuberculosis
gccagcgcggcggccag

SEQ ID NO: 3022291 - RNA, 16 nt, Mycobacterium avium subsp. paratuberculosis
gccagcgcggcggcgc

SEQ ID NO: 3022292 - RNA, 19 nt, Mycobacterium avium subsp. paratuberculosis
gccagcgcggcggcgccgu

SEQ ID NO: 3022293 - RNA, 20 nt, Mycobacterium avium subsp. paratuberculosis
gccagcgcggcggcgccguc

SEQ ID NO: 3022294 - RNA, 21 nt, Mycobacterium avium subsp. paratuberculosis
gccagcgcggcggcgccgucg

SEQ ID NO: 3022295 - RNA, 14 nt, Mycobacterium avium subsp. paratuberculosis
gccagcgcggcggu

SEQ ID NO: 3022296 - RNA, 15 nt, Mycobacterium avium subsp. paratuberculosis
gccagcgcggcgguc

SEQ ID NO: 3022297 - RNA, 13 nt, Mycobacterium avium subsp. paratuberculosis
gccagcgcggcgu

SEQ ID NO: 3022298 - RNA, 14 nt, Mycobacterium avium subsp. paratuberculosis
gccagcgcggcguc

SEQ ID NO: 3022299 - RNA, 15 nt, Mycobacterium avium subsp. paratuberculosis
gccagcgcggcguca

SEQ ID NO: 3022300 - RNA, 18 nt, Mycobacterium avium subsp. paratuberculosis
gccagcgcggggucggcc

SEQ ID NO: 3022301 - RNA, 20 nt, Mycobacterium avium subsp. paratuberculosis
gccagcgcggggucggccag

SEQ ID NO: 3022302 - RNA, 16 nt, Mycobacterium avium subsp. paratuberculosis
gccagcgcggugccca

SEQ ID NO: 3022303 - RNA, 18 nt, Mycobacterium avium subsp. paratuberculosis
gccagcgcggugcccagc

SEQ ID NO: 3022304 - RNA, 19 nt, Mycobacterium avium subsp. paratuberculosis
gccagcgcggugcccagcc

SEQ ID NO: 3022305 - RNA, 16 nt, Mycobacterium avium subsp. paratuberculosis
gccagcgcgguggcca

SEQ ID NO: 3022306 - RNA, 19 nt, Mycobacterium avium subsp. paratuberculosis
gccagcgcgguggccagca

SEQ ID NO: 3022307 - RNA, 20 nt, Mycobacterium avium subsp. paratuberculosis
gccagcgcgguggccagcag

SEQ ID NO: 3022308 - RNA, 21 nt, Mycobacterium avium subsp. paratuberculosis
gccagcgcgguggccagcagg

SEQ ID NO: 3022309 - RNA, 21 nt, Mycobacterium avium subsp. paratuberculosis
gccagcgcggugucgacgucg

SEQ ID NO: 3022310 - RNA, 14 nt, Mycobacterium avium subsp. paratuberculosis
gccagcgcgucgca

SEQ ID NO: 3022311 - RNA, 20 nt, Mycobacterium avium subsp. paratuberculosis
gccagcgcgucgcacagcgc

SEQ ID NO: 3022312 - RNA, 21 nt, Mycobacterium avium subsp. paratuberculosis
gccagcgcgucgcacagcgcc

SEQ ID NO: 3022313 - RNA, 22 nt, Mycobacterium avium subsp. paratuberculosis
gccagcgcgucgcacagcgccg

SEQ ID NO: 3022314 - RNA, 23 nt, Mycobacterium avium subsp. paratuberculosis
gccagcgcgucgcacagcgccgc

SEQ ID NO: 3022315 - RNA, 15 nt, Mycobacterium avium subsp. paratuberculosis
gccagcgcgucggcc

SEQ ID NO: 3022316 - RNA, 18 nt, Mycobacterium avium subsp. paratuberculosis
gccagcgcgucggccagc

SEQ ID NO: 3022317 - RNA, 21 nt, Mycobacterium avium subsp. paratuberculosis
gccagcgcgucggccagcacc

SEQ ID NO: 3022318 - RNA, 12 nt, Mycobacterium avium subsp. paratuberculosis
gccagcgcguga

SEQ ID NO: 3022319 - RNA, 20 nt, Mycobacterium avium subsp. paratuberculosis
gccagcgcgugaucggugcc

SEQ ID NO: 3022320 - RNA, 21 nt, Mycobacterium avium subsp. paratuberculosis
gccagcgcgugaucggugccc

SEQ ID NO: 3022321 - RNA, 23 nt, Mycobacterium avium subsp. paratuberculosis
gccagcgcgugaucggugcccgc

SEQ ID NO: 3022322 - RNA, 16 nt, Mycobacterium avium subsp. paratuberculosis
gccagcgcgugcgggg

SEQ ID NO: 3022323 - RNA, 22 nt, Mycobacterium avium subsp. paratuberculosis
gccagcgcgugcggggugugca

SEQ ID NO: 3022324 - RNA, 10 nt, Mycobacterium avium subsp. paratuberculosis
gccagcggca

SEQ ID NO: 3022325 - RNA, 18 nt, Mycobacterium avium subsp. paratuberculosis
gccagcggcaacugggcg

SEQ ID NO: 3022326 - RNA, 15 nt, Mycobacterium avium subsp. paratuberculosis
gccagcggcagcgcc

SEQ ID NO: 3022327 - RNA, 16 nt, Mycobacterium avium subsp. paratuberculosis
gccagcggcagcgcca

SEQ ID NO: 3022328 - RNA, 17 nt, Mycobacterium avium subsp. paratuberculosis
gccagcggcagcgccag

SEQ ID NO: 3022329 - RNA, 16 nt, Mycobacterium avium subsp. paratuberculosis
gccagcggcagcggcg

SEQ ID NO: 3022330 - RNA, 17 nt, Mycobacterium avium subsp. paratuberculosis
gccagcggcagcggcgu

SEQ ID NO: 3022331 - RNA, 19 nt, Mycobacterium avium subsp. paratuberculosis
gccagcggcagcggcgucg

SEQ ID NO: 3022332 - RNA, 14 nt, Mycobacterium avium subsp. paratuberculosis
gccagcggccagcc

SEQ ID NO: 3022333 - RNA, 15 nt, Mycobacterium avium subsp. paratuberculosis
gccagcggccagccc

SEQ ID NO: 3022334 - RNA, 16 nt, Mycobacterium avium subsp. paratuberculosis
gccagcggccagcccg

SEQ ID NO: 3022335 - RNA, 14 nt, Mycobacterium avium subsp. paratuberculosis
gccagcggccgauc

SEQ ID NO: 3022336 - RNA, 15 nt, Mycobacterium avium subsp. paratuberculosis
gccagcggcgccgaa

SEQ ID NO: 3022337 - RNA, 22 nt, Mycobacterium avium subsp. paratuberculosis
gccagcggcgccgaaaaacgcg

SEQ ID NO: 3022338 - RNA, 15 nt, Mycobacterium avium subsp. paratuberculosis
gccagcggcgccggg

SEQ ID NO: 3022339 - RNA, 20 nt, Mycobacterium avium subsp. paratuberculosis
gccagcggcgccgggucacc

SEQ ID NO: 3022340 - RNA, 15 nt, Mycobacterium avium subsp. paratuberculosis
gccagcggcuugccg

SEQ ID NO: 3022341 - RNA, 23 nt, Mycobacterium avium subsp. paratuberculosis
gccagcggcuuggccgugcaggg

SEQ ID NO: 3022342 - RNA, 23 nt, Mycobacterium avium subsp. paratuberculosis
gccagcgggauacccaugaucgc

SEQ ID NO: 3022343 - RNA, 15 nt, Mycobacterium avium subsp. paratuberculosis
gccagcgggccgacc

SEQ ID NO: 3022344 - RNA, 21 nt, Mycobacterium avium subsp. paratuberculosis
gccagcgggccgaccuggcgg

SEQ ID NO: 3022345 - RNA, 15 nt, Mycobacterium avium subsp. paratuberculosis
gccagcgggccgagc

SEQ ID NO: 3022346 - RNA, 16 nt, Mycobacterium avium subsp. paratuberculosis
gccagcgggccgagcg

SEQ ID NO: 3022347 - RNA, 22 nt, Mycobacterium avium subsp. paratuberculosis
gccagcgggccgagcguucggc

SEQ ID NO: 3022348 - RNA, 15 nt, Mycobacterium avium subsp. paratuberculosis
gccagcgggccgugc

SEQ ID NO: 3022349 - RNA, 16 nt, Mycobacterium avium subsp. paratuberculosis
gccagcgggccgugcc

SEQ ID NO: 3022350 - RNA, 17 nt, Mycobacterium avium subsp. paratuberculosis
gccagcgggccgugccg

SEQ ID NO: 3022351 - RNA, 21 nt, Mycobacterium avium subsp. paratuberculosis
gccagcgggccgugccgccau

SEQ ID NO: 3022352 - RNA, 14 nt, Mycobacterium avium subsp. paratuberculosis
gccagcgggcggcc

SEQ ID NO: 3022353 - RNA, 15 nt, Mycobacterium avium subsp. paratuberculosis
gccagcgggcggccc

SEQ ID NO: 3022354 - RNA, 20 nt, Mycobacterium avium subsp. paratuberculosis
gccagcgggcggccccgggc

SEQ ID NO: 3022355 - RNA, 22 nt, Mycobacterium avium subsp. paratuberculosis
gccagcgggcggccccgggcgc

SEQ ID NO: 3022356 - RNA, 16 nt, Mycobacterium avium subsp. paratuberculosis
gccagcggucacggac

SEQ ID NO: 3022357 - RNA, 15 nt, Mycobacterium avium subsp. paratuberculosis
gccagcgucagggcg

SEQ ID NO: 3022358 - RNA, 16 nt, Mycobacterium avium subsp. paratuberculosis
gccagcgucagggcga

SEQ ID NO: 3022359 - RNA, 19 nt, Mycobacterium avium subsp. paratuberculosis
gccagcgucagggcgacuc

SEQ ID NO: 3022360 - RNA, 19 nt, Mycobacterium avium subsp. paratuberculosis
gccagcgucgaguuguugg

SEQ ID NO: 3022361 - RNA, 13 nt, Mycobacterium avium subsp. paratuberculosis
gccagcgucgcgc

SEQ ID NO: 3022362 - RNA, 17 nt, Mycobacterium avium subsp. paratuberculosis
gccagcgucgcgccgcc

SEQ ID NO: 3022363 - RNA, 18 nt, Mycobacterium avium subsp. paratuberculosis
gccagcgucgcgccgcca

SEQ ID NO: 3022364 - RNA, 22 nt, Mycobacterium avium subsp. paratuberculosis
gccagcgucgcgccgccacccc

SEQ ID NO: 3022365 - RNA, 18 nt, Mycobacterium avium subsp. paratuberculosis
gccagcgucuccggcggg

SEQ ID NO: 3022366 - RNA, 19 nt, Mycobacterium avium subsp. paratuberculosis
gccagcgucuccggcgggc

SEQ ID NO: 3022367 - RNA, 21 nt, Mycobacterium avium subsp. paratuberculosis
gccagcgucugcugcgccauc

SEQ ID NO: 3022368 - RNA, 14 nt, Mycobacterium avium subsp. paratuberculosis
gccagcgugaacac

SEQ ID NO: 3022369 - RNA, 15 nt, Mycobacterium avium subsp. paratuberculosis
gccagcgugaacacc

SEQ ID NO: 3022370 - RNA, 18 nt, Mycobacterium avium subsp. paratuberculosis
gccagcgugaacagcgcc

SEQ ID NO: 3022371 - RNA, 19 nt, Mycobacterium avium subsp. paratuberculosis
gccagcgugaacagcgccc

SEQ ID NO: 3022372 - RNA, 12 nt, Mycobacterium avium subsp. paratuberculosis
gccagcgugacg

SEQ ID NO: 3022373 - RNA, 14 nt, Mycobacterium avium subsp. paratuberculosis
gccagcgugacgcc

SEQ ID NO: 3022374 - RNA, 16 nt, Mycobacterium avium subsp. paratuberculosis
gccagcgugacgcccg

SEQ ID NO: 3022375 - RNA, 18 nt, Mycobacterium avium subsp. paratuberculosis
gccagcgugacgcccggc

SEQ ID NO: 3022376 - RNA, 19 nt, Mycobacterium avium subsp. paratuberculosis
gccagcgugacgcccggcg

SEQ ID NO: 3022377 - RNA, 22 nt, Mycobacterium avium subsp. paratuberculosis
gccagcgugacgcccggcgccg

SEQ ID NO: 3022378 - RNA, 18 nt, Mycobacterium avium subsp. paratuberculosis
gccagcgugacgccgggc

SEQ ID NO: 3022379 - RNA, 19 nt, Mycobacterium avium subsp. paratuberculosis
gccagcgugacgccgggcc

SEQ ID NO: 3022380 - RNA, 23 nt, Mycobacterium avium subsp. paratuberculosis
gccagcgugacgccgggccgccg

SEQ ID NO: 3022381 - RNA, 15 nt, Mycobacterium avium subsp. paratuberculosis
gccagcgugacgcuc

SEQ ID NO: 3022382 - RNA, 17 nt, Mycobacterium avium subsp. paratuberculosis
gccagcgugacgcucgg

SEQ ID NO: 3022383 - RNA, 18 nt, Mycobacterium avium subsp. paratuberculosis
gccagcguggccagcacc

SEQ ID NO: 3022384 - RNA, 21 nt, Mycobacterium avium subsp. paratuberculosis
gccagcguggccagcaccguc

SEQ ID NO: 3022385 - RNA, 13 nt, Mycobacterium avium subsp. paratuberculosis
gccagcguggcgc

SEQ ID NO: 3022386 - RNA, 16 nt, Mycobacterium avium subsp. paratuberculosis
gccagcguggcgcgcc

SEQ ID NO: 3022387 - RNA, 21 nt, Mycobacterium avium subsp. paratuberculosis
gccagcguggcgcgccccggc

SEQ ID NO: 3022388 - RNA, 23 nt, Mycobacterium avium subsp. paratuberculosis
gccagcguggcgcgccccggccc

SEQ ID NO: 3022389 - RNA, 21 nt, Mycobacterium avium subsp. paratuberculosis
gccagcguuuccagcgccggc

SEQ ID NO: 3022390 - RNA, 21 nt, Mycobacterium avium subsp. paratuberculosis
gccagcguuuggccugcggca

SEQ ID NO: 3022391 - RNA, 17 nt, Mycobacterium avium subsp. paratuberculosis
gccgcccagcccgcgcc

SEQ ID NO: 3022392 - RNA, 18 nt, Mycobacterium avium subsp. paratuberculosis
gccgcccagcccgcgccg

SEQ ID NO: 3022393 - RNA, 19 nt, Mycobacterium avium subsp. paratuberculosis
gccgcccagcccgcgccga

SEQ ID NO: 3022394 - RNA, 13 nt, Mycobacterium avium subsp. paratuberculosis
gccgcccagcggc

SEQ ID NO: 3022395 - RNA, 16 nt, Mycobacterium avium subsp. paratuberculosis
gccgcccagcggcccc

SEQ ID NO: 3022396 - RNA, 17 nt, Mycobacterium avium subsp. paratuberculosis
gccgcccagcggccccg

SEQ ID NO: 3022397 - RNA, 14 nt, Mycobacterium avium subsp. paratuberculosis
gccgcccagcggug

SEQ ID NO: 3022398 - RNA, 15 nt, Mycobacterium avium subsp. paratuberculosis
gccgcccaggccccg

SEQ ID NO: 3022399 - RNA, 17 nt, Mycobacterium avium subsp. paratuberculosis
gccgcccaggccccggc

SEQ ID NO: 3022400 - RNA, 20 nt, Mycobacterium avium subsp. paratuberculosis
gccgcccaggccccggccga

SEQ ID NO: 3022401 - RNA, 16 nt, Mycobacterium avium subsp. paratuberculosis
gccgcccaggccgagc

SEQ ID NO: 3022402 - RNA, 14 nt, Mycobacterium avium subsp. paratuberculosis
gccgcccaggcggg

SEQ ID NO: 3022403 - RNA, 16 nt, Mycobacterium avium subsp. paratuberculosis
gccgcccaggcgggcc

SEQ ID NO: 3022404 - RNA, 20 nt, Mycobacterium avium subsp. paratuberculosis
gccgcccaggcgggccagcu

SEQ ID NO: 3022405 - RNA, 23 nt, Mycobacterium avium subsp. paratuberculosis
gccgcccaggcgggccagcucga

SEQ ID NO: 3022406 - RNA, 17 nt, Mycobacterium avium subsp. paratuberculosis
gccgcccagucgccgcc

SEQ ID NO: 3022407 - RNA, 18 nt, Mycobacterium avium subsp. paratuberculosis
gccgcccagucgccgccg

SEQ ID NO: 3022408 - RNA, 14 nt, Mycobacterium avium subsp. paratuberculosis
gccgcccaucaccc

SEQ ID NO: 3022409 - RNA, 15 nt, Mycobacterium avium subsp. paratuberculosis
gccgcccaucacccc

SEQ ID NO: 3022410 - RNA, 16 nt, Mycobacterium avium subsp. paratuberculosis
gccgcccaucaccccg

SEQ ID NO: 3022411 - RNA, 23 nt, Mycobacterium avium subsp. paratuberculosis
gccgcccaucagcaggaccaggc

SEQ ID NO: 3022412 - RNA, 15 nt, Mycobacterium avium subsp. paratuberculosis
gccgcccaucggcag

SEQ ID NO: 3022413 - RNA, 16 nt, Mycobacterium avium subsp. paratuberculosis
gccgcccaucggcagc

SEQ ID NO: 3022414 - RNA, 14 nt, Mycobacterium avium subsp. paratuberculosis
gccgcccaugccca

SEQ ID NO: 3022415 - RNA, 23 nt, Mycobacterium avium subsp. paratuberculosis
gccgcccaugcccaugucgaucg

SEQ ID NO: 3022416 - RNA, 20 nt, Mycobacterium avium subsp. paratuberculosis
gccgcccccgauagccccgc

SEQ ID NO: 3022417 - RNA, 16 nt, Mycobacterium avium subsp. paratuberculosis
gccgcccccgcccaca

SEQ ID NO: 3022418 - RNA, 14 nt, Mycobacterium avium subsp. paratuberculosis
gccgcccccgccgc

SEQ ID NO: 3022419 - RNA, 18 nt, Mycobacterium avium subsp. paratuberculosis
gccgcccccgccgcgagc

SEQ ID NO: 3022420 - RNA, 19 nt, Mycobacterium avium subsp. paratuberculosis
gccgcccccgccgcgagca

SEQ ID NO: 3022421 - RNA, 16 nt, Mycobacterium avium subsp. paratuberculosis
gccgcccccgcggcgu

SEQ ID NO: 3022422 - RNA, 17 nt, Mycobacterium avium subsp. paratuberculosis
gccgcccccgcggcguc

SEQ ID NO: 3022423 - RNA, 15 nt, Mycobacterium avium subsp. paratuberculosis
gccgcccccgcuggc

SEQ ID NO: 3022424 - RNA, 13 nt, Mycobacterium avium subsp. paratuberculosis
gccgccccggccg

SEQ ID NO: 3022425 - RNA, 14 nt, Mycobacterium avium subsp. paratuberculosis
gccgccccggccgc

SEQ ID NO: 3022426 - RNA, 15 nt, Mycobacterium avium subsp. paratuberculosis
gccgccccggccgcg

SEQ ID NO: 3022427 - RNA, 18 nt, Mycobacterium avium subsp. paratuberculosis
gccgccccggccgcgcac

SEQ ID NO: 3022428 - RNA, 14 nt, Mycobacterium avium subsp. paratuberculosis
gccgccccgucggu

SEQ ID NO: 3022429 - RNA, 13 nt, Mycobacterium avium subsp. paratuberculosis
gccgcccgaacuc

SEQ ID NO: 3022430 - RNA, 20 nt, Mycobacterium avium subsp. paratuberculosis
gccgcccgaacuccgaauac

SEQ ID NO: 3022431 - RNA, 14 nt, Mycobacterium avium subsp. paratuberculosis
gccgcccgacccgu

SEQ ID NO: 3022432 - RNA, 12 nt, Mycobacterium avium subsp. paratuberculosis
gccgcccgauca

SEQ ID NO: 3022433 - RNA, 23 nt, Mycobacterium avium subsp. paratuberculosis
gccgcccgaucaucucaccgacg

SEQ ID NO: 3022434 - RNA, 13 nt, Mycobacterium avium subsp. paratuberculosis
gccgcccgcacca

SEQ ID NO: 3022435 - RNA, 13 nt, Mycobacterium avium subsp. paratuberculosis
gccgcccgcaccu

SEQ ID NO: 3022436 - RNA, 16 nt, Mycobacterium avium subsp. paratuberculosis
gccgcccgcaccugcg

SEQ ID NO: 3022437 - RNA, 19 nt, Mycobacterium avium subsp. paratuberculosis
gccgcccgcaccugcgcgc

SEQ ID NO: 3022438 - RNA, 21 nt, Mycobacterium avium subsp. paratuberculosis
gccgcccgcaccugcgcgccg

SEQ ID NO: 3022439 - RNA, 13 nt, Mycobacterium avium subsp. paratuberculosis
gccgcccgcccga

SEQ ID NO: 3022440 - RNA, 14 nt, Mycobacterium avium subsp. paratuberculosis
gccgcccgcccgag

SEQ ID NO: 3022441 - RNA, 18 nt, Mycobacterium avium subsp. paratuberculosis
gccgcccgcccgagcguc

SEQ ID NO: 3022442 - RNA, 14 nt, Mycobacterium avium subsp. paratuberculosis
gccgcccgcgcggc

SEQ ID NO: 3022443 - RNA, 15 nt, Mycobacterium avium subsp. paratuberculosis
gccgcccgcgcggcg

SEQ ID NO: 3022444 - RNA, 13 nt, Mycobacterium avium subsp. paratuberculosis
gccgcccgcgcgu

SEQ ID NO: 3022445 - RNA, 14 nt, Mycobacterium avium subsp. paratuberculosis
gccgcccgcgcgug

SEQ ID NO: 3022446 - RNA, 17 nt, Mycobacterium avium subsp. paratuberculosis
gccgcccgcgcgugguc

SEQ ID NO: 3022447 - RNA, 16 nt, Mycobacterium avium subsp. paratuberculosis
gccgcccgcuccugca

SEQ ID NO: 3022448 - RNA, 22 nt, Mycobacterium avium subsp. paratuberculosis
gccgcccgcuccugcaggccga

SEQ ID NO: 3022449 - RNA, 20 nt, Mycobacterium avium subsp. paratuberculosis
gccgcccgcuggggcgcacc

SEQ ID NO: 3022450 - RNA, 22 nt, Mycobacterium avium subsp. paratuberculosis
gccgcccgcuggggcgcaccgc

SEQ ID NO: 3022451 - RNA, 13 nt, Mycobacterium avium subsp. paratuberculosis
gccgcccggaggu

SEQ ID NO: 3022452 - RNA, 17 nt, Mycobacterium avium subsp. paratuberculosis
gccgcccggcgagcagc

SEQ ID NO: 3022453 - RNA, 19 nt, Mycobacterium avium subsp. paratuberculosis
gccgcccggcgagcagccc

SEQ ID NO: 3022454 - RNA, 20 nt, Mycobacterium avium subsp. paratuberculosis
gccgcccggcgagcagcccg

SEQ ID NO: 3022455 - RNA, 22 nt, Mycobacterium avium subsp. paratuberculosis
gccgcccggcgagcagcccggc

SEQ ID NO: 3022456 - RNA, 13 nt, Mycobacterium avium subsp. paratuberculosis
gccgcccggcgau

SEQ ID NO: 3022457 - RNA, 18 nt, Mycobacterium avium subsp. paratuberculosis
gccgcccggcgaucucgg

SEQ ID NO: 3022458 - RNA, 12 nt, Mycobacterium avium subsp. paratuberculosis
gccgcccggcgc

SEQ ID NO: 3022459 - RNA, 16 nt, Mycobacterium avium subsp. paratuberculosis
gccgcccggcgccccg

SEQ ID NO: 3022460 - RNA, 15 nt, Mycobacterium avium subsp. paratuberculosis
gccgcccggcgcgcc

SEQ ID NO: 3022461 - RNA, 16 nt, Mycobacterium avium subsp. paratuberculosis
gccgcccggcgcgccg

SEQ ID NO: 3022462 - RNA, 18 nt, Mycobacterium avium subsp. paratuberculosis
gccgcccggcgcgccgca

SEQ ID NO: 3022463 - RNA, 19 nt, Mycobacterium avium subsp. paratuberculosis
gccgcccggcgcgccgcag

SEQ ID NO: 3022464 - RNA, 21 nt, Mycobacterium avium subsp. paratuberculosis
gccgcccggcgcgccgcagga

SEQ ID NO: 3022465 - RNA, 12 nt, Mycobacterium avium subsp. paratuberculosis
gccgcccgggcc

SEQ ID NO: 3022466 - RNA, 13 nt, Mycobacterium avium subsp. paratuberculosis
gccgcccgggccg

SEQ ID NO: 3022467 - RNA, 14 nt, Mycobacterium avium subsp. paratuberculosis
gccgcccgggccgc

SEQ ID NO: 3022468 - RNA, 18 nt, Mycobacterium avium subsp. paratuberculosis
gccgcccgggccgcgccc

SEQ ID NO: 3022469 - RNA, 15 nt, Mycobacterium avium subsp. paratuberculosis
gccgcccgggcggcc

SEQ ID NO: 3022470 - RNA, 16 nt, Mycobacterium avium subsp. paratuberculosis
gccgcccgggcggccc

SEQ ID NO: 3022471 - RNA, 18 nt, Mycobacterium avium subsp. paratuberculosis
gccgcccgggcggcccgc

SEQ ID NO: 3022472 - RNA, 14 nt, Mycobacterium avium subsp. paratuberculosis
gccgcccgucagcc

SEQ ID NO: 3022473 - RNA, 16 nt, Mycobacterium avium subsp. paratuberculosis
gccgcccgucagcccc

SEQ ID NO: 3022474 - RNA, 15 nt, Mycobacterium avium subsp. paratuberculosis
gccgccgagggccag

SEQ ID NO: 3022475 - RNA, 19 nt, Mycobacterium avium subsp. paratuberculosis
gccgccgagggccagcagc

SEQ ID NO: 3022476 - RNA, 13 nt, Mycobacterium avium subsp. paratuberculosis
gccgccgaucaac

SEQ ID NO: 3022477 - RNA, 14 nt, Mycobacterium avium subsp. paratuberculosis
gccgccgaucuuga

SEQ ID NO: 3022478 - RNA, 19 nt, Mycobacterium avium subsp. paratuberculosis
gccgccgaucuugagccgg

SEQ ID NO: 3022479 - RNA, 22 nt, Mycobacterium avium subsp. paratuberculosis
gccgccgaucuugagccggaug

SEQ ID NO: 3022480 - RNA, 18 nt, Mycobacterium avium subsp. paratuberculosis
gccgccgaugacggcgcg

SEQ ID NO: 3022481 - RNA, 19 nt, Mycobacterium avium subsp. paratuberculosis
gccgccgaugacggcgcga

SEQ ID NO: 3022482 - RNA, 22 nt, Mycobacterium avium subsp. paratuberculosis
gccgccgaugacggcgcgaacg

SEQ ID NO: 3022483 - RNA, 17 nt, Mycobacterium avium subsp. paratuberculosis
gccgccgaugcugaucc

SEQ ID NO: 3022484 - RNA, 21 nt, Mycobacterium avium subsp. paratuberculosis
gccgccgaugcugauccgcag

SEQ ID NO: 3022485 - RNA, 19 nt, Mycobacterium avium subsp. paratuberculosis
gccgccgaugugaucggcg

SEQ ID NO: 3022486 - RNA, 20 nt, Mycobacterium avium subsp. paratuberculosis
gccgccgauucaaccccgcg

SEQ ID NO: 3022487 - RNA, 22 nt, Mycobacterium avium subsp. paratuberculosis
gccgccgauucaaccccgcgcg

SEQ ID NO: 3022488 - RNA, 23 nt, Mycobacterium avium subsp. paratuberculosis
gccgccgauucaaccccgcgcgc

SEQ ID NO: 3022489 - RNA, 19 nt, Mycobacterium avium subsp. paratuberculosis
gccgccgauuccggccggc

SEQ ID NO: 3022490 - RNA, 18 nt, Mycobacterium avium subsp. paratuberculosis
gccgccgcaauacaccgc

SEQ ID NO: 3022491 - RNA, 19 nt, Mycobacterium avium subsp. paratuberculosis
gccgccgcaauacaccgcg

SEQ ID NO: 3022492 - RNA, 20 nt, Mycobacterium avium subsp. paratuberculosis
gccgccgcaauacaccgcga

SEQ ID NO: 3022493 - RNA, 20 nt, Mycobacterium avium subsp. paratuberculosis
gccgccgcacacuuccggga

SEQ ID NO: 3022494 - RNA, 13 nt, Mycobacterium avium subsp. paratuberculosis
gccgccgcaccgg

SEQ ID NO: 3022495 - RNA, 14 nt, Mycobacterium avium subsp. paratuberculosis
gccgccgcaccggc

SEQ ID NO: 3022496 - RNA, 17 nt, Mycobacterium avium subsp. paratuberculosis
gccgccgcaccggccgg

SEQ ID NO: 3022497 - RNA, 19 nt, Mycobacterium avium subsp. paratuberculosis
gccgccgcagcagccgcgc

SEQ ID NO: 3022498 - RNA, 17 nt, Mycobacterium avium subsp. paratuberculosis
gccgccgcagcgcagcg

SEQ ID NO: 3022499 - RNA, 14 nt, Mycobacterium avium subsp. paratuberculosis
gccgccgcaggcga

SEQ ID NO: 3022500 - RNA, 18 nt, Mycobacterium avium subsp. paratuberculosis
gccgccgcauaccgcccg

SEQ ID NO: 3022501 - RNA, 19 nt, Mycobacterium avium subsp. paratuberculosis
gccgccgcauaccgcccgc

SEQ ID NO: 3022502 - RNA, 20 nt, Mycobacterium avium subsp. paratuberculosis
gccgccgcauaccgcccgcg

SEQ ID NO: 3022503 - RNA, 22 nt, Mycobacterium avium subsp. paratuberculosis
gccgccgcauaccgcccgcgcu

SEQ ID NO: 3022504 - RNA, 13 nt, Mycobacterium avium subsp. paratuberculosis
gccgccgccaccg

SEQ ID NO: 3022505 - RNA, 21 nt, Mycobacterium avium subsp. paratuberculosis
gccgccgccaccgucgccggc

SEQ ID NO: 3022506 - RNA, 15 nt, Mycobacterium avium subsp. paratuberculosis
gccgccgccagcacc

SEQ ID NO: 3022507 - RNA, 16 nt, Mycobacterium avium subsp. paratuberculosis
gccgccgccagcacca

SEQ ID NO: 3022508 - RNA, 17 nt, Mycobacterium avium subsp. paratuberculosis
gccgccgccagcaccac

SEQ ID NO: 3022509 - RNA, 13 nt, Mycobacterium avium subsp. paratuberculosis
gccgccgccagcc

SEQ ID NO: 3022510 - RNA, 16 nt, Mycobacterium avium subsp. paratuberculosis
gccgccgccagccagc

SEQ ID NO: 3022511 - RNA, 19 nt, Mycobacterium avium subsp. paratuberculosis
gccgccgccagccagccgg

SEQ ID NO: 3022512 - RNA, 22 nt, Mycobacterium avium subsp. paratuberculosis
gccgccgccagccagccggugc

SEQ ID NO: 3022513 - RNA, 15 nt, Mycobacterium avium subsp. paratuberculosis
gccgccgccagcgcg

SEQ ID NO: 3022514 - RNA, 20 nt, Mycobacterium avium subsp. paratuberculosis
gccgccgccagcgcgggguc

SEQ ID NO: 3022515 - RNA, 22 nt, Mycobacterium avium subsp. paratuberculosis
gccgccgccaucuccuccgggc

SEQ ID NO: 3022516 - RNA, 13 nt, Mycobacterium avium subsp. paratuberculosis
gccgccgcccacg

SEQ ID NO: 3022517 - RNA, 17 nt, Mycobacterium avium subsp. paratuberculosis
gccgccgcccacgccgc

SEQ ID NO: 3022518 - RNA, 19 nt, Mycobacterium avium subsp. paratuberculosis
gccgccgcccacgccgccc

SEQ ID NO: 3022519 - RNA, 23 nt, Mycobacterium avium subsp. paratuberculosis
gccgccgcccacgccgcccaggc

SEQ ID NO: 3022520 - RNA, 14 nt, Mycobacterium avium subsp. paratuberculosis
gccgccgcccaggc

SEQ ID NO: 3022521 - RNA, 15 nt, Mycobacterium avium subsp. paratuberculosis
gccgccgcccaggcc

SEQ ID NO: 3022522 - RNA, 14 nt, Mycobacterium avium subsp. paratuberculosis
gccgccgcccgcgc

SEQ ID NO: 3022523 - RNA, 15 nt, Mycobacterium avium subsp. paratuberculosis
gccgccgcccgcgcg

SEQ ID NO: 3022524 - RNA, 18 nt, Mycobacterium avium subsp. paratuberculosis
gccgccgcccgcgcggcg

SEQ ID NO: 3022525 - RNA, 15 nt, Mycobacterium avium subsp. paratuberculosis
gccgccgccgaccac

SEQ ID NO: 3022526 - RNA, 12 nt, Mycobacterium avium subsp. paratuberculosis
gccgccgccgau

SEQ ID NO: 3022527 - RNA, 13 nt, Mycobacterium avium subsp. paratuberculosis
gccgccgccgccc

SEQ ID NO: 3022528 - RNA, 14 nt, Mycobacterium avium subsp. paratuberculosis
gccgccgccgcggc

SEQ ID NO: 3022529 - RNA, 17 nt, Mycobacterium avium subsp. paratuberculosis
gccgccgccgcggccgc

SEQ ID NO: 3022530 - RNA, 13 nt, Mycobacterium avium subsp. paratuberculosis
gccgccgccggcg

SEQ ID NO: 3022531 - RNA, 14 nt, Mycobacterium avium subsp. paratuberculosis
gccgccgccggcgu

SEQ ID NO: 3022532 - RNA, 16 nt, Mycobacterium avium subsp. paratuberculosis
gccgccgccggcgucg

SEQ ID NO: 3022533 - RNA, 17 nt, Mycobacterium avium subsp. paratuberculosis
gccgccgccggcgucgc

SEQ ID NO: 3022534 - RNA, 13 nt, Mycobacterium avium subsp. paratuberculosis
gccgccgccggga

SEQ ID NO: 3022535 - RNA, 14 nt, Mycobacterium avium subsp. paratuberculosis
gccgccgccgggau

SEQ ID NO: 3022536 - RNA, 15 nt, Mycobacterium avium subsp. paratuberculosis
gccgccgccugagcc

SEQ ID NO: 3022537 - RNA, 18 nt, Mycobacterium avium subsp. paratuberculosis
gccgccgccugagcccgc

SEQ ID NO: 3022538 - RNA, 20 nt, Mycobacterium avium subsp. paratuberculosis
gccgccgccugagcccgccu

SEQ ID NO: 3022539 - RNA, 14 nt, Mycobacterium avium subsp. paratuberculosis
gccgccgcgaacuc

SEQ ID NO: 3022540 - RNA, 18 nt, Mycobacterium avium subsp. paratuberculosis
gccgccgcgaacucaggc

SEQ ID NO: 3022541 - RNA, 18 nt, Mycobacterium avium subsp. paratuberculosis
gccgccgcgacacccgcg

SEQ ID NO: 3022542 - RNA, 12 nt, Mycobacterium avium subsp. paratuberculosis
gccgccgcgacc

SEQ ID NO: 3022543 - RNA, 13 nt, Mycobacterium avium subsp. paratuberculosis
gccgccgcgaccg

SEQ ID NO: 3022544 - RNA, 15 nt, Mycobacterium avium subsp. paratuberculosis
gccgccgcgaccguc

SEQ ID NO: 3022545 - RNA, 22 nt, Mycobacterium avium subsp. paratuberculosis
gccgccgcgaccgucagcaggg

SEQ ID NO: 3022546 - RNA, 23 nt, Mycobacterium avium subsp. paratuberculosis
gccgccgcgaccgucagcagggc

SEQ ID NO: 3022547 - RNA, 13 nt, Mycobacterium avium subsp. paratuberculosis
gccgccgcgacga

SEQ ID NO: 3022548 - RNA, 21 nt, Mycobacterium avium subsp. paratuberculosis
gccgccgcgacgaugccggcg

SEQ ID NO: 3022549 - RNA, 14 nt, Mycobacterium avium subsp. paratuberculosis
gccgccgcgacggc

SEQ ID NO: 3022550 - RNA, 11 nt, Mycobacterium avium subsp. paratuberculosis
gccgccgcgau

SEQ ID NO: 3022551 - RNA, 19 nt, Mycobacterium avium subsp. paratuberculosis
gccgccgcgaucagggccc

SEQ ID NO: 3022552 - RNA, 19 nt, Mycobacterium avium subsp. paratuberculosis
gccgccgcgaucuugccgc

SEQ ID NO: 3022553 - RNA, 13 nt, Mycobacterium avium subsp. paratuberculosis
gccgccgcgcagg

SEQ ID NO: 3022554 - RNA, 12 nt, Mycobacterium avium subsp. paratuberculosis
gccgccgcgcau

SEQ ID NO: 3022555 - RNA, 13 nt, Mycobacterium avium subsp. paratuberculosis
gccgccgcgcauc

SEQ ID NO: 3022556 - RNA, 19 nt, Mycobacterium avium subsp. paratuberculosis
gccgccgcgcauccgcacc

SEQ ID NO: 3022557 - RNA, 21 nt, Mycobacterium avium subsp. paratuberculosis
gccgccgcgcauccgcaccga

SEQ ID NO: 3022558 - RNA, 23 nt, Mycobacterium avium subsp. paratuberculosis
gccgccgcgccaccgaggccagc

SEQ ID NO: 3022559 - RNA, 19 nt, Mycobacterium avium subsp. paratuberculosis
gccgccgggcuuccccaac

SEQ ID NO: 3022560 - RNA, 13 nt, Mycobacterium avium subsp. paratuberculosis
gccgccggggacc

SEQ ID NO: 3022561 - RNA, 17 nt, Mycobacterium avium subsp. paratuberculosis
gccgccggggacccgca

SEQ ID NO: 3022562 - RNA, 23 nt, Mycobacterium avium subsp. paratuberculosis
gccgccggggacccgcaccggaa

SEQ ID NO: 3022563 - RNA, 14 nt, Mycobacterium avium subsp. paratuberculosis
gccgccggggcgca

SEQ ID NO: 3022564 - RNA, 17 nt, Mycobacterium avium subsp. paratuberculosis
gccgccggggcgccgcc

SEQ ID NO: 3022565 - RNA, 18 nt, Mycobacterium avium subsp. paratuberculosis
gccgccggggcgccgccg

SEQ ID NO: 3022566 - RNA, 15 nt, Mycobacterium avium subsp. paratuberculosis
gccgccggggcgggc

SEQ ID NO: 3022567 - RNA, 16 nt, Mycobacterium avium subsp. paratuberculosis
gccgccggggcgggca

SEQ ID NO: 3022568 - RNA, 17 nt, Mycobacterium avium subsp. paratuberculosis
gccgccggggcgggcag

SEQ ID NO: 3022569 - RNA, 18 nt, Mycobacterium avium subsp. paratuberculosis
gccgccggggcgggcagc

SEQ ID NO: 3022570 - RNA, 19 nt, Mycobacterium avium subsp. paratuberculosis
gccgccggggcgggcagca

SEQ ID NO: 3022571 - RNA, 21 nt, Mycobacterium avium subsp. paratuberculosis
gccgccggggcgggcagcacc

SEQ ID NO: 3022572 - RNA, 20 nt, Mycobacterium avium subsp. paratuberculosis
gccgccggggcgucggacgc

SEQ ID NO: 3022573 - RNA, 12 nt, Mycobacterium avium subsp. paratuberculosis
gccgccggggug

SEQ ID NO: 3022574 - RNA, 17 nt, Mycobacterium avium subsp. paratuberculosis
gccgccggggugcaccg

SEQ ID NO: 3022575 - RNA, 19 nt, Mycobacterium avium subsp. paratuberculosis
gccgccggguccuugcgcc

SEQ ID NO: 3022576 - RNA, 18 nt, Mycobacterium avium subsp. paratuberculosis
gccgccggguggcggggc

SEQ ID NO: 3022577 - RNA, 16 nt, Mycobacterium avium subsp. paratuberculosis
gccgccggucacggcg

SEQ ID NO: 3022578 - RNA, 22 nt, Mycobacterium avium subsp. paratuberculosis
gccgccggucacggcgucggcg

SEQ ID NO: 3022579 - RNA, 13 nt, Mycobacterium avium subsp. paratuberculosis
gccgccgguccag

SEQ ID NO: 3022580 - RNA, 21 nt, Mycobacterium avium subsp. paratuberculosis
gccgccgguccagugccggcg

SEQ ID NO: 3022581 - RNA, 23 nt, Mycobacterium avium subsp. paratuberculosis
gccgccgguccagugccggcgag

SEQ ID NO: 3022582 - RNA, 22 nt, Mycobacterium avium subsp. paratuberculosis
gccgccggucgcccccucggcc

SEQ ID NO: 3022583 - RNA, 14 nt, Mycobacterium avium subsp. paratuberculosis
gccgccggugaaca

SEQ ID NO: 3022584 - RNA, 14 nt, Mycobacterium avium subsp. paratuberculosis
gccgccggugacca

SEQ ID NO: 3022585 - RNA, 17 nt, Mycobacterium avium subsp. paratuberculosis
gccgccggugaccacgc

SEQ ID NO: 3022586 - RNA, 18 nt, Mycobacterium avium subsp. paratuberculosis
gccgccggugaccacgcu

SEQ ID NO: 3022587 - RNA, 13 nt, Mycobacterium avium subsp. paratuberculosis
gccgccggugccg

SEQ ID NO: 3022588 - RNA, 15 nt, Mycobacterium avium subsp. paratuberculosis
gccgccggugccgac

SEQ ID NO: 3022589 - RNA, 17 nt, Mycobacterium avium subsp. paratuberculosis
gccgccgguggcgucgg

SEQ ID NO: 3022590 - RNA, 18 nt, Mycobacterium avium subsp. paratuberculosis
gccgccgguggcgucggu

SEQ ID NO: 3022591 - RNA, 19 nt, Mycobacterium avium subsp. paratuberculosis
gccgccgguggcgucggug

SEQ ID NO: 3022592 - RNA, 23 nt, Mycobacterium avium subsp. paratuberculosis
gccgccgguggcgucggugaugc

SEQ ID NO: 3022593 - RNA, 19 nt, Mycobacterium avium subsp. paratuberculosis
gccgccgguugaucacccg

SEQ ID NO: 3022594 - RNA, 15 nt, Mycobacterium avium subsp. paratuberculosis
gccgccguagccggc

SEQ ID NO: 3022595 - RNA, 16 nt, Mycobacterium avium subsp. paratuberculosis
gccgccguagccggcg

SEQ ID NO: 3022596 - RNA, 19 nt, Mycobacterium avium subsp. paratuberculosis
gccgccguagccggcggug

SEQ ID NO: 3022597 - RNA, 22 nt, Mycobacterium avium subsp. paratuberculosis
gccgccguagccggcgguggcc

SEQ ID NO: 3022598 - RNA, 23 nt, Mycobacterium avium subsp. paratuberculosis
gccgccguagccggcgguggcca

SEQ ID NO: 3022599 - RNA, 16 nt, Mycobacterium avium subsp. paratuberculosis
gccgccguaucccugc

SEQ ID NO: 3022600 - RNA, 16 nt, Mycobacterium avium subsp. paratuberculosis
gccgccguccagcguc

SEQ ID NO: 3022601 - RNA, 14 nt, Mycobacterium avium subsp. paratuberculosis
gccgccgucccacc

SEQ ID NO: 3022602 - RNA, 17 nt, Mycobacterium avium subsp. paratuberculosis
gccgccgucccaccggc

SEQ ID NO: 3022603 - RNA, 18 nt, Mycobacterium avium subsp. paratuberculosis
gccgccgucccaccggcg

SEQ ID NO: 3022604 - RNA, 20 nt, Mycobacterium avium subsp. paratuberculosis
gccgccgucccaccggcgau

SEQ ID NO: 3022605 - RNA, 16 nt, Mycobacterium avium subsp. paratuberculosis
gccgccguccccgcgc

SEQ ID NO: 3022606 - RNA, 17 nt, Mycobacterium avium subsp. paratuberculosis
gccgccguccccgcgcg

SEQ ID NO: 3022607 - RNA, 19 nt, Mycobacterium avium subsp. paratuberculosis
gccgccguccccgcgcggc

SEQ ID NO: 3022608 - RNA, 15 nt, Mycobacterium avium subsp. paratuberculosis
gccgccgucgacgac

SEQ ID NO: 3022609 - RNA, 19 nt, Mycobacterium avium subsp. paratuberculosis
gccgccgucgccaccaccg

SEQ ID NO: 3022610 - RNA, 21 nt, Mycobacterium avium subsp. paratuberculosis
gccgccgucgccaccaccgcg

SEQ ID NO: 3022611 - RNA, 13 nt, Mycobacterium avium subsp. paratuberculosis
gccgccgucgcgc

SEQ ID NO: 3022612 - RNA, 15 nt, Mycobacterium avium subsp. paratuberculosis
gccgccgucgcgcca

SEQ ID NO: 3022613 - RNA, 16 nt, Mycobacterium avium subsp. paratuberculosis
gccgccgucgcgccag

SEQ ID NO: 3022614 - RNA, 18 nt, Mycobacterium avium subsp. paratuberculosis
gccgccgucgcgccagga

SEQ ID NO: 3022615 - RNA, 12 nt, Mycobacterium avium subsp. paratuberculosis
gccgccgucggu

SEQ ID NO: 3022616 - RNA, 13 nt, Mycobacterium avium subsp. paratuberculosis
gccgccgucggug

SEQ ID NO: 3022617 - RNA, 14 nt, Mycobacterium avium subsp. paratuberculosis
gccgccgucguagc

SEQ ID NO: 3022618 - RNA, 19 nt, Mycobacterium avium subsp. paratuberculosis
gccgccgucguagccgcgg

SEQ ID NO: 3022619 - RNA, 21 nt, Mycobacterium avium subsp. paratuberculosis
gccgccgucuucccagugccg

SEQ ID NO: 3022620 - RNA, 16 nt, Mycobacterium avium subsp. paratuberculosis
gccgccgugcauccag

SEQ ID NO: 3022621 - RNA, 14 nt, Mycobacterium avium subsp. paratuberculosis
gccgccgugcgcgg

SEQ ID NO: 3022622 - RNA, 15 nt, Mycobacterium avium subsp. paratuberculosis
gccgccgugcgcggc

SEQ ID NO: 3022623 - RNA, 16 nt, Mycobacterium avium subsp. paratuberculosis
gccgccgugcgcggcg

SEQ ID NO: 3022624 - RNA, 20 nt, Mycobacterium avium subsp. paratuberculosis
gccgccguggaagauguugc

SEQ ID NO: 3022625 - RNA, 14 nt, Mycobacterium avium subsp. paratuberculosis
gccgccguggacga

SEQ ID NO: 3022626 - RNA, 18 nt, Mycobacterium avium subsp. paratuberculosis
gccgccguguaggccgcg

SEQ ID NO: 3022627 - RNA, 15 nt, Mycobacterium avium subsp. paratuberculosis
gccgccguucgccgg

SEQ ID NO: 3022628 - RNA, 16 nt, Mycobacterium avium subsp. paratuberculosis
gccgccguucgccggc

SEQ ID NO: 3022629 - RNA, 19 nt, Mycobacterium avium subsp. paratuberculosis
gccgccguucgccggcgac

SEQ ID NO: 3022630 - RNA, 24 nt, Mycobacterium avium subsp. paratuberculosis
gccgccguucgccggcgacggcca

SEQ ID NO: 3022631 - RNA, 16 nt, Mycobacterium avium subsp. paratuberculosis
gccgccguucucgcgc

SEQ ID NO: 3022632 - RNA, 17 nt, Mycobacterium avium subsp. paratuberculosis
gccgccguucucgcgca

SEQ ID NO: 3022633 - RNA, 18 nt, Mycobacterium avium subsp. paratuberculosis
gccgccguucucgcgcag

SEQ ID NO: 3022634 - RNA, 22 nt, Mycobacterium avium subsp. paratuberculosis
gccgccguucucgcgcagguca

SEQ ID NO: 3022635 - RNA, 20 nt, Mycobacterium avium subsp. paratuberculosis
gccgccguugcgagucaucg

SEQ ID NO: 3022636 - RNA, 21 nt, Mycobacterium avium subsp. paratuberculosis
gccgccguugcgagucaucgc

SEQ ID NO: 3022637 - RNA, 23 nt, Mycobacterium avium subsp. paratuberculosis
gccgccguugcgagucaucgcca

SEQ ID NO: 3022638 - RNA, 18 nt, Mycobacterium avium subsp. paratuberculosis
gccgccucacgcagggcc

SEQ ID NO: 3022639 - RNA, 16 nt, Mycobacterium avium subsp. paratuberculosis
gccgccuccagcacgu

SEQ ID NO: 3022640 - RNA, 21 nt, Mycobacterium avium subsp. paratuberculosis
gccgccuccagcacgucgggg

SEQ ID NO: 3022641 - RNA, 19 nt, Mycobacterium avium subsp. paratuberculosis
gccgccucccgcagcgcca

SEQ ID NO: 3022642 - RNA, 20 nt, Mycobacterium avium subsp. paratuberculosis
gccgccucccgcagcgccag

SEQ ID NO: 3022643 - RNA, 15 nt, Mycobacterium avium subsp. paratuberculosis
gccgcgagcccggcg

SEQ ID NO: 3022644 - RNA, 17 nt, Mycobacterium avium subsp. paratuberculosis
gccgcgagcccggcgac

SEQ ID NO: 3022645 - RNA, 19 nt, Mycobacterium avium subsp. paratuberculosis
gccgcgagcccggcgacgu

SEQ ID NO: 3022646 - RNA, 14 nt, Mycobacterium avium subsp. paratuberculosis
gccgcgagccgccc

SEQ ID NO: 3022647 - RNA, 16 nt, Mycobacterium avium subsp. paratuberculosis
gccgcgagccgcccag

SEQ ID NO: 3022648 - RNA, 18 nt, Mycobacterium avium subsp. paratuberculosis
gccgcgagccgcccaggc

SEQ ID NO: 3022649 - RNA, 15 nt, Mycobacterium avium subsp. paratuberculosis
gccgcgagcgcagca

SEQ ID NO: 3022650 - RNA, 21 nt, Mycobacterium avium subsp. paratuberculosis
gccgcgaggauuucgcucagc

SEQ ID NO: 3022651 - RNA, 23 nt, Mycobacterium avium subsp. paratuberculosis
gccgcgaggauuucgcucagccg

SEQ ID NO: 3022652 - RNA, 15 nt, Mycobacterium avium subsp. paratuberculosis
gccgcgagucgaggu

SEQ ID NO: 3022653 - RNA, 15 nt, Mycobacterium avium subsp. paratuberculosis
gccgcgaucagggcc

SEQ ID NO: 3022654 - RNA, 13 nt, Mycobacterium avium subsp. paratuberculosis
gccgcgauccagc

SEQ ID NO: 3022655 - RNA, 14 nt, Mycobacterium avium subsp. paratuberculosis
gccgcgauccagcg

SEQ ID NO: 3022656 - RNA, 21 nt, Mycobacterium avium subsp. paratuberculosis
gccgcgauccagcgcuggccg

SEQ ID NO: 3022657 - RNA, 22 nt, Mycobacterium avium subsp. paratuberculosis
gccgcgauccagcgcuggccgg

SEQ ID NO: 3022658 - RNA, 15 nt, Mycobacterium avium subsp. paratuberculosis
gccgcgaucgccaac

SEQ ID NO: 3022659 - RNA, 13 nt, Mycobacterium avium subsp. paratuberculosis
gccgcgaucggcg

SEQ ID NO: 3022660 - RNA, 15 nt, Mycobacterium avium subsp. paratuberculosis
gccgcgaucggcgug

SEQ ID NO: 3022661 - RNA, 15 nt, Mycobacterium avium subsp. paratuberculosis
gccgcgaucucggcg

SEQ ID NO: 3022662 - RNA, 16 nt, Mycobacterium avium subsp. paratuberculosis
gccgcgaucucggcgg

SEQ ID NO: 3022663 - RNA, 18 nt, Mycobacterium avium subsp. paratuberculosis
gccgcgaucucggcggac

SEQ ID NO: 3022664 - RNA, 24 nt, Mycobacterium avium subsp. paratuberculosis
gccgcgaucucggcggacucggcg

SEQ ID NO: 3022665 - RNA, 21 nt, Mycobacterium avium subsp. paratuberculosis
gccgcgaucuugccgccgcgg

SEQ ID NO: 3022666 - RNA, 21 nt, Mycobacterium avium subsp. paratuberculosis
gccgcgaugaggcucaggccg

SEQ ID NO: 3022667 - RNA, 16 nt, Mycobacterium avium subsp. paratuberculosis
gccgcgaugaucacac

SEQ ID NO: 3022668 - RNA, 17 nt, Mycobacterium avium subsp. paratuberculosis
gccgcgaugaucacacc

SEQ ID NO: 3022669 - RNA, 16 nt, Mycobacterium avium subsp. paratuberculosis
gccgcgaugcaacacc

SEQ ID NO: 3022670 - RNA, 19 nt, Mycobacterium avium subsp. paratuberculosis
gccgcgaugcaacaccgaa

SEQ ID NO: 3022671 - RNA, 15 nt, Mycobacterium avium subsp. paratuberculosis
gccgcgaugcccgcc

SEQ ID NO: 3022672 - RNA, 16 nt, Mycobacterium avium subsp. paratuberculosis
gccgcgaugcccgccg

SEQ ID NO: 3022673 - RNA, 17 nt, Mycobacterium avium subsp. paratuberculosis
gccgcgaugcccgccgg

SEQ ID NO: 3022674 - RNA, 18 nt, Mycobacterium avium subsp. paratuberculosis
gccgcgaugcccgccggc

SEQ ID NO: 3022675 - RNA, 21 nt, Mycobacterium avium subsp. paratuberculosis
gccgcgauguagcggacgggc

SEQ ID NO: 3022676 - RNA, 23 nt, Mycobacterium avium subsp. paratuberculosis
gccgcgauguagcggacgggccg

SEQ ID NO: 3022677 - RNA, 15 nt, Mycobacterium avium subsp. paratuberculosis
gccgcgaugucggug

SEQ ID NO: 3022678 - RNA, 14 nt, Mycobacterium avium subsp. paratuberculosis
gccgcgcaccaccu

SEQ ID NO: 3022679 - RNA, 18 nt, Mycobacterium avium subsp. paratuberculosis
gccgcgcaccaccucuuc

SEQ ID NO: 3022680 - RNA, 13 nt, Mycobacterium avium subsp. paratuberculosis
gccgcgcaccacg

SEQ ID NO: 3022681 - RNA, 14 nt, Mycobacterium avium subsp. paratuberculosis
gccgcgcaccacgg

SEQ ID NO: 3022682 - RNA, 19 nt, Mycobacterium avium subsp. paratuberculosis
gccgcgcaccacgguggcg

SEQ ID NO: 3022683 - RNA, 22 nt, Mycobacterium avium subsp. paratuberculosis
gccgcgcaccacgguggcgccg

SEQ ID NO: 3022684 - RNA, 13 nt, Mycobacterium avium subsp. paratuberculosis
gccgcgcaccccg

SEQ ID NO: 3022685 - RNA, 23 nt, Mycobacterium avium subsp. paratuberculosis
gccgcgcaccccgaaccgcccgc

SEQ ID NO: 3022686 - RNA, 14 nt, Mycobacterium avium subsp. paratuberculosis
gccgcgcacccggc

SEQ ID NO: 3022687 - RNA, 18 nt, Mycobacterium avium subsp. paratuberculosis
gccgcgcacccggccacg

SEQ ID NO: 3022688 - RNA, 19 nt, Mycobacterium avium subsp. paratuberculosis
gccgcgcacccggccacgc

SEQ ID NO: 3022689 - RNA, 13 nt, Mycobacterium avium subsp. paratuberculosis
gccgcgcaccgcc

SEQ ID NO: 3022690 - RNA, 17 nt, Mycobacterium avium subsp. paratuberculosis
gccgcgcaccgccccgc

SEQ ID NO: 3022691 - RNA, 18 nt, Mycobacterium avium subsp. paratuberculosis
gccgcgcaccgccccgcc

SEQ ID NO: 3022692 - RNA, 14 nt, Mycobacterium avium subsp. paratuberculosis
gccgcgcaccgcgc

SEQ ID NO: 3022693 - RNA, 15 nt, Mycobacterium avium subsp. paratuberculosis
gccgcgcaccgcgcg

SEQ ID NO: 3022694 - RNA, 15 nt, Mycobacterium avium subsp. paratuberculosis
gccgcgcacgacgug

SEQ ID NO: 3022695 - RNA, 16 nt, Mycobacterium avium subsp. paratuberculosis
gccgcgcacuggagug

SEQ ID NO: 3022696 - RNA, 17 nt, Mycobacterium avium subsp. paratuberculosis
gccgcgcagaucgaugg

SEQ ID NO: 3022697 - RNA, 21 nt, Mycobacterium avium subsp. paratuberculosis
gccgcgcagaucgccagcacc

SEQ ID NO: 3022698 - RNA, 22 nt, Mycobacterium avium subsp. paratuberculosis
gccgcgcagaucgccagcaccg

SEQ ID NO: 3022699 - RNA, 21 nt, Mycobacterium avium subsp. paratuberculosis
gccgcgcagcaccgcgucggc

SEQ ID NO: 3022700 - RNA, 17 nt, Mycobacterium avium subsp. paratuberculosis
gccgcgcagcggggcgc

SEQ ID NO: 3022701 - RNA, 20 nt, Mycobacterium avium subsp. paratuberculosis
gccgcgcagcggggcgcgca

SEQ ID NO: 3022702 - RNA, 16 nt, Mycobacterium avium subsp. paratuberculosis
gccgcgcagcgugucg

SEQ ID NO: 3022703 - RNA, 17 nt, Mycobacterium avium subsp. paratuberculosis
gccgcgcagcucgacga

SEQ ID NO: 3022704 - RNA, 18 nt, Mycobacterium avium subsp. paratuberculosis
gccgcgcagcucgggguc

SEQ ID NO: 3022705 - RNA, 20 nt, Mycobacterium avium subsp. paratuberculosis
gccgcgcaggccgccgacga

SEQ ID NO: 3022706 - RNA, 16 nt, Mycobacterium avium subsp. paratuberculosis
gccgcgcaggccgucc

SEQ ID NO: 3022707 - RNA, 17 nt, Mycobacterium avium subsp. paratuberculosis
gccgcgcaggccgucca

SEQ ID NO: 3022708 - RNA, 20 nt, Mycobacterium avium subsp. paratuberculosis
gccgcgcaggccguccagca

SEQ ID NO: 3022709 - RNA, 16 nt, Mycobacterium avium subsp. paratuberculosis
gccgcgcaucaggggc

SEQ ID NO: 3022710 - RNA, 18 nt, Mycobacterium avium subsp. paratuberculosis
gccgcgcaucaucgccca

SEQ ID NO: 3022711 - RNA, 20 nt, Mycobacterium avium subsp. paratuberculosis
gccgcgcaucaucgcccagc

SEQ ID NO: 3022712 - RNA, 14 nt, Mycobacterium avium subsp. paratuberculosis
gccgcgcauccgca

SEQ ID NO: 3022713 - RNA, 17 nt, Mycobacterium avium subsp. paratuberculosis
gccgcgcauucaccagc

SEQ ID NO: 3022714 - RNA, 18 nt, Mycobacterium avium subsp. paratuberculosis
gccgcgcauucaccagcu

SEQ ID NO: 3022715 - RNA, 22 nt, Mycobacterium avium subsp. paratuberculosis
gccgcgccaacgaggcacggcc

SEQ ID NO: 3022716 - RNA, 22 nt, Mycobacterium avium subsp. paratuberculosis
gccgcgccacagcgucucgacc

SEQ ID NO: 3022717 - RNA, 23 nt, Mycobacterium avium subsp. paratuberculosis
gccgcgccacagcgucucgaccg

SEQ ID NO: 3022718 - RNA, 21 nt, Mycobacterium avium subsp. paratuberculosis
gccgcgccaccgaggccagca

SEQ ID NO: 3022719 - RNA, 15 nt, Mycobacterium avium subsp. paratuberculosis
gccgcgccaccgcgg

SEQ ID NO: 3022720 - RNA, 15 nt, Mycobacterium avium subsp. paratuberculosis
gccgcgccacgcgca

SEQ ID NO: 3022721 - RNA, 14 nt, Mycobacterium avium subsp. paratuberculosis
gccgcgccagcacc

SEQ ID NO: 3022722 - RNA, 16 nt, Mycobacterium avium subsp. paratuberculosis
gccgcgccagcaccuc

SEQ ID NO: 3022723 - RNA, 17 nt, Mycobacterium avium subsp. paratuberculosis
gccgcgccagcaccucg

SEQ ID NO: 3022724 - RNA, 18 nt, Mycobacterium avium subsp. paratuberculosis
gccgcgccagcaccucgg

SEQ ID NO: 3022725 - RNA, 20 nt, Mycobacterium avium subsp. paratuberculosis
gccgcgccagcaccucggcg

SEQ ID NO: 3022726 - RNA, 22 nt, Mycobacterium avium subsp. paratuberculosis
gccgcgccagcaccucggcgac

SEQ ID NO: 3022727 - RNA, 12 nt, Mycobacterium avium subsp. paratuberculosis
gccgcgccagcc

SEQ ID NO: 3022728 - RNA, 18 nt, Mycobacterium avium subsp. paratuberculosis
gccgcgcgcccgcggcca

SEQ ID NO: 3022729 - RNA, 14 nt, Mycobacterium avium subsp. paratuberculosis
gccgcgcgcccguc

SEQ ID NO: 3022730 - RNA, 21 nt, Mycobacterium avium subsp. paratuberculosis
gccgcgcgcccuagucgacgc

SEQ ID NO: 3022731 - RNA, 14 nt, Mycobacterium avium subsp. paratuberculosis
gccgcgcgccgaca

SEQ ID NO: 3022732 - RNA, 16 nt, Mycobacterium avium subsp. paratuberculosis
gccgcgcgccgacaga

SEQ ID NO: 3022733 - RNA, 16 nt, Mycobacterium avium subsp. paratuberculosis
gccgcgcgcgcggccu

SEQ ID NO: 3022734 - RNA, 22 nt, Mycobacterium avium subsp. paratuberculosis
gccgcgcgcgcggccuccagcc

SEQ ID NO: 3022735 - RNA, 23 nt, Mycobacterium avium subsp. paratuberculosis
gccgcgcgcgcggccuccagccg

SEQ ID NO: 3022736 - RNA, 14 nt, Mycobacterium avium subsp. paratuberculosis
gccgcgcgcggcca

SEQ ID NO: 3022737 - RNA, 16 nt, Mycobacterium avium subsp. paratuberculosis
gccgcgcgcggccacc

SEQ ID NO: 3022738 - RNA, 19 nt, Mycobacterium avium subsp. paratuberculosis
gccgcgcgcggccaccgcg

SEQ ID NO: 3022739 - RNA, 20 nt, Mycobacterium avium subsp. paratuberculosis
gccgcgcgcggccaccgcgc

SEQ ID NO: 3022740 - RNA, 13 nt, Mycobacterium avium subsp. paratuberculosis
gccgcgcgcggcg

SEQ ID NO: 3022741 - RNA, 14 nt, Mycobacterium avium subsp. paratuberculosis
gccgcgcgcggcgc

SEQ ID NO: 3022742 - RNA, 21 nt, Mycobacterium avium subsp. paratuberculosis
gccgcgcgcggcgcggagccg

SEQ ID NO: 3022743 - RNA, 16 nt, Mycobacterium avium subsp. paratuberculosis
gccgcgcgcgucgacg

SEQ ID NO: 3022744 - RNA, 21 nt, Mycobacterium avium subsp. paratuberculosis
gccgcgcgcgucgacguucgc

SEQ ID NO: 3022745 - RNA, 15 nt, Mycobacterium avium subsp. paratuberculosis
gccgcgcggacgcgg

SEQ ID NO: 3022746 - RNA, 14 nt, Mycobacterium avium subsp. paratuberculosis
gccgcgcggcaggu

SEQ ID NO: 3022747 - RNA, 17 nt, Mycobacterium avium subsp. paratuberculosis
gccgcgcggcccgcgac

SEQ ID NO: 3022748 - RNA, 14 nt, Mycobacterium avium subsp. paratuberculosis
gccgcgcggccgcc

SEQ ID NO: 3022749 - RNA, 18 nt, Mycobacterium avium subsp. paratuberculosis
gccgcgcggccgccuccg

SEQ ID NO: 3022750 - RNA, 15 nt, Mycobacterium avium subsp. paratuberculosis
gccgcgcggccggcc

SEQ ID NO: 3022751 - RNA, 17 nt, Mycobacterium avium subsp. paratuberculosis
gccgcgcggccggccac

SEQ ID NO: 3022752 - RNA, 14 nt, Mycobacterium avium subsp. paratuberculosis
gccgcgcggccggg

SEQ ID NO: 3022753 - RNA, 15 nt, Mycobacterium avium subsp. paratuberculosis
gccgcgcggccgggc

SEQ ID NO: 3022754 - RNA, 16 nt, Mycobacterium avium subsp. paratuberculosis
gccgcgcggccgggcu

SEQ ID NO: 3022755 - RNA, 14 nt, Mycobacterium avium subsp. paratuberculosis
gccgcgcggcgaug

SEQ ID NO: 3022756 - RNA, 14 nt, Mycobacterium avium subsp. paratuberculosis
gccgcgcggcgcca

SEQ ID NO: 3022757 - RNA, 16 nt, Mycobacterium avium subsp. paratuberculosis
gccgcgcggcgccagc

SEQ ID NO: 3022758 - RNA, 19 nt, Mycobacterium avium subsp. paratuberculosis
gccgcgcggcgccagcggc

SEQ ID NO: 3022759 - RNA, 13 nt, Mycobacterium avium subsp. paratuberculosis
gccgcgcggcggu

SEQ ID NO: 3022760 - RNA, 15 nt, Mycobacterium avium subsp. paratuberculosis
gccgcgcggcgguga

SEQ ID NO: 3022761 - RNA, 14 nt, Mycobacterium avium subsp. paratuberculosis
gccgcgcggcgucg

SEQ ID NO: 3022762 - RNA, 16 nt, Mycobacterium avium subsp. paratuberculosis
gccgcgcggcgucggc

SEQ ID NO: 3022763 - RNA, 22 nt, Mycobacterium avium subsp. paratuberculosis
gccgcgcggcgucggccgggcu

SEQ ID NO: 3022764 - RNA, 23 nt, Mycobacterium avium subsp. paratuberculosis
gccgcgcggcgucggccgggcug

SEQ ID NO: 3022765 - RNA, 13 nt, Mycobacterium avium subsp. paratuberculosis
gccgcgcgggcga

SEQ ID NO: 3022766 - RNA, 14 nt, Mycobacterium avium subsp. paratuberculosis
gccgcgcgggcggc

SEQ ID NO: 3022767 - RNA, 15 nt, Mycobacterium avium subsp. paratuberculosis
gccgcgcgggcggcg

SEQ ID NO: 3022768 - RNA, 19 nt, Mycobacterium avium subsp. paratuberculosis
gccgcgcgggcggcgucgu

SEQ ID NO: 3022769 - RNA, 19 nt, Mycobacterium avium subsp. paratuberculosis
gccgcgcggguacggcggc

SEQ ID NO: 3022770 - RNA, 23 nt, Mycobacterium avium subsp. paratuberculosis
gccgcgcggguacggcggccgcg

SEQ ID NO: 3022771 - RNA, 13 nt, Mycobacterium avium subsp. paratuberculosis
gccgcgcggugcu

SEQ ID NO: 3022772 - RNA, 16 nt, Mycobacterium avium subsp. paratuberculosis
gccgcgcgugcagccg

SEQ ID NO: 3022773 - RNA, 18 nt, Mycobacterium avium subsp. paratuberculosis
gccgcgcgugcagccggg

SEQ ID NO: 3022774 - RNA, 19 nt, Mycobacterium avium subsp. paratuberculosis
gccgcgcgugcagccgggc

SEQ ID NO: 3022775 - RNA, 23 nt, Mycobacterium avium subsp. paratuberculosis
gccgcgcgugcagccgggcggcg

SEQ ID NO: 3022776 - RNA, 17 nt, Mycobacterium avium subsp. paratuberculosis
gccgcgcguuccagcac

SEQ ID NO: 3022777 - RNA, 18 nt, Mycobacterium avium subsp. paratuberculosis
gccgcgcguuccagcacg

SEQ ID NO: 3022778 - RNA, 20 nt, Mycobacterium avium subsp. paratuberculosis
gccgcgcguuccagcacgcc

SEQ ID NO: 3022779 - RNA, 18 nt, Mycobacterium avium subsp. paratuberculosis
gccgcgcucaacccgggc

SEQ ID NO: 3022780 - RNA, 22 nt, Mycobacterium avium subsp. paratuberculosis
gccgcgcucaacccgggccgga

SEQ ID NO: 3022781 - RNA, 15 nt, Mycobacterium avium subsp. paratuberculosis
gccgcgcucgcacca

SEQ ID NO: 3022782 - RNA, 13 nt, Mycobacterium avium subsp. paratuberculosis
gccgcgcucggcc

SEQ ID NO: 3022783 - RNA, 21 nt, Mycobacterium avium subsp. paratuberculosis
gccgcgcucggccauccgggc

SEQ ID NO: 3022784 - RNA, 22 nt, Mycobacterium avium subsp. paratuberculosis
gccgcgcucggccauccgggcg

SEQ ID NO: 3022785 - RNA, 14 nt, Mycobacterium avium subsp. paratuberculosis
gccgcgcucgucga

SEQ ID NO: 3022786 - RNA, 23 nt, Mycobacterium avium subsp. paratuberculosis
gccgcgcucgucgaucaagaacg

SEQ ID NO: 3022787 - RNA, 13 nt, Mycobacterium avium subsp. paratuberculosis
gccgcgcucgugc

SEQ ID NO: 3022788 - RNA, 15 nt, Mycobacterium avium subsp. paratuberculosis
gccgcgcugcgccgg

SEQ ID NO: 3022789 - RNA, 17 nt, Mycobacterium avium subsp. paratuberculosis
gccgcgcugcgccgggu

SEQ ID NO: 3022790 - RNA, 18 nt, Mycobacterium avium subsp. paratuberculosis
gccgcgcugcgccgggug

SEQ ID NO: 3022791 - RNA, 16 nt, Mycobacterium avium subsp. paratuberculosis
gccgcgcuggccagcg

SEQ ID NO: 3022792 - RNA, 17 nt, Mycobacterium avium subsp. paratuberculosis
gccgcgcuggccagcgu

SEQ ID NO: 3022793 - RNA, 19 nt, Mycobacterium avium subsp. paratuberculosis
gccgcgcuggccagcguca

SEQ ID NO: 3022794 - RNA, 21 nt, Mycobacterium avium subsp. paratuberculosis
gccgcgcuggccagcgucagg

SEQ ID NO: 3022795 - RNA, 17 nt, Mycobacterium avium subsp. paratuberculosis
gccgcgcuggccgaucc

SEQ ID NO: 3022796 - RNA, 16 nt, Mycobacterium avium subsp. paratuberculosis
gccgcgcuggcgcagg

SEQ ID NO: 3022797 - RNA, 18 nt, Mycobacterium avium subsp. paratuberculosis
gccgcgcuggucaacucg

SEQ ID NO: 3022798 - RNA, 13 nt, Mycobacterium avium subsp. paratuberculosis
gccgcgcugucca

SEQ ID NO: 3022799 - RNA, 21 nt, Mycobacterium avium subsp. paratuberculosis
gccgcgcuguccacguccugc

SEQ ID NO: 3022800 - RNA, 18 nt, Mycobacterium avium subsp. paratuberculosis
gccgcgcuugacggccgg

SEQ ID NO: 3022801 - RNA, 20 nt, Mycobacterium avium subsp. paratuberculosis
gccgcgcuugacggccgggc

SEQ ID NO: 3022802 - RNA, 21 nt, Mycobacterium avium subsp. paratuberculosis
gccgcgcuugacggccgggcc

SEQ ID NO: 3022803 - RNA, 16 nt, Mycobacterium avium subsp. paratuberculosis
gccgcgcuugcgaccg

SEQ ID NO: 3022804 - RNA, 19 nt, Mycobacterium avium subsp. paratuberculosis
gccgcgcuugcgaccgccg

SEQ ID NO: 3022805 - RNA, 17 nt, Mycobacterium avium subsp. paratuberculosis
gccgcgcuugcgaucgc

SEQ ID NO: 3022806 - RNA, 19 nt, Mycobacterium avium subsp. paratuberculosis
gccgcgcuugcgaucgccg

SEQ ID NO: 3022807 - RNA, 17 nt, Mycobacterium avium subsp. paratuberculosis
gccgcggaagaacaguu

SEQ ID NO: 3022808 - RNA, 17 nt, Mycobacterium avium subsp. paratuberculosis
gccgcggaagccccagg

SEQ ID NO: 3022809 - RNA, 20 nt, Mycobacterium avium subsp. paratuberculosis
gccgcggaaggccagcuccu

SEQ ID NO: 3022810 - RNA, 19 nt, Mycobacterium avium subsp. paratuberculosis
gccgcggaauucgcgggug

SEQ ID NO: 3022811 - RNA, 12 nt, Mycobacterium avium subsp. paratuberculosis
gccgcggacccc

SEQ ID NO: 3022812 - RNA, 18 nt, Mycobacterium avium subsp. paratuberculosis
gccgcggacccgacgguc

SEQ ID NO: 3022813 - RNA, 15 nt, Mycobacterium avium subsp. paratuberculosis
gccgcggcggcagca

SEQ ID NO: 3022814 - RNA, 14 nt, Mycobacterium avium subsp. paratuberculosis
gccgcggcggcccg

SEQ ID NO: 3022815 - RNA, 20 nt, Mycobacterium avium subsp. paratuberculosis
gccgcggcggcccggcguca

SEQ ID NO: 3022816 - RNA, 14 nt, Mycobacterium avium subsp. paratuberculosis
gccgcggcggccug

SEQ ID NO: 3022817 - RNA, 15 nt, Mycobacterium avium subsp. paratuberculosis
gccgcggcggcgccg

SEQ ID NO: 3022818 - RNA, 16 nt, Mycobacterium avium subsp. paratuberculosis
gccgcggcggcgccga

SEQ ID NO: 3022819 - RNA, 17 nt, Mycobacterium avium subsp. paratuberculosis
gccgcggcggcgccgac

SEQ ID NO: 3022820 - RNA, 17 nt, Mycobacterium avium subsp. paratuberculosis
gccgcggcggcucggcg

SEQ ID NO: 3022821 - RNA, 20 nt, Mycobacterium avium subsp. paratuberculosis
gccgcggcggcucggcggcg

SEQ ID NO: 3022822 - RNA, 21 nt, Mycobacterium avium subsp. paratuberculosis
gccgcggcggcucggcggcgu

SEQ ID NO: 3022823 - RNA, 22 nt, Mycobacterium avium subsp. paratuberculosis
gccgcggcggcucggcggcguc

SEQ ID NO: 3022824 - RNA, 11 nt, Mycobacterium avium subsp. paratuberculosis
gccgcggcggg

SEQ ID NO: 3022825 - RNA, 15 nt, Mycobacterium avium subsp. paratuberculosis
gccgcggcgggcgcg

SEQ ID NO: 3022826 - RNA, 11 nt, Mycobacterium avium subsp. paratuberculosis
gccgcggcggu

SEQ ID NO: 3022827 - RNA, 14 nt, Mycobacterium avium subsp. paratuberculosis
gccgcggcgguggc

SEQ ID NO: 3022828 - RNA, 15 nt, Mycobacterium avium subsp. paratuberculosis
gccgcggcgguggcc

SEQ ID NO: 3022829 - RNA, 17 nt, Mycobacterium avium subsp. paratuberculosis
gccgcggcgguggccug

SEQ ID NO: 3022830 - RNA, 13 nt, Mycobacterium avium subsp. paratuberculosis
gccgcggcgucgg

SEQ ID NO: 3022831 - RNA, 23 nt, Mycobacterium avium subsp. paratuberculosis
gccgcggcgucgggauggucgau

SEQ ID NO: 3022832 - RNA, 18 nt, Mycobacterium avium subsp. paratuberculosis
gccgcggcgugcaacugc

SEQ ID NO: 3022833 - RNA, 17 nt, Mycobacterium avium subsp. paratuberculosis
gccgcggcuccagcagc

SEQ ID NO: 3022834 - RNA, 21 nt, Mycobacterium avium subsp. paratuberculosis
gccgcggcuccagcagcggcu

SEQ ID NO: 3022835 - RNA, 22 nt, Mycobacterium avium subsp. paratuberculosis
gccgcggcuccagcagcggcuc

SEQ ID NO: 3022836 - RNA, 14 nt, Mycobacterium avium subsp. paratuberculosis
gccgcggcucgcga

SEQ ID NO: 3022837 - RNA, 19 nt, Mycobacterium avium subsp. paratuberculosis
gccgcggcucgcgacgcgg

SEQ ID NO: 3022838 - RNA, 18 nt, Mycobacterium avium subsp. paratuberculosis
gccgcgggaggcccagua

SEQ ID NO: 3022839 - RNA, 12 nt, Mycobacterium avium subsp. paratuberculosis
gccgcgggccag

SEQ ID NO: 3022840 - RNA, 13 nt, Mycobacterium avium subsp. paratuberculosis
gccgcgggccagc

SEQ ID NO: 3022841 - RNA, 15 nt, Mycobacterium avium subsp. paratuberculosis
gccgcgggccagcag

SEQ ID NO: 3022842 - RNA, 17 nt, Mycobacterium avium subsp. paratuberculosis
gccgcgggccagcagcc

SEQ ID NO: 3022843 - RNA, 18 nt, Mycobacterium avium subsp. paratuberculosis
gccgcgggccagcagccg

SEQ ID NO: 3022844 - RNA, 17 nt, Mycobacterium avium subsp. paratuberculosis
gccgcgggcccaccgcc

SEQ ID NO: 3022845 - RNA, 20 nt, Mycobacterium avium subsp. paratuberculosis
gccgcgggcccaccgccacc

SEQ ID NO: 3022846 - RNA, 13 nt, Mycobacterium avium subsp. paratuberculosis
gccgcgggcgccg

SEQ ID NO: 3022847 - RNA, 18 nt, Mycobacterium avium subsp. paratuberculosis
gccgcgggcgccguaggc

SEQ ID NO: 3022848 - RNA, 14 nt, Mycobacterium avium subsp. paratuberculosis
gccgcgggcgggcc

SEQ ID NO: 3022849 - RNA, 15 nt, Mycobacterium avium subsp. paratuberculosis
gccgcgggcgggccg

SEQ ID NO: 3022850 - RNA, 16 nt, Mycobacterium avium subsp. paratuberculosis
gccgcgggcgggccga

SEQ ID NO: 3022851 - RNA, 18 nt, Mycobacterium avium subsp. paratuberculosis
gccgcgggcggucgcgca

SEQ ID NO: 3022852 - RNA, 21 nt, Mycobacterium avium subsp. paratuberculosis
gccgcgggcggucgcgcagcc

SEQ ID NO: 3022853 - RNA, 22 nt, Mycobacterium avium subsp. paratuberculosis
gccgcgggcggucgcgcagccg

SEQ ID NO: 3022854 - RNA, 23 nt, Mycobacterium avium subsp. paratuberculosis
gccgcgggcguucaucaccuggu

SEQ ID NO: 3022855 - RNA, 14 nt, Mycobacterium avium subsp. paratuberculosis
gccgcggggccggc

SEQ ID NO: 3022856 - RNA, 15 nt, Mycobacterium avium subsp. paratuberculosis
gccgcggggccggcg

SEQ ID NO: 3022857 - RNA, 16 nt, Mycobacterium avium subsp. paratuberculosis
gccgcggggccggcgc

SEQ ID NO: 3022858 - RNA, 18 nt, Mycobacterium avium subsp. paratuberculosis
gccgcggggccggcgcug

SEQ ID NO: 3022859 - RNA, 14 nt, Mycobacterium avium subsp. paratuberculosis
gccgcgggucggcg

SEQ ID NO: 3022860 - RNA, 16 nt, Mycobacterium avium subsp. paratuberculosis
gccgcgggucggcgac

SEQ ID NO: 3022861 - RNA, 17 nt, Mycobacterium avium subsp. paratuberculosis
gccgcgggucggcgacg

SEQ ID NO: 3022862 - RNA, 18 nt, Mycobacterium avium subsp. paratuberculosis
gccgcgggucggcgacgg

SEQ ID NO: 3022863 - RNA, 24 nt, Mycobacterium avium subsp. paratuberculosis
gccgcgggugacgaucaccgcugc

SEQ ID NO: 3022864 - RNA, 21 nt, Mycobacterium avium subsp. paratuberculosis
gccgcgggugacgaucuggcg

SEQ ID NO: 3022865 - RNA, 16 nt, Mycobacterium avium subsp. paratuberculosis
gccgcggguggccagc

SEQ ID NO: 3022866 - RNA, 13 nt, Mycobacterium avium subsp. paratuberculosis
gccgcggguggcg

SEQ ID NO: 3022867 - RNA, 23 nt, Mycobacterium avium subsp. paratuberculosis
gccgcggguggcgccacagccgg

SEQ ID NO: 3022868 - RNA, 15 nt, Mycobacterium avium subsp. paratuberculosis
gccgcgggugucgcc

SEQ ID NO: 3022869 - RNA, 17 nt, Mycobacterium avium subsp. paratuberculosis
gccgcgguagacaccgc

SEQ ID NO: 3022870 - RNA, 18 nt, Mycobacterium avium subsp. paratuberculosis
gccgcgguagacaccgcc

SEQ ID NO: 3022871 - RNA, 19 nt, Mycobacterium avium subsp. paratuberculosis
gccgcgguagacaccgccg

SEQ ID NO: 3022872 - RNA, 18 nt, Mycobacterium avium subsp. paratuberculosis
gccgcgguagcggaccug

SEQ ID NO: 3022873 - RNA, 23 nt, Mycobacterium avium subsp. paratuberculosis
gccgcgguagcggaccugcgaga

SEQ ID NO: 3022874 - RNA, 16 nt, Mycobacterium avium subsp. paratuberculosis
gccgcggucaucgagc

SEQ ID NO: 3022875 - RNA, 18 nt, Mycobacterium avium subsp. paratuberculosis
gccgcggucaucgagccg

SEQ ID NO: 3022876 - RNA, 17 nt, Mycobacterium avium subsp. paratuberculosis
gccgcggucgccccggc

SEQ ID NO: 3022877 - RNA, 19 nt, Mycobacterium avium subsp. paratuberculosis
gccgcggucgccccggccg

SEQ ID NO: 3022878 - RNA, 20 nt, Mycobacterium avium subsp. paratuberculosis
gccgcggucgccccggccgc

SEQ ID NO: 3022879 - RNA, 16 nt, Mycobacterium avium subsp. paratuberculosis
gccgcggucgcugacc

SEQ ID NO: 3022880 - RNA, 13 nt, Mycobacterium avium subsp. paratuberculosis
gccgcggucucga

SEQ ID NO: 3022881 - RNA, 15 nt, Mycobacterium avium subsp. paratuberculosis
gccgcggucucgacc

SEQ ID NO: 3022882 - RNA, 18 nt, Mycobacterium avium subsp. paratuberculosis
gccgcggucuuuggcgua

SEQ ID NO: 3022883 - RNA, 14 nt, Mycobacterium avium subsp. paratuberculosis
gccgcggugaccgc

SEQ ID NO: 3022884 - RNA, 18 nt, Mycobacterium avium subsp. paratuberculosis
gccgcggugaccgcgccg

SEQ ID NO: 3022885 - RNA, 19 nt, Mycobacterium avium subsp. paratuberculosis
gccgcggugaccgcgccgc

SEQ ID NO: 3022886 - RNA, 14 nt, Mycobacterium avium subsp. paratuberculosis
gccgcggugcagca

SEQ ID NO: 3022887 - RNA, 13 nt, Mycobacterium avium subsp. paratuberculosis
gccgcggugcgcc

SEQ ID NO: 3022888 - RNA, 21 nt, Mycobacterium avium subsp. paratuberculosis
gccgcggugcgccacgcccgc

SEQ ID NO: 3022889 - RNA, 15 nt, Mycobacterium avium subsp. paratuberculosis
gccgcggugcggccc

SEQ ID NO: 3022890 - RNA, 16 nt, Mycobacterium avium subsp. paratuberculosis
gccgcggugcggcccg

SEQ ID NO: 3022891 - RNA, 17 nt, Mycobacterium avium subsp. paratuberculosis
gccgcggugcggcccgc

SEQ ID NO: 3022892 - RNA, 20 nt, Mycobacterium avium subsp. paratuberculosis
gccgcggugcggcccgcggc

SEQ ID NO: 3022893 - RNA, 21 nt, Mycobacterium avium subsp. paratuberculosis
gccgcggugcggcccgcggca

SEQ ID NO: 3022894 - RNA, 22 nt, Mycobacterium avium subsp. paratuberculosis
gccgcggugcggcccgcggcau

SEQ ID NO: 3022895 - RNA, 13 nt, Mycobacterium avium subsp. paratuberculosis
gccgcggugcuga

SEQ ID NO: 3022896 - RNA, 20 nt, Mycobacterium avium subsp. paratuberculosis
gccgcgguggcgccgcgggc

SEQ ID NO: 3022897 - RNA, 14 nt, Mycobacterium avium subsp. paratuberculosis
gccgcgguggcggu

SEQ ID NO: 3022898 - RNA, 13 nt, Mycobacterium avium subsp. paratuberculosis
gccgcgugcaccu

SEQ ID NO: 3022899 - RNA, 18 nt, Mycobacterium avium subsp. paratuberculosis
gccgcgugggagagcggg

SEQ ID NO: 3022900 - RNA, 19 nt, Mycobacterium avium subsp. paratuberculosis
gccgcgugggagagcggga

SEQ ID NO: 3022901 - RNA, 14 nt, Mycobacterium avium subsp. paratuberculosis
gccgcguucacccg

SEQ ID NO: 3022902 - RNA, 15 nt, Mycobacterium avium subsp. paratuberculosis
gccgcguuccccggc

SEQ ID NO: 3022903 - RNA, 16 nt, Mycobacterium avium subsp. paratuberculosis
gccgcguuccccggcg

SEQ ID NO: 3022904 - RNA, 22 nt, Mycobacterium avium subsp. paratuberculosis
gccgcguuccccggcgugggug

SEQ ID NO: 3022905 - RNA, 12 nt, Mycobacterium avium subsp. paratuberculosis
gccgcguucgga

SEQ ID NO: 3022906 - RNA, 15 nt, Mycobacterium avium subsp. paratuberculosis
gccgcguucggcggc

SEQ ID NO: 3022907 - RNA, 19 nt, Mycobacterium avium subsp. paratuberculosis
gccgcguucggcggcgcgc

SEQ ID NO: 3022908 - RNA, 14 nt, Mycobacterium avium subsp. paratuberculosis
gccgcguugucgac

SEQ ID NO: 3022909 - RNA, 16 nt, Mycobacterium avium subsp. paratuberculosis
gccgcguugucgacca

SEQ ID NO: 3022910 - RNA, 17 nt, Mycobacterium avium subsp. paratuberculosis
gccgcguugucgaccac

SEQ ID NO: 3022911 - RNA, 16 nt, Mycobacterium avium subsp. paratuberculosis
gccgcguugucggcgu

SEQ ID NO: 3022912 - RNA, 19 nt, Mycobacterium avium subsp. paratuberculosis
gccgcguugucggcguccu

SEQ ID NO: 3022913 - RNA, 19 nt, Mycobacterium avium subsp. paratuberculosis
gccgcuagaccgauggcgg

SEQ ID NO: 3022914 - RNA, 21 nt, Mycobacterium avium subsp. paratuberculosis
gccgcuagaccgauggcggcg

SEQ ID NO: 3022915 - RNA, 19 nt, Mycobacterium avium subsp. paratuberculosis
gccgcuagguuuggccagc

SEQ ID NO: 3022916 - RNA, 20 nt, Mycobacterium avium subsp. paratuberculosis
gccgcuagguuuggccagca

SEQ ID NO: 3022917 - RNA, 21 nt, Mycobacterium avium subsp. paratuberculosis
gccgcuagguuuggccagcac

SEQ ID NO: 3022918 - RNA, 22 nt, Mycobacterium avium subsp. paratuberculosis
gccgcuagguuuggccagcacc

SEQ ID NO: 3022919 - RNA, 23 nt, Mycobacterium avium subsp. paratuberculosis
gccgcuagguuuggccagcaccg

SEQ ID NO: 3022920 - RNA, 18 nt, Mycobacterium avium subsp. paratuberculosis
gccgcuagucgcccagca

SEQ ID NO: 3022921 - RNA, 19 nt, Mycobacterium avium subsp. paratuberculosis
gccgcuagucgcccagcag

SEQ ID NO: 3022922 - RNA, 20 nt, Mycobacterium avium subsp. paratuberculosis
gccgcuagucgcccagcagc

SEQ ID NO: 3022923 - RNA, 21 nt, Mycobacterium avium subsp. paratuberculosis
gccgcuagucgcccagcagcc

SEQ ID NO: 3022924 - RNA, 23 nt, Mycobacterium avium subsp. paratuberculosis
gccgcucaaguccucgguggcca

SEQ ID NO: 3022925 - RNA, 13 nt, Mycobacterium avium subsp. paratuberculosis
gccgcucaccgcc

SEQ ID NO: 3022926 - RNA, 17 nt, Mycobacterium avium subsp. paratuberculosis
gccgcucaccgccgagc

SEQ ID NO: 3022927 - RNA, 20 nt, Mycobacterium avium subsp. paratuberculosis
gccgcucaccgccgagccgc

SEQ ID NO: 3022928 - RNA, 21 nt, Mycobacterium avium subsp. paratuberculosis
gccgcucagcgauugcggccg

SEQ ID NO: 3022929 - RNA, 15 nt, Mycobacterium avium subsp. paratuberculosis
gccgcucagcgggcg

SEQ ID NO: 3022930 - RNA, 21 nt, Mycobacterium avium subsp. paratuberculosis
gccgcucagcgggcggccagc

SEQ ID NO: 3022931 - RNA, 13 nt, Mycobacterium avium subsp. paratuberculosis
gccgcuccaccgc

SEQ ID NO: 3022932 - RNA, 15 nt, Mycobacterium avium subsp. paratuberculosis
gccgcuccaccgcgu

SEQ ID NO: 3022933 - RNA, 18 nt, Mycobacterium avium subsp. paratuberculosis
gccgcuccaccgcguccu

SEQ ID NO: 3022934 - RNA, 19 nt, Mycobacterium avium subsp. paratuberculosis
gccgcuccaccgcguccug

SEQ ID NO: 3022935 - RNA, 14 nt, Mycobacterium avium subsp. paratuberculosis
gccgcucccgcagc

SEQ ID NO: 3022936 - RNA, 14 nt, Mycobacterium avium subsp. paratuberculosis
gccgcucccggcgc

SEQ ID NO: 3022937 - RNA, 17 nt, Mycobacterium avium subsp. paratuberculosis
gccgcucccggcgcagc

SEQ ID NO: 3022938 - RNA, 18 nt, Mycobacterium avium subsp. paratuberculosis
gccgcucccggcgcagca

SEQ ID NO: 3022939 - RNA, 12 nt, Mycobacterium avium subsp. paratuberculosis
gccgcuccgcgg

SEQ ID NO: 3022940 - RNA, 16 nt, Mycobacterium avium subsp. paratuberculosis
gccgcuccgcggcggg

SEQ ID NO: 3022941 - RNA, 13 nt, Mycobacterium avium subsp. paratuberculosis
gccgcuccggccc

SEQ ID NO: 3022942 - RNA, 14 nt, Mycobacterium avium subsp. paratuberculosis
gccgcuccggcccg

SEQ ID NO: 3022943 - RNA, 15 nt, Mycobacterium avium subsp. paratuberculosis
gccgcuccggcccga

SEQ ID NO: 3022944 - RNA, 18 nt, Mycobacterium avium subsp. paratuberculosis
gccgcuccggcccgagca

SEQ ID NO: 3022945 - RNA, 13 nt, Mycobacterium avium subsp. paratuberculosis
gccgcuccggucg

SEQ ID NO: 3022946 - RNA, 14 nt, Mycobacterium avium subsp. paratuberculosis
gccgcuccggucgc

SEQ ID NO: 3022947 - RNA, 14 nt, Mycobacterium avium subsp. paratuberculosis
gccgcucgcccagc

SEQ ID NO: 3022948 - RNA, 17 nt, Mycobacterium avium subsp. paratuberculosis
gccgcucgcccagcgcg

SEQ ID NO: 3022949 - RNA, 21 nt, Mycobacterium avium subsp. paratuberculosis
gccgcucgcccagcgcggcgg

SEQ ID NO: 3022950 - RNA, 23 nt, Mycobacterium avium subsp. paratuberculosis
gccgcucgcccagcgcggcggcc

SEQ ID NO: 3022951 - RNA, 24 nt, Mycobacterium avium subsp. paratuberculosis
gccgcucgcccagcgcggcggcca

SEQ ID NO: 3022952 - RNA, 11 nt, Mycobacterium avium subsp. paratuberculosis
gccgcucgccg

SEQ ID NO: 3022953 - RNA, 15 nt, Mycobacterium avium subsp. paratuberculosis
gccgcucgccgggga

SEQ ID NO: 3022954 - RNA, 23 nt, Mycobacterium avium subsp. paratuberculosis
gccgcucgccggggacgacggcg

SEQ ID NO: 3022955 - RNA, 13 nt, Mycobacterium avium subsp. paratuberculosis
gccgcucgcgcac

SEQ ID NO: 3022956 - RNA, 15 nt, Mycobacterium avium subsp. paratuberculosis
gccgcucgcgcaccg

SEQ ID NO: 3022957 - RNA, 15 nt, Mycobacterium avium subsp. paratuberculosis
gccgcucgcgggcca

SEQ ID NO: 3022958 - RNA, 22 nt, Mycobacterium avium subsp. paratuberculosis
gccgcucgcgggccacagcggc

SEQ ID NO: 3022959 - RNA, 20 nt, Mycobacterium avium subsp. paratuberculosis
gccgcucggaguucgcccgc

SEQ ID NO: 3022960 - RNA, 20 nt, Mycobacterium avium subsp. paratuberculosis
gccgcucggauucccgcucg

SEQ ID NO: 3022961 - RNA, 14 nt, Mycobacterium avium subsp. paratuberculosis
gccgcucggccagc

SEQ ID NO: 3022962 - RNA, 16 nt, Mycobacterium avium subsp. paratuberculosis
gccgcucggccagcag

SEQ ID NO: 3022963 - RNA, 19 nt, Mycobacterium avium subsp. paratuberculosis
gccgcucggccagcagcac

SEQ ID NO: 3022964 - RNA, 15 nt, Mycobacterium avium subsp. paratuberculosis
gccgcucggccagcg

SEQ ID NO: 3022965 - RNA, 19 nt, Mycobacterium avium subsp. paratuberculosis
gccgcucggccagcgcagc

SEQ ID NO: 3022966 - RNA, 13 nt, Mycobacterium avium subsp. paratuberculosis
gccgcucggcgcu

SEQ ID NO: 3022967 - RNA, 22 nt, Mycobacterium avium subsp. paratuberculosis
gccgcucggcgcuccagcgggc

SEQ ID NO: 3022968 - RNA, 14 nt, Mycobacterium avium subsp. paratuberculosis
gccgcucggguguc

SEQ ID NO: 3022969 - RNA, 20 nt, Mycobacterium avium subsp. paratuberculosis
gccgcucgggugucgccgag

SEQ ID NO: 3022970 - RNA, 21 nt, Mycobacterium avium subsp. paratuberculosis
gccgcucgggugucgccgagc

SEQ ID NO: 3022971 - RNA, 23 nt, Mycobacterium avium subsp. paratuberculosis
gccgcucgggugucgccgagccg

SEQ ID NO: 3022972 - RNA, 18 nt, Mycobacterium avium subsp. paratuberculosis
gccgcucguaacgccacg

SEQ ID NO: 3022973 - RNA, 20 nt, Mycobacterium avium subsp. paratuberculosis
gccgcucguaacgccacggc

SEQ ID NO: 3022974 - RNA, 21 nt, Mycobacterium avium subsp. paratuberculosis
gccgcucguaacgccacggcg

SEQ ID NO: 3022975 - RNA, 22 nt, Mycobacterium avium subsp. paratuberculosis
gccgcucguaacgccacggcgg

SEQ ID NO: 3022976 - RNA, 14 nt, Mycobacterium avium subsp. paratuberculosis
gccgcucguaguug

SEQ ID NO: 3022977 - RNA, 22 nt, Mycobacterium avium subsp. paratuberculosis
gccgcucguaguuggggccggc

SEQ ID NO: 3022978 - RNA, 14 nt, Mycobacterium avium subsp. paratuberculosis
gccgcucgucgagu

SEQ ID NO: 3022979 - RNA, 12 nt, Mycobacterium avium subsp. paratuberculosis
gccgcucgucgg

SEQ ID NO: 3022980 - RNA, 15 nt, Mycobacterium avium subsp. paratuberculosis
gccgcucgucggcca

SEQ ID NO: 3022981 - RNA, 18 nt, Mycobacterium avium subsp. paratuberculosis
gccgcucgucggccagcg

SEQ ID NO: 3022982 - RNA, 19 nt, Mycobacterium avium subsp. paratuberculosis
gccgcucgucggccagcga

SEQ ID NO: 3022983 - RNA, 21 nt, Mycobacterium avium subsp. paratuberculosis
gccgcucgucggccagcgagu

SEQ ID NO: 3022984 - RNA, 17 nt, Mycobacterium avium subsp. paratuberculosis
gccgcucgucgggcaca

SEQ ID NO: 3022985 - RNA, 19 nt, Mycobacterium avium subsp. paratuberculosis
gccgcucgucgggcacauc

SEQ ID NO: 3022986 - RNA, 22 nt, Mycobacterium avium subsp. paratuberculosis
gccgcucgucgggcacaucccg

SEQ ID NO: 3022987 - RNA, 15 nt, Mycobacterium avium subsp. paratuberculosis
gccgcucuucgacga

SEQ ID NO: 3022988 - RNA, 19 nt, Mycobacterium avium subsp. paratuberculosis
gccgcucuucgacgacccg

SEQ ID NO: 3022989 - RNA, 19 nt, Mycobacterium avium subsp. paratuberculosis
gccgcugaaauccgggguc

SEQ ID NO: 3022990 - RNA, 21 nt, Mycobacterium avium subsp. paratuberculosis
gccgcugacgauggcgaccgc

SEQ ID NO: 3022991 - RNA, 22 nt, Mycobacterium avium subsp. paratuberculosis
gccgcugacgauggcgaccgcg

SEQ ID NO: 3022992 - RNA, 15 nt, Mycobacterium avium subsp. paratuberculosis
gccgcugacgcggcg

SEQ ID NO: 3022993 - RNA, 17 nt, Mycobacterium avium subsp. paratuberculosis
gccgcugacgcggcggg

SEQ ID NO: 3022994 - RNA, 20 nt, Mycobacterium avium subsp. paratuberculosis
gccgcugacgcggcgggcau

SEQ ID NO: 3022995 - RNA, 21 nt, Mycobacterium avium subsp. paratuberculosis
gccgcugacgcggcgggcaua

SEQ ID NO: 3022996 - RNA, 14 nt, Mycobacterium avium subsp. paratuberculosis
gccgcugacggucg

SEQ ID NO: 3022997 - RNA, 18 nt, Mycobacterium avium subsp. paratuberculosis
gccgcugacggucgccga

SEQ ID NO: 3022998 - RNA, 21 nt, Mycobacterium avium subsp. paratuberculosis
gccgcugacggucgccgacuc

SEQ ID NO: 3022999 - RNA, 21 nt, Mycobacterium avium subsp. paratuberculosis
gccgcugacugcgaucgccga

SEQ ID NO: 3023000 - RNA, 22 nt, Mycobacterium avium subsp. paratuberculosis
gccgcugacugcgaucgccgac

SEQ ID NO: 3023001 - RNA, 23 nt, Mycobacterium avium subsp. paratuberculosis
gccgcugacugcgaucgccgacg

SEQ ID NO: 3023002 - RNA, 24 nt, Mycobacterium avium subsp. paratuberculosis
gccgcugacugcgaucgccgacgc

SEQ ID NO: 3023003 - RNA, 21 nt, Mycobacterium avium subsp. paratuberculosis
gccgcugagcuucugcccggc

SEQ ID NO: 3023004 - RNA, 22 nt, Mycobacterium avium subsp. paratuberculosis
gccgcugagcuucugcccggcc

SEQ ID NO: 3023005 - RNA, 15 nt, Mycobacterium avium subsp. paratuberculosis
gccgcugcagcgccg

SEQ ID NO: 3023006 - RNA, 17 nt, Mycobacterium avium subsp. paratuberculosis
gccgcugcagcgccgcc

SEQ ID NO: 3023007 - RNA, 19 nt, Mycobacterium avium subsp. paratuberculosis
gccgcugcagcgccgcccg

SEQ ID NO: 3023008 - RNA, 14 nt, Mycobacterium avium subsp. paratuberculosis
gccgcugcagcugc

SEQ ID NO: 3023009 - RNA, 15 nt, Mycobacterium avium subsp. paratuberculosis
gccgcugcagcugcu

SEQ ID NO: 3023010 - RNA, 16 nt, Mycobacterium avium subsp. paratuberculosis
gccgcugcagcugcuc

SEQ ID NO: 3023011 - RNA, 18 nt, Mycobacterium avium subsp. paratuberculosis
gccgcugcagcugcucgu

SEQ ID NO: 3023012 - RNA, 21 nt, Mycobacterium avium subsp. paratuberculosis
gccgcugcauccgcagcacca

SEQ ID NO: 3023013 - RNA, 14 nt, Mycobacterium avium subsp. paratuberculosis
gccgcugcccgccg

SEQ ID NO: 3023014 - RNA, 15 nt, Mycobacterium avium subsp. paratuberculosis
gccgcugcccgccgc

SEQ ID NO: 3023015 - RNA, 13 nt, Mycobacterium avium subsp. paratuberculosis
gccgcugcccggc

SEQ ID NO: 3023016 - RNA, 15 nt, Mycobacterium avium subsp. paratuberculosis
gccgcugcccggcgc

SEQ ID NO: 3023017 - RNA, 16 nt, Mycobacterium avium subsp. paratuberculosis
gccgcugcccggcgcu

SEQ ID NO: 3023018 - RNA, 13 nt, Mycobacterium avium subsp. paratuberculosis
gccgcugccgggg

SEQ ID NO: 3023019 - RNA, 16 nt, Mycobacterium avium subsp. paratuberculosis
gccgcugccggggugc

SEQ ID NO: 3023020 - RNA, 23 nt, Mycobacterium avium subsp. paratuberculosis
gccgcugccggggugcagcacca

SEQ ID NO: 3023021 - RNA, 13 nt, Mycobacterium avium subsp. paratuberculosis
gccgcugccguuc

SEQ ID NO: 3023022 - RNA, 14 nt, Mycobacterium avium subsp. paratuberculosis
gccgcugcgacagg

SEQ ID NO: 3023023 - RNA, 20 nt, Mycobacterium avium subsp. paratuberculosis
gccgcugcgacaggucggcg

SEQ ID NO: 3023024 - RNA, 22 nt, Mycobacterium avium subsp. paratuberculosis
gccgcugcgacaggucggcggu

SEQ ID NO: 3023025 - RNA, 24 nt, Mycobacterium avium subsp. paratuberculosis
gccgcugcgacaggucggcggucg

SEQ ID NO: 3023026 - RNA, 17 nt, Mycobacterium avium subsp. paratuberculosis
gccgcugcgcccagcgc

SEQ ID NO: 3023027 - RNA, 23 nt, Mycobacterium avium subsp. paratuberculosis
gccgcugcgcccagcgcgcgauc

SEQ ID NO: 3023028 - RNA, 14 nt, Mycobacterium avium subsp. paratuberculosis
gccgcugcgccggc

SEQ ID NO: 3023029 - RNA, 15 nt, Mycobacterium avium subsp. paratuberculosis
gccgcugcgccggcg

SEQ ID NO: 3023030 - RNA, 16 nt, Mycobacterium avium subsp. paratuberculosis
gccgcugcgccggcgc

SEQ ID NO: 3023031 - RNA, 21 nt, Mycobacterium avium subsp. paratuberculosis
gccgcugcgccggcgcggcca

SEQ ID NO: 3023032 - RNA, 20 nt, Mycobacterium avium subsp. paratuberculosis
gccgcugcgcgcgcgaucgg

SEQ ID NO: 3023033 - RNA, 18 nt, Mycobacterium avium subsp. paratuberculosis
gccgcugcgggccaucga

SEQ ID NO: 3023034 - RNA, 23 nt, Mycobacterium avium subsp. paratuberculosis
gccgcugcgggccaucgacucca

SEQ ID NO: 3023035 - RNA, 13 nt, Mycobacterium avium subsp. paratuberculosis
gccgcugcgggcg

SEQ ID NO: 3023036 - RNA, 14 nt, Mycobacterium avium subsp. paratuberculosis
gccgcugcgggcgg

SEQ ID NO: 3023037 - RNA, 17 nt, Mycobacterium avium subsp. paratuberculosis
gccgcugcgggcgggcc

SEQ ID NO: 3023038 - RNA, 18 nt, Mycobacterium avium subsp. paratuberculosis
gccgcugcgggcgggccg

SEQ ID NO: 3023039 - RNA, 22 nt, Mycobacterium avium subsp. paratuberculosis
gccgcugcgggcgggccgccag

SEQ ID NO: 3023040 - RNA, 14 nt, Mycobacterium avium subsp. paratuberculosis
gccgcugcgugccc

SEQ ID NO: 3023041 - RNA, 15 nt, Mycobacterium avium subsp. paratuberculosis
gccgcugcugggugc

SEQ ID NO: 3023042 - RNA, 17 nt, Mycobacterium avium subsp. paratuberculosis
gccgcugcugggugccg

SEQ ID NO: 3023043 - RNA, 22 nt, Mycobacterium avium subsp. paratuberculosis
gccgcugcuuugucucacgccu

SEQ ID NO: 3023044 - RNA, 19 nt, Mycobacterium avium subsp. paratuberculosis
gccgcuggauuccaccgug

SEQ ID NO: 3023045 - RNA, 14 nt, Mycobacterium avium subsp. paratuberculosis
gccgcuggccgccc

SEQ ID NO: 3023046 - RNA, 13 nt, Mycobacterium avium subsp. paratuberculosis
gccgcuggccgcg

SEQ ID NO: 3023047 - RNA, 15 nt, Mycobacterium avium subsp. paratuberculosis
gccgcuggccgcgcc

SEQ ID NO: 3023048 - RNA, 17 nt, Mycobacterium avium subsp. paratuberculosis
gccgcuggccgcgccac

SEQ ID NO: 3023049 - RNA, 14 nt, Mycobacterium avium subsp. paratuberculosis
gccgcuggcguaga

SEQ ID NO: 3023050 - RNA, 14 nt, Mycobacterium avium subsp. paratuberculosis
gccgcuggcguuga

SEQ ID NO: 3023051 - RNA, 15 nt, Mycobacterium avium subsp. paratuberculosis
gccgcugggagcacg

SEQ ID NO: 3023052 - RNA, 22 nt, Mycobacterium avium subsp. paratuberculosis
gccgcugggcguggugcggugc

SEQ ID NO: 3023053 - RNA, 14 nt, Mycobacterium avium subsp. paratuberculosis
gccgcugguaggcg

SEQ ID NO: 3023054 - RNA, 21 nt, Mycobacterium avium subsp. paratuberculosis
gccgcugguaggcggcgcagc

SEQ ID NO: 3023055 - RNA, 17 nt, Mycobacterium avium subsp. paratuberculosis
gccgcuggucaggccga

SEQ ID NO: 3023056 - RNA, 20 nt, Mycobacterium avium subsp. paratuberculosis
gccgcuggugaggucgcgca

SEQ ID NO: 3023057 - RNA, 22 nt, Mycobacterium avium subsp. paratuberculosis
gccgcuggugaggucgcgcagg

SEQ ID NO: 3023058 - RNA, 14 nt, Mycobacterium avium subsp. paratuberculosis
gccgcuggugguga

SEQ ID NO: 3023059 - RNA, 23 nt, Mycobacterium avium subsp. paratuberculosis
gccgcugguggugaucacccagc

SEQ ID NO: 3023060 - RNA, 17 nt, Mycobacterium avium subsp. paratuberculosis
gccgcuguccucgucgg

SEQ ID NO: 3023061 - RNA, 13 nt, Mycobacterium avium subsp. paratuberculosis
gccgcugucgucg

SEQ ID NO: 3023062 - RNA, 14 nt, Mycobacterium avium subsp. paratuberculosis
gccgcugucgucga

SEQ ID NO: 3023063 - RNA, 17 nt, Mycobacterium avium subsp. paratuberculosis
gccgcugucgucgaaga

SEQ ID NO: 3023064 - RNA, 20 nt, Mycobacterium avium subsp. paratuberculosis
gccgcugucgucgaagagcu

SEQ ID NO: 3023065 - RNA, 15 nt, Mycobacterium avium subsp. paratuberculosis
gccgcuucccacccg

SEQ ID NO: 3023066 - RNA, 18 nt, Mycobacterium avium subsp. paratuberculosis
gccgcuucccacccgguc

SEQ ID NO: 3023067 - RNA, 20 nt, Mycobacterium avium subsp. paratuberculosis
gccggacgggucgaccgccg

SEQ ID NO: 3023068 - RNA, 21 nt, Mycobacterium avium subsp. paratuberculosis
gccggacgggucgaccgccgc

SEQ ID NO: 3023069 - RNA, 17 nt, Mycobacterium avium subsp. paratuberculosis
gccggacggugacgccg

SEQ ID NO: 3023070 - RNA, 19 nt, Mycobacterium avium subsp. paratuberculosis
gccggacggugacgccgga

SEQ ID NO: 3023071 - RNA, 18 nt, Mycobacterium avium subsp. paratuberculosis
gccggacuauacacgccu

SEQ ID NO: 3023072 - RNA, 15 nt, Mycobacterium avium subsp. paratuberculosis
gccggacucgaagau

SEQ ID NO: 3023073 - RNA, 20 nt, Mycobacterium avium subsp. paratuberculosis
gccggacucgaucgccaccg

SEQ ID NO: 3023074 - RNA, 22 nt, Mycobacterium avium subsp. paratuberculosis
gccggacucgaucgccaccgag

SEQ ID NO: 3023075 - RNA, 22 nt, Mycobacterium avium subsp. paratuberculosis
gccggacuugaugcugcccggc

SEQ ID NO: 3023076 - RNA, 15 nt, Mycobacterium avium subsp. paratuberculosis
gccggagaccagcag

SEQ ID NO: 3023077 - RNA, 16 nt, Mycobacterium avium subsp. paratuberculosis
gccggagaccagcagc

SEQ ID NO: 3023078 - RNA, 18 nt, Mycobacterium avium subsp. paratuberculosis
gccggagaccagcagcuu

SEQ ID NO: 3023079 - RNA, 14 nt, Mycobacterium avium subsp. paratuberculosis
gccggagaccgccg

SEQ ID NO: 3023080 - RNA, 16 nt, Mycobacterium avium subsp. paratuberculosis
gccggagaccgccgug

SEQ ID NO: 3023081 - RNA, 13 nt, Mycobacterium avium subsp. paratuberculosis
gccggagagcccg

SEQ ID NO: 3023082 - RNA, 22 nt, Mycobacterium avium subsp. paratuberculosis
gccggagaucccguaggucgcc

SEQ ID NO: 3023083 - RNA, 20 nt, Mycobacterium avium subsp. paratuberculosis
gccggagaugaauucggcga

SEQ ID NO: 3023084 - RNA, 14 nt, Mycobacterium avium subsp. paratuberculosis
gccggagcccagcu

SEQ ID NO: 3023085 - RNA, 13 nt, Mycobacterium avium subsp. paratuberculosis
gccggagccgacc

SEQ ID NO: 3023086 - RNA, 17 nt, Mycobacterium avium subsp. paratuberculosis
gccggagccgaccucgg

SEQ ID NO: 3023087 - RNA, 16 nt, Mycobacterium avium subsp. paratuberculosis
gccggagccgaucgcc

SEQ ID NO: 3023088 - RNA, 22 nt, Mycobacterium avium subsp. paratuberculosis
gccggagccgaucgccuccguc

SEQ ID NO: 3023089 - RNA, 14 nt, Mycobacterium avium subsp. paratuberculosis
gccggagccggccu

SEQ ID NO: 3023090 - RNA, 21 nt, Mycobacterium avium subsp. paratuberculosis
gccggagccggccucgccggc

SEQ ID NO: 3023091 - RNA, 22 nt, Mycobacterium avium subsp. paratuberculosis
gccggagccggccucgccggcg

SEQ ID NO: 3023092 - RNA, 17 nt, Mycobacterium avium subsp. paratuberculosis
gccggagccuucuucgc

SEQ ID NO: 3023093 - RNA, 20 nt, Mycobacterium avium subsp. paratuberculosis
gccggagccuucuucgccgc

SEQ ID NO: 3023094 - RNA, 22 nt, Mycobacterium avium subsp. paratuberculosis
gccggagccuucuucgccgcaa

SEQ ID NO: 3023095 - RNA, 23 nt, Mycobacterium avium subsp. paratuberculosis
gccggagccuucuucgccgcagc

SEQ ID NO: 3023096 - RNA, 19 nt, Mycobacterium avium subsp. paratuberculosis
gccggagccuugcuggcgg

SEQ ID NO: 3023097 - RNA, 20 nt, Mycobacterium avium subsp. paratuberculosis
gccggagccuuggucgcggc

SEQ ID NO: 3023098 - RNA, 13 nt, Mycobacterium avium subsp. paratuberculosis
gccggagcgcccc

SEQ ID NO: 3023099 - RNA, 21 nt, Mycobacterium avium subsp. paratuberculosis
gccggagcggugcggcucggg

SEQ ID NO: 3023100 - RNA, 19 nt, Mycobacterium avium subsp. paratuberculosis
gccggaggccagcucgacc

SEQ ID NO: 3023101 - RNA, 23 nt, Mycobacterium avium subsp. paratuberculosis
gccggaggccagcucgaccgcgg

SEQ ID NO: 3023102 - RNA, 14 nt, Mycobacterium avium subsp. paratuberculosis
gccggaggcggcgu

SEQ ID NO: 3023103 - RNA, 15 nt, Mycobacterium avium subsp. paratuberculosis
gccggaggcggcgua

SEQ ID NO: 3023104 - RNA, 22 nt, Mycobacterium avium subsp. paratuberculosis
gccggaggcggcguagucggcg

SEQ ID NO: 3023105 - RNA, 15 nt, Mycobacterium avium subsp. paratuberculosis
gccggaguugccgau

SEQ ID NO: 3023106 - RNA, 13 nt, Mycobacterium avium subsp. paratuberculosis
gccggaucaccug

SEQ ID NO: 3023107 - RNA, 19 nt, Mycobacterium avium subsp. paratuberculosis
gccggaucagcguuccggc

SEQ ID NO: 3023108 - RNA, 18 nt, Mycobacterium avium subsp. paratuberculosis
gccggaucaugucguuga

SEQ ID NO: 3023109 - RNA, 21 nt, Mycobacterium avium subsp. paratuberculosis
gccggaucaugucguugaugc

SEQ ID NO: 3023110 - RNA, 23 nt, Mycobacterium avium subsp. paratuberculosis
gccggaucccgguacggcucaac

SEQ ID NO: 3023111 - RNA, 13 nt, Mycobacterium avium subsp. paratuberculosis
gccggaucgaauc

SEQ ID NO: 3023112 - RNA, 17 nt, Mycobacterium avium subsp. paratuberculosis
gccggaucgaauccggc

SEQ ID NO: 3023113 - RNA, 19 nt, Mycobacterium avium subsp. paratuberculosis
gccggaucgaauccggcgg

SEQ ID NO: 3023114 - RNA, 20 nt, Mycobacterium avium subsp. paratuberculosis
gccggaucgaauccggcggc

SEQ ID NO: 3023115 - RNA, 18 nt, Mycobacterium avium subsp. paratuberculosis
gccggaucgagcacccgg

SEQ ID NO: 3023116 - RNA, 19 nt, Mycobacterium avium subsp. paratuberculosis
gccggaucgagcacccggc

SEQ ID NO: 3023117 - RNA, 12 nt, Mycobacterium avium subsp. paratuberculosis
gccggaucgccg

SEQ ID NO: 3023118 - RNA, 14 nt, Mycobacterium avium subsp. paratuberculosis
gccggaucgccgag

SEQ ID NO: 3023119 - RNA, 19 nt, Mycobacterium avium subsp. paratuberculosis
gccggaucgccgagguagc

SEQ ID NO: 3023120 - RNA, 13 nt, Mycobacterium avium subsp. paratuberculosis
gccggaucgcgca

SEQ ID NO: 3023121 - RNA, 15 nt, Mycobacterium avium subsp. paratuberculosis
gccggaucgcgcagu

SEQ ID NO: 3023122 - RNA, 17 nt, Mycobacterium avium subsp. paratuberculosis
gccggaucggcccccgg

SEQ ID NO: 3023123 - RNA, 22 nt, Mycobacterium avium subsp. paratuberculosis
gccggaucggcccccgggcccg

SEQ ID NO: 3023124 - RNA, 14 nt, Mycobacterium avium subsp. paratuberculosis
gccggaucggggug

SEQ ID NO: 3023125 - RNA, 22 nt, Mycobacterium avium subsp. paratuberculosis
gccggaucgggguggacgcgac

SEQ ID NO: 3023126 - RNA, 23 nt, Mycobacterium avium subsp. paratuberculosis
gccggaucggucucgguggagaa

SEQ ID NO: 3023127 - RNA, 20 nt, Mycobacterium avium subsp. paratuberculosis
gccggaucgugucccggcgc

SEQ ID NO: 3023128 - RNA, 23 nt, Mycobacterium avium subsp. paratuberculosis
gccggaucgugucccggcgcccu

SEQ ID NO: 3023129 - RNA, 21 nt, Mycobacterium avium subsp. paratuberculosis
gccggaucucgucgggcaccg

SEQ ID NO: 3023130 - RNA, 22 nt, Mycobacterium avium subsp. paratuberculosis
gccggaucucgucgggcaccgc

SEQ ID NO: 3023131 - RNA, 23 nt, Mycobacterium avium subsp. paratuberculosis
gccggaucucgucgggcaccgcc

SEQ ID NO: 3023132 - RNA, 12 nt, Mycobacterium avium subsp. paratuberculosis
gccggaugccag

SEQ ID NO: 3023133 - RNA, 14 nt, Mycobacterium avium subsp. paratuberculosis
gccggaugccagca

SEQ ID NO: 3023134 - RNA, 17 nt, Mycobacterium avium subsp. paratuberculosis
gccggaugccagcaggu

SEQ ID NO: 3023135 - RNA, 18 nt, Mycobacterium avium subsp. paratuberculosis
gccggaugccagcagguc

SEQ ID NO: 3023136 - RNA, 17 nt, Mycobacterium avium subsp. paratuberculosis
gccggaugccgcgcggc

SEQ ID NO: 3023137 - RNA, 18 nt, Mycobacterium avium subsp. paratuberculosis
gccggaugccgcgcggcg

SEQ ID NO: 3023138 - RNA, 19 nt, Mycobacterium avium subsp. paratuberculosis
gccggaugccgcgcggcgc

SEQ ID NO: 3023139 - RNA, 20 nt, Mycobacterium avium subsp. paratuberculosis
gccggaugccgcgcggcgcc

SEQ ID NO: 3023140 - RNA, 14 nt, Mycobacterium avium subsp. paratuberculosis
gccggaugcggccg

SEQ ID NO: 3023141 - RNA, 14 nt, Mycobacterium avium subsp. paratuberculosis
gccggaugcggcuc

SEQ ID NO: 3023142 - RNA, 18 nt, Mycobacterium avium subsp. paratuberculosis
gccggaugcggucgauga

SEQ ID NO: 3023143 - RNA, 20 nt, Mycobacterium avium subsp. paratuberculosis
gccggaugcggucgaugagc

SEQ ID NO: 3023144 - RNA, 14 nt, Mycobacterium avium subsp. paratuberculosis
gccggauggccagc

SEQ ID NO: 3023145 - RNA, 15 nt, Mycobacterium avium subsp. paratuberculosis
gccggauggccagca

SEQ ID NO: 3023146 - RNA, 17 nt, Mycobacterium avium subsp. paratuberculosis
gccggauggccagcagg

SEQ ID NO: 3023147 - RNA, 14 nt, Mycobacterium avium subsp. paratuberculosis
gccggaugggcgca

SEQ ID NO: 3023148 - RNA, 22 nt, Mycobacterium avium subsp. paratuberculosis
gccggaugggcgcacgaucggg

SEQ ID NO: 3023149 - RNA, 16 nt, Mycobacterium avium subsp. paratuberculosis
gccggaugguccgcau

SEQ ID NO: 3023150 - RNA, 22 nt, Mycobacterium avium subsp. paratuberculosis
gccggauguccuacggcgggug

SEQ ID NO: 3023151 - RNA, 15 nt, Mycobacterium avium subsp. paratuberculosis
cgggcagccggcgcc

SEQ ID NO: 3023152 - RNA, 20 nt, Mycobacterium avium subsp. paratuberculosis
cgggcagccggcgcccgcag

SEQ ID NO: 3023153 - RNA, 21 nt, Mycobacterium avium subsp. paratuberculosis
cgggcagccggcgcccgcagg

SEQ ID NO: 3023154 - RNA, 20 nt, Mycobacterium avium subsp. paratuberculosis
cgggcagcgagcacagcggc

SEQ ID NO: 3023155 - RNA, 21 nt, Mycobacterium avium subsp. paratuberculosis
cgggcagcgagcacagcggcg

SEQ ID NO: 3023156 - RNA, 14 nt, Mycobacterium avium subsp. paratuberculosis
cgggcagcgagucg

SEQ ID NO: 3023157 - RNA, 15 nt, Mycobacterium avium subsp. paratuberculosis
cgggcagcgagucga

SEQ ID NO: 3023158 - RNA, 13 nt, Mycobacterium avium subsp. paratuberculosis
cgggcagcgccuc

SEQ ID NO: 3023159 - RNA, 13 nt, Mycobacterium avium subsp. paratuberculosis
cgggcagcgcgac

SEQ ID NO: 3023160 - RNA, 14 nt, Mycobacterium avium subsp. paratuberculosis
cgggcagcgcgaca

SEQ ID NO: 3023161 - RNA, 16 nt, Mycobacterium avium subsp. paratuberculosis
cgggcagcgcgacacc

SEQ ID NO: 3023162 - RNA, 13 nt, Mycobacterium avium subsp. paratuberculosis
cgggcagcggccc

SEQ ID NO: 3023163 - RNA, 16 nt, Mycobacterium avium subsp. paratuberculosis
cgggcagcggccccac

SEQ ID NO: 3023164 - RNA, 13 nt, Mycobacterium avium subsp. paratuberculosis
cgggcagcguguc

SEQ ID NO: 3023165 - RNA, 18 nt, Mycobacterium avium subsp. paratuberculosis
cgggcagcgugucccggu

SEQ ID NO: 3023166 - RNA, 19 nt, Mycobacterium avium subsp. paratuberculosis
cgggcagcuuccgccucgg

SEQ ID NO: 3023167 - RNA, 21 nt, Mycobacterium avium subsp. paratuberculosis
cgggcagcuuccgccucggcg

SEQ ID NO: 3023168 - RNA, 17 nt, Mycobacterium avium subsp. paratuberculosis
cgggcaggaugccgcgu

SEQ ID NO: 3023169 - RNA, 21 nt, Mycobacterium avium subsp. paratuberculosis
cgggcaggauggucagcgagu

SEQ ID NO: 3023170 - RNA, 15 nt, Mycobacterium avium subsp. paratuberculosis
cgggcaggcacggug

SEQ ID NO: 3023171 - RNA, 14 nt, Mycobacterium avium subsp. paratuberculosis
cgggcaggcccgag

SEQ ID NO: 3023172 - RNA, 18 nt, Mycobacterium avium subsp. paratuberculosis
cgggcaggcccgagcccg

SEQ ID NO: 3023173 - RNA, 19 nt, Mycobacterium avium subsp. paratuberculosis
cgggcaggcccgagcccga

SEQ ID NO: 3023174 - RNA, 20 nt, Mycobacterium avium subsp. paratuberculosis
cgggcaggcccgagcccgac

SEQ ID NO: 3023175 - RNA, 21 nt, Mycobacterium avium subsp. paratuberculosis
cgggcaggcccgagcccgacg

SEQ ID NO: 3023176 - RNA, 23 nt, Mycobacterium avium subsp. paratuberculosis
cgggcaggcccgagcccgacggc

SEQ ID NO: 3023177 - RNA, 15 nt, Mycobacterium avium subsp. paratuberculosis
cgggcaggccgaaga

SEQ ID NO: 3023178 - RNA, 14 nt, Mycobacterium avium subsp. paratuberculosis
cgggcaggccggug

SEQ ID NO: 3023179 - RNA, 14 nt, Mycobacterium avium subsp. paratuberculosis
cgggcaggcggcgc

SEQ ID NO: 3023180 - RNA, 15 nt, Mycobacterium avium subsp. paratuberculosis
cgggcaggcggcgcg

SEQ ID NO: 3023181 - RNA, 23 nt, Mycobacterium avium subsp. paratuberculosis
cgggcaggcucagguaggcgcgg

SEQ ID NO: 3023182 - RNA, 18 nt, Mycobacterium avium subsp. paratuberculosis
cgggcagggggacgaacc

SEQ ID NO: 3023183 - RNA, 21 nt, Mycobacterium avium subsp. paratuberculosis
cgggcagggugaccgaggccg

SEQ ID NO: 3023184 - RNA, 17 nt, Mycobacterium avium subsp. paratuberculosis
cgggcagguggucggcg

SEQ ID NO: 3023185 - RNA, 17 nt, Mycobacterium avium subsp. paratuberculosis
cgggcagucugccggug

SEQ ID NO: 3023186 - RNA, 18 nt, Mycobacterium avium subsp. paratuberculosis
cgggcagucugccggugg

SEQ ID NO: 3023187 - RNA, 21 nt, Mycobacterium avium subsp. paratuberculosis
cgggcagugcacgacgaccgc

SEQ ID NO: 3023188 - RNA, 22 nt, Mycobacterium avium subsp. paratuberculosis
cgggcagugcacgacgaccgcg

SEQ ID NO: 3023189 - RNA, 14 nt, Mycobacterium avium subsp. paratuberculosis
cgggcagugcgcgg

SEQ ID NO: 3023190 - RNA, 16 nt, Mycobacterium avium subsp. paratuberculosis
cgggcagugcgcggcg

SEQ ID NO: 3023191 - RNA, 18 nt, Mycobacterium avium subsp. paratuberculosis
cgggcagugcgcggcguc

SEQ ID NO: 3023192 - RNA, 19 nt, Mycobacterium avium subsp. paratuberculosis
cgggcaguuccuugcgcag

SEQ ID NO: 3023193 - RNA, 20 nt, Mycobacterium avium subsp. paratuberculosis
cgggcaguuccuugcgcagc

SEQ ID NO: 3023194 - RNA, 23 nt, Mycobacterium avium subsp. paratuberculosis
cgggcaguuccuugcgcagcacc

SEQ ID NO: 3023195 - RNA, 16 nt, Mycobacterium avium subsp. paratuberculosis
cgggcaguugccggcc

SEQ ID NO: 3023196 - RNA, 14 nt, Mycobacterium avium subsp. paratuberculosis
cgggcaucccgccg

SEQ ID NO: 3023197 - RNA, 15 nt, Mycobacterium avium subsp. paratuberculosis
cgggcaucccgccga

SEQ ID NO: 3023198 - RNA, 18 nt, Mycobacterium avium subsp. paratuberculosis
cgggcauccggcucagaa

SEQ ID NO: 3023199 - RNA, 20 nt, Mycobacterium avium subsp. paratuberculosis
cgggcauccggcucagaagg

SEQ ID NO: 3023200 - RNA, 23 nt, Mycobacterium avium subsp. paratuberculosis
cgggcauccggcucagaaggcgu

SEQ ID NO: 3023201 - RNA, 17 nt, Mycobacterium avium subsp. paratuberculosis
cgggcauccgggccgcc

SEQ ID NO: 3023202 - RNA, 21 nt, Mycobacterium avium subsp. paratuberculosis
cgggcauccgggccgccgcgg

SEQ ID NO: 3023203 - RNA, 14 nt, Mycobacterium avium subsp. paratuberculosis
cgggcaucgcuggu

SEQ ID NO: 3023204 - RNA, 15 nt, Mycobacterium avium subsp. paratuberculosis
cgggcaucgcuggug

SEQ ID NO: 3023205 - RNA, 13 nt, Mycobacterium avium subsp. paratuberculosis
gaagugccggucc

SEQ ID NO: 3023206 - RNA, 15 nt, Mycobacterium avium subsp. paratuberculosis
gaagugccuuucggc

SEQ ID NO: 3023207 - RNA, 17 nt, Mycobacterium avium subsp. paratuberculosis
gaagugccuuucggccu

SEQ ID NO: 3023208 - RNA, 21 nt, Mycobacterium avium subsp. paratuberculosis
gaagugcucgaacgcgccgau

SEQ ID NO: 3023209 - RNA, 14 nt, Mycobacterium avium subsp. paratuberculosis
gaagugcucgagca

SEQ ID NO: 3023210 - RNA, 21 nt, Mycobacterium avium subsp. paratuberculosis
gaagugcucgagcacaucggc

SEQ ID NO: 3023211 - RNA, 17 nt, Mycobacterium avium subsp. paratuberculosis
gaaguggcagcgcuccu

SEQ ID NO: 3023212 - RNA, 15 nt, Mycobacterium avium subsp. paratuberculosis
gaaguggcuggucac

SEQ ID NO: 3023213 - RNA, 20 nt, Mycobacterium avium subsp. paratuberculosis
gaaguggucgaucugcaggc

SEQ ID NO: 3023214 - RNA, 18 nt, Mycobacterium avium subsp. paratuberculosis
gaaguucaccaccgcgcu

SEQ ID NO: 3023215 - RNA, 13 nt, Mycobacterium avium subsp. paratuberculosis
gaaguucacgucc

SEQ ID NO: 3023216 - RNA, 20 nt, Mycobacterium avium subsp. paratuberculosis
gaaguucggcaucucggccg

SEQ ID NO: 3023217 - RNA, 18 nt, Mycobacterium avium subsp. paratuberculosis
gaaguucucgcacccggu

SEQ ID NO: 3023218 - RNA, 17 nt, Mycobacterium avium subsp. paratuberculosis
gaaguucucgccgugca

SEQ ID NO: 3023219 - RNA, 22 nt, Mycobacterium avium subsp. paratuberculosis
gaaguugaagacgcgaaagcag

SEQ ID NO: 3023220 - RNA, 14 nt, Mycobacterium avium subsp. paratuberculosis
gaaguugccgguca

SEQ ID NO: 3023221 - RNA, 16 nt, Mycobacterium avium subsp. paratuberculosis
gaaguugcgguugacg

SEQ ID NO: 3023222 - RNA, 17 nt, Mycobacterium avium subsp. paratuberculosis
gaaguugcgguugacgu

SEQ ID NO: 3023223 - RNA, 16 nt, Mycobacterium avium subsp. paratuberculosis
gaaguuggccaccggg

SEQ ID NO: 3023224 - RNA, 18 nt, Mycobacterium avium subsp. paratuberculosis
gaaguuggccaccggggu

SEQ ID NO: 3023225 - RNA, 17 nt, Mycobacterium avium subsp. paratuberculosis
gaaguuggucaccacca

SEQ ID NO: 3023226 - RNA, 23 nt, Mycobacterium avium subsp. paratuberculosis
gaaguuguagacguagugcagcc

SEQ ID NO: 3023227 - RNA, 21 nt, Mycobacterium avium subsp. paratuberculosis
gaauaacgccggccccggcga

SEQ ID NO: 3023228 - RNA, 20 nt, Mycobacterium avium subsp. paratuberculosis
gaauaaggggguagauguca

SEQ ID NO: 3023229 - RNA, 21 nt, Mycobacterium avium subsp. paratuberculosis
gaauacccgcccagcaccagu

SEQ ID NO: 3023230 - RNA, 19 nt, Mycobacterium avium subsp. paratuberculosis
gaauacccuucggccggca

SEQ ID NO: 3023231 - RNA, 13 nt, Mycobacterium avium subsp. paratuberculosis
gaaucacccacgg

SEQ ID NO: 3023232 - RNA, 22 nt, Mycobacterium avium subsp. paratuberculosis
gaaucacgccccaggcgcccug

SEQ ID NO: 3023233 - RNA, 19 nt, Mycobacterium avium subsp. paratuberculosis
gaauccaaggagaaggccg

SEQ ID NO: 3023234 - RNA, 17 nt, Mycobacterium avium subsp. paratuberculosis
gaauccacacaggacca

SEQ ID NO: 3023235 - RNA, 22 nt, Mycobacterium avium subsp. paratuberculosis
gaauccacacaggaccagcacu

SEQ ID NO: 3023236 - RNA, 21 nt, Mycobacterium avium subsp. paratuberculosis
gaauccagccgugcggcuugc

SEQ ID NO: 3023237 - RNA, 18 nt, Mycobacterium avium subsp. paratuberculosis
gaaucccuccggcaggcc

SEQ ID NO: 3023238 - RNA, 12 nt, Mycobacterium avium subsp. paratuberculosis
gaauccgagcau

SEQ ID NO: 3023239 - RNA, 20 nt, Mycobacterium avium subsp. paratuberculosis
gaauccgagcaucggguugc

SEQ ID NO: 3023240 - RNA, 20 nt, Mycobacterium avium subsp. paratuberculosis
gaauccgauugcggcgcagg

SEQ ID NO: 3023241 - RNA, 12 nt, Mycobacterium avium subsp. paratuberculosis
gaauccgcgcag

SEQ ID NO: 3023242 - RNA, 14 nt, Mycobacterium avium subsp. paratuberculosis
gaauccgcgcagca

SEQ ID NO: 3023243 - RNA, 17 nt, Mycobacterium avium subsp. paratuberculosis
gaauccgcgcagcagcg

SEQ ID NO: 3023244 - RNA, 21 nt, Mycobacterium avium subsp. paratuberculosis
gaauccgcgggcguggcgguc

SEQ ID NO: 3023245 - RNA, 22 nt, Mycobacterium avium subsp. paratuberculosis
gaauccgcgggcguggcggucg

SEQ ID NO: 3023246 - RNA, 23 nt, Mycobacterium avium subsp. paratuberculosis
gaauccgcgggcguggcggucgg

SEQ ID NO: 3023247 - RNA, 13 nt, Mycobacterium avium subsp. paratuberculosis
gaauccggccgga

SEQ ID NO: 3023248 - RNA, 18 nt, Mycobacterium avium subsp. paratuberculosis
gaauccggcggcgcucag

SEQ ID NO: 3023249 - RNA, 20 nt, Mycobacterium avium subsp. paratuberculosis
gaauccggcggggacguguc

SEQ ID NO: 3023250 - RNA, 17 nt, Mycobacterium avium subsp. paratuberculosis
gaauccgggccuccugu

SEQ ID NO: 3023251 - RNA, 19 nt, Mycobacterium avium subsp. paratuberculosis
gaauccgggugucgacgcc

SEQ ID NO: 3023252 - RNA, 23 nt, Mycobacterium avium subsp. paratuberculosis
gaauccgggugucgacgccgggc

SEQ ID NO: 3023253 - RNA, 19 nt, Mycobacterium avium subsp. paratuberculosis
gaauccgguccacucgucg

SEQ ID NO: 3023254 - RNA, 23 nt, Mycobacterium avium subsp. paratuberculosis
gaauccggugggguuagggcguc

SEQ ID NO: 3023255 - RNA, 16 nt, Mycobacterium avium subsp. paratuberculosis
gaauccucagcacggc

SEQ ID NO: 3023256 - RNA, 21 nt, Mycobacterium avium subsp. paratuberculosis
gaauccucagcacggccgcgg

SEQ ID NO: 3023257 - RNA, 13 nt, Mycobacterium avium subsp. paratuberculosis
gaaucgacaccgc

SEQ ID NO: 3023258 - RNA, 14 nt, Mycobacterium avium subsp. paratuberculosis
gaaucgacaccgca

SEQ ID NO: 3023259 - RNA, 16 nt, Mycobacterium avium subsp. paratuberculosis
gaaucgacaccgcacg

SEQ ID NO: 3023260 - RNA, 22 nt, Mycobacterium avium subsp. paratuberculosis
gaaucgagccgccugcgcgccg

SEQ ID NO: 3023261 - RNA, 15 nt, Mycobacterium avium subsp. paratuberculosis
gaaucgagggcgcgc

SEQ ID NO: 3023262 - RNA, 18 nt, Mycobacterium avium subsp. paratuberculosis
gaaucgagggcgcgcagc

SEQ ID NO: 3023263 - RNA, 23 nt, Mycobacterium avium subsp. paratuberculosis
gaaucgcggaucgaacagggcgg

SEQ ID NO: 3023264 - RNA, 19 nt, Mycobacterium avium subsp. paratuberculosis
gaaucgcggcaggcgaccc

SEQ ID NO: 3023265 - RNA, 21 nt, Mycobacterium avium subsp. paratuberculosis
gaaucgcgggaucggccggcg

SEQ ID NO: 3023266 - RNA, 18 nt, Mycobacterium avium subsp. paratuberculosis
gaaucgcgguagcgcucg

SEQ ID NO: 3023267 - RNA, 19 nt, Mycobacterium avium subsp. paratuberculosis
gaaucggcgcacagcuagg

SEQ ID NO: 3023268 - RNA, 16 nt, Mycobacterium avium subsp. paratuberculosis
gaaucgguccggcgaa

SEQ ID NO: 3023269 - RNA, 16 nt, Mycobacterium avium subsp. paratuberculosis
gaaucgguucggccag

SEQ ID NO: 3023270 - RNA, 17 nt, Mycobacterium avium subsp. paratuberculosis
gaaucgguucggccaga

SEQ ID NO: 3023271 - RNA, 17 nt, Mycobacterium avium subsp. paratuberculosis
gaaucgucccgucgacc

SEQ ID NO: 3023272 - RNA, 14 nt, Mycobacterium avium subsp. paratuberculosis
gaaucgucgccguc

SEQ ID NO: 3023273 - RNA, 13 nt, Mycobacterium avium subsp. paratuberculosis
gaaucgucggcga

SEQ ID NO: 3023274 - RNA, 17 nt, Mycobacterium avium subsp. paratuberculosis
gaaucgucggcgaugga

SEQ ID NO: 3023275 - RNA, 16 nt, Mycobacterium avium subsp. paratuberculosis
gaaucguugagcacca

SEQ ID NO: 3023276 - RNA, 21 nt, Mycobacterium avium subsp. paratuberculosis
gaaucucgugguaccggcgcc

SEQ ID NO: 3023277 - RNA, 22 nt, Mycobacterium avium subsp. paratuberculosis
gaaucucgugguaccggcgcca

SEQ ID NO: 3023278 - RNA, 15 nt, Mycobacterium avium subsp. paratuberculosis
gaaucuuggccagca

SEQ ID NO: 3023279 - RNA, 17 nt, Mycobacterium avium subsp. paratuberculosis
gaaugaacgcggccagg

SEQ ID NO: 3023280 - RNA, 14 nt, Mycobacterium avium subsp. paratuberculosis
gaaugcagcggcuc

SEQ ID NO: 3023281 - RNA, 16 nt, Mycobacterium avium subsp. paratuberculosis
gaaugcagcggcuccg

SEQ ID NO: 3023282 - RNA, 22 nt, Mycobacterium avium subsp. paratuberculosis
gaaugcccagcggguaguucuu

SEQ ID NO: 3023283 - RNA, 15 nt, Mycobacterium avium subsp. paratuberculosis
gaaugcggugcugcc

SEQ ID NO: 3023284 - RNA, 15 nt, Mycobacterium avium subsp. paratuberculosis
gaaugcucagcggga

SEQ ID NO: 3023285 - RNA, 15 nt, Mycobacterium avium subsp. paratuberculosis
gaauggcaaggccag

SEQ ID NO: 3023286 - RNA, 16 nt, Mycobacterium avium subsp. paratuberculosis
gaauggcaaggccagc

SEQ ID NO: 3023287 - RNA, 12 nt, Mycobacterium avium subsp. paratuberculosis
gaauggcagcag

SEQ ID NO: 3023288 - RNA, 21 nt, Mycobacterium avium subsp. paratuberculosis
gaauggcagcagccggaaggc

SEQ ID NO: 3023289 - RNA, 17 nt, Mycobacterium avium subsp. paratuberculosis
gacaccccgcucggcca

SEQ ID NO: 3023290 - RNA, 20 nt, Mycobacterium avium subsp. paratuberculosis
gacaccccggccaguccgcg

SEQ ID NO: 3023291 - RNA, 22 nt, Mycobacterium avium subsp. paratuberculosis
gacaccccggcgaugaccggga

SEQ ID NO: 3023292 - RNA, 17 nt, Mycobacterium avium subsp. paratuberculosis
gacacccgcgcggugcc

SEQ ID NO: 3023293 - RNA, 18 nt, Mycobacterium avium subsp. paratuberculosis
gacacccgcgcggugccc

SEQ ID NO: 3023294 - RNA, 13 nt, Mycobacterium avium subsp. paratuberculosis
gacacccucgcgc

SEQ ID NO: 3023295 - RNA, 15 nt, Mycobacterium avium subsp. paratuberculosis
gacacccucggggua

SEQ ID NO: 3023296 - RNA, 22 nt, Mycobacterium avium subsp. paratuberculosis
gacacccuucaucagcaccgcg

SEQ ID NO: 3023297 - RNA, 18 nt, Mycobacterium avium subsp. paratuberculosis
gacaccgaacccaccagc

SEQ ID NO: 3023298 - RNA, 20 nt, Mycobacterium avium subsp. paratuberculosis
gacaccgaaccgccccgcgc

SEQ ID NO: 3023299 - RNA, 17 nt, Mycobacterium avium subsp. paratuberculosis
gacaccgacgaccauca

SEQ ID NO: 3023300 - RNA, 21 nt, Mycobacterium avium subsp. paratuberculosis
gacaccgacgaccaucagcgc

SEQ ID NO: 3023301 - RNA, 22 nt, Mycobacterium avium subsp. paratuberculosis
gacaccgacgaccaucagcgcc

SEQ ID NO: 3023302 - RNA, 23 nt, Mycobacterium avium subsp. paratuberculosis
gacaccgacgaccaucagcgccc

SEQ ID NO: 3023303 - RNA, 13 nt, Mycobacterium avium subsp. paratuberculosis
gacaccgcaccca

SEQ ID NO: 3023304 - RNA, 14 nt, Mycobacterium avium subsp. paratuberculosis
gacaccgcacccag

SEQ ID NO: 3023305 - RNA, 12 nt, Mycobacterium avium subsp. paratuberculosis
gacaccgcacgg

SEQ ID NO: 3023306 - RNA, 19 nt, Mycobacterium avium subsp. paratuberculosis
gacaccgcauggccggcga

SEQ ID NO: 3023307 - RNA, 11 nt, Mycobacterium avium subsp. paratuberculosis
gacaccgccag

SEQ ID NO: 3023308 - RNA, 19 nt, Mycobacterium avium subsp. paratuberculosis
gacaccgccagcagcgccg

SEQ ID NO: 3023309 - RNA, 20 nt, Mycobacterium avium subsp. paratuberculosis
gacaccgccagcagcgccgc

SEQ ID NO: 3023310 - RNA, 21 nt, Mycobacterium avium subsp. paratuberculosis
gacaccgccagcagcgccgcu

SEQ ID NO: 3023311 - RNA, 17 nt, Mycobacterium avium subsp. paratuberculosis
gacaccgccccgccgcg

SEQ ID NO: 3023312 - RNA, 12 nt, Mycobacterium avium subsp. paratuberculosis
gacaccgccguu

SEQ ID NO: 3023313 - RNA, 22 nt, Mycobacterium avium subsp. paratuberculosis
gacaccgccuucgacggccggc

SEQ ID NO: 3023314 - RNA, 14 nt, Mycobacterium avium subsp. paratuberculosis
gacaccgcggcgac

SEQ ID NO: 3023315 - RNA, 16 nt, Mycobacterium avium subsp. paratuberculosis
gacaccgcggcgacgu

SEQ ID NO: 3023316 - RNA, 18 nt, Mycobacterium avium subsp. paratuberculosis
gacaccgcggcgacgucg

SEQ ID NO: 3023317 - RNA, 22 nt, Mycobacterium avium subsp. paratuberculosis
gacaccgcggcgacgucgugca

SEQ ID NO: 3023318 - RNA, 13 nt, Mycobacterium avium subsp. paratuberculosis
gacaccgcuggcc

SEQ ID NO: 3023319 - RNA, 19 nt, Mycobacterium avium subsp. paratuberculosis
gacaccgcuggccgaggcc

SEQ ID NO: 3023320 - RNA, 16 nt, Mycobacterium avium subsp. paratuberculosis
gacaccggcacgucgg

SEQ ID NO: 3023321 - RNA, 20 nt, Mycobacterium avium subsp. paratuberculosis
gacaccggcacgucggccac

SEQ ID NO: 3023322 - RNA, 22 nt, Mycobacterium avium subsp. paratuberculosis
gacaccggcgugaugacggcgg

SEQ ID NO: 3023323 - RNA, 18 nt, Mycobacterium avium subsp. paratuberculosis
gacaccgggcaccgacau

SEQ ID NO: 3023324 - RNA, 20 nt, Mycobacterium avium subsp. paratuberculosis
gacaccgggucccccgccga

SEQ ID NO: 3023325 - RNA, 21 nt, Mycobacterium avium subsp. paratuberculosis
gacaccgggucccccgccgac

SEQ ID NO: 3023326 - RNA, 14 nt, Mycobacterium avium subsp. paratuberculosis
gacaccgucgccgu

SEQ ID NO: 3023327 - RNA, 15 nt, Mycobacterium avium subsp. paratuberculosis
gacaccgucgccgug

SEQ ID NO: 3023328 - RNA, 15 nt, Mycobacterium avium subsp. paratuberculosis
gacaccgugguggcg

SEQ ID NO: 3023329 - RNA, 18 nt, Mycobacterium avium subsp. paratuberculosis
gacaccgugguggcggcg

SEQ ID NO: 3023330 - RNA, 19 nt, Mycobacterium avium subsp. paratuberculosis
gacaccucggccagcgccg

SEQ ID NO: 3023331 - RNA, 13 nt, Mycobacterium avium subsp. paratuberculosis
gacaccucgucga

SEQ ID NO: 3023332 - RNA, 20 nt, Mycobacterium avium subsp. paratuberculosis
gacaccucgucgaucuucgc

SEQ ID NO: 3023333 - RNA, 16 nt, Mycobacterium avium subsp. paratuberculosis
gacaccugcucaccga

SEQ ID NO: 3023334 - RNA, 18 nt, Mycobacterium avium subsp. paratuberculosis
gacaccugcucaccgagc

SEQ ID NO: 3023335 - RNA, 16 nt, Mycobacterium avium subsp. paratuberculosis
gacaccuuggcggcca

SEQ ID NO: 3023336 - RNA, 14 nt, Mycobacterium avium subsp. paratuberculosis
gacacgaacgacgc

SEQ ID NO: 3023337 - RNA, 18 nt, Mycobacterium avium subsp. paratuberculosis
gacacgaacgacgcggca

SEQ ID NO: 3023338 - RNA, 19 nt, Mycobacterium avium subsp. paratuberculosis
gacacgaacgacgcggcac

SEQ ID NO: 3023339 - RNA, 18 nt, Mycobacterium avium subsp. paratuberculosis
gacacgaauacccuucgg

SEQ ID NO: 3023340 - RNA, 19 nt, Mycobacterium avium subsp. paratuberculosis
gacacgaauacccuucggc

SEQ ID NO: 3023341 - RNA, 18 nt, Mycobacterium avium subsp. paratuberculosis
gacacgaccgccugucag

SEQ ID NO: 3023342 - RNA, 14 nt, Mycobacterium avium subsp. paratuberculosis
gacacgaucggcau

SEQ ID NO: 3023343 - RNA, 22 nt, Mycobacterium avium subsp. paratuberculosis
gacacgccgacgauccgcgccg

SEQ ID NO: 3023344 - RNA, 23 nt, Mycobacterium avium subsp. paratuberculosis
gacacgccgacgauccgcgccgc

SEQ ID NO: 3023345 - RNA, 13 nt, Mycobacterium avium subsp. paratuberculosis
gacacgccgaucg

SEQ ID NO: 3023346 - RNA, 22 nt, Mycobacterium avium subsp. paratuberculosis
gacacgccgcgcaucaggggcu

SEQ ID NO: 3023347 - RNA, 12 nt, Mycobacterium avium subsp. paratuberculosis
gacacgcgccgg

SEQ ID NO: 3023348 - RNA, 15 nt, Mycobacterium avium subsp. paratuberculosis
gacacgcgccggcgc

SEQ ID NO: 3023349 - RNA, 19 nt, Mycobacterium avium subsp. paratuberculosis
gacacgcgccggcgcgggc

SEQ ID NO: 3023350 - RNA, 17 nt, Mycobacterium avium subsp. paratuberculosis
gacacgcucacgcucgg

SEQ ID NO: 3023351 - RNA, 13 nt, Mycobacterium avium subsp. paratuberculosis
gacacgcugccga

SEQ ID NO: 3023352 - RNA, 14 nt, Mycobacterium avium subsp. paratuberculosis
gacacgcugccgag

SEQ ID NO: 3023353 - RNA, 15 nt, Mycobacterium avium subsp. paratuberculosis
gacacggaaaccgcu

SEQ ID NO: 3023354 - RNA, 22 nt, Mycobacterium avium subsp. paratuberculosis
gacacggaaaccgcugcggcac

SEQ ID NO: 3023355 - RNA, 14 nt, Mycobacterium avium subsp. paratuberculosis
gacacggccagcgc

SEQ ID NO: 3023356 - RNA, 16 nt, Mycobacterium avium subsp. paratuberculosis
gacacggccagcgccg

SEQ ID NO: 3023357 - RNA, 17 nt, Mycobacterium avium subsp. paratuberculosis
gacacggcgccgugcgc

SEQ ID NO: 3023358 - RNA, 13 nt, Mycobacterium avium subsp. paratuberculosis
gacacggcggcgc

SEQ ID NO: 3023359 - RNA, 14 nt, Mycobacterium avium subsp. paratuberculosis
gacacggcggcgcg

SEQ ID NO: 3023360 - RNA, 16 nt, Mycobacterium avium subsp. paratuberculosis
gacacgggccgcgccg

SEQ ID NO: 3023361 - RNA, 17 nt, Mycobacterium avium subsp. paratuberculosis
gacacgggccgcgccga

SEQ ID NO: 3023362 - RNA, 15 nt, Mycobacterium avium subsp. paratuberculosis
gacacguaggccgcc

SEQ ID NO: 3023363 - RNA, 18 nt, Mycobacterium avium subsp. paratuberculosis
gacacguaggccgccugc

SEQ ID NO: 3023364 - RNA, 20 nt, Mycobacterium avium subsp. paratuberculosis
gacacgucgacacgccggcc

SEQ ID NO: 3023365 - RNA, 19 nt, Mycobacterium avium subsp. paratuberculosis
gacacugcaacuacgcacc

SEQ ID NO: 3023366 - RNA, 22 nt, Mycobacterium avium subsp. paratuberculosis
gacacugcaacuacgcacccga

SEQ ID NO: 3023367 - RNA, 19 nt, Mycobacterium avium subsp. paratuberculosis
gacagaaaucgcgcagaaa

SEQ ID NO: 3023368 - RNA, 14 nt, Mycobacterium avium subsp. paratuberculosis
gacagacccgacag

SEQ ID NO: 3023369 - RNA, 14 nt, Mycobacterium avium subsp. paratuberculosis
gacagacccgaucg

SEQ ID NO: 3023370 - RNA, 23 nt, Mycobacterium avium subsp. paratuberculosis
gacagaucgcccaucaccgcacc

SEQ ID NO: 3023371 - RNA, 21 nt, Mycobacterium avium subsp. paratuberculosis
gacagaugccagacgaacgcg

SEQ ID NO: 3023372 - RNA, 22 nt, Mycobacterium avium subsp. paratuberculosis
gacagaugcggcaccagcccgc

SEQ ID NO: 3023373 - RNA, 18 nt, Mycobacterium avium subsp. paratuberculosis
gacagcaaaccgaccgcc

SEQ ID NO: 3023374 - RNA, 13 nt, Mycobacterium avium subsp. paratuberculosis
gacaggcagcccg

SEQ ID NO: 3023375 - RNA, 14 nt, Mycobacterium avium subsp. paratuberculosis
gacaggcagcccgg

SEQ ID NO: 3023376 - RNA, 16 nt, Mycobacterium avium subsp. paratuberculosis
gacaggcagcccggcu

SEQ ID NO: 3023377 - RNA, 15 nt, Mycobacterium avium subsp. paratuberculosis
gacaggcccagcggc

SEQ ID NO: 3023378 - RNA, 13 nt, Mycobacterium avium subsp. paratuberculosis
gacaggccggccg

SEQ ID NO: 3023379 - RNA, 13 nt, Mycobacterium avium subsp. paratuberculosis
gacaggccggcga

SEQ ID NO: 3023380 - RNA, 22 nt, Mycobacterium avium subsp. paratuberculosis
gacaggcggucgugucagggau

SEQ ID NO: 3023381 - RNA, 16 nt, Mycobacterium avium subsp. paratuberculosis
gacagggagccgacga

SEQ ID NO: 3023382 - RNA, 23 nt, Mycobacterium avium subsp. paratuberculosis
gacagggaggacagcaccgccau

SEQ ID NO: 3023383 - RNA, 12 nt, Mycobacterium avium subsp. paratuberculosis
gacagggccagc

SEQ ID NO: 3023384 - RNA, 17 nt, Mycobacterium avium subsp. paratuberculosis
gacagggcggcgaccuu

SEQ ID NO: 3023385 - RNA, 14 nt, Mycobacterium avium subsp. paratuberculosis
gacaggggcagcag

SEQ ID NO: 3023386 - RNA, 16 nt, Mycobacterium avium subsp. paratuberculosis
gacaggggcagcagca

SEQ ID NO: 3023387 - RNA, 20 nt, Mycobacterium avium subsp. paratuberculosis
gacaggggcagcagcagauc

SEQ ID NO: 3023388 - RNA, 23 nt, Mycobacterium avium subsp. paratuberculosis
gacaggguaacccgggacccgga

SEQ ID NO: 3023389 - RNA, 16 nt, Mycobacterium avium subsp. paratuberculosis
gacagguagcgcagcc

SEQ ID NO: 3023390 - RNA, 18 nt, Mycobacterium avium subsp. paratuberculosis
gacagguagcgcagcccg

SEQ ID NO: 3023391 - RNA, 21 nt, Mycobacterium avium subsp. paratuberculosis
gacagguagcgcagcccgguu

SEQ ID NO: 3023392 - RNA, 15 nt, Mycobacterium avium subsp. paratuberculosis
gacaggucgaagggc

SEQ ID NO: 3023393 - RNA, 21 nt, Mycobacterium avium subsp. paratuberculosis
gacaggucgaagggcaucggg

SEQ ID NO: 3023394 - RNA, 20 nt, Mycobacterium avium subsp. paratuberculosis
gacaggucgagggugacccg

SEQ ID NO: 3023395 - RNA, 16 nt, Mycobacterium avium subsp. paratuberculosis
gacaggucggcggucg

SEQ ID NO: 3023396 - RNA, 20 nt, Mycobacterium avium subsp. paratuberculosis
gacaggugcauccagucggc

SEQ ID NO: 3023397 - RNA, 23 nt, Mycobacterium avium subsp. paratuberculosis
gacaggugcauccagucggcgcc

SEQ ID NO: 3023398 - RNA, 16 nt, Mycobacterium avium subsp. paratuberculosis
gacagguggccgauca

SEQ ID NO: 3023399 - RNA, 19 nt, Mycobacterium avium subsp. paratuberculosis
gacagguggccgaucagcg

SEQ ID NO: 3023400 - RNA, 22 nt, Mycobacterium avium subsp. paratuberculosis
gacagguggccgaucagcggcg

SEQ ID NO: 3023401 - RNA, 14 nt, Mycobacterium avium subsp. paratuberculosis
gacagguggggcac

SEQ ID NO: 3023402 - RNA, 19 nt, Mycobacterium avium subsp. paratuberculosis
gacagguggggcaccagaa

SEQ ID NO: 3023403 - RNA, 18 nt, Mycobacterium avium subsp. paratuberculosis
gacagguucuuggcggcc

SEQ ID NO: 3023404 - RNA, 20 nt, Mycobacterium avium subsp. paratuberculosis
gacagguucuuggcggccug

SEQ ID NO: 3023405 - RNA, 15 nt, Mycobacterium avium subsp. paratuberculosis
gacaguccgaccgcg

SEQ ID NO: 3023406 - RNA, 16 nt, Mycobacterium avium subsp. paratuberculosis
gacagucgcgggcagc

SEQ ID NO: 3023407 - RNA, 19 nt, Mycobacterium avium subsp. paratuberculosis
gacagucgcgggcagccgg

SEQ ID NO: 3023408 - RNA, 24 nt, Mycobacterium avium subsp. paratuberculosis
gacagucgcgggcgagccgacagu

SEQ ID NO: 3023409 - RNA, 23 nt, Mycobacterium avium subsp. paratuberculosis
gacagucgcgggcggggcgccga

SEQ ID NO: 3023410 - RNA, 15 nt, Mycobacterium avium subsp. paratuberculosis
gacaguuaggucuug

SEQ ID NO: 3023411 - RNA, 15 nt, Mycobacterium avium subsp. paratuberculosis
gacaguucggcgcgc

SEQ ID NO: 3023412 - RNA, 17 nt, Mycobacterium avium subsp. paratuberculosis
gacaguucgguggggcc

SEQ ID NO: 3023413 - RNA, 18 nt, Mycobacterium avium subsp. paratuberculosis
gacaguucgguggggccg

SEQ ID NO: 3023414 - RNA, 21 nt, Mycobacterium avium subsp. paratuberculosis
gacaguucgguggggccgccg

SEQ ID NO: 3023415 - RNA, 15 nt, Mycobacterium avium subsp. paratuberculosis
gacaucaccaccgcc

SEQ ID NO: 3023416 - RNA, 22 nt, Mycobacterium avium subsp. paratuberculosis
gacaucaccgcgggcgcgccgu

SEQ ID NO: 3023417 - RNA, 16 nt, Mycobacterium avium subsp. paratuberculosis
gacaucacgaacgcgu

SEQ ID NO: 3023418 - RNA, 19 nt, Mycobacterium avium subsp. paratuberculosis
gacaucagaucgccgacga

SEQ ID NO: 3023419 - RNA, 20 nt, Mycobacterium avium subsp. paratuberculosis
gacaucaggcccuugcccca

SEQ ID NO: 3023420 - RNA, 16 nt, Mycobacterium avium subsp. paratuberculosis
gacauccauugggccg

SEQ ID NO: 3023421 - RNA, 19 nt, Mycobacterium avium subsp. paratuberculosis
gacauccauugggccgcgg

SEQ ID NO: 3023422 - RNA, 21 nt, Mycobacterium avium subsp. paratuberculosis
gacauccauugggccgcggcg

SEQ ID NO: 3023423 - RNA, 22 nt, Mycobacterium avium subsp. paratuberculosis
gacaucgaaugcagcggcuccg

SEQ ID NO: 3023424 - RNA, 16 nt, Mycobacterium avium subsp. paratuberculosis
gacaucgccaccugga

SEQ ID NO: 3023425 - RNA, 17 nt, Mycobacterium avium subsp. paratuberculosis
gacaucgccaucagcag

SEQ ID NO: 3023426 - RNA, 22 nt, Mycobacterium avium subsp. paratuberculosis
gacaucgccaucagcagcgccu

SEQ ID NO: 3023427 - RNA, 15 nt, Mycobacterium avium subsp. paratuberculosis
gacaucgccgcggcc

SEQ ID NO: 3023428 - RNA, 16 nt, Mycobacterium avium subsp. paratuberculosis
gacaucgccgcggccg

SEQ ID NO: 3023429 - RNA, 16 nt, Mycobacterium avium subsp. paratuberculosis
gacaucgccggcgacc

SEQ ID NO: 3023430 - RNA, 15 nt, Mycobacterium avium subsp. paratuberculosis
gacaucgccucggcg

SEQ ID NO: 3023431 - RNA, 13 nt, Mycobacterium avium subsp. paratuberculosis
gacaucggcagca

SEQ ID NO: 3023432 - RNA, 16 nt, Mycobacterium avium subsp. paratuberculosis
gacaucggcagcaggg

SEQ ID NO: 3023433 - RNA, 22 nt, Mycobacterium avium subsp. paratuberculosis
gacaucggcagcagggugccgc

SEQ ID NO: 3023434 - RNA, 15 nt, Mycobacterium avium subsp. paratuberculosis
gacaucggcgccgac

SEQ ID NO: 3023435 - RNA, 13 nt, Mycobacterium avium subsp. paratuberculosis
gacaucggugacc

SEQ ID NO: 3023436 - RNA, 19 nt, Mycobacterium avium subsp. paratuberculosis
gacaucggugaccgucgcc

SEQ ID NO: 3023437 - RNA, 15 nt, Mycobacterium avium subsp. paratuberculosis
gacaucgucgcgccc

SEQ ID NO: 3023438 - RNA, 21 nt, Mycobacterium avium subsp. paratuberculosis
gacaucgucgcgcccaggaac

SEQ ID NO: 3023439 - RNA, 14 nt, Mycobacterium avium subsp. paratuberculosis
gacaucgucggcuc

SEQ ID NO: 3023440 - RNA, 15 nt, Mycobacterium avium subsp. paratuberculosis
gacaucucgacggug

SEQ ID NO: 3023441 - RNA, 21 nt, Mycobacterium avium subsp. paratuberculosis
gacaucucgacggugaccggc

SEQ ID NO: 3023442 - RNA, 14 nt, Mycobacterium avium subsp. paratuberculosis
gacaucucggugag

SEQ ID NO: 3023443 - RNA, 16 nt, Mycobacterium avium subsp. paratuberculosis
gacaucugccgggcgg

SEQ ID NO: 3023444 - RNA, 18 nt, Mycobacterium avium subsp. paratuberculosis
gacaucugccgggcggcg

SEQ ID NO: 3023445 - RNA, 16 nt, Mycobacterium avium subsp. paratuberculosis
gacaugaagcccccgu

SEQ ID NO: 3023446 - RNA, 15 nt, Mycobacterium avium subsp. paratuberculosis
gacaugaccaccgcg

SEQ ID NO: 3023447 - RNA, 19 nt, Mycobacterium avium subsp. paratuberculosis
gacaugaccaccgcgucgg

SEQ ID NO: 3023448 - RNA, 15 nt, Mycobacterium avium subsp. paratuberculosis
gacaugcagccgccg

SEQ ID NO: 3023449 - RNA, 16 nt, Mycobacterium avium subsp. paratuberculosis
gacaugcagccgccgc

SEQ ID NO: 3023450 - RNA, 13 nt, Mycobacterium avium subsp. paratuberculosis
gacaugcccgcgg

SEQ ID NO: 3023451 - RNA, 21 nt, Mycobacterium avium subsp. paratuberculosis
gacaugcccggcgacggcgcc

SEQ ID NO: 3023452 - RNA, 14 nt, Mycobacterium avium subsp. paratuberculosis
gacaugcccgggcu

SEQ ID NO: 3023453 - RNA, 17 nt, Mycobacterium avium subsp. paratuberculosis
gacaugccggcgccgau

SEQ ID NO: 3023454 - RNA, 13 nt, Mycobacterium avium subsp. paratuberculosis
gacaugcuguucc

SEQ ID NO: 3023455 - RNA, 16 nt, Mycobacterium avium subsp. paratuberculosis
gacauggacgcggccu

SEQ ID NO: 3023456 - RNA, 22 nt, Mycobacterium avium subsp. paratuberculosis
gacauggacgcggccucaccgc

SEQ ID NO: 3023457 - RNA, 19 nt, Mycobacterium avium subsp. paratuberculosis
gacauggccagcaccaucc

SEQ ID NO: 3023458 - RNA, 23 nt, Mycobacterium avium subsp. paratuberculosis
gacauguccgggauggacgacgu

SEQ ID NO: 3023459 - RNA, 16 nt, Mycobacterium avium subsp. paratuberculosis
gaccacggugcgcucg

SEQ ID NO: 3023460 - RNA, 17 nt, Mycobacterium avium subsp. paratuberculosis
gaccacggugcgcucgu

SEQ ID NO: 3023461 - RNA, 19 nt, Mycobacterium avium subsp. paratuberculosis
gaccacguccagcugggcu

SEQ ID NO: 3023462 - RNA, 22 nt, Mycobacterium avium subsp. paratuberculosis
gaccacuccuggguuccggugg

SEQ ID NO: 3023463 - RNA, 20 nt, Mycobacterium avium subsp. paratuberculosis
gaccagauaggccagcgcgu

SEQ ID NO: 3023464 - RNA, 14 nt, Mycobacterium avium subsp. paratuberculosis
gaccagauccucga

SEQ ID NO: 3023465 - RNA, 23 nt, Mycobacterium avium subsp. paratuberculosis
gaccagauccucgaauccgcggg

SEQ ID NO: 3023466 - RNA, 15 nt, Mycobacterium avium subsp. paratuberculosis
gaccagcacccgggc

SEQ ID NO: 3023467 - RNA, 18 nt, Mycobacterium avium subsp. paratuberculosis
gaccagcacccgggccuu

SEQ ID NO: 3023468 - RNA, 13 nt, Mycobacterium avium subsp. paratuberculosis
gaccagcaccgcg

SEQ ID NO: 3023469 - RNA, 14 nt, Mycobacterium avium subsp. paratuberculosis
gaccagcaccgcgg

SEQ ID NO: 3023470 - RNA, 23 nt, Mycobacterium avium subsp. paratuberculosis
gaccagcacguugugcucgucga

SEQ ID NO: 3023471 - RNA, 21 nt, Mycobacterium avium subsp. paratuberculosis
gaccagcaggacgcgcccggc

SEQ ID NO: 3023472 - RNA, 22 nt, Mycobacterium avium subsp. paratuberculosis
gaccagcaugugcucccagcuc

SEQ ID NO: 3023473 - RNA, 15 nt, Mycobacterium avium subsp. paratuberculosis
gaccagcccggccgc

SEQ ID NO: 3023474 - RNA, 17 nt, Mycobacterium avium subsp. paratuberculosis
gaccagcccggccgccg

SEQ ID NO: 3023475 - RNA, 20 nt, Mycobacterium avium subsp. paratuberculosis
gaccagcccggccgccgagg

SEQ ID NO: 3023476 - RNA, 21 nt, Mycobacterium avium subsp. paratuberculosis
gaccagccgaaguuggcgucg

SEQ ID NO: 3023477 - RNA, 22 nt, Mycobacterium avium subsp. paratuberculosis
gaccagccgaaguuggcgucgg

SEQ ID NO: 3023478 - RNA, 23 nt, Mycobacterium avium subsp. paratuberculosis
gaccagccgaaguuggcgucggg

SEQ ID NO: 3023479 - RNA, 15 nt, Mycobacterium avium subsp. paratuberculosis
gaccagccgaggcgc

SEQ ID NO: 3023480 - RNA, 15 nt, Mycobacterium avium subsp. paratuberculosis
gaccagccggguccg

SEQ ID NO: 3023481 - RNA, 12 nt, Mycobacterium avium subsp. paratuberculosis
gaccagcgacgc

SEQ ID NO: 3023482 - RNA, 14 nt, Mycobacterium avium subsp. paratuberculosis
gaccagcgacgcca

SEQ ID NO: 3023483 - RNA, 16 nt, Mycobacterium avium subsp. paratuberculosis
gaccagcgcaaccgcg

SEQ ID NO: 3023484 - RNA, 21 nt, Mycobacterium avium subsp. paratuberculosis
gaccagcgcaaccgcggcggc

SEQ ID NO: 3023485 - RNA, 20 nt, Mycobacterium avium subsp. paratuberculosis
gaccagcgcccccgacaggc

SEQ ID NO: 3023486 - RNA, 12 nt, Mycobacterium avium subsp. paratuberculosis
gaccagcgccga

SEQ ID NO: 3023487 - RNA, 19 nt, Mycobacterium avium subsp. paratuberculosis
gaccagcgccucgcgggug

SEQ ID NO: 3023488 - RNA, 19 nt, Mycobacterium avium subsp. paratuberculosis
gaccagcgccucggccugc

SEQ ID NO: 3023489 - RNA, 20 nt, Mycobacterium avium subsp. paratuberculosis
gaccagcgcgaacagcgcgg

SEQ ID NO: 3023490 - RNA, 22 nt, Mycobacterium avium subsp. paratuberculosis
gaccagcgcgaacagcgcggcc

SEQ ID NO: 3023491 - RNA, 12 nt, Mycobacterium avium subsp. paratuberculosis
gaccagcgcgcc

SEQ ID NO: 3023492 - RNA, 16 nt, Mycobacterium avium subsp. paratuberculosis
gaccagcgcgccgccc

SEQ ID NO: 3023493 - RNA, 17 nt, Mycobacterium avium subsp. paratuberculosis
gaccagcgcgccgccca

SEQ ID NO: 3023494 - RNA, 23 nt, Mycobacterium avium subsp. paratuberculosis
gaccagcgcgccgcccagcggcc

SEQ ID NO: 3023495 - RNA, 15 nt, Mycobacterium avium subsp. paratuberculosis
gaccagcgcgccggc

SEQ ID NO: 3023496 - RNA, 18 nt, Mycobacterium avium subsp. paratuberculosis
gaccagcgcgccggccag

SEQ ID NO: 3023497 - RNA, 20 nt, Mycobacterium avium subsp. paratuberculosis
gaccagcgcgccggccagca

SEQ ID NO: 3023498 - RNA, 23 nt, Mycobacterium avium subsp. paratuberculosis
gaccagcgcgccggccagcagca

SEQ ID NO: 3023499 - RNA, 14 nt, Mycobacterium avium subsp. paratuberculosis
gaccagcgcggugc

SEQ ID NO: 3023500 - RNA, 14 nt, Mycobacterium avium subsp. paratuberculosis
gaccagcggcagca

SEQ ID NO: 3023501 - RNA, 15 nt, Mycobacterium avium subsp. paratuberculosis
gaccagcggcagcac

SEQ ID NO: 3023502 - RNA, 17 nt, Mycobacterium avium subsp. paratuberculosis
gaccagcggcagcacgu

SEQ ID NO: 3023503 - RNA, 16 nt, Mycobacterium avium subsp. paratuberculosis
gaccagcggcagcagc

SEQ ID NO: 3023504 - RNA, 20 nt, Mycobacterium avium subsp. paratuberculosis
gaccagcggcagcagcacca

SEQ ID NO: 3023505 - RNA, 18 nt, Mycobacterium avium subsp. paratuberculosis
gaccagcggcccaccgcg

SEQ ID NO: 3023506 - RNA, 15 nt, Mycobacterium avium subsp. paratuberculosis
gaccagcggcgcgcc

SEQ ID NO: 3023507 - RNA, 18 nt, Mycobacterium avium subsp. paratuberculosis
gaccagcggcgcgccggg

SEQ ID NO: 3023508 - RNA, 19 nt, Mycobacterium avium subsp. paratuberculosis
gaccagcggcgcgccgggc

SEQ ID NO: 3023509 - RNA, 21 nt, Mycobacterium avium subsp. paratuberculosis
gaccagcggcgcgccgggcag

SEQ ID NO: 3023510 - RNA, 22 nt, Mycobacterium avium subsp. paratuberculosis
gaccagcggcgcgccgggcagc

SEQ ID NO: 3023511 - RNA, 21 nt, Mycobacterium avium subsp. paratuberculosis
gaccagcgggaugaaggcacc

SEQ ID NO: 3023512 - RNA, 19 nt, Mycobacterium avium subsp. paratuberculosis
gaccagcgggccgacagca

SEQ ID NO: 3023513 - RNA, 21 nt, Mycobacterium avium subsp. paratuberculosis
gaccagcgggccgacagcacg

SEQ ID NO: 3023514 - RNA, 17 nt, Mycobacterium avium subsp. paratuberculosis
gaccagcgggcugucgg

SEQ ID NO: 3023515 - RNA, 22 nt, Mycobacterium avium subsp. paratuberculosis
gaccagcgguuuggauggcccg

SEQ ID NO: 3023516 - RNA, 12 nt, Mycobacterium avium subsp. paratuberculosis
gaccagcgugac

SEQ ID NO: 3023517 - RNA, 17 nt, Mycobacterium avium subsp. paratuberculosis
gaccagcgugacgcuga

SEQ ID NO: 3023518 - RNA, 17 nt, Mycobacterium avium subsp. paratuberculosis
gaccagcgugucgccgg

SEQ ID NO: 3023519 - RNA, 19 nt, Mycobacterium avium subsp. paratuberculosis
gaccagcgugucgccgggg

SEQ ID NO: 3023520 - RNA, 21 nt, Mycobacterium avium subsp. paratuberculosis
gaccagcgugucgccggggcg

SEQ ID NO: 3023521 - RNA, 14 nt, Mycobacterium avium subsp. paratuberculosis
gaccagcuccugga

SEQ ID NO: 3023522 - RNA, 18 nt, Mycobacterium avium subsp. paratuberculosis
gaccaggaacacggcucg

SEQ ID NO: 3023523 - RNA, 20 nt, Mycobacterium avium subsp. paratuberculosis
gaccaggaacacggcucggg

SEQ ID NO: 3023524 - RNA, 17 nt, Mycobacterium avium subsp. paratuberculosis
gaccaggaagaugccga

SEQ ID NO: 3023525 - RNA, 21 nt, Mycobacterium avium subsp. paratuberculosis
gaccaggaaguacaccaccgc

SEQ ID NO: 3023526 - RNA, 19 nt, Mycobacterium avium subsp. paratuberculosis
gaccaggacgucggccggc

SEQ ID NO: 3023527 - RNA, 20 nt, Mycobacterium avium subsp. paratuberculosis
gaccaggaugucuccgcgca

SEQ ID NO: 3023528 - RNA, 22 nt, Mycobacterium avium subsp. paratuberculosis
gaccaggaugucuccgcgcagc

SEQ ID NO: 3023529 - RNA, 23 nt, Mycobacterium avium subsp. paratuberculosis
gaccaggaugucuccgcgcagcc

SEQ ID NO: 3023530 - RNA, 16 nt, Mycobacterium avium subsp. paratuberculosis
gaccaggcccagcgga

SEQ ID NO: 3023531 - RNA, 16 nt, Mycobacterium avium subsp. paratuberculosis
gaccaggccguccacc

SEQ ID NO: 3023532 - RNA, 19 nt, Mycobacterium avium subsp. paratuberculosis
gaccaggccguccaccaga

SEQ ID NO: 3023533 - RNA, 23 nt, Mycobacterium avium subsp. paratuberculosis
gaccaggcuugccccguacgggu

SEQ ID NO: 3023534 - RNA, 16 nt, Mycobacterium avium subsp. paratuberculosis
gaccaggcuuggcccg

SEQ ID NO: 3023535 - RNA, 18 nt, Mycobacterium avium subsp. paratuberculosis
gaccaggcuuggcccgcc

SEQ ID NO: 3023536 - RNA, 19 nt, Mycobacterium avium subsp. paratuberculosis
gaccaggcuuggcccgccg

SEQ ID NO: 3023537 - RNA, 22 nt, Mycobacterium avium subsp. paratuberculosis
gaccaggcuuggcccgccgccg

SEQ ID NO: 3023538 - RNA, 13 nt, Mycobacterium avium subsp. paratuberculosis
gaccagggccucg

SEQ ID NO: 3023539 - RNA, 19 nt, Mycobacterium avium subsp. paratuberculosis
gaccagggccucgucgucg

SEQ ID NO: 3023540 - RNA, 17 nt, Mycobacterium avium subsp. paratuberculosis
gaccagggcgaucaccg

SEQ ID NO: 3023541 - RNA, 19 nt, Mycobacterium avium subsp. paratuberculosis
gaccagggcgaucaccgcg

SEQ ID NO: 3023542 - RNA, 20 nt, Mycobacterium avium subsp. paratuberculosis
gaccagggcgaucaccgcgg

SEQ ID NO: 3023543 - RNA, 12 nt, Mycobacterium avium subsp. paratuberculosis
gaccccacagcg

SEQ ID NO: 3023544 - RNA, 14 nt, Mycobacterium avium subsp. paratuberculosis
gaccccacagcgcg

SEQ ID NO: 3023545 - RNA, 19 nt, Mycobacterium avium subsp. paratuberculosis
gaccccacagcgcgcccca

SEQ ID NO: 3023546 - RNA, 15 nt, Mycobacterium avium subsp. paratuberculosis
gaccccagcgugacg

SEQ ID NO: 3023547 - RNA, 15 nt, Mycobacterium avium subsp. paratuberculosis
gaccccagugcaggc

SEQ ID NO: 3023548 - RNA, 16 nt, Mycobacterium avium subsp. paratuberculosis
gaccccagugcaggcu

SEQ ID NO: 3023549 - RNA, 12 nt, Mycobacterium avium subsp. paratuberculosis
gacccccaccac

SEQ ID NO: 3023550 - RNA, 14 nt, Mycobacterium avium subsp. paratuberculosis
gacccccaccgcga

SEQ ID NO: 3023551 - RNA, 16 nt, Mycobacterium avium subsp. paratuberculosis
gacccccaccgcgaca

SEQ ID NO: 3023552 - RNA, 17 nt, Mycobacterium avium subsp. paratuberculosis
gaccccccgacgccgac

SEQ ID NO: 3023553 - RNA, 14 nt, Mycobacterium avium subsp. paratuberculosis
gacccccgccgcgu

SEQ ID NO: 3023554 - RNA, 14 nt, Mycobacterium avium subsp. paratuberculosis
gacccccucggggc

SEQ ID NO: 3023555 - RNA, 19 nt, Mycobacterium avium subsp. paratuberculosis
gacccccucggggcucacc

SEQ ID NO: 3023556 - RNA, 16 nt, Mycobacterium avium subsp. paratuberculosis
gaccccgacggcgccg

SEQ ID NO: 3023557 - RNA, 20 nt, Mycobacterium avium subsp. paratuberculosis
gaccccgaugcgcucgccga

SEQ ID NO: 3023558 - RNA, 13 nt, Mycobacterium avium subsp. paratuberculosis
gaccccgccagca

SEQ ID NO: 3023559 - RNA, 16 nt, Mycobacterium avium subsp. paratuberculosis
gaccccgccagcaccg

SEQ ID NO: 3023560 - RNA, 20 nt, Mycobacterium avium subsp. paratuberculosis
gaccccgcccagcgacucgg

SEQ ID NO: 3023561 - RNA, 23 nt, Mycobacterium avium subsp. paratuberculosis
gaccccgcccagcgacucggcca

SEQ ID NO: 3023562 - RNA, 13 nt, Mycobacterium avium subsp. paratuberculosis
gaccccgccggcc

SEQ ID NO: 3023563 - RNA, 14 nt, Mycobacterium avium subsp. paratuberculosis
gaccccgccggccc

SEQ ID NO: 3023564 - RNA, 15 nt, Mycobacterium avium subsp. paratuberculosis
gaccccgccggcccg

SEQ ID NO: 3023565 - RNA, 17 nt, Mycobacterium avium subsp. paratuberculosis
gaccccgccgucgacgc

SEQ ID NO: 3023566 - RNA, 15 nt, Mycobacterium avium subsp. paratuberculosis
gaccccgcucggcgu

SEQ ID NO: 3023567 - RNA, 19 nt, Mycobacterium avium subsp. paratuberculosis
gaccccgcucggcguggcg

SEQ ID NO: 3023568 - RNA, 20 nt, Mycobacterium avium subsp. paratuberculosis
gaccccgcucggcguggcgc

SEQ ID NO: 3023569 - RNA, 14 nt, Mycobacterium avium subsp. paratuberculosis
gaccccggccagga

SEQ ID NO: 3023570 - RNA, 17 nt, Mycobacterium avium subsp. paratuberculosis
gaccccggccccggccg

SEQ ID NO: 3023571 - RNA, 18 nt, Mycobacterium avium subsp. paratuberculosis
gaccccggccccggccgg

SEQ ID NO: 3023572 - RNA, 17 nt, Mycobacterium avium subsp. paratuberculosis
gaccccggcgaccagca

SEQ ID NO: 3023573 - RNA, 16 nt, Mycobacterium avium subsp. paratuberculosis
gaccccggcugcugca

SEQ ID NO: 3023574 - RNA, 20 nt, Mycobacterium avium subsp. paratuberculosis
gaccccguucgccgacagca

SEQ ID NO: 3023575 - RNA, 23 nt, Mycobacterium avium subsp. paratuberculosis
gaccccguucgccgacagcagcu

SEQ ID NO: 3023576 - RNA, 13 nt, Mycobacterium avium subsp. paratuberculosis
gaccccuacgggc

SEQ ID NO: 3023577 - RNA, 19 nt, Mycobacterium avium subsp. paratuberculosis
gaccccuccaacggccgca

SEQ ID NO: 3023578 - RNA, 21 nt, Mycobacterium avium subsp. paratuberculosis
gaccccuccaacggccgcacg

SEQ ID NO: 3023579 - RNA, 22 nt, Mycobacterium avium subsp. paratuberculosis
gaccccuccaacggccgcacgu

SEQ ID NO: 3023580 - RNA, 22 nt, Mycobacterium avium subsp. paratuberculosis
gaccccucggcauaacgcaacc

SEQ ID NO: 3023581 - RNA, 14 nt, Mycobacterium avium subsp. paratuberculosis
gaccccucggcggc

SEQ ID NO: 3023582 - RNA, 15 nt, Mycobacterium avium subsp. paratuberculosis
gacccgaaacuggga

SEQ ID NO: 3023583 - RNA, 16 nt, Mycobacterium avium subsp. paratuberculosis
gacccgaaccggauca

SEQ ID NO: 3023584 - RNA, 19 nt, Mycobacterium avium subsp. paratuberculosis
gacccgaacuucagcgcgu

SEQ ID NO: 3023585 - RNA, 13 nt, Mycobacterium avium subsp. paratuberculosis
gacccgaagccca

SEQ ID NO: 3023586 - RNA, 16 nt, Mycobacterium avium subsp. paratuberculosis
gacccgaagucgacgc

SEQ ID NO: 3023587 - RNA, 22 nt, Mycobacterium avium subsp. paratuberculosis
gacccgaagucgacgcaccacg

SEQ ID NO: 3023588 - RNA, 20 nt, Mycobacterium avium subsp. paratuberculosis
gacccgacgggaacucggcc

SEQ ID NO: 3023589 - RNA, 21 nt, Mycobacterium avium subsp. paratuberculosis
gacccgacgggaacucggcca

SEQ ID NO: 3023590 - RNA, 22 nt, Mycobacterium avium subsp. paratuberculosis
gacccgacggucgggcccaggu

SEQ ID NO: 3023591 - RNA, 20 nt, Mycobacterium avium subsp. paratuberculosis
gacccgauccagggcccgcu

SEQ ID NO: 3023592 - RNA, 13 nt, Mycobacterium avium subsp. paratuberculosis
gacccgcaacucg

SEQ ID NO: 3023593 - RNA, 23 nt, Mycobacterium avium subsp. paratuberculosis
gacccgcaacucgggcucgucgu

SEQ ID NO: 3023594 - RNA, 21 nt, Mycobacterium avium subsp. paratuberculosis
gacccgcaaggccgccagccg

SEQ ID NO: 3023595 - RNA, 14 nt, Mycobacterium avium subsp. paratuberculosis
gacccgcaccaccg

SEQ ID NO: 3023596 - RNA, 16 nt, Mycobacterium avium subsp. paratuberculosis
gacccgcaccaccgcc

SEQ ID NO: 3023597 - RNA, 17 nt, Mycobacterium avium subsp. paratuberculosis
gacccgcaccaccgccc

SEQ ID NO: 3023598 - RNA, 18 nt, Mycobacterium avium subsp. paratuberculosis
gacccgcaccaccgcccg

SEQ ID NO: 3023599 - RNA, 20 nt, Mycobacterium avium subsp. paratuberculosis
gacccgcaccaccgcccgga

SEQ ID NO: 3023600 - RNA, 23 nt, Mycobacterium avium subsp. paratuberculosis
gacccgcaccaccgcccggaccg

SEQ ID NO: 3023601 - RNA, 12 nt, Mycobacterium avium subsp. paratuberculosis
gacccgcaccga

SEQ ID NO: 3023602 - RNA, 23 nt, Mycobacterium avium subsp. paratuberculosis
gacccgcacgaaaugcgggcgau

SEQ ID NO: 3023603 - RNA, 18 nt, Mycobacterium avium subsp. paratuberculosis
gacccgcacgaugccgcg

SEQ ID NO: 3023604 - RNA, 16 nt, Mycobacterium avium subsp. paratuberculosis
gacccgcccgccgggc

SEQ ID NO: 3023605 - RNA, 17 nt, Mycobacterium avium subsp. paratuberculosis
gacccgcccgccgggca

SEQ ID NO: 3023606 - RNA, 16 nt, Mycobacterium avium subsp. paratuberculosis
gacccgccgcaacagc

SEQ ID NO: 3023607 - RNA, 18 nt, Mycobacterium avium subsp. paratuberculosis
gacccgccgcaacagccg

SEQ ID NO: 3023608 - RNA, 23 nt, Mycobacterium avium subsp. paratuberculosis
gacccgccgcaacagccggcccg

SEQ ID NO: 3023609 - RNA, 14 nt, Mycobacterium avium subsp. paratuberculosis
gacccgccgcagcc

SEQ ID NO: 3023610 - RNA, 16 nt, Mycobacterium avium subsp. paratuberculosis
gacccgccgcagcccg

SEQ ID NO: 3023611 - RNA, 19 nt, Mycobacterium avium subsp. paratuberculosis
gacccgccgugaccggcga

SEQ ID NO: 3023612 - RNA, 15 nt, Mycobacterium avium subsp. paratuberculosis
gacccgccuggccac

SEQ ID NO: 3023613 - RNA, 12 nt, Mycobacterium avium subsp. paratuberculosis
gacccgcgaccc

SEQ ID NO: 3023614 - RNA, 20 nt, Mycobacterium avium subsp. paratuberculosis
gacccgcggcgccgcggcgg

SEQ ID NO: 3023615 - RNA, 23 nt, Mycobacterium avium subsp. paratuberculosis
gacccgcggcgccgcggcggcac

SEQ ID NO: 3023616 - RNA, 20 nt, Mycobacterium avium subsp. paratuberculosis
gacccgcgucaucgggcccg

SEQ ID NO: 3023617 - RNA, 21 nt, Mycobacterium avium subsp. paratuberculosis
gacccgcgucaucgggcccga

SEQ ID NO: 3023618 - RNA, 17 nt, Mycobacterium avium subsp. paratuberculosis
gacccgcuccagcggcc

SEQ ID NO: 3023619 - RNA, 17 nt, Mycobacterium avium subsp. paratuberculosis
gacccgcuccccgaucc

SEQ ID NO: 3023620 - RNA, 21 nt, Mycobacterium avium subsp. paratuberculosis
gacccgcuccccgauccggcu

SEQ ID NO: 3023621 - RNA, 22 nt, Mycobacterium avium subsp. paratuberculosis
gacccgcucccgggacagcccg

SEQ ID NO: 3023622 - RNA, 18 nt, Mycobacterium avium subsp. paratuberculosis
gacccgcuccgacgcggu

SEQ ID NO: 3023623 - RNA, 20 nt, Mycobacterium avium subsp. paratuberculosis
gacccgcucgacgcgcaccc

SEQ ID NO: 3023624 - RNA, 13 nt, Mycobacterium avium subsp. paratuberculosis
gacccgcucgggc

SEQ ID NO: 3023625 - RNA, 14 nt, Mycobacterium avium subsp. paratuberculosis
gacccgcucgggcg

SEQ ID NO: 3023626 - RNA, 22 nt, Mycobacterium avium subsp. paratuberculosis
gacccgcuggaacagcgggccg

SEQ ID NO: 3023627 - RNA, 17 nt, Mycobacterium avium subsp. paratuberculosis
gacccgcuucgcccggc

SEQ ID NO: 3023628 - RNA, 21 nt, Mycobacterium avium subsp. paratuberculosis
gaccgaggcgaucgcggccac

SEQ ID NO: 3023629 - RNA, 22 nt, Mycobacterium avium subsp. paratuberculosis
gaccgaggcgaucgcggccacc

SEQ ID NO: 3023630 - RNA, 15 nt, Mycobacterium avium subsp. paratuberculosis
gaccgagggcgcggg

SEQ ID NO: 3023631 - RNA, 15 nt, Mycobacterium avium subsp. paratuberculosis
gaccgaggugccgcg

SEQ ID NO: 3023632 - RNA, 16 nt, Mycobacterium avium subsp. paratuberculosis
gaccgauccgccggcg

SEQ ID NO: 3023633 - RNA, 19 nt, Mycobacterium avium subsp. paratuberculosis
gaccgauccgccggcgaag

SEQ ID NO: 3023634 - RNA, 21 nt, Mycobacterium avium subsp. paratuberculosis
gaccgauccgccggcgaagcu

SEQ ID NO: 3023635 - RNA, 15 nt, Mycobacterium avium subsp. paratuberculosis
gaccgauccggcgcc

SEQ ID NO: 3023636 - RNA, 17 nt, Mycobacterium avium subsp. paratuberculosis
gaccgaucuggcgaucg

SEQ ID NO: 3023637 - RNA, 18 nt, Mycobacterium avium subsp. paratuberculosis
gaccgaucuggcgaucga

SEQ ID NO: 3023638 - RNA, 14 nt, Mycobacterium avium subsp. paratuberculosis
gaccgauggccgcc

SEQ ID NO: 3023639 - RNA, 15 nt, Mycobacterium avium subsp. paratuberculosis
gaccgauggccgccc

SEQ ID NO: 3023640 - RNA, 14 nt, Mycobacterium avium subsp. paratuberculosis
gaccgauggcggcg

SEQ ID NO: 3023641 - RNA, 19 nt, Mycobacterium avium subsp. paratuberculosis
gaccgcaagugcggucagc

SEQ ID NO: 3023642 - RNA, 21 nt, Mycobacterium avium subsp. paratuberculosis
gaccgcaagugcggucagcuc

SEQ ID NO: 3023643 - RNA, 17 nt, Mycobacterium avium subsp. paratuberculosis
gaccgcacaauccgguc

SEQ ID NO: 3023644 - RNA, 23 nt, Mycobacterium avium subsp. paratuberculosis
gaccgcacaugccgaggcacagc

SEQ ID NO: 3023645 - RNA, 19 nt, Mycobacterium avium subsp. paratuberculosis
gaccgcacccccagcucga

SEQ ID NO: 3023646 - RNA, 22 nt, Mycobacterium avium subsp. paratuberculosis
gaccgcacccccagcucgacga

SEQ ID NO: 3023647 - RNA, 16 nt, Mycobacterium avium subsp. paratuberculosis
gaccgcaccgaccagc

SEQ ID NO: 3023648 - RNA, 14 nt, Mycobacterium avium subsp. paratuberculosis
gaccgcacgccggg

SEQ ID NO: 3023649 - RNA, 13 nt, Mycobacterium avium subsp. paratuberculosis
gaccgcagcaggc

SEQ ID NO: 3023650 - RNA, 14 nt, Mycobacterium avium subsp. paratuberculosis
gaccgcagcaggcg

SEQ ID NO: 3023651 - RNA, 21 nt, Mycobacterium avium subsp. paratuberculosis
gaccgcagcaggcggacggcg

SEQ ID NO: 3023652 - RNA, 23 nt, Mycobacterium avium subsp. paratuberculosis
gaccgcagcaggcggacggcgac

SEQ ID NO: 3023653 - RNA, 13 nt, Mycobacterium avium subsp. paratuberculosis
gaccgcagccuuc

SEQ ID NO: 3023654 - RNA, 12 nt, Mycobacterium avium subsp. paratuberculosis
gaccgcaggaaa

SEQ ID NO: 3023655 - RNA, 22 nt, Mycobacterium avium subsp. paratuberculosis
gaccgcaggucgauggcguagc

SEQ ID NO: 3023656 - RNA, 13 nt, Mycobacterium avium subsp. paratuberculosis
gaccgccaccacc

SEQ ID NO: 3023657 - RNA, 20 nt, Mycobacterium avium subsp. paratuberculosis
gaccgccaccacccggcgau

SEQ ID NO: 3023658 - RNA, 20 nt, Mycobacterium avium subsp. paratuberculosis
gaccgccaccagaucguguc

SEQ ID NO: 3023659 - RNA, 15 nt, Mycobacterium avium subsp. paratuberculosis
gaccgccaccucgag

SEQ ID NO: 3023660 - RNA, 20 nt, Mycobacterium avium subsp. paratuberculosis
gaccgccagacugaugcccu

SEQ ID NO: 3023661 - RNA, 21 nt, Mycobacterium avium subsp. paratuberculosis
gaccgccagacugaugcccuc

SEQ ID NO: 3023662 - RNA, 13 nt, Mycobacterium avium subsp. paratuberculosis
gaccgccagcacc

SEQ ID NO: 3023663 - RNA, 14 nt, Mycobacterium avium subsp. paratuberculosis
gaccgccagcaccg

SEQ ID NO: 3023664 - RNA, 17 nt, Mycobacterium avium subsp. paratuberculosis
gaccgccagcaccgcgg

SEQ ID NO: 3023665 - RNA, 12 nt, Mycobacterium avium subsp. paratuberculosis
gaccgccagcag

SEQ ID NO: 3023666 - RNA, 16 nt, Mycobacterium avium subsp. paratuberculosis
gaccgccagcagcagc

SEQ ID NO: 3023667 - RNA, 17 nt, Mycobacterium avium subsp. paratuberculosis
gaccgccagcagcagcc

SEQ ID NO: 3023668 - RNA, 19 nt, Mycobacterium avium subsp. paratuberculosis
gaccgccagcagcagccgc

SEQ ID NO: 3023669 - RNA, 21 nt, Mycobacterium avium subsp. paratuberculosis
gaccgccagcagcagccgcgc

SEQ ID NO: 3023670 - RNA, 23 nt, Mycobacterium avium subsp. paratuberculosis
gaccgccagcagcagccgcgccg

SEQ ID NO: 3023671 - RNA, 16 nt, Mycobacterium avium subsp. paratuberculosis
gaccgcccaggacccg

SEQ ID NO: 3023672 - RNA, 13 nt, Mycobacterium avium subsp. paratuberculosis
gaccgcccgcucg

SEQ ID NO: 3023673 - RNA, 22 nt, Mycobacterium avium subsp. paratuberculosis
gaccgcccgcucgacggccggu

SEQ ID NO: 3023674 - RNA, 18 nt, Mycobacterium avium subsp. paratuberculosis
gaccgcccggggcgcgga

SEQ ID NO: 3023675 - RNA, 13 nt, Mycobacterium avium subsp. paratuberculosis
gaccgcccgggug

SEQ ID NO: 3023676 - RNA, 12 nt, Mycobacterium avium subsp. paratuberculosis
gaccgccgacac

SEQ ID NO: 3023677 - RNA, 17 nt, Mycobacterium avium subsp. paratuberculosis
gaccgccgacaccaccg

SEQ ID NO: 3023678 - RNA, 13 nt, Mycobacterium avium subsp. paratuberculosis
gaccgccgagcgg

SEQ ID NO: 3023679 - RNA, 20 nt, Mycobacterium avium subsp. paratuberculosis
gaccgccgagcgggcgaucu

SEQ ID NO: 3023680 - RNA, 14 nt, Mycobacterium avium subsp. paratuberculosis
gaccgccgccaucc

SEQ ID NO: 3023681 - RNA, 18 nt, Mycobacterium avium subsp. paratuberculosis
gaccgccgccauccgcgc

SEQ ID NO: 3023682 - RNA, 20 nt, Mycobacterium avium subsp. paratuberculosis
gaccgccgccauccgcgccg

SEQ ID NO: 3023683 - RNA, 22 nt, Mycobacterium avium subsp. paratuberculosis
gaccgccgccauccgcgccgaa

SEQ ID NO: 3023684 - RNA, 14 nt, Mycobacterium avium subsp. paratuberculosis
gaccgccgccgcga

SEQ ID NO: 3023685 - RNA, 18 nt, Mycobacterium avium subsp. paratuberculosis
gaccgccgcgcucggcca

SEQ ID NO: 3023686 - RNA, 14 nt, Mycobacterium avium subsp. paratuberculosis
gaccgccgcggccg

SEQ ID NO: 3023687 - RNA, 16 nt, Mycobacterium avium subsp. paratuberculosis
gaccgccgcggccgcc

SEQ ID NO: 3023688 - RNA, 13 nt, Mycobacterium avium subsp. paratuberculosis
gaccgccgcggcg

SEQ ID NO: 3023689 - RNA, 16 nt, Mycobacterium avium subsp. paratuberculosis
gaccgccgcggcgccc

SEQ ID NO: 3023690 - RNA, 18 nt, Mycobacterium avium subsp. paratuberculosis
gaccgccgcggcgcccgg

SEQ ID NO: 3023691 - RNA, 19 nt, Mycobacterium avium subsp. paratuberculosis
gaccgccgcggcgcccggc

SEQ ID NO: 3023692 - RNA, 15 nt, Mycobacterium avium subsp. paratuberculosis
gaccgccgcggcggc

SEQ ID NO: 3023693 - RNA, 20 nt, Mycobacterium avium subsp. paratuberculosis
gaccgccgcggcggccugcu

SEQ ID NO: 3023694 - RNA, 21 nt, Mycobacterium avium subsp. paratuberculosis
gaccgccgcguacagccagcc

SEQ ID NO: 3023695 - RNA, 22 nt, Mycobacterium avium subsp. paratuberculosis
gaccgccgcguacagccagccc

SEQ ID NO: 3023696 - RNA, 20 nt, Mycobacterium avium subsp. paratuberculosis
gaccgccgcucagcgauugc

SEQ ID NO: 3023697 - RNA, 12 nt, Mycobacterium avium subsp. paratuberculosis
gaccgccggaca

SEQ ID NO: 3023698 - RNA, 20 nt, Mycobacterium avium subsp. paratuberculosis
gaccgccggacaccaccgcg

SEQ ID NO: 3023699 - RNA, 21 nt, Mycobacterium avium subsp. paratuberculosis
gaccgccggacaccaccgcgg

SEQ ID NO: 3023700 - RNA, 16 nt, Mycobacterium avium subsp. paratuberculosis
gaccgccggugcgcag

SEQ ID NO: 3023701 - RNA, 17 nt, Mycobacterium avium subsp. paratuberculosis
gaccgccggugcgcagc

SEQ ID NO: 3023702 - RNA, 18 nt, Mycobacterium avium subsp. paratuberculosis
gaccgccggugcgcagcu

SEQ ID NO: 3023703 - RNA, 16 nt, Mycobacterium avium subsp. paratuberculosis
gaccgccucgauggcc

SEQ ID NO: 3023704 - RNA, 20 nt, Mycobacterium avium subsp. paratuberculosis
gaccgccucggauuccgcgg

SEQ ID NO: 3023705 - RNA, 23 nt, Mycobacterium avium subsp. paratuberculosis
gaccgccucgucgaaggucugca

SEQ ID NO: 3023706 - RNA, 14 nt, Mycobacterium avium subsp. paratuberculosis
gaccgccucgucgg

SEQ ID NO: 3023707 - RNA, 14 nt, Mycobacterium avium subsp. paratuberculosis
gaccgccugcggca

SEQ ID NO: 3023708 - RNA, 20 nt, Mycobacterium avium subsp. paratuberculosis
gaccgccugcuugagguuga

SEQ ID NO: 3023709 - RNA, 14 nt, Mycobacterium avium subsp. paratuberculosis
gaccgccugucagu

SEQ ID NO: 3023710 - RNA, 17 nt, Mycobacterium avium subsp. paratuberculosis
gaccgccuuggcgcgcu

SEQ ID NO: 3023711 - RNA, 20 nt, Mycobacterium avium subsp. paratuberculosis
gaccgccuuggcgcgcucgg

SEQ ID NO: 3023712 - RNA, 23 nt, Mycobacterium avium subsp. paratuberculosis
gaccgccuuggcgcgcucggugg

SEQ ID NO: 3023713 - RNA, 13 nt, Mycobacterium avium subsp. paratuberculosis
gaccggccagcag

SEQ ID NO: 3023714 - RNA, 16 nt, Mycobacterium avium subsp. paratuberculosis
gaccggccagcagccg

SEQ ID NO: 3023715 - RNA, 18 nt, Mycobacterium avium subsp. paratuberculosis
gaccggccagcagccgcu

SEQ ID NO: 3023716 - RNA, 15 nt, Mycobacterium avium subsp. paratuberculosis
gaccggcccggcggc

SEQ ID NO: 3023717 - RNA, 17 nt, Mycobacterium avium subsp. paratuberculosis
gaccggcccggcggccg

SEQ ID NO: 3023718 - RNA, 23 nt, Mycobacterium avium subsp. paratuberculosis
gaccggcccggcggccggccgcg

SEQ ID NO: 3023719 - RNA, 15 nt, Mycobacterium avium subsp. paratuberculosis
gaccggccggggcgg

SEQ ID NO: 3023720 - RNA, 19 nt, Mycobacterium avium subsp. paratuberculosis
gaccggccggggcgggcac

SEQ ID NO: 3023721 - RNA, 21 nt, Mycobacterium avium subsp. paratuberculosis
gaccggccugagacgacgcca

SEQ ID NO: 3023722 - RNA, 18 nt, Mycobacterium avium subsp. paratuberculosis
gaccggcgaucgucaggu

SEQ ID NO: 3023723 - RNA, 17 nt, Mycobacterium avium subsp. paratuberculosis
gaccggcgauuucggcc

SEQ ID NO: 3023724 - RNA, 18 nt, Mycobacterium avium subsp. paratuberculosis
gaccggcgauuucggccg

SEQ ID NO: 3023725 - RNA, 14 nt, Mycobacterium avium subsp. paratuberculosis
gaccggcgccggcc

SEQ ID NO: 3023726 - RNA, 17 nt, Mycobacterium avium subsp. paratuberculosis
gaccggcgccggccgcc

SEQ ID NO: 3023727 - RNA, 17 nt, Mycobacterium avium subsp. paratuberculosis
gaccggcgccgggucgc

SEQ ID NO: 3023728 - RNA, 13 nt, Mycobacterium avium subsp. paratuberculosis
gaccggcgcgcag

SEQ ID NO: 3023729 - RNA, 15 nt, Mycobacterium avium subsp. paratuberculosis
gaccggcgcgcagca

SEQ ID NO: 3023730 - RNA, 19 nt, Mycobacterium avium subsp. paratuberculosis
gaccggcgcgcagcaucuc

SEQ ID NO: 3023731 - RNA, 17 nt, Mycobacterium avium subsp. paratuberculosis
gaccggcgcgcccgagu

SEQ ID NO: 3023732 - RNA, 23 nt, Mycobacterium avium subsp. paratuberculosis
gaccggcggaaguagcccggagu

SEQ ID NO: 3023733 - RNA, 14 nt, Mycobacterium avium subsp. paratuberculosis
gaccggcggccagc

SEQ ID NO: 3023734 - RNA, 15 nt, Mycobacterium avium subsp. paratuberculosis
gaccggcggccagcg

SEQ ID NO: 3023735 - RNA, 14 nt, Mycobacterium avium subsp. paratuberculosis
gaccggcggccgcc

SEQ ID NO: 3023736 - RNA, 22 nt, Mycobacterium avium subsp. paratuberculosis
gaccggcggccgccaucauccg

SEQ ID NO: 3023737 - RNA, 15 nt, Mycobacterium avium subsp. paratuberculosis
gaccggcggcgaucg

SEQ ID NO: 3023738 - RNA, 14 nt, Mycobacterium avium subsp. paratuberculosis
gaccggcggugccg

SEQ ID NO: 3023739 - RNA, 15 nt, Mycobacterium avium subsp. paratuberculosis
gaccggcucagcccg

SEQ ID NO: 3023740 - RNA, 17 nt, Mycobacterium avium subsp. paratuberculosis
gaccggcucagcccggc

SEQ ID NO: 3023741 - RNA, 18 nt, Mycobacterium avium subsp. paratuberculosis
gaccggcucagcccggcg

SEQ ID NO: 3023742 - RNA, 19 nt, Mycobacterium avium subsp. paratuberculosis
gaccggcucagcccggcgc

SEQ ID NO: 3023743 - RNA, 22 nt, Mycobacterium avium subsp. paratuberculosis
gaccggcucagcccggcgcuca

SEQ ID NO: 3023744 - RNA, 13 nt, Mycobacterium avium subsp. paratuberculosis
gaccggcucgagc

SEQ ID NO: 3023745 - RNA, 13 nt, Mycobacterium avium subsp. paratuberculosis
gaccggcucgccg

SEQ ID NO: 3023746 - RNA, 19 nt, Mycobacterium avium subsp. paratuberculosis
gaccggcucgccggcgcgc

SEQ ID NO: 3023747 - RNA, 16 nt, Mycobacterium avium subsp. paratuberculosis
gaccggcucucagccg

SEQ ID NO: 3023748 - RNA, 19 nt, Mycobacterium avium subsp. paratuberculosis
gaccggcucucagccggaa

SEQ ID NO: 3023749 - RNA, 14 nt, Mycobacterium avium subsp. paratuberculosis
gaccggcugcucgc

SEQ ID NO: 3023750 - RNA, 19 nt, Mycobacterium avium subsp. paratuberculosis
gaccgggaaguagggcagc

SEQ ID NO: 3023751 - RNA, 22 nt, Mycobacterium avium subsp. paratuberculosis
gaccgggaaguagggcagcccg

SEQ ID NO: 3023752 - RNA, 14 nt, Mycobacterium avium subsp. paratuberculosis
gaccgggacgacgg

SEQ ID NO: 3023753 - RNA, 22 nt, Mycobacterium avium subsp. paratuberculosis
gaccgggacgacggcgccgccc

SEQ ID NO: 3023754 - RNA, 21 nt, Mycobacterium avium subsp. paratuberculosis
gaccgggaucguguggccgcc

SEQ ID NO: 3023755 - RNA, 14 nt, Mycobacterium avium subsp. paratuberculosis
gaccgggcccggcg

SEQ ID NO: 3023756 - RNA, 17 nt, Mycobacterium avium subsp. paratuberculosis
gaccgggcccggcgcca

SEQ ID NO: 3023757 - RNA, 18 nt, Mycobacterium avium subsp. paratuberculosis
gaccgggccgcuggugag

SEQ ID NO: 3023758 - RNA, 12 nt, Mycobacterium avium subsp. paratuberculosis
gaccgggcgcuc

SEQ ID NO: 3023759 - RNA, 15 nt, Mycobacterium avium subsp. paratuberculosis
gaccgggcuccagcg

SEQ ID NO: 3023760 - RNA, 16 nt, Mycobacterium avium subsp. paratuberculosis
gaccgggcuccagcgg

SEQ ID NO: 3023761 - RNA, 18 nt, Mycobacterium avium subsp. paratuberculosis
gaccggggcgccccgcug

SEQ ID NO: 3023762 - RNA, 14 nt, Mycobacterium avium subsp. paratuberculosis
gaccggggcgguga

SEQ ID NO: 3023763 - RNA, 16 nt, Mycobacterium avium subsp. paratuberculosis
gaccggggucggcgcc

SEQ ID NO: 3023764 - RNA, 21 nt, Mycobacterium avium subsp. paratuberculosis
gaccggggucggcgcccucgg

SEQ ID NO: 3023765 - RNA, 16 nt, Mycobacterium avium subsp. paratuberculosis
gaccgggucugccacg

SEQ ID NO: 3023766 - RNA, 24 nt, Mycobacterium avium subsp. paratuberculosis
gaccgggugaacgaggccgcgccg

SEQ ID NO: 3023767 - RNA, 16 nt, Mycobacterium avium subsp. paratuberculosis
gaccgggugaccggcg

SEQ ID NO: 3023768 - RNA, 18 nt, Mycobacterium avium subsp. paratuberculosis
gaccgggugaccggcgcg

SEQ ID NO: 3023769 - RNA, 19 nt, Mycobacterium avium subsp. paratuberculosis
gaccgggugaccggcgcgc

SEQ ID NO: 3023770 - RNA, 20 nt, Mycobacterium avium subsp. paratuberculosis
gaccgggugaccggcgcgca

SEQ ID NO: 3023771 - RNA, 16 nt, Mycobacterium avium subsp. paratuberculosis
gaccggguuggcgcgc

SEQ ID NO: 3023772 - RNA, 15 nt, Mycobacterium avium subsp. paratuberculosis
gaccgguaggcgcac

SEQ ID NO: 3023773 - RNA, 18 nt, Mycobacterium avium subsp. paratuberculosis
gaccgguaggcgcaccgc

SEQ ID NO: 3023774 - RNA, 19 nt, Mycobacterium avium subsp. paratuberculosis
gaccgguaggcgcaccgcc

SEQ ID NO: 3023775 - RNA, 12 nt, Mycobacterium avium subsp. paratuberculosis
gaccgguccgcc

SEQ ID NO: 3023776 - RNA, 13 nt, Mycobacterium avium subsp. paratuberculosis
gaccgguccgcgg

SEQ ID NO: 3023777 - RNA, 14 nt, Mycobacterium avium subsp. paratuberculosis
gaccgguccgcggu

SEQ ID NO: 3023778 - RNA, 16 nt, Mycobacterium avium subsp. paratuberculosis
gaccgguccuccccgc

SEQ ID NO: 3023779 - RNA, 15 nt, Mycobacterium avium subsp. paratuberculosis
gaccggucucgaccg

SEQ ID NO: 3023780 - RNA, 20 nt, Mycobacterium avium subsp. paratuberculosis
gaccggucucgaccgcggcg

SEQ ID NO: 3023781 - RNA, 20 nt, Mycobacterium avium subsp. paratuberculosis
gaccggugagcaccgggaac

SEQ ID NO: 3023782 - RNA, 12 nt, Mycobacterium avium subsp. paratuberculosis
gaccggugcgcc

SEQ ID NO: 3023783 - RNA, 15 nt, Mycobacterium avium subsp. paratuberculosis
gaccggugcgcccgc

SEQ ID NO: 3023784 - RNA, 17 nt, Mycobacterium avium subsp. paratuberculosis
gaccggugcgcccgcga

SEQ ID NO: 3023785 - RNA, 17 nt, Mycobacterium avium subsp. paratuberculosis
gaccggugcgcgcacca

SEQ ID NO: 3023786 - RNA, 22 nt, Mycobacterium avium subsp. paratuberculosis
gaccggugcgcgcaccaggccg

SEQ ID NO: 3023787 - RNA, 16 nt, Mycobacterium avium subsp. paratuberculosis
gaccggugcggucccg

SEQ ID NO: 3023788 - RNA, 20 nt, Mycobacterium avium subsp. paratuberculosis
gaccggugcggucccggucg

SEQ ID NO: 3023789 - RNA, 21 nt, Mycobacterium avium subsp. paratuberculosis
gaccgguugcccggaagccgc

SEQ ID NO: 3023790 - RNA, 20 nt, Mycobacterium avium subsp. paratuberculosis
gaccgguugcggcgaacgcg

SEQ ID NO: 3023791 - RNA, 23 nt, Mycobacterium avium subsp. paratuberculosis
gaccgguuuuccgucuucgaccg

SEQ ID NO: 3023792 - RNA, 17 nt, Mycobacterium avium subsp. paratuberculosis
gaccguacucgugggcc

SEQ ID NO: 3023793 - RNA, 18 nt, Mycobacterium avium subsp. paratuberculosis
gaccguacucgugggcca

SEQ ID NO: 3023794 - RNA, 21 nt, Mycobacterium avium subsp. paratuberculosis
gaccguacucgugggccacca

SEQ ID NO: 3023795 - RNA, 18 nt, Mycobacterium avium subsp. paratuberculosis
gaccguagccggucggcc

SEQ ID NO: 3023796 - RNA, 14 nt, Mycobacterium avium subsp. paratuberculosis
gaccgucaccgugg

SEQ ID NO: 3023797 - RNA, 16 nt, Mycobacterium avium subsp. paratuberculosis
gaccgucacgcuggcg

SEQ ID NO: 3023798 - RNA, 14 nt, Mycobacterium avium subsp. paratuberculosis
gacgaacgcggcga

SEQ ID NO: 3023799 - RNA, 15 nt, Mycobacterium avium subsp. paratuberculosis
gacgaacgcggcgga

SEQ ID NO: 3023800 - RNA, 12 nt, Mycobacterium avium subsp. paratuberculosis
gacgaacgcggu

SEQ ID NO: 3023801 - RNA, 13 nt, Mycobacterium avium subsp. paratuberculosis
gacgaacgcggug

SEQ ID NO: 3023802 - RNA, 16 nt, Mycobacterium avium subsp. paratuberculosis
gacgaacgcggugagc

SEQ ID NO: 3023803 - RNA, 17 nt, Mycobacterium avium subsp. paratuberculosis
gacgaacgcggugagcg

SEQ ID NO: 3023804 - RNA, 16 nt, Mycobacterium avium subsp. paratuberculosis
gacgaacggguaggug

SEQ ID NO: 3023805 - RNA, 20 nt, Mycobacterium avium subsp. paratuberculosis
gacgaacuccgcgcgcggca

SEQ ID NO: 3023806 - RNA, 23 nt, Mycobacterium avium subsp. paratuberculosis
gacgaacuccugcucgcgggcca

SEQ ID NO: 3023807 - RNA, 16 nt, Mycobacterium avium subsp. paratuberculosis
gacgaagaaggacgcc

SEQ ID NO: 3023808 - RNA, 13 nt, Mycobacterium avium subsp. paratuberculosis
gacgaagaccggg

SEQ ID NO: 3023809 - RNA, 12 nt, Mycobacterium avium subsp. paratuberculosis
gacgaagcagcu

SEQ ID NO: 3023810 - RNA, 15 nt, Mycobacterium avium subsp. paratuberculosis
gacgaagcagcucgc

SEQ ID NO: 3023811 - RNA, 20 nt, Mycobacterium avium subsp. paratuberculosis
gacgaagcagcucgcguagc

SEQ ID NO: 3023812 - RNA, 14 nt, Mycobacterium avium subsp. paratuberculosis
gacgaagccgccgc

SEQ ID NO: 3023813 - RNA, 16 nt, Mycobacterium avium subsp. paratuberculosis
gacgaagcggccgggg

SEQ ID NO: 3023814 - RNA, 21 nt, Mycobacterium avium subsp. paratuberculosis
gacgaagucggucagcgucgc

SEQ ID NO: 3023815 - RNA, 23 nt, Mycobacterium avium subsp. paratuberculosis
gacgaagucggucagcgucgccg

SEQ ID NO: 3023816 - RNA, 21 nt, Mycobacterium avium subsp. paratuberculosis
gacgaauccggugaccgccuc

SEQ ID NO: 3023817 - RNA, 23 nt, Mycobacterium avium subsp. paratuberculosis
gacgaaugucucgaugacaugga

SEQ ID NO: 3023818 - RNA, 15 nt, Mycobacterium avium subsp. paratuberculosis
gacgaauucggagac

SEQ ID NO: 3023819 - RNA, 15 nt, Mycobacterium avium subsp. paratuberculosis
gacgacaccaccgug

SEQ ID NO: 3023820 - RNA, 23 nt, Mycobacterium avium subsp. paratuberculosis
gacgacaccacggucgccgcgcc

SEQ ID NO: 3023821 - RNA, 19 nt, Mycobacterium avium subsp. paratuberculosis
gacgacacccuucaucagc

SEQ ID NO: 3023822 - RNA, 17 nt, Mycobacterium avium subsp. paratuberculosis
gacgacaccgugugacg

SEQ ID NO: 3023823 - RNA, 14 nt, Mycobacterium avium subsp. paratuberculosis
gacgaccaccagga

SEQ ID NO: 3023824 - RNA, 19 nt, Mycobacterium avium subsp. paratuberculosis
gacgaccagguccaccccg

SEQ ID NO: 3023825 - RNA, 21 nt, Mycobacterium avium subsp. paratuberculosis
gacgaccagguccaccccgcc

SEQ ID NO: 3023826 - RNA, 14 nt, Mycobacterium avium subsp. paratuberculosis
gacgaccaucagcg

SEQ ID NO: 3023827 - RNA, 22 nt, Mycobacterium avium subsp. paratuberculosis
gacgaccaucagcgcccgggug

SEQ ID NO: 3023828 - RNA, 13 nt, Mycobacterium avium subsp. paratuberculosis
gacgacccgaucc

SEQ ID NO: 3023829 - RNA, 14 nt, Mycobacterium avium subsp. paratuberculosis
gacgaccgcaccga

SEQ ID NO: 3023830 - RNA, 17 nt, Mycobacterium avium subsp. paratuberculosis
gacgaccgcaccgacca

SEQ ID NO: 3023831 - RNA, 22 nt, Mycobacterium avium subsp. paratuberculosis
gacgaccgcaccgaccagcggg

SEQ ID NO: 3023832 - RNA, 17 nt, Mycobacterium avium subsp. paratuberculosis
gacgaccgcgacggcgc

SEQ ID NO: 3023833 - RNA, 18 nt, Mycobacterium avium subsp. paratuberculosis
gacgaccgcgacggcgcc

SEQ ID NO: 3023834 - RNA, 21 nt, Mycobacterium avium subsp. paratuberculosis
gacgaccgcgacggcgcccgc

SEQ ID NO: 3023835 - RNA, 22 nt, Mycobacterium avium subsp. paratuberculosis
gacgaccgcgacggcgcccgcc

SEQ ID NO: 3023836 - RNA, 23 nt, Mycobacterium avium subsp. paratuberculosis
gacgaccgcgacggcgcccgccc

SEQ ID NO: 3023837 - RNA, 12 nt, Mycobacterium avium subsp. paratuberculosis
gacgaccgcguc

SEQ ID NO: 3023838 - RNA, 18 nt, Mycobacterium avium subsp. paratuberculosis
gacgaccgcguccgaggc

SEQ ID NO: 3023839 - RNA, 13 nt, Mycobacterium avium subsp. paratuberculosis
gacgaccggcagc

SEQ ID NO: 3023840 - RNA, 14 nt, Mycobacterium avium subsp. paratuberculosis
gacgaccggcagcc

SEQ ID NO: 3023841 - RNA, 18 nt, Mycobacterium avium subsp. paratuberculosis
gacgaccggcagccgcgc

SEQ ID NO: 3023842 - RNA, 19 nt, Mycobacterium avium subsp. paratuberculosis
gacgaccggcagccgcgcc

SEQ ID NO: 3023843 - RNA, 22 nt, Mycobacterium avium subsp. paratuberculosis
gacgaccggcagccgcgcccac

SEQ ID NO: 3023844 - RNA, 23 nt, Mycobacterium avium subsp. paratuberculosis
gacgaccggcagccgcgcccacc

SEQ ID NO: 3023845 - RNA, 20 nt, Mycobacterium avium subsp. paratuberculosis
gacgaccgucaucaucaccg

SEQ ID NO: 3023846 - RNA, 14 nt, Mycobacterium avium subsp. paratuberculosis
gacgaccucccccg

SEQ ID NO: 3023847 - RNA, 16 nt, Mycobacterium avium subsp. paratuberculosis
gacgaccucccccgac

SEQ ID NO: 3023848 - RNA, 14 nt, Mycobacterium avium subsp. paratuberculosis
gacgaccucgcccg

SEQ ID NO: 3023849 - RNA, 15 nt, Mycobacterium avium subsp. paratuberculosis
gacgaccucgcccgc

SEQ ID NO: 3023850 - RNA, 17 nt, Mycobacterium avium subsp. paratuberculosis
gacgaccucgcccgccg

SEQ ID NO: 3023851 - RNA, 14 nt, Mycobacterium avium subsp. paratuberculosis
gacgaccucgccga

SEQ ID NO: 3023852 - RNA, 15 nt, Mycobacterium avium subsp. paratuberculosis
gacgaccucgccgac

SEQ ID NO: 3023853 - RNA, 16 nt, Mycobacterium avium subsp. paratuberculosis
gacgaccucgccgacg

SEQ ID NO: 3023854 - RNA, 19 nt, Mycobacterium avium subsp. paratuberculosis
gacgaccucgccgacgucc

SEQ ID NO: 3023855 - RNA, 20 nt, Mycobacterium avium subsp. paratuberculosis
gacgaccucggugucgaggu

SEQ ID NO: 3023856 - RNA, 14 nt, Mycobacterium avium subsp. paratuberculosis
gacgaccucgucgu

SEQ ID NO: 3023857 - RNA, 15 nt, Mycobacterium avium subsp. paratuberculosis
gacgaccucgucguc

SEQ ID NO: 3023858 - RNA, 14 nt, Mycobacterium avium subsp. paratuberculosis
gacgaccugggcgc

SEQ ID NO: 3023859 - RNA, 21 nt, Mycobacterium avium subsp. paratuberculosis
gacgaccugggcgccgucgcc

SEQ ID NO: 3023860 - RNA, 22 nt, Mycobacterium avium subsp. paratuberculosis
gacgaccugggcgccgucgccg

SEQ ID NO: 3023861 - RNA, 23 nt, Mycobacterium avium subsp. paratuberculosis
gacgaccugggcgccgucgccga

SEQ ID NO: 3023862 - RNA, 13 nt, Mycobacterium avium subsp. paratuberculosis
gacgaccuggucg

SEQ ID NO: 3023863 - RNA, 15 nt, Mycobacterium avium subsp. paratuberculosis
gacgaccuggucgcc

SEQ ID NO: 3023864 - RNA, 18 nt, Mycobacterium avium subsp. paratuberculosis
gacgaccuggucgccgcc

SEQ ID NO: 3023865 - RNA, 19 nt, Mycobacterium avium subsp. paratuberculosis
gacgaccuugucgcgcacc

SEQ ID NO: 3023866 - RNA, 20 nt, Mycobacterium avium subsp. paratuberculosis
gacgacgaaaaugaugccga

SEQ ID NO: 3023867 - RNA, 22 nt, Mycobacterium avium subsp. paratuberculosis
gacgacgaaaaugaugccgacc

SEQ ID NO: 3023868 - RNA, 18 nt, Mycobacterium avium subsp. paratuberculosis
gacgacgaacgcggugag

SEQ ID NO: 3023869 - RNA, 14 nt, Mycobacterium avium subsp. paratuberculosis
gacgacgaagacgu

SEQ ID NO: 3023870 - RNA, 17 nt, Mycobacterium avium subsp. paratuberculosis
gacgacgaaucccgccu

SEQ ID NO: 3023871 - RNA, 20 nt, Mycobacterium avium subsp. paratuberculosis
gacgacgaaucccgccucgg

SEQ ID NO: 3023872 - RNA, 13 nt, Mycobacterium avium subsp. paratuberculosis
gacgacgacgucg

SEQ ID NO: 3023873 - RNA, 15 nt, Mycobacterium avium subsp. paratuberculosis
gacgacgccaccauc

SEQ ID NO: 3023874 - RNA, 19 nt, Mycobacterium avium subsp. paratuberculosis
gacgacgccaccaucgagu

SEQ ID NO: 3023875 - RNA, 13 nt, Mycobacterium avium subsp. paratuberculosis
gacgacgccagcu

SEQ ID NO: 3023876 - RNA, 16 nt, Mycobacterium avium subsp. paratuberculosis
gacgacgccagcugcc

SEQ ID NO: 3023877 - RNA, 18 nt, Mycobacterium avium subsp. paratuberculosis
gacgacgccagcugccgc

SEQ ID NO: 3023878 - RNA, 23 nt, Mycobacterium avium subsp. paratuberculosis
gacgacgccgauccgcagccgcu

SEQ ID NO: 3023879 - RNA, 15 nt, Mycobacterium avium subsp. paratuberculosis
gacgacggccaccgc

SEQ ID NO: 3023880 - RNA, 14 nt, Mycobacterium avium subsp. paratuberculosis
gacgacggccagcu

SEQ ID NO: 3023881 - RNA, 13 nt, Mycobacterium avium subsp. paratuberculosis
gacgacggcgccg

SEQ ID NO: 3023882 - RNA, 15 nt, Mycobacterium avium subsp. paratuberculosis
gacgacggcgccgcc

SEQ ID NO: 3023883 - RNA, 13 nt, Mycobacterium avium subsp. paratuberculosis
gacgaugacgcgg

SEQ ID NO: 3023884 - RNA, 19 nt, Mycobacterium avium subsp. paratuberculosis
gacgaugagggccagcagu

SEQ ID NO: 3023885 - RNA, 17 nt, Mycobacterium avium subsp. paratuberculosis
gacgaugaugucggccg

SEQ ID NO: 3023886 - RNA, 20 nt, Mycobacterium avium subsp. paratuberculosis
gacgaugaugucggccggca

SEQ ID NO: 3023887 - RNA, 17 nt, Mycobacterium avium subsp. paratuberculosis
gacgaugcccagccccu

SEQ ID NO: 3023888 - RNA, 21 nt, Mycobacterium avium subsp. paratuberculosis
gacgaugcccggggugcuggc

SEQ ID NO: 3023889 - RNA, 16 nt, Mycobacterium avium subsp. paratuberculosis
gacgaugccggccggg

SEQ ID NO: 3023890 - RNA, 22 nt, Mycobacterium avium subsp. paratuberculosis
gacgaugccguagagccguuug

SEQ ID NO: 3023891 - RNA, 14 nt, Mycobacterium avium subsp. paratuberculosis
gacgaugcgcaccc

SEQ ID NO: 3023892 - RNA, 16 nt, Mycobacterium avium subsp. paratuberculosis
gacgaugcgcaccccc

SEQ ID NO: 3023893 - RNA, 14 nt, Mycobacterium avium subsp. paratuberculosis
gacgaugcgcugcu

SEQ ID NO: 3023894 - RNA, 16 nt, Mycobacterium avium subsp. paratuberculosis
gacgaugcggccggcg

SEQ ID NO: 3023895 - RNA, 19 nt, Mycobacterium avium subsp. paratuberculosis
gacgaugcggccggcgggc

SEQ ID NO: 3023896 - RNA, 16 nt, Mycobacterium avium subsp. paratuberculosis
gacgaugcggccguug

SEQ ID NO: 3023897 - RNA, 18 nt, Mycobacterium avium subsp. paratuberculosis
gacgaugcggggccggcg

SEQ ID NO: 3023898 - RNA, 17 nt, Mycobacterium avium subsp. paratuberculosis
gacgaugcggggcggcg

SEQ ID NO: 3023899 - RNA, 18 nt, Mycobacterium avium subsp. paratuberculosis
gacgaugcggggcggcgg

SEQ ID NO: 3023900 - RNA, 14 nt, Mycobacterium avium subsp. paratuberculosis
gacgaugcugagca

SEQ ID NO: 3023901 - RNA, 22 nt, Mycobacterium avium subsp. paratuberculosis
gacgauggccaggcccagcccg

SEQ ID NO: 3023902 - RNA, 14 nt, Mycobacterium avium subsp. paratuberculosis
gacgauggcccgga

SEQ ID NO: 3023903 - RNA, 20 nt, Mycobacterium avium subsp. paratuberculosis
gacgauggcccggaccgccg

SEQ ID NO: 3023904 - RNA, 21 nt, Mycobacterium avium subsp. paratuberculosis
gacgauggcccggaccgccgc

SEQ ID NO: 3023905 - RNA, 17 nt, Mycobacterium avium subsp. paratuberculosis
gacgauggcccgggcca

SEQ ID NO: 3023906 - RNA, 19 nt, Mycobacterium avium subsp. paratuberculosis
gacgauggcccgggccaca

SEQ ID NO: 3023907 - RNA, 17 nt, Mycobacterium avium subsp. paratuberculosis
gacgauggcgaccgcgc

SEQ ID NO: 3023908 - RNA, 14 nt, Mycobacterium avium subsp. paratuberculosis
gacgaugggccgcc

SEQ ID NO: 3023909 - RNA, 17 nt, Mycobacterium avium subsp. paratuberculosis
gacgaugggccgcccgc

SEQ ID NO: 3023910 - RNA, 20 nt, Mycobacterium avium subsp. paratuberculosis
gacgaugggccgcccgcugg

SEQ ID NO: 3023911 - RNA, 23 nt, Mycobacterium avium subsp. paratuberculosis
gacgaugggccgcccgcuggggc

SEQ ID NO: 3023912 - RNA, 13 nt, Mycobacterium avium subsp. paratuberculosis
gacgaugucgacc

SEQ ID NO: 3023913 - RNA, 15 nt, Mycobacterium avium subsp. paratuberculosis
gacgauguuggcgac

SEQ ID NO: 3023914 - RNA, 17 nt, Mycobacterium avium subsp. paratuberculosis
gacgauguuggcgacga

SEQ ID NO: 3023915 - RNA, 17 nt, Mycobacterium avium subsp. paratuberculosis
gacgauucgcgaucaac

SEQ ID NO: 3023916 - RNA, 20 nt, Mycobacterium avium subsp. paratuberculosis
gacgauugucggggccgcac

SEQ ID NO: 3023917 - RNA, 15 nt, Mycobacterium avium subsp. paratuberculosis
gacgcaaaagccccc

SEQ ID NO: 3023918 - RNA, 20 nt, Mycobacterium avium subsp. paratuberculosis
gacgcaaaagccccgcgaca

SEQ ID NO: 3023919 - RNA, 21 nt, Mycobacterium avium subsp. paratuberculosis
gacgcaaaagccccgcgacac

SEQ ID NO: 3023920 - RNA, 21 nt, Mycobacterium avium subsp. paratuberculosis
gacgcaccucgcucagcccgg

SEQ ID NO: 3023921 - RNA, 15 nt, Mycobacterium avium subsp. paratuberculosis
gacgcaccucggccg

SEQ ID NO: 3023922 - RNA, 16 nt, Mycobacterium avium subsp. paratuberculosis
gacgcaccucggccgg

SEQ ID NO: 3023923 - RNA, 17 nt, Mycobacterium avium subsp. paratuberculosis
gacgcaccucggccggg

SEQ ID NO: 3023924 - RNA, 20 nt, Mycobacterium avium subsp. paratuberculosis
gacgcacgccggcggggguu

SEQ ID NO: 3023925 - RNA, 13 nt, Mycobacterium avium subsp. paratuberculosis
gacgcacgucggc

SEQ ID NO: 3023926 - RNA, 15 nt, Mycobacterium avium subsp. paratuberculosis
gacgcagccgauguc

SEQ ID NO: 3023927 - RNA, 15 nt, Mycobacterium avium subsp. paratuberculosis
gacgcaucaccacgc

SEQ ID NO: 3023928 - RNA, 16 nt, Mycobacterium avium subsp. paratuberculosis
gacgcauccacggccg

SEQ ID NO: 3023929 - RNA, 17 nt, Mycobacterium avium subsp. paratuberculosis
gacgcauguccgccguc

SEQ ID NO: 3023930 - RNA, 13 nt, Mycobacterium avium subsp. paratuberculosis
gacgccaccgcga

SEQ ID NO: 3023931 - RNA, 14 nt, Mycobacterium avium subsp. paratuberculosis
gacgccacggcgaa

SEQ ID NO: 3023932 - RNA, 20 nt, Mycobacterium avium subsp. paratuberculosis
gacgccagcacguggccggg

SEQ ID NO: 3023933 - RNA, 15 nt, Mycobacterium avium subsp. paratuberculosis
gacgccagcaugauc

SEQ ID NO: 3023934 - RNA, 21 nt, Mycobacterium avium subsp. paratuberculosis
gacgccagcaugaucaccgcc

SEQ ID NO: 3023935 - RNA, 13 nt, Mycobacterium avium subsp. paratuberculosis
gacgccagcgggc

SEQ ID NO: 3023936 - RNA, 15 nt, Mycobacterium avium subsp. paratuberculosis
gacgccagcgggccg

SEQ ID NO: 3023937 - RNA, 16 nt, Mycobacterium avium subsp. paratuberculosis
gacgccagcugccgcg

SEQ ID NO: 3023938 - RNA, 17 nt, Mycobacterium avium subsp. paratuberculosis
gacgccagcugccgcga

SEQ ID NO: 3023939 - RNA, 19 nt, Mycobacterium avium subsp. paratuberculosis
gacgccagcugccgcgacu

SEQ ID NO: 3023940 - RNA, 17 nt, Mycobacterium avium subsp. paratuberculosis
gacgccaguucgucggc

SEQ ID NO: 3023941 - RNA, 18 nt, Mycobacterium avium subsp. paratuberculosis
gacgccaguucgucggcc

SEQ ID NO: 3023942 - RNA, 19 nt, Mycobacterium avium subsp. paratuberculosis
gacgccaguucgucggccg

SEQ ID NO: 3023943 - RNA, 22 nt, Mycobacterium avium subsp. paratuberculosis
gacgccaguucgucggccgucg

SEQ ID NO: 3023944 - RNA, 17 nt, Mycobacterium avium subsp. paratuberculosis
gacgcccaacuacccgc

SEQ ID NO: 3023945 - RNA, 15 nt, Mycobacterium avium subsp. paratuberculosis
gacgcccacagcgcc

SEQ ID NO: 3023946 - RNA, 16 nt, Mycobacterium avium subsp. paratuberculosis
gacgcccacagcgcca

SEQ ID NO: 3023947 - RNA, 20 nt, Mycobacterium avium subsp. paratuberculosis
gacgcccacagcgccagcac

SEQ ID NO: 3023948 - RNA, 13 nt, Mycobacterium avium subsp. paratuberculosis
gccagcucaccgg

SEQ ID NO: 3023949 - RNA, 15 nt, Mycobacterium avium subsp. paratuberculosis
gccagcucaccggcc

SEQ ID NO: 3023950 - RNA, 22 nt, Mycobacterium avium subsp. paratuberculosis
gccagcucaccggccagggccg

SEQ ID NO: 3023951 - RNA, 23 nt, Mycobacterium avium subsp. paratuberculosis
gccagcucaccggccagggccgc

SEQ ID NO: 3023952 - RNA, 13 nt, Mycobacterium avium subsp. paratuberculosis
gccagcuccagca

SEQ ID NO: 3023953 - RNA, 14 nt, Mycobacterium avium subsp. paratuberculosis
gccagcuccagcag

SEQ ID NO: 3023954 - RNA, 16 nt, Mycobacterium avium subsp. paratuberculosis
gccagcuccagcagcc

SEQ ID NO: 3023955 - RNA, 24 nt, Mycobacterium avium subsp. paratuberculosis
gccaggaccacccacucccagccg

SEQ ID NO: 3023956 - RNA, 14 nt, Mycobacterium avium subsp. paratuberculosis
gccaggaccggauc

SEQ ID NO: 3023957 - RNA, 21 nt, Mycobacterium avium subsp. paratuberculosis
gccaggacgaaaaccaggaac

SEQ ID NO: 3023958 - RNA, 15 nt, Mycobacterium avium subsp. paratuberculosis
gccaggauccgauga

SEQ ID NO: 3023959 - RNA, 20 nt, Mycobacterium avium subsp. paratuberculosis
gccaggauccgaugacgcug

SEQ ID NO: 3023960 - RNA, 16 nt, Mycobacterium avium subsp. paratuberculosis
gccaggauccgcccgc

SEQ ID NO: 3023961 - RNA, 19 nt, Mycobacterium avium subsp. paratuberculosis
gccaggauccgcccgccgg

SEQ ID NO: 3023962 - RNA, 15 nt, Mycobacterium avium subsp. paratuberculosis
gccaggaucucgcgg

SEQ ID NO: 3023963 - RNA, 19 nt, Mycobacterium avium subsp. paratuberculosis
gccaggaucucgcgggccc

SEQ ID NO: 3023964 - RNA, 22 nt, Mycobacterium avium subsp. paratuberculosis
gccaggaucucgcgggcccgcg

SEQ ID NO: 3023965 - RNA, 16 nt, Mycobacterium avium subsp. paratuberculosis
gccaggaucucgucgg

SEQ ID NO: 3023966 - RNA, 16 nt, Mycobacterium avium subsp. paratuberculosis
gccaggaucugcucgg

SEQ ID NO: 3023967 - RNA, 18 nt, Mycobacterium avium subsp. paratuberculosis
gccaggaucugcucggcg

SEQ ID NO: 3023968 - RNA, 19 nt, Mycobacterium avium subsp. paratuberculosis
gccaggaucuugucggcgg

SEQ ID NO: 3023969 - RNA, 20 nt, Mycobacterium avium subsp. paratuberculosis
gccaggaucuugucggcggc

SEQ ID NO: 3023970 - RNA, 17 nt, Mycobacterium avium subsp. paratuberculosis
gccaggaugaacacccg

SEQ ID NO: 3023971 - RNA, 14 nt, Mycobacterium avium subsp. paratuberculosis
gccaggaugaaccg

SEQ ID NO: 3023972 - RNA, 20 nt, Mycobacterium avium subsp. paratuberculosis
gccaggaugaccgcccagga

SEQ ID NO: 3023973 - RNA, 18 nt, Mycobacterium avium subsp. paratuberculosis
gccaggaugccgaacgcg

SEQ ID NO: 3023974 - RNA, 20 nt, Mycobacterium avium subsp. paratuberculosis
gccaggauguacccgcaggc

SEQ ID NO: 3023975 - RNA, 13 nt, Mycobacterium avium subsp. paratuberculosis
gccaggaugucgg

SEQ ID NO: 3023976 - RNA, 19 nt, Mycobacterium avium subsp. paratuberculosis
gccaggauguucaccccgg

SEQ ID NO: 3023977 - RNA, 21 nt, Mycobacterium avium subsp. paratuberculosis
gccaggauguucaccccggcg

SEQ ID NO: 3023978 - RNA, 22 nt, Mycobacterium avium subsp. paratuberculosis
gccaggauguucaccccggcgc

SEQ ID NO: 3023979 - RNA, 14 nt, Mycobacterium avium subsp. paratuberculosis
gccaggcacagcag

SEQ ID NO: 3023980 - RNA, 20 nt, Mycobacterium avium subsp. paratuberculosis
gccaggcacagcagggcacc

SEQ ID NO: 3023981 - RNA, 16 nt, Mycobacterium avium subsp. paratuberculosis
gccaggcacggcccgu

SEQ ID NO: 3023982 - RNA, 13 nt, Mycobacterium avium subsp. paratuberculosis
gccaggcagaagc

SEQ ID NO: 3023983 - RNA, 22 nt, Mycobacterium avium subsp. paratuberculosis
gccaggcagaagcuccacgccg

SEQ ID NO: 3023984 - RNA, 12 nt, Mycobacterium avium subsp. paratuberculosis
gccaggcaggcg

SEQ ID NO: 3023985 - RNA, 15 nt, Mycobacterium avium subsp. paratuberculosis
gccaggcaggcggcc

SEQ ID NO: 3023986 - RNA, 23 nt, Mycobacterium avium subsp. paratuberculosis
gccaggcaggcggccagggcggc

SEQ ID NO: 3023987 - RNA, 15 nt, Mycobacterium avium subsp. paratuberculosis
gccaggccaccgcac

SEQ ID NO: 3023988 - RNA, 23 nt, Mycobacterium avium subsp. paratuberculosis
gccaggccaccgcacgucuuacg

SEQ ID NO: 3023989 - RNA, 15 nt, Mycobacterium avium subsp. paratuberculosis
gccaggccauggcgc

SEQ ID NO: 3023990 - RNA, 17 nt, Mycobacterium avium subsp. paratuberculosis
gccaggccauggcgcac

SEQ ID NO: 3023991 - RNA, 23 nt, Mycobacterium avium subsp. paratuberculosis
gccaggccauggcgcaccgcggc

SEQ ID NO: 3023992 - RNA, 20 nt, Mycobacterium avium subsp. paratuberculosis
gccaggcccaccgucgccac

SEQ ID NO: 3023993 - RNA, 22 nt, Mycobacterium avium subsp. paratuberculosis
gccaggcccaccgucgccacga

SEQ ID NO: 3023994 - RNA, 13 nt, Mycobacterium avium subsp. paratuberculosis
gccaggcccagcc

SEQ ID NO: 3023995 - RNA, 15 nt, Mycobacterium avium subsp. paratuberculosis
gccaggcccagccca

SEQ ID NO: 3023996 - RNA, 15 nt, Mycobacterium avium subsp. paratuberculosis
gccaggcccagcccg

SEQ ID NO: 3023997 - RNA, 17 nt, Mycobacterium avium subsp. paratuberculosis
gccaggcccagcccggc

SEQ ID NO: 3023998 - RNA, 18 nt, Mycobacterium avium subsp. paratuberculosis
gccaggcccagcccggcc

SEQ ID NO: 3023999 - RNA, 12 nt, Mycobacterium avium subsp. paratuberculosis
gccaggcccugc

SEQ ID NO: 3024000 - RNA, 15 nt, Mycobacterium avium subsp. paratuberculosis
gccaggcccugccag

SEQ ID NO: 3024001 - RNA, 20 nt, Mycobacterium avium subsp. paratuberculosis
gccaggcccugccagcgccc

SEQ ID NO: 3024002 - RNA, 22 nt, Mycobacterium avium subsp. paratuberculosis
gccaggcccugccagcgcccgc

SEQ ID NO: 3024003 - RNA, 12 nt, Mycobacterium avium subsp. paratuberculosis
gccaggccgccg

SEQ ID NO: 3024004 - RNA, 13 nt, Mycobacterium avium subsp. paratuberculosis
gccaggccgccgg

SEQ ID NO: 3024005 - RNA, 15 nt, Mycobacterium avium subsp. paratuberculosis
gccaggccgccgggc

SEQ ID NO: 3024006 - RNA, 16 nt, Mycobacterium avium subsp. paratuberculosis
gccaggccgccgggcc

SEQ ID NO: 3024007 - RNA, 13 nt, Mycobacterium avium subsp. paratuberculosis
gccaggccgcgag

SEQ ID NO: 3024008 - RNA, 14 nt, Mycobacterium avium subsp. paratuberculosis
gccaggccgcgagc

SEQ ID NO: 3024009 - RNA, 15 nt, Mycobacterium avium subsp. paratuberculosis
gccaggccgcgagca

SEQ ID NO: 3024010 - RNA, 17 nt, Mycobacterium avium subsp. paratuberculosis
gccaggccgcgagcacg

SEQ ID NO: 3024011 - RNA, 23 nt, Mycobacterium avium subsp. paratuberculosis
gccaggccgcgagcacgacgucg

SEQ ID NO: 3024012 - RNA, 14 nt, Mycobacterium avium subsp. paratuberculosis
gccaggccggccug

SEQ ID NO: 3024013 - RNA, 13 nt, Mycobacterium avium subsp. paratuberculosis
gccaggccggcga

SEQ ID NO: 3024014 - RNA, 16 nt, Mycobacterium avium subsp. paratuberculosis
gccaggccggcgacga

SEQ ID NO: 3024015 - RNA, 19 nt, Mycobacterium avium subsp. paratuberculosis
gccaggccggcgacgccgg

SEQ ID NO: 3024016 - RNA, 12 nt, Mycobacterium avium subsp. paratuberculosis
gccaggccuccc

SEQ ID NO: 3024017 - RNA, 18 nt, Mycobacterium avium subsp. paratuberculosis
gccaggccucccacagcg

SEQ ID NO: 3024018 - RNA, 20 nt, Mycobacterium avium subsp. paratuberculosis
gccaggccucccacagcgga

SEQ ID NO: 3024019 - RNA, 20 nt, Mycobacterium avium subsp. paratuberculosis
gccaggcgaugaagccggcg

SEQ ID NO: 3024020 - RNA, 14 nt, Mycobacterium avium subsp. paratuberculosis
gccaggcgcccagc

SEQ ID NO: 3024021 - RNA, 17 nt, Mycobacterium avium subsp. paratuberculosis
gccaggcgcccagcacc

SEQ ID NO: 3024022 - RNA, 18 nt, Mycobacterium avium subsp. paratuberculosis
gccaggcgcccagcaccc

SEQ ID NO: 3024023 - RNA, 13 nt, Mycobacterium avium subsp. paratuberculosis
gccaggcgcgcgc

SEQ ID NO: 3024024 - RNA, 15 nt, Mycobacterium avium subsp. paratuberculosis
gccaggcgcgcgcug

SEQ ID NO: 3024025 - RNA, 17 nt, Mycobacterium avium subsp. paratuberculosis
gccaggcgcgcgcuggu

SEQ ID NO: 3024026 - RNA, 20 nt, Mycobacterium avium subsp. paratuberculosis
gccaggcgcgcgcuggugcg

SEQ ID NO: 3024027 - RNA, 14 nt, Mycobacterium avium subsp. paratuberculosis
gccaggcggcgacg

SEQ ID NO: 3024028 - RNA, 15 nt, Mycobacterium avium subsp. paratuberculosis
gccaggcggcgacga

SEQ ID NO: 3024029 - RNA, 19 nt, Mycobacterium avium subsp. paratuberculosis
gccaggcgggccaccacag

SEQ ID NO: 3024030 - RNA, 13 nt, Mycobacterium avium subsp. paratuberculosis
gccaggcggguga

SEQ ID NO: 3024031 - RNA, 23 nt, Mycobacterium avium subsp. paratuberculosis
gccaggcgggugaucccgaugcc

SEQ ID NO: 3024032 - RNA, 12 nt, Mycobacterium avium subsp. paratuberculosis
gccaggcggugg

SEQ ID NO: 3024033 - RNA, 17 nt, Mycobacterium avium subsp. paratuberculosis
gccaggcgguggccgaa

SEQ ID NO: 3024034 - RNA, 19 nt, Mycobacterium avium subsp. paratuberculosis
gccaggcgguggccgaacc

SEQ ID NO: 3024035 - RNA, 18 nt, Mycobacterium avium subsp. paratuberculosis
gccaggcguugcaccgcg

SEQ ID NO: 3024036 - RNA, 21 nt, Mycobacterium avium subsp. paratuberculosis
gccaggcguuggucaccauca

SEQ ID NO: 3024037 - RNA, 22 nt, Mycobacterium avium subsp. paratuberculosis
gccaggcguuggucaccaucag

SEQ ID NO: 3024038 - RNA, 23 nt, Mycobacterium avium subsp. paratuberculosis
gccaggcguuggucaccaucagc

SEQ ID NO: 3024039 - RNA, 16 nt, Mycobacterium avium subsp. paratuberculosis
gccaggcucacguagu

SEQ ID NO: 3024040 - RNA, 18 nt, Mycobacterium avium subsp. paratuberculosis
gccagguuuugcagcgga

SEQ ID NO: 3024041 - RNA, 20 nt, Mycobacterium avium subsp. paratuberculosis
gccaguaccagcggccgucg

SEQ ID NO: 3024042 - RNA, 21 nt, Mycobacterium avium subsp. paratuberculosis
gccaguaccagcggccgucgc

SEQ ID NO: 3024043 - RNA, 14 nt, Mycobacterium avium subsp. paratuberculosis
gccagucaagcgcu

SEQ ID NO: 3024044 - RNA, 17 nt, Mycobacterium avium subsp. paratuberculosis
gccaguccaggccgccg

SEQ ID NO: 3024045 - RNA, 18 nt, Mycobacterium avium subsp. paratuberculosis
gccaguccaggccgccgu

SEQ ID NO: 3024046 - RNA, 17 nt, Mycobacterium avium subsp. paratuberculosis
gccaguccgccgccguc

SEQ ID NO: 3024047 - RNA, 19 nt, Mycobacterium avium subsp. paratuberculosis
gccaguccgccgccguccc

SEQ ID NO: 3024048 - RNA, 17 nt, Mycobacterium avium subsp. paratuberculosis
gccaguccggcagcagc

SEQ ID NO: 3024049 - RNA, 16 nt, Mycobacterium avium subsp. paratuberculosis
gccaguccggcgccga

SEQ ID NO: 3024050 - RNA, 20 nt, Mycobacterium avium subsp. paratuberculosis
gccaguccugggccggggcu

SEQ ID NO: 3024051 - RNA, 18 nt, Mycobacterium avium subsp. paratuberculosis
gccagucgaagaccacga

SEQ ID NO: 3024052 - RNA, 17 nt, Mycobacterium avium subsp. paratuberculosis
gccagucgaaguucggc

SEQ ID NO: 3024053 - RNA, 12 nt, Mycobacterium avium subsp. paratuberculosis
gccagucgccgc

SEQ ID NO: 3024054 - RNA, 14 nt, Mycobacterium avium subsp. paratuberculosis
gccagucgccgcgc

SEQ ID NO: 3024055 - RNA, 15 nt, Mycobacterium avium subsp. paratuberculosis
gccagucgccggcca

SEQ ID NO: 3024056 - RNA, 19 nt, Mycobacterium avium subsp. paratuberculosis
gccagucgccggccaggcc

SEQ ID NO: 3024057 - RNA, 22 nt, Mycobacterium avium subsp. paratuberculosis
gccagucgccggccaggccggc

SEQ ID NO: 3024058 - RNA, 13 nt, Mycobacterium avium subsp. paratuberculosis
gccagucgcggcg

SEQ ID NO: 3024059 - RNA, 21 nt, Mycobacterium avium subsp. paratuberculosis
gccagucgcggcgaaccagca

SEQ ID NO: 3024060 - RNA, 21 nt, Mycobacterium avium subsp. paratuberculosis
gccagucggucaacgugucga

SEQ ID NO: 3024061 - RNA, 22 nt, Mycobacterium avium subsp. paratuberculosis
gccagucguacucccaggccgc

SEQ ID NO: 3024062 - RNA, 13 nt, Mycobacterium avium subsp. paratuberculosis
gccagugauccug

SEQ ID NO: 3024063 - RNA, 13 nt, Mycobacterium avium subsp. paratuberculosis
gccagugccgcgc

SEQ ID NO: 3024064 - RNA, 14 nt, Mycobacterium avium subsp. paratuberculosis
gccagugccgcgcg

SEQ ID NO: 3024065 - RNA, 15 nt, Mycobacterium avium subsp. paratuberculosis
gccaguggcugcacg

SEQ ID NO: 3024066 - RNA, 15 nt, Mycobacterium avium subsp. paratuberculosis
gccaguguggccgcg

SEQ ID NO: 3024067 - RNA, 16 nt, Mycobacterium avium subsp. paratuberculosis
gccaguguggccgcgg

SEQ ID NO: 3024068 - RNA, 18 nt, Mycobacterium avium subsp. paratuberculosis
gccaguguggccgcggcg

SEQ ID NO: 3024069 - RNA, 19 nt, Mycobacterium avium subsp. paratuberculosis
gccaguguggccgcggcgg

SEQ ID NO: 3024070 - RNA, 14 nt, Mycobacterium avium subsp. paratuberculosis
gccaguucaccgcg

SEQ ID NO: 3024071 - RNA, 15 nt, Mycobacterium avium subsp. paratuberculosis
gccaguucaccgcgc

SEQ ID NO: 3024072 - RNA, 14 nt, Mycobacterium avium subsp. paratuberculosis
gccaguucccgggc

SEQ ID NO: 3024073 - RNA, 19 nt, Mycobacterium avium subsp. paratuberculosis
gccaguucgacgaucuugc

SEQ ID NO: 3024074 - RNA, 14 nt, Mycobacterium avium subsp. paratuberculosis
gccaguucgagcgc

SEQ ID NO: 3024075 - RNA, 19 nt, Mycobacterium avium subsp. paratuberculosis
gccaguucgagcgccgcgg

SEQ ID NO: 3024076 - RNA, 15 nt, Mycobacterium avium subsp. paratuberculosis
gccaguucgccagca

SEQ ID NO: 3024077 - RNA, 19 nt, Mycobacterium avium subsp. paratuberculosis
gccaguucgucgcgcgacu

SEQ ID NO: 3024078 - RNA, 14 nt, Mycobacterium avium subsp. paratuberculosis
gccaguucgucggc

SEQ ID NO: 3024079 - RNA, 19 nt, Mycobacterium avium subsp. paratuberculosis
gccaguucgucggccgucg

SEQ ID NO: 3024080 - RNA, 21 nt, Mycobacterium avium subsp. paratuberculosis
gccaguucgucggccgucggc

SEQ ID NO: 3024081 - RNA, 22 nt, Mycobacterium avium subsp. paratuberculosis
gccaguucgucggccgucggcg

SEQ ID NO: 3024082 - RNA, 17 nt, Mycobacterium avium subsp. paratuberculosis
gccaguugaaguccggc

SEQ ID NO: 3024083 - RNA, 21 nt, Mycobacterium avium subsp. paratuberculosis
gccaguugacguugaucgcgc

SEQ ID NO: 3024084 - RNA, 17 nt, Mycobacterium avium subsp. paratuberculosis
gccaguugaucagcccg

SEQ ID NO: 3024085 - RNA, 20 nt, Mycobacterium avium subsp. paratuberculosis
gccaguugcacuuucggcag

SEQ ID NO: 3024086 - RNA, 22 nt, Mycobacterium avium subsp. paratuberculosis
gccaguugcacuuucggcagcu

SEQ ID NO: 3024087 - RNA, 14 nt, Mycobacterium avium subsp. paratuberculosis
gccaguugcucggg

SEQ ID NO: 3024088 - RNA, 20 nt, Mycobacterium avium subsp. paratuberculosis
gccaguugggggccagcgcc

SEQ ID NO: 3024089 - RNA, 16 nt, Mycobacterium avium subsp. paratuberculosis
gccaguuugccgucgg

SEQ ID NO: 3024090 - RNA, 14 nt, Mycobacterium avium subsp. paratuberculosis
gccauaaaccggcc

SEQ ID NO: 3024091 - RNA, 15 nt, Mycobacterium avium subsp. paratuberculosis
gccauaaaccggccg

SEQ ID NO: 3024092 - RNA, 19 nt, Mycobacterium avium subsp. paratuberculosis
gccauaaaccggccggcgc

SEQ ID NO: 3024093 - RNA, 17 nt, Mycobacterium avium subsp. paratuberculosis
gccauagauguuggcgu

SEQ ID NO: 3024094 - RNA, 23 nt, Mycobacterium avium subsp. paratuberculosis
gccauauuucgugaagccggugg

SEQ ID NO: 3024095 - RNA, 21 nt, Mycobacterium avium subsp. paratuberculosis
gccaucaaccgauuucggcca

SEQ ID NO: 3024096 - RNA, 23 nt, Mycobacterium avium subsp. paratuberculosis
gccaucaaccgauuucggccagc

SEQ ID NO: 3024097 - RNA, 12 nt, Mycobacterium avium subsp. paratuberculosis
gccaucaccgcg

SEQ ID NO: 3024098 - RNA, 24 nt, Mycobacterium avium subsp. paratuberculosis
gccaucaccuccuuggccaggcgg

SEQ ID NO: 3024099 - RNA, 17 nt, Mycobacterium avium subsp. paratuberculosis
gccaucagaacgcccgc

SEQ ID NO: 3024100 - RNA, 15 nt, Mycobacterium avium subsp. paratuberculosis
gccaucagcaccacg

SEQ ID NO: 3024101 - RNA, 22 nt, Mycobacterium avium subsp. paratuberculosis
gccaucagcaccacguugcgcc

SEQ ID NO: 3024102 - RNA, 22 nt, Mycobacterium avium subsp. paratuberculosis
gccaucagcaccgaaucgccga

SEQ ID NO: 3024103 - RNA, 16 nt, Mycobacterium avium subsp. paratuberculosis
gccaucagcagcgccu

SEQ ID NO: 3024104 - RNA, 22 nt, Mycobacterium avium subsp. paratuberculosis
gccaucagcagcgccucgccgg

SEQ ID NO: 3024105 - RNA, 15 nt, Mycobacterium avium subsp. paratuberculosis
gccaucagcccggcg

SEQ ID NO: 3024106 - RNA, 17 nt, Mycobacterium avium subsp. paratuberculosis
gccaucagcccggcguc

SEQ ID NO: 3024107 - RNA, 19 nt, Mycobacterium avium subsp. paratuberculosis
gccaucagcccggcguccu

SEQ ID NO: 3024108 - RNA, 22 nt, Mycobacterium avium subsp. paratuberculosis
gccaucaugcccaccaucccgc

SEQ ID NO: 3024109 - RNA, 19 nt, Mycobacterium avium subsp. paratuberculosis
gccauccccgcguuggcca

SEQ ID NO: 3024110 - RNA, 11 nt, Mycobacterium avium subsp. paratuberculosis
gccaucccggu

SEQ ID NO: 3024111 - RNA, 14 nt, Mycobacterium avium subsp. paratuberculosis
gccaucccggugcc

SEQ ID NO: 3024112 - RNA, 16 nt, Mycobacterium avium subsp. paratuberculosis
gccaucccggugccgc

SEQ ID NO: 3024113 - RNA, 13 nt, Mycobacterium avium subsp. paratuberculosis
gccauccgccacc

SEQ ID NO: 3024114 - RNA, 14 nt, Mycobacterium avium subsp. paratuberculosis
gccauccgccaccc

SEQ ID NO: 3024115 - RNA, 16 nt, Mycobacterium avium subsp. paratuberculosis
gccauccgccacccgc

SEQ ID NO: 3024116 - RNA, 19 nt, Mycobacterium avium subsp. paratuberculosis
gccauccgccacccgcugc

SEQ ID NO: 3024117 - RNA, 16 nt, Mycobacterium avium subsp. paratuberculosis
gccauccgcugcgcgu

SEQ ID NO: 3024118 - RNA, 13 nt, Mycobacterium avium subsp. paratuberculosis
gccauccggccgg

SEQ ID NO: 3024119 - RNA, 14 nt, Mycobacterium avium subsp. paratuberculosis
gccauccggccggc

SEQ ID NO: 3024120 - RNA, 15 nt, Mycobacterium avium subsp. paratuberculosis
gccauccgggcggca

SEQ ID NO: 3024121 - RNA, 17 nt, Mycobacterium avium subsp. paratuberculosis
gccauccgggcggcauc

SEQ ID NO: 3024122 - RNA, 17 nt, Mycobacterium avium subsp. paratuberculosis
gccauccguucggcucu

SEQ ID NO: 3024123 - RNA, 23 nt, Mycobacterium avium subsp. paratuberculosis
gccauccugaagaagcggccgua

SEQ ID NO: 3024124 - RNA, 18 nt, Mycobacterium avium subsp. paratuberculosis
gccaucgacuccagcacc

SEQ ID NO: 3024125 - RNA, 19 nt, Mycobacterium avium subsp. paratuberculosis
gccaucgacuccagcaccg

SEQ ID NO: 3024126 - RNA, 22 nt, Mycobacterium avium subsp. paratuberculosis
gccaucgacuccagcaccggcg

SEQ ID NO: 3024127 - RNA, 19 nt, Mycobacterium avium subsp. paratuberculosis
gccaucgaucgggcgucgc

SEQ ID NO: 3024128 - RNA, 22 nt, Mycobacterium avium subsp. paratuberculosis
gccaucgaucgggcgucgcaga

SEQ ID NO: 3024129 - RNA, 23 nt, Mycobacterium avium subsp. paratuberculosis
gccaucgaucgggcgucgcagau

SEQ ID NO: 3024130 - RNA, 17 nt, Mycobacterium avium subsp. paratuberculosis
gccaucgcaccgcgagc

SEQ ID NO: 3024131 - RNA, 18 nt, Mycobacterium avium subsp. paratuberculosis
gccaucgcaccgcgagca

SEQ ID NO: 3024132 - RNA, 13 nt, Mycobacterium avium subsp. paratuberculosis
gccaucgcccggu

SEQ ID NO: 3024133 - RNA, 18 nt, Mycobacterium avium subsp. paratuberculosis
gccaucgcccggugcgcc

SEQ ID NO: 3024134 - RNA, 21 nt, Mycobacterium avium subsp. paratuberculosis
gccaucgcccggugcgccagc

SEQ ID NO: 3024135 - RNA, 17 nt, Mycobacterium avium subsp. paratuberculosis
gccaucgccgccaucgc

SEQ ID NO: 3024136 - RNA, 20 nt, Mycobacterium avium subsp. paratuberculosis
gccaucgccgcgguggcgcc

SEQ ID NO: 3024137 - RNA, 18 nt, Mycobacterium avium subsp. paratuberculosis
gccaucgccucggccacc

SEQ ID NO: 3024138 - RNA, 18 nt, Mycobacterium avium subsp. paratuberculosis
gccaucgccucgucccuc

SEQ ID NO: 3024139 - RNA, 19 nt, Mycobacterium avium subsp. paratuberculosis
gccaucgcggcguuguggc

SEQ ID NO: 3024140 - RNA, 15 nt, Mycobacterium avium subsp. paratuberculosis
gccaucggcagaccc

SEQ ID NO: 3024141 - RNA, 20 nt, Mycobacterium avium subsp. paratuberculosis
gccaucgucacuucgccggg

SEQ ID NO: 3024142 - RNA, 21 nt, Mycobacterium avium subsp. paratuberculosis
gccaucgucacuucgccgggc

SEQ ID NO: 3024143 - RNA, 22 nt, Mycobacterium avium subsp. paratuberculosis
gccaucgucacuucgccgggcu

SEQ ID NO: 3024144 - RNA, 12 nt, Mycobacterium avium subsp. paratuberculosis
gccaucguggcc

SEQ ID NO: 3024145 - RNA, 16 nt, Mycobacterium avium subsp. paratuberculosis
gccaucguggccgcgu

SEQ ID NO: 3024146 - RNA, 17 nt, Mycobacterium avium subsp. paratuberculosis
gccaucgugggcgccgu

SEQ ID NO: 3024147 - RNA, 19 nt, Mycobacterium avium subsp. paratuberculosis
gccaucgugggcgccgucg

SEQ ID NO: 3024148 - RNA, 20 nt, Mycobacterium avium subsp. paratuberculosis
gccaucgugggcgccgucgc

SEQ ID NO: 3024149 - RNA, 24 nt, Mycobacterium avium subsp. paratuberculosis
gccaucgugggcgccgucgccgcc

SEQ ID NO: 3024150 - RNA, 17 nt, Mycobacterium avium subsp. paratuberculosis
gccaucuccugcacgcg

SEQ ID NO: 3024151 - RNA, 18 nt, Mycobacterium avium subsp. paratuberculosis
gccaucuccugcacgcgc

SEQ ID NO: 3024152 - RNA, 20 nt, Mycobacterium avium subsp. paratuberculosis
gccaucuccugcacgcgcgg

SEQ ID NO: 3024153 - RNA, 15 nt, Mycobacterium avium subsp. paratuberculosis
gccaucucgggagug

SEQ ID NO: 3024154 - RNA, 22 nt, Mycobacterium avium subsp. paratuberculosis
gccaucucgggagugcggccca

SEQ ID NO: 3024155 - RNA, 11 nt, Mycobacterium avium subsp. paratuberculosis
gccaucuggcc

SEQ ID NO: 3024156 - RNA, 15 nt, Mycobacterium avium subsp. paratuberculosis
gccaucuggccgcgg

SEQ ID NO: 3024157 - RNA, 18 nt, Mycobacterium avium subsp. paratuberculosis
gccaucuggccgcgggug

SEQ ID NO: 3024158 - RNA, 22 nt, Mycobacterium avium subsp. paratuberculosis
gccaucuggccgcgggugcggc

SEQ ID NO: 3024159 - RNA, 21 nt, Mycobacterium avium subsp. paratuberculosis
gccaucuucacgugcgcggcg

SEQ ID NO: 3024160 - RNA, 21 nt, Mycobacterium avium subsp. paratuberculosis
gccaucuucaguucggccggc

SEQ ID NO: 3024161 - RNA, 22 nt, Mycobacterium avium subsp. paratuberculosis
gccaugaacugguuccacacca

SEQ ID NO: 3024162 - RNA, 20 nt, Mycobacterium avium subsp. paratuberculosis
gccaugaccaugucgacgcu

SEQ ID NO: 3024163 - RNA, 19 nt, Mycobacterium avium subsp. paratuberculosis
gccaugacuaauccccccg

SEQ ID NO: 3024164 - RNA, 23 nt, Mycobacterium avium subsp. paratuberculosis
gccaugaucgaaaggacgggcgu

SEQ ID NO: 3024165 - RNA, 17 nt, Mycobacterium avium subsp. paratuberculosis
gccaugcccucgaucga

SEQ ID NO: 3024166 - RNA, 24 nt, Mycobacterium avium subsp. paratuberculosis
gccaugccgccgaccgccgagcgg

SEQ ID NO: 3024167 - RNA, 15 nt, Mycobacterium avium subsp. paratuberculosis
gccaugccggccuga

SEQ ID NO: 3024168 - RNA, 16 nt, Mycobacterium avium subsp. paratuberculosis
gccaugccggccugac

SEQ ID NO: 3024169 - RNA, 12 nt, Mycobacterium avium subsp. paratuberculosis
gccaugccgggg

SEQ ID NO: 3024170 - RNA, 15 nt, Mycobacterium avium subsp. paratuberculosis
gccaugccggguuuc

SEQ ID NO: 3024171 - RNA, 21 nt, Mycobacterium avium subsp. paratuberculosis
gccaugccggguuucggcccg

SEQ ID NO: 3024172 - RNA, 13 nt, Mycobacterium avium subsp. paratuberculosis
gccaugccggugg

SEQ ID NO: 3024173 - RNA, 20 nt, Mycobacterium avium subsp. paratuberculosis
gccaugccucuucggcgcgc

SEQ ID NO: 3024174 - RNA, 21 nt, Mycobacterium avium subsp. paratuberculosis
gccaugccucuucggcgcgcc

SEQ ID NO: 3024175 - RNA, 22 nt, Mycobacterium avium subsp. paratuberculosis
gccaugccucuucggcgcgccg

SEQ ID NO: 3024176 - RNA, 24 nt, Mycobacterium avium subsp. paratuberculosis
gccaugccucuucggcgcgccggc

SEQ ID NO: 3024177 - RNA, 20 nt, Mycobacterium avium subsp. paratuberculosis
gccaugcgaccacgaccggg

SEQ ID NO: 3024178 - RNA, 22 nt, Mycobacterium avium subsp. paratuberculosis
gccaugcgcgagucgagcaccg

SEQ ID NO: 3024179 - RNA, 22 nt, Mycobacterium avium subsp. paratuberculosis
gccaugcugcccuuguugacgu

SEQ ID NO: 3024180 - RNA, 17 nt, Mycobacterium avium subsp. paratuberculosis
gccauggaaaccggcgg

SEQ ID NO: 3024181 - RNA, 20 nt, Mycobacterium avium subsp. paratuberculosis
gccauggcccacgacgucug

SEQ ID NO: 3024182 - RNA, 22 nt, Mycobacterium avium subsp. paratuberculosis
gccauggcccacgacgucuggg

SEQ ID NO: 3024183 - RNA, 14 nt, Mycobacterium avium subsp. paratuberculosis
gccauggcgcaccg

SEQ ID NO: 3024184 - RNA, 17 nt, Mycobacterium avium subsp. paratuberculosis
gccauggcgcaccgcgg

SEQ ID NO: 3024185 - RNA, 22 nt, Mycobacterium avium subsp. paratuberculosis
gccauggcgcaccgcggccucg

SEQ ID NO: 3024186 - RNA, 13 nt, Mycobacterium avium subsp. paratuberculosis
gccauggcggccc

SEQ ID NO: 3024187 - RNA, 17 nt, Mycobacterium avium subsp. paratuberculosis
gccauggcggcccgcgc

SEQ ID NO: 3024188 - RNA, 16 nt, Mycobacterium avium subsp. paratuberculosis
gccauggugccgccgu

SEQ ID NO: 3024189 - RNA, 13 nt, Mycobacterium avium subsp. paratuberculosis
gccauguccggca

SEQ ID NO: 3024190 - RNA, 19 nt, Mycobacterium avium subsp. paratuberculosis
gccauguccggcaggcuca

SEQ ID NO: 3024191 - RNA, 22 nt, Mycobacterium avium subsp. paratuberculosis
gccauguccuuggugaugucgg

SEQ ID NO: 3024192 - RNA, 19 nt, Mycobacterium avium subsp. paratuberculosis
gccaugucgaaggugaagg

SEQ ID NO: 3024193 - RNA, 14 nt, Mycobacterium avium subsp. paratuberculosis
gccaugucgauguc

SEQ ID NO: 3024194 - RNA, 15 nt, Mycobacterium avium subsp. paratuberculosis
gccaugucgaugucg

SEQ ID NO: 3024195 - RNA, 18 nt, Mycobacterium avium subsp. paratuberculosis
gccaugucgaugucgacg

SEQ ID NO: 3024196 - RNA, 20 nt, Mycobacterium avium subsp. paratuberculosis
gccaugucggagcugcgcgc

SEQ ID NO: 3024197 - RNA, 21 nt, Mycobacterium avium subsp. paratuberculosis
gccaugucggagcugcgcgcc

SEQ ID NO: 3024198 - RNA, 17 nt, Mycobacterium avium subsp. paratuberculosis
gccaugugccggcgcuc

SEQ ID NO: 3024199 - RNA, 19 nt, Mycobacterium avium subsp. paratuberculosis
gccaugugccggcgcucgu

SEQ ID NO: 3024200 - RNA, 21 nt, Mycobacterium avium subsp. paratuberculosis
gccaugugccggcgcucgucg

SEQ ID NO: 3024201 - RNA, 18 nt, Mycobacterium avium subsp. paratuberculosis
gccauucaucgcgcacca

SEQ ID NO: 3024202 - RNA, 22 nt, Mycobacterium avium subsp. paratuberculosis
gccauucaucgcgcaccagggc

SEQ ID NO: 3024203 - RNA, 15 nt, Mycobacterium avium subsp. paratuberculosis
gccauuucagcagcg

SEQ ID NO: 3024204 - RNA, 19 nt, Mycobacterium avium subsp. paratuberculosis
gccauuucagcagcgcggc

SEQ ID NO: 3024205 - RNA, 21 nt, Mycobacterium avium subsp. paratuberculosis
gccauuuccguugugccaccg

SEQ ID NO: 3024206 - RNA, 22 nt, Mycobacterium avium subsp. paratuberculosis
gccauuuccguugugccaccgc

SEQ ID NO: 3024207 - RNA, 21 nt, Mycobacterium avium subsp. paratuberculosis
gcccaaaaacgagaugcccca

SEQ ID NO: 3024208 - RNA, 17 nt, Mycobacterium avium subsp. paratuberculosis
gcccaccgcgcccagcc

SEQ ID NO: 3024209 - RNA, 22 nt, Mycobacterium avium subsp. paratuberculosis
gcccaccgcgcccagccccagc

SEQ ID NO: 3024210 - RNA, 14 nt, Mycobacterium avium subsp. paratuberculosis
gcccaccgcgcgcu

SEQ ID NO: 3024211 - RNA, 17 nt, Mycobacterium avium subsp. paratuberculosis
gcccaccgcgcgcugca

SEQ ID NO: 3024212 - RNA, 19 nt, Mycobacterium avium subsp. paratuberculosis
gcccaccgcgcgcugcagc

SEQ ID NO: 3024213 - RNA, 15 nt, Mycobacterium avium subsp. paratuberculosis
gcccaccgcggcgcg

SEQ ID NO: 3024214 - RNA, 22 nt, Mycobacterium avium subsp. paratuberculosis
gcccaccgcggcgcgcggccgc

SEQ ID NO: 3024215 - RNA, 19 nt, Mycobacterium avium subsp. paratuberculosis
gcccaccgcggugaccgcc

SEQ ID NO: 3024216 - RNA, 12 nt, Mycobacterium avium subsp. paratuberculosis
gcccaccgcguc

SEQ ID NO: 3024217 - RNA, 15 nt, Mycobacterium avium subsp. paratuberculosis
gcccaccgcgucgca

SEQ ID NO: 3024218 - RNA, 23 nt, Mycobacterium avium subsp. paratuberculosis
gcccaccgcgucgcagugccggu

SEQ ID NO: 3024219 - RNA, 13 nt, Mycobacterium avium subsp. paratuberculosis
gcccaccgcucgu

SEQ ID NO: 3024220 - RNA, 17 nt, Mycobacterium avium subsp. paratuberculosis
gcccaccgcuggaaccg

SEQ ID NO: 3024221 - RNA, 15 nt, Mycobacterium avium subsp. paratuberculosis
gcccaccggcccggc

SEQ ID NO: 3024222 - RNA, 16 nt, Mycobacterium avium subsp. paratuberculosis
gcccaccggcccggcg

SEQ ID NO: 3024223 - RNA, 17 nt, Mycobacterium avium subsp. paratuberculosis
gcccaccggcccggcgg

SEQ ID NO: 3024224 - RNA, 18 nt, Mycobacterium avium subsp. paratuberculosis
gcccaccggcccggcggg

SEQ ID NO: 3024225 - RNA, 14 nt, Mycobacterium avium subsp. paratuberculosis
gcccaccgggcagc

SEQ ID NO: 3024226 - RNA, 20 nt, Mycobacterium avium subsp. paratuberculosis
gcccaccgggcagccgcaca

SEQ ID NO: 3024227 - RNA, 18 nt, Mycobacterium avium subsp. paratuberculosis
gcccaccgguggccggga

SEQ ID NO: 3024228 - RNA, 21 nt, Mycobacterium avium subsp. paratuberculosis
gcccaccgguggccgggagug

SEQ ID NO: 3024229 - RNA, 18 nt, Mycobacterium avium subsp. paratuberculosis
gcccaccgucgccacgau

SEQ ID NO: 3024230 - RNA, 22 nt, Mycobacterium avium subsp. paratuberculosis
gcccaccgucgccacgaucacc

SEQ ID NO: 3024231 - RNA, 18 nt, Mycobacterium avium subsp. paratuberculosis
gcccaccucgagcacgcc

SEQ ID NO: 3024232 - RNA, 19 nt, Mycobacterium avium subsp. paratuberculosis
gcccaccucgagcacgccc

SEQ ID NO: 3024233 - RNA, 18 nt, Mycobacterium avium subsp. paratuberculosis
gcccaccuggaggccaac

SEQ ID NO: 3024234 - RNA, 21 nt, Mycobacterium avium subsp. paratuberculosis
gcccaccugguucucccgucg

SEQ ID NO: 3024235 - RNA, 21 nt, Mycobacterium avium subsp. paratuberculosis
gcccaccugguuggcccgcac

SEQ ID NO: 3024236 - RNA, 23 nt, Mycobacterium avium subsp. paratuberculosis
gcccaccugguuggcccgcacca

SEQ ID NO: 3024237 - RNA, 13 nt, Mycobacterium avium subsp. paratuberculosis
gcccacgaaccgg

SEQ ID NO: 3024238 - RNA, 22 nt, Mycobacterium avium subsp. paratuberculosis
gcccacgaagaugaucagcgcg

SEQ ID NO: 3024239 - RNA, 22 nt, Mycobacterium avium subsp. paratuberculosis
gcccacgacgucugggccgccg

SEQ ID NO: 3024240 - RNA, 16 nt, Mycobacterium avium subsp. paratuberculosis
gcccacgaucacgucg

SEQ ID NO: 3024241 - RNA, 21 nt, Mycobacterium avium subsp. paratuberculosis
gcccacgaucacgucggugac

SEQ ID NO: 3024242 - RNA, 14 nt, Mycobacterium avium subsp. paratuberculosis
gcccacgccgaggg

SEQ ID NO: 3024243 - RNA, 19 nt, Mycobacterium avium subsp. paratuberculosis
gcccacgccgagggugccg

SEQ ID NO: 3024244 - RNA, 22 nt, Mycobacterium avium subsp. paratuberculosis
gcccacgccgagggugccggcc

SEQ ID NO: 3024245 - RNA, 12 nt, Mycobacterium avium subsp. paratuberculosis
gcccacgccgcc

SEQ ID NO: 3024246 - RNA, 15 nt, Mycobacterium avium subsp. paratuberculosis
gcccacgccgcccag

SEQ ID NO: 3024247 - RNA, 16 nt, Mycobacterium avium subsp. paratuberculosis
gcccacgccgcccagg

SEQ ID NO: 3024248 - RNA, 12 nt, Mycobacterium avium subsp. paratuberculosis
gcccacgccggu

SEQ ID NO: 3024249 - RNA, 13 nt, Mycobacterium avium subsp. paratuberculosis
gcccacgccggug

SEQ ID NO: 3024250 - RNA, 21 nt, Mycobacterium avium subsp. paratuberculosis
gcccacgccgguggggucggu

SEQ ID NO: 3024251 - RNA, 14 nt, Mycobacterium avium subsp. paratuberculosis
gcccacgccgucga

SEQ ID NO: 3024252 - RNA, 23 nt, Mycobacterium avium subsp. paratuberculosis
gcccacgccgucgacccguuccc

SEQ ID NO: 3024253 - RNA, 16 nt, Mycobacterium avium subsp. paratuberculosis
gcccacgccgucgucg

SEQ ID NO: 3024254 - RNA, 13 nt, Mycobacterium avium subsp. paratuberculosis
gcccacgccgugc

SEQ ID NO: 3024255 - RNA, 14 nt, Mycobacterium avium subsp. paratuberculosis
gcccacgcucgacg

SEQ ID NO: 3024256 - RNA, 17 nt, Mycobacterium avium subsp. paratuberculosis
gcccacgcucgacgcgu

SEQ ID NO: 3024257 - RNA, 19 nt, Mycobacterium avium subsp. paratuberculosis
gcccacgcucgacgcgucg

SEQ ID NO: 3024258 - RNA, 14 nt, Mycobacterium avium subsp. paratuberculosis
gcccacggccacca

SEQ ID NO: 3024259 - RNA, 18 nt, Mycobacterium avium subsp. paratuberculosis
gcccacgggaugcggcac

SEQ ID NO: 3024260 - RNA, 22 nt, Mycobacterium avium subsp. paratuberculosis
gcccacgggaugcggcacgcgu

SEQ ID NO: 3024261 - RNA, 23 nt, Mycobacterium avium subsp. paratuberculosis
gcccacgggaugcggcacgcguc

SEQ ID NO: 3024262 - RNA, 15 nt, Mycobacterium avium subsp. paratuberculosis
gcccacgggucgccg

SEQ ID NO: 3024263 - RNA, 16 nt, Mycobacterium avium subsp. paratuberculosis
gcccacgggucgccga

SEQ ID NO: 3024264 - RNA, 18 nt, Mycobacterium avium subsp. paratuberculosis
gcccacgggucgccgauc

SEQ ID NO: 3024265 - RNA, 15 nt, Mycobacterium avium subsp. paratuberculosis
gcccacggugaggac

SEQ ID NO: 3024266 - RNA, 20 nt, Mycobacterium avium subsp. paratuberculosis
gcccacggugaggacaccac

SEQ ID NO: 3024267 - RNA, 15 nt, Mycobacterium avium subsp. paratuberculosis
gcccacggugauucc

SEQ ID NO: 3024268 - RNA, 23 nt, Mycobacterium avium subsp. paratuberculosis
gcccacguaggggcccggguuga

SEQ ID NO: 3024269 - RNA, 14 nt, Mycobacterium avium subsp. paratuberculosis
gcccacgucgcgcc

SEQ ID NO: 3024270 - RNA, 15 nt, Mycobacterium avium subsp. paratuberculosis
gcccacgucgcgccg

SEQ ID NO: 3024271 - RNA, 17 nt, Mycobacterium avium subsp. paratuberculosis
gcccacgucgcgccgau

SEQ ID NO: 3024272 - RNA, 15 nt, Mycobacterium avium subsp. paratuberculosis
gcccacgugccaucg

SEQ ID NO: 3024273 - RNA, 13 nt, Mycobacterium avium subsp. paratuberculosis
gcccacguucagc

SEQ ID NO: 3024274 - RNA, 17 nt, Mycobacterium avium subsp. paratuberculosis
gcccacguugagcacgc

SEQ ID NO: 3024275 - RNA, 21 nt, Mycobacterium avium subsp. paratuberculosis
gcccacguugagcacgcccgc

SEQ ID NO: 3024276 - RNA, 20 nt, Mycobacterium avium subsp. paratuberculosis
gcccacugccugacccggcc

SEQ ID NO: 3024277 - RNA, 23 nt, Mycobacterium avium subsp. paratuberculosis
gcccacugccugacccggccgug

SEQ ID NO: 3024278 - RNA, 19 nt, Mycobacterium avium subsp. paratuberculosis
gcccacugguaaccgcccg

SEQ ID NO: 3024279 - RNA, 13 nt, Mycobacterium avium subsp. paratuberculosis
gcccacuucgacg

SEQ ID NO: 3024280 - RNA, 16 nt, Mycobacterium avium subsp. paratuberculosis
gcccacuucgacggug

SEQ ID NO: 3024281 - RNA, 22 nt, Mycobacterium avium subsp. paratuberculosis
gcccagaacgacgcgcucagcc

SEQ ID NO: 3024282 - RNA, 16 nt, Mycobacterium avium subsp. paratuberculosis
gcccagaacugggccg

SEQ ID NO: 3024283 - RNA, 13 nt, Mycobacterium avium subsp. paratuberculosis
gcccagaagcccc

SEQ ID NO: 3024284 - RNA, 14 nt, Mycobacterium avium subsp. paratuberculosis
gcccagacaggccg

SEQ ID NO: 3024285 - RNA, 16 nt, Mycobacterium avium subsp. paratuberculosis
gcccagacaggccggc

SEQ ID NO: 3024286 - RNA, 17 nt, Mycobacterium avium subsp. paratuberculosis
gcccagacgaugucguc

SEQ ID NO: 3024287 - RNA, 19 nt, Mycobacterium avium subsp. paratuberculosis
gcccagacgaugucgucgc

SEQ ID NO: 3024288 - RNA, 13 nt, Mycobacterium avium subsp. paratuberculosis
gcccagacgcggg

SEQ ID NO: 3024289 - RNA, 23 nt, Mycobacterium avium subsp. paratuberculosis
gcccagacgcgggcgcccagcaa

SEQ ID NO: 3024290 - RNA, 19 nt, Mycobacterium avium subsp. paratuberculosis
gcccagacgguuccaccgg

SEQ ID NO: 3024291 - RNA, 14 nt, Mycobacterium avium subsp. paratuberculosis
gcccagauacgccg

SEQ ID NO: 3024292 - RNA, 17 nt, Mycobacterium avium subsp. paratuberculosis
gcccagauacgccgcga

SEQ ID NO: 3024293 - RNA, 21 nt, Mycobacterium avium subsp. paratuberculosis
gcccagcccgccgcguccggg

SEQ ID NO: 3024294 - RNA, 13 nt, Mycobacterium avium subsp. paratuberculosis
gcccagcccgcgc

SEQ ID NO: 3024295 - RNA, 19 nt, Mycobacterium avium subsp. paratuberculosis
gcccagcccgcgccgagca

SEQ ID NO: 3024296 - RNA, 20 nt, Mycobacterium avium subsp. paratuberculosis
gcccagcccgcgcgagcgca

SEQ ID NO: 3024297 - RNA, 15 nt, Mycobacterium avium subsp. paratuberculosis
gcccagcccgcgggc

SEQ ID NO: 3024298 - RNA, 15 nt, Mycobacterium avium subsp. paratuberculosis
gcccagcccggccag

SEQ ID NO: 3024299 - RNA, 17 nt, Mycobacterium avium subsp. paratuberculosis
gcccagcccggccagca

SEQ ID NO: 3024300 - RNA, 18 nt, Mycobacterium avium subsp. paratuberculosis
gcccagcccggccagcac

SEQ ID NO: 3024301 - RNA, 19 nt, Mycobacterium avium subsp. paratuberculosis
gcccagcccggccagcacc

SEQ ID NO: 3024302 - RNA, 22 nt, Mycobacterium avium subsp. paratuberculosis
gcccagcccggccagcacccgc

SEQ ID NO: 3024303 - RNA, 14 nt, Mycobacterium avium subsp. paratuberculosis
gcccagcccggccc

SEQ ID NO: 3024304 - RNA, 21 nt, Mycobacterium avium subsp. paratuberculosis
gcccagcccggccccaccgcc

SEQ ID NO: 3024305 - RNA, 23 nt, Mycobacterium avium subsp. paratuberculosis
gcccagcccggccccaccgccgc

SEQ ID NO: 3024306 - RNA, 13 nt, Mycobacterium avium subsp. paratuberculosis
gcccagccgagcc

SEQ ID NO: 3024307 - RNA, 19 nt, Mycobacterium avium subsp. paratuberculosis
gcccagccgcaggugcagc

SEQ ID NO: 3024308 - RNA, 23 nt, Mycobacterium avium subsp. paratuberculosis
gcccagccgcaggugcagcuccu

SEQ ID NO: 3024309 - RNA, 17 nt, Mycobacterium avium subsp. paratuberculosis
gcccagccgccagccgg

SEQ ID NO: 3024310 - RNA, 18 nt, Mycobacterium avium subsp. paratuberculosis
gcccagccgccagccggu

SEQ ID NO: 3024311 - RNA, 16 nt, Mycobacterium avium subsp. paratuberculosis
gcccagccgcgucacg

SEQ ID NO: 3024312 - RNA, 19 nt, Mycobacterium avium subsp. paratuberculosis
gcccagccgcgucacgucg

SEQ ID NO: 3024313 - RNA, 23 nt, Mycobacterium avium subsp. paratuberculosis
gcccagccgcgucacgucggccu

SEQ ID NO: 3024314 - RNA, 14 nt, Mycobacterium avium subsp. paratuberculosis
gcccagccgcugcg

SEQ ID NO: 3024315 - RNA, 12 nt, Mycobacterium avium subsp. paratuberculosis
gcccagccggcc

SEQ ID NO: 3024316 - RNA, 14 nt, Mycobacterium avium subsp. paratuberculosis
gcccagccggccga

SEQ ID NO: 3024317 - RNA, 15 nt, Mycobacterium avium subsp. paratuberculosis
gcccagccggccgac

SEQ ID NO: 3024318 - RNA, 21 nt, Mycobacterium avium subsp. paratuberculosis
gcccagccggccgacgcggcc

SEQ ID NO: 3024319 - RNA, 15 nt, Mycobacterium avium subsp. paratuberculosis
gcccagccggcggug

SEQ ID NO: 3024320 - RNA, 21 nt, Mycobacterium avium subsp. paratuberculosis
gcccagccggcggugcagggu

SEQ ID NO: 3024321 - RNA, 17 nt, Mycobacterium avium subsp. paratuberculosis
gcccagccggucgccgg

SEQ ID NO: 3024322 - RNA, 21 nt, Mycobacterium avium subsp. paratuberculosis
gcccagccggucgccgggccg

SEQ ID NO: 3024323 - RNA, 15 nt, Mycobacterium avium subsp. paratuberculosis
gcccagccggugcga

SEQ ID NO: 3024324 - RNA, 17 nt, Mycobacterium avium subsp. paratuberculosis
gcccagccggugcgagc

SEQ ID NO: 3024325 - RNA, 23 nt, Mycobacterium avium subsp. paratuberculosis
gcccagccggugcgagccgcuga

SEQ ID NO: 3024326 - RNA, 18 nt, Mycobacterium avium subsp. paratuberculosis
gcccagccgucgcaccgc

SEQ ID NO: 3024327 - RNA, 16 nt, Mycobacterium avium subsp. paratuberculosis
gcccagccuucgccgc

SEQ ID NO: 3024328 - RNA, 19 nt, Mycobacterium avium subsp. paratuberculosis
gcccagccuucgccgcacg

SEQ ID NO: 3024329 - RNA, 17 nt, Mycobacterium avium subsp. paratuberculosis
gcccagcgacucggcca

SEQ ID NO: 3024330 - RNA, 18 nt, Mycobacterium avium subsp. paratuberculosis
gcccagcgacucggccag

SEQ ID NO: 3024331 - RNA, 18 nt, Mycobacterium avium subsp. paratuberculosis
gcccagcgagcugccggc

SEQ ID NO: 3024332 - RNA, 20 nt, Mycobacterium avium subsp. paratuberculosis
gcccagcgagcugccggcgg

SEQ ID NO: 3024333 - RNA, 21 nt, Mycobacterium avium subsp. paratuberculosis
gcccagcgagcugccggcggc

SEQ ID NO: 3024334 - RNA, 16 nt, Mycobacterium avium subsp. paratuberculosis
gcccagcgaggcggcc

SEQ ID NO: 3024335 - RNA, 17 nt, Mycobacterium avium subsp. paratuberculosis
gcccagcgaggcggcca

SEQ ID NO: 3024336 - RNA, 19 nt, Mycobacterium avium subsp. paratuberculosis
gcccagcgaggcggccagc

SEQ ID NO: 3024337 - RNA, 22 nt, Mycobacterium avium subsp. paratuberculosis
gcccagcgaggcggccagcggc

SEQ ID NO: 3024338 - RNA, 16 nt, Mycobacterium avium subsp. paratuberculosis
gcccagcgagucgaga

SEQ ID NO: 3024339 - RNA, 15 nt, Mycobacterium avium subsp. paratuberculosis
gcccagcgcagcauc

SEQ ID NO: 3024340 - RNA, 14 nt, Mycobacterium avium subsp. paratuberculosis
gcccagcgcagcgc

SEQ ID NO: 3024341 - RNA, 16 nt, Mycobacterium avium subsp. paratuberculosis
gcccagcgcagcgccu

SEQ ID NO: 3024342 - RNA, 17 nt, Mycobacterium avium subsp. paratuberculosis
gcccagcgcagcgccuc

SEQ ID NO: 3024343 - RNA, 17 nt, Mycobacterium avium subsp. paratuberculosis
gcccagcgcauccacca

SEQ ID NO: 3024344 - RNA, 19 nt, Mycobacterium avium subsp. paratuberculosis
gcccagcgcauccaccagg

SEQ ID NO: 3024345 - RNA, 21 nt, Mycobacterium avium subsp. paratuberculosis
gcccagcgcauccaccagggc

SEQ ID NO: 3024346 - RNA, 23 nt, Mycobacterium avium subsp. paratuberculosis
gcccagcgcauccaccagggcgg

SEQ ID NO: 3024347 - RNA, 13 nt, Mycobacterium avium subsp. paratuberculosis
gcccagcgccacg

SEQ ID NO: 3024348 - RNA, 14 nt, Mycobacterium avium subsp. paratuberculosis
gcccagcgccacgg

SEQ ID NO: 3024349 - RNA, 22 nt, Mycobacterium avium subsp. paratuberculosis
gcccagcgccacgguggcgguc

SEQ ID NO: 3024350 - RNA, 13 nt, Mycobacterium avium subsp. paratuberculosis
gcccagcgccccg

SEQ ID NO: 3024351 - RNA, 13 nt, Mycobacterium avium subsp. paratuberculosis
gcccagcgcccgu

SEQ ID NO: 3024352 - RNA, 14 nt, Mycobacterium avium subsp. paratuberculosis
gcccagcgcccgua

SEQ ID NO: 3024353 - RNA, 16 nt, Mycobacterium avium subsp. paratuberculosis
gcccagcgccgcggcg

SEQ ID NO: 3024354 - RNA, 19 nt, Mycobacterium avium subsp. paratuberculosis
gcccagcgccgcggcgaaa

SEQ ID NO: 3024355 - RNA, 14 nt, Mycobacterium avium subsp. paratuberculosis
gcccagcgccgcgu

SEQ ID NO: 3024356 - RNA, 17 nt, Mycobacterium avium subsp. paratuberculosis
gcccagcgcgacgucga

SEQ ID NO: 3024357 - RNA, 19 nt, Mycobacterium avium subsp. paratuberculosis
gcccagcgcgaggucgacg

SEQ ID NO: 3024358 - RNA, 13 nt, Mycobacterium avium subsp. paratuberculosis
gcccagcgcgcga

SEQ ID NO: 3024359 - RNA, 17 nt, Mycobacterium avium subsp. paratuberculosis
gcccagcgcgcgaucgc

SEQ ID NO: 3024360 - RNA, 18 nt, Mycobacterium avium subsp. paratuberculosis
gcccagcgcgcgaucgcc

SEQ ID NO: 3024361 - RNA, 21 nt, Mycobacterium avium subsp. paratuberculosis
gcccagcgcgcgaucgccggu

SEQ ID NO: 3024362 - RNA, 14 nt, Mycobacterium avium subsp. paratuberculosis
gcccagcgcgcggc

SEQ ID NO: 3024363 - RNA, 16 nt, Mycobacterium avium subsp. paratuberculosis
gcccagcgcgcggcgg

SEQ ID NO: 3024364 - RNA, 15 nt, Mycobacterium avium subsp. paratuberculosis
gcccagcgcgcggug

SEQ ID NO: 3024365 - RNA, 16 nt, Mycobacterium avium subsp. paratuberculosis
gcccagcgcgcggugc

SEQ ID NO: 3024366 - RNA, 19 nt, Mycobacterium avium subsp. paratuberculosis
gcccagcgcgcggugcgcc

SEQ ID NO: 3024367 - RNA, 21 nt, Mycobacterium avium subsp. paratuberculosis
gcccagcgcgcggugcgccag

SEQ ID NO: 3024368 - RNA, 22 nt, Mycobacterium avium subsp. paratuberculosis
gcccagcgcgcggugcgccagc

SEQ ID NO: 3024369 - RNA, 13 nt, Mycobacterium avium subsp. paratuberculosis
gcccagcgcggcg

SEQ ID NO: 3024370 - RNA, 16 nt, Mycobacterium avium subsp. paratuberculosis
gcccagcgcggcggcc

SEQ ID NO: 3024371 - RNA, 18 nt, Mycobacterium avium subsp. paratuberculosis
gcccagcgcggcggccac

SEQ ID NO: 3024372 - RNA, 19 nt, Mycobacterium avium subsp. paratuberculosis
gcccagcgcggcggccacc

SEQ ID NO: 3024373 - RNA, 20 nt, Mycobacterium avium subsp. paratuberculosis
gcccagcgcggcggccaccu

SEQ ID NO: 3024374 - RNA, 22 nt, Mycobacterium avium subsp. paratuberculosis
gcccagcgcgguaaagucuucg

SEQ ID NO: 3024375 - RNA, 14 nt, Mycobacterium avium subsp. paratuberculosis
gcccagcgcggucg

SEQ ID NO: 3024376 - RNA, 23 nt, Mycobacterium avium subsp. paratuberculosis
gcccagcgcggucgccaccacca

SEQ ID NO: 3024377 - RNA, 24 nt, Mycobacterium avium subsp. paratuberculosis
gcccaggcucaggaucagcagccg

SEQ ID NO: 3024378 - RNA, 14 nt, Mycobacterium avium subsp. paratuberculosis
gcccagggcgccag

SEQ ID NO: 3024379 - RNA, 15 nt, Mycobacterium avium subsp. paratuberculosis
gcccagggcgcgucc

SEQ ID NO: 3024380 - RNA, 16 nt, Mycobacterium avium subsp. paratuberculosis
gcccagggcgcgucca

SEQ ID NO: 3024381 - RNA, 15 nt, Mycobacterium avium subsp. paratuberculosis
gcccagggcgugcgc

SEQ ID NO: 3024382 - RNA, 19 nt, Mycobacterium avium subsp. paratuberculosis
gcccagggcgugcgcggcc

SEQ ID NO: 3024383 - RNA, 20 nt, Mycobacterium avium subsp. paratuberculosis
gcccagggcgugcgcggccg

SEQ ID NO: 3024384 - RNA, 19 nt, Mycobacterium avium subsp. paratuberculosis
gcccaggggagcggcggag

SEQ ID NO: 3024385 - RNA, 22 nt, Mycobacterium avium subsp. paratuberculosis
gcccagguaaucgaaggccagg

SEQ ID NO: 3024386 - RNA, 17 nt, Mycobacterium avium subsp. paratuberculosis
gcccagguacuccucgg

SEQ ID NO: 3024387 - RNA, 19 nt, Mycobacterium avium subsp. paratuberculosis
gcccagguaguagcgccac

SEQ ID NO: 3024388 - RNA, 23 nt, Mycobacterium avium subsp. paratuberculosis
gcccagguauucguugcccugcc

SEQ ID NO: 3024389 - RNA, 14 nt, Mycobacterium avium subsp. paratuberculosis
gcccagguccacca

SEQ ID NO: 3024390 - RNA, 16 nt, Mycobacterium avium subsp. paratuberculosis
gcccagguccaccagg

SEQ ID NO: 3024391 - RNA, 18 nt, Mycobacterium avium subsp. paratuberculosis
gcccagguccaccaggug

SEQ ID NO: 3024392 - RNA, 19 nt, Mycobacterium avium subsp. paratuberculosis
gcccagguccaccguuguc

SEQ ID NO: 3024393 - RNA, 14 nt, Mycobacterium avium subsp. paratuberculosis
gcccaggucgggac

SEQ ID NO: 3024394 - RNA, 18 nt, Mycobacterium avium subsp. paratuberculosis
gcccagguucuccggccc

SEQ ID NO: 3024395 - RNA, 19 nt, Mycobacterium avium subsp. paratuberculosis
gcccagguucuccggcccg

SEQ ID NO: 3024396 - RNA, 20 nt, Mycobacterium avium subsp. paratuberculosis
gcccagguucuccggcccgc

SEQ ID NO: 3024397 - RNA, 21 nt, Mycobacterium avium subsp. paratuberculosis
gcccaguccagucgcgccgag

SEQ ID NO: 3024398 - RNA, 14 nt, Mycobacterium avium subsp. paratuberculosis
gcccagucgccgcc

SEQ ID NO: 3024399 - RNA, 15 nt, Mycobacterium avium subsp. paratuberculosis
gcccagugcgcgccg

SEQ ID NO: 3024400 - RNA, 17 nt, Mycobacterium avium subsp. paratuberculosis
gcccagugcgcgccgug

SEQ ID NO: 3024401 - RNA, 13 nt, Mycobacterium avium subsp. paratuberculosis
gcccaguggaucg

SEQ ID NO: 3024402 - RNA, 18 nt, Mycobacterium avium subsp. paratuberculosis
gcccaguggaucggcccg

SEQ ID NO: 3024403 - RNA, 19 nt, Mycobacterium avium subsp. paratuberculosis
gcccaguggaucggcccga

SEQ ID NO: 3024404 - RNA, 21 nt, Mycobacterium avium subsp. paratuberculosis
gcccaguggaucggcccgacg

SEQ ID NO: 3024405 - RNA, 21 nt, Mycobacterium avium subsp. paratuberculosis
gcccagugucgcaaagacauu

SEQ ID NO: 3024406 - RNA, 17 nt, Mycobacterium avium subsp. paratuberculosis
gcccaguucgcacccca

SEQ ID NO: 3024407 - RNA, 20 nt, Mycobacterium avium subsp. paratuberculosis
gcccaguugcacgguguaga

SEQ ID NO: 3024408 - RNA, 13 nt, Mycobacterium avium subsp. paratuberculosis
gcccaucaccagc

SEQ ID NO: 3024409 - RNA, 22 nt, Mycobacterium avium subsp. paratuberculosis
gcccaucaccagcagacccgac

SEQ ID NO: 3024410 - RNA, 16 nt, Mycobacterium avium subsp. paratuberculosis
gcccaucaccagcggc

SEQ ID NO: 3024411 - RNA, 22 nt, Mycobacterium avium subsp. paratuberculosis
gcccaucaccagcggcugcagc

SEQ ID NO: 3024412 - RNA, 13 nt, Mycobacterium avium subsp. paratuberculosis
gcccaucaccccg

SEQ ID NO: 3024413 - RNA, 16 nt, Mycobacterium avium subsp. paratuberculosis
gcccaucaccgcaccg

SEQ ID NO: 3024414 - RNA, 13 nt, Mycobacterium avium subsp. paratuberculosis
gcccaucaccgga

SEQ ID NO: 3024415 - RNA, 14 nt, Mycobacterium avium subsp. paratuberculosis
gcccaucaccggac

SEQ ID NO: 3024416 - RNA, 22 nt, Mycobacterium avium subsp. paratuberculosis
gcccaucaccggaccggccagc

SEQ ID NO: 3024417 - RNA, 13 nt, Mycobacterium avium subsp. paratuberculosis
gcccaucagcacg

SEQ ID NO: 3024418 - RNA, 12 nt, Mycobacterium avium subsp. paratuberculosis
gcccaucagcag

SEQ ID NO: 3024419 - RNA, 21 nt, Mycobacterium avium subsp. paratuberculosis
gcccaucagcaggaccaggcc

SEQ ID NO: 3024420 - RNA, 15 nt, Mycobacterium avium subsp. paratuberculosis
gcccauccaggccag

SEQ ID NO: 3024421 - RNA, 18 nt, Mycobacterium avium subsp. paratuberculosis
gcccauccaggccagcac

SEQ ID NO: 3024422 - RNA, 17 nt, Mycobacterium avium subsp. paratuberculosis
gcccaucccgauccgcg

SEQ ID NO: 3024423 - RNA, 12 nt, Mycobacterium avium subsp. paratuberculosis
gcccauccggcg

SEQ ID NO: 3024424 - RNA, 15 nt, Mycobacterium avium subsp. paratuberculosis
gcccauccggcgccg

SEQ ID NO: 3024425 - RNA, 18 nt, Mycobacterium avium subsp. paratuberculosis
gcccauccggcgccgcgc

SEQ ID NO: 3024426 - RNA, 19 nt, Mycobacterium avium subsp. paratuberculosis
gcccauccggcgccgcgca

SEQ ID NO: 3024427 - RNA, 14 nt, Mycobacterium avium subsp. paratuberculosis
gcccaucgaccgga

SEQ ID NO: 3024428 - RNA, 12 nt, Mycobacterium avium subsp. paratuberculosis
gcccaucgccac

SEQ ID NO: 3024429 - RNA, 14 nt, Mycobacterium avium subsp. paratuberculosis
gcccaucgccacgc

SEQ ID NO: 3024430 - RNA, 19 nt, Mycobacterium avium subsp. paratuberculosis
gcccaucgccacgccgugg

SEQ ID NO: 3024431 - RNA, 19 nt, Mycobacterium avium subsp. paratuberculosis
gcccaucgcggccgcccgg

SEQ ID NO: 3024432 - RNA, 20 nt, Mycobacterium avium subsp. paratuberculosis
gcccaucgcggccgcccggu

SEQ ID NO: 3024433 - RNA, 18 nt, Mycobacterium avium subsp. paratuberculosis
gcccaucgcggucagcgu

SEQ ID NO: 3024434 - RNA, 16 nt, Mycobacterium avium subsp. paratuberculosis
gcccaucggcagcccg

SEQ ID NO: 3024435 - RNA, 18 nt, Mycobacterium avium subsp. paratuberculosis
gcccaucggcagcccgga

SEQ ID NO: 3024436 - RNA, 23 nt, Mycobacterium avium subsp. paratuberculosis
gcccaucggcagcccggaggcga

SEQ ID NO: 3024437 - RNA, 17 nt, Mycobacterium avium subsp. paratuberculosis
gcccaucugcacagcuu

SEQ ID NO: 3024438 - RNA, 21 nt, Mycobacterium avium subsp. paratuberculosis
gcccaucugcacagcuucggc

SEQ ID NO: 3024439 - RNA, 19 nt, Mycobacterium avium subsp. paratuberculosis
gcccaugaacgcgucgccg

SEQ ID NO: 3024440 - RNA, 22 nt, Mycobacterium avium subsp. paratuberculosis
gcccaugaacgcgucgccgugc

SEQ ID NO: 3024441 - RNA, 23 nt, Mycobacterium avium subsp. paratuberculosis
gcccaugaacgcgucgccgugcc

SEQ ID NO: 3024442 - RNA, 16 nt, Mycobacterium avium subsp. paratuberculosis
gcccaugaucacaccg

SEQ ID NO: 3024443 - RNA, 17 nt, Mycobacterium avium subsp. paratuberculosis
gcccaugaucacaccgc

SEQ ID NO: 3024444 - RNA, 20 nt, Mycobacterium avium subsp. paratuberculosis
gcccaugaucacaccgcugu

SEQ ID NO: 3024445 - RNA, 14 nt, Mycobacterium avium subsp. paratuberculosis
gcccaugccgaugc

SEQ ID NO: 3024446 - RNA, 22 nt, Mycobacterium avium subsp. paratuberculosis
gcccauguccagguacgcgacg

SEQ ID NO: 3024447 - RNA, 17 nt, Mycobacterium avium subsp. paratuberculosis
gcccaugucgaucggcu

SEQ ID NO: 3024448 - RNA, 14 nt, Mycobacterium avium subsp. paratuberculosis
gcccaugucgccgg

SEQ ID NO: 3024449 - RNA, 18 nt, Mycobacterium avium subsp. paratuberculosis
gccccaaaagccuugacg

SEQ ID NO: 3024450 - RNA, 14 nt, Mycobacterium avium subsp. paratuberculosis
gccccaaccccccu

SEQ ID NO: 3024451 - RNA, 14 nt, Mycobacterium avium subsp. paratuberculosis
gccccaacggcgug

SEQ ID NO: 3024452 - RNA, 15 nt, Mycobacterium avium subsp. paratuberculosis
gccccaacggcgugc

SEQ ID NO: 3024453 - RNA, 17 nt, Mycobacterium avium subsp. paratuberculosis
gccccaacggugaucga

SEQ ID NO: 3024454 - RNA, 15 nt, Mycobacterium avium subsp. paratuberculosis
gccccacacgaugcg

SEQ ID NO: 3024455 - RNA, 20 nt, Mycobacterium avium subsp. paratuberculosis
gccccacacgcucggcgcgc

SEQ ID NO: 3024456 - RNA, 23 nt, Mycobacterium avium subsp. paratuberculosis
gccccacauugcugaugcccuug

SEQ ID NO: 3024457 - RNA, 13 nt, Mycobacterium avium subsp. paratuberculosis
gccccaccaccgc

SEQ ID NO: 3024458 - RNA, 15 nt, Mycobacterium avium subsp. paratuberculosis
gccccaccaccgcca

SEQ ID NO: 3024459 - RNA, 16 nt, Mycobacterium avium subsp. paratuberculosis
gccccaccaccgccac

SEQ ID NO: 3024460 - RNA, 21 nt, Mycobacterium avium subsp. paratuberculosis
gccccaccaccgccaccagcg

SEQ ID NO: 3024461 - RNA, 16 nt, Mycobacterium avium subsp. paratuberculosis
gccccaccaccgccgg

SEQ ID NO: 3024462 - RNA, 22 nt, Mycobacterium avium subsp. paratuberculosis
gcccccgcgggucgucgacguc

SEQ ID NO: 3024463 - RNA, 23 nt, Mycobacterium avium subsp. paratuberculosis
gcccccgcgggucgucgacgucg

SEQ ID NO: 3024464 - RNA, 18 nt, Mycobacterium avium subsp. paratuberculosis
gcccccgcuggcccggcg

SEQ ID NO: 3024465 - RNA, 13 nt, Mycobacterium avium subsp. paratuberculosis
gcccccgcuggcg

SEQ ID NO: 3024466 - RNA, 15 nt, Mycobacterium avium subsp. paratuberculosis
gcccccggaccacgu

SEQ ID NO: 3024467 - RNA, 21 nt, Mycobacterium avium subsp. paratuberculosis
gcccccggaccacguccccgg

SEQ ID NO: 3024468 - RNA, 16 nt, Mycobacterium avium subsp. paratuberculosis
gcccccggcucgaucg

SEQ ID NO: 3024469 - RNA, 17 nt, Mycobacterium avium subsp. paratuberculosis
gcccccggcucgaucgc

SEQ ID NO: 3024470 - RNA, 13 nt, Mycobacterium avium subsp. paratuberculosis
gcccccgggcccg

SEQ ID NO: 3024471 - RNA, 17 nt, Mycobacterium avium subsp. paratuberculosis
gcccccgggcccgaagc

SEQ ID NO: 3024472 - RNA, 18 nt, Mycobacterium avium subsp. paratuberculosis
gcccccugaucggccgca

SEQ ID NO: 3024473 - RNA, 17 nt, Mycobacterium avium subsp. paratuberculosis
gcccccugcucagcggc

SEQ ID NO: 3024474 - RNA, 19 nt, Mycobacterium avium subsp. paratuberculosis
gcccccugcucagcggcca

SEQ ID NO: 3024475 - RNA, 18 nt, Mycobacterium avium subsp. paratuberculosis
gccccgacagcaacgcca

SEQ ID NO: 3024476 - RNA, 21 nt, Mycobacterium avium subsp. paratuberculosis
gccccgacagcaacgccaggg

SEQ ID NO: 3024477 - RNA, 18 nt, Mycobacterium avium subsp. paratuberculosis
gccccgacaucgccauca

SEQ ID NO: 3024478 - RNA, 20 nt, Mycobacterium avium subsp. paratuberculosis
gccccgacgaucgcgccggc

SEQ ID NO: 3024479 - RNA, 21 nt, Mycobacterium avium subsp. paratuberculosis
gccccgacgaucgcgccggcc

SEQ ID NO: 3024480 - RNA, 22 nt, Mycobacterium avium subsp. paratuberculosis
gccccgacgugcagcgccagca

SEQ ID NO: 3024481 - RNA, 23 nt, Mycobacterium avium subsp. paratuberculosis
gccccgacgugcagcgccagcac

SEQ ID NO: 3024482 - RNA, 16 nt, Mycobacterium avium subsp. paratuberculosis
gccccgagaucccagc

SEQ ID NO: 3024483 - RNA, 14 nt, Mycobacterium avium subsp. paratuberculosis
gccccgagcagcgg

SEQ ID NO: 3024484 - RNA, 17 nt, Mycobacterium avium subsp. paratuberculosis
gccccgagccgacgaug

SEQ ID NO: 3024485 - RNA, 14 nt, Mycobacterium avium subsp. paratuberculosis
gccccgagccgcgg

SEQ ID NO: 3024486 - RNA, 15 nt, Mycobacterium avium subsp. paratuberculosis
gccccgagccgcgga

SEQ ID NO: 3024487 - RNA, 14 nt, Mycobacterium avium subsp. paratuberculosis
gccccgagcgucac

SEQ ID NO: 3024488 - RNA, 18 nt, Mycobacterium avium subsp. paratuberculosis
gccccgagcgucacgcca

SEQ ID NO: 3024489 - RNA, 17 nt, Mycobacterium avium subsp. paratuberculosis
gccccgaguccacgacg

SEQ ID NO: 3024490 - RNA, 23 nt, Mycobacterium avium subsp. paratuberculosis
gccccgaucggauccgccugccc

SEQ ID NO: 3024491 - RNA, 21 nt, Mycobacterium avium subsp. paratuberculosis
gccccgaugguauccgaucgc

SEQ ID NO: 3024492 - RNA, 15 nt, Mycobacterium avium subsp. paratuberculosis
gccccgcaccgagcc

SEQ ID NO: 3024493 - RNA, 13 nt, Mycobacterium avium subsp. paratuberculosis
gccccgcaccgcc

SEQ ID NO: 3024494 - RNA, 17 nt, Mycobacterium avium subsp. paratuberculosis
gccccgcaccgccaggc

SEQ ID NO: 3024495 - RNA, 21 nt, Mycobacterium avium subsp. paratuberculosis
gccccgccagauagggcagcg

SEQ ID NO: 3024496 - RNA, 23 nt, Mycobacterium avium subsp. paratuberculosis
gccccgccagauagggcagcguc

SEQ ID NO: 3024497 - RNA, 13 nt, Mycobacterium avium subsp. paratuberculosis
gccccgccagcag

SEQ ID NO: 3024498 - RNA, 14 nt, Mycobacterium avium subsp. paratuberculosis
gccccgccagcaga

SEQ ID NO: 3024499 - RNA, 21 nt, Mycobacterium avium subsp. paratuberculosis
gccccgccagcagaugccgcc

SEQ ID NO: 3024500 - RNA, 12 nt, Mycobacterium avium subsp. paratuberculosis
gccccgccaggc

SEQ ID NO: 3024501 - RNA, 13 nt, Mycobacterium avium subsp. paratuberculosis
gccccgccaggcg

SEQ ID NO: 3024502 - RNA, 17 nt, Mycobacterium avium subsp. paratuberculosis
gccccgccaggcggcga

SEQ ID NO: 3024503 - RNA, 15 nt, Mycobacterium avium subsp. paratuberculosis
gccccgcccgcgacu

SEQ ID NO: 3024504 - RNA, 13 nt, Mycobacterium avium subsp. paratuberculosis
gccccgcccggcg

SEQ ID NO: 3024505 - RNA, 16 nt, Mycobacterium avium subsp. paratuberculosis
gccccgcccggcgcgc

SEQ ID NO: 3024506 - RNA, 21 nt, Mycobacterium avium subsp. paratuberculosis
gccccgcccggcgcgcagccc

SEQ ID NO: 3024507 - RNA, 14 nt, Mycobacterium avium subsp. paratuberculosis
gccccgcccggcgg

SEQ ID NO: 3024508 - RNA, 16 nt, Mycobacterium avium subsp. paratuberculosis
gccccgcccggcggcc

SEQ ID NO: 3024509 - RNA, 17 nt, Mycobacterium avium subsp. paratuberculosis
gccccgcccggcggcca

SEQ ID NO: 3024510 - RNA, 19 nt, Mycobacterium avium subsp. paratuberculosis
gccccgcccggcggccacc

SEQ ID NO: 3024511 - RNA, 21 nt, Mycobacterium avium subsp. paratuberculosis
gccccgcccggcggccaccau

SEQ ID NO: 3024512 - RNA, 13 nt, Mycobacterium avium subsp. paratuberculosis
gccccgcccgggg

SEQ ID NO: 3024513 - RNA, 15 nt, Mycobacterium avium subsp. paratuberculosis
gccccgcccggggcg

SEQ ID NO: 3024514 - RNA, 16 nt, Mycobacterium avium subsp. paratuberculosis
gccccgccgcgccggg

SEQ ID NO: 3024515 - RNA, 16 nt, Mycobacterium avium subsp. paratuberculosis
gccccgccgcggccag

SEQ ID NO: 3024516 - RNA, 22 nt, Mycobacterium avium subsp. paratuberculosis
gccccgccgcggccaggucgag

SEQ ID NO: 3024517 - RNA, 22 nt, Mycobacterium avium subsp. paratuberculosis
gccccgccgggaucggcggggc

SEQ ID NO: 3024518 - RNA, 13 nt, Mycobacterium avium subsp. paratuberculosis
gccccgccggggg

SEQ ID NO: 3024519 - RNA, 18 nt, Mycobacterium avium subsp. paratuberculosis
gccccgccgggguccgca

SEQ ID NO: 3024520 - RNA, 18 nt, Mycobacterium avium subsp. paratuberculosis
gccccgccggugucggcg

SEQ ID NO: 3024521 - RNA, 19 nt, Mycobacterium avium subsp. paratuberculosis
gccccgccggugucggcga

SEQ ID NO: 3024522 - RNA, 20 nt, Mycobacterium avium subsp. paratuberculosis
gccccgccguuucagcagcg

SEQ ID NO: 3024523 - RNA, 23 nt, Mycobacterium avium subsp. paratuberculosis
gccccgccguuucagcagcgcgu

SEQ ID NO: 3024524 - RNA, 12 nt, Mycobacterium avium subsp. paratuberculosis
gccccgcgacac

SEQ ID NO: 3024525 - RNA, 14 nt, Mycobacterium avium subsp. paratuberculosis
gccccgcgacacgc

SEQ ID NO: 3024526 - RNA, 16 nt, Mycobacterium avium subsp. paratuberculosis
gccccgcgacacgccg

SEQ ID NO: 3024527 - RNA, 19 nt, Mycobacterium avium subsp. paratuberculosis
gccccgcgacacgccgcgc

SEQ ID NO: 3024528 - RNA, 20 nt, Mycobacterium avium subsp. paratuberculosis
gccccgcgacacgccgcgca

SEQ ID NO: 3024529 - RNA, 13 nt, Mycobacterium avium subsp. paratuberculosis
gccccgcgaccgc

SEQ ID NO: 3024530 - RNA, 17 nt, Mycobacterium avium subsp. paratuberculosis
gccccgcgaccgcagca

SEQ ID NO: 3024531 - RNA, 22 nt, Mycobacterium avium subsp. paratuberculosis
gccccgcgcgaucaggccggcc

SEQ ID NO: 3024532 - RNA, 13 nt, Mycobacterium avium subsp. paratuberculosis
gccccgcgugacg

SEQ ID NO: 3024533 - RNA, 14 nt, Mycobacterium avium subsp. paratuberculosis
gccccgcgugacgg

SEQ ID NO: 3024534 - RNA, 17 nt, Mycobacterium avium subsp. paratuberculosis
gccccgcgugacggccg

SEQ ID NO: 3024535 - RNA, 18 nt, Mycobacterium avium subsp. paratuberculosis
gccccgcgugacggccgc

SEQ ID NO: 3024536 - RNA, 19 nt, Mycobacterium avium subsp. paratuberculosis
gccccgcgugacggccgcg

SEQ ID NO: 3024537 - RNA, 21 nt, Mycobacterium avium subsp. paratuberculosis
gccccgcgugacggccgcggc

SEQ ID NO: 3024538 - RNA, 22 nt, Mycobacterium avium subsp. paratuberculosis
gccccgcuaaagccgacugccc

SEQ ID NO: 3024539 - RNA, 17 nt, Mycobacterium avium subsp. paratuberculosis
gccccgcuccuccucgc

SEQ ID NO: 3024540 - RNA, 19 nt, Mycobacterium avium subsp. paratuberculosis
gccccgcuccuccucgcgc

SEQ ID NO: 3024541 - RNA, 16 nt, Mycobacterium avium subsp. paratuberculosis
gccccgcugccguccg

SEQ ID NO: 3024542 - RNA, 20 nt, Mycobacterium avium subsp. paratuberculosis
gccccgcugccguccggcgg

SEQ ID NO: 3024543 - RNA, 22 nt, Mycobacterium avium subsp. paratuberculosis
gccccgcugccguccggcggca

SEQ ID NO: 3024544 - RNA, 18 nt, Mycobacterium avium subsp. paratuberculosis
gccccgcuggaacgccga

SEQ ID NO: 3024545 - RNA, 22 nt, Mycobacterium avium subsp. paratuberculosis
gccccggagaugguggcguagc

SEQ ID NO: 3024546 - RNA, 18 nt, Mycobacterium avium subsp. paratuberculosis
gccccucgacccgaagcc

SEQ ID NO: 3024547 - RNA, 12 nt, Mycobacterium avium subsp. paratuberculosis
gccccucgacga

SEQ ID NO: 3024548 - RNA, 20 nt, Mycobacterium avium subsp. paratuberculosis
gccccucgacgaacgcggcg

SEQ ID NO: 3024549 - RNA, 22 nt, Mycobacterium avium subsp. paratuberculosis
gccccucgacgaacgcggcgga

SEQ ID NO: 3024550 - RNA, 15 nt, Mycobacterium avium subsp. paratuberculosis
gccccucgacgucca

SEQ ID NO: 3024551 - RNA, 19 nt, Mycobacterium avium subsp. paratuberculosis
gccccucgacguccaggcc

SEQ ID NO: 3024552 - RNA, 22 nt, Mycobacterium avium subsp. paratuberculosis
gccccucgacguccaggccggc

SEQ ID NO: 3024553 - RNA, 15 nt, Mycobacterium avium subsp. paratuberculosis
gccccucgccgggcg

SEQ ID NO: 3024554 - RNA, 19 nt, Mycobacterium avium subsp. paratuberculosis
gccccucgccgggcgucac

SEQ ID NO: 3024555 - RNA, 14 nt, Mycobacterium avium subsp. paratuberculosis
gccccucggggcug

SEQ ID NO: 3024556 - RNA, 15 nt, Mycobacterium avium subsp. paratuberculosis
gccccucggggcugc

SEQ ID NO: 3024557 - RNA, 19 nt, Mycobacterium avium subsp. paratuberculosis
gccccucggggcugcgcgg

SEQ ID NO: 3024558 - RNA, 21 nt, Mycobacterium avium subsp. paratuberculosis
gccccucggggcugcgcggcu

SEQ ID NO: 3024559 - RNA, 19 nt, Mycobacterium avium subsp. paratuberculosis
gccccucguccaggugcac

SEQ ID NO: 3024560 - RNA, 20 nt, Mycobacterium avium subsp. paratuberculosis
gccccugagggugucggcga

SEQ ID NO: 3024561 - RNA, 14 nt, Mycobacterium avium subsp. paratuberculosis
gccccugcaccacg

SEQ ID NO: 3024562 - RNA, 14 nt, Mycobacterium avium subsp. paratuberculosis
gccccugcggggug

SEQ ID NO: 3024563 - RNA, 15 nt, Mycobacterium avium subsp. paratuberculosis
gccccugcggggugu

SEQ ID NO: 3024564 - RNA, 16 nt, Mycobacterium avium subsp. paratuberculosis
gccccugcgggguguc

SEQ ID NO: 3024565 - RNA, 19 nt, Mycobacterium avium subsp. paratuberculosis
gccccugcggggugucgac

SEQ ID NO: 3024566 - RNA, 17 nt, Mycobacterium avium subsp. paratuberculosis
gccccuggcgucgggcu

SEQ ID NO: 3024567 - RNA, 15 nt, Mycobacterium avium subsp. paratuberculosis
gccccuuaccggccg

SEQ ID NO: 3024568 - RNA, 14 nt, Mycobacterium avium subsp. paratuberculosis
gccccuucgauguc

SEQ ID NO: 3024569 - RNA, 20 nt, Mycobacterium avium subsp. paratuberculosis
gccccuucgaugucgccggc

SEQ ID NO: 3024570 - RNA, 21 nt, Mycobacterium avium subsp. paratuberculosis
gccccuucgaugucgccggcg

SEQ ID NO: 3024571 - RNA, 14 nt, Mycobacterium avium subsp. paratuberculosis
gccccuucgcgaca

SEQ ID NO: 3024572 - RNA, 17 nt, Mycobacterium avium subsp. paratuberculosis
gcccgaaaacgcccggg

SEQ ID NO: 3024573 - RNA, 18 nt, Mycobacterium avium subsp. paratuberculosis
gcccgaaaacgcccgggu

SEQ ID NO: 3024574 - RNA, 17 nt, Mycobacterium avium subsp. paratuberculosis
gcccgaaacgucgcagc

SEQ ID NO: 3024575 - RNA, 18 nt, Mycobacterium avium subsp. paratuberculosis
gcccgaaacgucgcagcc

SEQ ID NO: 3024576 - RNA, 20 nt, Mycobacterium avium subsp. paratuberculosis
gcccgaaaguccccgggugg

SEQ ID NO: 3024577 - RNA, 15 nt, Mycobacterium avium subsp. paratuberculosis
gcccgaacaccuccu

SEQ ID NO: 3024578 - RNA, 19 nt, Mycobacterium avium subsp. paratuberculosis
gcccgaacaccuccucggu

SEQ ID NO: 3024579 - RNA, 19 nt, Mycobacterium avium subsp. paratuberculosis
gcccgaacacgggcggcag

SEQ ID NO: 3024580 - RNA, 13 nt, Mycobacterium avium subsp. paratuberculosis
gcccgaacagccg

SEQ ID NO: 3024581 - RNA, 15 nt, Mycobacterium avium subsp. paratuberculosis
gcccgaacagccggg

SEQ ID NO: 3024582 - RNA, 18 nt, Mycobacterium avium subsp. paratuberculosis
gcccgaacagccgggcca

SEQ ID NO: 3024583 - RNA, 23 nt, Mycobacterium avium subsp. paratuberculosis
gcccgaacagccgggccagcagc

SEQ ID NO: 3024584 - RNA, 17 nt, Mycobacterium avium subsp. paratuberculosis
gcccgaacagccgggcg

SEQ ID NO: 3024585 - RNA, 19 nt, Mycobacterium avium subsp. paratuberculosis
gcccgaacagccgggcggc

SEQ ID NO: 3024586 - RNA, 21 nt, Mycobacterium avium subsp. paratuberculosis
gcccgaacagccgggcggccg

SEQ ID NO: 3024587 - RNA, 21 nt, Mycobacterium avium subsp. paratuberculosis
gcccgaacaucgccucggccg

SEQ ID NO: 3024588 - RNA, 15 nt, Mycobacterium avium subsp. paratuberculosis
gcccgaaccgcgucc

SEQ ID NO: 3024589 - RNA, 16 nt, Mycobacterium avium subsp. paratuberculosis
gcccgaaccgcgucca

SEQ ID NO: 3024590 - RNA, 18 nt, Mycobacterium avium subsp. paratuberculosis
gcccgaaccgcguccacg

SEQ ID NO: 3024591 - RNA, 14 nt, Mycobacterium avium subsp. paratuberculosis
gcccgaacgcgcgu

SEQ ID NO: 3024592 - RNA, 15 nt, Mycobacterium avium subsp. paratuberculosis
gcccgaacgcgcguc

SEQ ID NO: 3024593 - RNA, 16 nt, Mycobacterium avium subsp. paratuberculosis
gcccgaacgcgcgucg

SEQ ID NO: 3024594 - RNA, 18 nt, Mycobacterium avium subsp. paratuberculosis
gcccgaacgcgcgucggu

SEQ ID NO: 3024595 - RNA, 19 nt, Mycobacterium avium subsp. paratuberculosis
gcccgaacucauggcgugc

SEQ ID NO: 3024596 - RNA, 21 nt, Mycobacterium avium subsp. paratuberculosis
gcccgaauugcgcugcaccgc

SEQ ID NO: 3024597 - RNA, 14 nt, Mycobacterium avium subsp. paratuberculosis
gcccgacaccgccc

SEQ ID NO: 3024598 - RNA, 18 nt, Mycobacterium avium subsp. paratuberculosis
gcccgacaccgccccgcc

SEQ ID NO: 3024599 - RNA, 23 nt, Mycobacterium avium subsp. paratuberculosis
gcccgacaccgccccgccgcgcc

SEQ ID NO: 3024600 - RNA, 24 nt, Mycobacterium avium subsp. paratuberculosis
gcccgacaccgccccgccgcgccg

SEQ ID NO: 3024601 - RNA, 22 nt, Mycobacterium avium subsp. paratuberculosis
gcccgacauccaggaccgcgcg

SEQ ID NO: 3024602 - RNA, 18 nt, Mycobacterium avium subsp. paratuberculosis
gcccgacaucugccgggc

SEQ ID NO: 3024603 - RNA, 21 nt, Mycobacterium avium subsp. paratuberculosis
gcccgacaucugccgggcggc

SEQ ID NO: 3024604 - RNA, 22 nt, Mycobacterium avium subsp. paratuberculosis
gcccgaccaccuccccgcggug

SEQ ID NO: 3024605 - RNA, 16 nt, Mycobacterium avium subsp. paratuberculosis
gcccgaccagcgggcc

SEQ ID NO: 3024606 - RNA, 18 nt, Mycobacterium avium subsp. paratuberculosis
gcccgaccagcgggccga

SEQ ID NO: 3024607 - RNA, 13 nt, Mycobacterium avium subsp. paratuberculosis
gcccgacccgcac

SEQ ID NO: 3024608 - RNA, 16 nt, Mycobacterium avium subsp. paratuberculosis
gcccgacccgcaccac

SEQ ID NO: 3024609 - RNA, 17 nt, Mycobacterium avium subsp. paratuberculosis
gcccgacccgcaccacc

SEQ ID NO: 3024610 - RNA, 18 nt, Mycobacterium avium subsp. paratuberculosis
gcccgacccgcaccaccg

SEQ ID NO: 3024611 - RNA, 22 nt, Mycobacterium avium subsp. paratuberculosis
gcccgacccgcaccaccgcccg

SEQ ID NO: 3024612 - RNA, 12 nt, Mycobacterium avium subsp. paratuberculosis
gcccgacccggc

SEQ ID NO: 3024613 - RNA, 16 nt, Mycobacterium avium subsp. paratuberculosis
gcccgacccguccagc

SEQ ID NO: 3024614 - RNA, 20 nt, Mycobacterium avium subsp. paratuberculosis
gcccgacccguccagcagca

SEQ ID NO: 3024615 - RNA, 21 nt, Mycobacterium avium subsp. paratuberculosis
gcccgacccguccagcagcau

SEQ ID NO: 3024616 - RNA, 12 nt, Mycobacterium avium subsp. paratuberculosis
gcccgaccgcgc

SEQ ID NO: 3024617 - RNA, 15 nt, Mycobacterium avium subsp. paratuberculosis
gcccgaccgcgccga

SEQ ID NO: 3024618 - RNA, 17 nt, Mycobacterium avium subsp. paratuberculosis
gcccgaccgcgccgaac

SEQ ID NO: 3024619 - RNA, 18 nt, Mycobacterium avium subsp. paratuberculosis
gcccgaccuucugcugca

SEQ ID NO: 3024620 - RNA, 16 nt, Mycobacterium avium subsp. paratuberculosis
gcccgacgacgacguc

SEQ ID NO: 3024621 - RNA, 17 nt, Mycobacterium avium subsp. paratuberculosis
gcccgacgacgacgucg

SEQ ID NO: 3024622 - RNA, 14 nt, Mycobacterium avium subsp. paratuberculosis
gcccgacgacgauc

SEQ ID NO: 3024623 - RNA, 17 nt, Mycobacterium avium subsp. paratuberculosis
gcccgacgacgccguca

SEQ ID NO: 3024624 - RNA, 13 nt, Mycobacterium avium subsp. paratuberculosis
gcccgacgagucg

SEQ ID NO: 3024625 - RNA, 19 nt, Mycobacterium avium subsp. paratuberculosis
gcccgacgagucgccguug

SEQ ID NO: 3024626 - RNA, 11 nt, Mycobacterium avium subsp. paratuberculosis
gcccgacgaug

SEQ ID NO: 3024627 - RNA, 19 nt, Mycobacterium avium subsp. paratuberculosis
gcccgacgaugcggggcgg

SEQ ID NO: 3024628 - RNA, 12 nt, Mycobacterium avium subsp. paratuberculosis
gcccgacgccgg

SEQ ID NO: 3024629 - RNA, 13 nt, Mycobacterium avium subsp. paratuberculosis
gcccgacgccgga

SEQ ID NO: 3024630 - RNA, 17 nt, Mycobacterium avium subsp. paratuberculosis
gcccgacggauucccga

SEQ ID NO: 3024631 - RNA, 18 nt, Mycobacterium avium subsp. paratuberculosis
gcccgcaaaucagccgag

SEQ ID NO: 3024632 - RNA, 20 nt, Mycobacterium avium subsp. paratuberculosis
gcccgcaaaucagccgagcc

SEQ ID NO: 3024633 - RNA, 19 nt, Mycobacterium avium subsp. paratuberculosis
gcccgcaacuccacaacca

SEQ ID NO: 3024634 - RNA, 23 nt, Mycobacterium avium subsp. paratuberculosis
gcccgcaacuccacaaccagcga

SEQ ID NO: 3024635 - RNA, 19 nt, Mycobacterium avium subsp. paratuberculosis
gcccgcaacuguucgcggc

SEQ ID NO: 3024636 - RNA, 21 nt, Mycobacterium avium subsp. paratuberculosis
gcccgcaacuguucgcggcug

SEQ ID NO: 3024637 - RNA, 13 nt, Mycobacterium avium subsp. paratuberculosis
gcccgcaccaccc

SEQ ID NO: 3024638 - RNA, 18 nt, Mycobacterium avium subsp. paratuberculosis
gcccgcaccagcaggucc

SEQ ID NO: 3024639 - RNA, 12 nt, Mycobacterium avium subsp. paratuberculosis
gcccgcacccgc

SEQ ID NO: 3024640 - RNA, 15 nt, Mycobacterium avium subsp. paratuberculosis
gcccgcacccgccgc

SEQ ID NO: 3024641 - RNA, 16 nt, Mycobacterium avium subsp. paratuberculosis
gcccgcacccgccgcc

SEQ ID NO: 3024642 - RNA, 19 nt, Mycobacterium avium subsp. paratuberculosis
gcccgcacccgccgcccga

SEQ ID NO: 3024643 - RNA, 23 nt, Mycobacterium avium subsp. paratuberculosis
gcccgcacccuugacuaccgcgc

SEQ ID NO: 3024644 - RNA, 16 nt, Mycobacterium avium subsp. paratuberculosis
gcccgcaccugcgcgc

SEQ ID NO: 3024645 - RNA, 18 nt, Mycobacterium avium subsp. paratuberculosis
gcccgcaccugcgcgccg

SEQ ID NO: 3024646 - RNA, 20 nt, Mycobacterium avium subsp. paratuberculosis
gcccgcaccugcgcgccguu

SEQ ID NO: 3024647 - RNA, 21 nt, Mycobacterium avium subsp. paratuberculosis
gcccgcaccugcgcgccguug

SEQ ID NO: 3024648 - RNA, 13 nt, Mycobacterium avium subsp. paratuberculosis
gcccgcacggccg

SEQ ID NO: 3024649 - RNA, 14 nt, Mycobacterium avium subsp. paratuberculosis
gcccgcacggccgc

SEQ ID NO: 3024650 - RNA, 15 nt, Mycobacterium avium subsp. paratuberculosis
gcccgcacggccgcc

SEQ ID NO: 3024651 - RNA, 15 nt, Mycobacterium avium subsp. paratuberculosis
gcccgcacguagacg

SEQ ID NO: 3024652 - RNA, 20 nt, Mycobacterium avium subsp. paratuberculosis
gcccgcacuggucgugcugg

SEQ ID NO: 3024653 - RNA, 21 nt, Mycobacterium avium subsp. paratuberculosis
gcccgcagcacgcccguagcg

SEQ ID NO: 3024654 - RNA, 12 nt, Mycobacterium avium subsp. paratuberculosis
gcccgcagcauc

SEQ ID NO: 3024655 - RNA, 15 nt, Mycobacterium avium subsp. paratuberculosis
gcccgcagccagcgc

SEQ ID NO: 3024656 - RNA, 19 nt, Mycobacterium avium subsp. paratuberculosis
gcccgcagccagcgcagca

SEQ ID NO: 3024657 - RNA, 16 nt, Mycobacterium avium subsp. paratuberculosis
gcccgcagccgcuggc

SEQ ID NO: 3024658 - RNA, 22 nt, Mycobacterium avium subsp. paratuberculosis
gcccgcagccgcuggccgcgcc

SEQ ID NO: 3024659 - RNA, 14 nt, Mycobacterium avium subsp. paratuberculosis
gcccgcagcgcauc

SEQ ID NO: 3024660 - RNA, 17 nt, Mycobacterium avium subsp. paratuberculosis
gcccgcagcgccucggc

SEQ ID NO: 3024661 - RNA, 18 nt, Mycobacterium avium subsp. paratuberculosis
gcccgcagcgccucggcg

SEQ ID NO: 3024662 - RNA, 12 nt, Mycobacterium avium subsp. paratuberculosis
gcccgcagcucg

SEQ ID NO: 3024663 - RNA, 15 nt, Mycobacterium avium subsp. paratuberculosis
gcccgcagcucggag

SEQ ID NO: 3024664 - RNA, 15 nt, Mycobacterium avium subsp. paratuberculosis
gcccgcaggaucgag

SEQ ID NO: 3024665 - RNA, 17 nt, Mycobacterium avium subsp. paratuberculosis
gcccgcaggaucgagcc

SEQ ID NO: 3024666 - RNA, 21 nt, Mycobacterium avium subsp. paratuberculosis
gcccgcaggaucgagccggcc

SEQ ID NO: 3024667 - RNA, 18 nt, Mycobacterium avium subsp. paratuberculosis
gcccgcaguucggccgcc

SEQ ID NO: 3024668 - RNA, 19 nt, Mycobacterium avium subsp. paratuberculosis
gcccgcaguucggccgccg

SEQ ID NO: 3024669 - RNA, 21 nt, Mycobacterium avium subsp. paratuberculosis
gcccgcaguucggccgccgug

SEQ ID NO: 3024670 - RNA, 22 nt, Mycobacterium avium subsp. paratuberculosis
gcccgcaguucggccgccgugc

SEQ ID NO: 3024671 - RNA, 13 nt, Mycobacterium avium subsp. paratuberculosis
gcccgcaucgacg

SEQ ID NO: 3024672 - RNA, 15 nt, Mycobacterium avium subsp. paratuberculosis
gcccgcaucgcacag

SEQ ID NO: 3024673 - RNA, 22 nt, Mycobacterium avium subsp. paratuberculosis
gcccgcaucgcacagauacgcg

SEQ ID NO: 3024674 - RNA, 15 nt, Mycobacterium avium subsp. paratuberculosis
gcccgcaucgcggcg

SEQ ID NO: 3024675 - RNA, 17 nt, Mycobacterium avium subsp. paratuberculosis
gcccgcaucgcggcgau

SEQ ID NO: 3024676 - RNA, 19 nt, Mycobacterium avium subsp. paratuberculosis
gcccgcauguucucgagcc

SEQ ID NO: 3024677 - RNA, 22 nt, Mycobacterium avium subsp. paratuberculosis
gcccgcauguucucgagcccga

SEQ ID NO: 3024678 - RNA, 18 nt, Mycobacterium avium subsp. paratuberculosis
gcccgccaaaacggggug

SEQ ID NO: 3024679 - RNA, 16 nt, Mycobacterium avium subsp. paratuberculosis
gcccgccacccgaggc

SEQ ID NO: 3024680 - RNA, 18 nt, Mycobacterium avium subsp. paratuberculosis
gcccgccacccgaggccg

SEQ ID NO: 3024681 - RNA, 14 nt, Mycobacterium avium subsp. paratuberculosis
gcccgccacggcca

SEQ ID NO: 3024682 - RNA, 16 nt, Mycobacterium avium subsp. paratuberculosis
gcccgccacggccagc

SEQ ID NO: 3024683 - RNA, 14 nt, Mycobacterium avium subsp. paratuberculosis
gcccgccacgugcg

SEQ ID NO: 3024684 - RNA, 15 nt, Mycobacterium avium subsp. paratuberculosis
gcccgccacgugcgg

SEQ ID NO: 3024685 - RNA, 12 nt, Mycobacterium avium subsp. paratuberculosis
gcccgccagauc

SEQ ID NO: 3024686 - RNA, 13 nt, Mycobacterium avium subsp. paratuberculosis
gcccgccagcaug

SEQ ID NO: 3024687 - RNA, 23 nt, Mycobacterium avium subsp. paratuberculosis
gcccgccaggaauaacgccggcc

SEQ ID NO: 3024688 - RNA, 15 nt, Mycobacterium avium subsp. paratuberculosis
gcccgccaucgcccg

SEQ ID NO: 3024689 - RNA, 18 nt, Mycobacterium avium subsp. paratuberculosis
gcccgccaucgcccggug

SEQ ID NO: 3024690 - RNA, 13 nt, Mycobacterium avium subsp. paratuberculosis
gcccgcccaccac

SEQ ID NO: 3024691 - RNA, 14 nt, Mycobacterium avium subsp. paratuberculosis
gcccgcccaccacg

SEQ ID NO: 3024692 - RNA, 19 nt, Mycobacterium avium subsp. paratuberculosis
gcccgcccaccacgaacgc

SEQ ID NO: 3024693 - RNA, 22 nt, Mycobacterium avium subsp. paratuberculosis
gcccgcccaccacgaacgcgcc

SEQ ID NO: 3024694 - RNA, 13 nt, Mycobacterium avium subsp. paratuberculosis
gcccgcccagcgc

SEQ ID NO: 3024695 - RNA, 16 nt, Mycobacterium avium subsp. paratuberculosis
gcccgcccagcgcagc

SEQ ID NO: 3024696 - RNA, 15 nt, Mycobacterium avium subsp. paratuberculosis
gcccgcccagcgcca

SEQ ID NO: 3024697 - RNA, 17 nt, Mycobacterium avium subsp. paratuberculosis
gcccgcccagcgccacg

SEQ ID NO: 3024698 - RNA, 19 nt, Mycobacterium avium subsp. paratuberculosis
gcccgcccagcgccacggu

SEQ ID NO: 3024699 - RNA, 13 nt, Mycobacterium avium subsp. paratuberculosis
gcccgcccagcug

SEQ ID NO: 3024700 - RNA, 17 nt, Mycobacterium avium subsp. paratuberculosis
gcccgcccagcugcacc

SEQ ID NO: 3024701 - RNA, 13 nt, Mycobacterium avium subsp. paratuberculosis
gcccgcccaggcc

SEQ ID NO: 3024702 - RNA, 14 nt, Mycobacterium avium subsp. paratuberculosis
gcccgcccaggccg

SEQ ID NO: 3024703 - RNA, 17 nt, Mycobacterium avium subsp. paratuberculosis
gcccgcccaggccgcca

SEQ ID NO: 3024704 - RNA, 13 nt, Mycobacterium avium subsp. paratuberculosis
gcccgccccgacg

SEQ ID NO: 3024705 - RNA, 16 nt, Mycobacterium avium subsp. paratuberculosis
gcccgccccgacgugc

SEQ ID NO: 3024706 - RNA, 17 nt, Mycobacterium avium subsp. paratuberculosis
gcccgccccgacgugca

SEQ ID NO: 3024707 - RNA, 23 nt, Mycobacterium avium subsp. paratuberculosis
gcccgccccgacgugcagcgcca

SEQ ID NO: 3024708 - RNA, 16 nt, Mycobacterium avium subsp. paratuberculosis
gcccgccccgcccggc

SEQ ID NO: 3024709 - RNA, 19 nt, Mycobacterium avium subsp. paratuberculosis
gcccgccccgcccggcggc

SEQ ID NO: 3024710 - RNA, 20 nt, Mycobacterium avium subsp. paratuberculosis
gcccgccccgcccggcggcc

SEQ ID NO: 3024711 - RNA, 21 nt, Mycobacterium avium subsp. paratuberculosis
gcccgccccgcccggcggcca

SEQ ID NO: 3024712 - RNA, 13 nt, Mycobacterium avium subsp. paratuberculosis
gcccgcccgagag

SEQ ID NO: 3024713 - RNA, 19 nt, Mycobacterium avium subsp. paratuberculosis
gcccgcccgagaguccgcc

SEQ ID NO: 3024714 - RNA, 23 nt, Mycobacterium avium subsp. paratuberculosis
gcccgcccgagaguccgccgccg

SEQ ID NO: 3024715 - RNA, 16 nt, Mycobacterium avium subsp. paratuberculosis
gcccgcccgcagcggc

SEQ ID NO: 3024716 - RNA, 19 nt, Mycobacterium avium subsp. paratuberculosis
gcccgccgguggccgcgcu

SEQ ID NO: 3024717 - RNA, 21 nt, Mycobacterium avium subsp. paratuberculosis
gcccgccgguggccgcgcugg

SEQ ID NO: 3024718 - RNA, 15 nt, Mycobacterium avium subsp. paratuberculosis
gcccgccgucgacca

SEQ ID NO: 3024719 - RNA, 20 nt, Mycobacterium avium subsp. paratuberculosis
gcccgccgucgaccacgaag

SEQ ID NO: 3024720 - RNA, 13 nt, Mycobacterium avium subsp. paratuberculosis
gcccgccgucggc

SEQ ID NO: 3024721 - RNA, 14 nt, Mycobacterium avium subsp. paratuberculosis
gcccgccucacagc

SEQ ID NO: 3024722 - RNA, 18 nt, Mycobacterium avium subsp. paratuberculosis
gcccgccucacagcgaca

SEQ ID NO: 3024723 - RNA, 16 nt, Mycobacterium avium subsp. paratuberculosis
gcccgccucgcagcga

SEQ ID NO: 3024724 - RNA, 18 nt, Mycobacterium avium subsp. paratuberculosis
gcccgccucgcagcgaca

SEQ ID NO: 3024725 - RNA, 13 nt, Mycobacterium avium subsp. paratuberculosis
gcccgccucggcg

SEQ ID NO: 3024726 - RNA, 15 nt, Mycobacterium avium subsp. paratuberculosis
gcccgccucggcggc

SEQ ID NO: 3024727 - RNA, 16 nt, Mycobacterium avium subsp. paratuberculosis
gcccgccucggcggcc

SEQ ID NO: 3024728 - RNA, 20 nt, Mycobacterium avium subsp. paratuberculosis
gcccgccucggcggccgccu

SEQ ID NO: 3024729 - RNA, 20 nt, Mycobacterium avium subsp. paratuberculosis
gcccgccuuugagcgacaac

SEQ ID NO: 3024730 - RNA, 22 nt, Mycobacterium avium subsp. paratuberculosis
gcccgcgaaaucuucgccguca

SEQ ID NO: 3024731 - RNA, 15 nt, Mycobacterium avium subsp. paratuberculosis
gcccgcgaacacgcg

SEQ ID NO: 3024732 - RNA, 16 nt, Mycobacterium avium subsp. paratuberculosis
gcccgcgaacacgcga

SEQ ID NO: 3024733 - RNA, 21 nt, Mycobacterium avium subsp. paratuberculosis
gcccgcgaacacgcgaugauc

SEQ ID NO: 3024734 - RNA, 16 nt, Mycobacterium avium subsp. paratuberculosis
gcccgcgacggcgagc

SEQ ID NO: 3024735 - RNA, 22 nt, Mycobacterium avium subsp. paratuberculosis
gcccgcgacggcgagccgggcc

SEQ ID NO: 3024736 - RNA, 13 nt, Mycobacterium avium subsp. paratuberculosis
gcccgcgacgucg

SEQ ID NO: 3024737 - RNA, 14 nt, Mycobacterium avium subsp. paratuberculosis
gcccgcgacgucgg

SEQ ID NO: 3024738 - RNA, 15 nt, Mycobacterium avium subsp. paratuberculosis
gcccgcgacugucgg

SEQ ID NO: 3024739 - RNA, 18 nt, Mycobacterium avium subsp. paratuberculosis
gcccgcgacugucggcgc

SEQ ID NO: 3024740 - RNA, 19 nt, Mycobacterium avium subsp. paratuberculosis
gcccgcgacugucggcgcc

SEQ ID NO: 3024741 - RNA, 18 nt, Mycobacterium avium subsp. paratuberculosis
gcccgcgacugucggcuc

SEQ ID NO: 3024742 - RNA, 23 nt, Mycobacterium avium subsp. paratuberculosis
gcccgcgacugucggcucgcccg

SEQ ID NO: 3024743 - RNA, 20 nt, Mycobacterium avium subsp. paratuberculosis
gcccgcgaucaacaccgguc

SEQ ID NO: 3024744 - RNA, 15 nt, Mycobacterium avium subsp. paratuberculosis
gcccgcgaucgccag

SEQ ID NO: 3024745 - RNA, 19 nt, Mycobacterium avium subsp. paratuberculosis
gcccgcgaucgccagcgcg

SEQ ID NO: 3024746 - RNA, 20 nt, Mycobacterium avium subsp. paratuberculosis
gcccgcgaucggcgccacga

SEQ ID NO: 3024747 - RNA, 15 nt, Mycobacterium avium subsp. paratuberculosis
gcccgcgcaggcccc

SEQ ID NO: 3024748 - RNA, 16 nt, Mycobacterium avium subsp. paratuberculosis
gcccgcgcaggccccg

SEQ ID NO: 3024749 - RNA, 16 nt, Mycobacterium avium subsp. paratuberculosis
gcccgcgcaucccguc

SEQ ID NO: 3024750 - RNA, 20 nt, Mycobacterium avium subsp. paratuberculosis
gcccgcgcaucccgucgacc

SEQ ID NO: 3024751 - RNA, 21 nt, Mycobacterium avium subsp. paratuberculosis
gcccgcgcaucccgucgacca

SEQ ID NO: 3024752 - RNA, 14 nt, Mycobacterium avium subsp. paratuberculosis
gcccgcgccacccc

SEQ ID NO: 3024753 - RNA, 17 nt, Mycobacterium avium subsp. paratuberculosis
gcccgcgccaccccgag

SEQ ID NO: 3024754 - RNA, 13 nt, Mycobacterium avium subsp. paratuberculosis
gcccgcgccagcu

SEQ ID NO: 3024755 - RNA, 17 nt, Mycobacterium avium subsp. paratuberculosis
gcccgcgccagcucggc

SEQ ID NO: 3024756 - RNA, 19 nt, Mycobacterium avium subsp. paratuberculosis
gcccgcgccagcucggcgg

SEQ ID NO: 3024757 - RNA, 20 nt, Mycobacterium avium subsp. paratuberculosis
gcccgcgccagcucggcggc

SEQ ID NO: 3024758 - RNA, 22 nt, Mycobacterium avium subsp. paratuberculosis
gcccgcgccagcucggcggccg

SEQ ID NO: 3024759 - RNA, 17 nt, Mycobacterium avium subsp. paratuberculosis
gcccgcgcccaccugga

SEQ ID NO: 3024760 - RNA, 16 nt, Mycobacterium avium subsp. paratuberculosis
gcccgcgccccggcgg

SEQ ID NO: 3024761 - RNA, 17 nt, Mycobacterium avium subsp. paratuberculosis
gcccgcgccccggcggc

SEQ ID NO: 3024762 - RNA, 13 nt, Mycobacterium avium subsp. paratuberculosis
gcccgcgcccgcu

SEQ ID NO: 3024763 - RNA, 13 nt, Mycobacterium avium subsp. paratuberculosis
gcccgcgccgacc

SEQ ID NO: 3024764 - RNA, 16 nt, Mycobacterium avium subsp. paratuberculosis
gcccgcgccgaccagc

SEQ ID NO: 3024765 - RNA, 15 nt, Mycobacterium avium subsp. paratuberculosis
gcccgcgccgacggc

SEQ ID NO: 3024766 - RNA, 17 nt, Mycobacterium avium subsp. paratuberculosis
gcccgcgccgacggccg

SEQ ID NO: 3024767 - RNA, 19 nt, Mycobacterium avium subsp. paratuberculosis
gcccgcgccgacggccgcg

SEQ ID NO: 3024768 - RNA, 20 nt, Mycobacterium avium subsp. paratuberculosis
gcccgcgccgacggccgcgc

SEQ ID NO: 3024769 - RNA, 16 nt, Mycobacterium avium subsp. paratuberculosis
gcccgcgccgcgucgu

SEQ ID NO: 3024770 - RNA, 12 nt, Mycobacterium avium subsp. paratuberculosis
gcccgcgccggc

SEQ ID NO: 3024771 - RNA, 13 nt, Mycobacterium avium subsp. paratuberculosis
gcccgcgccggcg

SEQ ID NO: 3024772 - RNA, 14 nt, Mycobacterium avium subsp. paratuberculosis
gcccgcgccggcgu

SEQ ID NO: 3024773 - RNA, 15 nt, Mycobacterium avium subsp. paratuberculosis
gcccgcgccggcgug

SEQ ID NO: 3024774 - RNA, 14 nt, Mycobacterium avium subsp. paratuberculosis
gcccgcgcgagcgc

SEQ ID NO: 3024775 - RNA, 15 nt, Mycobacterium avium subsp. paratuberculosis
gcccgcgcgaucggc

SEQ ID NO: 3024776 - RNA, 19 nt, Mycobacterium avium subsp. paratuberculosis
gcccgcgcgaucggcgagc

SEQ ID NO: 3024777 - RNA, 22 nt, Mycobacterium avium subsp. paratuberculosis
gcccgcgcgaugcgggcgccga

SEQ ID NO: 3024778 - RNA, 17 nt, Mycobacterium avium subsp. paratuberculosis
gcccgcgcggccgccag

SEQ ID NO: 3024779 - RNA, 12 nt, Mycobacterium avium subsp. paratuberculosis
gcccgcgcggcg

SEQ ID NO: 3024780 - RNA, 13 nt, Mycobacterium avium subsp. paratuberculosis
gcccgcgcggcgg

SEQ ID NO: 3024781 - RNA, 14 nt, Mycobacterium avium subsp. paratuberculosis
gcccgcgcggcggc

SEQ ID NO: 3024782 - RNA, 19 nt, Mycobacterium avium subsp. paratuberculosis
gcccgcgcggcggccaacg

SEQ ID NO: 3024783 - RNA, 14 nt, Mycobacterium avium subsp. paratuberculosis
gcccgcgcggcggu

SEQ ID NO: 3024784 - RNA, 20 nt, Mycobacterium avium subsp. paratuberculosis
gcccgcgcggcucacagcgc

SEQ ID NO: 3024785 - RNA, 15 nt, Mycobacterium avium subsp. paratuberculosis
gcccgcgcgggcugc

SEQ ID NO: 3024786 - RNA, 17 nt, Mycobacterium avium subsp. paratuberculosis
gcccgcgcgggcugcag

SEQ ID NO: 3024787 - RNA, 21 nt, Mycobacterium avium subsp. paratuberculosis
gcccgcgcgggcugcagggcc

SEQ ID NO: 3024788 - RNA, 22 nt, Mycobacterium avium subsp. paratuberculosis
gcccgcgcgugggccaacgcga

SEQ ID NO: 3024789 - RNA, 13 nt, Mycobacterium avium subsp. paratuberculosis
gcccgcgcguggu

SEQ ID NO: 3024790 - RNA, 21 nt, Mycobacterium avium subsp. paratuberculosis
gcccgcgcuggugcugcugcc

SEQ ID NO: 3024791 - RNA, 17 nt, Mycobacterium avium subsp. paratuberculosis
gcccgcggaucgcguag

SEQ ID NO: 3024792 - RNA, 23 nt, Mycobacterium avium subsp. paratuberculosis
gcccgcggaucgcguaguccagc

SEQ ID NO: 3024793 - RNA, 12 nt, Mycobacterium avium subsp. paratuberculosis
gcccgcggcacg

SEQ ID NO: 3024794 - RNA, 14 nt, Mycobacterium avium subsp. paratuberculosis
gcccgcggcacgcu

SEQ ID NO: 3024795 - RNA, 17 nt, Mycobacterium avium subsp. paratuberculosis
gcccgcggcacgcugcg

SEQ ID NO: 3024796 - RNA, 19 nt, Mycobacterium avium subsp. paratuberculosis
gcccgcggcacgcugcgcc

SEQ ID NO: 3024797 - RNA, 22 nt, Mycobacterium avium subsp. paratuberculosis
gcccgcggcacgcugcgccagc

SEQ ID NO: 3024798 - RNA, 13 nt, Mycobacterium avium subsp. paratuberculosis
gcccgcggcagcc

SEQ ID NO: 3024799 - RNA, 15 nt, Mycobacterium avium subsp. paratuberculosis
gcccgcggcagccag

SEQ ID NO: 3024800 - RNA, 16 nt, Mycobacterium avium subsp. paratuberculosis
gcccgcggcagccagc

SEQ ID NO: 3024801 - RNA, 18 nt, Mycobacterium avium subsp. paratuberculosis
gcccggaaaaccccaccc

SEQ ID NO: 3024802 - RNA, 17 nt, Mycobacterium avium subsp. paratuberculosis
gcccggaaagcgcgggc

SEQ ID NO: 3024803 - RNA, 16 nt, Mycobacterium avium subsp. paratuberculosis
gcccggaacgcgucgc

SEQ ID NO: 3024804 - RNA, 19 nt, Mycobacterium avium subsp. paratuberculosis
gcccggaacgcgucgccca

SEQ ID NO: 3024805 - RNA, 17 nt, Mycobacterium avium subsp. paratuberculosis
gcccggaaucgucggcc

SEQ ID NO: 3024806 - RNA, 20 nt, Mycobacterium avium subsp. paratuberculosis
gcccggaaucgucggccacg

SEQ ID NO: 3024807 - RNA, 16 nt, Mycobacterium avium subsp. paratuberculosis
gcccggacaccccgua

SEQ ID NO: 3024808 - RNA, 19 nt, Mycobacterium avium subsp. paratuberculosis
gcccggacaccccguaggu

SEQ ID NO: 3024809 - RNA, 13 nt, Mycobacterium avium subsp. paratuberculosis
gcccggaccaggg

SEQ ID NO: 3024810 - RNA, 17 nt, Mycobacterium avium subsp. paratuberculosis
gcccggaccaggguggc

SEQ ID NO: 3024811 - RNA, 14 nt, Mycobacterium avium subsp. paratuberculosis
gcccggacccgcuc

SEQ ID NO: 3024812 - RNA, 17 nt, Mycobacterium avium subsp. paratuberculosis
gcccggacccgcucgcc

SEQ ID NO: 3024813 - RNA, 18 nt, Mycobacterium avium subsp. paratuberculosis
gcccggacccgcucgccg

SEQ ID NO: 3024814 - RNA, 19 nt, Mycobacterium avium subsp. paratuberculosis
gcccggacccgcucgccga

SEQ ID NO: 3024815 - RNA, 15 nt, Mycobacterium avium subsp. paratuberculosis
gcccggaccgccgcg

SEQ ID NO: 3024816 - RNA, 21 nt, Mycobacterium avium subsp. paratuberculosis
gcccggaccgcggucgggucc

SEQ ID NO: 3024817 - RNA, 15 nt, Mycobacterium avium subsp. paratuberculosis
gcccggaccggccgu

SEQ ID NO: 3024818 - RNA, 16 nt, Mycobacterium avium subsp. paratuberculosis
gcccggaccggccgug

SEQ ID NO: 3024819 - RNA, 17 nt, Mycobacterium avium subsp. paratuberculosis
gcccggaccggccgugc

SEQ ID NO: 3024820 - RNA, 14 nt, Mycobacterium avium subsp. paratuberculosis
gcccggaccggcuc

SEQ ID NO: 3024821 - RNA, 18 nt, Mycobacterium avium subsp. paratuberculosis
gcccggacgaugccgcgg

SEQ ID NO: 3024822 - RNA, 23 nt, Mycobacterium avium subsp. paratuberculosis
gcccggacgcgcacacggccucg

SEQ ID NO: 3024823 - RNA, 18 nt, Mycobacterium avium subsp. paratuberculosis
gcccggacggagccgugc

SEQ ID NO: 3024824 - RNA, 23 nt, Mycobacterium avium subsp. paratuberculosis
gcccggacggagccgugcccgag

SEQ ID NO: 3024825 - RNA, 16 nt, Mycobacterium avium subsp. paratuberculosis
gcccggacggccaccu

SEQ ID NO: 3024826 - RNA, 20 nt, Mycobacterium avium subsp. paratuberculosis
gcccggacggccaccuuguc

SEQ ID NO: 3024827 - RNA, 15 nt, Mycobacterium avium subsp. paratuberculosis
gcccggagaaaccgu

SEQ ID NO: 3024828 - RNA, 15 nt, Mycobacterium avium subsp. paratuberculosis
gcccggagcugucgg

SEQ ID NO: 3024829 - RNA, 18 nt, Mycobacterium avium subsp. paratuberculosis
gcccggagcugucgguga

SEQ ID NO: 3024830 - RNA, 21 nt, Mycobacterium avium subsp. paratuberculosis
gcccggaggcgaugcggguca

SEQ ID NO: 3024831 - RNA, 18 nt, Mycobacterium avium subsp. paratuberculosis
gcccggaguccggcucgg

SEQ ID NO: 3024832 - RNA, 14 nt, Mycobacterium avium subsp. paratuberculosis
gcccggaucagcug

SEQ ID NO: 3024833 - RNA, 15 nt, Mycobacterium avium subsp. paratuberculosis
gcccggaucagcuga

SEQ ID NO: 3024834 - RNA, 20 nt, Mycobacterium avium subsp. paratuberculosis
gcccggaucagcugaccggc

SEQ ID NO: 3024835 - RNA, 23 nt, Mycobacterium avium subsp. paratuberculosis
gcccggaucagcugaccggcgau

SEQ ID NO: 3024836 - RNA, 18 nt, Mycobacterium avium subsp. paratuberculosis
gcccggaucgccgaacgc

SEQ ID NO: 3024837 - RNA, 15 nt, Mycobacterium avium subsp. paratuberculosis
gcccggaugccggcg

SEQ ID NO: 3024838 - RNA, 19 nt, Mycobacterium avium subsp. paratuberculosis
gcccggaugccggcgccca

SEQ ID NO: 3024839 - RNA, 21 nt, Mycobacterium avium subsp. paratuberculosis
gcccggaugccggcgcccagc

SEQ ID NO: 3024840 - RNA, 17 nt, Mycobacterium avium subsp. paratuberculosis
gcccggauggccgggca

SEQ ID NO: 3024841 - RNA, 18 nt, Mycobacterium avium subsp. paratuberculosis
gcccggauggccgggcag

SEQ ID NO: 3024842 - RNA, 13 nt, Mycobacterium avium subsp. paratuberculosis
gcccggaugucgg

SEQ ID NO: 3024843 - RNA, 16 nt, Mycobacterium avium subsp. paratuberculosis
gcccggaugucgggcg

SEQ ID NO: 3024844 - RNA, 18 nt, Mycobacterium avium subsp. paratuberculosis
gcccggauucgcggcggc

SEQ ID NO: 3024845 - RNA, 19 nt, Mycobacterium avium subsp. paratuberculosis
gcccggauucgcggcggcg

SEQ ID NO: 3024846 - RNA, 24 nt, Mycobacterium avium subsp. paratuberculosis
gcccggauuucgucccaguccagc

SEQ ID NO: 3024847 - RNA, 19 nt, Mycobacterium avium subsp. paratuberculosis
gcccggcaacacguagucg

SEQ ID NO: 3024848 - RNA, 23 nt, Mycobacterium avium subsp. paratuberculosis
gcccggcaacacguagucgccga

SEQ ID NO: 3024849 - RNA, 22 nt, Mycobacterium avium subsp. paratuberculosis
gcccggcaaccgaaucgagccg

SEQ ID NO: 3024850 - RNA, 13 nt, Mycobacterium avium subsp. paratuberculosis
gcccggcaccgcg

SEQ ID NO: 3024851 - RNA, 15 nt, Mycobacterium avium subsp. paratuberculosis
gcccggcaccgggac

SEQ ID NO: 3024852 - RNA, 17 nt, Mycobacterium avium subsp. paratuberculosis
gcccggcaccggugcgg

SEQ ID NO: 3024853 - RNA, 15 nt, Mycobacterium avium subsp. paratuberculosis
gcccggcacgaacgc

SEQ ID NO: 3024854 - RNA, 20 nt, Mycobacterium avium subsp. paratuberculosis
gcccggcacgaacgcgacga

SEQ ID NO: 3024855 - RNA, 21 nt, Mycobacterium avium subsp. paratuberculosis
gcccggcacgaacgcgacgau

SEQ ID NO: 3024856 - RNA, 15 nt, Mycobacterium avium subsp. paratuberculosis
gcccggcacuggcga

SEQ ID NO: 3024857 - RNA, 23 nt, Mycobacterium avium subsp. paratuberculosis
gcccggcagccgcuccggcccga

SEQ ID NO: 3024858 - RNA, 14 nt, Mycobacterium avium subsp. paratuberculosis
gcccggcagccggg

SEQ ID NO: 3024859 - RNA, 15 nt, Mycobacterium avium subsp. paratuberculosis
gcccggcagccgggg

SEQ ID NO: 3024860 - RNA, 18 nt, Mycobacterium avium subsp. paratuberculosis
gcccggcagccggggugc

SEQ ID NO: 3024861 - RNA, 14 nt, Mycobacterium avium subsp. paratuberculosis
gcccggcagcgggg

SEQ ID NO: 3024862 - RNA, 15 nt, Mycobacterium avium subsp. paratuberculosis
gcccggcagcggggc

SEQ ID NO: 3024863 - RNA, 14 nt, Mycobacterium avium subsp. paratuberculosis
gcccggcagcgguc

SEQ ID NO: 3024864 - RNA, 14 nt, Mycobacterium avium subsp. paratuberculosis
gcccggccaacuac

SEQ ID NO: 3024865 - RNA, 17 nt, Mycobacterium avium subsp. paratuberculosis
gcccggccaccuggccg

SEQ ID NO: 3024866 - RNA, 17 nt, Mycobacterium avium subsp. paratuberculosis
gcccggccagcacccgc

SEQ ID NO: 3024867 - RNA, 19 nt, Mycobacterium avium subsp. paratuberculosis
gcccggccagcacccgcuc

SEQ ID NO: 3024868 - RNA, 14 nt, Mycobacterium avium subsp. paratuberculosis
gcccggccagcagg

SEQ ID NO: 3024869 - RNA, 16 nt, Mycobacterium avium subsp. paratuberculosis
gcccggccagcaggua

SEQ ID NO: 3024870 - RNA, 13 nt, Mycobacterium avium subsp. paratuberculosis
gcccggccagccg

SEQ ID NO: 3024871 - RNA, 14 nt, Mycobacterium avium subsp. paratuberculosis
gcccggccagccgg

SEQ ID NO: 3024872 - RNA, 17 nt, Mycobacterium avium subsp. paratuberculosis
gcccggccagccggccg

SEQ ID NO: 3024873 - RNA, 18 nt, Mycobacterium avium subsp. paratuberculosis
gcccggccagccgggcgg

SEQ ID NO: 3024874 - RNA, 19 nt, Mycobacterium avium subsp. paratuberculosis
gcccggccagccgggcggc

SEQ ID NO: 3024875 - RNA, 13 nt, Mycobacterium avium subsp. paratuberculosis
gcccggccagcgg

SEQ ID NO: 3024876 - RNA, 14 nt, Mycobacterium avium subsp. paratuberculosis
gcccggccagcggc

SEQ ID NO: 3024877 - RNA, 13 nt, Mycobacterium avium subsp. paratuberculosis
gcccggcccaaga

SEQ ID NO: 3024878 - RNA, 20 nt, Mycobacterium avium subsp. paratuberculosis
gcccggcccaagacccgcgu

SEQ ID NO: 3024879 - RNA, 21 nt, Mycobacterium avium subsp. paratuberculosis
gcccggcccaagacccgcguc

SEQ ID NO: 3024880 - RNA, 22 nt, Mycobacterium avium subsp. paratuberculosis
gcccggcccaagacccgcguca

SEQ ID NO: 3024881 - RNA, 14 nt, Mycobacterium avium subsp. paratuberculosis
gcccggcccagccg

SEQ ID NO: 3024882 - RNA, 16 nt, Mycobacterium avium subsp. paratuberculosis
gcccggcccagccgcu

SEQ ID NO: 3024883 - RNA, 15 nt, Mycobacterium avium subsp. paratuberculosis
gcccggcccagccgg

SEQ ID NO: 3024884 - RNA, 16 nt, Mycobacterium avium subsp. paratuberculosis
gcccggcccagccggu

SEQ ID NO: 3024885 - RNA, 18 nt, Mycobacterium avium subsp. paratuberculosis
gcccggcccaggcacagc

SEQ ID NO: 3024886 - RNA, 19 nt, Mycobacterium avium subsp. paratuberculosis
gcccggcgcugcgcccggu

SEQ ID NO: 3024887 - RNA, 13 nt, Mycobacterium avium subsp. paratuberculosis
gcccggcggccac

SEQ ID NO: 3024888 - RNA, 15 nt, Mycobacterium avium subsp. paratuberculosis
gcccggcggccacca

SEQ ID NO: 3024889 - RNA, 15 nt, Mycobacterium avium subsp. paratuberculosis
gcccggcggccggcc

SEQ ID NO: 3024890 - RNA, 16 nt, Mycobacterium avium subsp. paratuberculosis
gcccggcggccggccg

SEQ ID NO: 3024891 - RNA, 19 nt, Mycobacterium avium subsp. paratuberculosis
gcccggcggccggccgcgc

SEQ ID NO: 3024892 - RNA, 15 nt, Mycobacterium avium subsp. paratuberculosis
gcccggcgggccacg

SEQ ID NO: 3024893 - RNA, 13 nt, Mycobacterium avium subsp. paratuberculosis
gcccggcggugcc

SEQ ID NO: 3024894 - RNA, 20 nt, Mycobacterium avium subsp. paratuberculosis
gcccggcggugccgaaccgg

SEQ ID NO: 3024895 - RNA, 15 nt, Mycobacterium avium subsp. paratuberculosis
gcccggcgucacgcu

SEQ ID NO: 3024896 - RNA, 13 nt, Mycobacterium avium subsp. paratuberculosis
gcccggcguccug

SEQ ID NO: 3024897 - RNA, 17 nt, Mycobacterium avium subsp. paratuberculosis
gcccggcguccugcagc

SEQ ID NO: 3024898 - RNA, 15 nt, Mycobacterium avium subsp. paratuberculosis
gcccggcgucggugg

SEQ ID NO: 3024899 - RNA, 17 nt, Mycobacterium avium subsp. paratuberculosis
gcccggcgucggugguc

SEQ ID NO: 3024900 - RNA, 17 nt, Mycobacterium avium subsp. paratuberculosis
gcccggcgugcaggauc

SEQ ID NO: 3024901 - RNA, 17 nt, Mycobacterium avium subsp. paratuberculosis
gcccggcgugggccgca

SEQ ID NO: 3024902 - RNA, 22 nt, Mycobacterium avium subsp. paratuberculosis
gcccggcgugggccgcagcgcg

SEQ ID NO: 3024903 - RNA, 22 nt, Mycobacterium avium subsp. paratuberculosis
gcccggcguguaguacaggccg

SEQ ID NO: 3024904 - RNA, 17 nt, Mycobacterium avium subsp. paratuberculosis
gcccggcguuccagcgc

SEQ ID NO: 3024905 - RNA, 18 nt, Mycobacterium avium subsp. paratuberculosis
gcccggcguuccagcgca

SEQ ID NO: 3024906 - RNA, 20 nt, Mycobacterium avium subsp. paratuberculosis
gcccggcguuccagcgcaca

SEQ ID NO: 3024907 - RNA, 22 nt, Mycobacterium avium subsp. paratuberculosis
gcccggcuaauucgggccgccg

SEQ ID NO: 3024908 - RNA, 22 nt, Mycobacterium avium subsp. paratuberculosis
gcccggcuacucggacgccggc

SEQ ID NO: 3024909 - RNA, 19 nt, Mycobacterium avium subsp. paratuberculosis
gcccggcucaaaccguuga

SEQ ID NO: 3024910 - RNA, 22 nt, Mycobacterium avium subsp. paratuberculosis
gcccggcucagcgcgacgugcc

SEQ ID NO: 3024911 - RNA, 15 nt, Mycobacterium avium subsp. paratuberculosis
gcccggcuccacgau

SEQ ID NO: 3024912 - RNA, 13 nt, Mycobacterium avium subsp. paratuberculosis
gcccggcucgccg

SEQ ID NO: 3024913 - RNA, 14 nt, Mycobacterium avium subsp. paratuberculosis
gcccggcucgccgg

SEQ ID NO: 3024914 - RNA, 18 nt, Mycobacterium avium subsp. paratuberculosis
gcccggcucgccgggcug

SEQ ID NO: 3024915 - RNA, 15 nt, Mycobacterium avium subsp. paratuberculosis
gcccggcucggugcg

SEQ ID NO: 3024916 - RNA, 13 nt, Mycobacterium avium subsp. paratuberculosis
gcccggcugcgca

SEQ ID NO: 3024917 - RNA, 17 nt, Mycobacterium avium subsp. paratuberculosis
gcccggcugcgcagcgc

SEQ ID NO: 3024918 - RNA, 13 nt, Mycobacterium avium subsp. paratuberculosis
gcccggcugcgcc

SEQ ID NO: 3024919 - RNA, 17 nt, Mycobacterium avium subsp. paratuberculosis
gcccggcugcgccgcgc

SEQ ID NO: 3024920 - RNA, 16 nt, Mycobacterium avium subsp. paratuberculosis
gcccggcugggcgcgc

SEQ ID NO: 3024921 - RNA, 16 nt, Mycobacterium avium subsp. paratuberculosis
gcccggcuucgccgcc

SEQ ID NO: 3024922 - RNA, 17 nt, Mycobacterium avium subsp. paratuberculosis
gcccggcuucgccgccg

SEQ ID NO: 3024923 - RNA, 19 nt, Mycobacterium avium subsp. paratuberculosis
gcccggcuucgccgccgca

SEQ ID NO: 3024924 - RNA, 21 nt, Mycobacterium avium subsp. paratuberculosis
gcccggcuucgccgccgcacc

SEQ ID NO: 3024925 - RNA, 17 nt, Mycobacterium avium subsp. paratuberculosis
gcccggcuucgccgcgc

SEQ ID NO: 3024926 - RNA, 18 nt, Mycobacterium avium subsp. paratuberculosis
gcccggcuucgccgcgcu

SEQ ID NO: 3024927 - RNA, 23 nt, Mycobacterium avium subsp. paratuberculosis
gcccgggaaaauuuccuggccga

SEQ ID NO: 3024928 - RNA, 18 nt, Mycobacterium avium subsp. paratuberculosis
gcccgggaaagcggguga

SEQ ID NO: 3024929 - RNA, 17 nt, Mycobacterium avium subsp. paratuberculosis
gcccgggaagccgcagc

SEQ ID NO: 3024930 - RNA, 23 nt, Mycobacterium avium subsp. paratuberculosis
gcccgggaaguucacguccuugg

SEQ ID NO: 3024931 - RNA, 17 nt, Mycobacterium avium subsp. paratuberculosis
gcccgggcacgacgguc

SEQ ID NO: 3024932 - RNA, 18 nt, Mycobacterium avium subsp. paratuberculosis
gcccgggcacgacgguca

SEQ ID NO: 3024933 - RNA, 17 nt, Mycobacterium avium subsp. paratuberculosis
gcccgggcaggcggcgc

SEQ ID NO: 3024934 - RNA, 15 nt, Mycobacterium avium subsp. paratuberculosis
gcccgggcaucccgc

SEQ ID NO: 3024935 - RNA, 16 nt, Mycobacterium avium subsp. paratuberculosis
gcccgggcaucccgcc

SEQ ID NO: 3024936 - RNA, 12 nt, Mycobacterium avium subsp. paratuberculosis
gcccgggccaca

SEQ ID NO: 3024937 - RNA, 20 nt, Mycobacterium avium subsp. paratuberculosis
gcccgggccacacccgucga

SEQ ID NO: 3024938 - RNA, 17 nt, Mycobacterium avium subsp. paratuberculosis
gcccgggccacccgcga

SEQ ID NO: 3024939 - RNA, 13 nt, Mycobacterium avium subsp. paratuberculosis
gcccgggccagga

SEQ ID NO: 3024940 - RNA, 14 nt, Mycobacterium avium subsp. paratuberculosis
gcccgggccaggcg

SEQ ID NO: 3024941 - RNA, 16 nt, Mycobacterium avium subsp. paratuberculosis
gcccgggccaggcgcg

SEQ ID NO: 3024942 - RNA, 17 nt, Mycobacterium avium subsp. paratuberculosis
gcccgggccaggcgcgc

SEQ ID NO: 3024943 - RNA, 19 nt, Mycobacterium avium subsp. paratuberculosis
gcccgggccaggucgguga

SEQ ID NO: 3024944 - RNA, 12 nt, Mycobacterium avium subsp. paratuberculosis
gcccgggcccgu

SEQ ID NO: 3024945 - RNA, 23 nt, Mycobacterium avium subsp. paratuberculosis
gcccgggcccguagcucgcgccg

SEQ ID NO: 3024946 - RNA, 15 nt, Mycobacterium avium subsp. paratuberculosis
gcccgggccgcagcu

SEQ ID NO: 3024947 - RNA, 14 nt, Mycobacterium avium subsp. paratuberculosis
gcccgggccgcgcc

SEQ ID NO: 3024948 - RNA, 20 nt, Mycobacterium avium subsp. paratuberculosis
gcccgggccgcgcccagugu

SEQ ID NO: 3024949 - RNA, 16 nt, Mycobacterium avium subsp. paratuberculosis
gcccgggccggaggug

SEQ ID NO: 3024950 - RNA, 21 nt, Mycobacterium avium subsp. paratuberculosis
gcccgggccguaucggccccg

SEQ ID NO: 3024951 - RNA, 20 nt, Mycobacterium avium subsp. paratuberculosis
gcccgggccgucaucgccga

SEQ ID NO: 3024952 - RNA, 22 nt, Mycobacterium avium subsp. paratuberculosis
gcccgggccguccgggugcggg

SEQ ID NO: 3024953 - RNA, 20 nt, Mycobacterium avium subsp. paratuberculosis
gcccgggcgauucgucgucg

SEQ ID NO: 3024954 - RNA, 12 nt, Mycobacterium avium subsp. paratuberculosis
gcccgggcgccg

SEQ ID NO: 3024955 - RNA, 13 nt, Mycobacterium avium subsp. paratuberculosis
gcccgggcgccga

SEQ ID NO: 3024956 - RNA, 14 nt, Mycobacterium avium subsp. paratuberculosis
gcccgggcggcccg

SEQ ID NO: 3024957 - RNA, 15 nt, Mycobacterium avium subsp. paratuberculosis
gcccgggcggcccgc

SEQ ID NO: 3024958 - RNA, 13 nt, Mycobacterium avium subsp. paratuberculosis
gcccgggcggcga

SEQ ID NO: 3024959 - RNA, 23 nt, Mycobacterium avium subsp. paratuberculosis
gcccgggcggcgaguccggccag

SEQ ID NO: 3024960 - RNA, 14 nt, Mycobacterium avium subsp. paratuberculosis
gcccgggcggcggg

SEQ ID NO: 3024961 - RNA, 16 nt, Mycobacterium avium subsp. paratuberculosis
gcccgggcggcggggc

SEQ ID NO: 3024962 - RNA, 21 nt, Mycobacterium avium subsp. paratuberculosis
gcccgggcggcggggcugccc

SEQ ID NO: 3024963 - RNA, 20 nt, Mycobacterium avium subsp. paratuberculosis
gcccgggcuaucgcccggcg

SEQ ID NO: 3024964 - RNA, 14 nt, Mycobacterium avium subsp. paratuberculosis
gcccgggcugcagc

SEQ ID NO: 3024965 - RNA, 15 nt, Mycobacterium avium subsp. paratuberculosis
gcccgggcugcagca

SEQ ID NO: 3024966 - RNA, 17 nt, Mycobacterium avium subsp. paratuberculosis
gcccgggcugcagcagc

SEQ ID NO: 3024967 - RNA, 16 nt, Mycobacterium avium subsp. paratuberculosis
gcccgggcugcccggg

SEQ ID NO: 3024968 - RNA, 20 nt, Mycobacterium avium subsp. paratuberculosis
gcccgggcuguugaccacgg

SEQ ID NO: 3024969 - RNA, 18 nt, Mycobacterium avium subsp. paratuberculosis
gcccggggacacccucgg

SEQ ID NO: 3024970 - RNA, 17 nt, Mycobacterium avium subsp. paratuberculosis
gcccggggcgcggaccg

SEQ ID NO: 3024971 - RNA, 22 nt, Mycobacterium avium subsp. paratuberculosis
gcccguagaacaguucgacgua

SEQ ID NO: 3024972 - RNA, 23 nt, Mycobacterium avium subsp. paratuberculosis
gcccguagaacaguucgacguag

SEQ ID NO: 3024973 - RNA, 18 nt, Mycobacterium avium subsp. paratuberculosis
gcccguagacccacagcu

SEQ ID NO: 3024974 - RNA, 20 nt, Mycobacterium avium subsp. paratuberculosis
gcccguagacccacagcugc

SEQ ID NO: 3024975 - RNA, 16 nt, Mycobacterium avium subsp. paratuberculosis
gcccguagaugccggu

SEQ ID NO: 3024976 - RNA, 20 nt, Mycobacterium avium subsp. paratuberculosis
gcccguagaugcggcccagc

SEQ ID NO: 3024977 - RNA, 23 nt, Mycobacterium avium subsp. paratuberculosis
gcccguagaugcggcccagcccg

SEQ ID NO: 3024978 - RNA, 14 nt, Mycobacterium avium subsp. paratuberculosis
gcccguagccgcgg

SEQ ID NO: 3024979 - RNA, 23 nt, Mycobacterium avium subsp. paratuberculosis
gcccguagccgcgguucggcguc

SEQ ID NO: 3024980 - RNA, 15 nt, Mycobacterium avium subsp. paratuberculosis
gcccguagcggcgga

SEQ ID NO: 3024981 - RNA, 21 nt, Mycobacterium avium subsp. paratuberculosis
gcccguagcggcggaacucga

SEQ ID NO: 3024982 - RNA, 16 nt, Mycobacterium avium subsp. paratuberculosis
gcccguagcggugggc

SEQ ID NO: 3024983 - RNA, 21 nt, Mycobacterium avium subsp. paratuberculosis
gcccguagcggugggcgcgua

SEQ ID NO: 3024984 - RNA, 17 nt, Mycobacterium avium subsp. paratuberculosis
gcccguagcucgcgccg

SEQ ID NO: 3024985 - RNA, 18 nt, Mycobacterium avium subsp. paratuberculosis
gcccguagcucgcgccga

SEQ ID NO: 3024986 - RNA, 19 nt, Mycobacterium avium subsp. paratuberculosis
gcccguagcucgcgccgac

SEQ ID NO: 3024987 - RNA, 20 nt, Mycobacterium avium subsp. paratuberculosis
gcccguagcucgcgccgacc

SEQ ID NO: 3024988 - RNA, 20 nt, Mycobacterium avium subsp. paratuberculosis
gcccgucacgcuggcgugac

SEQ ID NO: 3024989 - RNA, 21 nt, Mycobacterium avium subsp. paratuberculosis
gcccgucacgcuggcgugacg

SEQ ID NO: 3024990 - RNA, 15 nt, Mycobacterium avium subsp. paratuberculosis
gcccgucacggccgu

SEQ ID NO: 3024991 - RNA, 17 nt, Mycobacterium avium subsp. paratuberculosis
gcccgucacggccgucc

SEQ ID NO: 3024992 - RNA, 21 nt, Mycobacterium avium subsp. paratuberculosis
gcccgucacggccguccaggc

SEQ ID NO: 3024993 - RNA, 20 nt, Mycobacterium avium subsp. paratuberculosis
gcccguccagaucggccagc

SEQ ID NO: 3024994 - RNA, 21 nt, Mycobacterium avium subsp. paratuberculosis
gcccguccagaucggccagcg

SEQ ID NO: 3024995 - RNA, 22 nt, Mycobacterium avium subsp. paratuberculosis
gcccguccagaucggccagcgc

SEQ ID NO: 3024996 - RNA, 23 nt, Mycobacterium avium subsp. paratuberculosis
gcccguccagaucggccagcgcg

SEQ ID NO: 3024997 - RNA, 14 nt, Mycobacterium avium subsp. paratuberculosis
gcccguccagcgca

SEQ ID NO: 3024998 - RNA, 16 nt, Mycobacterium avium subsp. paratuberculosis
gcccguccccaccacc

SEQ ID NO: 3024999 - RNA, 17 nt, Mycobacterium avium subsp. paratuberculosis
gcccguccccaccaccg

SEQ ID NO: 3025000 - RNA, 20 nt, Mycobacterium avium subsp. paratuberculosis
gcccguccccaccaccgaca

SEQ ID NO: 3025001 - RNA, 17 nt, Mycobacterium avium subsp. paratuberculosis
gcccgucccgccgacgg

SEQ ID NO: 3025002 - RNA, 15 nt, Mycobacterium avium subsp. paratuberculosis
gcccgucccggccca

SEQ ID NO: 3025003 - RNA, 15 nt, Mycobacterium avium subsp. paratuberculosis
gcccgucccugcgcg

SEQ ID NO: 3025004 - RNA, 16 nt, Mycobacterium avium subsp. paratuberculosis
gcccgucccugcgcgg

SEQ ID NO: 3025005 - RNA, 16 nt, Mycobacterium avium subsp. paratuberculosis
gcccguccgccccgcu

SEQ ID NO: 3025006 - RNA, 14 nt, Mycobacterium avium subsp. paratuberculosis
gcccguccgggccg

SEQ ID NO: 3025007 - RNA, 22 nt, Mycobacterium avium subsp. paratuberculosis
gcccguccuggaugaacagcac

SEQ ID NO: 3025008 - RNA, 20 nt, Mycobacterium avium subsp. paratuberculosis
gcccgucgaccuccucgacc

SEQ ID NO: 3025009 - RNA, 23 nt, Mycobacterium avium subsp. paratuberculosis
gcccgucgaccuccucgaccccg

SEQ ID NO: 3025010 - RNA, 13 nt, Mycobacterium avium subsp. paratuberculosis
gcccgucgacggg

SEQ ID NO: 3025011 - RNA, 16 nt, Mycobacterium avium subsp. paratuberculosis
gcccgucgacgggcca

SEQ ID NO: 3025012 - RNA, 19 nt, Mycobacterium avium subsp. paratuberculosis
gcccgucgacgggccacca

SEQ ID NO: 3025013 - RNA, 21 nt, Mycobacterium avium subsp. paratuberculosis
gcccgucgacgggccaccagc

SEQ ID NO: 3025014 - RNA, 14 nt, Mycobacterium avium subsp. paratuberculosis
gcccgucgacgucg

SEQ ID NO: 3025015 - RNA, 15 nt, Mycobacterium avium subsp. paratuberculosis
gcccgucgacgucga

SEQ ID NO: 3025016 - RNA, 13 nt, Mycobacterium avium subsp. paratuberculosis
gcccgucgagcgg

SEQ ID NO: 3025017 - RNA, 13 nt, Mycobacterium avium subsp. paratuberculosis
gcccgucgagcgu

SEQ ID NO: 3025018 - RNA, 14 nt, Mycobacterium avium subsp. paratuberculosis
gcccgucgagcguc

SEQ ID NO: 3025019 - RNA, 15 nt, Mycobacterium avium subsp. paratuberculosis
gcccgucgagcguca

SEQ ID NO: 3025020 - RNA, 16 nt, Mycobacterium avium subsp. paratuberculosis
gcccgucgagcgucac

SEQ ID NO: 3025021 - RNA, 20 nt, Mycobacterium avium subsp. paratuberculosis
gcccgucgagcgucacgccg

SEQ ID NO: 3025022 - RNA, 22 nt, Mycobacterium avium subsp. paratuberculosis
gcccgucgagcgucacgccgcg

SEQ ID NO: 3025023 - RNA, 18 nt, Mycobacterium avium subsp. paratuberculosis
gcccgucgaucccggacu

SEQ ID NO: 3025024 - RNA, 14 nt, Mycobacterium avium subsp. paratuberculosis
gcccgucgccacca

SEQ ID NO: 3025025 - RNA, 16 nt, Mycobacterium avium subsp. paratuberculosis
gcccgucgccaccacg

SEQ ID NO: 3025026 - RNA, 17 nt, Mycobacterium avium subsp. paratuberculosis
gcccgucgccaccacgg

SEQ ID NO: 3025027 - RNA, 20 nt, Mycobacterium avium subsp. paratuberculosis
gcccgucgccaccacggcgc

SEQ ID NO: 3025028 - RNA, 12 nt, Mycobacterium avium subsp. paratuberculosis
gcccgucgccga

SEQ ID NO: 3025029 - RNA, 13 nt, Mycobacterium avium subsp. paratuberculosis
gcccgucgccgau

SEQ ID NO: 3025030 - RNA, 14 nt, Mycobacterium avium subsp. paratuberculosis
gcccgucgccgauc

SEQ ID NO: 3025031 - RNA, 14 nt, Mycobacterium avium subsp. paratuberculosis
gcccgucgccggcg

SEQ ID NO: 3025032 - RNA, 15 nt, Mycobacterium avium subsp. paratuberculosis
gcccgucgccggcgc

SEQ ID NO: 3025033 - RNA, 16 nt, Mycobacterium avium subsp. paratuberculosis
gcccgucgccggcgcg

SEQ ID NO: 3025034 - RNA, 17 nt, Mycobacterium avium subsp. paratuberculosis
gcccgucgccggcgcgc

SEQ ID NO: 3025035 - RNA, 20 nt, Mycobacterium avium subsp. paratuberculosis
gcccgucgccggcgcgcagc

SEQ ID NO: 3025036 - RNA, 23 nt, Mycobacterium avium subsp. paratuberculosis
gcccgucgccuccugcuggcgcu

SEQ ID NO: 3025037 - RNA, 19 nt, Mycobacterium avium subsp. paratuberculosis
gcccgucggaggacaacgc

SEQ ID NO: 3025038 - RNA, 14 nt, Mycobacterium avium subsp. paratuberculosis
gcccgucggcaacg

SEQ ID NO: 3025039 - RNA, 16 nt, Mycobacterium avium subsp. paratuberculosis
gcccgucggcaacgcc

SEQ ID NO: 3025040 - RNA, 17 nt, Mycobacterium avium subsp. paratuberculosis
gcccgucggcaacgccg

SEQ ID NO: 3025041 - RNA, 20 nt, Mycobacterium avium subsp. paratuberculosis
gcccgucggcaacgccgggu

SEQ ID NO: 3025042 - RNA, 19 nt, Mycobacterium avium subsp. paratuberculosis
gcccgucggccuccagccg

SEQ ID NO: 3025043 - RNA, 14 nt, Mycobacterium avium subsp. paratuberculosis
gcccgucggccucg

SEQ ID NO: 3025044 - RNA, 19 nt, Mycobacterium avium subsp. paratuberculosis
gcccgucggccucggcggu

SEQ ID NO: 3025045 - RNA, 13 nt, Mycobacterium avium subsp. paratuberculosis
gcccgucggcgug

SEQ ID NO: 3025046 - RNA, 14 nt, Mycobacterium avium subsp. paratuberculosis
gcccgucggcguga

SEQ ID NO: 3025047 - RNA, 19 nt, Mycobacterium avium subsp. paratuberculosis
gcccgucgggcgcggcggc

SEQ ID NO: 3025048 - RNA, 23 nt, Mycobacterium avium subsp. paratuberculosis
gcccgucgggcgcggcggcaacc

SEQ ID NO: 3025049 - RNA, 20 nt, Mycobacterium avium subsp. paratuberculosis
gcccgucggggcccggcccg

SEQ ID NO: 3025050 - RNA, 23 nt, Mycobacterium avium subsp. paratuberculosis
gcccgucguccuugagcccccac

SEQ ID NO: 3025051 - RNA, 14 nt, Mycobacterium avium subsp. paratuberculosis
gcccgucgucgccg

SEQ ID NO: 3025052 - RNA, 15 nt, Mycobacterium avium subsp. paratuberculosis
gcccgucgucgccga

SEQ ID NO: 3025053 - RNA, 17 nt, Mycobacterium avium subsp. paratuberculosis
gcccgucgucgccgaug

SEQ ID NO: 3025054 - RNA, 14 nt, Mycobacterium avium subsp. paratuberculosis
gcccgucucggcgu

SEQ ID NO: 3025055 - RNA, 17 nt, Mycobacterium avium subsp. paratuberculosis
gcccucgcgcagggcca

SEQ ID NO: 3025056 - RNA, 15 nt, Mycobacterium avium subsp. paratuberculosis
gcccucgcugccgcc

SEQ ID NO: 3025057 - RNA, 17 nt, Mycobacterium avium subsp. paratuberculosis
gcccucgcugccgcccc

SEQ ID NO: 3025058 - RNA, 21 nt, Mycobacterium avium subsp. paratuberculosis
gcccucggacgggagacgcug

SEQ ID NO: 3025059 - RNA, 16 nt, Mycobacterium avium subsp. paratuberculosis
gcccucggaggugccg

SEQ ID NO: 3025060 - RNA, 17 nt, Mycobacterium avium subsp. paratuberculosis
gcccucggaggugccgc

SEQ ID NO: 3025061 - RNA, 19 nt, Mycobacterium avium subsp. paratuberculosis
gcccucggccguaccggcg

SEQ ID NO: 3025062 - RNA, 24 nt, Mycobacterium avium subsp. paratuberculosis
gcccucggccguaccggcguacga

SEQ ID NO: 3025063 - RNA, 19 nt, Mycobacterium avium subsp. paratuberculosis
gcccucggcgaucucgucc

SEQ ID NO: 3025064 - RNA, 19 nt, Mycobacterium avium subsp. paratuberculosis
gcccucggcuuccgagccg

SEQ ID NO: 3025065 - RNA, 19 nt, Mycobacterium avium subsp. paratuberculosis
gcccucgggguacucggcg

SEQ ID NO: 3025066 - RNA, 23 nt, Mycobacterium avium subsp. paratuberculosis
gcccucgguguucgggucggugg

SEQ ID NO: 3025067 - RNA, 22 nt, Mycobacterium avium subsp. paratuberculosis
gcccucguagaaggaccggucc

SEQ ID NO: 3025068 - RNA, 14 nt, Mycobacterium avium subsp. paratuberculosis
gcccucguagcggc

SEQ ID NO: 3025069 - RNA, 17 nt, Mycobacterium avium subsp. paratuberculosis
gcccucguagcggccgc

SEQ ID NO: 3025070 - RNA, 18 nt, Mycobacterium avium subsp. paratuberculosis
gcccucguagcggccgca

SEQ ID NO: 3025071 - RNA, 15 nt, Mycobacterium avium subsp. paratuberculosis
gcccucgucgaagcc

SEQ ID NO: 3025072 - RNA, 17 nt, Mycobacterium avium subsp. paratuberculosis
gcccucgucgaagccga

SEQ ID NO: 3025073 - RNA, 13 nt, Mycobacterium avium subsp. paratuberculosis
gcccucgucgaug

SEQ ID NO: 3025074 - RNA, 14 nt, Mycobacterium avium subsp. paratuberculosis
gcccucgucgauga

SEQ ID NO: 3025075 - RNA, 22 nt, Mycobacterium avium subsp. paratuberculosis
gcccucgucgaugacguccacc

SEQ ID NO: 3025076 - RNA, 23 nt, Mycobacterium avium subsp. paratuberculosis
gcccucgucgaugacguccacca

SEQ ID NO: 3025077 - RNA, 15 nt, Mycobacterium avium subsp. paratuberculosis
gcccucgucggcgag

SEQ ID NO: 3025078 - RNA, 19 nt, Mycobacterium avium subsp. paratuberculosis
gcccucgucggcgagcagc

SEQ ID NO: 3025079 - RNA, 20 nt, Mycobacterium avium subsp. paratuberculosis
gcccucgucuuccgcggcgg

SEQ ID NO: 3025080 - RNA, 23 nt, Mycobacterium avium subsp. paratuberculosis
gcccucgucuuccgcggcggccg

SEQ ID NO: 3025081 - RNA, 21 nt, Mycobacterium avium subsp. paratuberculosis
gcccucgugcguagcggcccg

SEQ ID NO: 3025082 - RNA, 13 nt, Mycobacterium avium subsp. paratuberculosis
gcccucucacggc

SEQ ID NO: 3025083 - RNA, 17 nt, Mycobacterium avium subsp. paratuberculosis
gcccucuuccucgcugu

SEQ ID NO: 3025084 - RNA, 23 nt, Mycobacterium avium subsp. paratuberculosis
gcccucuuccucgcuguccugcc

SEQ ID NO: 3025085 - RNA, 19 nt, Mycobacterium avium subsp. paratuberculosis
gcccucuucuucgaggucg

SEQ ID NO: 3025086 - RNA, 22 nt, Mycobacterium avium subsp. paratuberculosis
gcccugaagcugggcgcccaga

SEQ ID NO: 3025087 - RNA, 20 nt, Mycobacterium avium subsp. paratuberculosis
gcccugacacagcaccggcg

SEQ ID NO: 3025088 - RNA, 13 nt, Mycobacterium avium subsp. paratuberculosis
gcccugaccccgg

SEQ ID NO: 3025089 - RNA, 15 nt, Mycobacterium avium subsp. paratuberculosis
gcccugaggcccggu

SEQ ID NO: 3025090 - RNA, 14 nt, Mycobacterium avium subsp. paratuberculosis
gcccugcacccagc

SEQ ID NO: 3025091 - RNA, 19 nt, Mycobacterium avium subsp. paratuberculosis
gcccugcacccagccgugc

SEQ ID NO: 3025092 - RNA, 19 nt, Mycobacterium avium subsp. paratuberculosis
gcccugcacgaucucggcg

SEQ ID NO: 3025093 - RNA, 23 nt, Mycobacterium avium subsp. paratuberculosis
gcccugcacgcaaaaaccaugcc

SEQ ID NO: 3025094 - RNA, 17 nt, Mycobacterium avium subsp. paratuberculosis
gcccugcagccgggugg

SEQ ID NO: 3025095 - RNA, 22 nt, Mycobacterium avium subsp. paratuberculosis
gcccugcagcgccuugaccgcg

SEQ ID NO: 3025096 - RNA, 15 nt, Mycobacterium avium subsp. paratuberculosis
gcccugcagcgcgaa

SEQ ID NO: 3025097 - RNA, 23 nt, Mycobacterium avium subsp. paratuberculosis
gcccugcagguagguggccagcc

SEQ ID NO: 3025098 - RNA, 22 nt, Mycobacterium avium subsp. paratuberculosis
gcccugcagguucugcacgugg

SEQ ID NO: 3025099 - RNA, 18 nt, Mycobacterium avium subsp. paratuberculosis
gcccugccacagcgacag

SEQ ID NO: 3025100 - RNA, 17 nt, Mycobacterium avium subsp. paratuberculosis
gcccugccagcgcccgc

SEQ ID NO: 3025101 - RNA, 14 nt, Mycobacterium avium subsp. paratuberculosis
gcccugcccgucgg

SEQ ID NO: 3025102 - RNA, 15 nt, Mycobacterium avium subsp. paratuberculosis
gcccugccugcugcc

SEQ ID NO: 3025103 - RNA, 17 nt, Mycobacterium avium subsp. paratuberculosis
gcccugccugcugccca

SEQ ID NO: 3025104 - RNA, 22 nt, Mycobacterium avium subsp. paratuberculosis
gcccugcgaauacccgcccagc

SEQ ID NO: 3025105 - RNA, 22 nt, Mycobacterium avium subsp. paratuberculosis
gcccugcgagcccgggaacguc

SEQ ID NO: 3025106 - RNA, 15 nt, Mycobacterium avium subsp. paratuberculosis
gcccugcgccagcag

SEQ ID NO: 3025107 - RNA, 17 nt, Mycobacterium avium subsp. paratuberculosis
gcccugcgccagcagca

SEQ ID NO: 3025108 - RNA, 19 nt, Mycobacterium avium subsp. paratuberculosis
gcccugcgccagcagcagc

SEQ ID NO: 3025109 - RNA, 19 nt, Mycobacterium avium subsp. paratuberculosis
gcccugcgcgcccugcugg

SEQ ID NO: 3025110 - RNA, 13 nt, Mycobacterium avium subsp. paratuberculosis
gcccugcgcggcc

SEQ ID NO: 3025111 - RNA, 15 nt, Mycobacterium avium subsp. paratuberculosis
gcccugcgcggccug

SEQ ID NO: 3025112 - RNA, 19 nt, Mycobacterium avium subsp. paratuberculosis
gcccugcgcggccugcagc

SEQ ID NO: 3025113 - RNA, 13 nt, Mycobacterium avium subsp. paratuberculosis
gcccugcggccag

SEQ ID NO: 3025114 - RNA, 17 nt, Mycobacterium avium subsp. paratuberculosis
gcccugcgucaucggcu

SEQ ID NO: 3025115 - RNA, 15 nt, Mycobacterium avium subsp. paratuberculosis
gcccugcucggccag

SEQ ID NO: 3025116 - RNA, 16 nt, Mycobacterium avium subsp. paratuberculosis
gcccugcucggccagc

SEQ ID NO: 3025117 - RNA, 21 nt, Mycobacterium avium subsp. paratuberculosis
gcccugcucggccagcgggug

SEQ ID NO: 3025118 - RNA, 23 nt, Mycobacterium avium subsp. paratuberculosis
gcccugcucggugaugccgagcg

SEQ ID NO: 3025119 - RNA, 17 nt, Mycobacterium avium subsp. paratuberculosis
gcccugcucgucguuga

SEQ ID NO: 3025120 - RNA, 21 nt, Mycobacterium avium subsp. paratuberculosis
gcccugcucuucgcgcgcggc

SEQ ID NO: 3025121 - RNA, 23 nt, Mycobacterium avium subsp. paratuberculosis
gcccugcucuucgcgcgcggcgu

SEQ ID NO: 3025122 - RNA, 17 nt, Mycobacterium avium subsp. paratuberculosis
gcccugcugcagcgcga

SEQ ID NO: 3025123 - RNA, 19 nt, Mycobacterium avium subsp. paratuberculosis
gcccugcuugaccgcgacg

SEQ ID NO: 3025124 - RNA, 14 nt, Mycobacterium avium subsp. paratuberculosis
gcccuggaaggcga

SEQ ID NO: 3025125 - RNA, 23 nt, Mycobacterium avium subsp. paratuberculosis
gcccuggaucgcgccuugggcca

SEQ ID NO: 3025126 - RNA, 20 nt, Mycobacterium avium subsp. paratuberculosis
gcccuggcaggugagccggg

SEQ ID NO: 3025127 - RNA, 21 nt, Mycobacterium avium subsp. paratuberculosis
gcccuggcaggugagccgggu

SEQ ID NO: 3025128 - RNA, 14 nt, Mycobacterium avium subsp. paratuberculosis
gcccuggccgccgg

SEQ ID NO: 3025129 - RNA, 15 nt, Mycobacterium avium subsp. paratuberculosis
gcccuggccgccggc

SEQ ID NO: 3025130 - RNA, 19 nt, Mycobacterium avium subsp. paratuberculosis
gcccuggccgccggccgcg

SEQ ID NO: 3025131 - RNA, 17 nt, Mycobacterium avium subsp. paratuberculosis
gcccuggcgggcggccc

SEQ ID NO: 3025132 - RNA, 18 nt, Mycobacterium avium subsp. paratuberculosis
gcccuggcgggcggcccg

SEQ ID NO: 3025133 - RNA, 20 nt, Mycobacterium avium subsp. paratuberculosis
gcccuggcgggcggcccgca

SEQ ID NO: 3025134 - RNA, 17 nt, Mycobacterium avium subsp. paratuberculosis
gcccugggggucgguga

SEQ ID NO: 3025135 - RNA, 23 nt, Mycobacterium avium subsp. paratuberculosis
gcccugguacgcgccgucgucgu

SEQ ID NO: 3025136 - RNA, 17 nt, Mycobacterium avium subsp. paratuberculosis
gcccugguaggccugga

SEQ ID NO: 3025137 - RNA, 17 nt, Mycobacterium avium subsp. paratuberculosis
gcccuggucggccaggg

SEQ ID NO: 3025138 - RNA, 18 nt, Mycobacterium avium subsp. paratuberculosis
gcccuggucggccagggc

SEQ ID NO: 3025139 - RNA, 18 nt, Mycobacterium avium subsp. paratuberculosis
gccgaacgcaccaccgcg

SEQ ID NO: 3025140 - RNA, 20 nt, Mycobacterium avium subsp. paratuberculosis
gccgaacgccuccgccgccc

SEQ ID NO: 3025141 - RNA, 13 nt, Mycobacterium avium subsp. paratuberculosis
gccgaacgcgcug

SEQ ID NO: 3025142 - RNA, 14 nt, Mycobacterium avium subsp. paratuberculosis
gccgaacgcgcugu

SEQ ID NO: 3025143 - RNA, 18 nt, Mycobacterium avium subsp. paratuberculosis
gccgaacgcgcugucgcc

SEQ ID NO: 3025144 - RNA, 19 nt, Mycobacterium avium subsp. paratuberculosis
gccgaacgcgcugucgccc

SEQ ID NO: 3025145 - RNA, 20 nt, Mycobacterium avium subsp. paratuberculosis
gccgaacgcgcugucgcccu

SEQ ID NO: 3025146 - RNA, 18 nt, Mycobacterium avium subsp. paratuberculosis
gccgaacggcaugucggu

SEQ ID NO: 3025147 - RNA, 18 nt, Mycobacterium avium subsp. paratuberculosis
gccgaacgggucggcgac

SEQ ID NO: 3025148 - RNA, 19 nt, Mycobacterium avium subsp. paratuberculosis
gccgaacgggucggcgacc

SEQ ID NO: 3025149 - RNA, 17 nt, Mycobacterium avium subsp. paratuberculosis
gccgaacgucgagcgcg

SEQ ID NO: 3025150 - RNA, 22 nt, Mycobacterium avium subsp. paratuberculosis
gccgaacgucgagcgcggcccg

SEQ ID NO: 3025151 - RNA, 23 nt, Mycobacterium avium subsp. paratuberculosis
gccgaacgucgagcgcggcccgc

SEQ ID NO: 3025152 - RNA, 16 nt, Mycobacterium avium subsp. paratuberculosis
gccgaacgugauggcg

SEQ ID NO: 3025153 - RNA, 18 nt, Mycobacterium avium subsp. paratuberculosis
gccgaacgugauggcgaa

SEQ ID NO: 3025154 - RNA, 16 nt, Mycobacterium avium subsp. paratuberculosis
gccgaacgugcgcggc

SEQ ID NO: 3025155 - RNA, 17 nt, Mycobacterium avium subsp. paratuberculosis
gccgaacgugcgcggcg

SEQ ID NO: 3025156 - RNA, 18 nt, Mycobacterium avium subsp. paratuberculosis
gccgaacgugcgcggcgc

SEQ ID NO: 3025157 - RNA, 20 nt, Mycobacterium avium subsp. paratuberculosis
gccgaacgugcgcggcgcgc

SEQ ID NO: 3025158 - RNA, 22 nt, Mycobacterium avium subsp. paratuberculosis
gccgaacgugcgcggcgcgcga

SEQ ID NO: 3025159 - RNA, 23 nt, Mycobacterium avium subsp. paratuberculosis
gccgaacgugcgcggcgcgcgaa

SEQ ID NO: 3025160 - RNA, 23 nt, Mycobacterium avium subsp. paratuberculosis
gccgaacgugcugugcgggcggu

SEQ ID NO: 3025161 - RNA, 15 nt, Mycobacterium avium subsp. paratuberculosis
gccgaacuccgccga

SEQ ID NO: 3025162 - RNA, 16 nt, Mycobacterium avium subsp. paratuberculosis
gccgaacuccgccgaa

SEQ ID NO: 3025163 - RNA, 20 nt, Mycobacterium avium subsp. paratuberculosis
gccgaacuccgccgaaccga

SEQ ID NO: 3025164 - RNA, 22 nt, Mycobacterium avium subsp. paratuberculosis
gccgaacucggcgccgccgguc

SEQ ID NO: 3025165 - RNA, 13 nt, Mycobacterium avium subsp. paratuberculosis
gccgaacugccga

SEQ ID NO: 3025166 - RNA, 16 nt, Mycobacterium avium subsp. paratuberculosis
gccgaacugccggacc

SEQ ID NO: 3025167 - RNA, 22 nt, Mycobacterium avium subsp. paratuberculosis
gccgaacugguuguagucgucg

SEQ ID NO: 3025168 - RNA, 22 nt, Mycobacterium avium subsp. paratuberculosis
gccgaagaacgacuggcggcgg

SEQ ID NO: 3025169 - RNA, 18 nt, Mycobacterium avium subsp. paratuberculosis
gccgaagaacucagccga

SEQ ID NO: 3025170 - RNA, 19 nt, Mycobacterium avium subsp. paratuberculosis
gccgaagaacucagccgaa

SEQ ID NO: 3025171 - RNA, 16 nt, Mycobacterium avium subsp. paratuberculosis
gccgaagaagauguug

SEQ ID NO: 3025172 - RNA, 22 nt, Mycobacterium avium subsp. paratuberculosis
gccgaagaagauguugcggcgg

SEQ ID NO: 3025173 - RNA, 23 nt, Mycobacterium avium subsp. paratuberculosis
gccgaagaagauguugcggcggc

SEQ ID NO: 3025174 - RNA, 24 nt, Mycobacterium avium subsp. paratuberculosis
gccgaagaagauguugcggcggcc

SEQ ID NO: 3025175 - RNA, 15 nt, Mycobacterium avium subsp. paratuberculosis
gccgaagaccgccga

SEQ ID NO: 3025176 - RNA, 13 nt, Mycobacterium avium subsp. paratuberculosis
gccgaagaccggg

SEQ ID NO: 3025177 - RNA, 15 nt, Mycobacterium avium subsp. paratuberculosis
gccgaagaccgggcc

SEQ ID NO: 3025178 - RNA, 16 nt, Mycobacterium avium subsp. paratuberculosis
gccgaagaccgggccg

SEQ ID NO: 3025179 - RNA, 18 nt, Mycobacterium avium subsp. paratuberculosis
gccgaagaucaccgcguc

SEQ ID NO: 3025180 - RNA, 21 nt, Mycobacterium avium subsp. paratuberculosis
gccgaagaucaccgcgucggc

SEQ ID NO: 3025181 - RNA, 17 nt, Mycobacterium avium subsp. paratuberculosis
gccgaagaucagcgcgu

SEQ ID NO: 3025182 - RNA, 15 nt, Mycobacterium avium subsp. paratuberculosis
gccgaagauggccag

SEQ ID NO: 3025183 - RNA, 18 nt, Mycobacterium avium subsp. paratuberculosis
gccgaagauggccagcgc

SEQ ID NO: 3025184 - RNA, 20 nt, Mycobacterium avium subsp. paratuberculosis
gccgaagauggccagcgcgg

SEQ ID NO: 3025185 - RNA, 23 nt, Mycobacterium avium subsp. paratuberculosis
gccgaagauggccagcgcggcgu

SEQ ID NO: 3025186 - RNA, 17 nt, Mycobacterium avium subsp. paratuberculosis
gccgaagaugucggugc

SEQ ID NO: 3025187 - RNA, 13 nt, Mycobacterium avium subsp. paratuberculosis
gccgaagcccgac

SEQ ID NO: 3025188 - RNA, 22 nt, Mycobacterium avium subsp. paratuberculosis
gccgaagcccgacaucugccgg

SEQ ID NO: 3025189 - RNA, 16 nt, Mycobacterium avium subsp. paratuberculosis
gccgaagcccgcagcg

SEQ ID NO: 3025190 - RNA, 17 nt, Mycobacterium avium subsp. paratuberculosis
gccgaagcccgcagcga

SEQ ID NO: 3025191 - RNA, 21 nt, Mycobacterium avium subsp. paratuberculosis
gccgaagcccgcagcgaacgc

SEQ ID NO: 3025192 - RNA, 22 nt, Mycobacterium avium subsp. paratuberculosis
gccgaagcccgcagcgaacgcg

SEQ ID NO: 3025193 - RNA, 14 nt, Mycobacterium avium subsp. paratuberculosis
gccgaagccgacac

SEQ ID NO: 3025194 - RNA, 15 nt, Mycobacterium avium subsp. paratuberculosis
gccgaagccgccguc

SEQ ID NO: 3025195 - RNA, 17 nt, Mycobacterium avium subsp. paratuberculosis
gccgaagccgccguccc

SEQ ID NO: 3025196 - RNA, 21 nt, Mycobacterium avium subsp. paratuberculosis
gccgaagccgccguccccgcg

SEQ ID NO: 3025197 - RNA, 14 nt, Mycobacterium avium subsp. paratuberculosis
gccgaagccggcgc

SEQ ID NO: 3025198 - RNA, 17 nt, Mycobacterium avium subsp. paratuberculosis
gccgaagccggcgcagg

SEQ ID NO: 3025199 - RNA, 13 nt, Mycobacterium avium subsp. paratuberculosis
gccgaagccgucg

SEQ ID NO: 3025200 - RNA, 16 nt, Mycobacterium avium subsp. paratuberculosis
gccgaagccgucgacc

SEQ ID NO: 3025201 - RNA, 23 nt, Mycobacterium avium subsp. paratuberculosis
gccgaagccgucgaccccgccgg

SEQ ID NO: 3025202 - RNA, 15 nt, Mycobacterium avium subsp. paratuberculosis
gccgaagcgccgcau

SEQ ID NO: 3025203 - RNA, 16 nt, Mycobacterium avium subsp. paratuberculosis
gccgaagcggcgcacg

SEQ ID NO: 3025204 - RNA, 23 nt, Mycobacterium avium subsp. paratuberculosis
gccgaagcggcgcacgcagugcc

SEQ ID NO: 3025205 - RNA, 19 nt, Mycobacterium avium subsp. paratuberculosis
gccgaagcguuccgccguc

SEQ ID NO: 3025206 - RNA, 21 nt, Mycobacterium avium subsp. paratuberculosis
gccgaagcguuccgccguccu

SEQ ID NO: 3025207 - RNA, 13 nt, Mycobacterium avium subsp. paratuberculosis
gccgaaggcggcg

SEQ ID NO: 3025208 - RNA, 18 nt, Mycobacterium avium subsp. paratuberculosis
gccgaaggcggcgccggc

SEQ ID NO: 3025209 - RNA, 19 nt, Mycobacterium avium subsp. paratuberculosis
gccgaaggcggcgccggcc

SEQ ID NO: 3025210 - RNA, 21 nt, Mycobacterium avium subsp. paratuberculosis
gccgaaggcggcgccggccgg

SEQ ID NO: 3025211 - RNA, 16 nt, Mycobacterium avium subsp. paratuberculosis
gccgaagggcaaccgc

SEQ ID NO: 3025212 - RNA, 19 nt, Mycobacterium avium subsp. paratuberculosis
gccgaaguauccggucagc

SEQ ID NO: 3025213 - RNA, 16 nt, Mycobacterium avium subsp. paratuberculosis
gccgaaguccuugacc

SEQ ID NO: 3025214 - RNA, 17 nt, Mycobacterium avium subsp. paratuberculosis
gccgaagucgcugaggc

SEQ ID NO: 3025215 - RNA, 19 nt, Mycobacterium avium subsp. paratuberculosis
gccgaaguuccagccgauc

SEQ ID NO: 3025216 - RNA, 23 nt, Mycobacterium avium subsp. paratuberculosis
gccgaaguuccagccgaucgcgg

SEQ ID NO: 3025217 - RNA, 14 nt, Mycobacterium avium subsp. paratuberculosis
gccgaaguuggcgu

SEQ ID NO: 3025218 - RNA, 16 nt, Mycobacterium avium subsp. paratuberculosis
gccgaaguuggcgucg

SEQ ID NO: 3025219 - RNA, 17 nt, Mycobacterium avium subsp. paratuberculosis
gccgaaguuggcgucgg

SEQ ID NO: 3025220 - RNA, 18 nt, Mycobacterium avium subsp. paratuberculosis
gccgaaguuggcgucggg

SEQ ID NO: 3025221 - RNA, 12 nt, Mycobacterium avium subsp. paratuberculosis
gccgaauccggc

SEQ ID NO: 3025222 - RNA, 22 nt, Mycobacterium avium subsp. paratuberculosis
gccgaauccggccggagaccgc

SEQ ID NO: 3025223 - RNA, 22 nt, Mycobacterium avium subsp. paratuberculosis
gccgaccaggcucgcgagggcg

SEQ ID NO: 3025224 - RNA, 19 nt, Mycobacterium avium subsp. paratuberculosis
gccgaccagguagcgcugc

SEQ ID NO: 3025225 - RNA, 18 nt, Mycobacterium avium subsp. paratuberculosis
gccgaccaguucggccac

SEQ ID NO: 3025226 - RNA, 19 nt, Mycobacterium avium subsp. paratuberculosis
gccgaccaguucggccacc

SEQ ID NO: 3025227 - RNA, 21 nt, Mycobacterium avium subsp. paratuberculosis
gccgaccaguucggccaccgc

SEQ ID NO: 3025228 - RNA, 22 nt, Mycobacterium avium subsp. paratuberculosis
gccgaccaguucggccaccgcg

SEQ ID NO: 3025229 - RNA, 19 nt, Mycobacterium avium subsp. paratuberculosis
gccgacccccgccgcgucg

SEQ ID NO: 3025230 - RNA, 20 nt, Mycobacterium avium subsp. paratuberculosis
gccgacccccgccgcgucgg

SEQ ID NO: 3025231 - RNA, 14 nt, Mycobacterium avium subsp. paratuberculosis
gccgacccgcccgc

SEQ ID NO: 3025232 - RNA, 17 nt, Mycobacterium avium subsp. paratuberculosis
gccgacccgcccgccgg

SEQ ID NO: 3025233 - RNA, 18 nt, Mycobacterium avium subsp. paratuberculosis
gccgacccgcccgccggg

SEQ ID NO: 3025234 - RNA, 13 nt, Mycobacterium avium subsp. paratuberculosis
gccgacccgcugc

SEQ ID NO: 3025235 - RNA, 12 nt, Mycobacterium avium subsp. paratuberculosis
gccgacccggcc

SEQ ID NO: 3025236 - RNA, 14 nt, Mycobacterium avium subsp. paratuberculosis
gccgacccggccga

SEQ ID NO: 3025237 - RNA, 21 nt, Mycobacterium avium subsp. paratuberculosis
gccgacccgggcuagacgcgc

SEQ ID NO: 3025238 - RNA, 20 nt, Mycobacterium avium subsp. paratuberculosis
gccgacccugcguccggccc

SEQ ID NO: 3025239 - RNA, 22 nt, Mycobacterium avium subsp. paratuberculosis
gccgacccugcguccggcccgg

SEQ ID NO: 3025240 - RNA, 23 nt, Mycobacterium avium subsp. paratuberculosis
gccgacccugcguccggcccggc

SEQ ID NO: 3025241 - RNA, 20 nt, Mycobacterium avium subsp. paratuberculosis
gccgaccgacagccgcacca

SEQ ID NO: 3025242 - RNA, 16 nt, Mycobacterium avium subsp. paratuberculosis
gccgaccgacaguucg

SEQ ID NO: 3025243 - RNA, 18 nt, Mycobacterium avium subsp. paratuberculosis
gccgaccgacaguucggc

SEQ ID NO: 3025244 - RNA, 23 nt, Mycobacterium avium subsp. paratuberculosis
gccgaccgacaguucggcgcgca

SEQ ID NO: 3025245 - RNA, 14 nt, Mycobacterium avium subsp. paratuberculosis
gccgaccgacccgg

SEQ ID NO: 3025246 - RNA, 16 nt, Mycobacterium avium subsp. paratuberculosis
gccgaccgagggcgcg

SEQ ID NO: 3025247 - RNA, 17 nt, Mycobacterium avium subsp. paratuberculosis
gccgaccgaucagcgga

SEQ ID NO: 3025248 - RNA, 13 nt, Mycobacterium avium subsp. paratuberculosis
gccgaccgcccgc

SEQ ID NO: 3025249 - RNA, 16 nt, Mycobacterium avium subsp. paratuberculosis
gccgaccgcccgcugu

SEQ ID NO: 3025250 - RNA, 14 nt, Mycobacterium avium subsp. paratuberculosis
gccgaccgccgagc

SEQ ID NO: 3025251 - RNA, 15 nt, Mycobacterium avium subsp. paratuberculosis
gccgaccgccgagcg

SEQ ID NO: 3025252 - RNA, 20 nt, Mycobacterium avium subsp. paratuberculosis
gccgaccgccgagcgggcga

SEQ ID NO: 3025253 - RNA, 12 nt, Mycobacterium avium subsp. paratuberculosis
gccgaccgccgc

SEQ ID NO: 3025254 - RNA, 13 nt, Mycobacterium avium subsp. paratuberculosis
gccgaccgccgcc

SEQ ID NO: 3025255 - RNA, 16 nt, Mycobacterium avium subsp. paratuberculosis
gccgaccgcgaucgag

SEQ ID NO: 3025256 - RNA, 21 nt, Mycobacterium avium subsp. paratuberculosis
gccgaccgcggucgcggcgcc

SEQ ID NO: 3025257 - RNA, 22 nt, Mycobacterium avium subsp. paratuberculosis
gccgaccgcggucgcggcgccg

SEQ ID NO: 3025258 - RNA, 11 nt, Mycobacterium avium subsp. paratuberculosis
gccgaccgcgu

SEQ ID NO: 3025259 - RNA, 12 nt, Mycobacterium avium subsp. paratuberculosis
gccgaccggccg

SEQ ID NO: 3025260 - RNA, 14 nt, Mycobacterium avium subsp. paratuberculosis
gccgaccggccggu

SEQ ID NO: 3025261 - RNA, 19 nt, Mycobacterium avium subsp. paratuberculosis
gccgaccggccgguuguug

SEQ ID NO: 3025262 - RNA, 20 nt, Mycobacterium avium subsp. paratuberculosis
gccgaccggccgguuguugc

SEQ ID NO: 3025263 - RNA, 22 nt, Mycobacterium avium subsp. paratuberculosis
gccgaccggccgguuguugcgg

SEQ ID NO: 3025264 - RNA, 14 nt, Mycobacterium avium subsp. paratuberculosis
gccgaccgguccgc

SEQ ID NO: 3025265 - RNA, 20 nt, Mycobacterium avium subsp. paratuberculosis
gccgaccgguccgccgccgg

SEQ ID NO: 3025266 - RNA, 23 nt, Mycobacterium avium subsp. paratuberculosis
gccgaccgguccgccgccggcgg

SEQ ID NO: 3025267 - RNA, 19 nt, Mycobacterium avium subsp. paratuberculosis
gccgaccggucucgaccgc

SEQ ID NO: 3025268 - RNA, 22 nt, Mycobacterium avium subsp. paratuberculosis
gccgaccggucucgaccgcggc

SEQ ID NO: 3025269 - RNA, 16 nt, Mycobacterium avium subsp. paratuberculosis
gccgaccucgauggcg

SEQ ID NO: 3025270 - RNA, 19 nt, Mycobacterium avium subsp. paratuberculosis
gccgaccucgauggcgacg

SEQ ID NO: 3025271 - RNA, 14 nt, Mycobacterium avium subsp. paratuberculosis
gccgaccucggcca

SEQ ID NO: 3025272 - RNA, 18 nt, Mycobacterium avium subsp. paratuberculosis
gccgaccucggccagcgu

SEQ ID NO: 3025273 - RNA, 13 nt, Mycobacterium avium subsp. paratuberculosis
gccgaccucggcg

SEQ ID NO: 3025274 - RNA, 14 nt, Mycobacterium avium subsp. paratuberculosis
gccgaccucgucgg

SEQ ID NO: 3025275 - RNA, 18 nt, Mycobacterium avium subsp. paratuberculosis
gccgaccucgucggcggu

SEQ ID NO: 3025276 - RNA, 23 nt, Mycobacterium avium subsp. paratuberculosis
gccgaccucgucggcggugccga

SEQ ID NO: 3025277 - RNA, 19 nt, Mycobacterium avium subsp. paratuberculosis
gccgaccugcacgcugaag

SEQ ID NO: 3025278 - RNA, 18 nt, Mycobacterium avium subsp. paratuberculosis
gccgaccugcgcgacggc

SEQ ID NO: 3025279 - RNA, 19 nt, Mycobacterium avium subsp. paratuberculosis
gccgaccugcgcgacggcg

SEQ ID NO: 3025280 - RNA, 13 nt, Mycobacterium avium subsp. paratuberculosis
gccgaccuggcgg

SEQ ID NO: 3025281 - RNA, 15 nt, Mycobacterium avium subsp. paratuberculosis
gccgaccuggcggcc

SEQ ID NO: 3025282 - RNA, 16 nt, Mycobacterium avium subsp. paratuberculosis
gccgaccuggcggccg

SEQ ID NO: 3025283 - RNA, 18 nt, Mycobacterium avium subsp. paratuberculosis
gccgaccuggcggccgga

SEQ ID NO: 3025284 - RNA, 16 nt, Mycobacterium avium subsp. paratuberculosis
gccgaccugggcggcc

SEQ ID NO: 3025285 - RNA, 17 nt, Mycobacterium avium subsp. paratuberculosis
gccgaccugggcggcca

SEQ ID NO: 3025286 - RNA, 18 nt, Mycobacterium avium subsp. paratuberculosis
gccgaccugggcggccac

SEQ ID NO: 3025287 - RNA, 22 nt, Mycobacterium avium subsp. paratuberculosis
gccgaccugggcggccaccgcg

SEQ ID NO: 3025288 - RNA, 16 nt, Mycobacterium avium subsp. paratuberculosis
gccgaccuggucgccg

SEQ ID NO: 3025289 - RNA, 19 nt, Mycobacterium avium subsp. paratuberculosis
gccgaccuggucgccgaac

SEQ ID NO: 3025290 - RNA, 23 nt, Mycobacterium avium subsp. paratuberculosis
gccgaccuguagggcgagcucgu

SEQ ID NO: 3025291 - RNA, 13 nt, Mycobacterium avium subsp. paratuberculosis
gccgaccuugacc

SEQ ID NO: 3025292 - RNA, 19 nt, Mycobacterium avium subsp. paratuberculosis
gccgaccuugacccaggcc

SEQ ID NO: 3025293 - RNA, 20 nt, Mycobacterium avium subsp. paratuberculosis
gccgaccuugacccaggccc

SEQ ID NO: 3025294 - RNA, 17 nt, Mycobacterium avium subsp. paratuberculosis
gccgacgaagaucccgc

SEQ ID NO: 3025295 - RNA, 13 nt, Mycobacterium avium subsp. paratuberculosis
gccgacgacggcg

SEQ ID NO: 3025296 - RNA, 13 nt, Mycobacterium avium subsp. paratuberculosis
gccgacgacgucg

SEQ ID NO: 3025297 - RNA, 15 nt, Mycobacterium avium subsp. paratuberculosis
gccgacgacgucgcg

SEQ ID NO: 3025298 - RNA, 16 nt, Mycobacterium avium subsp. paratuberculosis
gccgacgacgucgcgc

SEQ ID NO: 3025299 - RNA, 17 nt, Mycobacterium avium subsp. paratuberculosis
gccgacgacgucgcgca

SEQ ID NO: 3025300 - RNA, 17 nt, Mycobacterium avium subsp. paratuberculosis
gccgacgacgucguaga

SEQ ID NO: 3025301 - RNA, 22 nt, Mycobacterium avium subsp. paratuberculosis
gccgacgauacgugcucccgcc

SEQ ID NO: 3025302 - RNA, 16 nt, Mycobacterium avium subsp. paratuberculosis
gccgacgaucccggcg

SEQ ID NO: 3025303 - RNA, 18 nt, Mycobacterium avium subsp. paratuberculosis
gccgacgaucccggcgag

SEQ ID NO: 3025304 - RNA, 19 nt, Mycobacterium avium subsp. paratuberculosis
gccgacgaucccggcgagc

SEQ ID NO: 3025305 - RNA, 16 nt, Mycobacterium avium subsp. paratuberculosis
gccgacgauccgcgcc

SEQ ID NO: 3025306 - RNA, 17 nt, Mycobacterium avium subsp. paratuberculosis
gccgacgauccgcgccg

SEQ ID NO: 3025307 - RNA, 20 nt, Mycobacterium avium subsp. paratuberculosis
gccgacgauccgcgccgcga

SEQ ID NO: 3025308 - RNA, 15 nt, Mycobacterium avium subsp. paratuberculosis
gccgacuccccgccc

SEQ ID NO: 3025309 - RNA, 17 nt, Mycobacterium avium subsp. paratuberculosis
gccgacuccccgcccgg

SEQ ID NO: 3025310 - RNA, 21 nt, Mycobacterium avium subsp. paratuberculosis
gccgacuccccgcccggcaac

SEQ ID NO: 3025311 - RNA, 18 nt, Mycobacterium avium subsp. paratuberculosis
gccgacucgaugcgcgug

SEQ ID NO: 3025312 - RNA, 18 nt, Mycobacterium avium subsp. paratuberculosis
gccgacugauccaccauc

SEQ ID NO: 3025313 - RNA, 23 nt, Mycobacterium avium subsp. paratuberculosis
gccgacugccccgcuccuccucg

SEQ ID NO: 3025314 - RNA, 17 nt, Mycobacterium avium subsp. paratuberculosis
gccgacuugaucgcggc

SEQ ID NO: 3025315 - RNA, 18 nt, Mycobacterium avium subsp. paratuberculosis
gccgacuugaucgcggcg

SEQ ID NO: 3025316 - RNA, 15 nt, Mycobacterium avium subsp. paratuberculosis
gccgacuuggucagc

SEQ ID NO: 3025317 - RNA, 18 nt, Mycobacterium avium subsp. paratuberculosis
gccgacuuggucagcccg

SEQ ID NO: 3025318 - RNA, 19 nt, Mycobacterium avium subsp. paratuberculosis
gccgacuuggucagcccgc

SEQ ID NO: 3025319 - RNA, 16 nt, Mycobacterium avium subsp. paratuberculosis
gccgagaacaggccga

SEQ ID NO: 3025320 - RNA, 21 nt, Mycobacterium avium subsp. paratuberculosis
gccgagaacaggccgagcgcg

SEQ ID NO: 3025321 - RNA, 22 nt, Mycobacterium avium subsp. paratuberculosis
gccgagaacaggccgagcgcgc

SEQ ID NO: 3025322 - RNA, 20 nt, Mycobacterium avium subsp. paratuberculosis
gccgagaccagccagaacga

SEQ ID NO: 3025323 - RNA, 13 nt, Mycobacterium avium subsp. paratuberculosis
gccgagacggcgu

SEQ ID NO: 3025324 - RNA, 14 nt, Mycobacterium avium subsp. paratuberculosis
gccgagacggcgug

SEQ ID NO: 3025325 - RNA, 17 nt, Mycobacterium avium subsp. paratuberculosis
gccgagacggcguggcu

SEQ ID NO: 3025326 - RNA, 15 nt, Mycobacterium avium subsp. paratuberculosis
gccgagacguggugg

SEQ ID NO: 3025327 - RNA, 16 nt, Mycobacterium avium subsp. paratuberculosis
gccgagacugauggug

SEQ ID NO: 3025328 - RNA, 18 nt, Mycobacterium avium subsp. paratuberculosis
gccgagacugaugguggc

SEQ ID NO: 3025329 - RNA, 19 nt, Mycobacterium avium subsp. paratuberculosis
gccgagacugaugguggcg

SEQ ID NO: 3025330 - RNA, 15 nt, Mycobacterium avium subsp. paratuberculosis
gccgagagcgcgucg

SEQ ID NO: 3025331 - RNA, 18 nt, Mycobacterium avium subsp. paratuberculosis
gccgagagcgcgucgacg

SEQ ID NO: 3025332 - RNA, 20 nt, Mycobacterium avium subsp. paratuberculosis
gccgagagcgcgucgacgcg

SEQ ID NO: 3025333 - RNA, 21 nt, Mycobacterium avium subsp. paratuberculosis
gccgagagcgcgucgacgcgg

SEQ ID NO: 3025334 - RNA, 22 nt, Mycobacterium avium subsp. paratuberculosis
gccgagagcgcgucgacgcggu

SEQ ID NO: 3025335 - RNA, 23 nt, Mycobacterium avium subsp. paratuberculosis
gccgagagcgcgucgacgcgguc

SEQ ID NO: 3025336 - RNA, 22 nt, Mycobacterium avium subsp. paratuberculosis
gccgagagcgucuuguuggcga

SEQ ID NO: 3025337 - RNA, 17 nt, Mycobacterium avium subsp. paratuberculosis
gccgagauccaccgcgc

SEQ ID NO: 3025338 - RNA, 18 nt, Mycobacterium avium subsp. paratuberculosis
gccgagauccaccgcgcg

SEQ ID NO: 3025339 - RNA, 20 nt, Mycobacterium avium subsp. paratuberculosis
gccgagauccaccgcgcggc

SEQ ID NO: 3025340 - RNA, 23 nt, Mycobacterium avium subsp. paratuberculosis
gccgagauccaccgcgcggccag

SEQ ID NO: 3025341 - RNA, 13 nt, Mycobacterium avium subsp. paratuberculosis
gccgagaucgacc

SEQ ID NO: 3025342 - RNA, 14 nt, Mycobacterium avium subsp. paratuberculosis
gccgagaucgaccc

SEQ ID NO: 3025343 - RNA, 17 nt, Mycobacterium avium subsp. paratuberculosis
gccgagaucgcgguggc

SEQ ID NO: 3025344 - RNA, 18 nt, Mycobacterium avium subsp. paratuberculosis
gccgagaucgcgguggcg

SEQ ID NO: 3025345 - RNA, 20 nt, Mycobacterium avium subsp. paratuberculosis
gccgagaucgcgguggcgcc

SEQ ID NO: 3025346 - RNA, 16 nt, Mycobacterium avium subsp. paratuberculosis
gccgagauuggacgac

SEQ ID NO: 3025347 - RNA, 21 nt, Mycobacterium avium subsp. paratuberculosis
gccgagauuggacgacaccac

SEQ ID NO: 3025348 - RNA, 17 nt, Mycobacterium avium subsp. paratuberculosis
gccgagcaacagcccga

SEQ ID NO: 3025349 - RNA, 13 nt, Mycobacterium avium subsp. paratuberculosis
gccgagcaaccgg

SEQ ID NO: 3025350 - RNA, 16 nt, Mycobacterium avium subsp. paratuberculosis
gccgagcaaccgggau

SEQ ID NO: 3025351 - RNA, 14 nt, Mycobacterium avium subsp. paratuberculosis
gccgagcacaccgu

SEQ ID NO: 3025352 - RNA, 15 nt, Mycobacterium avium subsp. paratuberculosis
gccgagcacaccguc

SEQ ID NO: 3025353 - RNA, 16 nt, Mycobacterium avium subsp. paratuberculosis
gccgagcacaccgucg

SEQ ID NO: 3025354 - RNA, 19 nt, Mycobacterium avium subsp. paratuberculosis
gccgagcacaccgucgccc

SEQ ID NO: 3025355 - RNA, 20 nt, Mycobacterium avium subsp. paratuberculosis
gccgagcacaccgucgcccg

SEQ ID NO: 3025356 - RNA, 21 nt, Mycobacterium avium subsp. paratuberculosis
gccgagcacaccgucgcccgc

SEQ ID NO: 3025357 - RNA, 16 nt, Mycobacterium avium subsp. paratuberculosis
gccgagcaccaggcgc

SEQ ID NO: 3025358 - RNA, 13 nt, Mycobacterium avium subsp. paratuberculosis
gccgagcaccccg

SEQ ID NO: 3025359 - RNA, 22 nt, Mycobacterium avium subsp. paratuberculosis
gccgagcaccccgucgagcagc

SEQ ID NO: 3025360 - RNA, 13 nt, Mycobacterium avium subsp. paratuberculosis
gccgagcaccggc

SEQ ID NO: 3025361 - RNA, 14 nt, Mycobacterium avium subsp. paratuberculosis
gccgagcaccggca

SEQ ID NO: 3025362 - RNA, 19 nt, Mycobacterium avium subsp. paratuberculosis
gccgagcaccggcagcacc

SEQ ID NO: 3025363 - RNA, 20 nt, Mycobacterium avium subsp. paratuberculosis
gccgagcaccggcagcaccg

SEQ ID NO: 3025364 - RNA, 21 nt, Mycobacterium avium subsp. paratuberculosis
gccgagcaccggcagcaccgc

SEQ ID NO: 3025365 - RNA, 22 nt, Mycobacterium avium subsp. paratuberculosis
gccgagcaccggcagcaccgcc

SEQ ID NO: 3025366 - RNA, 12 nt, Mycobacterium avium subsp. paratuberculosis
gccgagcaccuc

SEQ ID NO: 3025367 - RNA, 19 nt, Mycobacterium avium subsp. paratuberculosis
gccgagcaccuccgacauc

SEQ ID NO: 3025368 - RNA, 22 nt, Mycobacterium avium subsp. paratuberculosis
gccgagcaccucgucgccgucg

SEQ ID NO: 3025369 - RNA, 14 nt, Mycobacterium avium subsp. paratuberculosis
gccgagcaccuggc

SEQ ID NO: 3025370 - RNA, 14 nt, Mycobacterium avium subsp. paratuberculosis
gccgagcacgcagc

SEQ ID NO: 3025371 - RNA, 15 nt, Mycobacterium avium subsp. paratuberculosis
gccgagcacgcagcc

SEQ ID NO: 3025372 - RNA, 19 nt, Mycobacterium avium subsp. paratuberculosis
gccgagcacgcagccgcgc

SEQ ID NO: 3025373 - RNA, 23 nt, Mycobacterium avium subsp. paratuberculosis
gccgagcacgcagccgcgcccga

SEQ ID NO: 3025374 - RNA, 13 nt, Mycobacterium avium subsp. paratuberculosis
gccgagcacgcgg

SEQ ID NO: 3025375 - RNA, 18 nt, Mycobacterium avium subsp. paratuberculosis
gccgagcacgcggccgcg

SEQ ID NO: 3025376 - RNA, 22 nt, Mycobacterium avium subsp. paratuberculosis
gccgagcacggcucguccauca

SEQ ID NO: 3025377 - RNA, 14 nt, Mycobacterium avium subsp. paratuberculosis
gccgagcagagcua

SEQ ID NO: 3025378 - RNA, 14 nt, Mycobacterium avium subsp. paratuberculosis
gccgagcagaucgg

SEQ ID NO: 3025379 - RNA, 13 nt, Mycobacterium avium subsp. paratuberculosis
gccgagcagcacc

SEQ ID NO: 3025380 - RNA, 16 nt, Mycobacterium avium subsp. paratuberculosis
gccgagcagcaccgcg

SEQ ID NO: 3025381 - RNA, 17 nt, Mycobacterium avium subsp. paratuberculosis
gccgagcagcaccgcga

SEQ ID NO: 3025382 - RNA, 19 nt, Mycobacterium avium subsp. paratuberculosis
gccgagcagcaccgcgacc

SEQ ID NO: 3025383 - RNA, 16 nt, Mycobacterium avium subsp. paratuberculosis
gccgagcagcaccggc

SEQ ID NO: 3025384 - RNA, 12 nt, Mycobacterium avium subsp. paratuberculosis
gccgagcagccg

SEQ ID NO: 3025385 - RNA, 19 nt, Mycobacterium avium subsp. paratuberculosis
gccgagcagccgggccagc

SEQ ID NO: 3025386 - RNA, 22 nt, Mycobacterium avium subsp. paratuberculosis
gccgagcagccgggccagcaac

SEQ ID NO: 3025387 - RNA, 23 nt, Mycobacterium avium subsp. paratuberculosis
gccgagcagccgggccagcaaca

SEQ ID NO: 3025388 - RNA, 20 nt, Mycobacterium avium subsp. paratuberculosis
gccgagcagccgguccaugu

SEQ ID NO: 3025389 - RNA, 15 nt, Mycobacterium avium subsp. paratuberculosis
gccgagcagcucagc

SEQ ID NO: 3025390 - RNA, 17 nt, Mycobacterium avium subsp. paratuberculosis
gccgagcagcucagccg

SEQ ID NO: 3025391 - RNA, 22 nt, Mycobacterium avium subsp. paratuberculosis
gccgagcagcucagccgccugg

SEQ ID NO: 3025392 - RNA, 18 nt, Mycobacterium avium subsp. paratuberculosis
gccgaggccaacucgcga

SEQ ID NO: 3025393 - RNA, 14 nt, Mycobacterium avium subsp. paratuberculosis
gccgaggccagcac

SEQ ID NO: 3025394 - RNA, 16 nt, Mycobacterium avium subsp. paratuberculosis
gccgaggccgauggcg

SEQ ID NO: 3025395 - RNA, 22 nt, Mycobacterium avium subsp. paratuberculosis
gccgaggccgauggcgcccagc

SEQ ID NO: 3025396 - RNA, 15 nt, Mycobacterium avium subsp. paratuberculosis
gccgaggccuccagg

SEQ ID NO: 3025397 - RNA, 16 nt, Mycobacterium avium subsp. paratuberculosis
gccgaggccuccaggu

SEQ ID NO: 3025398 - RNA, 16 nt, Mycobacterium avium subsp. paratuberculosis
gccgaggcgagugagg

SEQ ID NO: 3025399 - RNA, 18 nt, Mycobacterium avium subsp. paratuberculosis
gccgaggcgaugccgugc

SEQ ID NO: 3025400 - RNA, 17 nt, Mycobacterium avium subsp. paratuberculosis
gccgaggcgcaacaccg

SEQ ID NO: 3025401 - RNA, 14 nt, Mycobacterium avium subsp. paratuberculosis
gccgaggcgcucgc

SEQ ID NO: 3025402 - RNA, 14 nt, Mycobacterium avium subsp. paratuberculosis
gccgaggcgcucgg

SEQ ID NO: 3025403 - RNA, 20 nt, Mycobacterium avium subsp. paratuberculosis
gccgaggcugacgaucgucg

SEQ ID NO: 3025404 - RNA, 14 nt, Mycobacterium avium subsp. paratuberculosis
gccgaggcugucgg

SEQ ID NO: 3025405 - RNA, 16 nt, Mycobacterium avium subsp. paratuberculosis
gccgaggcugucggag

SEQ ID NO: 3025406 - RNA, 13 nt, Mycobacterium avium subsp. paratuberculosis
gccgagggccagc

SEQ ID NO: 3025407 - RNA, 16 nt, Mycobacterium avium subsp. paratuberculosis
gccgagggccagcagc

SEQ ID NO: 3025408 - RNA, 20 nt, Mycobacterium avium subsp. paratuberculosis
gccgagggccagcagccagc

SEQ ID NO: 3025409 - RNA, 16 nt, Mycobacterium avium subsp. paratuberculosis
gccgagggcccgggca

SEQ ID NO: 3025410 - RNA, 19 nt, Mycobacterium avium subsp. paratuberculosis
gccgagggcccgggcaggc

SEQ ID NO: 3025411 - RNA, 13 nt, Mycobacterium avium subsp. paratuberculosis
gccgagggcgacg

SEQ ID NO: 3025412 - RNA, 12 nt, Mycobacterium avium subsp. paratuberculosis
gccgagggcggc

SEQ ID NO: 3025413 - RNA, 13 nt, Mycobacterium avium subsp. paratuberculosis
gccgagggcggcg

SEQ ID NO: 3025414 - RNA, 16 nt, Mycobacterium avium subsp. paratuberculosis
gccgagggcggcggcu

SEQ ID NO: 3025415 - RNA, 23 nt, Mycobacterium avium subsp. paratuberculosis
gccgagggguccggggcacggug

SEQ ID NO: 3025416 - RNA, 17 nt, Mycobacterium avium subsp. paratuberculosis
gccgagggugccggcca

SEQ ID NO: 3025417 - RNA, 18 nt, Mycobacterium avium subsp. paratuberculosis
gccgagggugccggccac

SEQ ID NO: 3025418 - RNA, 22 nt, Mycobacterium avium subsp. paratuberculosis
gccgagggugccggccaccggc

SEQ ID NO: 3025419 - RNA, 16 nt, Mycobacterium avium subsp. paratuberculosis
gccgaggguuccagcc

SEQ ID NO: 3025420 - RNA, 15 nt, Mycobacterium avium subsp. paratuberculosis
gccgagguacgcgcu

SEQ ID NO: 3025421 - RNA, 17 nt, Mycobacterium avium subsp. paratuberculosis
gccgagguagccgcgca

SEQ ID NO: 3025422 - RNA, 22 nt, Mycobacterium avium subsp. paratuberculosis
gccgagguagccgcgcaccacg

SEQ ID NO: 3025423 - RNA, 17 nt, Mycobacterium avium subsp. paratuberculosis
gccgagguagucggccu

SEQ ID NO: 3025424 - RNA, 16 nt, Mycobacterium avium subsp. paratuberculosis
gccgaggucaccgcgg

SEQ ID NO: 3025425 - RNA, 14 nt, Mycobacterium avium subsp. paratuberculosis
gccgagguccucga

SEQ ID NO: 3025426 - RNA, 16 nt, Mycobacterium avium subsp. paratuberculosis
gccgagguccucgacc

SEQ ID NO: 3025427 - RNA, 16 nt, Mycobacterium avium subsp. paratuberculosis
gccgaggucgccgacg

SEQ ID NO: 3025428 - RNA, 17 nt, Mycobacterium avium subsp. paratuberculosis
gccgaggucgccgacgc

SEQ ID NO: 3025429 - RNA, 19 nt, Mycobacterium avium subsp. paratuberculosis
gccgaggucgccgguguca

SEQ ID NO: 3025430 - RNA, 21 nt, Mycobacterium avium subsp. paratuberculosis
gccgaggucgcggcggccggc

SEQ ID NO: 3025431 - RNA, 20 nt, Mycobacterium avium subsp. paratuberculosis
gccgaggucuuucaucgccc

SEQ ID NO: 3025432 - RNA, 24 nt, Mycobacterium avium subsp. paratuberculosis
gccgaggucuuucaucgccccggc

SEQ ID NO: 3025433 - RNA, 23 nt, Mycobacterium avium subsp. paratuberculosis
gccgaggugcaacacucgagcgc

SEQ ID NO: 3025434 - RNA, 19 nt, Mycobacterium avium subsp. paratuberculosis
gccgaggugcugucgucgc

SEQ ID NO: 3025435 - RNA, 13 nt, Mycobacterium avium subsp. paratuberculosis
gccgagguggccc

SEQ ID NO: 3025436 - RNA, 15 nt, Mycobacterium avium subsp. paratuberculosis
gccgagguggcccgc

SEQ ID NO: 3025437 - RNA, 20 nt, Mycobacterium avium subsp. paratuberculosis
gccgagguggcccgccacgu

SEQ ID NO: 3025438 - RNA, 17 nt, Mycobacterium avium subsp. paratuberculosis
gccgagguggccgccag

SEQ ID NO: 3025439 - RNA, 18 nt, Mycobacterium avium subsp. paratuberculosis
gccgaguaccgacgagau

SEQ ID NO: 3025440 - RNA, 21 nt, Mycobacterium avium subsp. paratuberculosis
gccgaguauccgcgcagcguc

SEQ ID NO: 3025441 - RNA, 15 nt, Mycobacterium avium subsp. paratuberculosis
gccgaguccgggccg

SEQ ID NO: 3025442 - RNA, 19 nt, Mycobacterium avium subsp. paratuberculosis
gccgaguccgggccgccgg

SEQ ID NO: 3025443 - RNA, 20 nt, Mycobacterium avium subsp. paratuberculosis
gccgaguccgggccgccggc

SEQ ID NO: 3025444 - RNA, 21 nt, Mycobacterium avium subsp. paratuberculosis
gccgagucgacgugcucggcg

SEQ ID NO: 3025445 - RNA, 23 nt, Mycobacterium avium subsp. paratuberculosis
gccgagucgacgugcucggcggc

SEQ ID NO: 3025446 - RNA, 19 nt, Mycobacterium avium subsp. paratuberculosis
gccgagucgaucgccagcg

SEQ ID NO: 3025447 - RNA, 21 nt, Mycobacterium avium subsp. paratuberculosis
gccgagucgaucgccagcgcg

SEQ ID NO: 3025448 - RNA, 14 nt, Mycobacterium avium subsp. paratuberculosis
gccgagucgcgccg

SEQ ID NO: 3025449 - RNA, 15 nt, Mycobacterium avium subsp. paratuberculosis
gccgagucgcgccgc

SEQ ID NO: 3025450 - RNA, 16 nt, Mycobacterium avium subsp. paratuberculosis
gccgagucgcgccgcg

SEQ ID NO: 3025451 - RNA, 18 nt, Mycobacterium avium subsp. paratuberculosis
gccgagucgcgccgcguc

SEQ ID NO: 3025452 - RNA, 19 nt, Mycobacterium avium subsp. paratuberculosis
gccgagucgcgccgcgucg

SEQ ID NO: 3025453 - RNA, 20 nt, Mycobacterium avium subsp. paratuberculosis
gccgagucgcgccgcgucgc

SEQ ID NO: 3025454 - RNA, 21 nt, Mycobacterium avium subsp. paratuberculosis
gccgagucgcgccgcgucgcg

SEQ ID NO: 3025455 - RNA, 20 nt, Mycobacterium avium subsp. paratuberculosis
gccgaguuccugcgaccgcc

SEQ ID NO: 3025456 - RNA, 14 nt, Mycobacterium avium subsp. paratuberculosis
gccgaguucgaccu

SEQ ID NO: 3025457 - RNA, 16 nt, Mycobacterium avium subsp. paratuberculosis
gccgaguucgaccucg

SEQ ID NO: 3025458 - RNA, 17 nt, Mycobacterium avium subsp. paratuberculosis
gccgaguucgaccucgg

SEQ ID NO: 3025459 - RNA, 16 nt, Mycobacterium avium subsp. paratuberculosis
gccgaguuugcgguga

SEQ ID NO: 3025460 - RNA, 17 nt, Mycobacterium avium subsp. paratuberculosis
gccgauagucgcgggug

SEQ ID NO: 3025461 - RNA, 17 nt, Mycobacterium avium subsp. paratuberculosis
gccgauauaggugagaa

SEQ ID NO: 3025462 - RNA, 20 nt, Mycobacterium avium subsp. paratuberculosis
gccgauauaggugagaaaag

SEQ ID NO: 3025463 - RNA, 12 nt, Mycobacterium avium subsp. paratuberculosis
gccgaucaacag

SEQ ID NO: 3025464 - RNA, 15 nt, Mycobacterium avium subsp. paratuberculosis
gccgaucaacaggcc

SEQ ID NO: 3025465 - RNA, 13 nt, Mycobacterium avium subsp. paratuberculosis
gccgaucaccgcg

SEQ ID NO: 3025466 - RNA, 22 nt, Mycobacterium avium subsp. paratuberculosis
gccgaucaccgcguugucggcg

SEQ ID NO: 3025467 - RNA, 13 nt, Mycobacterium avium subsp. paratuberculosis
gccgaucaccggc

SEQ ID NO: 3025468 - RNA, 17 nt, Mycobacterium avium subsp. paratuberculosis
gccgaucaccggcacgu

SEQ ID NO: 3025469 - RNA, 20 nt, Mycobacterium avium subsp. paratuberculosis
gccgaucaccggcacgugcg

SEQ ID NO: 3025470 - RNA, 21 nt, Mycobacterium avium subsp. paratuberculosis
gccgaucaccggcacgugcgg

SEQ ID NO: 3025471 - RNA, 15 nt, Mycobacterium avium subsp. paratuberculosis
gccgaucaccggcgc

SEQ ID NO: 3025472 - RNA, 16 nt, Mycobacterium avium subsp. paratuberculosis
gccgaucaccggcgcg

SEQ ID NO: 3025473 - RNA, 17 nt, Mycobacterium avium subsp. paratuberculosis
gccgaucaccggcgcgu

SEQ ID NO: 3025474 - RNA, 18 nt, Mycobacterium avium subsp. paratuberculosis
gccgaucaccggcgcguu

SEQ ID NO: 3025475 - RNA, 13 nt, Mycobacterium avium subsp. paratuberculosis
gccgaucaccucg

SEQ ID NO: 3025476 - RNA, 16 nt, Mycobacterium avium subsp. paratuberculosis
gccgaucaccucgaug

SEQ ID NO: 3025477 - RNA, 13 nt, Mycobacterium avium subsp. paratuberculosis
gccgaucuggcgg

SEQ ID NO: 3025478 - RNA, 14 nt, Mycobacterium avium subsp. paratuberculosis
gccgaucuggcggg

SEQ ID NO: 3025479 - RNA, 18 nt, Mycobacterium avium subsp. paratuberculosis
gccgaucuggcgggcggu

SEQ ID NO: 3025480 - RNA, 22 nt, Mycobacterium avium subsp. paratuberculosis
gccgaucuggcgggcgguccag

SEQ ID NO: 3025481 - RNA, 12 nt, Mycobacterium avium subsp. paratuberculosis
gccgaucugguc

SEQ ID NO: 3025482 - RNA, 17 nt, Mycobacterium avium subsp. paratuberculosis
gccgaucugucgcgcuc

SEQ ID NO: 3025483 - RNA, 18 nt, Mycobacterium avium subsp. paratuberculosis
gccgaugaacaugcccug

SEQ ID NO: 3025484 - RNA, 19 nt, Mycobacterium avium subsp. paratuberculosis
gccgaugaacaugcccugc

SEQ ID NO: 3025485 - RNA, 20 nt, Mycobacterium avium subsp. paratuberculosis
gccgaugaacaugcccugca

SEQ ID NO: 3025486 - RNA, 12 nt, Mycobacterium avium subsp. paratuberculosis
gccgaugaaccg

SEQ ID NO: 3025487 - RNA, 14 nt, Mycobacterium avium subsp. paratuberculosis
gccgaugaccgcgg

SEQ ID NO: 3025488 - RNA, 16 nt, Mycobacterium avium subsp. paratuberculosis
gccgaugaccgcggcg

SEQ ID NO: 3025489 - RNA, 17 nt, Mycobacterium avium subsp. paratuberculosis
gccgaugaccgcggcgg

SEQ ID NO: 3025490 - RNA, 18 nt, Mycobacterium avium subsp. paratuberculosis
gccgaugaccgcggcggg

SEQ ID NO: 3025491 - RNA, 22 nt, Mycobacterium avium subsp. paratuberculosis
gccgaugaccgcggcgggcagg

SEQ ID NO: 3025492 - RNA, 16 nt, Mycobacterium avium subsp. paratuberculosis
gccgaugacggcgcga

SEQ ID NO: 3025493 - RNA, 20 nt, Mycobacterium avium subsp. paratuberculosis
gccgaugagccucagcgcgc

SEQ ID NO: 3025494 - RNA, 18 nt, Mycobacterium avium subsp. paratuberculosis
gccgaugaugaugccgcc

SEQ ID NO: 3025495 - RNA, 15 nt, Mycobacterium avium subsp. paratuberculosis
gccgaugcagcacau

SEQ ID NO: 3025496 - RNA, 19 nt, Mycobacterium avium subsp. paratuberculosis
gccgaugcagcacauccag

SEQ ID NO: 3025497 - RNA, 16 nt, Mycobacterium avium subsp. paratuberculosis
gccgaugcccagcagc

SEQ ID NO: 3025498 - RNA, 18 nt, Mycobacterium avium subsp. paratuberculosis
gccgaugcccaucacgcc

SEQ ID NO: 3025499 - RNA, 20 nt, Mycobacterium avium subsp. paratuberculosis
gccgaugcccaucacgcccc

SEQ ID NO: 3025500 - RNA, 21 nt, Mycobacterium avium subsp. paratuberculosis
gccgaugcccaucacgcccca

SEQ ID NO: 3025501 - RNA, 15 nt, Mycobacterium avium subsp. paratuberculosis
gccgaugccgcgcug

SEQ ID NO: 3025502 - RNA, 20 nt, Mycobacterium avium subsp. paratuberculosis
gccgaugccgcgcugcgccg

SEQ ID NO: 3025503 - RNA, 23 nt, Mycobacterium avium subsp. paratuberculosis
gccgaugccgcgcugcgccgggu

SEQ ID NO: 3025504 - RNA, 12 nt, Mycobacterium avium subsp. paratuberculosis
gccgaugccggc

SEQ ID NO: 3025505 - RNA, 21 nt, Mycobacterium avium subsp. paratuberculosis
gccgaugccggccuggcccag

SEQ ID NO: 3025506 - RNA, 14 nt, Mycobacterium avium subsp. paratuberculosis
gccgaugccggcgu

SEQ ID NO: 3025507 - RNA, 13 nt, Mycobacterium avium subsp. paratuberculosis
gccgaugcgcccg

SEQ ID NO: 3025508 - RNA, 14 nt, Mycobacterium avium subsp. paratuberculosis
gccgaugcgcccgc

SEQ ID NO: 3025509 - RNA, 15 nt, Mycobacterium avium subsp. paratuberculosis
gccgaugcgcccgcg

SEQ ID NO: 3025510 - RNA, 17 nt, Mycobacterium avium subsp. paratuberculosis
gccgaugcgcccgcgcc

SEQ ID NO: 3025511 - RNA, 16 nt, Mycobacterium avium subsp. paratuberculosis
gccgaugcgcccgcug

SEQ ID NO: 3025512 - RNA, 17 nt, Mycobacterium avium subsp. paratuberculosis
gccgaugcgcccgcugc

SEQ ID NO: 3025513 - RNA, 14 nt, Mycobacterium avium subsp. paratuberculosis
gccgaugcgccgca

SEQ ID NO: 3025514 - RNA, 17 nt, Mycobacterium avium subsp. paratuberculosis
gccgaugcgccgcacca

SEQ ID NO: 3025515 - RNA, 14 nt, Mycobacterium avium subsp. paratuberculosis
gccgaugcgguuga

SEQ ID NO: 3025516 - RNA, 18 nt, Mycobacterium avium subsp. paratuberculosis
gccgaugcugagcggguc

SEQ ID NO: 3025517 - RNA, 22 nt, Mycobacterium avium subsp. paratuberculosis
gccgaugcugagcgggucggcc

SEQ ID NO: 3025518 - RNA, 23 nt, Mycobacterium avium subsp. paratuberculosis
gccgaugcugagcgggucggccg

SEQ ID NO: 3025519 - RNA, 20 nt, Mycobacterium avium subsp. paratuberculosis
gccgauggacacgcugccga

SEQ ID NO: 3025520 - RNA, 14 nt, Mycobacterium avium subsp. paratuberculosis
gccgauggagaccu

SEQ ID NO: 3025521 - RNA, 14 nt, Mycobacterium avium subsp. paratuberculosis
gccgauggccaccg

SEQ ID NO: 3025522 - RNA, 15 nt, Mycobacterium avium subsp. paratuberculosis
gccgauggccaccgg

SEQ ID NO: 3025523 - RNA, 16 nt, Mycobacterium avium subsp. paratuberculosis
gccgauggccaccggg

SEQ ID NO: 3025524 - RNA, 17 nt, Mycobacterium avium subsp. paratuberculosis
gccgauggccaccgggc

SEQ ID NO: 3025525 - RNA, 18 nt, Mycobacterium avium subsp. paratuberculosis
gccgauggccaccgggcg

SEQ ID NO: 3025526 - RNA, 19 nt, Mycobacterium avium subsp. paratuberculosis
gccgauggccaccgggcgu

SEQ ID NO: 3025527 - RNA, 15 nt, Mycobacterium avium subsp. paratuberculosis
gccgauggcccaggc

SEQ ID NO: 3025528 - RNA, 20 nt, Mycobacterium avium subsp. paratuberculosis
gccgauggcccaggccgcgg

SEQ ID NO: 3025529 - RNA, 22 nt, Mycobacterium avium subsp. paratuberculosis
gccgauggcccaggccgcgguc

SEQ ID NO: 3025530 - RNA, 23 nt, Mycobacterium avium subsp. paratuberculosis
gccgauggcccaggccgcggucg

SEQ ID NO: 3025531 - RNA, 19 nt, Mycobacterium avium subsp. paratuberculosis
gccgauggccugguggccc

SEQ ID NO: 3025532 - RNA, 20 nt, Mycobacterium avium subsp. paratuberculosis
gccgauggccugguggccca

SEQ ID NO: 3025533 - RNA, 22 nt, Mycobacterium avium subsp. paratuberculosis
gccgauggccugguggcccagg

SEQ ID NO: 3025534 - RNA, 21 nt, Mycobacterium avium subsp. paratuberculosis
gccgauggcgaagcccaugcc

SEQ ID NO: 3025535 - RNA, 16 nt, Mycobacterium avium subsp. paratuberculosis
gccgauggcgcccagc

SEQ ID NO: 3025536 - RNA, 19 nt, Mycobacterium avium subsp. paratuberculosis
gccgauggcgcccagcguc

SEQ ID NO: 3025537 - RNA, 20 nt, Mycobacterium avium subsp. paratuberculosis
gccgauggcgcccagcgucu

SEQ ID NO: 3025538 - RNA, 21 nt, Mycobacterium avium subsp. paratuberculosis
gccgauggcguucaucgucca

SEQ ID NO: 3025539 - RNA, 13 nt, Mycobacterium avium subsp. paratuberculosis
gccgauggucagc

SEQ ID NO: 3025540 - RNA, 16 nt, Mycobacterium avium subsp. paratuberculosis
gccgauggucagcugc

SEQ ID NO: 3025541 - RNA, 17 nt, Mycobacterium avium subsp. paratuberculosis
gccgauggucagcugcc

SEQ ID NO: 3025542 - RNA, 18 nt, Mycobacterium avium subsp. paratuberculosis
gccgauggucagcugccg

SEQ ID NO: 3025543 - RNA, 19 nt, Mycobacterium avium subsp. paratuberculosis
gccgauggucagcugccgc

SEQ ID NO: 3025544 - RNA, 20 nt, Mycobacterium avium subsp. paratuberculosis
gccgauggucagcugccgca

SEQ ID NO: 3025545 - RNA, 16 nt, Mycobacterium avium subsp. paratuberculosis
gccgauggugaccucg

SEQ ID NO: 3025546 - RNA, 18 nt, Mycobacterium avium subsp. paratuberculosis
gccgauggugaccucggu

SEQ ID NO: 3025547 - RNA, 19 nt, Mycobacterium avium subsp. paratuberculosis
gccgauggugaccucgguc

SEQ ID NO: 3025548 - RNA, 23 nt, Mycobacterium avium subsp. paratuberculosis
gccgauggugacgauccggucga

SEQ ID NO: 3025549 - RNA, 17 nt, Mycobacterium avium subsp. paratuberculosis
gccgauggugacggugc

SEQ ID NO: 3025550 - RNA, 23 nt, Mycobacterium avium subsp. paratuberculosis
gccgauggugacggugccgccgu

SEQ ID NO: 3025551 - RNA, 18 nt, Mycobacterium avium subsp. paratuberculosis
gccgauggugguaccgac

SEQ ID NO: 3025552 - RNA, 20 nt, Mycobacterium avium subsp. paratuberculosis
gccgauggugguaccgaccu

SEQ ID NO: 3025553 - RNA, 18 nt, Mycobacterium avium subsp. paratuberculosis
gccgaugguguggaucgc

SEQ ID NO: 3025554 - RNA, 24 nt, Mycobacterium avium subsp. paratuberculosis
gccgaugguguggaucgcuucggc

SEQ ID NO: 3025555 - RNA, 15 nt, Mycobacterium avium subsp. paratuberculosis
gccgauguccccgcg

SEQ ID NO: 3025556 - RNA, 19 nt, Mycobacterium avium subsp. paratuberculosis
gccgaugucggacuucugg

SEQ ID NO: 3025557 - RNA, 14 nt, Mycobacterium avium subsp. paratuberculosis
gccgaugucggccg

SEQ ID NO: 3025558 - RNA, 14 nt, Mycobacterium avium subsp. paratuberculosis
gccgaugucggcgu

SEQ ID NO: 3025559 - RNA, 16 nt, Mycobacterium avium subsp. paratuberculosis
gccgaugucggcguug

SEQ ID NO: 3025560 - RNA, 17 nt, Mycobacterium avium subsp. paratuberculosis
gccgaugucggcguugc

SEQ ID NO: 3025561 - RNA, 20 nt, Mycobacterium avium subsp. paratuberculosis
gccgcaccucgccggccgcc

SEQ ID NO: 3025562 - RNA, 12 nt, Mycobacterium avium subsp. paratuberculosis
gccgcaccucgg

SEQ ID NO: 3025563 - RNA, 21 nt, Mycobacterium avium subsp. paratuberculosis
gccgcaccucggggcguggcg

SEQ ID NO: 3025564 - RNA, 22 nt, Mycobacterium avium subsp. paratuberculosis
gccgcaccucggggcguggcgg

SEQ ID NO: 3025565 - RNA, 14 nt, Mycobacterium avium subsp. paratuberculosis
gccgcaccugaucg

SEQ ID NO: 3025566 - RNA, 15 nt, Mycobacterium avium subsp. paratuberculosis
gccgcaccuggcagc

SEQ ID NO: 3025567 - RNA, 13 nt, Mycobacterium avium subsp. paratuberculosis
gccgcaccugguu

SEQ ID NO: 3025568 - RNA, 17 nt, Mycobacterium avium subsp. paratuberculosis
gccgcacgaaccgcucg

SEQ ID NO: 3025569 - RNA, 13 nt, Mycobacterium avium subsp. paratuberculosis
gccgcacgcccac

SEQ ID NO: 3025570 - RNA, 14 nt, Mycobacterium avium subsp. paratuberculosis
gccgcacgcgaaca

SEQ ID NO: 3025571 - RNA, 18 nt, Mycobacterium avium subsp. paratuberculosis
gccgcacgcgaacaccag

SEQ ID NO: 3025572 - RNA, 16 nt, Mycobacterium avium subsp. paratuberculosis
gccgcacgcgaccgcg

SEQ ID NO: 3025573 - RNA, 17 nt, Mycobacterium avium subsp. paratuberculosis
gccgcacgcgaccgcgu

SEQ ID NO: 3025574 - RNA, 18 nt, Mycobacterium avium subsp. paratuberculosis
gccgcacgcgaccgcguc

SEQ ID NO: 3025575 - RNA, 20 nt, Mycobacterium avium subsp. paratuberculosis
gccgcacgcgaccgcgucga

SEQ ID NO: 3025576 - RNA, 22 nt, Mycobacterium avium subsp. paratuberculosis
gccgcacgcgaccgcgucgacg

SEQ ID NO: 3025577 - RNA, 18 nt, Mycobacterium avium subsp. paratuberculosis
gccgcacggugcagcagc

SEQ ID NO: 3025578 - RNA, 17 nt, Mycobacterium avium subsp. paratuberculosis
gccgcacguauccgcgg

SEQ ID NO: 3025579 - RNA, 22 nt, Mycobacterium avium subsp. paratuberculosis
gccgcacguauccgcggucgac

SEQ ID NO: 3025580 - RNA, 23 nt, Mycobacterium avium subsp. paratuberculosis
gccgcacguauccgcggucgacc

SEQ ID NO: 3025581 - RNA, 14 nt, Mycobacterium avium subsp. paratuberculosis
gccgcacgucccgc

SEQ ID NO: 3025582 - RNA, 19 nt, Mycobacterium avium subsp. paratuberculosis
gccgcacgucccgcccggc

SEQ ID NO: 3025583 - RNA, 22 nt, Mycobacterium avium subsp. paratuberculosis
gccgcacgucccgcccggcgcc

SEQ ID NO: 3025584 - RNA, 20 nt, Mycobacterium avium subsp. paratuberculosis
gccgcacguguucucacggc

SEQ ID NO: 3025585 - RNA, 22 nt, Mycobacterium avium subsp. paratuberculosis
gccgcacguguucucacggcga

SEQ ID NO: 3025586 - RNA, 18 nt, Mycobacterium avium subsp. paratuberculosis
gccgcacuccgucgcgau

SEQ ID NO: 3025587 - RNA, 19 nt, Mycobacterium avium subsp. paratuberculosis
gccgcacuccgucgcgauc

SEQ ID NO: 3025588 - RNA, 23 nt, Mycobacterium avium subsp. paratuberculosis
gccgcacuccgucgcgaucacac

SEQ ID NO: 3025589 - RNA, 18 nt, Mycobacterium avium subsp. paratuberculosis
gccgcacucuugcgugcg

SEQ ID NO: 3025590 - RNA, 17 nt, Mycobacterium avium subsp. paratuberculosis
gccgcacugcacggccu

SEQ ID NO: 3025591 - RNA, 23 nt, Mycobacterium avium subsp. paratuberculosis
gccgcacuuggccucgggcgacg

SEQ ID NO: 3025592 - RNA, 17 nt, Mycobacterium avium subsp. paratuberculosis
gccgcagaucagggcga

SEQ ID NO: 3025593 - RNA, 14 nt, Mycobacterium avium subsp. paratuberculosis
gccgcagcaccacc

SEQ ID NO: 3025594 - RNA, 17 nt, Mycobacterium avium subsp. paratuberculosis
gccgcagcaccaccucg

SEQ ID NO: 3025595 - RNA, 12 nt, Mycobacterium avium subsp. paratuberculosis
gccgcagcacgg

SEQ ID NO: 3025596 - RNA, 12 nt, Mycobacterium avium subsp. paratuberculosis
gccgcagcagcc

SEQ ID NO: 3025597 - RNA, 13 nt, Mycobacterium avium subsp. paratuberculosis
gccgcagcagccg

SEQ ID NO: 3025598 - RNA, 16 nt, Mycobacterium avium subsp. paratuberculosis
gccgcagcagccgcgc

SEQ ID NO: 3025599 - RNA, 14 nt, Mycobacterium avium subsp. paratuberculosis
gccgcagcagcgag

SEQ ID NO: 3025600 - RNA, 17 nt, Mycobacterium avium subsp. paratuberculosis
gccgcagcagcgaggcc

SEQ ID NO: 3025601 - RNA, 23 nt, Mycobacterium avium subsp. paratuberculosis
gccgcagcagcgaggccucgccg

SEQ ID NO: 3025602 - RNA, 19 nt, Mycobacterium avium subsp. paratuberculosis
gccgcagcaggugcgccag

SEQ ID NO: 3025603 - RNA, 21 nt, Mycobacterium avium subsp. paratuberculosis
gccgcagcaggugcgccagau

SEQ ID NO: 3025604 - RNA, 14 nt, Mycobacterium avium subsp. paratuberculosis
gccgcagcccaggc

SEQ ID NO: 3025605 - RNA, 15 nt, Mycobacterium avium subsp. paratuberculosis
gccgcagcccaggcc

SEQ ID NO: 3025606 - RNA, 20 nt, Mycobacterium avium subsp. paratuberculosis
gccgcagcccaggcccagca

SEQ ID NO: 3025607 - RNA, 21 nt, Mycobacterium avium subsp. paratuberculosis
gccgcagcccaggcccagcag

SEQ ID NO: 3025608 - RNA, 22 nt, Mycobacterium avium subsp. paratuberculosis
gccgcagcccaggcccagcagc

SEQ ID NO: 3025609 - RNA, 14 nt, Mycobacterium avium subsp. paratuberculosis
gccgcagccgaucu

SEQ ID NO: 3025610 - RNA, 12 nt, Mycobacterium avium subsp. paratuberculosis
gccgcagccgcg

SEQ ID NO: 3025611 - RNA, 22 nt, Mycobacterium avium subsp. paratuberculosis
gccgcagccgcgcggccggcca

SEQ ID NO: 3025612 - RNA, 15 nt, Mycobacterium avium subsp. paratuberculosis
gccgcagccgggugg

SEQ ID NO: 3025613 - RNA, 20 nt, Mycobacterium avium subsp. paratuberculosis
gccgcagccgggugggcggc

SEQ ID NO: 3025614 - RNA, 24 nt, Mycobacterium avium subsp. paratuberculosis
gccgcagccuucuuggcgggcgcc

SEQ ID NO: 3025615 - RNA, 14 nt, Mycobacterium avium subsp. paratuberculosis
gccgcagcgcagcg

SEQ ID NO: 3025616 - RNA, 19 nt, Mycobacterium avium subsp. paratuberculosis
gccgcagcgcagcgucggc

SEQ ID NO: 3025617 - RNA, 22 nt, Mycobacterium avium subsp. paratuberculosis
gccgcagcgcagcgucggcgug

SEQ ID NO: 3025618 - RNA, 13 nt, Mycobacterium avium subsp. paratuberculosis
gccgcagcgcauc

SEQ ID NO: 3025619 - RNA, 14 nt, Mycobacterium avium subsp. paratuberculosis
gccgcagcgcaucg

SEQ ID NO: 3025620 - RNA, 17 nt, Mycobacterium avium subsp. paratuberculosis
gccgcagcgcaucgccg

SEQ ID NO: 3025621 - RNA, 19 nt, Mycobacterium avium subsp. paratuberculosis
gccgcagcgcaucgccggc

SEQ ID NO: 3025622 - RNA, 13 nt, Mycobacterium avium subsp. paratuberculosis
gccgcagcgcccg

SEQ ID NO: 3025623 - RNA, 19 nt, Mycobacterium avium subsp. paratuberculosis
gccgcagcgcccggcagcg

SEQ ID NO: 3025624 - RNA, 12 nt, Mycobacterium avium subsp. paratuberculosis
gccgcagcgcga

SEQ ID NO: 3025625 - RNA, 14 nt, Mycobacterium avium subsp. paratuberculosis
gccgcagcgcgacg

SEQ ID NO: 3025626 - RNA, 12 nt, Mycobacterium avium subsp. paratuberculosis
gccgcagcgcgc

SEQ ID NO: 3025627 - RNA, 15 nt, Mycobacterium avium subsp. paratuberculosis
gccgcagcgcgcgac

SEQ ID NO: 3025628 - RNA, 18 nt, Mycobacterium avium subsp. paratuberculosis
gccgcagcgcgcgaccgc

SEQ ID NO: 3025629 - RNA, 19 nt, Mycobacterium avium subsp. paratuberculosis
gccgcagcgcgcgaccgcg

SEQ ID NO: 3025630 - RNA, 16 nt, Mycobacterium avium subsp. paratuberculosis
gccgcagcgcgcgcuc

SEQ ID NO: 3025631 - RNA, 15 nt, Mycobacterium avium subsp. paratuberculosis
gccgcagcgcgcggg

SEQ ID NO: 3025632 - RNA, 15 nt, Mycobacterium avium subsp. paratuberculosis
gccgcagcgcggcga

SEQ ID NO: 3025633 - RNA, 16 nt, Mycobacterium avium subsp. paratuberculosis
gccgcagcgcggcgac

SEQ ID NO: 3025634 - RNA, 17 nt, Mycobacterium avium subsp. paratuberculosis
gccgcagcgcggcgaca

SEQ ID NO: 3025635 - RNA, 16 nt, Mycobacterium avium subsp. paratuberculosis
gccgcagcggcgccgc

SEQ ID NO: 3025636 - RNA, 17 nt, Mycobacterium avium subsp. paratuberculosis
gccgcagcggcgccgca

SEQ ID NO: 3025637 - RNA, 22 nt, Mycobacterium avium subsp. paratuberculosis
gccgcagcggcgccgcagcucg

SEQ ID NO: 3025638 - RNA, 23 nt, Mycobacterium avium subsp. paratuberculosis
gccgcagcggcgccgcagcucgu

SEQ ID NO: 3025639 - RNA, 13 nt, Mycobacterium avium subsp. paratuberculosis
gccgcagcggcgg

SEQ ID NO: 3025640 - RNA, 14 nt, Mycobacterium avium subsp. paratuberculosis
gccgcagcggcggc

SEQ ID NO: 3025641 - RNA, 15 nt, Mycobacterium avium subsp. paratuberculosis
gccgcagcggcggca

SEQ ID NO: 3025642 - RNA, 15 nt, Mycobacterium avium subsp. paratuberculosis
gccgcagcggcggcu

SEQ ID NO: 3025643 - RNA, 18 nt, Mycobacterium avium subsp. paratuberculosis
gccgcagcggcggcucgu

SEQ ID NO: 3025644 - RNA, 18 nt, Mycobacterium avium subsp. paratuberculosis
gccgcagcgugggcaccg

SEQ ID NO: 3025645 - RNA, 14 nt, Mycobacterium avium subsp. paratuberculosis
gccgcagcucgauc

SEQ ID NO: 3025646 - RNA, 13 nt, Mycobacterium avium subsp. paratuberculosis
gccgccacgcugg

SEQ ID NO: 3025647 - RNA, 22 nt, Mycobacterium avium subsp. paratuberculosis
gccgccacgcuggugugacgcu

SEQ ID NO: 3025648 - RNA, 15 nt, Mycobacterium avium subsp. paratuberculosis
gccgccacggcacgu

SEQ ID NO: 3025649 - RNA, 19 nt, Mycobacterium avium subsp. paratuberculosis
gccgccacggccaccgccg

SEQ ID NO: 3025650 - RNA, 13 nt, Mycobacterium avium subsp. paratuberculosis
gccgccacggcgc

SEQ ID NO: 3025651 - RNA, 15 nt, Mycobacterium avium subsp. paratuberculosis
gccgccacggcgcca

SEQ ID NO: 3025652 - RNA, 21 nt, Mycobacterium avium subsp. paratuberculosis
gccgccacggcgccaugcgcc

SEQ ID NO: 3025653 - RNA, 18 nt, Mycobacterium avium subsp. paratuberculosis
gccgccacggggcccgcg

SEQ ID NO: 3025654 - RNA, 20 nt, Mycobacterium avium subsp. paratuberculosis
gccgccacggggcccgcgac

SEQ ID NO: 3025655 - RNA, 15 nt, Mycobacterium avium subsp. paratuberculosis
gccgccagcaacccc

SEQ ID NO: 3025656 - RNA, 18 nt, Mycobacterium avium subsp. paratuberculosis
gccgccagcaaccccgcg

SEQ ID NO: 3025657 - RNA, 20 nt, Mycobacterium avium subsp. paratuberculosis
gccgccagcaaccccgcggu

SEQ ID NO: 3025658 - RNA, 21 nt, Mycobacterium avium subsp. paratuberculosis
gccgccagcaaccccgcggug

SEQ ID NO: 3025659 - RNA, 22 nt, Mycobacterium avium subsp. paratuberculosis
gccgccagcaaccccgcggugc

SEQ ID NO: 3025660 - RNA, 15 nt, Mycobacterium avium subsp. paratuberculosis
gccgccagcaccacc

SEQ ID NO: 3025661 - RNA, 20 nt, Mycobacterium avium subsp. paratuberculosis
gccgccagcaccaccgucac

SEQ ID NO: 3025662 - RNA, 14 nt, Mycobacterium avium subsp. paratuberculosis
gccgccagcaccuc

SEQ ID NO: 3025663 - RNA, 22 nt, Mycobacterium avium subsp. paratuberculosis
gccgccagcaccucgcggcagc

SEQ ID NO: 3025664 - RNA, 15 nt, Mycobacterium avium subsp. paratuberculosis
gccgccagcacguga

SEQ ID NO: 3025665 - RNA, 20 nt, Mycobacterium avium subsp. paratuberculosis
gccgccagcacgugaugcag

SEQ ID NO: 3025666 - RNA, 12 nt, Mycobacterium avium subsp. paratuberculosis
gccgccagcagc

SEQ ID NO: 3025667 - RNA, 20 nt, Mycobacterium avium subsp. paratuberculosis
gccgccagcagcacggcaau

SEQ ID NO: 3025668 - RNA, 16 nt, Mycobacterium avium subsp. paratuberculosis
gccgccagcagcagcg

SEQ ID NO: 3025669 - RNA, 22 nt, Mycobacterium avium subsp. paratuberculosis
gccgccagcagcagcgccgcca

SEQ ID NO: 3025670 - RNA, 14 nt, Mycobacterium avium subsp. paratuberculosis
gccgccagcagugu

SEQ ID NO: 3025671 - RNA, 14 nt, Mycobacterium avium subsp. paratuberculosis
gccgccagccagcc

SEQ ID NO: 3025672 - RNA, 16 nt, Mycobacterium avium subsp. paratuberculosis
gccgccagccagccgg

SEQ ID NO: 3025673 - RNA, 19 nt, Mycobacterium avium subsp. paratuberculosis
gccgccagccgcagcaggc

SEQ ID NO: 3025674 - RNA, 13 nt, Mycobacterium avium subsp. paratuberculosis
gccgccagccgcg

SEQ ID NO: 3025675 - RNA, 15 nt, Mycobacterium avium subsp. paratuberculosis
gccgccagccgcguc

SEQ ID NO: 3025676 - RNA, 12 nt, Mycobacterium avium subsp. paratuberculosis
gccgccagccgg

SEQ ID NO: 3025677 - RNA, 13 nt, Mycobacterium avium subsp. paratuberculosis
gccgccagccggu

SEQ ID NO: 3025678 - RNA, 12 nt, Mycobacterium avium subsp. paratuberculosis
gccgccagcgca

SEQ ID NO: 3025679 - RNA, 19 nt, Mycobacterium avium subsp. paratuberculosis
gccgccagcgcaccgagcc

SEQ ID NO: 3025680 - RNA, 12 nt, Mycobacterium avium subsp. paratuberculosis
gccgccagcgcc

SEQ ID NO: 3025681 - RNA, 16 nt, Mycobacterium avium subsp. paratuberculosis
gccgccagcgccaccc

SEQ ID NO: 3025682 - RNA, 21 nt, Mycobacterium avium subsp. paratuberculosis
gccgccagcgccaccccccag

SEQ ID NO: 3025683 - RNA, 16 nt, Mycobacterium avium subsp. paratuberculosis
gccgccagcgcccgcg

SEQ ID NO: 3025684 - RNA, 22 nt, Mycobacterium avium subsp. paratuberculosis
gccgccagcgcccgcgcguggg

SEQ ID NO: 3025685 - RNA, 19 nt, Mycobacterium avium subsp. paratuberculosis
gccgccagcgcggcgauca

SEQ ID NO: 3025686 - RNA, 21 nt, Mycobacterium avium subsp. paratuberculosis
gccgccagcgcggcgaucagc

SEQ ID NO: 3025687 - RNA, 17 nt, Mycobacterium avium subsp. paratuberculosis
gccgccagcgcgggguc

SEQ ID NO: 3025688 - RNA, 20 nt, Mycobacterium avium subsp. paratuberculosis
gccgccagcgcggggucggc

SEQ ID NO: 3025689 - RNA, 22 nt, Mycobacterium avium subsp. paratuberculosis
gccgccagcgucccguccuggg

SEQ ID NO: 3025690 - RNA, 13 nt, Mycobacterium avium subsp. paratuberculosis
gccgccagcucgu

SEQ ID NO: 3025691 - RNA, 14 nt, Mycobacterium avium subsp. paratuberculosis
gccgccagcucguc

SEQ ID NO: 3025692 - RNA, 21 nt, Mycobacterium avium subsp. paratuberculosis
gccgccaggaucugcucggcg

SEQ ID NO: 3025693 - RNA, 14 nt, Mycobacterium avium subsp. paratuberculosis
gccgccagggccag

SEQ ID NO: 3025694 - RNA, 21 nt, Mycobacterium avium subsp. paratuberculosis
gccgccagggucucgggcagc

SEQ ID NO: 3025695 - RNA, 21 nt, Mycobacterium avium subsp. paratuberculosis
gccgccaggucggggcccguc

SEQ ID NO: 3025696 - RNA, 16 nt, Mycobacterium avium subsp. paratuberculosis
gccgccagguuggcgg

SEQ ID NO: 3025697 - RNA, 20 nt, Mycobacterium avium subsp. paratuberculosis
gccgccagguuggcggcggc

SEQ ID NO: 3025698 - RNA, 21 nt, Mycobacterium avium subsp. paratuberculosis
gccgccagguuggcggcggcc

SEQ ID NO: 3025699 - RNA, 21 nt, Mycobacterium avium subsp. paratuberculosis
gccgccaguuguuggccgggc

SEQ ID NO: 3025700 - RNA, 22 nt, Mycobacterium avium subsp. paratuberculosis
gccgccaguuguuggccgggca

SEQ ID NO: 3025701 - RNA, 13 nt, Mycobacterium avium subsp. paratuberculosis
gccgccaucaccg

SEQ ID NO: 3025702 - RNA, 15 nt, Mycobacterium avium subsp. paratuberculosis
gccgccaucauccgc

SEQ ID NO: 3025703 - RNA, 18 nt, Mycobacterium avium subsp. paratuberculosis
gccgccaucauccgcugg

SEQ ID NO: 3025704 - RNA, 12 nt, Mycobacterium avium subsp. paratuberculosis
gccgccauccgc

SEQ ID NO: 3025705 - RNA, 15 nt, Mycobacterium avium subsp. paratuberculosis
gccgccauccgcgcc

SEQ ID NO: 3025706 - RNA, 16 nt, Mycobacterium avium subsp. paratuberculosis
gccgccauccgcgccg

SEQ ID NO: 3025707 - RNA, 21 nt, Mycobacterium avium subsp. paratuberculosis
gccgccauccgcgccgaacgc

SEQ ID NO: 3025708 - RNA, 16 nt, Mycobacterium avium subsp. paratuberculosis
gccgccauccguucgg

SEQ ID NO: 3025709 - RNA, 17 nt, Mycobacterium avium subsp. paratuberculosis
gccgccauccguucggc

SEQ ID NO: 3025710 - RNA, 19 nt, Mycobacterium avium subsp. paratuberculosis
gccgccauccguucggcuc

SEQ ID NO: 3025711 - RNA, 18 nt, Mycobacterium avium subsp. paratuberculosis
gccgccaucgccgccgcc

SEQ ID NO: 3025712 - RNA, 19 nt, Mycobacterium avium subsp. paratuberculosis
gccgccaucgccgccgcca

SEQ ID NO: 3025713 - RNA, 15 nt, Mycobacterium avium subsp. paratuberculosis
gccgccaucgccucg

SEQ ID NO: 3025714 - RNA, 14 nt, Mycobacterium avium subsp. paratuberculosis
gccgccaucuccuc

SEQ ID NO: 3025715 - RNA, 23 nt, Mycobacterium avium subsp. paratuberculosis
gccgccauguacagaccccacac

SEQ ID NO: 3025716 - RNA, 20 nt, Mycobacterium avium subsp. paratuberculosis
gccgcccaacgacgucggcg

SEQ ID NO: 3025717 - RNA, 16 nt, Mycobacterium avium subsp. paratuberculosis
gccgcccacaccgaca

SEQ ID NO: 3025718 - RNA, 22 nt, Mycobacterium avium subsp. paratuberculosis
gccgcccacaccgacaccggcc

SEQ ID NO: 3025719 - RNA, 13 nt, Mycobacterium avium subsp. paratuberculosis
gccgcccaccacc

SEQ ID NO: 3025720 - RNA, 22 nt, Mycobacterium avium subsp. paratuberculosis
gccgcccaccacgaaccaggcg

SEQ ID NO: 3025721 - RNA, 21 nt, Mycobacterium avium subsp. paratuberculosis
gccgcccaccuucccaacccc

SEQ ID NO: 3025722 - RNA, 18 nt, Mycobacterium avium subsp. paratuberculosis
gccgcccacgccgcccag

SEQ ID NO: 3025723 - RNA, 21 nt, Mycobacterium avium subsp. paratuberculosis
gccgcccacgccgcccaggcc

SEQ ID NO: 3025724 - RNA, 19 nt, Mycobacterium avium subsp. paratuberculosis
gccgcccacguaggggccc

SEQ ID NO: 3025725 - RNA, 20 nt, Mycobacterium avium subsp. paratuberculosis
gccgcccacguaggggcccg

SEQ ID NO: 3025726 - RNA, 16 nt, Mycobacterium avium subsp. paratuberculosis
gccgcccacguucagc

SEQ ID NO: 3025727 - RNA, 20 nt, Mycobacterium avium subsp. paratuberculosis
gccgcccacuggucguugca

SEQ ID NO: 3025728 - RNA, 17 nt, Mycobacterium avium subsp. paratuberculosis
gccgcccagcagcgggc

SEQ ID NO: 3025729 - RNA, 18 nt, Mycobacterium avium subsp. paratuberculosis
gccgcccagcagcgggcc

SEQ ID NO: 3025730 - RNA, 12 nt, Mycobacterium avium subsp. paratuberculosis
gacgcccgcgag

SEQ ID NO: 3025731 - RNA, 14 nt, Mycobacterium avium subsp. paratuberculosis
gacgcccggcgccg

SEQ ID NO: 3025732 - RNA, 24 nt, Mycobacterium avium subsp. paratuberculosis
gacgcccggcuucgccgccgcacc

SEQ ID NO: 3025733 - RNA, 14 nt, Mycobacterium avium subsp. paratuberculosis
gacgcccgucgcgc

SEQ ID NO: 3025734 - RNA, 13 nt, Mycobacterium avium subsp. paratuberculosis
gacgcccuccugg

SEQ ID NO: 3025735 - RNA, 14 nt, Mycobacterium avium subsp. paratuberculosis
gacgcccuccuggc

SEQ ID NO: 3025736 - RNA, 21 nt, Mycobacterium avium subsp. paratuberculosis
gacgcccuccuggcggguggc

SEQ ID NO: 3025737 - RNA, 23 nt, Mycobacterium avium subsp. paratuberculosis
gacgcccuccuggcggguggcga

SEQ ID NO: 3025738 - RNA, 15 nt, Mycobacterium avium subsp. paratuberculosis
gacgcccugccacag

SEQ ID NO: 3025739 - RNA, 16 nt, Mycobacterium avium subsp. paratuberculosis
gacgcccugccacagc

SEQ ID NO: 3025740 - RNA, 20 nt, Mycobacterium avium subsp. paratuberculosis
gacgcccugccacagcgaca

SEQ ID NO: 3025741 - RNA, 17 nt, Mycobacterium avium subsp. paratuberculosis
gacgcccuuggcgccca

SEQ ID NO: 3025742 - RNA, 22 nt, Mycobacterium avium subsp. paratuberculosis
gacgcccuuggcgcccagcgug

SEQ ID NO: 3025743 - RNA, 21 nt, Mycobacterium avium subsp. paratuberculosis
gacgcccuuguccucgagccg

SEQ ID NO: 3025744 - RNA, 19 nt, Mycobacterium avium subsp. paratuberculosis
gacgccgaagaucagcgcg

SEQ ID NO: 3025745 - RNA, 16 nt, Mycobacterium avium subsp. paratuberculosis
gacgccgaauccgggc

SEQ ID NO: 3025746 - RNA, 20 nt, Mycobacterium avium subsp. paratuberculosis
gacgccgaauccgggcaugc

SEQ ID NO: 3025747 - RNA, 22 nt, Mycobacterium avium subsp. paratuberculosis
gacgccgaauccgggcaugcuc

SEQ ID NO: 3025748 - RNA, 14 nt, Mycobacterium avium subsp. paratuberculosis
gacgccgacaccag

SEQ ID NO: 3025749 - RNA, 19 nt, Mycobacterium avium subsp. paratuberculosis
gacgccgacaccagcgcgc

SEQ ID NO: 3025750 - RNA, 16 nt, Mycobacterium avium subsp. paratuberculosis
gacgccgacagcgaca

SEQ ID NO: 3025751 - RNA, 20 nt, Mycobacterium avium subsp. paratuberculosis
gacgccgacaucgcggcgau

SEQ ID NO: 3025752 - RNA, 13 nt, Mycobacterium avium subsp. paratuberculosis
gacgccgaccgcg

SEQ ID NO: 3025753 - RNA, 22 nt, Mycobacterium avium subsp. paratuberculosis
gacgccgacgcccagcgcggcg

SEQ ID NO: 3025754 - RNA, 15 nt, Mycobacterium avium subsp. paratuberculosis
gacgccgacggcaau

SEQ ID NO: 3025755 - RNA, 12 nt, Mycobacterium avium subsp. paratuberculosis
gacgccgacgua

SEQ ID NO: 3025756 - RNA, 15 nt, Mycobacterium avium subsp. paratuberculosis
gacgccgacguagga

SEQ ID NO: 3025757 - RNA, 19 nt, Mycobacterium avium subsp. paratuberculosis
gacgccgacguaggacagc

SEQ ID NO: 3025758 - RNA, 11 nt, Mycobacterium avium subsp. paratuberculosis
gacgccgagca

SEQ ID NO: 3025759 - RNA, 13 nt, Mycobacterium avium subsp. paratuberculosis
gacgccgagcagc

SEQ ID NO: 3025760 - RNA, 17 nt, Mycobacterium avium subsp. paratuberculosis
gacgccgagcagcucag

SEQ ID NO: 3025761 - RNA, 20 nt, Mycobacterium avium subsp. paratuberculosis
gacgccgagcagcucagccg

SEQ ID NO: 3025762 - RNA, 21 nt, Mycobacterium avium subsp. paratuberculosis
gacgccgagcagcucagccgc

SEQ ID NO: 3025763 - RNA, 14 nt, Mycobacterium avium subsp. paratuberculosis
gacgccgauccgca

SEQ ID NO: 3025764 - RNA, 17 nt, Mycobacterium avium subsp. paratuberculosis
gacgccgauccgcagcc

SEQ ID NO: 3025765 - RNA, 19 nt, Mycobacterium avium subsp. paratuberculosis
gacgccgauccgcagccgc

SEQ ID NO: 3025766 - RNA, 13 nt, Mycobacterium avium subsp. paratuberculosis
gacgccgauggug

SEQ ID NO: 3025767 - RNA, 17 nt, Mycobacterium avium subsp. paratuberculosis
gacgccgaugugcucgg

SEQ ID NO: 3025768 - RNA, 20 nt, Mycobacterium avium subsp. paratuberculosis
gacgccgaugugcucgguca

SEQ ID NO: 3025769 - RNA, 12 nt, Mycobacterium avium subsp. paratuberculosis
gacgccgcacga

SEQ ID NO: 3025770 - RNA, 23 nt, Mycobacterium avium subsp. paratuberculosis
gacgccgcacgaauugccggugg

SEQ ID NO: 3025771 - RNA, 14 nt, Mycobacterium avium subsp. paratuberculosis
gacgccgcacgcga

SEQ ID NO: 3025772 - RNA, 20 nt, Mycobacterium avium subsp. paratuberculosis
gacgccgcacgcgaccgcgu

SEQ ID NO: 3025773 - RNA, 13 nt, Mycobacterium avium subsp. paratuberculosis
gacgccgccgaac

SEQ ID NO: 3025774 - RNA, 15 nt, Mycobacterium avium subsp. paratuberculosis
gacgccgccgaaccc

SEQ ID NO: 3025775 - RNA, 17 nt, Mycobacterium avium subsp. paratuberculosis
gacgccgccgaacccca

SEQ ID NO: 3025776 - RNA, 23 nt, Mycobacterium avium subsp. paratuberculosis
gacgccgccgaaccccagcuccg

SEQ ID NO: 3025777 - RNA, 13 nt, Mycobacterium avium subsp. paratuberculosis
gacgccgccgagg

SEQ ID NO: 3025778 - RNA, 23 nt, Mycobacterium avium subsp. paratuberculosis
gacgccgccgccgagcucggcca

SEQ ID NO: 3025779 - RNA, 21 nt, Mycobacterium avium subsp. paratuberculosis
gacgccgccgucguagccgcg

SEQ ID NO: 3025780 - RNA, 14 nt, Mycobacterium avium subsp. paratuberculosis
gacgccgccgugga

SEQ ID NO: 3025781 - RNA, 19 nt, Mycobacterium avium subsp. paratuberculosis
gacgccgccguggacgagu

SEQ ID NO: 3025782 - RNA, 12 nt, Mycobacterium avium subsp. paratuberculosis
gacgccgcgcac

SEQ ID NO: 3025783 - RNA, 16 nt, Mycobacterium avium subsp. paratuberculosis
gacgccgcgcaccccg

SEQ ID NO: 3025784 - RNA, 13 nt, Mycobacterium avium subsp. paratuberculosis
gacgccgcgcagc

SEQ ID NO: 3025785 - RNA, 14 nt, Mycobacterium avium subsp. paratuberculosis
gacgccgcgcagcg

SEQ ID NO: 3025786 - RNA, 15 nt, Mycobacterium avium subsp. paratuberculosis
gacgccgcgcagcgg

SEQ ID NO: 3025787 - RNA, 19 nt, Mycobacterium avium subsp. paratuberculosis
gacgccgcgcagcggggcg

SEQ ID NO: 3025788 - RNA, 13 nt, Mycobacterium avium subsp. paratuberculosis
gacgccgcgccgc

SEQ ID NO: 3025789 - RNA, 15 nt, Mycobacterium avium subsp. paratuberculosis
gacgccgcgccgccc

SEQ ID NO: 3025790 - RNA, 18 nt, Mycobacterium avium subsp. paratuberculosis
gacgccgcgccgcccggc

SEQ ID NO: 3025791 - RNA, 21 nt, Mycobacterium avium subsp. paratuberculosis
gacgccgcgccgcccggcgau

SEQ ID NO: 3025792 - RNA, 17 nt, Mycobacterium avium subsp. paratuberculosis
gacgccgcgcuggccgg

SEQ ID NO: 3025793 - RNA, 17 nt, Mycobacterium avium subsp. paratuberculosis
gacgccgcggaagcccc

SEQ ID NO: 3025794 - RNA, 18 nt, Mycobacterium avium subsp. paratuberculosis
gacgccgcggugcagcag

SEQ ID NO: 3025795 - RNA, 15 nt, Mycobacterium avium subsp. paratuberculosis
gacgccgcgguggcc

SEQ ID NO: 3025796 - RNA, 16 nt, Mycobacterium avium subsp. paratuberculosis
gacgccgcgguggccg

SEQ ID NO: 3025797 - RNA, 23 nt, Mycobacterium avium subsp. paratuberculosis
gacgccgcgguggccgggaugcc

SEQ ID NO: 3025798 - RNA, 14 nt, Mycobacterium avium subsp. paratuberculosis
gacgccgcgguugg

SEQ ID NO: 3025799 - RNA, 20 nt, Mycobacterium avium subsp. paratuberculosis
gacgccgcgguuggucacca

SEQ ID NO: 3025800 - RNA, 23 nt, Mycobacterium avium subsp. paratuberculosis
gacgccgcgguuggucaccaggu

SEQ ID NO: 3025801 - RNA, 14 nt, Mycobacterium avium subsp. paratuberculosis
gacgccgcucggcc

SEQ ID NO: 3025802 - RNA, 17 nt, Mycobacterium avium subsp. paratuberculosis
gacgccgcucggccagc

SEQ ID NO: 3025803 - RNA, 19 nt, Mycobacterium avium subsp. paratuberculosis
gacgccgcugccggggugc

SEQ ID NO: 3025804 - RNA, 16 nt, Mycobacterium avium subsp. paratuberculosis
gacgccgcugcgugcc

SEQ ID NO: 3025805 - RNA, 18 nt, Mycobacterium avium subsp. paratuberculosis
gacgccgcugggcguggu

SEQ ID NO: 3025806 - RNA, 18 nt, Mycobacterium avium subsp. paratuberculosis
gacgccgcuguccucguc

SEQ ID NO: 3025807 - RNA, 13 nt, Mycobacterium avium subsp. paratuberculosis
gacgccggacagc

SEQ ID NO: 3025808 - RNA, 17 nt, Mycobacterium avium subsp. paratuberculosis
gacgccggacagcuggc

SEQ ID NO: 3025809 - RNA, 18 nt, Mycobacterium avium subsp. paratuberculosis
gacgccggacagcuggcg

SEQ ID NO: 3025810 - RNA, 19 nt, Mycobacterium avium subsp. paratuberculosis
gacgccggacagcuggcgg

SEQ ID NO: 3025811 - RNA, 15 nt, Mycobacterium avium subsp. paratuberculosis
gacgccggaccccac

SEQ ID NO: 3025812 - RNA, 22 nt, Mycobacterium avium subsp. paratuberculosis
gacgccggaccccacagcgcgc

SEQ ID NO: 3025813 - RNA, 16 nt, Mycobacterium avium subsp. paratuberculosis
gacgccggauaccccg

SEQ ID NO: 3025814 - RNA, 18 nt, Mycobacterium avium subsp. paratuberculosis
gacgccggauaccccgga

SEQ ID NO: 3025815 - RNA, 13 nt, Mycobacterium avium subsp. paratuberculosis
gacgccggcagcc

SEQ ID NO: 3025816 - RNA, 17 nt, Mycobacterium avium subsp. paratuberculosis
gacgccggccaccaaca

SEQ ID NO: 3025817 - RNA, 20 nt, Mycobacterium avium subsp. paratuberculosis
gacgccggccucucgucgac

SEQ ID NO: 3025818 - RNA, 21 nt, Mycobacterium avium subsp. paratuberculosis
gacgccggccucucgucgacg

SEQ ID NO: 3025819 - RNA, 21 nt, Mycobacterium avium subsp. paratuberculosis
gacgccggcgaggcggucggc

SEQ ID NO: 3025820 - RNA, 15 nt, Mycobacterium avium subsp. paratuberculosis
gacgccgggcacucc

SEQ ID NO: 3025821 - RNA, 13 nt, Mycobacterium avium subsp. paratuberculosis
gacgccgggcagc

SEQ ID NO: 3025822 - RNA, 15 nt, Mycobacterium avium subsp. paratuberculosis
gacgccgggcagcgc

SEQ ID NO: 3025823 - RNA, 16 nt, Mycobacterium avium subsp. paratuberculosis
gacgccgggcagcgcg

SEQ ID NO: 3025824 - RNA, 21 nt, Mycobacterium avium subsp. paratuberculosis
gacgccgggcagcgcgcgaga

SEQ ID NO: 3025825 - RNA, 13 nt, Mycobacterium avium subsp. paratuberculosis
gacgccgggccgc

SEQ ID NO: 3025826 - RNA, 14 nt, Mycobacterium avium subsp. paratuberculosis
gacgccgggccgcc

SEQ ID NO: 3025827 - RNA, 17 nt, Mycobacterium avium subsp. paratuberculosis
gacgccgggccgccgcg

SEQ ID NO: 3025828 - RNA, 18 nt, Mycobacterium avium subsp. paratuberculosis
gacgccgggccgccgcgg

SEQ ID NO: 3025829 - RNA, 12 nt, Mycobacterium avium subsp. paratuberculosis
gacgccgggcgc

SEQ ID NO: 3025830 - RNA, 14 nt, Mycobacterium avium subsp. paratuberculosis
gacgccgggcgccc

SEQ ID NO: 3025831 - RNA, 16 nt, Mycobacterium avium subsp. paratuberculosis
gacgccgggcgcccgc

SEQ ID NO: 3025832 - RNA, 11 nt, Mycobacterium avium subsp. paratuberculosis
gacgccggucg

SEQ ID NO: 3025833 - RNA, 13 nt, Mycobacterium avium subsp. paratuberculosis
gacgccggucgcu

SEQ ID NO: 3025834 - RNA, 20 nt, Mycobacterium avium subsp. paratuberculosis
gacgccggugaaaccggcgc

SEQ ID NO: 3025835 - RNA, 23 nt, Mycobacterium avium subsp. paratuberculosis
gacgccggugaaaccggcgccga

SEQ ID NO: 3025836 - RNA, 21 nt, Mycobacterium avium subsp. paratuberculosis
gacgccguagaucacgccggu

SEQ ID NO: 3025837 - RNA, 21 nt, Mycobacterium avium subsp. paratuberculosis
gacgccgucacggaucgccca

SEQ ID NO: 3025838 - RNA, 23 nt, Mycobacterium avium subsp. paratuberculosis
gacgccgucacggaucgcccacc

SEQ ID NO: 3025839 - RNA, 16 nt, Mycobacterium avium subsp. paratuberculosis
gacgccgucaucccca

SEQ ID NO: 3025840 - RNA, 16 nt, Mycobacterium avium subsp. paratuberculosis
gacgccguccgacgug

SEQ ID NO: 3025841 - RNA, 13 nt, Mycobacterium avium subsp. paratuberculosis
gacgccguggauc

SEQ ID NO: 3025842 - RNA, 13 nt, Mycobacterium avium subsp. paratuberculosis
gacgccguggucc

SEQ ID NO: 3025843 - RNA, 18 nt, Mycobacterium avium subsp. paratuberculosis
gacgccgugguccagccg

SEQ ID NO: 3025844 - RNA, 22 nt, Mycobacterium avium subsp. paratuberculosis
gacgccgugguccagccggucg

SEQ ID NO: 3025845 - RNA, 21 nt, Mycobacterium avium subsp. paratuberculosis
gacgccguugacaccgggugc

SEQ ID NO: 3025846 - RNA, 22 nt, Mycobacterium avium subsp. paratuberculosis
gacgccguugacaccgggugcg

SEQ ID NO: 3025847 - RNA, 15 nt, Mycobacterium avium subsp. paratuberculosis
gacgccucaggcgag

SEQ ID NO: 3025848 - RNA, 14 nt, Mycobacterium avium subsp. paratuberculosis
gacgccucccccac

SEQ ID NO: 3025849 - RNA, 17 nt, Mycobacterium avium subsp. paratuberculosis
gacgccucccccacccg

SEQ ID NO: 3025850 - RNA, 23 nt, Mycobacterium avium subsp. paratuberculosis
gacgccucccccacccgcacggu

SEQ ID NO: 3025851 - RNA, 12 nt, Mycobacterium avium subsp. paratuberculosis
gacgccucgcgc

SEQ ID NO: 3025852 - RNA, 15 nt, Mycobacterium avium subsp. paratuberculosis
gacgccucgcgcagc

SEQ ID NO: 3025853 - RNA, 16 nt, Mycobacterium avium subsp. paratuberculosis
gacgccucgcgcagcg

SEQ ID NO: 3025854 - RNA, 17 nt, Mycobacterium avium subsp. paratuberculosis
gacgccucgcgcagcgc

SEQ ID NO: 3025855 - RNA, 18 nt, Mycobacterium avium subsp. paratuberculosis
gacgccucgcgcagcgcg

SEQ ID NO: 3025856 - RNA, 12 nt, Mycobacterium avium subsp. paratuberculosis
gacgccugccgc

SEQ ID NO: 3025857 - RNA, 13 nt, Mycobacterium avium subsp. paratuberculosis
gacgccugcggcc

SEQ ID NO: 3025858 - RNA, 15 nt, Mycobacterium avium subsp. paratuberculosis
gacgccugcggccca

SEQ ID NO: 3025859 - RNA, 18 nt, Mycobacterium avium subsp. paratuberculosis
gacgccugcggcccagcg

SEQ ID NO: 3025860 - RNA, 15 nt, Mycobacterium avium subsp. paratuberculosis
gacgcgaaagcaccc

SEQ ID NO: 3025861 - RNA, 17 nt, Mycobacterium avium subsp. paratuberculosis
gacgcgaaagcacccga

SEQ ID NO: 3025862 - RNA, 20 nt, Mycobacterium avium subsp. paratuberculosis
gacgcgaaagcacccgacac

SEQ ID NO: 3025863 - RNA, 19 nt, Mycobacterium avium subsp. paratuberculosis
gacgcgaaagcagcguucg

SEQ ID NO: 3025864 - RNA, 18 nt, Mycobacterium avium subsp. paratuberculosis
gacgcgaacgcgccccgc

SEQ ID NO: 3025865 - RNA, 20 nt, Mycobacterium avium subsp. paratuberculosis
gacgcgaacgcgccccgccg

SEQ ID NO: 3025866 - RNA, 19 nt, Mycobacterium avium subsp. paratuberculosis
gacgcgaaugucgaccacc

SEQ ID NO: 3025867 - RNA, 21 nt, Mycobacterium avium subsp. paratuberculosis
gacgcgaaugucgaccaccgg

SEQ ID NO: 3025868 - RNA, 14 nt, Mycobacterium avium subsp. paratuberculosis
gacgcgaccaggcc

SEQ ID NO: 3025869 - RNA, 20 nt, Mycobacterium avium subsp. paratuberculosis
gacgcgaccaggcccagcgg

SEQ ID NO: 3025870 - RNA, 14 nt, Mycobacterium avium subsp. paratuberculosis
gacgcgaccgcgcg

SEQ ID NO: 3025871 - RNA, 16 nt, Mycobacterium avium subsp. paratuberculosis
gacgcgaccgcgcggc

SEQ ID NO: 3025872 - RNA, 17 nt, Mycobacterium avium subsp. paratuberculosis
gacgcgaccgcgcggcg

SEQ ID NO: 3025873 - RNA, 15 nt, Mycobacterium avium subsp. paratuberculosis
gacgcgaccggcccg

SEQ ID NO: 3025874 - RNA, 16 nt, Mycobacterium avium subsp. paratuberculosis
gacgcgaccggcccga

SEQ ID NO: 3025875 - RNA, 15 nt, Mycobacterium avium subsp. paratuberculosis
gacgcgacgcgcucg

SEQ ID NO: 3025876 - RNA, 17 nt, Mycobacterium avium subsp. paratuberculosis
gacgcgacgcgcucggc

SEQ ID NO: 3025877 - RNA, 20 nt, Mycobacterium avium subsp. paratuberculosis
gacgcgacgcgcucggcgac

SEQ ID NO: 3025878 - RNA, 21 nt, Mycobacterium avium subsp. paratuberculosis
gacgcgacgcgcucggcgacc

SEQ ID NO: 3025879 - RNA, 23 nt, Mycobacterium avium subsp. paratuberculosis
gacgcgacgcgcucggcgaccgc

SEQ ID NO: 3025880 - RNA, 19 nt, Mycobacterium avium subsp. paratuberculosis
gacgcgauggcgcuggccg

SEQ ID NO: 3025881 - RNA, 19 nt, Mycobacterium avium subsp. paratuberculosis
gacgcgcacacggccucgc

SEQ ID NO: 3025882 - RNA, 19 nt, Mycobacterium avium subsp. paratuberculosis
gacgcgcaccagggccgcg

SEQ ID NO: 3025883 - RNA, 20 nt, Mycobacterium avium subsp. paratuberculosis
gacgcgcaccagggccgcga

SEQ ID NO: 3025884 - RNA, 13 nt, Mycobacterium avium subsp. paratuberculosis
gacgcgcaccgcc

SEQ ID NO: 3025885 - RNA, 14 nt, Mycobacterium avium subsp. paratuberculosis
gacgcgcaccgcca

SEQ ID NO: 3025886 - RNA, 15 nt, Mycobacterium avium subsp. paratuberculosis
gacgcgcaccgccac

SEQ ID NO: 3025887 - RNA, 18 nt, Mycobacterium avium subsp. paratuberculosis
gacgcgcaccgccaccgc

SEQ ID NO: 3025888 - RNA, 19 nt, Mycobacterium avium subsp. paratuberculosis
gacgcgcaccgccaccgcc

SEQ ID NO: 3025889 - RNA, 20 nt, Mycobacterium avium subsp. paratuberculosis
gacgcgcagaucgucgaacu

SEQ ID NO: 3025890 - RNA, 14 nt, Mycobacterium avium subsp. paratuberculosis
gacgcgcagcacgg

SEQ ID NO: 3025891 - RNA, 19 nt, Mycobacterium avium subsp. paratuberculosis
gacgcgccacgccccggcg

SEQ ID NO: 3025892 - RNA, 22 nt, Mycobacterium avium subsp. paratuberculosis
gacgcgccacgccccggcgccg

SEQ ID NO: 3025893 - RNA, 15 nt, Mycobacterium avium subsp. paratuberculosis
gacgcgcccggcgac

SEQ ID NO: 3025894 - RNA, 19 nt, Mycobacterium avium subsp. paratuberculosis
gacgcgccgcacugcacgg

SEQ ID NO: 3025895 - RNA, 20 nt, Mycobacterium avium subsp. paratuberculosis
gacgcgccgcacugcacggc

SEQ ID NO: 3025896 - RNA, 23 nt, Mycobacterium avium subsp. paratuberculosis
gacgcgccgcacugcacggccuc

SEQ ID NO: 3025897 - RNA, 12 nt, Mycobacterium avium subsp. paratuberculosis
gacgcgccgucg

SEQ ID NO: 3025898 - RNA, 14 nt, Mycobacterium avium subsp. paratuberculosis
gacgcgccgucggc

SEQ ID NO: 3025899 - RNA, 18 nt, Mycobacterium avium subsp. paratuberculosis
gacgcgccgucggcccac

SEQ ID NO: 3025900 - RNA, 15 nt, Mycobacterium avium subsp. paratuberculosis
gacgcgcgugacggc

SEQ ID NO: 3025901 - RNA, 22 nt, Mycobacterium avium subsp. paratuberculosis
gacgcgcgugacggcggggcgg

SEQ ID NO: 3025902 - RNA, 15 nt, Mycobacterium avium subsp. paratuberculosis
gacgcgcucagcccc

SEQ ID NO: 3025903 - RNA, 16 nt, Mycobacterium avium subsp. paratuberculosis
gacgcgcucagcccca

SEQ ID NO: 3025904 - RNA, 21 nt, Mycobacterium avium subsp. paratuberculosis
gacgcgcucagccccagcgga

SEQ ID NO: 3025905 - RNA, 14 nt, Mycobacterium avium subsp. paratuberculosis
gacgcgcucggcga

SEQ ID NO: 3025906 - RNA, 16 nt, Mycobacterium avium subsp. paratuberculosis
gacgcgcugcgcgccg

SEQ ID NO: 3025907 - RNA, 20 nt, Mycobacterium avium subsp. paratuberculosis
gacgcgcuuguacaggucga

SEQ ID NO: 3025908 - RNA, 22 nt, Mycobacterium avium subsp. paratuberculosis
gacgcgcuuguacaggucgacc

SEQ ID NO: 3025909 - RNA, 23 nt, Mycobacterium avium subsp. paratuberculosis
gacgcgcuuguacaggucgacca

SEQ ID NO: 3025910 - RNA, 17 nt, Mycobacterium avium subsp. paratuberculosis
gacgcggcacgccgcuc

SEQ ID NO: 3025911 - RNA, 12 nt, Mycobacterium avium subsp. paratuberculosis
gacgcggccagc

SEQ ID NO: 3025912 - RNA, 13 nt, Mycobacterium avium subsp. paratuberculosis
gacgcggccagcg

SEQ ID NO: 3025913 - RNA, 22 nt, Mycobacterium avium subsp. paratuberculosis
gacgcggccagcgcccgcgcga

SEQ ID NO: 3025914 - RNA, 14 nt, Mycobacterium avium subsp. paratuberculosis
gacgcggccgagcc

SEQ ID NO: 3025915 - RNA, 16 nt, Mycobacterium avium subsp. paratuberculosis
gacgcggccgagccga

SEQ ID NO: 3025916 - RNA, 16 nt, Mycobacterium avium subsp. paratuberculosis
gacgcggccucaccgc

SEQ ID NO: 3025917 - RNA, 17 nt, Mycobacterium avium subsp. paratuberculosis
gacgcggcgaccaccac

SEQ ID NO: 3025918 - RNA, 14 nt, Mycobacterium avium subsp. paratuberculosis
gacgcggcgcgaca

SEQ ID NO: 3025919 - RNA, 15 nt, Mycobacterium avium subsp. paratuberculosis
gacgcggcgcgacac

SEQ ID NO: 3025920 - RNA, 18 nt, Mycobacterium avium subsp. paratuberculosis
gacgcggcgcgacaccgc

SEQ ID NO: 3025921 - RNA, 19 nt, Mycobacterium avium subsp. paratuberculosis
gacgcggcgcgacaccgcg

SEQ ID NO: 3025922 - RNA, 20 nt, Mycobacterium avium subsp. paratuberculosis
gacgcggcgcgacaccgcgg

SEQ ID NO: 3025923 - RNA, 23 nt, Mycobacterium avium subsp. paratuberculosis
gacgcggcgcgcgauggacagca

SEQ ID NO: 3025924 - RNA, 14 nt, Mycobacterium avium subsp. paratuberculosis
gacgcggcggacga

SEQ ID NO: 3025925 - RNA, 12 nt, Mycobacterium avium subsp. paratuberculosis
gacgcggcggcc

SEQ ID NO: 3025926 - RNA, 13 nt, Mycobacterium avium subsp. paratuberculosis
gacgcggcggccg

SEQ ID NO: 3025927 - RNA, 16 nt, Mycobacterium avium subsp. paratuberculosis
gacgcggcggccgaca

SEQ ID NO: 3025928 - RNA, 20 nt, Mycobacterium avium subsp. paratuberculosis
gacgcggcgggaaaccaccu

SEQ ID NO: 3025929 - RNA, 22 nt, Mycobacterium avium subsp. paratuberculosis
gacgcggcgggaaaccaccugc

SEQ ID NO: 3025930 - RNA, 15 nt, Mycobacterium avium subsp. paratuberculosis
gacgcggcgucgggc

SEQ ID NO: 3025931 - RNA, 13 nt, Mycobacterium avium subsp. paratuberculosis
gacgcggcucgcg

SEQ ID NO: 3025932 - RNA, 15 nt, Mycobacterium avium subsp. paratuberculosis
gacgcggcucgcgcg

SEQ ID NO: 3025933 - RNA, 18 nt, Mycobacterium avium subsp. paratuberculosis
gacgcggcucgcgcggug

SEQ ID NO: 3025934 - RNA, 16 nt, Mycobacterium avium subsp. paratuberculosis
gacgcgggaccgggcc

SEQ ID NO: 3025935 - RNA, 21 nt, Mycobacterium avium subsp. paratuberculosis
gacgcgggaccgggcccggcg

SEQ ID NO: 3025936 - RNA, 14 nt, Mycobacterium avium subsp. paratuberculosis
gacgcgggccggca

SEQ ID NO: 3025937 - RNA, 18 nt, Mycobacterium avium subsp. paratuberculosis
gacgcgggccggcacccg

SEQ ID NO: 3025938 - RNA, 23 nt, Mycobacterium avium subsp. paratuberculosis
gacgcgggccggcacccgggccu

SEQ ID NO: 3025939 - RNA, 12 nt, Mycobacterium avium subsp. paratuberculosis
gacgcgggcgcc

SEQ ID NO: 3025940 - RNA, 16 nt, Mycobacterium avium subsp. paratuberculosis
gacgcggggcggcggc

SEQ ID NO: 3025941 - RNA, 18 nt, Mycobacterium avium subsp. paratuberculosis
gacgcggggcggcggcgc

SEQ ID NO: 3025942 - RNA, 21 nt, Mycobacterium avium subsp. paratuberculosis
gacgcggggcggcggcgccgg

SEQ ID NO: 3025943 - RNA, 15 nt, Mycobacterium avium subsp. paratuberculosis
gacgcggucaccggc

SEQ ID NO: 3025944 - RNA, 16 nt, Mycobacterium avium subsp. paratuberculosis
gacgcggucaccggcu

SEQ ID NO: 3025945 - RNA, 19 nt, Mycobacterium avium subsp. paratuberculosis
gacgcggucaccggcucgg

SEQ ID NO: 3025946 - RNA, 22 nt, Mycobacterium avium subsp. paratuberculosis
gacgcggucgaacaacgcggug

SEQ ID NO: 3025947 - RNA, 14 nt, Mycobacterium avium subsp. paratuberculosis
gacgcggucgccgc

SEQ ID NO: 3025948 - RNA, 15 nt, Mycobacterium avium subsp. paratuberculosis
gacgcggucgccgcc

SEQ ID NO: 3025949 - RNA, 22 nt, Mycobacterium avium subsp. paratuberculosis
gacgcggucgccgcccacgccg

SEQ ID NO: 3025950 - RNA, 19 nt, Mycobacterium avium subsp. paratuberculosis
gacgcggugacaugcccgg

SEQ ID NO: 3025951 - RNA, 21 nt, Mycobacterium avium subsp. paratuberculosis
gacgcggugacaugcccgggc

SEQ ID NO: 3025952 - RNA, 12 nt, Mycobacterium avium subsp. paratuberculosis
gacgcggugacg

SEQ ID NO: 3025953 - RNA, 19 nt, Mycobacterium avium subsp. paratuberculosis
gacgcggugagcgcgccgg

SEQ ID NO: 3025954 - RNA, 20 nt, Mycobacterium avium subsp. paratuberculosis
gacgcggugagcgcgccggc

SEQ ID NO: 3025955 - RNA, 21 nt, Mycobacterium avium subsp. paratuberculosis
gacgcggugagcgcgccggcc

SEQ ID NO: 3025956 - RNA, 13 nt, Mycobacterium avium subsp. paratuberculosis
gacgcgguggugc

SEQ ID NO: 3025957 - RNA, 19 nt, Mycobacterium avium subsp. paratuberculosis
gacgcgguggugcucgccc

SEQ ID NO: 3025958 - RNA, 21 nt, Mycobacterium avium subsp. paratuberculosis
gacgcgguggugcucgccccg

SEQ ID NO: 3025959 - RNA, 20 nt, Mycobacterium avium subsp. paratuberculosis
gacgcguccguagugcucgg

SEQ ID NO: 3025960 - RNA, 12 nt, Mycobacterium avium subsp. paratuberculosis
gacgcgucgaca

SEQ ID NO: 3025961 - RNA, 18 nt, Mycobacterium avium subsp. paratuberculosis
gacgcgucgagcgugggc

SEQ ID NO: 3025962 - RNA, 15 nt, Mycobacterium avium subsp. paratuberculosis
gacgcgucgcggcgg

SEQ ID NO: 3025963 - RNA, 16 nt, Mycobacterium avium subsp. paratuberculosis
gacgcgucgcggcggg

SEQ ID NO: 3025964 - RNA, 17 nt, Mycobacterium avium subsp. paratuberculosis
gacgcguuguugcucgg

SEQ ID NO: 3025965 - RNA, 15 nt, Mycobacterium avium subsp. paratuberculosis
gacgcucacccggcc

SEQ ID NO: 3025966 - RNA, 13 nt, Mycobacterium avium subsp. paratuberculosis
gacgcucaggcgu

SEQ ID NO: 3025967 - RNA, 18 nt, Mycobacterium avium subsp. paratuberculosis
gacgcucaggcguccagc

SEQ ID NO: 3025968 - RNA, 18 nt, Mycobacterium avium subsp. paratuberculosis
gacgcucgacggccggcg

SEQ ID NO: 3025969 - RNA, 19 nt, Mycobacterium avium subsp. paratuberculosis
gacgcucgaggccccgcgu

SEQ ID NO: 3025970 - RNA, 19 nt, Mycobacterium avium subsp. paratuberculosis
gacgcucgccaccccgcgc

SEQ ID NO: 3025971 - RNA, 21 nt, Mycobacterium avium subsp. paratuberculosis
gacgcucgccaccccgcgcca

SEQ ID NO: 3025972 - RNA, 14 nt, Mycobacterium avium subsp. paratuberculosis
gacgcucgccggcg

SEQ ID NO: 3025973 - RNA, 19 nt, Mycobacterium avium subsp. paratuberculosis
gacgcucgccggcggccgc

SEQ ID NO: 3025974 - RNA, 20 nt, Mycobacterium avium subsp. paratuberculosis
gacgcucgccggcggccgcc

SEQ ID NO: 3025975 - RNA, 21 nt, Mycobacterium avium subsp. paratuberculosis
gacgcucgccggcggccgcca

SEQ ID NO: 3025976 - RNA, 21 nt, Mycobacterium avium subsp. paratuberculosis
gacgcucgcgguugggccgcc

SEQ ID NO: 3025977 - RNA, 12 nt, Mycobacterium avium subsp. paratuberculosis
gacgcucggccg

SEQ ID NO: 3025978 - RNA, 12 nt, Mycobacterium avium subsp. paratuberculosis
gacgcucggccu

SEQ ID NO: 3025979 - RNA, 13 nt, Mycobacterium avium subsp. paratuberculosis
gacgcucggcgau

SEQ ID NO: 3025980 - RNA, 16 nt, Mycobacterium avium subsp. paratuberculosis
gacgcucggcgauggu

SEQ ID NO: 3025981 - RNA, 13 nt, Mycobacterium avium subsp. paratuberculosis
gacgcucggcgcc

SEQ ID NO: 3025982 - RNA, 17 nt, Mycobacterium avium subsp. paratuberculosis
gacgcucggcggccgag

SEQ ID NO: 3025983 - RNA, 20 nt, Mycobacterium avium subsp. paratuberculosis
gacgcucgggcuucggcguc

SEQ ID NO: 3025984 - RNA, 22 nt, Mycobacterium avium subsp. paratuberculosis
gacgcucgggcuucggcgucac

SEQ ID NO: 3025985 - RNA, 15 nt, Mycobacterium avium subsp. paratuberculosis
gacgcucggucgcca

SEQ ID NO: 3025986 - RNA, 21 nt, Mycobacterium avium subsp. paratuberculosis
gacgcucggucgccacggccg

SEQ ID NO: 3025987 - RNA, 16 nt, Mycobacterium avium subsp. paratuberculosis
gacgcugaacagcagc

SEQ ID NO: 3025988 - RNA, 17 nt, Mycobacterium avium subsp. paratuberculosis
gacgcugaacagcagca

SEQ ID NO: 3025989 - RNA, 17 nt, Mycobacterium avium subsp. paratuberculosis
gacgcugaacagcccga

SEQ ID NO: 3025990 - RNA, 23 nt, Mycobacterium avium subsp. paratuberculosis
gacgcugaagaagaugggcgccg

SEQ ID NO: 3025991 - RNA, 18 nt, Mycobacterium avium subsp. paratuberculosis
gacgcugaccgugguguc

SEQ ID NO: 3025992 - RNA, 19 nt, Mycobacterium avium subsp. paratuberculosis
gacgcugacgaugcggccg

SEQ ID NO: 3025993 - RNA, 21 nt, Mycobacterium avium subsp. paratuberculosis
gacgcugacgaugcggccggc

SEQ ID NO: 3025994 - RNA, 14 nt, Mycobacterium avium subsp. paratuberculosis
gacgcugagcaccc

SEQ ID NO: 3025995 - RNA, 16 nt, Mycobacterium avium subsp. paratuberculosis
gacgcugagcacccgc

SEQ ID NO: 3025996 - RNA, 21 nt, Mycobacterium avium subsp. paratuberculosis
gacgcugagcacccgcccgga

SEQ ID NO: 3025997 - RNA, 19 nt, Mycobacterium avium subsp. paratuberculosis
gacgcugagccgcucgucg

SEQ ID NO: 3025998 - RNA, 22 nt, Mycobacterium avium subsp. paratuberculosis
gacgcugagucuacuuggccag

SEQ ID NO: 3025999 - RNA, 24 nt, Mycobacterium avium subsp. paratuberculosis
gacgcugaucuacgucggcuggcg

SEQ ID NO: 3026000 - RNA, 14 nt, Mycobacterium avium subsp. paratuberculosis
gacgcugcaggugg

SEQ ID NO: 3026001 - RNA, 18 nt, Mycobacterium avium subsp. paratuberculosis
gacgcugcagguggccca

SEQ ID NO: 3026002 - RNA, 21 nt, Mycobacterium avium subsp. paratuberculosis
gacgcugcagguggcccacac

SEQ ID NO: 3026003 - RNA, 13 nt, Mycobacterium avium subsp. paratuberculosis
gacgcugccgcgc

SEQ ID NO: 3026004 - RNA, 14 nt, Mycobacterium avium subsp. paratuberculosis
gacgcugccgcugg

SEQ ID NO: 3026005 - RNA, 15 nt, Mycobacterium avium subsp. paratuberculosis
gacgcugccgguggu

SEQ ID NO: 3026006 - RNA, 14 nt, Mycobacterium avium subsp. paratuberculosis
gacgcuggccacga

SEQ ID NO: 3026007 - RNA, 22 nt, Mycobacterium avium subsp. paratuberculosis
gacgcuggccacgauccggggc

SEQ ID NO: 3026008 - RNA, 17 nt, Mycobacterium avium subsp. paratuberculosis
gacgcuggccgagagcc

SEQ ID NO: 3026009 - RNA, 16 nt, Mycobacterium avium subsp. paratuberculosis
gacgcugggcggcgac

SEQ ID NO: 3026010 - RNA, 17 nt, Mycobacterium avium subsp. paratuberculosis
gacgcugguggccugca

SEQ ID NO: 3026011 - RNA, 22 nt, Mycobacterium avium subsp. paratuberculosis
gacgcugugcgccuugccgucg

SEQ ID NO: 3026012 - RNA, 18 nt, Mycobacterium avium subsp. paratuberculosis
gacggacacccgcgcggu

SEQ ID NO: 3026013 - RNA, 21 nt, Mycobacterium avium subsp. paratuberculosis
gacggacacccgcgcggugcc

SEQ ID NO: 3026014 - RNA, 20 nt, Mycobacterium avium subsp. paratuberculosis
gacggacuugggcgucucga

SEQ ID NO: 3026015 - RNA, 23 nt, Mycobacterium avium subsp. paratuberculosis
gacggacuugggcgucucgauga

SEQ ID NO: 3026016 - RNA, 13 nt, Mycobacterium avium subsp. paratuberculosis
gacggagacgacc

SEQ ID NO: 3026017 - RNA, 23 nt, Mycobacterium avium subsp. paratuberculosis
gacggagacgacgacgaacgcgg

SEQ ID NO: 3026018 - RNA, 14 nt, Mycobacterium avium subsp. paratuberculosis
gacggagccgagca

SEQ ID NO: 3026019 - RNA, 17 nt, Mycobacterium avium subsp. paratuberculosis
gacggagccgagcacca

SEQ ID NO: 3026020 - RNA, 14 nt, Mycobacterium avium subsp. paratuberculosis
gacggagccgugcc

SEQ ID NO: 3026021 - RNA, 15 nt, Mycobacterium avium subsp. paratuberculosis
gacggagucgucggc

SEQ ID NO: 3026022 - RNA, 17 nt, Mycobacterium avium subsp. paratuberculosis
gacggagucgucggcgc

SEQ ID NO: 3026023 - RNA, 19 nt, Mycobacterium avium subsp. paratuberculosis
gacggaguuggaucgccgc

SEQ ID NO: 3026024 - RNA, 15 nt, Mycobacterium avium subsp. paratuberculosis
gacggauccgggcgc

SEQ ID NO: 3026025 - RNA, 16 nt, Mycobacterium avium subsp. paratuberculosis
gacggauccgggcgcc

SEQ ID NO: 3026026 - RNA, 17 nt, Mycobacterium avium subsp. paratuberculosis
gacggauccgggcgccg

SEQ ID NO: 3026027 - RNA, 21 nt, Mycobacterium avium subsp. paratuberculosis
gacggaucgagucccgcgcgg

SEQ ID NO: 3026028 - RNA, 19 nt, Mycobacterium avium subsp. paratuberculosis
gacggaucggccgcgucgg

SEQ ID NO: 3026029 - RNA, 21 nt, Mycobacterium avium subsp. paratuberculosis
gacggaucgguguagcccggu

SEQ ID NO: 3026030 - RNA, 22 nt, Mycobacterium avium subsp. paratuberculosis
gacggaucgguguagcccggug

SEQ ID NO: 3026031 - RNA, 19 nt, Mycobacterium avium subsp. paratuberculosis
gacggaugugacgcgggac

SEQ ID NO: 3026032 - RNA, 22 nt, Mycobacterium avium subsp. paratuberculosis
gacggaugugacgcgggaccgg

SEQ ID NO: 3026033 - RNA, 15 nt, Mycobacterium avium subsp. paratuberculosis
gacggauguggucgg

SEQ ID NO: 3026034 - RNA, 18 nt, Mycobacterium avium subsp. paratuberculosis
gacggauguggucggcca

SEQ ID NO: 3026035 - RNA, 21 nt, Mycobacterium avium subsp. paratuberculosis
gacggauguggucggccacga

SEQ ID NO: 3026036 - RNA, 14 nt, Mycobacterium avium subsp. paratuberculosis
gacggauucccgaa

SEQ ID NO: 3026037 - RNA, 23 nt, Mycobacterium avium subsp. paratuberculosis
gacggcaagcaguaugcccgccg

SEQ ID NO: 3026038 - RNA, 19 nt, Mycobacterium avium subsp. paratuberculosis
gacggcaauccggccccgc

SEQ ID NO: 3026039 - RNA, 15 nt, Mycobacterium avium subsp. paratuberculosis
gacggcaccgccggc

SEQ ID NO: 3026040 - RNA, 16 nt, Mycobacterium avium subsp. paratuberculosis
gacggcaccgccggcg

SEQ ID NO: 3026041 - RNA, 17 nt, Mycobacterium avium subsp. paratuberculosis
gacggcaccgccggcgg

SEQ ID NO: 3026042 - RNA, 19 nt, Mycobacterium avium subsp. paratuberculosis
gacggcaccgccggcggcc

SEQ ID NO: 3026043 - RNA, 22 nt, Mycobacterium avium subsp. paratuberculosis
gacggcaccgccggcggccucc

SEQ ID NO: 3026044 - RNA, 15 nt, Mycobacterium avium subsp. paratuberculosis
gacggcaccucucgg

SEQ ID NO: 3026045 - RNA, 15 nt, Mycobacterium avium subsp. paratuberculosis
gacggcagcaccgcc

SEQ ID NO: 3026046 - RNA, 16 nt, Mycobacterium avium subsp. paratuberculosis
gacggcagcaccgccg

SEQ ID NO: 3026047 - RNA, 17 nt, Mycobacterium avium subsp. paratuberculosis
gacggcagcaccgccga

SEQ ID NO: 3026048 - RNA, 20 nt, Mycobacterium avium subsp. paratuberculosis
gacggcagcaccgccgacau

SEQ ID NO: 3026049 - RNA, 15 nt, Mycobacterium avium subsp. paratuberculosis
gacggcagcaccucg

SEQ ID NO: 3026050 - RNA, 21 nt, Mycobacterium avium subsp. paratuberculosis
gacggcagcaccucgcgcagc

SEQ ID NO: 3026051 - RNA, 12 nt, Mycobacterium avium subsp. paratuberculosis
gacggcagcgcg

SEQ ID NO: 3026052 - RNA, 13 nt, Mycobacterium avium subsp. paratuberculosis
gacggcagcgcga

SEQ ID NO: 3026053 - RNA, 14 nt, Mycobacterium avium subsp. paratuberculosis
gacggcagcgcgau

SEQ ID NO: 3026054 - RNA, 15 nt, Mycobacterium avium subsp. paratuberculosis
gacggcagcgcgauc

SEQ ID NO: 3026055 - RNA, 21 nt, Mycobacterium avium subsp. paratuberculosis
gacggcagcggcaccaacccg

SEQ ID NO: 3026056 - RNA, 14 nt, Mycobacterium avium subsp. paratuberculosis
gacggcaucggcgc

SEQ ID NO: 3026057 - RNA, 17 nt, Mycobacterium avium subsp. paratuberculosis
gacggcaucggcgcccu

SEQ ID NO: 3026058 - RNA, 22 nt, Mycobacterium avium subsp. paratuberculosis
gacggcaucggcgcccucgccg

SEQ ID NO: 3026059 - RNA, 12 nt, Mycobacterium avium subsp. paratuberculosis
gacggcaugccg

SEQ ID NO: 3026060 - RNA, 23 nt, Mycobacterium avium subsp. paratuberculosis
gacggcaugccgggccagccggc

SEQ ID NO: 3026061 - RNA, 17 nt, Mycobacterium avium subsp. paratuberculosis
gacggccagaccgcaca

SEQ ID NO: 3026062 - RNA, 20 nt, Mycobacterium avium subsp. paratuberculosis
gacggccagcagcaccgcgu

SEQ ID NO: 3026063 - RNA, 14 nt, Mycobacterium avium subsp. paratuberculosis
gacggccagcagga

SEQ ID NO: 3026064 - RNA, 21 nt, Mycobacterium avium subsp. paratuberculosis
gacggccagcagggcgccgac

SEQ ID NO: 3026065 - RNA, 22 nt, Mycobacterium avium subsp. paratuberculosis
gacggccagcagggcgccgacg

SEQ ID NO: 3026066 - RNA, 17 nt, Mycobacterium avium subsp. paratuberculosis
gacggccagcccgucgg

SEQ ID NO: 3026067 - RNA, 19 nt, Mycobacterium avium subsp. paratuberculosis
gacggcccacgucgcgccg

SEQ ID NO: 3026068 - RNA, 21 nt, Mycobacterium avium subsp. paratuberculosis
gacggcccacgucgcgccgau

SEQ ID NO: 3026069 - RNA, 18 nt, Mycobacterium avium subsp. paratuberculosis
gacggccccagacgaagu

SEQ ID NO: 3026070 - RNA, 23 nt, Mycobacterium avium subsp. paratuberculosis
gacggccccccgggcaccagcgc

SEQ ID NO: 3026071 - RNA, 12 nt, Mycobacterium avium subsp. paratuberculosis
gacggcccgacg

SEQ ID NO: 3026072 - RNA, 18 nt, Mycobacterium avium subsp. paratuberculosis
gacggcccgacgacgccg

SEQ ID NO: 3026073 - RNA, 19 nt, Mycobacterium avium subsp. paratuberculosis
gacggcccgccggagccga

SEQ ID NO: 3026074 - RNA, 19 nt, Mycobacterium avium subsp. paratuberculosis
gacggccgaaacgcccggc

SEQ ID NO: 3026075 - RNA, 17 nt, Mycobacterium avium subsp. paratuberculosis
gacggccgcaccccacc

SEQ ID NO: 3026076 - RNA, 19 nt, Mycobacterium avium subsp. paratuberculosis
gacggccgcaccccacccg

SEQ ID NO: 3026077 - RNA, 15 nt, Mycobacterium avium subsp. paratuberculosis
gacggccgccgcgac

SEQ ID NO: 3026078 - RNA, 16 nt, Mycobacterium avium subsp. paratuberculosis
gacggccgccgcgacg

SEQ ID NO: 3026079 - RNA, 23 nt, Mycobacterium avium subsp. paratuberculosis
gacggccgcgccgaacaccacgc

SEQ ID NO: 3026080 - RNA, 17 nt, Mycobacterium avium subsp. paratuberculosis
gacggccgcggcgcggc

SEQ ID NO: 3026081 - RNA, 18 nt, Mycobacterium avium subsp. paratuberculosis
gacggccgcggcgcggcc

SEQ ID NO: 3026082 - RNA, 14 nt, Mycobacterium avium subsp. paratuberculosis
gacggccgcggcgg

SEQ ID NO: 3026083 - RNA, 15 nt, Mycobacterium avium subsp. paratuberculosis
gacggccgcggcggu

SEQ ID NO: 3026084 - RNA, 16 nt, Mycobacterium avium subsp. paratuberculosis
gacggccggcccugca

SEQ ID NO: 3026085 - RNA, 14 nt, Mycobacterium avium subsp. paratuberculosis
gacggccggggcca

SEQ ID NO: 3026086 - RNA, 16 nt, Mycobacterium avium subsp. paratuberculosis
gacggccggggccagc

SEQ ID NO: 3026087 - RNA, 17 nt, Mycobacterium avium subsp. paratuberculosis
gacggccggggccagca

SEQ ID NO: 3026088 - RNA, 19 nt, Mycobacterium avium subsp. paratuberculosis
gacggccggggccagcacc

SEQ ID NO: 3026089 - RNA, 14 nt, Mycobacterium avium subsp. paratuberculosis
gacggccguacgcg

SEQ ID NO: 3026090 - RNA, 17 nt, Mycobacterium avium subsp. paratuberculosis
gacggccguccggucgc

SEQ ID NO: 3026091 - RNA, 12 nt, Mycobacterium avium subsp. paratuberculosis
gacggccguucu

SEQ ID NO: 3026092 - RNA, 13 nt, Mycobacterium avium subsp. paratuberculosis
gacggccucgccg

SEQ ID NO: 3026093 - RNA, 13 nt, Mycobacterium avium subsp. paratuberculosis
gacggccucgugg

SEQ ID NO: 3026094 - RNA, 16 nt, Mycobacterium avium subsp. paratuberculosis
gacggccugcaccacc

SEQ ID NO: 3026095 - RNA, 17 nt, Mycobacterium avium subsp. paratuberculosis
gacggccugcaccacca

SEQ ID NO: 3026096 - RNA, 24 nt, Mycobacterium avium subsp. paratuberculosis
gacggccugcaccaccacacccag

SEQ ID NO: 3026097 - RNA, 17 nt, Mycobacterium avium subsp. paratuberculosis
gacggccugggcgacca

SEQ ID NO: 3026098 - RNA, 13 nt, Mycobacterium avium subsp. paratuberculosis
gacggcgaacggu

SEQ ID NO: 3026099 - RNA, 19 nt, Mycobacterium avium subsp. paratuberculosis
gacggcgaacuuggccgac

SEQ ID NO: 3026100 - RNA, 15 nt, Mycobacterium avium subsp. paratuberculosis
gacggcgaagccggc

SEQ ID NO: 3026101 - RNA, 19 nt, Mycobacterium avium subsp. paratuberculosis
gacggcgaagccggcguca

SEQ ID NO: 3026102 - RNA, 16 nt, Mycobacterium avium subsp. paratuberculosis
gacggcgaccauccac

SEQ ID NO: 3026103 - RNA, 20 nt, Mycobacterium avium subsp. paratuberculosis
gacggcgaccauccacucgg

SEQ ID NO: 3026104 - RNA, 17 nt, Mycobacterium avium subsp. paratuberculosis
gacggcgacgaccguca

SEQ ID NO: 3026105 - RNA, 13 nt, Mycobacterium avium subsp. paratuberculosis
gacggcgacggca

SEQ ID NO: 3026106 - RNA, 15 nt, Mycobacterium avium subsp. paratuberculosis
gacggcgacggcagc

SEQ ID NO: 3026107 - RNA, 18 nt, Mycobacterium avium subsp. paratuberculosis
gacggcgacggcagcgcg

SEQ ID NO: 3026108 - RNA, 20 nt, Mycobacterium avium subsp. paratuberculosis
gacggcgacggcagcgcgau

SEQ ID NO: 3026109 - RNA, 16 nt, Mycobacterium avium subsp. paratuberculosis
gacggcgacggccaga

SEQ ID NO: 3026110 - RNA, 17 nt, Mycobacterium avium subsp. paratuberculosis
gacggcgacggccagac

SEQ ID NO: 3026111 - RNA, 18 nt, Mycobacterium avium subsp. paratuberculosis
gacggcgacggcguugcu

SEQ ID NO: 3026112 - RNA, 15 nt, Mycobacterium avium subsp. paratuberculosis
gacggcgagccgggc

SEQ ID NO: 3026113 - RNA, 16 nt, Mycobacterium avium subsp. paratuberculosis
gacggcgagcggcccu

SEQ ID NO: 3026114 - RNA, 17 nt, Mycobacterium avium subsp. paratuberculosis
gacggcgagcggcccug

SEQ ID NO: 3026115 - RNA, 18 nt, Mycobacterium avium subsp. paratuberculosis
gacggcgagcggcccugc

SEQ ID NO: 3026116 - RNA, 17 nt, Mycobacterium avium subsp. paratuberculosis
gacggcgaggaucgcga

SEQ ID NO: 3026117 - RNA, 23 nt, Mycobacterium avium subsp. paratuberculosis
gacggcgaggaucgcgaugucga

SEQ ID NO: 3026118 - RNA, 22 nt, Mycobacterium avium subsp. paratuberculosis
gacggcgagguaauggugggcg

SEQ ID NO: 3026119 - RNA, 22 nt, Mycobacterium avium subsp. paratuberculosis
gacggcgcccgccccgacgugc

SEQ ID NO: 3026120 - RNA, 14 nt, Mycobacterium avium subsp. paratuberculosis
gacggcgccgcccg

SEQ ID NO: 3026121 - RNA, 12 nt, Mycobacterium avium subsp. paratuberculosis
gacggcgccgcg

SEQ ID NO: 3026122 - RNA, 16 nt, Mycobacterium avium subsp. paratuberculosis
gacggcgccgcggccg

SEQ ID NO: 3026123 - RNA, 17 nt, Mycobacterium avium subsp. paratuberculosis
gacggcgccgcggccgu

SEQ ID NO: 3026124 - RNA, 13 nt, Mycobacterium avium subsp. paratuberculosis
gacggcgccgcgu

SEQ ID NO: 3026125 - RNA, 20 nt, Mycobacterium avium subsp. paratuberculosis
gacggcgccggacaccuugg

SEQ ID NO: 3026126 - RNA, 19 nt, Mycobacterium avium subsp. paratuberculosis
gacggcgccugauccgcgg

SEQ ID NO: 3026127 - RNA, 12 nt, Mycobacterium avium subsp. paratuberculosis
gacggcgcguga

SEQ ID NO: 3026128 - RNA, 23 nt, Mycobacterium avium subsp. paratuberculosis
gacggcgcgugauccggaaugcg

SEQ ID NO: 3026129 - RNA, 13 nt, Mycobacterium avium subsp. paratuberculosis
gacggcgcucacc

SEQ ID NO: 3026130 - RNA, 15 nt, Mycobacterium avium subsp. paratuberculosis
gacggcgcucaccgg

SEQ ID NO: 3026131 - RNA, 20 nt, Mycobacterium avium subsp. paratuberculosis
gacggcgcucaccggcgugg

SEQ ID NO: 3026132 - RNA, 17 nt, Mycobacterium avium subsp. paratuberculosis
gacggcgcuggccgcgg

SEQ ID NO: 3026133 - RNA, 22 nt, Mycobacterium avium subsp. paratuberculosis
gacggcgcuggccgcggccagc

SEQ ID NO: 3026134 - RNA, 19 nt, Mycobacterium avium subsp. paratuberculosis
gacggcgcuguaccgcgag

SEQ ID NO: 3026135 - RNA, 22 nt, Mycobacterium avium subsp. paratuberculosis
gacggcgcuguaccgcgagauc

SEQ ID NO: 3026136 - RNA, 13 nt, Mycobacterium avium subsp. paratuberculosis
gacggcggcgagu

SEQ ID NO: 3026137 - RNA, 17 nt, Mycobacterium avium subsp. paratuberculosis
gacggcggcgaguucgg

SEQ ID NO: 3026138 - RNA, 14 nt, Mycobacterium avium subsp. paratuberculosis
gacggcggcgcccu

SEQ ID NO: 3026139 - RNA, 16 nt, Mycobacterium avium subsp. paratuberculosis
gacggcggcgcccugc

SEQ ID NO: 3026140 - RNA, 15 nt, Mycobacterium avium subsp. paratuberculosis
gacggcggcggugcc

SEQ ID NO: 3026141 - RNA, 24 nt, Mycobacterium avium subsp. paratuberculosis
gacggcggcggugccgcaggcgaa

SEQ ID NO: 3026142 - RNA, 23 nt, Mycobacterium avium subsp. paratuberculosis
gacggcggcgucccagugcucga

SEQ ID NO: 3026143 - RNA, 13 nt, Mycobacterium avium subsp. paratuberculosis
gacggcggggcgg

SEQ ID NO: 3026144 - RNA, 13 nt, Mycobacterium avium subsp. paratuberculosis
gacggcggguggg

SEQ ID NO: 3026145 - RNA, 22 nt, Mycobacterium avium subsp. paratuberculosis
gacggcggugacguuccagccg

SEQ ID NO: 3026146 - RNA, 15 nt, Mycobacterium avium subsp. paratuberculosis
gacggcguccagcug

SEQ ID NO: 3026147 - RNA, 17 nt, Mycobacterium avium subsp. paratuberculosis
gacggcguccagcugcg

SEQ ID NO: 3026148 - RNA, 20 nt, Mycobacterium avium subsp. paratuberculosis
gacggcguccagcugcgcgc

SEQ ID NO: 3026149 - RNA, 17 nt, Mycobacterium avium subsp. paratuberculosis
gacggcgucggcgagcg

SEQ ID NO: 3026150 - RNA, 22 nt, Mycobacterium avium subsp. paratuberculosis
gacggcgucggcgagcgguucg

SEQ ID NO: 3026151 - RNA, 15 nt, Mycobacterium avium subsp. paratuberculosis
gacggcgucggcgau

SEQ ID NO: 3026152 - RNA, 16 nt, Mycobacterium avium subsp. paratuberculosis
gacggcgucggcggcc

SEQ ID NO: 3026153 - RNA, 17 nt, Mycobacterium avium subsp. paratuberculosis
gacggcgucuuggggau

SEQ ID NO: 3026154 - RNA, 22 nt, Mycobacterium avium subsp. paratuberculosis
gacggcguggaacacgcccagc

SEQ ID NO: 3026155 - RNA, 20 nt, Mycobacterium avium subsp. paratuberculosis
gacggcguggucggcgaagc

SEQ ID NO: 3026156 - RNA, 17 nt, Mycobacterium avium subsp. paratuberculosis
gacggcguugcuggcgc

SEQ ID NO: 3026157 - RNA, 22 nt, Mycobacterium avium subsp. paratuberculosis
gacggcuaccugaccagcggcg

SEQ ID NO: 3026158 - RNA, 18 nt, Mycobacterium avium subsp. paratuberculosis
gacggcucuucgcggcgg

SEQ ID NO: 3026159 - RNA, 16 nt, Mycobacterium avium subsp. paratuberculosis
gacggcucuucggcgc

SEQ ID NO: 3026160 - RNA, 17 nt, Mycobacterium avium subsp. paratuberculosis
gacggcucuucggcgcc

SEQ ID NO: 3026161 - RNA, 14 nt, Mycobacterium avium subsp. paratuberculosis
gacggcugcccggc

SEQ ID NO: 3026162 - RNA, 17 nt, Mycobacterium avium subsp. paratuberculosis
gacggcugcccggcccg

SEQ ID NO: 3026163 - RNA, 19 nt, Mycobacterium avium subsp. paratuberculosis
gacggcugcccggcccgcc

SEQ ID NO: 3026164 - RNA, 16 nt, Mycobacterium avium subsp. paratuberculosis
gacggcugcgguuggc

SEQ ID NO: 3026165 - RNA, 20 nt, Mycobacterium avium subsp. paratuberculosis
gacggcugcgguuggccggc

SEQ ID NO: 3026166 - RNA, 22 nt, Mycobacterium avium subsp. paratuberculosis
gacggcugcgguuggccggccg

SEQ ID NO: 3026167 - RNA, 23 nt, Mycobacterium avium subsp. paratuberculosis
gacggcugcgguuggccggccgg

SEQ ID NO: 3026168 - RNA, 22 nt, Mycobacterium avium subsp. paratuberculosis
gacggcuggaaucccgccucgg

SEQ ID NO: 3026169 - RNA, 17 nt, Mycobacterium avium subsp. paratuberculosis
gacggcuuccgcggacg

SEQ ID NO: 3026170 - RNA, 16 nt, Mycobacterium avium subsp. paratuberculosis
gacgggaacucggcca

SEQ ID NO: 3026171 - RNA, 22 nt, Mycobacterium avium subsp. paratuberculosis
gacgggaagaucgcagcgguga

SEQ ID NO: 3026172 - RNA, 14 nt, Mycobacterium avium subsp. paratuberculosis
gacgggaccgcacg

SEQ ID NO: 3026173 - RNA, 15 nt, Mycobacterium avium subsp. paratuberculosis
gacgggaccgcacgc

SEQ ID NO: 3026174 - RNA, 17 nt, Mycobacterium avium subsp. paratuberculosis
gacgggaccgcacgccg

SEQ ID NO: 3026175 - RNA, 18 nt, Mycobacterium avium subsp. paratuberculosis
gacgggacguuggcggac

SEQ ID NO: 3026176 - RNA, 16 nt, Mycobacterium avium subsp. paratuberculosis
gacgggagucgggccc

SEQ ID NO: 3026177 - RNA, 17 nt, Mycobacterium avium subsp. paratuberculosis
gacgggagucgggcccg

SEQ ID NO: 3026178 - RNA, 15 nt, Mycobacterium avium subsp. paratuberculosis
gacgggaucggcgcg

SEQ ID NO: 3026179 - RNA, 15 nt, Mycobacterium avium subsp. paratuberculosis
gacgggcacccgcgc

SEQ ID NO: 3026180 - RNA, 16 nt, Mycobacterium avium subsp. paratuberculosis
gacgggcacccgcgcg

SEQ ID NO: 3026181 - RNA, 15 nt, Mycobacterium avium subsp. paratuberculosis
gacgggcagggugac

SEQ ID NO: 3026182 - RNA, 21 nt, Mycobacterium avium subsp. paratuberculosis
gacgggcauccggcucagaag

SEQ ID NO: 3026183 - RNA, 16 nt, Mycobacterium avium subsp. paratuberculosis
gacgggcaugccgucg

SEQ ID NO: 3026184 - RNA, 19 nt, Mycobacterium avium subsp. paratuberculosis
gacgggcaugccgucggcg

SEQ ID NO: 3026185 - RNA, 21 nt, Mycobacterium avium subsp. paratuberculosis
gacgggcaugccgucggcgcc

SEQ ID NO: 3026186 - RNA, 14 nt, Mycobacterium avium subsp. paratuberculosis
gacgggccaccagc

SEQ ID NO: 3026187 - RNA, 15 nt, Mycobacterium avium subsp. paratuberculosis
gacgggcccagcgcg

SEQ ID NO: 3026188 - RNA, 22 nt, Mycobacterium avium subsp. paratuberculosis
gacgggccgaucacgcggaucg

SEQ ID NO: 3026189 - RNA, 17 nt, Mycobacterium avium subsp. paratuberculosis
gacgggccgcauccgcg

SEQ ID NO: 3026190 - RNA, 18 nt, Mycobacterium avium subsp. paratuberculosis
gacgggccgcauccgcga

SEQ ID NO: 3026191 - RNA, 17 nt, Mycobacterium avium subsp. paratuberculosis
gacgggccgcggccagc

SEQ ID NO: 3026192 - RNA, 13 nt, Mycobacterium avium subsp. paratuberculosis
gacgggccggcgg

SEQ ID NO: 3026193 - RNA, 14 nt, Mycobacterium avium subsp. paratuberculosis
gacgggccggcggg

SEQ ID NO: 3026194 - RNA, 21 nt, Mycobacterium avium subsp. paratuberculosis
gacgggccgggcacgucgacg

SEQ ID NO: 3026195 - RNA, 20 nt, Mycobacterium avium subsp. paratuberculosis
gacgggccuagugccggggg

SEQ ID NO: 3026196 - RNA, 12 nt, Mycobacterium avium subsp. paratuberculosis
gacgggcgaucu

SEQ ID NO: 3026197 - RNA, 18 nt, Mycobacterium avium subsp. paratuberculosis
gacgggcgucggcgggcg

SEQ ID NO: 3026198 - RNA, 13 nt, Mycobacterium avium subsp. paratuberculosis
gacgggcgugaca

SEQ ID NO: 3026199 - RNA, 21 nt, Mycobacterium avium subsp. paratuberculosis
gacgggcgugacggaugugac

SEQ ID NO: 3026200 - RNA, 18 nt, Mycobacterium avium subsp. paratuberculosis
gacgggcgugccggcggc

SEQ ID NO: 3026201 - RNA, 20 nt, Mycobacterium avium subsp. paratuberculosis
gacgggcgugccggcggcgg

SEQ ID NO: 3026202 - RNA, 22 nt, Mycobacterium avium subsp. paratuberculosis
gacgggcguguagccugcggcc

SEQ ID NO: 3026203 - RNA, 13 nt, Mycobacterium avium subsp. paratuberculosis
gacgggcucggcg

SEQ ID NO: 3026204 - RNA, 20 nt, Mycobacterium avium subsp. paratuberculosis
gacgggcugcugcacgucgc

SEQ ID NO: 3026205 - RNA, 18 nt, Mycobacterium avium subsp. paratuberculosis
gacgggcugucccggccg

SEQ ID NO: 3026206 - RNA, 13 nt, Mycobacterium avium subsp. paratuberculosis
gacggggcgaugc

SEQ ID NO: 3026207 - RNA, 14 nt, Mycobacterium avium subsp. paratuberculosis
gacggggcgaugcc

SEQ ID NO: 3026208 - RNA, 16 nt, Mycobacterium avium subsp. paratuberculosis
gacgggucgaccgccg

SEQ ID NO: 3026209 - RNA, 18 nt, Mycobacterium avium subsp. paratuberculosis
gacgggucgaccgccgcg

SEQ ID NO: 3026210 - RNA, 16 nt, Mycobacterium avium subsp. paratuberculosis
gacgggucggcggcga

SEQ ID NO: 3026211 - RNA, 17 nt, Mycobacterium avium subsp. paratuberculosis
gacgggucggcggcgaa

SEQ ID NO: 3026212 - RNA, 18 nt, Mycobacterium avium subsp. paratuberculosis
gacgggucggcggcgaac

SEQ ID NO: 3026213 - RNA, 14 nt, Mycobacterium avium subsp. paratuberculosis
gacgggucgguggu

SEQ ID NO: 3026214 - RNA, 22 nt, Mycobacterium avium subsp. paratuberculosis
gacgggucguaggacaccacgg

SEQ ID NO: 3026215 - RNA, 16 nt, Mycobacterium avium subsp. paratuberculosis
gacggguucgcgcagc

SEQ ID NO: 3026216 - RNA, 17 nt, Mycobacterium avium subsp. paratuberculosis
gacggguucgcgcagcc

SEQ ID NO: 3026217 - RNA, 20 nt, Mycobacterium avium subsp. paratuberculosis
gacggguucgcgcagccacc

SEQ ID NO: 3026218 - RNA, 19 nt, Mycobacterium avium subsp. paratuberculosis
gacggguugcaggccacgc

SEQ ID NO: 3026219 - RNA, 15 nt, Mycobacterium avium subsp. paratuberculosis
gacggguugggcgcc

SEQ ID NO: 3026220 - RNA, 21 nt, Mycobacterium avium subsp. paratuberculosis
gacggguugggcgccagcagc

SEQ ID NO: 3026221 - RNA, 22 nt, Mycobacterium avium subsp. paratuberculosis
gacggguugggcgccagcagca

SEQ ID NO: 3026222 - RNA, 16 nt, Mycobacterium avium subsp. paratuberculosis
gacggguuggucggcg

SEQ ID NO: 3026223 - RNA, 21 nt, Mycobacterium avium subsp. paratuberculosis
gacggguuggucggcgcggcg

SEQ ID NO: 3026224 - RNA, 19 nt, Mycobacterium avium subsp. paratuberculosis
gacgguaugcccgccgcgu

SEQ ID NO: 3026225 - RNA, 17 nt, Mycobacterium avium subsp. paratuberculosis
gacggucaccggcaggc

SEQ ID NO: 3026226 - RNA, 20 nt, Mycobacterium avium subsp. paratuberculosis
gacggucaccggcaggcggu

SEQ ID NO: 3026227 - RNA, 12 nt, Mycobacterium avium subsp. paratuberculosis
gacggucacgcu

SEQ ID NO: 3026228 - RNA, 21 nt, Mycobacterium avium subsp. paratuberculosis
gacggucacgcuggcgugacg

SEQ ID NO: 3026229 - RNA, 14 nt, Mycobacterium avium subsp. paratuberculosis
gacggucacggccg

SEQ ID NO: 3026230 - RNA, 17 nt, Mycobacterium avium subsp. paratuberculosis
gacggucacggccgcca

SEQ ID NO: 3026231 - RNA, 11 nt, Mycobacterium avium subsp. paratuberculosis
gacggucagcg

SEQ ID NO: 3026232 - RNA, 14 nt, Mycobacterium avium subsp. paratuberculosis
gacggucagcgcgc

SEQ ID NO: 3026233 - RNA, 16 nt, Mycobacterium avium subsp. paratuberculosis
gacggucagcgcgccg

SEQ ID NO: 3026234 - RNA, 21 nt, Mycobacterium avium subsp. paratuberculosis
gacggucagcgcgccgucgga

SEQ ID NO: 3026235 - RNA, 23 nt, Mycobacterium avium subsp. paratuberculosis
gacggucagguucuucugcgcga

SEQ ID NO: 3026236 - RNA, 17 nt, Mycobacterium avium subsp. paratuberculosis
gacggucaugccgagcc

SEQ ID NO: 3026237 - RNA, 13 nt, Mycobacterium avium subsp. paratuberculosis
gacggucccgacg

SEQ ID NO: 3026238 - RNA, 17 nt, Mycobacterium avium subsp. paratuberculosis
gacgguccgcucaucgu

SEQ ID NO: 3026239 - RNA, 18 nt, Mycobacterium avium subsp. paratuberculosis
gacgguccucucgaagcg

SEQ ID NO: 3026240 - RNA, 19 nt, Mycobacterium avium subsp. paratuberculosis
gacgguccucucgaagcga

SEQ ID NO: 3026241 - RNA, 14 nt, Mycobacterium avium subsp. paratuberculosis
gacggucgccgacg

SEQ ID NO: 3026242 - RNA, 15 nt, Mycobacterium avium subsp. paratuberculosis
gacggucgccgacgu

SEQ ID NO: 3026243 - RNA, 18 nt, Mycobacterium avium subsp. paratuberculosis
gacggucgugcugggccg

SEQ ID NO: 3026244 - RNA, 21 nt, Mycobacterium avium subsp. paratuberculosis
gacggucgugcugggccgggc

SEQ ID NO: 3026245 - RNA, 13 nt, Mycobacterium avium subsp. paratuberculosis
gacggucugcacc

SEQ ID NO: 3026246 - RNA, 13 nt, Mycobacterium avium subsp. paratuberculosis
gacggucugccgg

SEQ ID NO: 3026247 - RNA, 20 nt, Mycobacterium avium subsp. paratuberculosis
gacggucugggaggcggcgg

SEQ ID NO: 3026248 - RNA, 21 nt, Mycobacterium avium subsp. paratuberculosis
gacggucugggaggcggcggu

SEQ ID NO: 3026249 - RNA, 20 nt, Mycobacterium avium subsp. paratuberculosis
gacggucuucccgccgccgu

SEQ ID NO: 3026250 - RNA, 15 nt, Mycobacterium avium subsp. paratuberculosis
gacggugaacuucac

SEQ ID NO: 3026251 - RNA, 15 nt, Mycobacterium avium subsp. paratuberculosis
gacggugaccggcgc

SEQ ID NO: 3026252 - RNA, 17 nt, Mycobacterium avium subsp. paratuberculosis
gacggugaccggcgcgc

SEQ ID NO: 3026253 - RNA, 21 nt, Mycobacterium avium subsp. paratuberculosis
gacggugaccggcgcgcccga

SEQ ID NO: 3026254 - RNA, 16 nt, Mycobacterium avium subsp. paratuberculosis
gacggugaccucgucg

SEQ ID NO: 3026255 - RNA, 17 nt, Mycobacterium avium subsp. paratuberculosis
gacggugaccucgucgg

SEQ ID NO: 3026256 - RNA, 14 nt, Mycobacterium avium subsp. paratuberculosis
gacggugacgccgg

SEQ ID NO: 3026257 - RNA, 21 nt, Mycobacterium avium subsp. paratuberculosis
gacggugagcaccgccguccc

SEQ ID NO: 3026258 - RNA, 21 nt, Mycobacterium avium subsp. paratuberculosis
gacggugaugucgccggcggc

SEQ ID NO: 3026259 - RNA, 14 nt, Mycobacterium avium subsp. paratuberculosis
gacggugcgcccgu

SEQ ID NO: 3026260 - RNA, 17 nt, Mycobacterium avium subsp. paratuberculosis
gacggugcgcccgucgu

SEQ ID NO: 3026261 - RNA, 21 nt, Mycobacterium avium subsp. paratuberculosis
gacggugcgcccgucgucgcc

SEQ ID NO: 3026262 - RNA, 17 nt, Mycobacterium avium subsp. paratuberculosis
gacggugcgugccagca

SEQ ID NO: 3026263 - RNA, 18 nt, Mycobacterium avium subsp. paratuberculosis
gacggugcgugccagcag

SEQ ID NO: 3026264 - RNA, 20 nt, Mycobacterium avium subsp. paratuberculosis
gacggugcgugccagcagcu

SEQ ID NO: 3026265 - RNA, 16 nt, Mycobacterium avium subsp. paratuberculosis
gacggugcugccguug

SEQ ID NO: 3026266 - RNA, 14 nt, Mycobacterium avium subsp. paratuberculosis
gacggugcuggcga

SEQ ID NO: 3026267 - RNA, 15 nt, Mycobacterium avium subsp. paratuberculosis
gacggugcuggcgau

SEQ ID NO: 3026268 - RNA, 17 nt, Mycobacterium avium subsp. paratuberculosis
gacggugcuggcgaugu

SEQ ID NO: 3026269 - RNA, 19 nt, Mycobacterium avium subsp. paratuberculosis
gacggugcuggcgauguga

SEQ ID NO: 3026270 - RNA, 13 nt, Mycobacterium avium subsp. paratuberculosis
gacgguggacccg

SEQ ID NO: 3026271 - RNA, 15 nt, Mycobacterium avium subsp. paratuberculosis
gacgguggcccccac

SEQ ID NO: 3026272 - RNA, 23 nt, Mycobacterium avium subsp. paratuberculosis
gacgguggccgucucgucggccg

SEQ ID NO: 3026273 - RNA, 18 nt, Mycobacterium avium subsp. paratuberculosis
gacgguggccucggcgcu

SEQ ID NO: 3026274 - RNA, 13 nt, Mycobacterium avium subsp. paratuberculosis
gacgguggcggcg

SEQ ID NO: 3026275 - RNA, 15 nt, Mycobacterium avium subsp. paratuberculosis
gacgguggcggcgau

SEQ ID NO: 3026276 - RNA, 17 nt, Mycobacterium avium subsp. paratuberculosis
gacgguggcgggccgcc

SEQ ID NO: 3026277 - RNA, 13 nt, Mycobacterium avium subsp. paratuberculosis
gacggugggcccg

SEQ ID NO: 3026278 - RNA, 15 nt, Mycobacterium avium subsp. paratuberculosis
gacggugggcccgcc

SEQ ID NO: 3026279 - RNA, 20 nt, Mycobacterium avium subsp. paratuberculosis
gacggugggcccgccgucga

SEQ ID NO: 3026280 - RNA, 22 nt, Mycobacterium avium subsp. paratuberculosis
gacggugggcccgccgucgacc

SEQ ID NO: 3026281 - RNA, 18 nt, Mycobacterium avium subsp. paratuberculosis
gacgguggggcuggccgc

SEQ ID NO: 3026282 - RNA, 19 nt, Mycobacterium avium subsp. paratuberculosis
gacgguggggcuggccgca

SEQ ID NO: 3026283 - RNA, 22 nt, Mycobacterium avium subsp. paratuberculosis
gacgguggggcuggccgcacgg

SEQ ID NO: 3026284 - RNA, 21 nt, Mycobacterium avium subsp. paratuberculosis
gacgguguaggacgccgugca

SEQ ID NO: 3026285 - RNA, 14 nt, Mycobacterium avium subsp. paratuberculosis
gacgguguccgcgg

SEQ ID NO: 3026286 - RNA, 19 nt, Mycobacterium avium subsp. paratuberculosis
gacgguguccgcggcgucg

SEQ ID NO: 3026287 - RNA, 13 nt, Mycobacterium avium subsp. paratuberculosis
gacggugucgccc

SEQ ID NO: 3026288 - RNA, 19 nt, Mycobacterium avium subsp. paratuberculosis
gacggugucgcccucgcgc

SEQ ID NO: 3026289 - RNA, 23 nt, Mycobacterium avium subsp. paratuberculosis
gacggugucgcccucgcgcaggg

SEQ ID NO: 3026290 - RNA, 17 nt, Mycobacterium avium subsp. paratuberculosis
gacggugugcgggucgg

SEQ ID NO: 3026291 - RNA, 17 nt, Mycobacterium avium subsp. paratuberculosis
gacgguuccaccggucg

SEQ ID NO: 3026292 - RNA, 17 nt, Mycobacterium avium subsp. paratuberculosis
gacgguugccucggcca

SEQ ID NO: 3026293 - RNA, 17 nt, Mycobacterium avium subsp. paratuberculosis
gacgguuucaccgccgu

SEQ ID NO: 3026294 - RNA, 19 nt, Mycobacterium avium subsp. paratuberculosis
gacgguuucugccggccgc

SEQ ID NO: 3026295 - RNA, 20 nt, Mycobacterium avium subsp. paratuberculosis
gacgguuucugccggccgcc

SEQ ID NO: 3026296 - RNA, 22 nt, Mycobacterium avium subsp. paratuberculosis
gacgguuucugccggccgccgu

SEQ ID NO: 3026297 - RNA, 16 nt, Mycobacterium avium subsp. paratuberculosis
gacgguuugcccggcg

SEQ ID NO: 3026298 - RNA, 23 nt, Mycobacterium avium subsp. paratuberculosis
gacgguuuuggucugcgccggcg

SEQ ID NO: 3026299 - RNA, 18 nt, Mycobacterium avium subsp. paratuberculosis
gacguaagugucguggcg

SEQ ID NO: 3026300 - RNA, 23 nt, Mycobacterium avium subsp. paratuberculosis
gacguaagugucguggcgugccg

SEQ ID NO: 3026301 - RNA, 22 nt, Mycobacterium avium subsp. paratuberculosis
gacguacagcgagccgucgacc

SEQ ID NO: 3026302 - RNA, 22 nt, Mycobacterium avium subsp. paratuberculosis
gacguaccagcugcccaccagc

SEQ ID NO: 3026303 - RNA, 23 nt, Mycobacterium avium subsp. paratuberculosis
gacguaccagcugcccaccagca

SEQ ID NO: 3026304 - RNA, 15 nt, Mycobacterium avium subsp. paratuberculosis
gacguacccccgcac

SEQ ID NO: 3026305 - RNA, 21 nt, Mycobacterium avium subsp. paratuberculosis
gacguacccccgcacgccagc

SEQ ID NO: 3026306 - RNA, 23 nt, Mycobacterium avium subsp. paratuberculosis
gacguacccccgcacgccagcau

SEQ ID NO: 3026307 - RNA, 20 nt, Mycobacterium avium subsp. paratuberculosis
gacguacgggcugaagauca

SEQ ID NO: 3026308 - RNA, 17 nt, Mycobacterium avium subsp. paratuberculosis
gacguacuggcgccggu

SEQ ID NO: 3026309 - RNA, 19 nt, Mycobacterium avium subsp. paratuberculosis
gacguacuggcgccggucg

SEQ ID NO: 3026310 - RNA, 21 nt, Mycobacterium avium subsp. paratuberculosis
gacguacuggcgccggucggu

SEQ ID NO: 3026311 - RNA, 22 nt, Mycobacterium avium subsp. paratuberculosis
gacguagaagucgauugccgcg

SEQ ID NO: 3026312 - RNA, 23 nt, Mycobacterium avium subsp. paratuberculosis
gacguagacgacgggcaggguga

SEQ ID NO: 3026313 - RNA, 18 nt, Mycobacterium avium subsp. paratuberculosis
gacguagacgagccgguu

SEQ ID NO: 3026314 - RNA, 21 nt, Mycobacterium avium subsp. paratuberculosis
gacguagaucauuugaccgca

SEQ ID NO: 3026315 - RNA, 20 nt, Mycobacterium avium subsp. paratuberculosis
gacguagcaccagucggcca

SEQ ID NO: 3026316 - RNA, 22 nt, Mycobacterium avium subsp. paratuberculosis
gacguagcaccagucggccauc

SEQ ID NO: 3026317 - RNA, 13 nt, Mycobacterium avium subsp. paratuberculosis
gacguaggccaga

SEQ ID NO: 3026318 - RNA, 14 nt, Mycobacterium avium subsp. paratuberculosis
gacguaggcggcca

SEQ ID NO: 3026319 - RNA, 18 nt, Mycobacterium avium subsp. paratuberculosis
gacguaggcggccagcag

SEQ ID NO: 3026320 - RNA, 20 nt, Mycobacterium avium subsp. paratuberculosis
gacguaggcggccagcagca

SEQ ID NO: 3026321 - RNA, 23 nt, Mycobacterium avium subsp. paratuberculosis
gacguaggcggccagcagcacca

SEQ ID NO: 3026322 - RNA, 22 nt, Mycobacterium avium subsp. paratuberculosis
gacguaggugagcaacgccagc

SEQ ID NO: 3026323 - RNA, 24 nt, Mycobacterium avium subsp. paratuberculosis
gacguaggugagcaacgccagcgc

SEQ ID NO: 3026324 - RNA, 15 nt, Mycobacterium avium subsp. paratuberculosis
gacguagucgcgcac

SEQ ID NO: 3026325 - RNA, 18 nt, Mycobacterium avium subsp. paratuberculosis
gacguagugcagccgccc

SEQ ID NO: 3026326 - RNA, 15 nt, Mycobacterium avium subsp. paratuberculosis
gacgucagcccgcgu

SEQ ID NO: 3026327 - RNA, 21 nt, Mycobacterium avium subsp. paratuberculosis
gacgucagcccgcgucgcgca

SEQ ID NO: 3026328 - RNA, 23 nt, Mycobacterium avium subsp. paratuberculosis
gacgucagcccgcgucgcgcagc

SEQ ID NO: 3026329 - RNA, 18 nt, Mycobacterium avium subsp. paratuberculosis
gacgucaggccggucagc

SEQ ID NO: 3026330 - RNA, 14 nt, Mycobacterium avium subsp. paratuberculosis
gacgucaggguggc

SEQ ID NO: 3026331 - RNA, 15 nt, Mycobacterium avium subsp. paratuberculosis
gacgucauccggcug

SEQ ID NO: 3026332 - RNA, 17 nt, Mycobacterium avium subsp. paratuberculosis
gacgucauccggcugcc

SEQ ID NO: 3026333 - RNA, 18 nt, Mycobacterium avium subsp. paratuberculosis
gacgucauccggcugccc

SEQ ID NO: 3026334 - RNA, 17 nt, Mycobacterium avium subsp. paratuberculosis
gacguccaccagggugg

SEQ ID NO: 3026335 - RNA, 13 nt, Mycobacterium avium subsp. paratuberculosis
gacguccaccgga

SEQ ID NO: 3026336 - RNA, 15 nt, Mycobacterium avium subsp. paratuberculosis
gacguccaccggaug

SEQ ID NO: 3026337 - RNA, 23 nt, Mycobacterium avium subsp. paratuberculosis
gacguccacguugaugccgccca

SEQ ID NO: 3026338 - RNA, 15 nt, Mycobacterium avium subsp. paratuberculosis
gacguccaggccggc

SEQ ID NO: 3026339 - RNA, 16 nt, Mycobacterium avium subsp. paratuberculosis
gacguccaggccggcg

SEQ ID NO: 3026340 - RNA, 17 nt, Mycobacterium avium subsp. paratuberculosis
gacguccaggccggcgc

SEQ ID NO: 3026341 - RNA, 19 nt, Mycobacterium avium subsp. paratuberculosis
gacguccaggccggcgccg

SEQ ID NO: 3026342 - RNA, 15 nt, Mycobacterium avium subsp. paratuberculosis
gacguccaucgggac

SEQ ID NO: 3026343 - RNA, 23 nt, Mycobacterium avium subsp. paratuberculosis
gacguccaucgggaccgcgggcg

SEQ ID NO: 3026344 - RNA, 19 nt, Mycobacterium avium subsp. paratuberculosis
gacgucccagcacaacgcc

SEQ ID NO: 3026345 - RNA, 13 nt, Mycobacterium avium subsp. paratuberculosis
gacguccgcggga

SEQ ID NO: 3026346 - RNA, 15 nt, Mycobacterium avium subsp. paratuberculosis
gacguccgcgucggc

SEQ ID NO: 3026347 - RNA, 17 nt, Mycobacterium avium subsp. paratuberculosis
gacguccgcgucggcgc

SEQ ID NO: 3026348 - RNA, 19 nt, Mycobacterium avium subsp. paratuberculosis
gacguccgcgucggcgccg

SEQ ID NO: 3026349 - RNA, 22 nt, Mycobacterium avium subsp. paratuberculosis
gacguccgcgucggcgccggcc

SEQ ID NO: 3026350 - RNA, 13 nt, Mycobacterium avium subsp. paratuberculosis
gacguccgggccg

SEQ ID NO: 3026351 - RNA, 15 nt, Mycobacterium avium subsp. paratuberculosis
gacguccgggccgcc

SEQ ID NO: 3026352 - RNA, 15 nt, Mycobacterium avium subsp. paratuberculosis
gacguccucgacgau

SEQ ID NO: 3026353 - RNA, 22 nt, Mycobacterium avium subsp. paratuberculosis
gacguccucgaugccgaccgac

SEQ ID NO: 3026354 - RNA, 14 nt, Mycobacterium avium subsp. paratuberculosis
gacguccucgcccg

SEQ ID NO: 3026355 - RNA, 14 nt, Mycobacterium avium subsp. paratuberculosis
gacguccugguuga

SEQ ID NO: 3026356 - RNA, 19 nt, Mycobacterium avium subsp. paratuberculosis
gacguccuugacccggccg

SEQ ID NO: 3026357 - RNA, 17 nt, Mycobacterium avium subsp. paratuberculosis
gacguccuugaucagca

SEQ ID NO: 3026358 - RNA, 13 nt, Mycobacterium avium subsp. paratuberculosis
gacgucgaccgcg

SEQ ID NO: 3026359 - RNA, 16 nt, Mycobacterium avium subsp. paratuberculosis
gacgucgaccgcgacg

SEQ ID NO: 3026360 - RNA, 19 nt, Mycobacterium avium subsp. paratuberculosis
gacgucgaccgcgacgacc

SEQ ID NO: 3026361 - RNA, 14 nt, Mycobacterium avium subsp. paratuberculosis
gacgucgaccgcgc

SEQ ID NO: 3026362 - RNA, 21 nt, Mycobacterium avium subsp. paratuberculosis
gacgucgacgucgagggcgcc

SEQ ID NO: 3026363 - RNA, 14 nt, Mycobacterium avium subsp. paratuberculosis
gacgucgacguucg

SEQ ID NO: 3026364 - RNA, 15 nt, Mycobacterium avium subsp. paratuberculosis
gacgucgacugaucg

SEQ ID NO: 3026365 - RNA, 16 nt, Mycobacterium avium subsp. paratuberculosis
gacgucgacugaucga

SEQ ID NO: 3026366 - RNA, 22 nt, Mycobacterium avium subsp. paratuberculosis
gacgucgacugaucgacgagcc

SEQ ID NO: 3026367 - RNA, 19 nt, Mycobacterium avium subsp. paratuberculosis
gacgucgagaaaggccagc

SEQ ID NO: 3026368 - RNA, 20 nt, Mycobacterium avium subsp. paratuberculosis
gacgucgagaaaggccagca

SEQ ID NO: 3026369 - RNA, 21 nt, Mycobacterium avium subsp. paratuberculosis
gacgucgagaaaggccagcac

SEQ ID NO: 3026370 - RNA, 19 nt, Mycobacterium avium subsp. paratuberculosis
gacgucgagccagcgggcc

SEQ ID NO: 3026371 - RNA, 24 nt, Mycobacterium avium subsp. paratuberculosis
gacgucgagccagcgggccgagcg

SEQ ID NO: 3026372 - RNA, 16 nt, Mycobacterium avium subsp. paratuberculosis
gacgucgagcggcgcc

SEQ ID NO: 3026373 - RNA, 22 nt, Mycobacterium avium subsp. paratuberculosis
gacgucgagguguugucgugcc

SEQ ID NO: 3026374 - RNA, 14 nt, Mycobacterium avium subsp. paratuberculosis
gacgucgaugccgg

SEQ ID NO: 3026375 - RNA, 15 nt, Mycobacterium avium subsp. paratuberculosis
gacgucgaugccggc

SEQ ID NO: 3026376 - RNA, 16 nt, Mycobacterium avium subsp. paratuberculosis
gacgucgaugccggcc

SEQ ID NO: 3026377 - RNA, 17 nt, Mycobacterium avium subsp. paratuberculosis
gacgucgaugccggcca

SEQ ID NO: 3026378 - RNA, 21 nt, Mycobacterium avium subsp. paratuberculosis
gacgucgaugccggccagcgg

SEQ ID NO: 3026379 - RNA, 17 nt, Mycobacterium avium subsp. paratuberculosis
gacgucgaugugcucgg

SEQ ID NO: 3026380 - RNA, 13 nt, Mycobacterium avium subsp. paratuberculosis
gacgucgcccacc

SEQ ID NO: 3026381 - RNA, 14 nt, Mycobacterium avium subsp. paratuberculosis
gacgucgcccaccc

SEQ ID NO: 3026382 - RNA, 16 nt, Mycobacterium avium subsp. paratuberculosis
gacgucgcccacccgg

SEQ ID NO: 3026383 - RNA, 12 nt, Mycobacterium avium subsp. paratuberculosis
gacgucgccgau

SEQ ID NO: 3026384 - RNA, 16 nt, Mycobacterium avium subsp. paratuberculosis
gacgucgccggccugc

SEQ ID NO: 3026385 - RNA, 18 nt, Mycobacterium avium subsp. paratuberculosis
gacgucgccggccugccc

SEQ ID NO: 3026386 - RNA, 21 nt, Mycobacterium avium subsp. paratuberculosis
gacgucgcgcagguagguggc

SEQ ID NO: 3026387 - RNA, 13 nt, Mycobacterium avium subsp. paratuberculosis
gacgucgcgccgc

SEQ ID NO: 3026388 - RNA, 18 nt, Mycobacterium avium subsp. paratuberculosis
gacgucgcgcggggugac

SEQ ID NO: 3026389 - RNA, 19 nt, Mycobacterium avium subsp. paratuberculosis
gacgucgcgcggggugacg

SEQ ID NO: 3026390 - RNA, 16 nt, Mycobacterium avium subsp. paratuberculosis
gacgucggacgcggcc

SEQ ID NO: 3026391 - RNA, 20 nt, Mycobacterium avium subsp. paratuberculosis
gacgucggacgcggccgagc

SEQ ID NO: 3026392 - RNA, 15 nt, Mycobacterium avium subsp. paratuberculosis
gacgucggccggcug

SEQ ID NO: 3026393 - RNA, 19 nt, Mycobacterium avium subsp. paratuberculosis
gacgucggccggcugcagc

SEQ ID NO: 3026394 - RNA, 22 nt, Mycobacterium avium subsp. paratuberculosis
gacgucggccggcugcagccgg

SEQ ID NO: 3026395 - RNA, 13 nt, Mycobacterium avium subsp. paratuberculosis
gacgucggccggg

SEQ ID NO: 3026396 - RNA, 15 nt, Mycobacterium avium subsp. paratuberculosis
gacgucggcgcgcuc

SEQ ID NO: 3026397 - RNA, 22 nt, Mycobacterium avium subsp. paratuberculosis
gacgucggcgucaucgacuugc

SEQ ID NO: 3026398 - RNA, 20 nt, Mycobacterium avium subsp. paratuberculosis
gacgucggguccgaccagca

SEQ ID NO: 3026399 - RNA, 13 nt, Mycobacterium avium subsp. paratuberculosis
gacgucggucagc

SEQ ID NO: 3026400 - RNA, 18 nt, Mycobacterium avium subsp. paratuberculosis
gacgucggucagcaucgg

SEQ ID NO: 3026401 - RNA, 20 nt, Mycobacterium avium subsp. paratuberculosis
gacgucggucagcaucgggu

SEQ ID NO: 3026402 - RNA, 22 nt, Mycobacterium avium subsp. paratuberculosis
gacgucggugaaauagcgcagc

SEQ ID NO: 3026403 - RNA, 19 nt, Mycobacterium avium subsp. paratuberculosis
gacgucgguguagcccucc

SEQ ID NO: 3026404 - RNA, 13 nt, Mycobacterium avium subsp. paratuberculosis
gacgucgucgacc

SEQ ID NO: 3026405 - RNA, 13 nt, Mycobacterium avium subsp. paratuberculosis
gacgucgucgccc

SEQ ID NO: 3026406 - RNA, 16 nt, Mycobacterium avium subsp. paratuberculosis
gacgucgucgcccacc

SEQ ID NO: 3026407 - RNA, 14 nt, Mycobacterium avium subsp. paratuberculosis
gacgucgucgcggc

SEQ ID NO: 3026408 - RNA, 15 nt, Mycobacterium avium subsp. paratuberculosis
gacgucgucgcggcg

SEQ ID NO: 3026409 - RNA, 15 nt, Mycobacterium avium subsp. paratuberculosis
gacgucgucguccca

SEQ ID NO: 3026410 - RNA, 22 nt, Mycobacterium avium subsp. paratuberculosis
gacgucguugaccgaggcgauc

SEQ ID NO: 3026411 - RNA, 20 nt, Mycobacterium avium subsp. paratuberculosis
gacgucguuuuccagccggc

SEQ ID NO: 3026412 - RNA, 22 nt, Mycobacterium avium subsp. paratuberculosis
gacgucguuuuccagccggcgc

SEQ ID NO: 3026413 - RNA, 23 nt, Mycobacterium avium subsp. paratuberculosis
gacgucguuuuccagccggcgca

SEQ ID NO: 3026414 - RNA, 21 nt, Mycobacterium avium subsp. paratuberculosis
gacgucuaagucgaugccgcc

SEQ ID NO: 3026415 - RNA, 23 nt, Mycobacterium avium subsp. paratuberculosis
gacgucuaagucgaugccgcccc

SEQ ID NO: 3026416 - RNA, 23 nt, Mycobacterium avium subsp. paratuberculosis
gacgucucauaccagugcccgag

SEQ ID NO: 3026417 - RNA, 17 nt, Mycobacterium avium subsp. paratuberculosis
gacgucugcggcucggc

SEQ ID NO: 3026418 - RNA, 18 nt, Mycobacterium avium subsp. paratuberculosis
gacgucugcggcucggcg

SEQ ID NO: 3026419 - RNA, 13 nt, Mycobacterium avium subsp. paratuberculosis
gacgucugggccg

SEQ ID NO: 3026420 - RNA, 19 nt, Mycobacterium avium subsp. paratuberculosis
gacgugaaaucccccgacc

SEQ ID NO: 3026421 - RNA, 16 nt, Mycobacterium avium subsp. paratuberculosis
gacgugacgaccuggu

SEQ ID NO: 3026422 - RNA, 23 nt, Mycobacterium avium subsp. paratuberculosis
gacgugauaguggucgucgucga

SEQ ID NO: 3026423 - RNA, 21 nt, Mycobacterium avium subsp. paratuberculosis
gacgugauaucccuugccgcc

SEQ ID NO: 3026424 - RNA, 22 nt, Mycobacterium avium subsp. paratuberculosis
gacgugauaucccuugccgccg

SEQ ID NO: 3026425 - RNA, 14 nt, Mycobacterium avium subsp. paratuberculosis
gacgugauaucggg

SEQ ID NO: 3026426 - RNA, 16 nt, Mycobacterium avium subsp. paratuberculosis
gacgugaucggcggcc

SEQ ID NO: 3026427 - RNA, 22 nt, Mycobacterium avium subsp. paratuberculosis
gacgugaucuggucggccagcg

SEQ ID NO: 3026428 - RNA, 23 nt, Mycobacterium avium subsp. paratuberculosis
gacgugaucuggucggccagcgc

SEQ ID NO: 3026429 - RNA, 16 nt, Mycobacterium avium subsp. paratuberculosis
gacgugaugcacccgg

SEQ ID NO: 3026430 - RNA, 13 nt, Mycobacterium avium subsp. paratuberculosis
gacgugcaccacc

SEQ ID NO: 3026431 - RNA, 16 nt, Mycobacterium avium subsp. paratuberculosis
gacgugcaccaccgcg

SEQ ID NO: 3026432 - RNA, 17 nt, Mycobacterium avium subsp. paratuberculosis
gacgugcaccaccgcgu

SEQ ID NO: 3026433 - RNA, 20 nt, Mycobacterium avium subsp. paratuberculosis
gacgugcaccaccgcguuga

SEQ ID NO: 3026434 - RNA, 16 nt, Mycobacterium avium subsp. paratuberculosis
gacgugcaccugcagc

SEQ ID NO: 3026435 - RNA, 22 nt, Mycobacterium avium subsp. paratuberculosis
gacgugcaccugcagccggucg

SEQ ID NO: 3026436 - RNA, 14 nt, Mycobacterium avium subsp. paratuberculosis
gacgugcagcgcca

SEQ ID NO: 3026437 - RNA, 18 nt, Mycobacterium avium subsp. paratuberculosis
gacgugccccucgacccg

SEQ ID NO: 3026438 - RNA, 20 nt, Mycobacterium avium subsp. paratuberculosis
gacgugcccgaucucgucgg

SEQ ID NO: 3026439 - RNA, 19 nt, Mycobacterium avium subsp. paratuberculosis
gacgugcccuuccccggcg

SEQ ID NO: 3026440 - RNA, 20 nt, Mycobacterium avium subsp. paratuberculosis
gacgugcccuuccccggcgg

SEQ ID NO: 3026441 - RNA, 21 nt, Mycobacterium avium subsp. paratuberculosis
gacgugcccuuccccggcggc

SEQ ID NO: 3026442 - RNA, 13 nt, Mycobacterium avium subsp. paratuberculosis
gacgugccggcga

SEQ ID NO: 3026443 - RNA, 17 nt, Mycobacterium avium subsp. paratuberculosis
gacgugccggcgauggu

SEQ ID NO: 3026444 - RNA, 18 nt, Mycobacterium avium subsp. paratuberculosis
gacgugccggcgauggug

SEQ ID NO: 3026445 - RNA, 14 nt, Mycobacterium avium subsp. paratuberculosis
gacgugccggcggc

SEQ ID NO: 3026446 - RNA, 16 nt, Mycobacterium avium subsp. paratuberculosis
gacgugccgguggacg

SEQ ID NO: 3026447 - RNA, 17 nt, Mycobacterium avium subsp. paratuberculosis
gacgugccgguggacga

SEQ ID NO: 3026448 - RNA, 23 nt, Mycobacterium avium subsp. paratuberculosis
gacgugccgguggacgaggugac

SEQ ID NO: 3026449 - RNA, 15 nt, Mycobacterium avium subsp. paratuberculosis
gacgugccguugacg

SEQ ID NO: 3026450 - RNA, 20 nt, Mycobacterium avium subsp. paratuberculosis
gacgugcgacaccggcguga

SEQ ID NO: 3026451 - RNA, 23 nt, Mycobacterium avium subsp. paratuberculosis
gacgugcgcggcguucuccagca

SEQ ID NO: 3026452 - RNA, 15 nt, Mycobacterium avium subsp. paratuberculosis
gacgugcucggcggc

SEQ ID NO: 3026453 - RNA, 16 nt, Mycobacterium avium subsp. paratuberculosis
gacgugcucggcggcc

SEQ ID NO: 3026454 - RNA, 18 nt, Mycobacterium avium subsp. paratuberculosis
gacgugcucggcggccgc

SEQ ID NO: 3026455 - RNA, 17 nt, Mycobacterium avium subsp. paratuberculosis
gacgugcuuggccagcu

SEQ ID NO: 3026456 - RNA, 18 nt, Mycobacterium avium subsp. paratuberculosis
gacgugcuuggccagcuc

SEQ ID NO: 3026457 - RNA, 21 nt, Mycobacterium avium subsp. paratuberculosis
gacgugcuuggccagcucggc

SEQ ID NO: 3026458 - RNA, 16 nt, Mycobacterium avium subsp. paratuberculosis
gacguggagcugaagu

SEQ ID NO: 3026459 - RNA, 14 nt, Mycobacterium avium subsp. paratuberculosis
gacguggaucucga

SEQ ID NO: 3026460 - RNA, 15 nt, Mycobacterium avium subsp. paratuberculosis
gacguggaucucgaa

SEQ ID NO: 3026461 - RNA, 13 nt, Mycobacterium avium subsp. paratuberculosis
gacguggcggccg

SEQ ID NO: 3026462 - RNA, 16 nt, Mycobacterium avium subsp. paratuberculosis
gacguggcggccgucg

SEQ ID NO: 3026463 - RNA, 19 nt, Mycobacterium avium subsp. paratuberculosis
gacguggcggccgucgcgc

SEQ ID NO: 3026464 - RNA, 21 nt, Mycobacterium avium subsp. paratuberculosis
gacguggcggccgucgcgcac

SEQ ID NO: 3026465 - RNA, 16 nt, Mycobacterium avium subsp. paratuberculosis
gacguggcggcggugg

SEQ ID NO: 3026466 - RNA, 19 nt, Mycobacterium avium subsp. paratuberculosis
gacguggcggcgguggcga

SEQ ID NO: 3026467 - RNA, 13 nt, Mycobacterium avium subsp. paratuberculosis
gacgugggcggcc

SEQ ID NO: 3026468 - RNA, 14 nt, Mycobacterium avium subsp. paratuberculosis
gacgugggcggcca

SEQ ID NO: 3026469 - RNA, 22 nt, Mycobacterium avium subsp. paratuberculosis
gacgugggcggccaccaacggc

SEQ ID NO: 3026470 - RNA, 21 nt, Mycobacterium avium subsp. paratuberculosis
gacgugggugguggugccguc

SEQ ID NO: 3026471 - RNA, 22 nt, Mycobacterium avium subsp. paratuberculosis
gacgugggugguggugccgucg

SEQ ID NO: 3026472 - RNA, 23 nt, Mycobacterium avium subsp. paratuberculosis
gacgugggugguggugccgucgc

SEQ ID NO: 3026473 - RNA, 14 nt, Mycobacterium avium subsp. paratuberculosis
gacguggucgggca

SEQ ID NO: 3026474 - RNA, 14 nt, Mycobacterium avium subsp. paratuberculosis
gacguggugcaccg

SEQ ID NO: 3026475 - RNA, 17 nt, Mycobacterium avium subsp. paratuberculosis
gacguggugcaccgcca

SEQ ID NO: 3026476 - RNA, 19 nt, Mycobacterium avium subsp. paratuberculosis
gacguggugcaccgccagc

SEQ ID NO: 3026477 - RNA, 21 nt, Mycobacterium avium subsp. paratuberculosis
gacguggugcaccgccagcgc

SEQ ID NO: 3026478 - RNA, 22 nt, Mycobacterium avium subsp. paratuberculosis
gacguggugcaccgccagcgcg

SEQ ID NO: 3026479 - RNA, 22 nt, Mycobacterium avium subsp. paratuberculosis
gacgugguggaugaugccggcg

SEQ ID NO: 3026480 - RNA, 21 nt, Mycobacterium avium subsp. paratuberculosis
gacgugguugcguucgccggc

SEQ ID NO: 3026481 - RNA, 22 nt, Mycobacterium avium subsp. paratuberculosis
gacgugguugcguucgccggcg

SEQ ID NO: 3026482 - RNA, 23 nt, Mycobacterium avium subsp. paratuberculosis
gacgugguugcguucgccggcgu

SEQ ID NO: 3026483 - RNA, 20 nt, Mycobacterium avium subsp. paratuberculosis
gacgugucgucgucgccgcc

SEQ ID NO: 3026484 - RNA, 23 nt, Mycobacterium avium subsp. paratuberculosis
gacgugucgucgucgccgccggu

SEQ ID NO: 3026485 - RNA, 20 nt, Mycobacterium avium subsp. paratuberculosis
gacguguucaacgcgccgau

SEQ ID NO: 3026486 - RNA, 21 nt, Mycobacterium avium subsp. paratuberculosis
gacguguucaacgcgccgaug

SEQ ID NO: 3026487 - RNA, 19 nt, Mycobacterium avium subsp. paratuberculosis
gacguuccgaacgugcagc

SEQ ID NO: 3026488 - RNA, 20 nt, Mycobacterium avium subsp. paratuberculosis
gacguucgagucggccacgu

SEQ ID NO: 3026489 - RNA, 21 nt, Mycobacterium avium subsp. paratuberculosis
gacguucgcguugagcgucgc

SEQ ID NO: 3026490 - RNA, 23 nt, Mycobacterium avium subsp. paratuberculosis
gacguucgcguugagcgucgcca

SEQ ID NO: 3026491 - RNA, 13 nt, Mycobacterium avium subsp. paratuberculosis
gacguucggcggg

SEQ ID NO: 3026492 - RNA, 19 nt, Mycobacterium avium subsp. paratuberculosis
gacguucgucagcuaggaa

SEQ ID NO: 3026493 - RNA, 16 nt, Mycobacterium avium subsp. paratuberculosis
gacguucuccccgccg

SEQ ID NO: 3026494 - RNA, 15 nt, Mycobacterium avium subsp. paratuberculosis
gacguugaccgcgaa

SEQ ID NO: 3026495 - RNA, 15 nt, Mycobacterium avium subsp. paratuberculosis
gacguugaucgcgcc

SEQ ID NO: 3026496 - RNA, 19 nt, Mycobacterium avium subsp. paratuberculosis
gacguugaucgcgccgauc

SEQ ID NO: 3026497 - RNA, 20 nt, Mycobacterium avium subsp. paratuberculosis
gacguugaugucguccaugc

SEQ ID NO: 3026498 - RNA, 23 nt, Mycobacterium avium subsp. paratuberculosis
gacguugccgaucccggccagca

SEQ ID NO: 3026499 - RNA, 14 nt, Mycobacterium avium subsp. paratuberculosis
gacguugccgcaca

SEQ ID NO: 3026500 - RNA, 20 nt, Mycobacterium avium subsp. paratuberculosis
gacguugccgcacaccgcgc

SEQ ID NO: 3026501 - RNA, 15 nt, Mycobacterium avium subsp. paratuberculosis
gacguuggccagcac

SEQ ID NO: 3026502 - RNA, 19 nt, Mycobacterium avium subsp. paratuberculosis
gacguuggugaucgccgac

SEQ ID NO: 3026503 - RNA, 21 nt, Mycobacterium avium subsp. paratuberculosis
gacguuggugaucgccgacgu

SEQ ID NO: 3026504 - RNA, 20 nt, Mycobacterium avium subsp. paratuberculosis
gacuaauccccccgcgccgc

SEQ ID NO: 3026505 - RNA, 17 nt, Mycobacterium avium subsp. paratuberculosis
gacuaccgcgcccaggg

SEQ ID NO: 3026506 - RNA, 15 nt, Mycobacterium avium subsp. paratuberculosis
gacuagcgcggcggc

SEQ ID NO: 3026507 - RNA, 19 nt, Mycobacterium avium subsp. paratuberculosis
gacucacggcggcagcgcg

SEQ ID NO: 3026508 - RNA, 22 nt, Mycobacterium avium subsp. paratuberculosis
gacucacggcggcagcgcggcg

SEQ ID NO: 3026509 - RNA, 19 nt, Mycobacterium avium subsp. paratuberculosis
gacucagcccggcccagcc

SEQ ID NO: 3026510 - RNA, 21 nt, Mycobacterium avium subsp. paratuberculosis
gacucagcccggcccagccgg

SEQ ID NO: 3026511 - RNA, 15 nt, Mycobacterium avium subsp. paratuberculosis
gacucagcgucgaug

SEQ ID NO: 3026512 - RNA, 21 nt, Mycobacterium avium subsp. paratuberculosis
gacucauucgacuccggcgac

SEQ ID NO: 3026513 - RNA, 16 nt, Mycobacterium avium subsp. paratuberculosis
gacuccaccaccuggc

SEQ ID NO: 3026514 - RNA, 17 nt, Mycobacterium avium subsp. paratuberculosis
gacuccaccaccuggcc

SEQ ID NO: 3026515 - RNA, 18 nt, Mycobacterium avium subsp. paratuberculosis
gacuccaccaccuggccg

SEQ ID NO: 3026516 - RNA, 14 nt, Mycobacterium avium subsp. paratuberculosis
gacuccaccgccac

SEQ ID NO: 3026517 - RNA, 15 nt, Mycobacterium avium subsp. paratuberculosis
gacuccaccgccacc

SEQ ID NO: 3026518 - RNA, 18 nt, Mycobacterium avium subsp. paratuberculosis
gacuccaccgccaccgcg

SEQ ID NO: 3026519 - RNA, 15 nt, Mycobacterium avium subsp. paratuberculosis
gacuccagcaccagc

SEQ ID NO: 3026520 - RNA, 20 nt, Mycobacterium avium subsp. paratuberculosis
gacuccagcaccagcacggc

SEQ ID NO: 3026521 - RNA, 19 nt, Mycobacterium avium subsp. paratuberculosis
gacuccagcaccggcgcca

SEQ ID NO: 3026522 - RNA, 13 nt, Mycobacterium avium subsp. paratuberculosis
gacuccagcagcg

SEQ ID NO: 3026523 - RNA, 14 nt, Mycobacterium avium subsp. paratuberculosis
gacuccagcagcgc

SEQ ID NO: 3026524 - RNA, 16 nt, Mycobacterium avium subsp. paratuberculosis
gacuccagcagcgcca

SEQ ID NO: 3026525 - RNA, 19 nt, Mycobacterium avium subsp. paratuberculosis
gacuccagcagcgccagca

SEQ ID NO: 3026526 - RNA, 20 nt, Mycobacterium avium subsp. paratuberculosis
gacuccagcagcgccagcac

SEQ ID NO: 3026527 - RNA, 22 nt, Mycobacterium avium subsp. paratuberculosis
gacuccagcagcgccuugccga

SEQ ID NO: 3026528 - RNA, 12 nt, Mycobacterium avium subsp. paratuberculosis
gacuccagcgcg

SEQ ID NO: 3026529 - RNA, 14 nt, Mycobacterium avium subsp. paratuberculosis
gacuccagcgcgau

SEQ ID NO: 3026530 - RNA, 19 nt, Mycobacterium avium subsp. paratuberculosis
gacuccaguugacggcgca

SEQ ID NO: 3026531 - RNA, 16 nt, Mycobacterium avium subsp. paratuberculosis
gacucccccaccacgu

SEQ ID NO: 3026532 - RNA, 16 nt, Mycobacterium avium subsp. paratuberculosis
gacuccccgcccggca

SEQ ID NO: 3026533 - RNA, 21 nt, Mycobacterium avium subsp. paratuberculosis
gacuccccgcccggcaacacg

SEQ ID NO: 3026534 - RNA, 20 nt, Mycobacterium avium subsp. paratuberculosis
gacucccgagcgugggggcc

SEQ ID NO: 3026535 - RNA, 17 nt, Mycobacterium avium subsp. paratuberculosis
gacuccggcgccgguca

SEQ ID NO: 3026536 - RNA, 22 nt, Mycobacterium avium subsp. paratuberculosis
gacuccggcgccggucagcggc

SEQ ID NO: 3026537 - RNA, 19 nt, Mycobacterium avium subsp. paratuberculosis
gacuccuccggcccgaucg

SEQ ID NO: 3026538 - RNA, 14 nt, Mycobacterium avium subsp. paratuberculosis
gacuccuccucggc

SEQ ID NO: 3026539 - RNA, 16 nt, Mycobacterium avium subsp. paratuberculosis
gacuccuccucggcca

SEQ ID NO: 3026540 - RNA, 22 nt, Mycobacterium avium subsp. paratuberculosis
gacuccuccucggccagcccca

SEQ ID NO: 3026541 - RNA, 18 nt, Mycobacterium avium subsp. paratuberculosis
gacuccuccugcgacggc

SEQ ID NO: 3026542 - RNA, 16 nt, Mycobacterium avium subsp. paratuberculosis
gacuccucgguggccu

SEQ ID NO: 3026543 - RNA, 19 nt, Mycobacterium avium subsp. paratuberculosis
gacuccucgguggccucgc

SEQ ID NO: 3026544 - RNA, 14 nt, Mycobacterium avium subsp. paratuberculosis
gacuccucugccag

SEQ ID NO: 3026545 - RNA, 16 nt, Mycobacterium avium subsp. paratuberculosis
gacuccugacgcaccu

SEQ ID NO: 3026546 - RNA, 20 nt, Mycobacterium avium subsp. paratuberculosis
gacuccuugggagacugcga

SEQ ID NO: 3026547 - RNA, 21 nt, Mycobacterium avium subsp. paratuberculosis
gacucgaagaaccgcaacacc

SEQ ID NO: 3026548 - RNA, 19 nt, Mycobacterium avium subsp. paratuberculosis
gacucgaagaucgccugca

SEQ ID NO: 3026549 - RNA, 21 nt, Mycobacterium avium subsp. paratuberculosis
gacucgaagaucgccugcagg

SEQ ID NO: 3026550 - RNA, 18 nt, Mycobacterium avium subsp. paratuberculosis
gacucgaccccgcccagc

SEQ ID NO: 3026551 - RNA, 17 nt, Mycobacterium avium subsp. paratuberculosis
gacucgaugcgcgugac

SEQ ID NO: 3026552 - RNA, 18 nt, Mycobacterium avium subsp. paratuberculosis
gacucgaugcgcgugacg

SEQ ID NO: 3026553 - RNA, 14 nt, Mycobacterium avium subsp. paratuberculosis
gacucgcgccggau

SEQ ID NO: 3026554 - RNA, 13 nt, Mycobacterium avium subsp. paratuberculosis
gacucggccagga

SEQ ID NO: 3026555 - RNA, 16 nt, Mycobacterium avium subsp. paratuberculosis
gacucggccuccgcgc

SEQ ID NO: 3026556 - RNA, 13 nt, Mycobacterium avium subsp. paratuberculosis
gacucggcgaagu

SEQ ID NO: 3026557 - RNA, 18 nt, Mycobacterium avium subsp. paratuberculosis
gacucggcgaagucauca

SEQ ID NO: 3026558 - RNA, 23 nt, Mycobacterium avium subsp. paratuberculosis
gacucgggguugacccggccggu

SEQ ID NO: 3026559 - RNA, 16 nt, Mycobacterium avium subsp. paratuberculosis
gacucguucgacgccg

SEQ ID NO: 3026560 - RNA, 17 nt, Mycobacterium avium subsp. paratuberculosis
gacucguucgacgccgg

SEQ ID NO: 3026561 - RNA, 18 nt, Mycobacterium avium subsp. paratuberculosis
gacucguucgacgccggu

SEQ ID NO: 3026562 - RNA, 17 nt, Mycobacterium avium subsp. paratuberculosis
gacucguuggggccacc

SEQ ID NO: 3026563 - RNA, 18 nt, Mycobacterium avium subsp. paratuberculosis
gacucguuggggccacca

SEQ ID NO: 3026564 - RNA, 13 nt, Mycobacterium avium subsp. paratuberculosis
gacucuucuuccu

SEQ ID NO: 3026565 - RNA, 21 nt, Mycobacterium avium subsp. paratuberculosis
gacucuucuuccugcuugacg

SEQ ID NO: 3026566 - RNA, 22 nt, Mycobacterium avium subsp. paratuberculosis
gacugaaguaguacgaccgcga

SEQ ID NO: 3026567 - RNA, 15 nt, Mycobacterium avium subsp. paratuberculosis
gacugacccgcacga

SEQ ID NO: 3026568 - RNA, 20 nt, Mycobacterium avium subsp. paratuberculosis
gacugauccaccaucuucca

SEQ ID NO: 3026569 - RNA, 13 nt, Mycobacterium avium subsp. paratuberculosis
gacugaucgacga

SEQ ID NO: 3026570 - RNA, 20 nt, Mycobacterium avium subsp. paratuberculosis
gacugaucgacgagccgggc

SEQ ID NO: 3026571 - RNA, 15 nt, Mycobacterium avium subsp. paratuberculosis
gacugaugaagccgc

SEQ ID NO: 3026572 - RNA, 18 nt, Mycobacterium avium subsp. paratuberculosis
gacugaugaagccgccga

SEQ ID NO: 3026573 - RNA, 19 nt, Mycobacterium avium subsp. paratuberculosis
gacugaugcccucgccggu

SEQ ID NO: 3026574 - RNA, 14 nt, Mycobacterium avium subsp. paratuberculosis
gacugaugguggcg

SEQ ID NO: 3026575 - RNA, 16 nt, Mycobacterium avium subsp. paratuberculosis
gacugaugguggcgcg

SEQ ID NO: 3026576 - RNA, 17 nt, Mycobacterium avium subsp. paratuberculosis
gacugcacagugcgucg

SEQ ID NO: 3026577 - RNA, 21 nt, Mycobacterium avium subsp. paratuberculosis
gacugcacagugcgucgccca

SEQ ID NO: 3026578 - RNA, 12 nt, Mycobacterium avium subsp. paratuberculosis
gacugcacccga

SEQ ID NO: 3026579 - RNA, 13 nt, Mycobacterium avium subsp. paratuberculosis
gacugcaccgacu

SEQ ID NO: 3026580 - RNA, 15 nt, Mycobacterium avium subsp. paratuberculosis
gacugcagcgcggug

SEQ ID NO: 3026581 - RNA, 17 nt, Mycobacterium avium subsp. paratuberculosis
gacugcccgaccgcgcc

SEQ ID NO: 3026582 - RNA, 12 nt, Mycobacterium avium subsp. paratuberculosis
gacugccgagca

SEQ ID NO: 3026583 - RNA, 21 nt, Mycobacterium avium subsp. paratuberculosis
gacugccgagcaucagcugcc

SEQ ID NO: 3026584 - RNA, 22 nt, Mycobacterium avium subsp. paratuberculosis
gacugccggcgacgguggcgcc

SEQ ID NO: 3026585 - RNA, 20 nt, Mycobacterium avium subsp. paratuberculosis
gacugcgacggaucugcucg

SEQ ID NO: 3026586 - RNA, 19 nt, Mycobacterium avium subsp. paratuberculosis
gacugcgaucgccgacgcc

SEQ ID NO: 3026587 - RNA, 14 nt, Mycobacterium avium subsp. paratuberculosis
gacugcgcaccgcc

SEQ ID NO: 3026588 - RNA, 18 nt, Mycobacterium avium subsp. paratuberculosis
gacugcgcaccgccagca

SEQ ID NO: 3026589 - RNA, 21 nt, Mycobacterium avium subsp. paratuberculosis
gacugcgcaccgccagcaccg

SEQ ID NO: 3026590 - RNA, 18 nt, Mycobacterium avium subsp. paratuberculosis
gacugcgccggggccgcg

SEQ ID NO: 3026591 - RNA, 22 nt, Mycobacterium avium subsp. paratuberculosis
gacugcgccggggccgcggcuc

SEQ ID NO: 3026592 - RNA, 15 nt, Mycobacterium avium subsp. paratuberculosis
gacugcgcggccggc

SEQ ID NO: 3026593 - RNA, 15 nt, Mycobacterium avium subsp. paratuberculosis
gacugcgugcugggc

SEQ ID NO: 3026594 - RNA, 21 nt, Mycobacterium avium subsp. paratuberculosis
gacugcuugggcgccucgccg

SEQ ID NO: 3026595 - RNA, 21 nt, Mycobacterium avium subsp. paratuberculosis
gacuggauggcgauggccuug

SEQ ID NO: 3026596 - RNA, 17 nt, Mycobacterium avium subsp. paratuberculosis
gacuggccaccgcgauc

SEQ ID NO: 3026597 - RNA, 23 nt, Mycobacterium avium subsp. paratuberculosis
gacuggcccucggaggugccgcg

SEQ ID NO: 3026598 - RNA, 17 nt, Mycobacterium avium subsp. paratuberculosis
gacuggcugagcagcac

SEQ ID NO: 3026599 - RNA, 13 nt, Mycobacterium avium subsp. paratuberculosis
gacugggccaggu

SEQ ID NO: 3026600 - RNA, 14 nt, Mycobacterium avium subsp. paratuberculosis
gacugggcgcccac

SEQ ID NO: 3026601 - RNA, 21 nt, Mycobacterium avium subsp. paratuberculosis
gacugggugggacggaaaucg

SEQ ID NO: 3026602 - RNA, 23 nt, Mycobacterium avium subsp. paratuberculosis
gacuggugauagaucaucccggc

SEQ ID NO: 3026603 - RNA, 23 nt, Mycobacterium avium subsp. paratuberculosis
gacugucggcgccccgcccgcga

SEQ ID NO: 3026604 - RNA, 17 nt, Mycobacterium avium subsp. paratuberculosis
gacugucggcucgcccg

SEQ ID NO: 3026605 - RNA, 20 nt, Mycobacterium avium subsp. paratuberculosis
gacugucggcucgcccgcga

SEQ ID NO: 3026606 - RNA, 21 nt, Mycobacterium avium subsp. paratuberculosis
gacuucccaguccggccagcg

SEQ ID NO: 3026607 - RNA, 16 nt, Mycobacterium avium subsp. paratuberculosis
gacuucggcucggcga

SEQ ID NO: 3026608 - RNA, 15 nt, Mycobacterium avium subsp. paratuberculosis
gacuucguugguggu

SEQ ID NO: 3026609 - RNA, 22 nt, Mycobacterium avium subsp. paratuberculosis
gacuucguugguggucgacgcg

SEQ ID NO: 3026610 - RNA, 24 nt, Mycobacterium avium subsp. paratuberculosis
gacuucguugguggucgacgcgcc

SEQ ID NO: 3026611 - RNA, 14 nt, Mycobacterium avium subsp. paratuberculosis
gacuucuacggcgg

SEQ ID NO: 3026612 - RNA, 21 nt, Mycobacterium avium subsp. paratuberculosis
gacuucuacggcgggccggcg

SEQ ID NO: 3026613 - RNA, 22 nt, Mycobacterium avium subsp. paratuberculosis
gacuucuacggcgggccggcgc

SEQ ID NO: 3026614 - RNA, 16 nt, Mycobacterium avium subsp. paratuberculosis
gacuucuucgccggcg

SEQ ID NO: 3026615 - RNA, 12 nt, Mycobacterium avium subsp. paratuberculosis
gacuugccgccg

SEQ ID NO: 3026616 - RNA, 16 nt, Mycobacterium avium subsp. paratuberculosis
gacuugccgccggcgc

SEQ ID NO: 3026617 - RNA, 20 nt, Mycobacterium avium subsp. paratuberculosis
gacuuggccagcagccgcga

SEQ ID NO: 3026618 - RNA, 17 nt, Mycobacterium avium subsp. paratuberculosis
gacuugguggccagcac

SEQ ID NO: 3026619 - RNA, 23 nt, Mycobacterium avium subsp. paratuberculosis
gacuugguggccagcaccacguc

SEQ ID NO: 3026620 - RNA, 13 nt, Mycobacterium avium subsp. paratuberculosis
gacuugucgccgu

SEQ ID NO: 3026621 - RNA, 14 nt, Mycobacterium avium subsp. paratuberculosis
gacuugucgggccg

SEQ ID NO: 3026622 - RNA, 16 nt, Mycobacterium avium subsp. paratuberculosis
gacuugucgggccgca

SEQ ID NO: 3026623 - RNA, 17 nt, Mycobacterium avium subsp. paratuberculosis
gacuugucgggccgcac

SEQ ID NO: 3026624 - RNA, 18 nt, Mycobacterium avium subsp. paratuberculosis
gacuugucgggccgcacu

SEQ ID NO: 3026625 - RNA, 19 nt, Mycobacterium avium subsp. paratuberculosis
gacuuucgcgucugcucgc

SEQ ID NO: 3026626 - RNA, 17 nt, Mycobacterium avium subsp. paratuberculosis
gagaaaagcgaccagcg

SEQ ID NO: 3026627 - RNA, 17 nt, Mycobacterium avium subsp. paratuberculosis
gagaaaaucgcccgcga

SEQ ID NO: 3026628 - RNA, 17 nt, Mycobacterium avium subsp. paratuberculosis
gagaaaggccagcacgc

SEQ ID NO: 3026629 - RNA, 15 nt, Mycobacterium avium subsp. paratuberculosis
gagaacaucagcccc

SEQ ID NO: 3026630 - RNA, 22 nt, Mycobacterium avium subsp. paratuberculosis
gagaaccucaacgugaccaccg

SEQ ID NO: 3026631 - RNA, 14 nt, Mycobacterium avium subsp. paratuberculosis
gagaacgucaggcc

SEQ ID NO: 3026632 - RNA, 18 nt, Mycobacterium avium subsp. paratuberculosis
gagaacuccuugagcucc

SEQ ID NO: 3026633 - RNA, 22 nt, Mycobacterium avium subsp. paratuberculosis
gagaacucgaucugcagccggc

SEQ ID NO: 3026634 - RNA, 17 nt, Mycobacterium avium subsp. paratuberculosis
gagaagcccgugcgacg

SEQ ID NO: 3026635 - RNA, 22 nt, Mycobacterium avium subsp. paratuberculosis
gagaagcucaugucguacgggc

SEQ ID NO: 3026636 - RNA, 13 nt, Mycobacterium avium subsp. paratuberculosis
gagaaggcggcgu

SEQ ID NO: 3026637 - RNA, 15 nt, Mycobacterium avium subsp. paratuberculosis
gagaaggcggcgucg

SEQ ID NO: 3026638 - RNA, 15 nt, Mycobacterium avium subsp. paratuberculosis
gagacaccgucgcgc

SEQ ID NO: 3026639 - RNA, 12 nt, Mycobacterium avium subsp. paratuberculosis
gagaccagcagc

SEQ ID NO: 3026640 - RNA, 13 nt, Mycobacterium avium subsp. paratuberculosis
gagaccagcagcu

SEQ ID NO: 3026641 - RNA, 23 nt, Mycobacterium avium subsp. paratuberculosis
gagaccagccagaacgaacagau

SEQ ID NO: 3026642 - RNA, 15 nt, Mycobacterium avium subsp. paratuberculosis
gagaccaggucggcc

SEQ ID NO: 3026643 - RNA, 14 nt, Mycobacterium avium subsp. paratuberculosis
gagaccaugccgcc

SEQ ID NO: 3026644 - RNA, 18 nt, Mycobacterium avium subsp. paratuberculosis
gagaccaugucggccagg

SEQ ID NO: 3026645 - RNA, 12 nt, Mycobacterium avium subsp. paratuberculosis
gagaccgccgug

SEQ ID NO: 3026646 - RNA, 12 nt, Mycobacterium avium subsp. paratuberculosis
gagaccucccgg

SEQ ID NO: 3026647 - RNA, 15 nt, Mycobacterium avium subsp. paratuberculosis
gagaccucccggcgc

SEQ ID NO: 3026648 - RNA, 17 nt, Mycobacterium avium subsp. paratuberculosis
gagaccucccggcgcca

SEQ ID NO: 3026649 - RNA, 16 nt, Mycobacterium avium subsp. paratuberculosis
gagaccucuucgaccc

SEQ ID NO: 3026650 - RNA, 13 nt, Mycobacterium avium subsp. paratuberculosis
gagacgaccagga

SEQ ID NO: 3026651 - RNA, 22 nt, Mycobacterium avium subsp. paratuberculosis
gagacgacgacgaacgcgguga

SEQ ID NO: 3026652 - RNA, 15 nt, Mycobacterium avium subsp. paratuberculosis
gagacgacgccacca

SEQ ID NO: 3026653 - RNA, 17 nt, Mycobacterium avium subsp. paratuberculosis
gagacgacgccaccauc

SEQ ID NO: 3026654 - RNA, 17 nt, Mycobacterium avium subsp. paratuberculosis
gagacgagccgccgcgg

SEQ ID NO: 3026655 - RNA, 21 nt, Mycobacterium avium subsp. paratuberculosis
gagacguaagccauggcggcc

SEQ ID NO: 3026656 - RNA, 22 nt, Mycobacterium avium subsp. paratuberculosis
gagacguaccagcugcccacca

SEQ ID NO: 3026657 - RNA, 15 nt, Mycobacterium avium subsp. paratuberculosis
gagacgucggccggg

SEQ ID NO: 3026658 - RNA, 18 nt, Mycobacterium avium subsp. paratuberculosis
gagacgucggccgggucg

SEQ ID NO: 3026659 - RNA, 14 nt, Mycobacterium avium subsp. paratuberculosis
gagacgucggcgua

SEQ ID NO: 3026660 - RNA, 14 nt, Mycobacterium avium subsp. paratuberculosis
gagacguggcggcg

SEQ ID NO: 3026661 - RNA, 15 nt, Mycobacterium avium subsp. paratuberculosis
gagacguggcggcgg

SEQ ID NO: 3026662 - RNA, 16 nt, Mycobacterium avium subsp. paratuberculosis
gagacguggcggcggu

SEQ ID NO: 3026663 - RNA, 19 nt, Mycobacterium avium subsp. paratuberculosis
gagacguggucgggcaugc

SEQ ID NO: 3026664 - RNA, 15 nt, Mycobacterium avium subsp. paratuberculosis
gagacguugccgcac

SEQ ID NO: 3026665 - RNA, 19 nt, Mycobacterium avium subsp. paratuberculosis
gagacguugccgcacaccg

SEQ ID NO: 3026666 - RNA, 20 nt, Mycobacterium avium subsp. paratuberculosis
gagacguugccgcacaccgc

SEQ ID NO: 3026667 - RNA, 17 nt, Mycobacterium avium subsp. paratuberculosis
gagacugaugguggcgc

SEQ ID NO: 3026668 - RNA, 16 nt, Mycobacterium avium subsp. paratuberculosis
gagagcccgucgucgg

SEQ ID NO: 3026669 - RNA, 20 nt, Mycobacterium avium subsp. paratuberculosis
gagagccgguagaucagcgc

SEQ ID NO: 3026670 - RNA, 19 nt, Mycobacterium avium subsp. paratuberculosis
gagagcgcgggcaccgucg

SEQ ID NO: 3026671 - RNA, 15 nt, Mycobacterium avium subsp. paratuberculosis
gagagcgcgucgacg

SEQ ID NO: 3026672 - RNA, 16 nt, Mycobacterium avium subsp. paratuberculosis
gagagcggaucggcgg

SEQ ID NO: 3026673 - RNA, 17 nt, Mycobacterium avium subsp. paratuberculosis
gagagcggaucggcggc

SEQ ID NO: 3026674 - RNA, 19 nt, Mycobacterium avium subsp. paratuberculosis
gagagcgguuugcgggucg

SEQ ID NO: 3026675 - RNA, 22 nt, Mycobacterium avium subsp. paratuberculosis
gagagcgucuuguuggcgaagu

SEQ ID NO: 3026676 - RNA, 16 nt, Mycobacterium avium subsp. paratuberculosis
gagagcugcugccgcc

SEQ ID NO: 3026677 - RNA, 13 nt, Mycobacterium avium subsp. paratuberculosis
gagaggcgcggcg

SEQ ID NO: 3026678 - RNA, 14 nt, Mycobacterium avium subsp. paratuberculosis
gagaggcgcggcgc

SEQ ID NO: 3026679 - RNA, 16 nt, Mycobacterium avium subsp. paratuberculosis
gagaggcgcggcgcga

SEQ ID NO: 3026680 - RNA, 13 nt, Mycobacterium avium subsp. paratuberculosis
gagaguaucgcca

SEQ ID NO: 3026681 - RNA, 14 nt, Mycobacterium avium subsp. paratuberculosis
gagaguaucgccac

SEQ ID NO: 3026682 - RNA, 22 nt, Mycobacterium avium subsp. paratuberculosis
gagagugcaacuagcgacggcc

SEQ ID NO: 3026683 - RNA, 16 nt, Mycobacterium avium subsp. paratuberculosis
gagaguuugcccucgu

SEQ ID NO: 3026684 - RNA, 19 nt, Mycobacterium avium subsp. paratuberculosis
gagaguuugcccucgucga

SEQ ID NO: 3026685 - RNA, 21 nt, Mycobacterium avium subsp. paratuberculosis
gagaguuugcccucgucgacc

SEQ ID NO: 3026686 - RNA, 16 nt, Mycobacterium avium subsp. paratuberculosis
gagaucagcaccaggu

SEQ ID NO: 3026687 - RNA, 17 nt, Mycobacterium avium subsp. paratuberculosis
gagaucagcaccaggug

SEQ ID NO: 3026688 - RNA, 16 nt, Mycobacterium avium subsp. paratuberculosis
gagaucagcaccgggu

SEQ ID NO: 3026689 - RNA, 21 nt, Mycobacterium avium subsp. paratuberculosis
gagaucagcaccgggugauac

SEQ ID NO: 3026690 - RNA, 13 nt, Mycobacterium avium subsp. paratuberculosis
gagaucagcgcca

SEQ ID NO: 3026691 - RNA, 19 nt, Mycobacterium avium subsp. paratuberculosis
gagaucagggcgcgcaccg

SEQ ID NO: 3026692 - RNA, 22 nt, Mycobacterium avium subsp. paratuberculosis
gagaucagggugcucagccgca

SEQ ID NO: 3026693 - RNA, 20 nt, Mycobacterium avium subsp. paratuberculosis
gagaucaugccggcgaacuc

SEQ ID NO: 3026694 - RNA, 14 nt, Mycobacterium avium subsp. paratuberculosis
gagauccaccgcgc

SEQ ID NO: 3026695 - RNA, 15 nt, Mycobacterium avium subsp. paratuberculosis
gagauccaccgcgcg

SEQ ID NO: 3026696 - RNA, 20 nt, Mycobacterium avium subsp. paratuberculosis
gagauccaccgcgcggccag

SEQ ID NO: 3026697 - RNA, 23 nt, Mycobacterium avium subsp. paratuberculosis
gagauccaccgcgcggccagcgg

SEQ ID NO: 3026698 - RNA, 22 nt, Mycobacterium avium subsp. paratuberculosis
gagaucccagcgggacagcacc

SEQ ID NO: 3026699 - RNA, 22 nt, Mycobacterium avium subsp. paratuberculosis
gagaucgcgggcugcggcgagu

SEQ ID NO: 3026700 - RNA, 15 nt, Mycobacterium avium subsp. paratuberculosis
gagaucggcgagugc

SEQ ID NO: 3026701 - RNA, 21 nt, Mycobacterium avium subsp. paratuberculosis
gagaucggcgcggagcgucgc

SEQ ID NO: 3026702 - RNA, 14 nt, Mycobacterium avium subsp. paratuberculosis
gagaucgguuggcu

SEQ ID NO: 3026703 - RNA, 13 nt, Mycobacterium avium subsp. paratuberculosis
gagaucucggcgu

SEQ ID NO: 3026704 - RNA, 20 nt, Mycobacterium avium subsp. paratuberculosis
gagaucucgucgaugggcuc

SEQ ID NO: 3026705 - RNA, 16 nt, Mycobacterium avium subsp. paratuberculosis
gagaugaauucggcga

SEQ ID NO: 3026706 - RNA, 19 nt, Mycobacterium avium subsp. paratuberculosis
gagaugaauucggcgaucu

SEQ ID NO: 3026707 - RNA, 16 nt, Mycobacterium avium subsp. paratuberculosis
gagaugaucagccgcc

SEQ ID NO: 3026708 - RNA, 16 nt, Mycobacterium avium subsp. paratuberculosis
gagaugauggccgcgc

SEQ ID NO: 3026709 - RNA, 18 nt, Mycobacterium avium subsp. paratuberculosis
gagaugauggccgcgccg

SEQ ID NO: 3026710 - RNA, 13 nt, Mycobacterium avium subsp. paratuberculosis
gagaugcccaccc

SEQ ID NO: 3026711 - RNA, 15 nt, Mycobacterium avium subsp. paratuberculosis
gagaugccgggaagc

SEQ ID NO: 3026712 - RNA, 16 nt, Mycobacterium avium subsp. paratuberculosis
gagaugccgggaagcg

SEQ ID NO: 3026713 - RNA, 17 nt, Mycobacterium avium subsp. paratuberculosis
gagaugccgggaagcga

SEQ ID NO: 3026714 - RNA, 16 nt, Mycobacterium avium subsp. paratuberculosis
gagaugcuggugacgc

SEQ ID NO: 3026715 - RNA, 22 nt, Mycobacterium avium subsp. paratuberculosis
gagauggccagcaccaccgcga

SEQ ID NO: 3026716 - RNA, 15 nt, Mycobacterium avium subsp. paratuberculosis
gagauggggugaugc

SEQ ID NO: 3026717 - RNA, 22 nt, Mycobacterium avium subsp. paratuberculosis
gagauuggacgacaccacgguc

SEQ ID NO: 3026718 - RNA, 15 nt, Mycobacterium avium subsp. paratuberculosis
gagcaaauccggcag

SEQ ID NO: 3026719 - RNA, 22 nt, Mycobacterium avium subsp. paratuberculosis
gagcaaauccggcagcgcucgu

SEQ ID NO: 3026720 - RNA, 14 nt, Mycobacterium avium subsp. paratuberculosis
gagcaacaccaccu

SEQ ID NO: 3026721 - RNA, 16 nt, Mycobacterium avium subsp. paratuberculosis
gagcaacaccggcacg

SEQ ID NO: 3026722 - RNA, 17 nt, Mycobacterium avium subsp. paratuberculosis
gagcaacaccggcacga

SEQ ID NO: 3026723 - RNA, 17 nt, Mycobacterium avium subsp. paratuberculosis
gagcaacaccucgggca

SEQ ID NO: 3026724 - RNA, 16 nt, Mycobacterium avium subsp. paratuberculosis
gagcaacagcccgacc

SEQ ID NO: 3026725 - RNA, 22 nt, Mycobacterium avium subsp. paratuberculosis
gagcaaccgccgaaacaccggc

SEQ ID NO: 3026726 - RNA, 20 nt, Mycobacterium avium subsp. paratuberculosis
gagcaaggucgucgcggcca

SEQ ID NO: 3026727 - RNA, 14 nt, Mycobacterium avium subsp. paratuberculosis
gagcaagucggcgg

SEQ ID NO: 3026728 - RNA, 15 nt, Mycobacterium avium subsp. paratuberculosis
gagcaagucggcggu

SEQ ID NO: 3026729 - RNA, 19 nt, Mycobacterium avium subsp. paratuberculosis
gagcaauuaaccggcaggc

SEQ ID NO: 3026730 - RNA, 21 nt, Mycobacterium avium subsp. paratuberculosis
gagcaauuaaccggcaggccg

SEQ ID NO: 3026731 - RNA, 22 nt, Mycobacterium avium subsp. paratuberculosis
gagcaauuaaccggcaggccgu

SEQ ID NO: 3026732 - RNA, 20 nt, Mycobacterium avium subsp. paratuberculosis
gagcacacacaggucgcccg

SEQ ID NO: 3026733 - RNA, 23 nt, Mycobacterium avium subsp. paratuberculosis
gagcacacccagcgagccgauga

SEQ ID NO: 3026734 - RNA, 19 nt, Mycobacterium avium subsp. paratuberculosis
gagcacacccucaccccgc

SEQ ID NO: 3026735 - RNA, 23 nt, Mycobacterium avium subsp. paratuberculosis
gagcacaccgucgcccgcccagg

SEQ ID NO: 3026736 - RNA, 13 nt, Mycobacterium avium subsp. paratuberculosis
gagcacagcggcg

SEQ ID NO: 3026737 - RNA, 21 nt, Mycobacterium avium subsp. paratuberculosis
gagcacaggaacgcgacggug

SEQ ID NO: 3026738 - RNA, 15 nt, Mycobacterium avium subsp. paratuberculosis
gagcacaucggcguu

SEQ ID NO: 3026739 - RNA, 22 nt, Mycobacterium avium subsp. paratuberculosis
gagcaccacacgugcggauggc

SEQ ID NO: 3026740 - RNA, 23 nt, Mycobacterium avium subsp. paratuberculosis
gagcaccaccaggcccaccacca

SEQ ID NO: 3026741 - RNA, 13 nt, Mycobacterium avium subsp. paratuberculosis
gagcaccacggcc

SEQ ID NO: 3026742 - RNA, 17 nt, Mycobacterium avium subsp. paratuberculosis
gagcaccacggcccgcg

SEQ ID NO: 3026743 - RNA, 15 nt, Mycobacterium avium subsp. paratuberculosis
gagcaccagcccggc

SEQ ID NO: 3026744 - RNA, 20 nt, Mycobacterium avium subsp. paratuberculosis
gagcaccagcccggccagcg

SEQ ID NO: 3026745 - RNA, 22 nt, Mycobacterium avium subsp. paratuberculosis
gagcaccagcccggccagcggc

SEQ ID NO: 3026746 - RNA, 12 nt, Mycobacterium avium subsp. paratuberculosis
gagcaccagcgu

SEQ ID NO: 3026747 - RNA, 17 nt, Mycobacterium avium subsp. paratuberculosis
gagcaccagcgucgacg

SEQ ID NO: 3026748 - RNA, 18 nt, Mycobacterium avium subsp. paratuberculosis
gagcaccagcgucgacgc

SEQ ID NO: 3026749 - RNA, 20 nt, Mycobacterium avium subsp. paratuberculosis
gagcaccaggcgcaccagcu

SEQ ID NO: 3026750 - RNA, 17 nt, Mycobacterium avium subsp. paratuberculosis
gagcaccaggucguugc

SEQ ID NO: 3026751 - RNA, 14 nt, Mycobacterium avium subsp. paratuberculosis
gagcaccccggcgg

SEQ ID NO: 3026752 - RNA, 15 nt, Mycobacterium avium subsp. paratuberculosis
gagcaccccggcggc

SEQ ID NO: 3026753 - RNA, 17 nt, Mycobacterium avium subsp. paratuberculosis
gagcaccccggcggccg

SEQ ID NO: 3026754 - RNA, 18 nt, Mycobacterium avium subsp. paratuberculosis
gagcaccccggcggccgc

SEQ ID NO: 3026755 - RNA, 20 nt, Mycobacterium avium subsp. paratuberculosis
gagcaccccggcggccgcgu

SEQ ID NO: 3026756 - RNA, 22 nt, Mycobacterium avium subsp. paratuberculosis
gagcacccggaugucguagacg

SEQ ID NO: 3026757 - RNA, 13 nt, Mycobacterium avium subsp. paratuberculosis
gagcacccggcgg

SEQ ID NO: 3026758 - RNA, 14 nt, Mycobacterium avium subsp. paratuberculosis
gagcaccgcgaaga

SEQ ID NO: 3026759 - RNA, 22 nt, Mycobacterium avium subsp. paratuberculosis
gagcaccgcgaccacgccgcgg

SEQ ID NO: 3026760 - RNA, 23 nt, Mycobacterium avium subsp. paratuberculosis
gagcaccgcgaccacgccgcggu

SEQ ID NO: 3026761 - RNA, 18 nt, Mycobacterium avium subsp. paratuberculosis
gagcaccgcgaucaccga

SEQ ID NO: 3026762 - RNA, 20 nt, Mycobacterium avium subsp. paratuberculosis
gagcaccgcgaucaccgaga

SEQ ID NO: 3026763 - RNA, 15 nt, Mycobacterium avium subsp. paratuberculosis
gagcaccgcgaucgc

SEQ ID NO: 3026764 - RNA, 20 nt, Mycobacterium avium subsp. paratuberculosis
gagcaccgcgaucugcucgg

SEQ ID NO: 3026765 - RNA, 16 nt, Mycobacterium avium subsp. paratuberculosis
gagcaccgcgcucacc

SEQ ID NO: 3026766 - RNA, 15 nt, Mycobacterium avium subsp. paratuberculosis
gagcaccgcguccgc

SEQ ID NO: 3026767 - RNA, 14 nt, Mycobacterium avium subsp. paratuberculosis
gagcaccgcgucgu

SEQ ID NO: 3026768 - RNA, 22 nt, Mycobacterium avium subsp. paratuberculosis
gagcaccgcgucguagagcuga

SEQ ID NO: 3026769 - RNA, 18 nt, Mycobacterium avium subsp. paratuberculosis
gagcaccggaucgaccaa

SEQ ID NO: 3026770 - RNA, 21 nt, Mycobacterium avium subsp. paratuberculosis
gagcaccggaucgaccaacuc

SEQ ID NO: 3026771 - RNA, 17 nt, Mycobacterium avium subsp. paratuberculosis
gagcaccggcagcaccg

SEQ ID NO: 3026772 - RNA, 19 nt, Mycobacterium avium subsp. paratuberculosis
gagcaccggcagcaccgcc

SEQ ID NO: 3026773 - RNA, 23 nt, Mycobacterium avium subsp. paratuberculosis
gagcaccggcagcaccgccgagc

SEQ ID NO: 3026774 - RNA, 20 nt, Mycobacterium avium subsp. paratuberculosis
gagcaccggcagccgcagcg

SEQ ID NO: 3026775 - RNA, 20 nt, Mycobacterium avium subsp. paratuberculosis
gagcaccggcggcagcgacu

SEQ ID NO: 3026776 - RNA, 20 nt, Mycobacterium avium subsp. paratuberculosis
gagcaccggcuggugcagca

SEQ ID NO: 3026777 - RNA, 21 nt, Mycobacterium avium subsp. paratuberculosis
gagcaccggcuggugcagcag

SEQ ID NO: 3026778 - RNA, 17 nt, Mycobacterium avium subsp. paratuberculosis
gagcaccgggaacagcc

SEQ ID NO: 3026779 - RNA, 21 nt, Mycobacterium avium subsp. paratuberculosis
gagcaccgggaacagccaggc

SEQ ID NO: 3026780 - RNA, 16 nt, Mycobacterium avium subsp. paratuberculosis
gagcaccgggcgucgg

SEQ ID NO: 3026781 - RNA, 17 nt, Mycobacterium avium subsp. paratuberculosis
gagcaccgggcgucggg

SEQ ID NO: 3026782 - RNA, 20 nt, Mycobacterium avium subsp. paratuberculosis
gagcaccgggcgucggggcc

SEQ ID NO: 3026783 - RNA, 22 nt, Mycobacterium avium subsp. paratuberculosis
gagcaccgggcugucgggcagg

SEQ ID NO: 3026784 - RNA, 21 nt, Mycobacterium avium subsp. paratuberculosis
gagcaccgugccgucggcguc

SEQ ID NO: 3026785 - RNA, 14 nt, Mycobacterium avium subsp. paratuberculosis
gagcaccuccgaca

SEQ ID NO: 3026786 - RNA, 21 nt, Mycobacterium avium subsp. paratuberculosis
gagcaccuccgacaucaggcc

SEQ ID NO: 3026787 - RNA, 22 nt, Mycobacterium avium subsp. paratuberculosis
gagcaccucuucgaaagccacc

SEQ ID NO: 3026788 - RNA, 18 nt, Mycobacterium avium subsp. paratuberculosis
gagcaccugaacggccgc

SEQ ID NO: 3026789 - RNA, 23 nt, Mycobacterium avium subsp. paratuberculosis
gagcaccugaacggccgcgcaga

SEQ ID NO: 3026790 - RNA, 16 nt, Mycobacterium avium subsp. paratuberculosis
gagcaccugcgcgacg

SEQ ID NO: 3026791 - RNA, 18 nt, Mycobacterium avium subsp. paratuberculosis
gagcaccugcgcgacgcu

SEQ ID NO: 3026792 - RNA, 14 nt, Mycobacterium avium subsp. paratuberculosis
gagcaccuggccgu

SEQ ID NO: 3026793 - RNA, 23 nt, Mycobacterium avium subsp. paratuberculosis
gagcaccuggccguucaggucga

SEQ ID NO: 3026794 - RNA, 19 nt, Mycobacterium avium subsp. paratuberculosis
gagcacgaccgccagcagc

SEQ ID NO: 3026795 - RNA, 13 nt, Mycobacterium avium subsp. paratuberculosis
gagcacgacgucg

SEQ ID NO: 3026796 - RNA, 15 nt, Mycobacterium avium subsp. paratuberculosis
gagcacgcagccgcg

SEQ ID NO: 3026797 - RNA, 16 nt, Mycobacterium avium subsp. paratuberculosis
gagcacgcagccgcgc

SEQ ID NO: 3026798 - RNA, 22 nt, Mycobacterium avium subsp. paratuberculosis
gagcacgcagccgcgcccgaug

SEQ ID NO: 3026799 - RNA, 17 nt, Mycobacterium avium subsp. paratuberculosis
gagcacgcccgcgaucg

SEQ ID NO: 3026800 - RNA, 18 nt, Mycobacterium avium subsp. paratuberculosis
gagcacgcccgcgaucgg

SEQ ID NO: 3026801 - RNA, 15 nt, Mycobacterium avium subsp. paratuberculosis
gagcacgcccugcgg

SEQ ID NO: 3026802 - RNA, 14 nt, Mycobacterium avium subsp. paratuberculosis
gagcacgccgccgg

SEQ ID NO: 3026803 - RNA, 24 nt, Mycobacterium avium subsp. paratuberculosis
gagcacgcggaccuuggugucggc

SEQ ID NO: 3026804 - RNA, 15 nt, Mycobacterium avium subsp. paratuberculosis
gagcacgcggccgcg

SEQ ID NO: 3026805 - RNA, 19 nt, Mycobacterium avium subsp. paratuberculosis
gagcacgcggccgcgccgg

SEQ ID NO: 3026806 - RNA, 17 nt, Mycobacterium avium subsp. paratuberculosis
gagcacggcucguccau

SEQ ID NO: 3026807 - RNA, 13 nt, Mycobacterium avium subsp. paratuberculosis
gagcacgggauga

SEQ ID NO: 3026808 - RNA, 19 nt, Mycobacterium avium subsp. paratuberculosis
gagcacgggaugaucggcg

SEQ ID NO: 3026809 - RNA, 20 nt, Mycobacterium avium subsp. paratuberculosis
gagcacgggaugaucggcgc

SEQ ID NO: 3026810 - RNA, 21 nt, Mycobacterium avium subsp. paratuberculosis
gagcacggugaacuccgggcc

SEQ ID NO: 3026811 - RNA, 13 nt, Mycobacterium avium subsp. paratuberculosis
gagcacggugauc

SEQ ID NO: 3026812 - RNA, 20 nt, Mycobacterium avium subsp. paratuberculosis
gagcacggugaucagcagca

SEQ ID NO: 3026813 - RNA, 14 nt, Mycobacterium avium subsp. paratuberculosis
gagcacggugggcg

SEQ ID NO: 3026814 - RNA, 17 nt, Mycobacterium avium subsp. paratuberculosis
gagcacggugggcgccg

SEQ ID NO: 3026815 - RNA, 20 nt, Mycobacterium avium subsp. paratuberculosis
gagcacggugggcgccgggu

SEQ ID NO: 3026816 - RNA, 11 nt, Mycobacterium avium subsp. paratuberculosis
gagcacgucga

SEQ ID NO: 3026817 - RNA, 13 nt, Mycobacterium avium subsp. paratuberculosis
gagcacgucgacg

SEQ ID NO: 3026818 - RNA, 17 nt, Mycobacterium avium subsp. paratuberculosis
gagcacgucgagcaccg

SEQ ID NO: 3026819 - RNA, 19 nt, Mycobacterium avium subsp. paratuberculosis
gagcacgucgagcaccgcg

SEQ ID NO: 3026820 - RNA, 20 nt, Mycobacterium avium subsp. paratuberculosis
gagcacgucgagcaccgcgu

SEQ ID NO: 3026821 - RNA, 16 nt, Mycobacterium avium subsp. paratuberculosis
gagcacgugggucaac

SEQ ID NO: 3026822 - RNA, 20 nt, Mycobacterium avium subsp. paratuberculosis
gagcagacacaaaagcaccc

SEQ ID NO: 3026823 - RNA, 20 nt, Mycobacterium avium subsp. paratuberculosis
gagcagacacaaaagcgccc

SEQ ID NO: 3026824 - RNA, 14 nt, Mycobacterium avium subsp. paratuberculosis
gagcagacccgccg

SEQ ID NO: 3026825 - RNA, 20 nt, Mycobacterium avium subsp. paratuberculosis
gagcagaccgaacccgggcg

SEQ ID NO: 3026826 - RNA, 23 nt, Mycobacterium avium subsp. paratuberculosis
gagcagaccgaacccgggcgcgc

SEQ ID NO: 3026827 - RNA, 17 nt, Mycobacterium avium subsp. paratuberculosis
gagcagacgcaaaagcc

SEQ ID NO: 3026828 - RNA, 19 nt, Mycobacterium avium subsp. paratuberculosis
gagcagacgcaaaagcccc

SEQ ID NO: 3026829 - RNA, 20 nt, Mycobacterium avium subsp. paratuberculosis
gagcagacgcaaaagccccg

SEQ ID NO: 3026830 - RNA, 21 nt, Mycobacterium avium subsp. paratuberculosis
gagcagacgcaaaagccccgc

SEQ ID NO: 3026831 - RNA, 22 nt, Mycobacterium avium subsp. paratuberculosis
gagcagacgcgaaagcacccga

SEQ ID NO: 3026832 - RNA, 24 nt, Mycobacterium avium subsp. paratuberculosis
gagcagacgcgaaagcacccgaca

SEQ ID NO: 3026833 - RNA, 21 nt, Mycobacterium avium subsp. paratuberculosis
gagcagacgugaaaucccccg

SEQ ID NO: 3026834 - RNA, 14 nt, Mycobacterium avium subsp. paratuberculosis
gagcagagcuacgg

SEQ ID NO: 3026835 - RNA, 14 nt, Mycobacterium avium subsp. paratuberculosis
gagcagauccugca

SEQ ID NO: 3026836 - RNA, 20 nt, Mycobacterium avium subsp. paratuberculosis
gagcagauccugcagcuggc

SEQ ID NO: 3026837 - RNA, 21 nt, Mycobacterium avium subsp. paratuberculosis
gagcagauccugcagcuggcg

SEQ ID NO: 3026838 - RNA, 23 nt, Mycobacterium avium subsp. paratuberculosis
gagcagaucgcggaucucgguga

SEQ ID NO: 3026839 - RNA, 18 nt, Mycobacterium avium subsp. paratuberculosis
gagcagaucgggucccag

SEQ ID NO: 3026840 - RNA, 16 nt, Mycobacterium avium subsp. paratuberculosis
gagcagaucgggucgc

SEQ ID NO: 3026841 - RNA, 14 nt, Mycobacterium avium subsp. paratuberculosis
gagcagcaccaccc

SEQ ID NO: 3026842 - RNA, 13 nt, Mycobacterium avium subsp. paratuberculosis
gagcagcacccga

SEQ ID NO: 3026843 - RNA, 22 nt, Mycobacterium avium subsp. paratuberculosis
gagcagcaccgcgacccaggcc

SEQ ID NO: 3026844 - RNA, 23 nt, Mycobacterium avium subsp. paratuberculosis
gagcagcaccgcgacccaggccg

SEQ ID NO: 3026845 - RNA, 15 nt, Mycobacterium avium subsp. paratuberculosis
gagcagcaccggcau

SEQ ID NO: 3026846 - RNA, 23 nt, Mycobacterium avium subsp. paratuberculosis
gagcagcagaccgccggugcgca

SEQ ID NO: 3026847 - RNA, 20 nt, Mycobacterium avium subsp. paratuberculosis
gagcagcagccgcagcggcg

SEQ ID NO: 3026848 - RNA, 22 nt, Mycobacterium avium subsp. paratuberculosis
gagcagcagccgcagcggcggc

SEQ ID NO: 3026849 - RNA, 15 nt, Mycobacterium avium subsp. paratuberculosis
gagcagcagccgccg

SEQ ID NO: 3026850 - RNA, 21 nt, Mycobacterium avium subsp. paratuberculosis
gagcagcagccgccgggccac

SEQ ID NO: 3026851 - RNA, 15 nt, Mycobacterium avium subsp. paratuberculosis
gagcagcagcgcggu

SEQ ID NO: 3026852 - RNA, 23 nt, Mycobacterium avium subsp. paratuberculosis
gagcagcagcgcggugccgaccu

SEQ ID NO: 3026853 - RNA, 13 nt, Mycobacterium avium subsp. paratuberculosis
gagcagcaugccg

SEQ ID NO: 3026854 - RNA, 15 nt, Mycobacterium avium subsp. paratuberculosis
gagcagcaugccgag

SEQ ID NO: 3026855 - RNA, 17 nt, Mycobacterium avium subsp. paratuberculosis
gagcagcaugccgagca

SEQ ID NO: 3026856 - RNA, 18 nt, Mycobacterium avium subsp. paratuberculosis
gagcagcaugccgagcac

SEQ ID NO: 3026857 - RNA, 23 nt, Mycobacterium avium subsp. paratuberculosis
gagcagcaugccgagcaccuccg

SEQ ID NO: 3026858 - RNA, 19 nt, Mycobacterium avium subsp. paratuberculosis
gagcagcccgaccaccucc

SEQ ID NO: 3026859 - RNA, 21 nt, Mycobacterium avium subsp. paratuberculosis
gagcagcccggcgaacaccac

SEQ ID NO: 3026860 - RNA, 20 nt, Mycobacterium avium subsp. paratuberculosis
gagcagccgaucuggcgggc

SEQ ID NO: 3026861 - RNA, 21 nt, Mycobacterium avium subsp. paratuberculosis
gagcagccgaucuggcgggcg

SEQ ID NO: 3026862 - RNA, 22 nt, Mycobacterium avium subsp. paratuberculosis
gagcagccgaucuggcgggcgg

SEQ ID NO: 3026863 - RNA, 22 nt, Mycobacterium avium subsp. paratuberculosis
gagcagccgcaacacggccucg

SEQ ID NO: 3026864 - RNA, 15 nt, Mycobacterium avium subsp. paratuberculosis
gagcagccgcaacca

SEQ ID NO: 3026865 - RNA, 13 nt, Mycobacterium avium subsp. paratuberculosis
gagcagcgcccgg

SEQ ID NO: 3026866 - RNA, 19 nt, Mycobacterium avium subsp. paratuberculosis
gagcagcgcccgggugcgc

SEQ ID NO: 3026867 - RNA, 20 nt, Mycobacterium avium subsp. paratuberculosis
gagcagcgcccgggugcgcu

SEQ ID NO: 3026868 - RNA, 21 nt, Mycobacterium avium subsp. paratuberculosis
gagcagcgccugcugccagga

SEQ ID NO: 3026869 - RNA, 22 nt, Mycobacterium avium subsp. paratuberculosis
gagcagcgccugcugccaggac

SEQ ID NO: 3026870 - RNA, 21 nt, Mycobacterium avium subsp. paratuberculosis
gagcagcgcgaugccggccag

SEQ ID NO: 3026871 - RNA, 23 nt, Mycobacterium avium subsp. paratuberculosis
gagcagcgcgaugccggccaggc

SEQ ID NO: 3026872 - RNA, 14 nt, Mycobacterium avium subsp. paratuberculosis
gagcagcgcgcgcu

SEQ ID NO: 3026873 - RNA, 22 nt, Mycobacterium avium subsp. paratuberculosis
gagcagcgcgcgcuugcgcucg

SEQ ID NO: 3026874 - RNA, 13 nt, Mycobacterium avium subsp. paratuberculosis
gagcagcggggug

SEQ ID NO: 3026875 - RNA, 23 nt, Mycobacterium avium subsp. paratuberculosis
gagcagcggggugagcaccgcga

SEQ ID NO: 3026876 - RNA, 13 nt, Mycobacterium avium subsp. paratuberculosis
gagcagcgggucg

SEQ ID NO: 3026877 - RNA, 16 nt, Mycobacterium avium subsp. paratuberculosis
gagcagcucagccgcc

SEQ ID NO: 3026878 - RNA, 22 nt, Mycobacterium avium subsp. paratuberculosis
gagcagcucgacaucggccgcc

SEQ ID NO: 3026879 - RNA, 20 nt, Mycobacterium avium subsp. paratuberculosis
gagcagcucgcggauccgca

SEQ ID NO: 3026880 - RNA, 21 nt, Mycobacterium avium subsp. paratuberculosis
gagcagcucgcggauccgcag

SEQ ID NO: 3026881 - RNA, 22 nt, Mycobacterium avium subsp. paratuberculosis
gagcagcucgcggauccgcagc

SEQ ID NO: 3026882 - RNA, 15 nt, Mycobacterium avium subsp. paratuberculosis
gagcagcucggcggc

SEQ ID NO: 3026883 - RNA, 22 nt, Mycobacterium avium subsp. paratuberculosis
gagcagcucggucaccagcggc

SEQ ID NO: 3026884 - RNA, 23 nt, Mycobacterium avium subsp. paratuberculosis
gagcagcucggucaccagcggcc

SEQ ID NO: 3026885 - RNA, 17 nt, Mycobacterium avium subsp. paratuberculosis
gagcagcugcagcgucg

SEQ ID NO: 3026886 - RNA, 16 nt, Mycobacterium avium subsp. paratuberculosis
gagcagcugggacagc

SEQ ID NO: 3026887 - RNA, 18 nt, Mycobacterium avium subsp. paratuberculosis
gagcagcugggacagcgu

SEQ ID NO: 3026888 - RNA, 14 nt, Mycobacterium avium subsp. paratuberculosis
gagcaggaccgagc

SEQ ID NO: 3026889 - RNA, 16 nt, Mycobacterium avium subsp. paratuberculosis
gagcaggaccgagccg

SEQ ID NO: 3026890 - RNA, 23 nt, Mycobacterium avium subsp. paratuberculosis
gagcaggaccgagccgcgcgccg

SEQ ID NO: 3026891 - RNA, 19 nt, Mycobacterium avium subsp. paratuberculosis
gagcaggcugaucucggcg

SEQ ID NO: 3026892 - RNA, 20 nt, Mycobacterium avium subsp. paratuberculosis
gagcaggcugaucucggcgg

SEQ ID NO: 3026893 - RNA, 22 nt, Mycobacterium avium subsp. paratuberculosis
gagcaggcugaucucggcgguc

SEQ ID NO: 3026894 - RNA, 19 nt, Mycobacterium avium subsp. paratuberculosis
gagcaggcuggcaugccgg

SEQ ID NO: 3026895 - RNA, 23 nt, Mycobacterium avium subsp. paratuberculosis
gagcaggcuucgcagcagauccu

SEQ ID NO: 3026896 - RNA, 14 nt, Mycobacterium avium subsp. paratuberculosis
gagcagggccagcg

SEQ ID NO: 3026897 - RNA, 15 nt, Mycobacterium avium subsp. paratuberculosis
gagcagggccagcgg

SEQ ID NO: 3026898 - RNA, 16 nt, Mycobacterium avium subsp. paratuberculosis
gagcagggccagcggc

SEQ ID NO: 3026899 - RNA, 13 nt, Mycobacterium avium subsp. paratuberculosis
gagcaggucagcc

SEQ ID NO: 3026900 - RNA, 22 nt, Mycobacterium avium subsp. paratuberculosis
gagcagguccucgaucgacacc

SEQ ID NO: 3026901 - RNA, 21 nt, Mycobacterium avium subsp. paratuberculosis
gagcagguucuccucccagcc

SEQ ID NO: 3026902 - RNA, 19 nt, Mycobacterium avium subsp. paratuberculosis
gagcagugcaucgcugccg

SEQ ID NO: 3026903 - RNA, 20 nt, Mycobacterium avium subsp. paratuberculosis
gagcaguucgaugcgcucgg

SEQ ID NO: 3026904 - RNA, 21 nt, Mycobacterium avium subsp. paratuberculosis
gagcaguucgaugcgcucggc

SEQ ID NO: 3026905 - RNA, 22 nt, Mycobacterium avium subsp. paratuberculosis
gagcaguugcgcguugcgcgga

SEQ ID NO: 3026906 - RNA, 12 nt, Mycobacterium avium subsp. paratuberculosis
gagcaucacgaa

SEQ ID NO: 3026907 - RNA, 14 nt, Mycobacterium avium subsp. paratuberculosis
gagcaucacgaacc

SEQ ID NO: 3026908 - RNA, 20 nt, Mycobacterium avium subsp. paratuberculosis
gagcaucacgaacccgugga

SEQ ID NO: 3026909 - RNA, 20 nt, Mycobacterium avium subsp. paratuberculosis
gagcauccggcgcacggcgc

SEQ ID NO: 3026910 - RNA, 17 nt, Mycobacterium avium subsp. paratuberculosis
gagcauccggugccgag

SEQ ID NO: 3026911 - RNA, 18 nt, Mycobacterium avium subsp. paratuberculosis
gagcauccggugccgagc

SEQ ID NO: 3026912 - RNA, 19 nt, Mycobacterium avium subsp. paratuberculosis
gagcauccggugccgagcg

SEQ ID NO: 3026913 - RNA, 15 nt, Mycobacterium avium subsp. paratuberculosis
gagcaucgccgagcg

SEQ ID NO: 3026914 - RNA, 20 nt, Mycobacterium avium subsp. paratuberculosis
gagcaucgggguuccaccgu

SEQ ID NO: 3026915 - RNA, 21 nt, Mycobacterium avium subsp. paratuberculosis
gagcaucggguugccggcggc

SEQ ID NO: 3026916 - RNA, 20 nt, Mycobacterium avium subsp. paratuberculosis
gagcaucucggugccgucga

SEQ ID NO: 3026917 - RNA, 14 nt, Mycobacterium avium subsp. paratuberculosis
gagcaugcggguga

SEQ ID NO: 3026918 - RNA, 21 nt, Mycobacterium avium subsp. paratuberculosis
gagcaugcguccggucugcuc

SEQ ID NO: 3026919 - RNA, 15 nt, Mycobacterium avium subsp. paratuberculosis
gagcauuggcgaugg

SEQ ID NO: 3026920 - RNA, 20 nt, Mycobacterium avium subsp. paratuberculosis
gagccacaacaugucccggg

SEQ ID NO: 3026921 - RNA, 13 nt, Mycobacterium avium subsp. paratuberculosis
gagccaccacugc

SEQ ID NO: 3026922 - RNA, 17 nt, Mycobacterium avium subsp. paratuberculosis
gagccaccacugcgccg

SEQ ID NO: 3026923 - RNA, 23 nt, Mycobacterium avium subsp. paratuberculosis
gagccagacgguggggcuggccg

SEQ ID NO: 3026924 - RNA, 18 nt, Mycobacterium avium subsp. paratuberculosis
gagccagcgggccgagcg

SEQ ID NO: 3026925 - RNA, 15 nt, Mycobacterium avium subsp. paratuberculosis
gagccagcugcgcgu

SEQ ID NO: 3026926 - RNA, 21 nt, Mycobacterium avium subsp. paratuberculosis
gagccagcugcgcgucggccg

SEQ ID NO: 3026927 - RNA, 17 nt, Mycobacterium avium subsp. paratuberculosis
gagccaguucgccagca

SEQ ID NO: 3026928 - RNA, 20 nt, Mycobacterium avium subsp. paratuberculosis
gagccaguucgccagcaugc

SEQ ID NO: 3026929 - RNA, 19 nt, Mycobacterium avium subsp. paratuberculosis
gagccauaaaccggccggc

SEQ ID NO: 3026930 - RNA, 20 nt, Mycobacterium avium subsp. paratuberculosis
gagccauaaaccggccggcg

SEQ ID NO: 3026931 - RNA, 13 nt, Mycobacterium avium subsp. paratuberculosis
gagcccaccgcgc

SEQ ID NO: 3026932 - RNA, 14 nt, Mycobacterium avium subsp. paratuberculosis
gagcccaccgcgcc

SEQ ID NO: 3026933 - RNA, 18 nt, Mycobacterium avium subsp. paratuberculosis
gagcccaccgcgcccagc

SEQ ID NO: 3026934 - RNA, 21 nt, Mycobacterium avium subsp. paratuberculosis
gagcccaccgcgcccagcccc

SEQ ID NO: 3026935 - RNA, 23 nt, Mycobacterium avium subsp. paratuberculosis
gagcccaccgcgcccagccccag

SEQ ID NO: 3026936 - RNA, 13 nt, Mycobacterium avium subsp. paratuberculosis
gagcccagcguga

SEQ ID NO: 3026937 - RNA, 14 nt, Mycobacterium avium subsp. paratuberculosis
gagcccagcgugaa

SEQ ID NO: 3026938 - RNA, 17 nt, Mycobacterium avium subsp. paratuberculosis
gagcccagcgugaaacu

SEQ ID NO: 3026939 - RNA, 13 nt, Mycobacterium avium subsp. paratuberculosis
gagcccagcugcg

SEQ ID NO: 3026940 - RNA, 14 nt, Mycobacterium avium subsp. paratuberculosis
gagcccagcuuggc

SEQ ID NO: 3026941 - RNA, 16 nt, Mycobacterium avium subsp. paratuberculosis
gagcccagcuuggcgc

SEQ ID NO: 3026942 - RNA, 12 nt, Mycobacterium avium subsp. paratuberculosis
gagcccccaccu

SEQ ID NO: 3026943 - RNA, 22 nt, Mycobacterium avium subsp. paratuberculosis
gagcccccaccugaucgcggcg

SEQ ID NO: 3026944 - RNA, 14 nt, Mycobacterium avium subsp. paratuberculosis
gagcccgaacacgg

SEQ ID NO: 3026945 - RNA, 16 nt, Mycobacterium avium subsp. paratuberculosis
gagcccgacggcagca

SEQ ID NO: 3026946 - RNA, 17 nt, Mycobacterium avium subsp. paratuberculosis
gagcccgacggcagcac

SEQ ID NO: 3026947 - RNA, 18 nt, Mycobacterium avium subsp. paratuberculosis
gagcccgacggcagcacc

SEQ ID NO: 3026948 - RNA, 18 nt, Mycobacterium avium subsp. paratuberculosis
gagcccgaugcuggccau

SEQ ID NO: 3026949 - RNA, 21 nt, Mycobacterium avium subsp. paratuberculosis
gagcccgcaaaucagccgagc

SEQ ID NO: 3026950 - RNA, 12 nt, Mycobacterium avium subsp. paratuberculosis
gagcccgccggc

SEQ ID NO: 3026951 - RNA, 13 nt, Mycobacterium avium subsp. paratuberculosis
gagcccgccggcg

SEQ ID NO: 3026952 - RNA, 16 nt, Mycobacterium avium subsp. paratuberculosis
gagcccgccggcggcg

SEQ ID NO: 3026953 - RNA, 13 nt, Mycobacterium avium subsp. paratuberculosis
gagcccggccagu

SEQ ID NO: 3026954 - RNA, 21 nt, Mycobacterium avium subsp. paratuberculosis
gagcccggccaguccggcagc

SEQ ID NO: 3026955 - RNA, 17 nt, Mycobacterium avium subsp. paratuberculosis
gagcccgggcaggcggc

SEQ ID NO: 3026956 - RNA, 18 nt, Mycobacterium avium subsp. paratuberculosis
gagcccgggcaggcggcg

SEQ ID NO: 3026957 - RNA, 19 nt, Mycobacterium avium subsp. paratuberculosis
gagcccgggcaggcggcgc

SEQ ID NO: 3026958 - RNA, 13 nt, Mycobacterium avium subsp. paratuberculosis
gagcccgucgacg

SEQ ID NO: 3026959 - RNA, 16 nt, Mycobacterium avium subsp. paratuberculosis
gagcccgucgacgucg

SEQ ID NO: 3026960 - RNA, 13 nt, Mycobacterium avium subsp. paratuberculosis
gagcccuccagcu

SEQ ID NO: 3026961 - RNA, 12 nt, Mycobacterium avium subsp. paratuberculosis
gagcccugcgcc

SEQ ID NO: 3026962 - RNA, 16 nt, Mycobacterium avium subsp. paratuberculosis
gagcccugcgccagca

SEQ ID NO: 3026963 - RNA, 17 nt, Mycobacterium avium subsp. paratuberculosis
gagcccugcgccagcag

SEQ ID NO: 3026964 - RNA, 18 nt, Mycobacterium avium subsp. paratuberculosis
gagcccugcgccagcagc

SEQ ID NO: 3026965 - RNA, 18 nt, Mycobacterium avium subsp. paratuberculosis
gagcccuucgcggugugc

SEQ ID NO: 3026966 - RNA, 18 nt, Mycobacterium avium subsp. paratuberculosis
gagccgaaacggugcccg

SEQ ID NO: 3026967 - RNA, 23 nt, Mycobacterium avium subsp. paratuberculosis
gagccgaagaucaccgcgucggc

SEQ ID NO: 3026968 - RNA, 18 nt, Mycobacterium avium subsp. paratuberculosis
gagccgacagucgcgggc

SEQ ID NO: 3026969 - RNA, 14 nt, Mycobacterium avium subsp. paratuberculosis
gagccgaccagcgc

SEQ ID NO: 3026970 - RNA, 16 nt, Mycobacterium avium subsp. paratuberculosis
gagccgaccagcgcga

SEQ ID NO: 3026971 - RNA, 18 nt, Mycobacterium avium subsp. paratuberculosis
gagccgaccucggcgacg

SEQ ID NO: 3026972 - RNA, 21 nt, Mycobacterium avium subsp. paratuberculosis
gagccgaccucggcgacgaug

SEQ ID NO: 3026973 - RNA, 21 nt, Mycobacterium avium subsp. paratuberculosis
gagccgacgaagaucccgcug

SEQ ID NO: 3026974 - RNA, 21 nt, Mycobacterium avium subsp. paratuberculosis
gagccgacguaaccguacggc

SEQ ID NO: 3026975 - RNA, 17 nt, Mycobacterium avium subsp. paratuberculosis
gagccgagcaccaggcg

SEQ ID NO: 3026976 - RNA, 24 nt, Mycobacterium avium subsp. paratuberculosis
gagccgagcaccaggcgcaccagc

SEQ ID NO: 3026977 - RNA, 14 nt, Mycobacterium avium subsp. paratuberculosis
gagccgagcaccgg

SEQ ID NO: 3026978 - RNA, 19 nt, Mycobacterium avium subsp. paratuberculosis
gagccgagcaccggcagca

SEQ ID NO: 3026979 - RNA, 16 nt, Mycobacterium avium subsp. paratuberculosis
gagccgagcaccgggc

SEQ ID NO: 3026980 - RNA, 22 nt, Mycobacterium avium subsp. paratuberculosis
gagccgagcaccgggcugucgg

SEQ ID NO: 3026981 - RNA, 12 nt, Mycobacterium avium subsp. paratuberculosis
gagccgagcacg

SEQ ID NO: 3026982 - RNA, 19 nt, Mycobacterium avium subsp. paratuberculosis
gagccgagcacgcagccgc

SEQ ID NO: 3026983 - RNA, 14 nt, Mycobacterium avium subsp. paratuberculosis
gagccgagccgacc

SEQ ID NO: 3026984 - RNA, 15 nt, Mycobacterium avium subsp. paratuberculosis
gagccgagccgaccc

SEQ ID NO: 3026985 - RNA, 16 nt, Mycobacterium avium subsp. paratuberculosis
gagccgaucgccuccg

SEQ ID NO: 3026986 - RNA, 14 nt, Mycobacterium avium subsp. paratuberculosis
gagccgaugcccag

SEQ ID NO: 3026987 - RNA, 15 nt, Mycobacterium avium subsp. paratuberculosis
gagccgaugcccagc

SEQ ID NO: 3026988 - RNA, 17 nt, Mycobacterium avium subsp. paratuberculosis
gagccgaugcccagcag

SEQ ID NO: 3026989 - RNA, 18 nt, Mycobacterium avium subsp. paratuberculosis
gagccgaugcccagcagc

SEQ ID NO: 3026990 - RNA, 20 nt, Mycobacterium avium subsp. paratuberculosis
gagccgaugcccagcagcgg

SEQ ID NO: 3026991 - RNA, 13 nt, Mycobacterium avium subsp. paratuberculosis
gagccgcaccgcc

SEQ ID NO: 3026992 - RNA, 15 nt, Mycobacterium avium subsp. paratuberculosis
gagccgcaccgccuc

SEQ ID NO: 3026993 - RNA, 12 nt, Mycobacterium avium subsp. paratuberculosis
gagccgcagccg

SEQ ID NO: 3026994 - RNA, 17 nt, Mycobacterium avium subsp. paratuberculosis
gagccgcagccgggugg

SEQ ID NO: 3026995 - RNA, 13 nt, Mycobacterium avium subsp. paratuberculosis
gagccgcagucga

SEQ ID NO: 3026996 - RNA, 22 nt, Mycobacterium avium subsp. paratuberculosis
gagccgcagucgaucaccgaga

SEQ ID NO: 3026997 - RNA, 23 nt, Mycobacterium avium subsp. paratuberculosis
gagccgcaucgcaagaaccucca

SEQ ID NO: 3026998 - RNA, 13 nt, Mycobacterium avium subsp. paratuberculosis
gagccgccacagc

SEQ ID NO: 3026999 - RNA, 17 nt, Mycobacterium avium subsp. paratuberculosis
gagccgccacagcgccu

SEQ ID NO: 3027000 - RNA, 19 nt, Mycobacterium avium subsp. paratuberculosis
gagccgccacagcgccucg

SEQ ID NO: 3027001 - RNA, 21 nt, Mycobacterium avium subsp. paratuberculosis
gagccgccacggggcccgcga

SEQ ID NO: 3027002 - RNA, 15 nt, Mycobacterium avium subsp. paratuberculosis
gagccgcccaggcgg

SEQ ID NO: 3027003 - RNA, 21 nt, Mycobacterium avium subsp. paratuberculosis
gagccgcccaggcgggccagc

SEQ ID NO: 3027004 - RNA, 22 nt, Mycobacterium avium subsp. paratuberculosis
gagccgcccaggcgggccagcu

SEQ ID NO: 3027005 - RNA, 15 nt, Mycobacterium avium subsp. paratuberculosis
gagccgccgagccgg

SEQ ID NO: 3027006 - RNA, 16 nt, Mycobacterium avium subsp. paratuberculosis
gagccgccgagccggc

SEQ ID NO: 3027007 - RNA, 12 nt, Mycobacterium avium subsp. paratuberculosis
gagccgccgcgg

SEQ ID NO: 3027008 - RNA, 14 nt, Mycobacterium avium subsp. paratuberculosis
gagccgccgcggca

SEQ ID NO: 3027009 - RNA, 15 nt, Mycobacterium avium subsp. paratuberculosis
gagccgccgcggguc

SEQ ID NO: 3027010 - RNA, 22 nt, Mycobacterium avium subsp. paratuberculosis
gagccgccgcgggucggcgacg

SEQ ID NO: 3027011 - RNA, 21 nt, Mycobacterium avium subsp. paratuberculosis
gagccgccggaucggcagcgc

SEQ ID NO: 3027012 - RNA, 22 nt, Mycobacterium avium subsp. paratuberculosis
gagccgccggaucggcagcgcg

SEQ ID NO: 3027013 - RNA, 15 nt, Mycobacterium avium subsp. paratuberculosis
gagccgccggggcgc

SEQ ID NO: 3027014 - RNA, 17 nt, Mycobacterium avium subsp. paratuberculosis
gagccgccggggcgccg

SEQ ID NO: 3027015 - RNA, 19 nt, Mycobacterium avium subsp. paratuberculosis
gagccgccggggcgccgcc

SEQ ID NO: 3027016 - RNA, 20 nt, Mycobacterium avium subsp. paratuberculosis
gagccgccggggcgccgccg

SEQ ID NO: 3027017 - RNA, 13 nt, Mycobacterium avium subsp. paratuberculosis
gagccgccugcgc

SEQ ID NO: 3027018 - RNA, 15 nt, Mycobacterium avium subsp. paratuberculosis
gagccgccugcgcgc

SEQ ID NO: 3027019 - RNA, 14 nt, Mycobacterium avium subsp. paratuberculosis
gagccgcgccacgc

SEQ ID NO: 3027020 - RNA, 14 nt, Mycobacterium avium subsp. paratuberculosis
gagccgcgcgccga

SEQ ID NO: 3027021 - RNA, 18 nt, Mycobacterium avium subsp. paratuberculosis
gagccgcgcgccgagagc

SEQ ID NO: 3027022 - RNA, 15 nt, Mycobacterium avium subsp. paratuberculosis
gagccgcggauggcc

SEQ ID NO: 3027023 - RNA, 19 nt, Mycobacterium avium subsp. paratuberculosis
gagccgcggauggccucgg

SEQ ID NO: 3027024 - RNA, 23 nt, Mycobacterium avium subsp. paratuberculosis
gagccgcgggugacgaucaccgc

SEQ ID NO: 3027025 - RNA, 17 nt, Mycobacterium avium subsp. paratuberculosis
gagccgcuccaccgcgu

SEQ ID NO: 3027026 - RNA, 19 nt, Mycobacterium avium subsp. paratuberculosis
gagccgcucccgcagcggg

SEQ ID NO: 3027027 - RNA, 21 nt, Mycobacterium avium subsp. paratuberculosis
gagccgcucccgcagcggggc

SEQ ID NO: 3027028 - RNA, 13 nt, Mycobacterium avium subsp. paratuberculosis
gagccgcucgcgc

SEQ ID NO: 3027029 - RNA, 18 nt, Mycobacterium avium subsp. paratuberculosis
gagccgcucgcgcaccgg

SEQ ID NO: 3027030 - RNA, 23 nt, Mycobacterium avium subsp. paratuberculosis
gagccgcugagcuucugcccggc

SEQ ID NO: 3027031 - RNA, 17 nt, Mycobacterium avium subsp. paratuberculosis
gagccgcuugguggcgc

SEQ ID NO: 3027032 - RNA, 20 nt, Mycobacterium avium subsp. paratuberculosis
gagccgcuugguggcgccgg

SEQ ID NO: 3027033 - RNA, 17 nt, Mycobacterium avium subsp. paratuberculosis
gagccggacaucucccg

SEQ ID NO: 3027034 - RNA, 18 nt, Mycobacterium avium subsp. paratuberculosis
gagccggacaucucccgc

SEQ ID NO: 3027035 - RNA, 22 nt, Mycobacterium avium subsp. paratuberculosis
gagccggagccuugcuggcggc

SEQ ID NO: 3027036 - RNA, 16 nt, Mycobacterium avium subsp. paratuberculosis
gagccggaugcggccg

SEQ ID NO: 3027037 - RNA, 22 nt, Mycobacterium avium subsp. paratuberculosis
gagccggccagguugaccacca

SEQ ID NO: 3027038 - RNA, 22 nt, Mycobacterium avium subsp. paratuberculosis
gagccggcccggggugugcccg

SEQ ID NO: 3027039 - RNA, 13 nt, Mycobacterium avium subsp. paratuberculosis
gagccggcccugc

SEQ ID NO: 3027040 - RNA, 16 nt, Mycobacterium avium subsp. paratuberculosis
gagccggcccugcggc

SEQ ID NO: 3027041 - RNA, 23 nt, Mycobacterium avium subsp. paratuberculosis
gagccggcccugcggccagugcc

SEQ ID NO: 3027042 - RNA, 14 nt, Mycobacterium avium subsp. paratuberculosis
gagccggccgaagc

SEQ ID NO: 3027043 - RNA, 14 nt, Mycobacterium avium subsp. paratuberculosis
gagccggccgccga

SEQ ID NO: 3027044 - RNA, 14 nt, Mycobacterium avium subsp. paratuberculosis
gagccggccucgcc

SEQ ID NO: 3027045 - RNA, 15 nt, Mycobacterium avium subsp. paratuberculosis
gagccggccucgccg

SEQ ID NO: 3027046 - RNA, 19 nt, Mycobacterium avium subsp. paratuberculosis
gagccggccucgccggcgc

SEQ ID NO: 3027047 - RNA, 17 nt, Mycobacterium avium subsp. paratuberculosis
gagccggcgcaccgcgu

SEQ ID NO: 3027048 - RNA, 19 nt, Mycobacterium avium subsp. paratuberculosis
gagccggcgcaccgcgucg

SEQ ID NO: 3027049 - RNA, 21 nt, Mycobacterium avium subsp. paratuberculosis
gagccggcgcaccgcgucgau

SEQ ID NO: 3027050 - RNA, 13 nt, Mycobacterium avium subsp. paratuberculosis
gagccggcgcacu

SEQ ID NO: 3027051 - RNA, 18 nt, Mycobacterium avium subsp. paratuberculosis
gagccggcgcacucccgc

SEQ ID NO: 3027052 - RNA, 12 nt, Mycobacterium avium subsp. paratuberculosis
gagccggcggcg

SEQ ID NO: 3027053 - RNA, 14 nt, Mycobacterium avium subsp. paratuberculosis
gagccggcggcguu

SEQ ID NO: 3027054 - RNA, 12 nt, Mycobacterium avium subsp. paratuberculosis
gagccggcguac

SEQ ID NO: 3027055 - RNA, 12 nt, Mycobacterium avium subsp. paratuberculosis
gagccggcgucg

SEQ ID NO: 3027056 - RNA, 16 nt, Mycobacterium avium subsp. paratuberculosis
gagccgggcagcgcga

SEQ ID NO: 3027057 - RNA, 20 nt, Mycobacterium avium subsp. paratuberculosis
gagccgggcagcgcgacacc

SEQ ID NO: 3027058 - RNA, 22 nt, Mycobacterium avium subsp. paratuberculosis
gagccgggccaauuacgcugcg

SEQ ID NO: 3027059 - RNA, 23 nt, Mycobacterium avium subsp. paratuberculosis
gagccgggccaauuacgcugcgg

SEQ ID NO: 3027060 - RNA, 17 nt, Mycobacterium avium subsp. paratuberculosis
gagccgggcgcgggcgc

SEQ ID NO: 3027061 - RNA, 14 nt, Mycobacterium avium subsp. paratuberculosis
gagccgggcggcca

SEQ ID NO: 3027062 - RNA, 15 nt, Mycobacterium avium subsp. paratuberculosis
gagccgggcggccag

SEQ ID NO: 3027063 - RNA, 14 nt, Mycobacterium avium subsp. paratuberculosis
gagccggggcuggg

SEQ ID NO: 3027064 - RNA, 19 nt, Mycobacterium avium subsp. paratuberculosis
gagccgggucauccagccg

SEQ ID NO: 3027065 - RNA, 19 nt, Mycobacterium avium subsp. paratuberculosis
gagccgguagggccgguca

SEQ ID NO: 3027066 - RNA, 21 nt, Mycobacterium avium subsp. paratuberculosis
gagccgguagggccggucacc

SEQ ID NO: 3027067 - RNA, 20 nt, Mycobacterium avium subsp. paratuberculosis
gagccgguccgaccagcggc

SEQ ID NO: 3027068 - RNA, 19 nt, Mycobacterium avium subsp. paratuberculosis
gagccgguccgacggcugc

SEQ ID NO: 3027069 - RNA, 14 nt, Mycobacterium avium subsp. paratuberculosis
gagccggucgaacg

SEQ ID NO: 3027070 - RNA, 16 nt, Mycobacterium avium subsp. paratuberculosis
gagccggucgaacgcc

SEQ ID NO: 3027071 - RNA, 17 nt, Mycobacterium avium subsp. paratuberculosis
gagccggucgaacgcca

SEQ ID NO: 3027072 - RNA, 23 nt, Mycobacterium avium subsp. paratuberculosis
gagccggucgaacgccagcgccg

SEQ ID NO: 3027073 - RNA, 14 nt, Mycobacterium avium subsp. paratuberculosis
gagccggucgggau

SEQ ID NO: 3027074 - RNA, 16 nt, Mycobacterium avium subsp. paratuberculosis
gagccggucgugcgac

SEQ ID NO: 3027075 - RNA, 17 nt, Mycobacterium avium subsp. paratuberculosis
gagccggucugggcgac

SEQ ID NO: 3027076 - RNA, 24 nt, Mycobacterium avium subsp. paratuberculosis
gagccggucugggcgaccaugccg

SEQ ID NO: 3027077 - RNA, 12 nt, Mycobacterium avium subsp. paratuberculosis
gagccggugaug

SEQ ID NO: 3027078 - RNA, 13 nt, Mycobacterium avium subsp. paratuberculosis
gagccggugauga

SEQ ID NO: 3027079 - RNA, 17 nt, Mycobacterium avium subsp. paratuberculosis
gagccggugccgaggca

SEQ ID NO: 3027080 - RNA, 18 nt, Mycobacterium avium subsp. paratuberculosis
gagccggugccgcccauc

SEQ ID NO: 3027081 - RNA, 20 nt, Mycobacterium avium subsp. paratuberculosis
gagccgguugacccucagca

SEQ ID NO: 3027082 - RNA, 24 nt, Mycobacterium avium subsp. paratuberculosis
gagccgguugacccucagcagggc

SEQ ID NO: 3027083 - RNA, 20 nt, Mycobacterium avium subsp. paratuberculosis
gagccguccggguucgacgc

SEQ ID NO: 3027084 - RNA, 12 nt, Mycobacterium avium subsp. paratuberculosis
gagccgucgacc

SEQ ID NO: 3027085 - RNA, 19 nt, Mycobacterium avium subsp. paratuberculosis
gagccgucgaccggguccg

SEQ ID NO: 3027086 - RNA, 20 nt, Mycobacterium avium subsp. paratuberculosis
gagccgucggcuuccuccuc

SEQ ID NO: 3027087 - RNA, 19 nt, Mycobacterium avium subsp. paratuberculosis
gagccgucgucgcugcagu

SEQ ID NO: 3027088 - RNA, 15 nt, Mycobacterium avium subsp. paratuberculosis
gagccgucucggagc

SEQ ID NO: 3027089 - RNA, 16 nt, Mycobacterium avium subsp. paratuberculosis
gagccgugcagcgccc

SEQ ID NO: 3027090 - RNA, 21 nt, Mycobacterium avium subsp. paratuberculosis
gagccgugcagcgcccagccg

SEQ ID NO: 3027091 - RNA, 18 nt, Mycobacterium avium subsp. paratuberculosis
gagccgugcccgagguga

SEQ ID NO: 3027092 - RNA, 22 nt, Mycobacterium avium subsp. paratuberculosis
gagccguuugaugccguccggg

SEQ ID NO: 3027093 - RNA, 18 nt, Mycobacterium avium subsp. paratuberculosis
gagccguuuggcgccgcc

SEQ ID NO: 3027094 - RNA, 20 nt, Mycobacterium avium subsp. paratuberculosis
gagccguuuggcgccgccca

SEQ ID NO: 3027095 - RNA, 22 nt, Mycobacterium avium subsp. paratuberculosis
gagccguuuggcgccgcccacc

SEQ ID NO: 3027096 - RNA, 15 nt, Mycobacterium avium subsp. paratuberculosis
gagccucagggcgcg

SEQ ID NO: 3027097 - RNA, 17 nt, Mycobacterium avium subsp. paratuberculosis
gagccucagggcgcgcu

SEQ ID NO: 3027098 - RNA, 15 nt, Mycobacterium avium subsp. paratuberculosis
gagccugggauugcc

SEQ ID NO: 3027099 - RNA, 23 nt, Mycobacterium avium subsp. paratuberculosis
gagccugggauugccgggcacca

SEQ ID NO: 3027100 - RNA, 20 nt, Mycobacterium avium subsp. paratuberculosis
gagccuucuugaccgcagcc

SEQ ID NO: 3027101 - RNA, 21 nt, Mycobacterium avium subsp. paratuberculosis
gagccuucuugaccgcagccu

SEQ ID NO: 3027102 - RNA, 18 nt, Mycobacterium avium subsp. paratuberculosis
gagccuugcuggcggccu

SEQ ID NO: 3027103 - RNA, 13 nt, Mycobacterium avium subsp. paratuberculosis
gagccuuggucgc

SEQ ID NO: 3027104 - RNA, 18 nt, Mycobacterium avium subsp. paratuberculosis
gagccuuggucgcggccu

SEQ ID NO: 3027105 - RNA, 17 nt, Mycobacterium avium subsp. paratuberculosis
gagcgaaggugccgcga

SEQ ID NO: 3027106 - RNA, 18 nt, Mycobacterium avium subsp. paratuberculosis
gagcgaaggugccgcgau

SEQ ID NO: 3027107 - RNA, 20 nt, Mycobacterium avium subsp. paratuberculosis
gagcgacauggucgggcgca

SEQ ID NO: 3027108 - RNA, 22 nt, Mycobacterium avium subsp. paratuberculosis
gagcgacauggucgggcgcacc

SEQ ID NO: 3027109 - RNA, 23 nt, Mycobacterium avium subsp. paratuberculosis
gagcgacauggucgggcgcacca

SEQ ID NO: 3027110 - RNA, 18 nt, Mycobacterium avium subsp. paratuberculosis
gagcgagaugaucagccg

SEQ ID NO: 3027111 - RNA, 20 nt, Mycobacterium avium subsp. paratuberculosis
gagcgagaugaucagccgcc

SEQ ID NO: 3027112 - RNA, 13 nt, Mycobacterium avium subsp. paratuberculosis
gagcgagcgcacc

SEQ ID NO: 3027113 - RNA, 20 nt, Mycobacterium avium subsp. paratuberculosis
gagcgaggacgucgagcggc

SEQ ID NO: 3027114 - RNA, 15 nt, Mycobacterium avium subsp. paratuberculosis
gagcgaugggcgcga

SEQ ID NO: 3027115 - RNA, 22 nt, Mycobacterium avium subsp. paratuberculosis
gagcgcaacguguacucggcgu

SEQ ID NO: 3027116 - RNA, 14 nt, Mycobacterium avium subsp. paratuberculosis
gagcgcaccgccca

SEQ ID NO: 3027117 - RNA, 13 nt, Mycobacterium avium subsp. paratuberculosis
gagcgcaccgcgg

SEQ ID NO: 3027118 - RNA, 21 nt, Mycobacterium avium subsp. paratuberculosis
gagcgcagcagguaaaccagc

SEQ ID NO: 3027119 - RNA, 13 nt, Mycobacterium avium subsp. paratuberculosis
gagcgcaggccgu

SEQ ID NO: 3027120 - RNA, 19 nt, Mycobacterium avium subsp. paratuberculosis
gagcgcaucgacugcgaca

SEQ ID NO: 3027121 - RNA, 13 nt, Mycobacterium avium subsp. paratuberculosis
gagcgccaccccg

SEQ ID NO: 3027122 - RNA, 14 nt, Mycobacterium avium subsp. paratuberculosis
gagcgccaccccga

SEQ ID NO: 3027123 - RNA, 18 nt, Mycobacterium avium subsp. paratuberculosis
gagcgccagcgcggugcc

SEQ ID NO: 3027124 - RNA, 23 nt, Mycobacterium avium subsp. paratuberculosis
gagcgccagcgcggugcccagcc

SEQ ID NO: 3027125 - RNA, 16 nt, Mycobacterium avium subsp. paratuberculosis
gagcgccaggccaugg

SEQ ID NO: 3027126 - RNA, 22 nt, Mycobacterium avium subsp. paratuberculosis
gagcgccaggccauggcgcacc

SEQ ID NO: 3027127 - RNA, 17 nt, Mycobacterium avium subsp. paratuberculosis
gagcgccagggucuggc

SEQ ID NO: 3027128 - RNA, 20 nt, Mycobacterium avium subsp. paratuberculosis
gagcgccagggucuggcccg

SEQ ID NO: 3027129 - RNA, 22 nt, Mycobacterium avium subsp. paratuberculosis
gagcgccagggucuggcccggu

SEQ ID NO: 3027130 - RNA, 16 nt, Mycobacterium avium subsp. paratuberculosis
gagcgccccagggccu

SEQ ID NO: 3027131 - RNA, 21 nt, Mycobacterium avium subsp. paratuberculosis
gagcgccccagggccucggcg

SEQ ID NO: 3027132 - RNA, 11 nt, Mycobacterium avium subsp. paratuberculosis
gagcgcccggc

SEQ ID NO: 3027133 - RNA, 16 nt, Mycobacterium avium subsp. paratuberculosis
gagcgcccggccagcc

SEQ ID NO: 3027134 - RNA, 23 nt, Mycobacterium avium subsp. paratuberculosis
gagcgcccggccagccggccgcu

SEQ ID NO: 3027135 - RNA, 16 nt, Mycobacterium avium subsp. paratuberculosis
gagcgcccgggcguuc

SEQ ID NO: 3027136 - RNA, 22 nt, Mycobacterium avium subsp. paratuberculosis
gagcgcccgggcguucccgcgc

SEQ ID NO: 3027137 - RNA, 13 nt, Mycobacterium avium subsp. paratuberculosis
gagcgccgcggcc

SEQ ID NO: 3027138 - RNA, 14 nt, Mycobacterium avium subsp. paratuberculosis
gagcgccgcggcca

SEQ ID NO: 3027139 - RNA, 15 nt, Mycobacterium avium subsp. paratuberculosis
gagcgccgcggccac

SEQ ID NO: 3027140 - RNA, 22 nt, Mycobacterium avium subsp. paratuberculosis
gagcgccgcggccaccgggucg

SEQ ID NO: 3027141 - RNA, 18 nt, Mycobacterium avium subsp. paratuberculosis
gagcgccgcguucacccg

SEQ ID NO: 3027142 - RNA, 14 nt, Mycobacterium avium subsp. paratuberculosis
gagcgccggggcgg

SEQ ID NO: 3027143 - RNA, 19 nt, Mycobacterium avium subsp. paratuberculosis
gagcgcgaaaaccagcacc

SEQ ID NO: 3027144 - RNA, 20 nt, Mycobacterium avium subsp. paratuberculosis
gagcgcgaaaaccagcaccg

SEQ ID NO: 3027145 - RNA, 12 nt, Mycobacterium avium subsp. paratuberculosis
gagcgcgaagcc

SEQ ID NO: 3027146 - RNA, 13 nt, Mycobacterium avium subsp. paratuberculosis
gagcgcgccgagc

SEQ ID NO: 3027147 - RNA, 17 nt, Mycobacterium avium subsp. paratuberculosis
gagcgcgccgagguggc

SEQ ID NO: 3027148 - RNA, 22 nt, Mycobacterium avium subsp. paratuberculosis
gagcgcgccgagguggcccgcc

SEQ ID NO: 3027149 - RNA, 23 nt, Mycobacterium avium subsp. paratuberculosis
gagcgcgccgagguggcccgcca

SEQ ID NO: 3027150 - RNA, 12 nt, Mycobacterium avium subsp. paratuberculosis
gagcgcgccgcc

SEQ ID NO: 3027151 - RNA, 16 nt, Mycobacterium avium subsp. paratuberculosis
gagcgcgccggcccga

SEQ ID NO: 3027152 - RNA, 19 nt, Mycobacterium avium subsp. paratuberculosis
gagcgcgccggcccgauag

SEQ ID NO: 3027153 - RNA, 16 nt, Mycobacterium avium subsp. paratuberculosis
gagcgcgcgaucuccg

SEQ ID NO: 3027154 - RNA, 14 nt, Mycobacterium avium subsp. paratuberculosis
gagcgcgcggugau

SEQ ID NO: 3027155 - RNA, 15 nt, Mycobacterium avium subsp. paratuberculosis
gagcgcgcggugaug

SEQ ID NO: 3027156 - RNA, 23 nt, Mycobacterium avium subsp. paratuberculosis
gagcgcgcucaaccgcccagcgg

SEQ ID NO: 3027157 - RNA, 14 nt, Mycobacterium avium subsp. paratuberculosis
gagcgcgcugaucg

SEQ ID NO: 3027158 - RNA, 21 nt, Mycobacterium avium subsp. paratuberculosis
gagcgcgcuguaggucgcgua

SEQ ID NO: 3027159 - RNA, 14 nt, Mycobacterium avium subsp. paratuberculosis
gagcgcgcugugcg

SEQ ID NO: 3027160 - RNA, 11 nt, Mycobacterium avium subsp. paratuberculosis
gagcgcgcuua

SEQ ID NO: 3027161 - RNA, 21 nt, Mycobacterium avium subsp. paratuberculosis
gagcgcgcuuaauacagcgcg

SEQ ID NO: 3027162 - RNA, 12 nt, Mycobacterium avium subsp. paratuberculosis
gagcgcggcccg

SEQ ID NO: 3027163 - RNA, 16 nt, Mycobacterium avium subsp. paratuberculosis
gagcgcggcccgccga

SEQ ID NO: 3027164 - RNA, 17 nt, Mycobacterium avium subsp. paratuberculosis
gagcgcggcgagcggca

SEQ ID NO: 3027165 - RNA, 18 nt, Mycobacterium avium subsp. paratuberculosis
gagcgcgguccacggugg

SEQ ID NO: 3027166 - RNA, 16 nt, Mycobacterium avium subsp. paratuberculosis
gagcgcguacacgaug

SEQ ID NO: 3027167 - RNA, 16 nt, Mycobacterium avium subsp. paratuberculosis
gagcgcgucgaccagc

SEQ ID NO: 3027168 - RNA, 19 nt, Mycobacterium avium subsp. paratuberculosis
gagcgcgucgaccagccgc

SEQ ID NO: 3027169 - RNA, 14 nt, Mycobacterium avium subsp. paratuberculosis
gagcgcgucgacgc

SEQ ID NO: 3027170 - RNA, 16 nt, Mycobacterium avium subsp. paratuberculosis
gagcgcgucgucgccg

SEQ ID NO: 3027171 - RNA, 20 nt, Mycobacterium avium subsp. paratuberculosis
gagcgcguucuccaccgcgc

SEQ ID NO: 3027172 - RNA, 12 nt, Mycobacterium avium subsp. paratuberculosis
gagcgcuaccgc

SEQ ID NO: 3027173 - RNA, 14 nt, Mycobacterium avium subsp. paratuberculosis
gagcgcuaccgcgc

SEQ ID NO: 3027174 - RNA, 18 nt, Mycobacterium avium subsp. paratuberculosis
gagcgcuaccgcgcucac

SEQ ID NO: 3027175 - RNA, 19 nt, Mycobacterium avium subsp. paratuberculosis
gagcgcuggucggcgaacc

SEQ ID NO: 3027176 - RNA, 17 nt, Mycobacterium avium subsp. paratuberculosis
gagcggaucggcggcga

SEQ ID NO: 3027177 - RNA, 21 nt, Mycobacterium avium subsp. paratuberculosis
gagcggauggcgccgucgagg

SEQ ID NO: 3027178 - RNA, 14 nt, Mycobacterium avium subsp. paratuberculosis
gagcggcaccaggu

SEQ ID NO: 3027179 - RNA, 14 nt, Mycobacterium avium subsp. paratuberculosis
gagcggcacgaucg

SEQ ID NO: 3027180 - RNA, 20 nt, Mycobacterium avium subsp. paratuberculosis
gagcggcacgaucggcagcg

SEQ ID NO: 3027181 - RNA, 21 nt, Mycobacterium avium subsp. paratuberculosis
gagcggcacgaucggcagcgc

SEQ ID NO: 3027182 - RNA, 20 nt, Mycobacterium avium subsp. paratuberculosis
gagcggcccaacacgcccug

SEQ ID NO: 3027183 - RNA, 22 nt, Mycobacterium avium subsp. paratuberculosis
gagcggcccaacacgcccugca

SEQ ID NO: 3027184 - RNA, 21 nt, Mycobacterium avium subsp. paratuberculosis
gagcggcccagcucggugauc

SEQ ID NO: 3027185 - RNA, 13 nt, Mycobacterium avium subsp. paratuberculosis
gagcggcccgucg

SEQ ID NO: 3027186 - RNA, 23 nt, Mycobacterium avium subsp. paratuberculosis
gagcggcgacuccagcagcgcca

SEQ ID NO: 3027187 - RNA, 13 nt, Mycobacterium avium subsp. paratuberculosis
gagcggcgccacg

SEQ ID NO: 3027188 - RNA, 20 nt, Mycobacterium avium subsp. paratuberculosis
gagcggcgccacguggucga

SEQ ID NO: 3027189 - RNA, 16 nt, Mycobacterium avium subsp. paratuberculosis
gagcggcgcugcagca

SEQ ID NO: 3027190 - RNA, 18 nt, Mycobacterium avium subsp. paratuberculosis
gagcggcgcugcagcagc

SEQ ID NO: 3027191 - RNA, 21 nt, Mycobacterium avium subsp. paratuberculosis
gagcggcgcugcagcagcccg

SEQ ID NO: 3027192 - RNA, 16 nt, Mycobacterium avium subsp. paratuberculosis
gagcggcggucacgaa

SEQ ID NO: 3027193 - RNA, 18 nt, Mycobacterium avium subsp. paratuberculosis
gagcgggaccgaggugcc

SEQ ID NO: 3027194 - RNA, 14 nt, Mycobacterium avium subsp. paratuberculosis
gagcgggacgcgca

SEQ ID NO: 3027195 - RNA, 23 nt, Mycobacterium avium subsp. paratuberculosis
gagcgggacgcgcagaucgucga

SEQ ID NO: 3027196 - RNA, 14 nt, Mycobacterium avium subsp. paratuberculosis
gagcgggaucccca

SEQ ID NO: 3027197 - RNA, 16 nt, Mycobacterium avium subsp. paratuberculosis
gagcgggaucccgcag

SEQ ID NO: 3027198 - RNA, 21 nt, Mycobacterium avium subsp. paratuberculosis
gagcgggaucccgcagccgcg

SEQ ID NO: 3027199 - RNA, 22 nt, Mycobacterium avium subsp. paratuberculosis
gagcgggaucccgcagccgcga

SEQ ID NO: 3027200 - RNA, 23 nt, Mycobacterium avium subsp. paratuberculosis
gagcgggaucccgcagccgcgac

SEQ ID NO: 3027201 - RNA, 16 nt, Mycobacterium avium subsp. paratuberculosis
gagcgggcacgccgcc

SEQ ID NO: 3027202 - RNA, 20 nt, Mycobacterium avium subsp. paratuberculosis
gagcgggcacgccgccgcga

SEQ ID NO: 3027203 - RNA, 13 nt, Mycobacterium avium subsp. paratuberculosis
gagcgggccacgc

SEQ ID NO: 3027204 - RNA, 15 nt, Mycobacterium avium subsp. paratuberculosis
gagcgggccgaccgu

SEQ ID NO: 3027205 - RNA, 16 nt, Mycobacterium avium subsp. paratuberculosis
gagcgggcgaucucga

SEQ ID NO: 3027206 - RNA, 20 nt, Mycobacterium avium subsp. paratuberculosis
gagcgggguguggcugucgg

SEQ ID NO: 3027207 - RNA, 17 nt, Mycobacterium avium subsp. paratuberculosis
gagcggguaaccgcagc

SEQ ID NO: 3027208 - RNA, 17 nt, Mycobacterium avium subsp. paratuberculosis
gagcggguccgccccga

SEQ ID NO: 3027209 - RNA, 14 nt, Mycobacterium avium subsp. paratuberculosis
gagcgggucggccg

SEQ ID NO: 3027210 - RNA, 14 nt, Mycobacterium avium subsp. paratuberculosis
gagcgggucgucgu

SEQ ID NO: 3027211 - RNA, 14 nt, Mycobacterium avium subsp. paratuberculosis
gagcggugacaucg

SEQ ID NO: 3027212 - RNA, 17 nt, Mycobacterium avium subsp. paratuberculosis
gagcggugacaucgcca

SEQ ID NO: 3027213 - RNA, 20 nt, Mycobacterium avium subsp. paratuberculosis
gagcggugacaucgccaccu

SEQ ID NO: 3027214 - RNA, 14 nt, Mycobacterium avium subsp. paratuberculosis
gagcggugaccucg

SEQ ID NO: 3027215 - RNA, 18 nt, Mycobacterium avium subsp. paratuberculosis
gagcggugaccucgagca

SEQ ID NO: 3027216 - RNA, 13 nt, Mycobacterium avium subsp. paratuberculosis
gagcggugcggcu

SEQ ID NO: 3027217 - RNA, 23 nt, Mycobacterium avium subsp. paratuberculosis
gagcggugucgcuuugcggcgaa

SEQ ID NO: 3027218 - RNA, 16 nt, Mycobacterium avium subsp. paratuberculosis
gagcgguuggcgacgc

SEQ ID NO: 3027219 - RNA, 20 nt, Mycobacterium avium subsp. paratuberculosis
gagcguagcccuaccggcuc

SEQ ID NO: 3027220 - RNA, 23 nt, Mycobacterium avium subsp. paratuberculosis
gagcguagcccuaccggcucggc

SEQ ID NO: 3027221 - RNA, 12 nt, Mycobacterium avium subsp. paratuberculosis
gagcgucacgcc

SEQ ID NO: 3027222 - RNA, 16 nt, Mycobacterium avium subsp. paratuberculosis
gagcgucacgccagcg

SEQ ID NO: 3027223 - RNA, 20 nt, Mycobacterium avium subsp. paratuberculosis
gagcgucacgccaguguggc

SEQ ID NO: 3027224 - RNA, 18 nt, Mycobacterium avium subsp. paratuberculosis
gagcgucacgccgcgccc

SEQ ID NO: 3027225 - RNA, 12 nt, Mycobacterium avium subsp. paratuberculosis
gagcgucacgcu

SEQ ID NO: 3027226 - RNA, 20 nt, Mycobacterium avium subsp. paratuberculosis
gagcgucacgcuagcgugac

SEQ ID NO: 3027227 - RNA, 21 nt, Mycobacterium avium subsp. paratuberculosis
gagcgucacgcuagcgugaca

SEQ ID NO: 3027228 - RNA, 13 nt, Mycobacterium avium subsp. paratuberculosis
gagcgucacgcug

SEQ ID NO: 3027229 - RNA, 20 nt, Mycobacterium avium subsp. paratuberculosis
gagcgucacgcuggcgugac

SEQ ID NO: 3027230 - RNA, 21 nt, Mycobacterium avium subsp. paratuberculosis
gagcgucacgcuggcgugaca

SEQ ID NO: 3027231 - RNA, 21 nt, Mycobacterium avium subsp. paratuberculosis
gagcgucacgcuggcgugacg

SEQ ID NO: 3027232 - RNA, 19 nt, Mycobacterium avium subsp. paratuberculosis
gagcgucauuccgccgcgc

SEQ ID NO: 3027233 - RNA, 13 nt, Mycobacterium avium subsp. paratuberculosis
gagcgucgccacc

SEQ ID NO: 3027234 - RNA, 12 nt, Mycobacterium avium subsp. paratuberculosis
gagcgucgugcg

SEQ ID NO: 3027235 - RNA, 13 nt, Mycobacterium avium subsp. paratuberculosis
gagcgugaaacua

SEQ ID NO: 3027236 - RNA, 20 nt, Mycobacterium avium subsp. paratuberculosis
gagcgugaagcuagcuucac

SEQ ID NO: 3027237 - RNA, 16 nt, Mycobacterium avium subsp. paratuberculosis
gagcguggacaccgca

SEQ ID NO: 3027238 - RNA, 17 nt, Mycobacterium avium subsp. paratuberculosis
gagcguggacaccgcac

SEQ ID NO: 3027239 - RNA, 17 nt, Mycobacterium avium subsp. paratuberculosis
gagcgugggcccuaggu

SEQ ID NO: 3027240 - RNA, 14 nt, Mycobacterium avium subsp. paratuberculosis
gagcguuccagcuu

SEQ ID NO: 3027241 - RNA, 21 nt, Mycobacterium avium subsp. paratuberculosis
gagcguuccagguucagcccg

SEQ ID NO: 3027242 - RNA, 23 nt, Mycobacterium avium subsp. paratuberculosis
gagcguuccagguucagcccggc

SEQ ID NO: 3027243 - RNA, 19 nt, Mycobacterium avium subsp. paratuberculosis
gagcguuccuuacgccgac

SEQ ID NO: 3027244 - RNA, 20 nt, Mycobacterium avium subsp. paratuberculosis
gagcguuccuuacgccgacg

SEQ ID NO: 3027245 - RNA, 23 nt, Mycobacterium avium subsp. paratuberculosis
gagcguuccuuacgccgacguca

SEQ ID NO: 3027246 - RNA, 16 nt, Mycobacterium avium subsp. paratuberculosis
gagcguucuccacccg

SEQ ID NO: 3027247 - RNA, 21 nt, Mycobacterium avium subsp. paratuberculosis
gagcuacugcugguagacccg

SEQ ID NO: 3027248 - RNA, 23 nt, Mycobacterium avium subsp. paratuberculosis
gagcuacugcugguagacccggg

SEQ ID NO: 3027249 - RNA, 14 nt, Mycobacterium avium subsp. paratuberculosis
gagcuaggcggccg

SEQ ID NO: 3027250 - RNA, 19 nt, Mycobacterium avium subsp. paratuberculosis
gagcuaggcggccgggcgg

SEQ ID NO: 3027251 - RNA, 24 nt, Mycobacterium avium subsp. paratuberculosis
gagcuaggcggccgggcggccgga

SEQ ID NO: 3027252 - RNA, 16 nt, Mycobacterium avium subsp. paratuberculosis
gagcuaggucaccgga

SEQ ID NO: 3027253 - RNA, 15 nt, Mycobacterium avium subsp. paratuberculosis
gagcuaucagcucgc

SEQ ID NO: 3027254 - RNA, 15 nt, Mycobacterium avium subsp. paratuberculosis
gagcucaaccggucc

SEQ ID NO: 3027255 - RNA, 22 nt, Mycobacterium avium subsp. paratuberculosis
gagcucaccgacaagggccggg

SEQ ID NO: 3027256 - RNA, 14 nt, Mycobacterium avium subsp. paratuberculosis
gagcucaccgccga

SEQ ID NO: 3027257 - RNA, 17 nt, Mycobacterium avium subsp. paratuberculosis
gagcucaccgccgauga

SEQ ID NO: 3027258 - RNA, 15 nt, Mycobacterium avium subsp. paratuberculosis
gagcucaggccggcc

SEQ ID NO: 3027259 - RNA, 17 nt, Mycobacterium avium subsp. paratuberculosis
gagcucaggccggccuu

SEQ ID NO: 3027260 - RNA, 16 nt, Mycobacterium avium subsp. paratuberculosis
gagcuccucggccagc

SEQ ID NO: 3027261 - RNA, 17 nt, Mycobacterium avium subsp. paratuberculosis
gagcuccucggccagcg

SEQ ID NO: 3027262 - RNA, 17 nt, Mycobacterium avium subsp. paratuberculosis
gagcucgaagcccaggg

SEQ ID NO: 3027263 - RNA, 12 nt, Mycobacterium avium subsp. paratuberculosis
gagcucgauguc

SEQ ID NO: 3027264 - RNA, 14 nt, Mycobacterium avium subsp. paratuberculosis
gagcucgcagucga

SEQ ID NO: 3027265 - RNA, 20 nt, Mycobacterium avium subsp. paratuberculosis
gagcucgcgcugcaugccgg

SEQ ID NO: 3027266 - RNA, 17 nt, Mycobacterium avium subsp. paratuberculosis
gagcucgcggcgcagcu

SEQ ID NO: 3027267 - RNA, 20 nt, Mycobacterium avium subsp. paratuberculosis
gagcucgcggcgcagcucgc

SEQ ID NO: 3027268 - RNA, 22 nt, Mycobacterium avium subsp. paratuberculosis
gagcucgcggcgcagcucgcgc

SEQ ID NO: 3027269 - RNA, 16 nt, Mycobacterium avium subsp. paratuberculosis
gagcucggccaccagc

SEQ ID NO: 3027270 - RNA, 20 nt, Mycobacterium avium subsp. paratuberculosis
gagcucggccaccagcgccc

SEQ ID NO: 3027271 - RNA, 20 nt, Mycobacterium avium subsp. paratuberculosis
gagcucggccuugagccggu

SEQ ID NO: 3027272 - RNA, 21 nt, Mycobacterium avium subsp. paratuberculosis
gagcucggcgaggucguucga

SEQ ID NO: 3027273 - RNA, 23 nt, Mycobacterium avium subsp. paratuberculosis
gagcucgggcgcgaacagcgccg

SEQ ID NO: 3027274 - RNA, 23 nt, Mycobacterium avium subsp. paratuberculosis
gagcucgucggguguggcgccgu

SEQ ID NO: 3027275 - RNA, 23 nt, Mycobacterium avium subsp. paratuberculosis
gagcucgugaugguccagcaccg

SEQ ID NO: 3027276 - RNA, 16 nt, Mycobacterium avium subsp. paratuberculosis
gagcucguucucggcg

SEQ ID NO: 3027277 - RNA, 18 nt, Mycobacterium avium subsp. paratuberculosis
gagcucguucucggcgaa

SEQ ID NO: 3027278 - RNA, 22 nt, Mycobacterium avium subsp. paratuberculosis
gagcucugguuuuacacaccag

SEQ ID NO: 3027279 - RNA, 18 nt, Mycobacterium avium subsp. paratuberculosis
gagcugaaguucaccacc

SEQ ID NO: 3027280 - RNA, 20 nt, Mycobacterium avium subsp. paratuberculosis
gagcugaaguucaccaccgc

SEQ ID NO: 3027281 - RNA, 22 nt, Mycobacterium avium subsp. paratuberculosis
gagcugaaguucaccaccgcgc

SEQ ID NO: 3027282 - RNA, 24 nt, Mycobacterium avium subsp. paratuberculosis
gagcugaaguucaccaccgcgcug

SEQ ID NO: 3027283 - RNA, 15 nt, Mycobacterium avium subsp. paratuberculosis
gagcugacacccgac

SEQ ID NO: 3027284 - RNA, 23 nt, Mycobacterium avium subsp. paratuberculosis
gagcugacacccgacgaagccgc

SEQ ID NO: 3027285 - RNA, 17 nt, Mycobacterium avium subsp. paratuberculosis
gagcugaccuggcugac

SEQ ID NO: 3027286 - RNA, 16 nt, Mycobacterium avium subsp. paratuberculosis
gagcugacggccauga

SEQ ID NO: 3027287 - RNA, 23 nt, Mycobacterium avium subsp. paratuberculosis
gagcugacgggaccgcacgccgg

SEQ ID NO: 3027288 - RNA, 17 nt, Mycobacterium avium subsp. paratuberculosis
gagcugaucgcggccgg

SEQ ID NO: 3027289 - RNA, 18 nt, Mycobacterium avium subsp. paratuberculosis
gagcugaucgcggccggc

SEQ ID NO: 3027290 - RNA, 19 nt, Mycobacterium avium subsp. paratuberculosis
gagcugaucgcggccggcg

SEQ ID NO: 3027291 - RNA, 22 nt, Mycobacterium avium subsp. paratuberculosis
gagcugaucgcggccggcgagu

SEQ ID NO: 3027292 - RNA, 20 nt, Mycobacterium avium subsp. paratuberculosis
gagcugaucgcgucgacggc

SEQ ID NO: 3027293 - RNA, 22 nt, Mycobacterium avium subsp. paratuberculosis
gagcugaucgcgucgacggcgc

SEQ ID NO: 3027294 - RNA, 14 nt, Mycobacterium avium subsp. paratuberculosis
gagcugaucggcgu

SEQ ID NO: 3027295 - RNA, 15 nt, Mycobacterium avium subsp. paratuberculosis
gagcugaucggcguu

SEQ ID NO: 3027296 - RNA, 22 nt, Mycobacterium avium subsp. paratuberculosis
gagcugcaccggguacaccggc

SEQ ID NO: 3027297 - RNA, 23 nt, Mycobacterium avium subsp. paratuberculosis
gagcugcaccggguacaccggcu

SEQ ID NO: 3027298 - RNA, 19 nt, Mycobacterium avium subsp. paratuberculosis
gagcugccccuucgcgaca

SEQ ID NO: 3027299 - RNA, 23 nt, Mycobacterium avium subsp. paratuberculosis
gagcugccccuucgcgacacugc

SEQ ID NO: 3027300 - RNA, 17 nt, Mycobacterium avium subsp. paratuberculosis
gagcugcccgcacuggu

SEQ ID NO: 3027301 - RNA, 22 nt, Mycobacterium avium subsp. paratuberculosis
gagcugccggcgaccagccccu

SEQ ID NO: 3027302 - RNA, 14 nt, Mycobacterium avium subsp. paratuberculosis
gagcugccggcggc

SEQ ID NO: 3027303 - RNA, 20 nt, Mycobacterium avium subsp. paratuberculosis
gagcugccggcggccgccgg

SEQ ID NO: 3027304 - RNA, 13 nt, Mycobacterium avium subsp. paratuberculosis
gagcugcgcccac

SEQ ID NO: 3027305 - RNA, 16 nt, Mycobacterium avium subsp. paratuberculosis
gagcugcgcgccccgg

SEQ ID NO: 3027306 - RNA, 22 nt, Mycobacterium avium subsp. paratuberculosis
gagcugcgcgccccggcccggc

SEQ ID NO: 3027307 - RNA, 15 nt, Mycobacterium avium subsp. paratuberculosis
gagcugcugccgccg

SEQ ID NO: 3027308 - RNA, 22 nt, Mycobacterium avium subsp. paratuberculosis
gagcugcugccgccgcagcagc

SEQ ID NO: 3027309 - RNA, 23 nt, Mycobacterium avium subsp. paratuberculosis
gagcugcugccgccgcagcagcc

SEQ ID NO: 3027310 - RNA, 19 nt, Mycobacterium avium subsp. paratuberculosis
gagcugcuucgucgccggg

SEQ ID NO: 3027311 - RNA, 15 nt, Mycobacterium avium subsp. paratuberculosis
gagcuggccgcccac

SEQ ID NO: 3027312 - RNA, 18 nt, Mycobacterium avium subsp. paratuberculosis
gagcuggccgcgcagcgu

SEQ ID NO: 3027313 - RNA, 14 nt, Mycobacterium avium subsp. paratuberculosis
gagcugggcccgcg

SEQ ID NO: 3027314 - RNA, 13 nt, Mycobacterium avium subsp. paratuberculosis
gagcugggccggc

SEQ ID NO: 3027315 - RNA, 16 nt, Mycobacterium avium subsp. paratuberculosis
gagcugggccggcgcc

SEQ ID NO: 3027316 - RNA, 13 nt, Mycobacterium avium subsp. paratuberculosis
gagcugggcggcg

SEQ ID NO: 3027317 - RNA, 14 nt, Mycobacterium avium subsp. paratuberculosis
gagcugggcggcgc

SEQ ID NO: 3027318 - RNA, 17 nt, Mycobacterium avium subsp. paratuberculosis
gagcugggcggcgcgcu

SEQ ID NO: 3027319 - RNA, 18 nt, Mycobacterium avium subsp. paratuberculosis
gagcuggugggccaucgc

SEQ ID NO: 3027320 - RNA, 20 nt, Mycobacterium avium subsp. paratuberculosis
gagcuggugggccaucgcca

SEQ ID NO: 3027321 - RNA, 22 nt, Mycobacterium avium subsp. paratuberculosis
gagcuggugggccaucgccagg

SEQ ID NO: 3027322 - RNA, 15 nt, Mycobacterium avium subsp. paratuberculosis
gagcugucggugacg

SEQ ID NO: 3027323 - RNA, 14 nt, Mycobacterium avium subsp. paratuberculosis
gagcugugccgcgg

SEQ ID NO: 3027324 - RNA, 22 nt, Mycobacterium avium subsp. paratuberculosis
gagcugugccgcggugcggccc

SEQ ID NO: 3027325 - RNA, 14 nt, Mycobacterium avium subsp. paratuberculosis
gagcuucccggcgg

SEQ ID NO: 3027326 - RNA, 15 nt, Mycobacterium avium subsp. paratuberculosis
gagcuucccggcggu

SEQ ID NO: 3027327 - RNA, 14 nt, Mycobacterium avium subsp. paratuberculosis
gagcuuccgccgag

SEQ ID NO: 3027328 - RNA, 21 nt, Mycobacterium avium subsp. paratuberculosis
gagcuucucggugaucacccg

SEQ ID NO: 3027329 - RNA, 15 nt, Mycobacterium avium subsp. paratuberculosis
gagcuucugcccggc

SEQ ID NO: 3027330 - RNA, 16 nt, Mycobacterium avium subsp. paratuberculosis
gagcuugccuugcgcc

SEQ ID NO: 3027331 - RNA, 18 nt, Mycobacterium avium subsp. paratuberculosis
gagcuuggcgggcgucac

SEQ ID NO: 3027332 - RNA, 15 nt, Mycobacterium avium subsp. paratuberculosis
gagcuugggccggug

SEQ ID NO: 3027333 - RNA, 22 nt, Mycobacterium avium subsp. paratuberculosis
gagcuugggccggugcagcacg

SEQ ID NO: 3027334 - RNA, 21 nt, Mycobacterium avium subsp. paratuberculosis
gagcuuuucgucggugcgcgc

SEQ ID NO: 3027335 - RNA, 13 nt, Mycobacterium avium subsp. paratuberculosis
gaggaacccgacc

SEQ ID NO: 3027336 - RNA, 16 nt, Mycobacterium avium subsp. paratuberculosis
gaggaacccgaccgcg

SEQ ID NO: 3027337 - RNA, 21 nt, Mycobacterium avium subsp. paratuberculosis
gaggaacccgaccgcgaugca

SEQ ID NO: 3027338 - RNA, 15 nt, Mycobacterium avium subsp. paratuberculosis
gaggaacucagcgcc

SEQ ID NO: 3027339 - RNA, 21 nt, Mycobacterium avium subsp. paratuberculosis
gaggaacucagcgcccaggau

SEQ ID NO: 3027340 - RNA, 14 nt, Mycobacterium avium subsp. paratuberculosis
gaggaagacgucga

SEQ ID NO: 3027341 - RNA, 15 nt, Mycobacterium avium subsp. paratuberculosis
gaggaauucgccgac

SEQ ID NO: 3027342 - RNA, 13 nt, Mycobacterium avium subsp. paratuberculosis
gaggacaccacga

SEQ ID NO: 3027343 - RNA, 14 nt, Mycobacterium avium subsp. paratuberculosis
gaggacaccacgau

SEQ ID NO: 3027344 - RNA, 19 nt, Mycobacterium avium subsp. paratuberculosis
gaggacacguuggccagau

SEQ ID NO: 3027345 - RNA, 13 nt, Mycobacterium avium subsp. paratuberculosis
gaggacagcaccg

SEQ ID NO: 3027346 - RNA, 19 nt, Mycobacterium avium subsp. paratuberculosis
gaggacagggaggacagca

SEQ ID NO: 3027347 - RNA, 14 nt, Mycobacterium avium subsp. paratuberculosis
gaggaccgagauga

SEQ ID NO: 3027348 - RNA, 19 nt, Mycobacterium avium subsp. paratuberculosis
gaggacgucgagcggcgcc

SEQ ID NO: 3027349 - RNA, 13 nt, Mycobacterium avium subsp. paratuberculosis
gaggaggggucgg

SEQ ID NO: 3027350 - RNA, 15 nt, Mycobacterium avium subsp. paratuberculosis
gaggaggggucggug

SEQ ID NO: 3027351 - RNA, 21 nt, Mycobacterium avium subsp. paratuberculosis
gaggagguuuugcguggucua

SEQ ID NO: 3027352 - RNA, 20 nt, Mycobacterium avium subsp. paratuberculosis
gaggagucgggaaaucggac

SEQ ID NO: 3027353 - RNA, 13 nt, Mycobacterium avium subsp. paratuberculosis
gaggagucgggca

SEQ ID NO: 3027354 - RNA, 19 nt, Mycobacterium avium subsp. paratuberculosis
gaggaucgcaggauggccu

SEQ ID NO: 3027355 - RNA, 16 nt, Mycobacterium avium subsp. paratuberculosis
gaggaucgcggccacg

SEQ ID NO: 3027356 - RNA, 17 nt, Mycobacterium avium subsp. paratuberculosis
gaggaucgcggccacgc

SEQ ID NO: 3027357 - RNA, 19 nt, Mycobacterium avium subsp. paratuberculosis
gaggaucugcacgucggcg

SEQ ID NO: 3027358 - RNA, 23 nt, Mycobacterium avium subsp. paratuberculosis
gaggaucugcacgucggcggccg

SEQ ID NO: 3027359 - RNA, 20 nt, Mycobacterium avium subsp. paratuberculosis
gaggaucugggcggcgggac

SEQ ID NO: 3027360 - RNA, 21 nt, Mycobacterium avium subsp. paratuberculosis
gaggaucugggcggcgggacg

SEQ ID NO: 3027361 - RNA, 23 nt, Mycobacterium avium subsp. paratuberculosis
gaggaugacgacggucaccggca

SEQ ID NO: 3027362 - RNA, 17 nt, Mycobacterium avium subsp. paratuberculosis
gaggaugcgcaccacgc

SEQ ID NO: 3027363 - RNA, 24 nt, Mycobacterium avium subsp. paratuberculosis
gaggaugcgcaccacgcccgacga

SEQ ID NO: 3027364 - RNA, 15 nt, Mycobacterium avium subsp. paratuberculosis
gaggauggggucgcg

SEQ ID NO: 3027365 - RNA, 21 nt, Mycobacterium avium subsp. paratuberculosis
gaggauggggucgcgggcgcc

SEQ ID NO: 3027366 - RNA, 14 nt, Mycobacterium avium subsp. paratuberculosis
gaggauuucgcgau

SEQ ID NO: 3027367 - RNA, 11 nt, Mycobacterium avium subsp. paratuberculosis
gaggcacccgc

SEQ ID NO: 3027368 - RNA, 19 nt, Mycobacterium avium subsp. paratuberculosis
gaggcacccgcugcaccag

SEQ ID NO: 3027369 - RNA, 20 nt, Mycobacterium avium subsp. paratuberculosis
gaggcacccgcugcaccagc

SEQ ID NO: 3027370 - RNA, 21 nt, Mycobacterium avium subsp. paratuberculosis
gaggcacccgcugcaccagcc

SEQ ID NO: 3027371 - RNA, 21 nt, Mycobacterium avium subsp. paratuberculosis
gaggcaccgaacgccagcagc

SEQ ID NO: 3027372 - RNA, 18 nt, Mycobacterium avium subsp. paratuberculosis
gaggcacggcccgcucgg

SEQ ID NO: 3027373 - RNA, 13 nt, Mycobacterium avium subsp. paratuberculosis
gaggcacuggcgc

SEQ ID NO: 3027374 - RNA, 12 nt, Mycobacterium avium subsp. paratuberculosis
gaggcagcgcgg

SEQ ID NO: 3027375 - RNA, 13 nt, Mycobacterium avium subsp. paratuberculosis
gaggcagcgcgga

SEQ ID NO: 3027376 - RNA, 20 nt, Mycobacterium avium subsp. paratuberculosis
gaggcagcgcggauuccagc

SEQ ID NO: 3027377 - RNA, 17 nt, Mycobacterium avium subsp. paratuberculosis
gaggcaguuccaugucg

SEQ ID NO: 3027378 - RNA, 22 nt, Mycobacterium avium subsp. paratuberculosis
gaggcaguuccaugucgacgac

SEQ ID NO: 3027379 - RNA, 17 nt, Mycobacterium avium subsp. paratuberculosis
gaggccaacgagcgcgc

SEQ ID NO: 3027380 - RNA, 19 nt, Mycobacterium avium subsp. paratuberculosis
gaggccaacgagcgcgccg

SEQ ID NO: 3027381 - RNA, 15 nt, Mycobacterium avium subsp. paratuberculosis
gaggccaacucgcga

SEQ ID NO: 3027382 - RNA, 16 nt, Mycobacterium avium subsp. paratuberculosis
gaggccaccgcgccgu

SEQ ID NO: 3027383 - RNA, 18 nt, Mycobacterium avium subsp. paratuberculosis
gaggccaccgcgccgucu

SEQ ID NO: 3027384 - RNA, 11 nt, Mycobacterium avium subsp. paratuberculosis
gaggccagcac

SEQ ID NO: 3027385 - RNA, 14 nt, Mycobacterium avium subsp. paratuberculosis
gaggccagcacccg

SEQ ID NO: 3027386 - RNA, 16 nt, Mycobacterium avium subsp. paratuberculosis
gaggccagcacgccgg

SEQ ID NO: 3027387 - RNA, 13 nt, Mycobacterium avium subsp. paratuberculosis
gaggccagcgcga

SEQ ID NO: 3027388 - RNA, 16 nt, Mycobacterium avium subsp. paratuberculosis
gaggccagcgcgaucg

SEQ ID NO: 3027389 - RNA, 19 nt, Mycobacterium avium subsp. paratuberculosis
gaggccagcucgaccgcgg

SEQ ID NO: 3027390 - RNA, 16 nt, Mycobacterium avium subsp. paratuberculosis
gaggccagcugcaccg

SEQ ID NO: 3027391 - RNA, 18 nt, Mycobacterium avium subsp. paratuberculosis
gaggccagcugcaccggg

SEQ ID NO: 3027392 - RNA, 20 nt, Mycobacterium avium subsp. paratuberculosis
gaggccagcugcaccggggc

SEQ ID NO: 3027393 - RNA, 11 nt, Mycobacterium avium subsp. paratuberculosis
gaggccaggcg

SEQ ID NO: 3027394 - RNA, 12 nt, Mycobacterium avium subsp. paratuberculosis
gaggccaggcgu

SEQ ID NO: 3027395 - RNA, 19 nt, Mycobacterium avium subsp. paratuberculosis
gaggccagggcccgcagcc

SEQ ID NO: 3027396 - RNA, 21 nt, Mycobacterium avium subsp. paratuberculosis
gaggccagggcccgcagccgc

SEQ ID NO: 3027397 - RNA, 19 nt, Mycobacterium avium subsp. paratuberculosis
gaggcccacguugagcacg

SEQ ID NO: 3027398 - RNA, 13 nt, Mycobacterium avium subsp. paratuberculosis
gaggcccagcccg

SEQ ID NO: 3027399 - RNA, 15 nt, Mycobacterium avium subsp. paratuberculosis
gaggcccagcccgcc

SEQ ID NO: 3027400 - RNA, 22 nt, Mycobacterium avium subsp. paratuberculosis
gaggccccgcgugacggccgcg

SEQ ID NO: 3027401 - RNA, 15 nt, Mycobacterium avium subsp. paratuberculosis
gaggcccggacggcc

SEQ ID NO: 3027402 - RNA, 19 nt, Mycobacterium avium subsp. paratuberculosis
gaggcccggcagccggggu

SEQ ID NO: 3027403 - RNA, 12 nt, Mycobacterium avium subsp. paratuberculosis
gaggccgagguc

SEQ ID NO: 3027404 - RNA, 15 nt, Mycobacterium avium subsp. paratuberculosis
gaggccgccccggcc

SEQ ID NO: 3027405 - RNA, 17 nt, Mycobacterium avium subsp. paratuberculosis
gaggccgccccggccgc

SEQ ID NO: 3027406 - RNA, 13 nt, Mycobacterium avium subsp. paratuberculosis
gaggccgcccgcu

SEQ ID NO: 3027407 - RNA, 16 nt, Mycobacterium avium subsp. paratuberculosis
gaggccgcgccgugcg

SEQ ID NO: 3027408 - RNA, 15 nt, Mycobacterium avium subsp. paratuberculosis
gaggccgcggcgaca

SEQ ID NO: 3027409 - RNA, 21 nt, Mycobacterium avium subsp. paratuberculosis
gaggccgcgggcguucaucac

SEQ ID NO: 3027410 - RNA, 14 nt, Mycobacterium avium subsp. paratuberculosis
gaggccggccagcg

SEQ ID NO: 3027411 - RNA, 15 nt, Mycobacterium avium subsp. paratuberculosis
gaggccgggcuggcg

SEQ ID NO: 3027412 - RNA, 16 nt, Mycobacterium avium subsp. paratuberculosis
gaggccgggcuggcgc

SEQ ID NO: 3027413 - RNA, 20 nt, Mycobacterium avium subsp. paratuberculosis
gaggccguaucccaccacga

SEQ ID NO: 3027414 - RNA, 21 nt, Mycobacterium avium subsp. paratuberculosis
gaggccguaucccaccacgaa

SEQ ID NO: 3027415 - RNA, 14 nt, Mycobacterium avium subsp. paratuberculosis
gaggccuccaggcu

SEQ ID NO: 3027416 - RNA, 13 nt, Mycobacterium avium subsp. paratuberculosis
gaggccucgccgc

SEQ ID NO: 3027417 - RNA, 14 nt, Mycobacterium avium subsp. paratuberculosis
gaggccucgccgcu

SEQ ID NO: 3027418 - RNA, 13 nt, Mycobacterium avium subsp. paratuberculosis
gaggccugcgcgg

SEQ ID NO: 3027419 - RNA, 15 nt, Mycobacterium avium subsp. paratuberculosis
gaggccugcgcggcc

SEQ ID NO: 3027420 - RNA, 16 nt, Mycobacterium avium subsp. paratuberculosis
gaggccugcgcggccg

SEQ ID NO: 3027421 - RNA, 20 nt, Mycobacterium avium subsp. paratuberculosis
gaggccugcgcggccgcguc

SEQ ID NO: 3027422 - RNA, 21 nt, Mycobacterium avium subsp. paratuberculosis
gaggccugcgcggccgcgucg

SEQ ID NO: 3027423 - RNA, 19 nt, Mycobacterium avium subsp. paratuberculosis
gaggcgaagguggcgucgg

SEQ ID NO: 3027424 - RNA, 14 nt, Mycobacterium avium subsp. paratuberculosis
gaggcgaaugcggc

SEQ ID NO: 3027425 - RNA, 19 nt, Mycobacterium avium subsp. paratuberculosis
gaggcgaaugcggccaugu

SEQ ID NO: 3027426 - RNA, 14 nt, Mycobacterium avium subsp. paratuberculosis
gaggcgacccccgg

SEQ ID NO: 3027427 - RNA, 18 nt, Mycobacterium avium subsp. paratuberculosis
gaggcgacccccgguguc

SEQ ID NO: 3027428 - RNA, 16 nt, Mycobacterium avium subsp. paratuberculosis
gaggcgacgucgaacg

SEQ ID NO: 3027429 - RNA, 14 nt, Mycobacterium avium subsp. paratuberculosis
gaggcgagcaauua

SEQ ID NO: 3027430 - RNA, 21 nt, Mycobacterium avium subsp. paratuberculosis
gaggcgagcaauuaaccggca

SEQ ID NO: 3027431 - RNA, 14 nt, Mycobacterium avium subsp. paratuberculosis
gaggcgagcagccg

SEQ ID NO: 3027432 - RNA, 16 nt, Mycobacterium avium subsp. paratuberculosis
gaggcgagcagccggg

SEQ ID NO: 3027433 - RNA, 21 nt, Mycobacterium avium subsp. paratuberculosis
gaggcgaguaaggccgaggcg

SEQ ID NO: 3027434 - RNA, 16 nt, Mycobacterium avium subsp. paratuberculosis
gaggcgagugaggacg

SEQ ID NO: 3027435 - RNA, 20 nt, Mycobacterium avium subsp. paratuberculosis
gaggcgagugaggacgaggc

SEQ ID NO: 3027436 - RNA, 17 nt, Mycobacterium avium subsp. paratuberculosis
gaggcgaucaucgcccc

SEQ ID NO: 3027437 - RNA, 20 nt, Mycobacterium avium subsp. paratuberculosis
gaggcgaucaucgccccgga

SEQ ID NO: 3027438 - RNA, 21 nt, Mycobacterium avium subsp. paratuberculosis
gaggcgauggugcccucgugg

SEQ ID NO: 3027439 - RNA, 17 nt, Mycobacterium avium subsp. paratuberculosis
gaggcgcaggaggcggc

SEQ ID NO: 3027440 - RNA, 22 nt, Mycobacterium avium subsp. paratuberculosis
gaggcgcaggaggcggccaaca

SEQ ID NO: 3027441 - RNA, 23 nt, Mycobacterium avium subsp. paratuberculosis
gaggcgccacaacuggucgugcu

SEQ ID NO: 3027442 - RNA, 20 nt, Mycobacterium avium subsp. paratuberculosis
gaggcgccguauuggcaggc

SEQ ID NO: 3027443 - RNA, 21 nt, Mycobacterium avium subsp. paratuberculosis
gaggcgccguauuggcaggcg

SEQ ID NO: 3027444 - RNA, 14 nt, Mycobacterium avium subsp. paratuberculosis
gaggcgcggcgcga

SEQ ID NO: 3027445 - RNA, 14 nt, Mycobacterium avium subsp. paratuberculosis
gaggcgcggggcgc

SEQ ID NO: 3027446 - RNA, 15 nt, Mycobacterium avium subsp. paratuberculosis
gaggcgcggggcgcg

SEQ ID NO: 3027447 - RNA, 22 nt, Mycobacterium avium subsp. paratuberculosis
gaggcgcucgcacaacccgccc

SEQ ID NO: 3027448 - RNA, 14 nt, Mycobacterium avium subsp. paratuberculosis
gaggcgcucggccc

SEQ ID NO: 3027449 - RNA, 17 nt, Mycobacterium avium subsp. paratuberculosis
gaggcgcucggcccgcu

SEQ ID NO: 3027450 - RNA, 16 nt, Mycobacterium avium subsp. paratuberculosis
gaggcggccagcggca

SEQ ID NO: 3027451 - RNA, 20 nt, Mycobacterium avium subsp. paratuberculosis
gaggcggcguagucgccggu

SEQ ID NO: 3027452 - RNA, 19 nt, Mycobacterium avium subsp. paratuberculosis
gaggcggcguagucggcgc

SEQ ID NO: 3027453 - RNA, 13 nt, Mycobacterium avium subsp. paratuberculosis
gaggcgggcgauc

SEQ ID NO: 3027454 - RNA, 14 nt, Mycobacterium avium subsp. paratuberculosis
gaggcgggcgaucu

SEQ ID NO: 3027455 - RNA, 18 nt, Mycobacterium avium subsp. paratuberculosis
gaggcggguaggcgucgc

SEQ ID NO: 3027456 - RNA, 17 nt, Mycobacterium avium subsp. paratuberculosis
gaggcgggugaggacgc

SEQ ID NO: 3027457 - RNA, 22 nt, Mycobacterium avium subsp. paratuberculosis
gaggcgggugaggacgcccggc

SEQ ID NO: 3027458 - RNA, 22 nt, Mycobacterium avium subsp. paratuberculosis
gaggcggguguauucgcccacc

SEQ ID NO: 3027459 - RNA, 23 nt, Mycobacterium avium subsp. paratuberculosis
gaggcggguguauucgcccaccc

SEQ ID NO: 3027460 - RNA, 16 nt, Mycobacterium avium subsp. paratuberculosis
gaggcgguggugaugg

SEQ ID NO: 3027461 - RNA, 17 nt, Mycobacterium avium subsp. paratuberculosis
gaggcgguuccgguggc

SEQ ID NO: 3027462 - RNA, 19 nt, Mycobacterium avium subsp. paratuberculosis
gaggcgguuccgguggcgc

SEQ ID NO: 3027463 - RNA, 21 nt, Mycobacterium avium subsp. paratuberculosis
gaggcgguuccgguggcgcga

SEQ ID NO: 3027464 - RNA, 20 nt, Mycobacterium avium subsp. paratuberculosis
gaggcguagcugcaggcgac

SEQ ID NO: 3027465 - RNA, 22 nt, Mycobacterium avium subsp. paratuberculosis
gaggcguagcugcaggcgacga

SEQ ID NO: 3027466 - RNA, 18 nt, Mycobacterium avium subsp. paratuberculosis
gaggcguagugcgcccag

SEQ ID NO: 3027467 - RNA, 23 nt, Mycobacterium avium subsp. paratuberculosis
gaggcgucagggguuggcgcgca

SEQ ID NO: 3027468 - RNA, 12 nt, Mycobacterium avium subsp. paratuberculosis
gaggcguccucc

SEQ ID NO: 3027469 - RNA, 14 nt, Mycobacterium avium subsp. paratuberculosis
gaggcguccuccuc

SEQ ID NO: 3027470 - RNA, 23 nt, Mycobacterium avium subsp. paratuberculosis
gaggcgugccgcugggagcacgu

SEQ ID NO: 3027471 - RNA, 23 nt, Mycobacterium avium subsp. paratuberculosis
gaggcguucggcgauccgggcac

SEQ ID NO: 3027472 - RNA, 19 nt, Mycobacterium avium subsp. paratuberculosis
gaggcguugcgucccgcgc

SEQ ID NO: 3027473 - RNA, 15 nt, Mycobacterium avium subsp. paratuberculosis
gaggcguuggcccgc

SEQ ID NO: 3027474 - RNA, 16 nt, Mycobacterium avium subsp. paratuberculosis
gaggcguuggcccgca

SEQ ID NO: 3027475 - RNA, 22 nt, Mycobacterium avium subsp. paratuberculosis
gaggcguuggcccgcacccgcc

SEQ ID NO: 3027476 - RNA, 19 nt, Mycobacterium avium subsp. paratuberculosis
gaggcucaggccgguggcg

SEQ ID NO: 3027477 - RNA, 23 nt, Mycobacterium avium subsp. paratuberculosis
gaggcugcggguggggaagacgu

SEQ ID NO: 3027478 - RNA, 17 nt, Mycobacterium avium subsp. paratuberculosis
gaggcuguccagcagcg

SEQ ID NO: 3027479 - RNA, 17 nt, Mycobacterium avium subsp. paratuberculosis
gaggcugucggaggccu

SEQ ID NO: 3027480 - RNA, 20 nt, Mycobacterium avium subsp. paratuberculosis
gaggcugugggccagcagcg

SEQ ID NO: 3027481 - RNA, 14 nt, Mycobacterium avium subsp. paratuberculosis
gagggaacgccgau

SEQ ID NO: 3027482 - RNA, 16 nt, Mycobacterium avium subsp. paratuberculosis
gagggaacgccgauca

SEQ ID NO: 3027483 - RNA, 22 nt, Mycobacterium avium subsp. paratuberculosis
gagggaacgccgaucaccggca

SEQ ID NO: 3027484 - RNA, 20 nt, Mycobacterium avium subsp. paratuberculosis
gagggagcacucgauggcgg

SEQ ID NO: 3027485 - RNA, 15 nt, Mycobacterium avium subsp. paratuberculosis
gagggccaccggcuc

SEQ ID NO: 3027486 - RNA, 14 nt, Mycobacterium avium subsp. paratuberculosis
gagggccagcagcc

SEQ ID NO: 3027487 - RNA, 14 nt, Mycobacterium avium subsp. paratuberculosis
gagggccagcaguc

SEQ ID NO: 3027488 - RNA, 16 nt, Mycobacterium avium subsp. paratuberculosis
gagggccagcagucgu

SEQ ID NO: 3027489 - RNA, 16 nt, Mycobacterium avium subsp. paratuberculosis
gagggccauccggccg

SEQ ID NO: 3027490 - RNA, 18 nt, Mycobacterium avium subsp. paratuberculosis
gagggccauccggccggc

SEQ ID NO: 3027491 - RNA, 15 nt, Mycobacterium avium subsp. paratuberculosis
gagggcccgggcagg

SEQ ID NO: 3027492 - RNA, 18 nt, Mycobacterium avium subsp. paratuberculosis
gagggcccgggcaggcau

SEQ ID NO: 3027493 - RNA, 17 nt, Mycobacterium avium subsp. paratuberculosis
gagggccuccaccacca

SEQ ID NO: 3027494 - RNA, 22 nt, Mycobacterium avium subsp. paratuberculosis
gagggcgacgaugccggccggg

SEQ ID NO: 3027495 - RNA, 22 nt, Mycobacterium avium subsp. paratuberculosis
gagggcgccguuguaggccgcg

SEQ ID NO: 3027496 - RNA, 23 nt, Mycobacterium avium subsp. paratuberculosis
gagggcgccguuguaggccgcgc

SEQ ID NO: 3027497 - RNA, 12 nt, Mycobacterium avium subsp. paratuberculosis
gagggcgcggcg

SEQ ID NO: 3027498 - RNA, 12 nt, Mycobacterium avium subsp. paratuberculosis
gagggcgggcca

SEQ ID NO: 3027499 - RNA, 15 nt, Mycobacterium avium subsp. paratuberculosis
gagggcggggcagca

SEQ ID NO: 3027500 - RNA, 15 nt, Mycobacterium avium subsp. paratuberculosis
gagggcguccuucca

SEQ ID NO: 3027501 - RNA, 15 nt, Mycobacterium avium subsp. paratuberculosis
gagggcguucgcggu

SEQ ID NO: 3027502 - RNA, 13 nt, Mycobacterium avium subsp. paratuberculosis
gaggggcagcagc

SEQ ID NO: 3027503 - RNA, 13 nt, Mycobacterium avium subsp. paratuberculosis
gaggggcgcggca

SEQ ID NO: 3027504 - RNA, 22 nt, Mycobacterium avium subsp. paratuberculosis
gaggggguggguccggucagca

SEQ ID NO: 3027505 - RNA, 22 nt, Mycobacterium avium subsp. paratuberculosis
gagggucaagauaccggccggc

SEQ ID NO: 3027506 - RNA, 19 nt, Mycobacterium avium subsp. paratuberculosis
gagggucgagacaccgucg

SEQ ID NO: 3027507 - RNA, 19 nt, Mycobacterium avium subsp. paratuberculosis
gagggucgccaggccaccg

SEQ ID NO: 3027508 - RNA, 18 nt, Mycobacterium avium subsp. paratuberculosis
gagggucgguggcccagc

SEQ ID NO: 3027509 - RNA, 19 nt, Mycobacterium avium subsp. paratuberculosis
gagggugacccgggcgaug

SEQ ID NO: 3027510 - RNA, 21 nt, Mycobacterium avium subsp. paratuberculosis
gagggugacgguggcguccuc

SEQ ID NO: 3027511 - RNA, 21 nt, Mycobacterium avium subsp. paratuberculosis
gagggugaugucgcugccgcc

SEQ ID NO: 3027512 - RNA, 17 nt, Mycobacterium avium subsp. paratuberculosis
gagggugccggccaccg

SEQ ID NO: 3027513 - RNA, 15 nt, Mycobacterium avium subsp. paratuberculosis
gagggugucggcggg

SEQ ID NO: 3027514 - RNA, 23 nt, Mycobacterium avium subsp. paratuberculosis
gaggguucgguggccccgggccg

SEQ ID NO: 3027515 - RNA, 23 nt, Mycobacterium avium subsp. paratuberculosis
gaggguuuccacgugcacggcgc

SEQ ID NO: 3027516 - RNA, 16 nt, Mycobacterium avium subsp. paratuberculosis
gaggguuuucggggcg

SEQ ID NO: 3027517 - RNA, 18 nt, Mycobacterium avium subsp. paratuberculosis
gaggguuuucggggcgug

SEQ ID NO: 3027518 - RNA, 17 nt, Mycobacterium avium subsp. paratuberculosis
gagguacucgagcgugc

SEQ ID NO: 3027519 - RNA, 23 nt, Mycobacterium avium subsp. paratuberculosis
gagguacucgagcgugcccgcgc

SEQ ID NO: 3027520 - RNA, 17 nt, Mycobacterium avium subsp. paratuberculosis
gagguacugcagcaguc

SEQ ID NO: 3027521 - RNA, 17 nt, Mycobacterium avium subsp. paratuberculosis
gagguagccgcgcacca

SEQ ID NO: 3027522 - RNA, 14 nt, Mycobacterium avium subsp. paratuberculosis
gagguaggccaccg

SEQ ID NO: 3027523 - RNA, 16 nt, Mycobacterium avium subsp. paratuberculosis
gagguaggccaccggg

SEQ ID NO: 3027524 - RNA, 16 nt, Mycobacterium avium subsp. paratuberculosis
gagguaggcgagauca

SEQ ID NO: 3027525 - RNA, 22 nt, Mycobacterium avium subsp. paratuberculosis
gaggucaccaccgagccggugc

SEQ ID NO: 3027526 - RNA, 12 nt, Mycobacterium avium subsp. paratuberculosis
gaggucaccgcg

SEQ ID NO: 3027527 - RNA, 15 nt, Mycobacterium avium subsp. paratuberculosis
gaggucaccgcgacc

SEQ ID NO: 3027528 - RNA, 19 nt, Mycobacterium avium subsp. paratuberculosis
gaggucaccgcgaccaugc

SEQ ID NO: 3027529 - RNA, 13 nt, Mycobacterium avium subsp. paratuberculosis
gaggucaccgcgg

SEQ ID NO: 3027530 - RNA, 13 nt, Mycobacterium avium subsp. paratuberculosis
gaggucagcgcgu

SEQ ID NO: 3027531 - RNA, 16 nt, Mycobacterium avium subsp. paratuberculosis
gaggucagcggcccga

SEQ ID NO: 3027532 - RNA, 17 nt, Mycobacterium avium subsp. paratuberculosis
gaggucauggcgaccgc

SEQ ID NO: 3027533 - RNA, 21 nt, Mycobacterium avium subsp. paratuberculosis
gaggucauggcgaccgcgacg

SEQ ID NO: 3027534 - RNA, 16 nt, Mycobacterium avium subsp. paratuberculosis
gagguccucgcgcaac

SEQ ID NO: 3027535 - RNA, 14 nt, Mycobacterium avium subsp. paratuberculosis
gagguccucggcga

SEQ ID NO: 3027536 - RNA, 15 nt, Mycobacterium avium subsp. paratuberculosis
gagguccucggcgau

SEQ ID NO: 3027537 - RNA, 23 nt, Mycobacterium avium subsp. paratuberculosis
gagguccuugcggaaccgcugca

SEQ ID NO: 3027538 - RNA, 19 nt, Mycobacterium avium subsp. paratuberculosis
gaggucgaaccacgcggcg

SEQ ID NO: 3027539 - RNA, 22 nt, Mycobacterium avium subsp. paratuberculosis
gaggucgaaccacgcggcggcg

SEQ ID NO: 3027540 - RNA, 23 nt, Mycobacterium avium subsp. paratuberculosis
gaggucgaaccacgcggcggcgg

SEQ ID NO: 3027541 - RNA, 14 nt, Mycobacterium avium subsp. paratuberculosis
gaggucgcgaccgc

SEQ ID NO: 3027542 - RNA, 15 nt, Mycobacterium avium subsp. paratuberculosis
gaggucgcgcagcac

SEQ ID NO: 3027543 - RNA, 21 nt, Mycobacterium avium subsp. paratuberculosis
gaggucgcggcggccggcgcc

SEQ ID NO: 3027544 - RNA, 14 nt, Mycobacterium avium subsp. paratuberculosis
gaggucggccagca

SEQ ID NO: 3027545 - RNA, 19 nt, Mycobacterium avium subsp. paratuberculosis
gaggucggccagcaggucg

SEQ ID NO: 3027546 - RNA, 15 nt, Mycobacterium avium subsp. paratuberculosis
gaggucggucgcggc

SEQ ID NO: 3027547 - RNA, 14 nt, Mycobacterium avium subsp. paratuberculosis
gaggucggugaggc

SEQ ID NO: 3027548 - RNA, 19 nt, Mycobacterium avium subsp. paratuberculosis
gaggucggugaggcugggu

SEQ ID NO: 3027549 - RNA, 14 nt, Mycobacterium avium subsp. paratuberculosis
gaggucgucgaggg

SEQ ID NO: 3027550 - RNA, 14 nt, Mycobacterium avium subsp. paratuberculosis
gaggucgucgcguc

SEQ ID NO: 3027551 - RNA, 13 nt, Mycobacterium avium subsp. paratuberculosis
gaggucgucggcc

SEQ ID NO: 3027552 - RNA, 15 nt, Mycobacterium avium subsp. paratuberculosis
gaggucucccggucc

SEQ ID NO: 3027553 - RNA, 21 nt, Mycobacterium avium subsp. paratuberculosis
gaggucucccgguccacggug

SEQ ID NO: 3027554 - RNA, 15 nt, Mycobacterium avium subsp. paratuberculosis
gaggucuucgguccc

SEQ ID NO: 3027555 - RNA, 22 nt, Mycobacterium avium subsp. paratuberculosis
gaggucuuucaucgccccggcg

SEQ ID NO: 3027556 - RNA, 14 nt, Mycobacterium avium subsp. paratuberculosis
gaggugaaccgcga

SEQ ID NO: 3027557 - RNA, 16 nt, Mycobacterium avium subsp. paratuberculosis
gaggugaaccgcgacg

SEQ ID NO: 3027558 - RNA, 17 nt, Mycobacterium avium subsp. paratuberculosis
gaggugaaccgcgacgc

SEQ ID NO: 3027559 - RNA, 12 nt, Mycobacterium avium subsp. paratuberculosis
gaggugaagccg

SEQ ID NO: 3027560 - RNA, 16 nt, Mycobacterium avium subsp. paratuberculosis
gaggugaagccguugu

SEQ ID NO: 3027561 - RNA, 23 nt, Mycobacterium avium subsp. paratuberculosis
gaggugaauaccacugcgcgccc

SEQ ID NO: 3027562 - RNA, 16 nt, Mycobacterium avium subsp. paratuberculosis
gaggugaccggcgagg

SEQ ID NO: 3027563 - RNA, 15 nt, Mycobacterium avium subsp. paratuberculosis
gaggugacgucgcgc

SEQ ID NO: 3027564 - RNA, 23 nt, Mycobacterium avium subsp. paratuberculosis
gaggugaucgcgaacgcgccggu

SEQ ID NO: 3027565 - RNA, 16 nt, Mycobacterium avium subsp. paratuberculosis
gaggugaugccgucca

SEQ ID NO: 3027566 - RNA, 19 nt, Mycobacterium avium subsp. paratuberculosis
gaggugaugccguccagca

SEQ ID NO: 3027567 - RNA, 21 nt, Mycobacterium avium subsp. paratuberculosis
gaggugaugccguccagcaac

SEQ ID NO: 3027568 - RNA, 19 nt, Mycobacterium avium subsp. paratuberculosis
gaggugcaacacucgagcg

SEQ ID NO: 3027569 - RNA, 19 nt, Mycobacterium avium subsp. paratuberculosis
gaggugcagcgggcuggcg

SEQ ID NO: 3027570 - RNA, 20 nt, Mycobacterium avium subsp. paratuberculosis
gaggugccgcgcagcaccgu

SEQ ID NO: 3027571 - RNA, 16 nt, Mycobacterium avium subsp. paratuberculosis
gaggugccgcgcggca

SEQ ID NO: 3027572 - RNA, 13 nt, Mycobacterium avium subsp. paratuberculosis
gaggugccggccg

SEQ ID NO: 3027573 - RNA, 17 nt, Mycobacterium avium subsp. paratuberculosis
gaggugccggccggucg

SEQ ID NO: 3027574 - RNA, 15 nt, Mycobacterium avium subsp. paratuberculosis
gaggugcucgacggc

SEQ ID NO: 3027575 - RNA, 19 nt, Mycobacterium avium subsp. paratuberculosis
gaggugcugucgucgcccu

SEQ ID NO: 3027576 - RNA, 12 nt, Mycobacterium avium subsp. paratuberculosis
gagguggcccgc

SEQ ID NO: 3027577 - RNA, 13 nt, Mycobacterium avium subsp. paratuberculosis
gagguggcccgcc

SEQ ID NO: 3027578 - RNA, 17 nt, Mycobacterium avium subsp. paratuberculosis
gagguggcccgccacgu

SEQ ID NO: 3027579 - RNA, 16 nt, Mycobacterium avium subsp. paratuberculosis
gagguggcugggcgcu

SEQ ID NO: 3027580 - RNA, 24 nt, Mycobacterium avium subsp. paratuberculosis
gaggugguccgcgaaauugauagc

SEQ ID NO: 3027581 - RNA, 21 nt, Mycobacterium avium subsp. paratuberculosis
gaggugguuucggggucgccg

SEQ ID NO: 3027582 - RNA, 13 nt, Mycobacterium avium subsp. paratuberculosis
gaggugugaggag

SEQ ID NO: 3027583 - RNA, 16 nt, Mycobacterium avium subsp. paratuberculosis
gaggugugaggagucg

SEQ ID NO: 3027584 - RNA, 16 nt, Mycobacterium avium subsp. paratuberculosis
gagguguugucgugcc

SEQ ID NO: 3027585 - RNA, 17 nt, Mycobacterium avium subsp. paratuberculosis
gagguugaugccgacgu

SEQ ID NO: 3027586 - RNA, 18 nt, Mycobacterium avium subsp. paratuberculosis
gagguugaugccgacguc

SEQ ID NO: 3027587 - RNA, 20 nt, Mycobacterium avium subsp. paratuberculosis
gagguuuccgcugaugcggc

SEQ ID NO: 3027588 - RNA, 20 nt, Mycobacterium avium subsp. paratuberculosis
gaguaaggccgaggcgagug

SEQ ID NO: 3027589 - RNA, 22 nt, Mycobacterium avium subsp. paratuberculosis
gaguaaggccgaggcgagugag

SEQ ID NO: 3027590 - RNA, 14 nt, Mycobacterium avium subsp. paratuberculosis
gaguacccgccgca

SEQ ID NO: 3027591 - RNA, 13 nt, Mycobacterium avium subsp. paratuberculosis
gaguacucggugu

SEQ ID NO: 3027592 - RNA, 23 nt, Mycobacterium avium subsp. paratuberculosis
gaguacucgguguagagcaccuc

SEQ ID NO: 3027593 - RNA, 22 nt, Mycobacterium avium subsp. paratuberculosis
gaguagccgguucgucccgcgc

SEQ ID NO: 3027594 - RNA, 17 nt, Mycobacterium avium subsp. paratuberculosis
gaguagcgcgcgaaggc

SEQ ID NO: 3027595 - RNA, 20 nt, Mycobacterium avium subsp. paratuberculosis
gaguaggugcccgagcugau

SEQ ID NO: 3027596 - RNA, 13 nt, Mycobacterium avium subsp. paratuberculosis
gaguaguccagca

SEQ ID NO: 3027597 - RNA, 14 nt, Mycobacterium avium subsp. paratuberculosis
gaguagucggcgau

SEQ ID NO: 3027598 - RNA, 17 nt, Mycobacterium avium subsp. paratuberculosis
gaguaguuccggcgguc

SEQ ID NO: 3027599 - RNA, 19 nt, Mycobacterium avium subsp. paratuberculosis
gaguauccgcgcagcgucu

SEQ ID NO: 3027600 - RNA, 17 nt, Mycobacterium avium subsp. paratuberculosis
gaguaugcagaugaugc

SEQ ID NO: 3027601 - RNA, 12 nt, Mycobacterium avium subsp. paratuberculosis
gagucaccggcu

SEQ ID NO: 3027602 - RNA, 13 nt, Mycobacterium avium subsp. paratuberculosis
gagucaucgccac

SEQ ID NO: 3027603 - RNA, 21 nt, Mycobacterium avium subsp. paratuberculosis
gagucaucgccacccgcaccu

SEQ ID NO: 3027604 - RNA, 15 nt, Mycobacterium avium subsp. paratuberculosis
gaguccacgacgucc

SEQ ID NO: 3027605 - RNA, 16 nt, Mycobacterium avium subsp. paratuberculosis
gaguccacgacguccu

SEQ ID NO: 3027606 - RNA, 14 nt, Mycobacterium avium subsp. paratuberculosis
gaguccagcacgcc

SEQ ID NO: 3027607 - RNA, 13 nt, Mycobacterium avium subsp. paratuberculosis
gaguccagccagc

SEQ ID NO: 3027608 - RNA, 14 nt, Mycobacterium avium subsp. paratuberculosis
gaguccagccagcc

SEQ ID NO: 3027609 - RNA, 16 nt, Mycobacterium avium subsp. paratuberculosis
gaguccagccagccgc

SEQ ID NO: 3027610 - RNA, 15 nt, Mycobacterium avium subsp. paratuberculosis
gagucccaugggcug

SEQ ID NO: 3027611 - RNA, 15 nt, Mycobacterium avium subsp. paratuberculosis
gagucccggcgcacc

SEQ ID NO: 3027612 - RNA, 20 nt, Mycobacterium avium subsp. paratuberculosis
gagucccggcgcaccaggcg

SEQ ID NO: 3027613 - RNA, 13 nt, Mycobacterium avium subsp. paratuberculosis
gagucccucggcg

SEQ ID NO: 3027614 - RNA, 20 nt, Mycobacterium avium subsp. paratuberculosis
gaguccgcggaggcgagcag

SEQ ID NO: 3027615 - RNA, 21 nt, Mycobacterium avium subsp. paratuberculosis
gaguccgcggaggcgagcagc

SEQ ID NO: 3027616 - RNA, 22 nt, Mycobacterium avium subsp. paratuberculosis
gaguccgcggaggcgagcagcc

SEQ ID NO: 3027617 - RNA, 16 nt, Mycobacterium avium subsp. paratuberculosis
gaguccggcucggugc

SEQ ID NO: 3027618 - RNA, 17 nt, Mycobacterium avium subsp. paratuberculosis
gaguccggcucggugcc

SEQ ID NO: 3027619 - RNA, 21 nt, Mycobacterium avium subsp. paratuberculosis
gaguccggcucggugccgcgg

SEQ ID NO: 3027620 - RNA, 19 nt, Mycobacterium avium subsp. paratuberculosis
gaguccugguaccccagca

SEQ ID NO: 3027621 - RNA, 17 nt, Mycobacterium avium subsp. paratuberculosis
gagucgaagcggugcac

SEQ ID NO: 3027622 - RNA, 20 nt, Mycobacterium avium subsp. paratuberculosis
gagucgaaggcgcgggcguc

SEQ ID NO: 3027623 - RNA, 16 nt, Mycobacterium avium subsp. paratuberculosis
gagucgagcaccgcga

SEQ ID NO: 3027624 - RNA, 16 nt, Mycobacterium avium subsp. paratuberculosis
gagucgagguugaugc

SEQ ID NO: 3027625 - RNA, 15 nt, Mycobacterium avium subsp. paratuberculosis
gagucgaucgccagc

SEQ ID NO: 3027626 - RNA, 19 nt, Mycobacterium avium subsp. paratuberculosis
gagucgaucgccagcgcgc

SEQ ID NO: 3027627 - RNA, 13 nt, Mycobacterium avium subsp. paratuberculosis
gagucgaugaccu

SEQ ID NO: 3027628 - RNA, 17 nt, Mycobacterium avium subsp. paratuberculosis
gagucgaugaccucgcg

SEQ ID NO: 3027629 - RNA, 19 nt, Mycobacterium avium subsp. paratuberculosis
gagucgaugaccucgcgcc

SEQ ID NO: 3027630 - RNA, 13 nt, Mycobacterium avium subsp. paratuberculosis
gagucgccguugg

SEQ ID NO: 3027631 - RNA, 13 nt, Mycobacterium avium subsp. paratuberculosis
gagucgcgccgcg

SEQ ID NO: 3027632 - RNA, 16 nt, Mycobacterium avium subsp. paratuberculosis
gagucgcgccgcgucg

SEQ ID NO: 3027633 - RNA, 23 nt, Mycobacterium avium subsp. paratuberculosis
gagucgcgccgcgucgcgccgcc

SEQ ID NO: 3027634 - RNA, 14 nt, Mycobacterium avium subsp. paratuberculosis
gagucgcugcagca

SEQ ID NO: 3027635 - RNA, 13 nt, Mycobacterium avium subsp. paratuberculosis
gagucgcuggcgc

SEQ ID NO: 3027636 - RNA, 15 nt, Mycobacterium avium subsp. paratuberculosis
gagucgcuggcgcgc

SEQ ID NO: 3027637 - RNA, 20 nt, Mycobacterium avium subsp. paratuberculosis
gagucgcuggcgcgcuuggu

SEQ ID NO: 3027638 - RNA, 13 nt, Mycobacterium avium subsp. paratuberculosis
gagucggccaccg

SEQ ID NO: 3027639 - RNA, 16 nt, Mycobacterium avium subsp. paratuberculosis
gagucggggugcucga

SEQ ID NO: 3027640 - RNA, 20 nt, Mycobacterium avium subsp. paratuberculosis
gagucggggugcucgaucgg

SEQ ID NO: 3027641 - RNA, 13 nt, Mycobacterium avium subsp. paratuberculosis
gagucggucgagu

SEQ ID NO: 3027642 - RNA, 15 nt, Mycobacterium avium subsp. paratuberculosis
gagucggucgagucg

SEQ ID NO: 3027643 - RNA, 20 nt, Mycobacterium avium subsp. paratuberculosis
gagucguacuucgcccccgg

SEQ ID NO: 3027644 - RNA, 14 nt, Mycobacterium avium subsp. paratuberculosis
gagucgucggcgcg

SEQ ID NO: 3027645 - RNA, 17 nt, Mycobacterium avium subsp. paratuberculosis
gagucgucggcgcgguu

SEQ ID NO: 3027646 - RNA, 18 nt, Mycobacterium avium subsp. paratuberculosis
gagucuacuuggccagcu

SEQ ID NO: 3027647 - RNA, 13 nt, Mycobacterium avium subsp. paratuberculosis
gagugaccgccag

SEQ ID NO: 3027648 - RNA, 19 nt, Mycobacterium avium subsp. paratuberculosis
gagugaccgccagcaccgc

SEQ ID NO: 3027649 - RNA, 20 nt, Mycobacterium avium subsp. paratuberculosis
gagugaccgccagcaccgcg

SEQ ID NO: 3027650 - RNA, 21 nt, Mycobacterium avium subsp. paratuberculosis
gagugaccgccagcaccgcgg

SEQ ID NO: 3027651 - RNA, 13 nt, Mycobacterium avium subsp. paratuberculosis
gagugaggacgag

SEQ ID NO: 3027652 - RNA, 22 nt, Mycobacterium avium subsp. paratuberculosis
gagugaggccgaggcgagugag

SEQ ID NO: 3027653 - RNA, 16 nt, Mycobacterium avium subsp. paratuberculosis
gagugccggccagcuc

SEQ ID NO: 3027654 - RNA, 19 nt, Mycobacterium avium subsp. paratuberculosis
gagugcgaaacucaccgcg

SEQ ID NO: 3027655 - RNA, 20 nt, Mycobacterium avium subsp. paratuberculosis
gagugcgaaacucaccgcgu

SEQ ID NO: 3027656 - RNA, 18 nt, Mycobacterium avium subsp. paratuberculosis
gagugcgccgugcagcac

SEQ ID NO: 3027657 - RNA, 21 nt, Mycobacterium avium subsp. paratuberculosis
gagugcgccgugcagcacgcc

SEQ ID NO: 3027658 - RNA, 14 nt, Mycobacterium avium subsp. paratuberculosis
gagugcggcgcggu

SEQ ID NO: 3027659 - RNA, 19 nt, Mycobacterium avium subsp. paratuberculosis
gagugcggcgcggugcgcc

SEQ ID NO: 3027660 - RNA, 19 nt, Mycobacterium avium subsp. paratuberculosis
gagugcucgauggccagcg

SEQ ID NO: 3027661 - RNA, 20 nt, Mycobacterium avium subsp. paratuberculosis
gagugcucgauggccagcgc

SEQ ID NO: 3027662 - RNA, 23 nt, Mycobacterium avium subsp. paratuberculosis
gagugcucggcguugagccggcg

SEQ ID NO: 3027663 - RNA, 15 nt, Mycobacterium avium subsp. paratuberculosis
gagugcuggacggcc

SEQ ID NO: 3027664 - RNA, 18 nt, Mycobacterium avium subsp. paratuberculosis
gagugcuggacggcccga

SEQ ID NO: 3027665 - RNA, 17 nt, Mycobacterium avium subsp. paratuberculosis
gaguggaacagccggau

SEQ ID NO: 3027666 - RNA, 19 nt, Mycobacterium avium subsp. paratuberculosis
gagugggugaaggccugga

SEQ ID NO: 3027667 - RNA, 17 nt, Mycobacterium avium subsp. paratuberculosis
gagugguaccggguggc

SEQ ID NO: 3027668 - RNA, 15 nt, Mycobacterium avium subsp. paratuberculosis
gagugguagggcucc

SEQ ID NO: 3027669 - RNA, 16 nt, Mycobacterium avium subsp. paratuberculosis
gagugguagggcuccg

SEQ ID NO: 3027670 - RNA, 15 nt, Mycobacterium avium subsp. paratuberculosis
gaguggucaggccca

SEQ ID NO: 3027671 - RNA, 15 nt, Mycobacterium avium subsp. paratuberculosis
gaguggucggccgcc

SEQ ID NO: 3027672 - RNA, 16 nt, Mycobacterium avium subsp. paratuberculosis
gagugugaagaccgga

SEQ ID NO: 3027673 - RNA, 22 nt, Mycobacterium avium subsp. paratuberculosis
gaguguguacacagggcggcga

SEQ ID NO: 3027674 - RNA, 15 nt, Mycobacterium avium subsp. paratuberculosis
gaguguugaagccgc

SEQ ID NO: 3027675 - RNA, 19 nt, Mycobacterium avium subsp. paratuberculosis
gaguucacccguggcugac

SEQ ID NO: 3027676 - RNA, 21 nt, Mycobacterium avium subsp. paratuberculosis
gaguucagaagucgcccgcgu

SEQ ID NO: 3027677 - RNA, 22 nt, Mycobacterium avium subsp. paratuberculosis
gaguucagcgucgaugugggcc

SEQ ID NO: 3027678 - RNA, 19 nt, Mycobacterium avium subsp. paratuberculosis
gaguucaucgacgucgaag

SEQ ID NO: 3027679 - RNA, 22 nt, Mycobacterium avium subsp. paratuberculosis
gaguuccgcgucggcccccagc

SEQ ID NO: 3027680 - RNA, 14 nt, Mycobacterium avium subsp. paratuberculosis
gaguucgaccucgg

SEQ ID NO: 3027681 - RNA, 17 nt, Mycobacterium avium subsp. paratuberculosis
gaguucgaccucgguga

SEQ ID NO: 3027682 - RNA, 19 nt, Mycobacterium avium subsp. paratuberculosis
gaguucgaccucggugaug

SEQ ID NO: 3027683 - RNA, 20 nt, Mycobacterium avium subsp. paratuberculosis
gaguucgaccucggugaugg

SEQ ID NO: 3027684 - RNA, 20 nt, Mycobacterium avium subsp. paratuberculosis
gaguucgaugacgucgcgcu

SEQ ID NO: 3027685 - RNA, 20 nt, Mycobacterium avium subsp. paratuberculosis
gaguucgcgcacgcuggccg

SEQ ID NO: 3027686 - RNA, 17 nt, Mycobacterium avium subsp. paratuberculosis
gaguucgcugaccgcca

SEQ ID NO: 3027687 - RNA, 17 nt, Mycobacterium avium subsp. paratuberculosis
gaguucggcggcccgcu

SEQ ID NO: 3027688 - RNA, 20 nt, Mycobacterium avium subsp. paratuberculosis
gaguucggugaacugcagcc

SEQ ID NO: 3027689 - RNA, 24 nt, Mycobacterium avium subsp. paratuberculosis
gaguucgucggcgaucgccagcac

SEQ ID NO: 3027690 - RNA, 15 nt, Mycobacterium avium subsp. paratuberculosis
gaguucuuucaugcc

SEQ ID NO: 3027691 - RNA, 19 nt, Mycobacterium avium subsp. paratuberculosis
gaguugauaggucacgccg

SEQ ID NO: 3027692 - RNA, 19 nt, Mycobacterium avium subsp. paratuberculosis
gaguugcgcagccgggcgg

SEQ ID NO: 3027693 - RNA, 22 nt, Mycobacterium avium subsp. paratuberculosis
gaguugcgcagccgggcgguga

SEQ ID NO: 3027694 - RNA, 14 nt, Mycobacterium avium subsp. paratuberculosis
gaguuggccaucgu

SEQ ID NO: 3027695 - RNA, 19 nt, Mycobacterium avium subsp. paratuberculosis
gaguuggccggcacucgcc

SEQ ID NO: 3027696 - RNA, 17 nt, Mycobacterium avium subsp. paratuberculosis
gaguugggucacaucgc

SEQ ID NO: 3027697 - RNA, 12 nt, Mycobacterium avium subsp. paratuberculosis
gaguugggucgc

SEQ ID NO: 3027698 - RNA, 17 nt, Mycobacterium avium subsp. paratuberculosis
gaguuguacccuucggc

SEQ ID NO: 3027699 - RNA, 19 nt, Mycobacterium avium subsp. paratuberculosis
gaguuugcccucgucgacc

SEQ ID NO: 3027700 - RNA, 20 nt, Mycobacterium avium subsp. paratuberculosis
gaguuuuucgggguggugga

SEQ ID NO: 3027701 - RNA, 18 nt, Mycobacterium avium subsp. paratuberculosis
gauaacccagcaccacca

SEQ ID NO: 3027702 - RNA, 19 nt, Mycobacterium avium subsp. paratuberculosis
gauaacccagcaccaccac

SEQ ID NO: 3027703 - RNA, 18 nt, Mycobacterium avium subsp. paratuberculosis
gauaaccucggcggcggc

SEQ ID NO: 3027704 - RNA, 22 nt, Mycobacterium avium subsp. paratuberculosis
gauaaccucggcggcggcgcgc

SEQ ID NO: 3027705 - RNA, 19 nt, Mycobacterium avium subsp. paratuberculosis
gauaagcggauugaccagc

SEQ ID NO: 3027706 - RNA, 14 nt, Mycobacterium avium subsp. paratuberculosis
gauaauggcggccg

SEQ ID NO: 3027707 - RNA, 19 nt, Mycobacterium avium subsp. paratuberculosis
gauaauggcggccgccgcg

SEQ ID NO: 3027708 - RNA, 13 nt, Mycobacterium avium subsp. paratuberculosis
gauaccagccgcg

SEQ ID NO: 3027709 - RNA, 18 nt, Mycobacterium avium subsp. paratuberculosis
gauacccaugaucgccag

SEQ ID NO: 3027710 - RNA, 19 nt, Mycobacterium avium subsp. paratuberculosis
gauacccaugaucgccagu

SEQ ID NO: 3027711 - RNA, 15 nt, Mycobacterium avium subsp. paratuberculosis
gauacccgcggccuc

SEQ ID NO: 3027712 - RNA, 17 nt, Mycobacterium avium subsp. paratuberculosis
gauacccgggagcaucg

SEQ ID NO: 3027713 - RNA, 15 nt, Mycobacterium avium subsp. paratuberculosis
gauaccggccagcac

SEQ ID NO: 3027714 - RNA, 21 nt, Mycobacterium avium subsp. paratuberculosis
gauaccggcccagcgcggugu

SEQ ID NO: 3027715 - RNA, 13 nt, Mycobacterium avium subsp. paratuberculosis
gauaccggccggc

SEQ ID NO: 3027716 - RNA, 15 nt, Mycobacterium avium subsp. paratuberculosis
gauaccggccggcgc

SEQ ID NO: 3027717 - RNA, 20 nt, Mycobacterium avium subsp. paratuberculosis
gauaccggccggcgcggcgg

SEQ ID NO: 3027718 - RNA, 17 nt, Mycobacterium avium subsp. paratuberculosis
gauaccguccgcgccca

SEQ ID NO: 3027719 - RNA, 19 nt, Mycobacterium avium subsp. paratuberculosis
gauaccguccgcgcccacc

SEQ ID NO: 3027720 - RNA, 20 nt, Mycobacterium avium subsp. paratuberculosis
gauaccguccgcgcccaccc

SEQ ID NO: 3027721 - RNA, 17 nt, Mycobacterium avium subsp. paratuberculosis
gauacgacguccgggcc

SEQ ID NO: 3027722 - RNA, 15 nt, Mycobacterium avium subsp. paratuberculosis
gauacgcccggccac

SEQ ID NO: 3027723 - RNA, 21 nt, Mycobacterium avium subsp. paratuberculosis
gauacgcccggccaccuggcc

SEQ ID NO: 3027724 - RNA, 14 nt, Mycobacterium avium subsp. paratuberculosis
gauacgccgcgacg

SEQ ID NO: 3027725 - RNA, 20 nt, Mycobacterium avium subsp. paratuberculosis
gauacucgggcaacgcgccg

SEQ ID NO: 3027726 - RNA, 19 nt, Mycobacterium avium subsp. paratuberculosis
gauagaccucacggucggc

SEQ ID NO: 3027727 - RNA, 14 nt, Mycobacterium avium subsp. paratuberculosis
gauagagcaccgcg

SEQ ID NO: 3027728 - RNA, 15 nt, Mycobacterium avium subsp. paratuberculosis
gauagaucgacgcga

SEQ ID NO: 3027729 - RNA, 17 nt, Mycobacterium avium subsp. paratuberculosis
gauagaucgacgcgacc

SEQ ID NO: 3027730 - RNA, 22 nt, Mycobacterium avium subsp. paratuberculosis
gauagaugagccgcagccgggu

SEQ ID NO: 3027731 - RNA, 17 nt, Mycobacterium avium subsp. paratuberculosis
gauagauguugcggccg

SEQ ID NO: 3027732 - RNA, 19 nt, Mycobacterium avium subsp. paratuberculosis
gauagauguugcggccggc

SEQ ID NO: 3027733 - RNA, 14 nt, Mycobacterium avium subsp. paratuberculosis
gauagcccagccag

SEQ ID NO: 3027734 - RNA, 15 nt, Mycobacterium avium subsp. paratuberculosis
gauagcccagccagc

SEQ ID NO: 3027735 - RNA, 16 nt, Mycobacterium avium subsp. paratuberculosis
gauagcccagccagcc

SEQ ID NO: 3027736 - RNA, 17 nt, Mycobacterium avium subsp. paratuberculosis
gauagcccaggccuugu

SEQ ID NO: 3027737 - RNA, 20 nt, Mycobacterium avium subsp. paratuberculosis
gauagccccgccaggcggcg

SEQ ID NO: 3027738 - RNA, 16 nt, Mycobacterium avium subsp. paratuberculosis
gauagcccgccgcggc

SEQ ID NO: 3027739 - RNA, 18 nt, Mycobacterium avium subsp. paratuberculosis
gauagccgagcggcgcca

SEQ ID NO: 3027740 - RNA, 19 nt, Mycobacterium avium subsp. paratuberculosis
gauagccgagcggcgccac

SEQ ID NO: 3027741 - RNA, 17 nt, Mycobacterium avium subsp. paratuberculosis
gauagccgcccugcccg

SEQ ID NO: 3027742 - RNA, 23 nt, Mycobacterium avium subsp. paratuberculosis
gauagccggugaucgcggcgcug

SEQ ID NO: 3027743 - RNA, 17 nt, Mycobacterium avium subsp. paratuberculosis
gauagccguacacggcg

SEQ ID NO: 3027744 - RNA, 19 nt, Mycobacterium avium subsp. paratuberculosis
gauagccguacacggcggc

SEQ ID NO: 3027745 - RNA, 20 nt, Mycobacterium avium subsp. paratuberculosis
gauagccguacacggcggcg

SEQ ID NO: 3027746 - RNA, 14 nt, Mycobacterium avium subsp. paratuberculosis
gauagccgucggcg

SEQ ID NO: 3027747 - RNA, 22 nt, Mycobacterium avium subsp. paratuberculosis
gauagccgucggcggaggucau

SEQ ID NO: 3027748 - RNA, 14 nt, Mycobacterium avium subsp. paratuberculosis
gauagcggccgcgg

SEQ ID NO: 3027749 - RNA, 22 nt, Mycobacterium avium subsp. paratuberculosis
gauagcggcguaccgcggcggc

SEQ ID NO: 3027750 - RNA, 18 nt, Mycobacterium avium subsp. paratuberculosis
gauagcuugagccccgcc

SEQ ID NO: 3027751 - RNA, 12 nt, Mycobacterium avium subsp. paratuberculosis
gauaggcggcca

SEQ ID NO: 3027752 - RNA, 15 nt, Mycobacterium avium subsp. paratuberculosis
gauaggcggccagcu

SEQ ID NO: 3027753 - RNA, 23 nt, Mycobacterium avium subsp. paratuberculosis
gauaggcggcgacggcgucggcg

SEQ ID NO: 3027754 - RNA, 13 nt, Mycobacterium avium subsp. paratuberculosis
gauaggggcaggg

SEQ ID NO: 3027755 - RNA, 15 nt, Mycobacterium avium subsp. paratuberculosis
gauaggggcagggca

SEQ ID NO: 3027756 - RNA, 15 nt, Mycobacterium avium subsp. paratuberculosis
gauaggggucggcga

SEQ ID NO: 3027757 - RNA, 20 nt, Mycobacterium avium subsp. paratuberculosis
gauaggucacgccgggguag

SEQ ID NO: 3027758 - RNA, 14 nt, Mycobacterium avium subsp. paratuberculosis
gauagucgcgggug

SEQ ID NO: 3027759 - RNA, 16 nt, Mycobacterium avium subsp. paratuberculosis
gauaguggucgucguc

SEQ ID NO: 3027760 - RNA, 15 nt, Mycobacterium avium subsp. paratuberculosis
gauaguucgccgccg

SEQ ID NO: 3027761 - RNA, 22 nt, Mycobacterium avium subsp. paratuberculosis
gauaguucgccgccgccagcac

SEQ ID NO: 3027762 - RNA, 18 nt, Mycobacterium avium subsp. paratuberculosis
gauauaggugagaaaagc

SEQ ID NO: 3027763 - RNA, 22 nt, Mycobacterium avium subsp. paratuberculosis
gauauccagccuugcagccgcu

SEQ ID NO: 3027764 - RNA, 13 nt, Mycobacterium avium subsp. paratuberculosis
gauaucccgcggg

SEQ ID NO: 3027765 - RNA, 14 nt, Mycobacterium avium subsp. paratuberculosis
gauaucggccgcgg

SEQ ID NO: 3027766 - RNA, 15 nt, Mycobacterium avium subsp. paratuberculosis
gauaucggccgcggg

SEQ ID NO: 3027767 - RNA, 17 nt, Mycobacterium avium subsp. paratuberculosis
gaucaaaucccgcagcu

SEQ ID NO: 3027768 - RNA, 14 nt, Mycobacterium avium subsp. paratuberculosis
gaucaacaccgcca

SEQ ID NO: 3027769 - RNA, 14 nt, Mycobacterium avium subsp. paratuberculosis
gaucaacaccgcgc

SEQ ID NO: 3027770 - RNA, 18 nt, Mycobacterium avium subsp. paratuberculosis
gaucaacaccgguccggc

SEQ ID NO: 3027771 - RNA, 23 nt, Mycobacterium avium subsp. paratuberculosis
gaucaacacgucgucgugcgcgg

SEQ ID NO: 3027772 - RNA, 17 nt, Mycobacterium avium subsp. paratuberculosis
gaucaacaggcccagca

SEQ ID NO: 3027773 - RNA, 21 nt, Mycobacterium avium subsp. paratuberculosis
gaucaacaggcccagcagcgc

SEQ ID NO: 3027774 - RNA, 18 nt, Mycobacterium avium subsp. paratuberculosis
gaucaaccacaccagcau

SEQ ID NO: 3027775 - RNA, 19 nt, Mycobacterium avium subsp. paratuberculosis
gaucaacgcggacacggcc

SEQ ID NO: 3027776 - RNA, 22 nt, Mycobacterium avium subsp. paratuberculosis
gaucaacgcggacacggccggg

SEQ ID NO: 3027777 - RNA, 20 nt, Mycobacterium avium subsp. paratuberculosis
gaucaacgggucgagcacgu

SEQ ID NO: 3027778 - RNA, 16 nt, Mycobacterium avium subsp. paratuberculosis
gaucacaccgucggcg

SEQ ID NO: 3027779 - RNA, 18 nt, Mycobacterium avium subsp. paratuberculosis
gaucacagcgcccuugag

SEQ ID NO: 3027780 - RNA, 16 nt, Mycobacterium avium subsp. paratuberculosis
gaucaccaccccggug

SEQ ID NO: 3027781 - RNA, 22 nt, Mycobacterium avium subsp. paratuberculosis
gaucaccaccccggugccgcag

SEQ ID NO: 3027782 - RNA, 16 nt, Mycobacterium avium subsp. paratuberculosis
gaucaccaccuggucc

SEQ ID NO: 3027783 - RNA, 23 nt, Mycobacterium avium subsp. paratuberculosis
gaucaccacggucagggccagca

SEQ ID NO: 3027784 - RNA, 18 nt, Mycobacterium avium subsp. paratuberculosis
gaucaccacgguggccgc

SEQ ID NO: 3027785 - RNA, 15 nt, Mycobacterium avium subsp. paratuberculosis
gaucaccagaccggg

SEQ ID NO: 3027786 - RNA, 17 nt, Mycobacterium avium subsp. paratuberculosis
gaucaccaggcccaggc

SEQ ID NO: 3027787 - RNA, 19 nt, Mycobacterium avium subsp. paratuberculosis
gaucaccaggcccaggccg

SEQ ID NO: 3027788 - RNA, 15 nt, Mycobacterium avium subsp. paratuberculosis
gaucacccagccguu

SEQ ID NO: 3027789 - RNA, 23 nt, Mycobacterium avium subsp. paratuberculosis
gaucacccagccguugggcagcu

SEQ ID NO: 3027790 - RNA, 18 nt, Mycobacterium avium subsp. paratuberculosis
gaucacccccgacaccgu

SEQ ID NO: 3027791 - RNA, 23 nt, Mycobacterium avium subsp. paratuberculosis
gaucacccccgacaccguggugg

SEQ ID NO: 3027792 - RNA, 20 nt, Mycobacterium avium subsp. paratuberculosis
gaucacccgccggguggccg

SEQ ID NO: 3027793 - RNA, 14 nt, Mycobacterium avium subsp. paratuberculosis
gaucacccgggucg

SEQ ID NO: 3027794 - RNA, 14 nt, Mycobacterium avium subsp. paratuberculosis
gaucacccucggcg

SEQ ID NO: 3027795 - RNA, 20 nt, Mycobacterium avium subsp. paratuberculosis
gaucacccucggcgucccgu

SEQ ID NO: 3027796 - RNA, 17 nt, Mycobacterium avium subsp. paratuberculosis
gaucaccgacagcgcgu

SEQ ID NO: 3027797 - RNA, 23 nt, Mycobacterium avium subsp. paratuberculosis
gaucaccgagauggccaccauca

SEQ ID NO: 3027798 - RNA, 16 nt, Mycobacterium avium subsp. paratuberculosis
gaucaccgccagcgcg

SEQ ID NO: 3027799 - RNA, 21 nt, Mycobacterium avium subsp. paratuberculosis
gaucaccgccagcgcgccgau

SEQ ID NO: 3027800 - RNA, 15 nt, Mycobacterium avium subsp. paratuberculosis
gaucaccgccgcggc

SEQ ID NO: 3027801 - RNA, 15 nt, Mycobacterium avium subsp. paratuberculosis
gaucaccgcgcucgg

SEQ ID NO: 3027802 - RNA, 16 nt, Mycobacterium avium subsp. paratuberculosis
gaucaccgcggccacc

SEQ ID NO: 3027803 - RNA, 18 nt, Mycobacterium avium subsp. paratuberculosis
gaucaccgcggccaccac

SEQ ID NO: 3027804 - RNA, 20 nt, Mycobacterium avium subsp. paratuberculosis
gaucaccgcggccaccaccg

SEQ ID NO: 3027805 - RNA, 22 nt, Mycobacterium avium subsp. paratuberculosis
gaucaccgcggccaccaccgcc

SEQ ID NO: 3027806 - RNA, 23 nt, Mycobacterium avium subsp. paratuberculosis
gaucaccgcggccaccaccgcca

SEQ ID NO: 3027807 - RNA, 17 nt, Mycobacterium avium subsp. paratuberculosis
gaucaccgcggccaccu

SEQ ID NO: 3027808 - RNA, 14 nt, Mycobacterium avium subsp. paratuberculosis
gaucaccgcguagc

SEQ ID NO: 3027809 - RNA, 19 nt, Mycobacterium avium subsp. paratuberculosis
gaucaccgcguagcgccgc

SEQ ID NO: 3027810 - RNA, 21 nt, Mycobacterium avium subsp. paratuberculosis
gaucaccgcguagcgccgccc

SEQ ID NO: 3027811 - RNA, 24 nt, Mycobacterium avium subsp. paratuberculosis
gaucaccgcguagcgccgcccguc

SEQ ID NO: 3027812 - RNA, 12 nt, Mycobacterium avium subsp. paratuberculosis
gaucaccgcguc

SEQ ID NO: 3027813 - RNA, 20 nt, Mycobacterium avium subsp. paratuberculosis
gaucaccgcgucggcccaga

SEQ ID NO: 3027814 - RNA, 20 nt, Mycobacterium avium subsp. paratuberculosis
gaucaccgcguugucggcga

SEQ ID NO: 3027815 - RNA, 14 nt, Mycobacterium avium subsp. paratuberculosis
gaucaccgcugcca

SEQ ID NO: 3027816 - RNA, 11 nt, Mycobacterium avium subsp. paratuberculosis
gaucaccggca

SEQ ID NO: 3027817 - RNA, 19 nt, Mycobacterium avium subsp. paratuberculosis
gaucaccggcagcagcgcg

SEQ ID NO: 3027818 - RNA, 20 nt, Mycobacterium avium subsp. paratuberculosis
gaucaccggcagcagcgcgu

SEQ ID NO: 3027819 - RNA, 21 nt, Mycobacterium avium subsp. paratuberculosis
gaucaccggcgcguuggcccg

SEQ ID NO: 3027820 - RNA, 21 nt, Mycobacterium avium subsp. paratuberculosis
gaucaccggcuuggcggugau

SEQ ID NO: 3027821 - RNA, 14 nt, Mycobacterium avium subsp. paratuberculosis
gaucaccgggcggc

SEQ ID NO: 3027822 - RNA, 17 nt, Mycobacterium avium subsp. paratuberculosis
gaucaccgggcggccgu

SEQ ID NO: 3027823 - RNA, 14 nt, Mycobacterium avium subsp. paratuberculosis
gaucaccgugaucg

SEQ ID NO: 3027824 - RNA, 15 nt, Mycobacterium avium subsp. paratuberculosis
gaucaccgugaucgc

SEQ ID NO: 3027825 - RNA, 18 nt, Mycobacterium avium subsp. paratuberculosis
gaucaccgugaucgccac

SEQ ID NO: 3027826 - RNA, 21 nt, Mycobacterium avium subsp. paratuberculosis
gaucaccgugaucgccaccac

SEQ ID NO: 3027827 - RNA, 17 nt, Mycobacterium avium subsp. paratuberculosis
gaucaccucaucgccca

SEQ ID NO: 3027828 - RNA, 23 nt, Mycobacterium avium subsp. paratuberculosis
gaucaccucaucgcccagccggc

SEQ ID NO: 3027829 - RNA, 16 nt, Mycobacterium avium subsp. paratuberculosis
gaucaccucgccggcc

SEQ ID NO: 3027830 - RNA, 19 nt, Mycobacterium avium subsp. paratuberculosis
gaucaccucgccggccggg

SEQ ID NO: 3027831 - RNA, 22 nt, Mycobacterium avium subsp. paratuberculosis
gaucaccucgcugacgucgaug

SEQ ID NO: 3027832 - RNA, 14 nt, Mycobacterium avium subsp. paratuberculosis
gaucaccucgguga

SEQ ID NO: 3027833 - RNA, 23 nt, Mycobacterium avium subsp. paratuberculosis
gaucaccucggugaugucgacgu

SEQ ID NO: 3027834 - RNA, 15 nt, Mycobacterium avium subsp. paratuberculosis
gaucaccugcgggcg

SEQ ID NO: 3027835 - RNA, 15 nt, Mycobacterium avium subsp. paratuberculosis
gaucaccuugcggcc

SEQ ID NO: 3027836 - RNA, 18 nt, Mycobacterium avium subsp. paratuberculosis
gaucaccuugcggccggc

SEQ ID NO: 3027837 - RNA, 19 nt, Mycobacterium avium subsp. paratuberculosis
gaucaccuugcggccggcg

SEQ ID NO: 3027838 - RNA, 22 nt, Mycobacterium avium subsp. paratuberculosis
gaucaccuugcggccggcggcg

SEQ ID NO: 3027839 - RNA, 14 nt, Mycobacterium avium subsp. paratuberculosis
gaucacgaagaacu

SEQ ID NO: 3027840 - RNA, 21 nt, Mycobacterium avium subsp. paratuberculosis
gaucacgaaguugaucgcggc

SEQ ID NO: 3027841 - RNA, 13 nt, Mycobacterium avium subsp. paratuberculosis
gaucacgauguug

SEQ ID NO: 3027842 - RNA, 13 nt, Mycobacterium avium subsp. paratuberculosis
gaucacgccggug

SEQ ID NO: 3027843 - RNA, 16 nt, Mycobacterium avium subsp. paratuberculosis
gaucacgccggugagc

SEQ ID NO: 3027844 - RNA, 17 nt, Mycobacterium avium subsp. paratuberculosis
gaucacgccggugagca

SEQ ID NO: 3027845 - RNA, 23 nt, Mycobacterium avium subsp. paratuberculosis
gaucacgccggugagcacgaccg

SEQ ID NO: 3027846 - RNA, 14 nt, Mycobacterium avium subsp. paratuberculosis
gaucacgccggugg

SEQ ID NO: 3027847 - RNA, 13 nt, Mycobacterium avium subsp. paratuberculosis
gaucacgcggcgg

SEQ ID NO: 3027848 - RNA, 14 nt, Mycobacterium avium subsp. paratuberculosis
gaucacgcggcggg

SEQ ID NO: 3027849 - RNA, 12 nt, Mycobacterium avium subsp. paratuberculosis
gaucacgggcac

SEQ ID NO: 3027850 - RNA, 18 nt, Mycobacterium avium subsp. paratuberculosis
gaucacggugaucgccgg

SEQ ID NO: 3027851 - RNA, 20 nt, Mycobacterium avium subsp. paratuberculosis
gaucacguguccgucgccgg

SEQ ID NO: 3027852 - RNA, 22 nt, Mycobacterium avium subsp. paratuberculosis
gaucacguucaccugacgcauc

SEQ ID NO: 3027853 - RNA, 18 nt, Mycobacterium avium subsp. paratuberculosis
gaucacguugucgcggcc

SEQ ID NO: 3027854 - RNA, 14 nt, Mycobacterium avium subsp. paratuberculosis
gaucagagcgggcc

SEQ ID NO: 3027855 - RNA, 15 nt, Mycobacterium avium subsp. paratuberculosis
gaucagagcgggccg

SEQ ID NO: 3027856 - RNA, 21 nt, Mycobacterium avium subsp. paratuberculosis
gaucagcaccagguggcccga

SEQ ID NO: 3027857 - RNA, 15 nt, Mycobacterium avium subsp. paratuberculosis
gaucagcaccagguu

SEQ ID NO: 3027858 - RNA, 15 nt, Mycobacterium avium subsp. paratuberculosis
gaucagcaccgccac

SEQ ID NO: 3027859 - RNA, 16 nt, Mycobacterium avium subsp. paratuberculosis
gaucagcaccgccacg

SEQ ID NO: 3027860 - RNA, 23 nt, Mycobacterium avium subsp. paratuberculosis
gaucagcaccgccacgccguugg

SEQ ID NO: 3027861 - RNA, 16 nt, Mycobacterium avium subsp. paratuberculosis
gaucagcaccggguga

SEQ ID NO: 3027862 - RNA, 16 nt, Mycobacterium avium subsp. paratuberculosis
gaucagcaccguccac

SEQ ID NO: 3027863 - RNA, 18 nt, Mycobacterium avium subsp. paratuberculosis
gaucagcaccguccacag

SEQ ID NO: 3027864 - RNA, 23 nt, Mycobacterium avium subsp. paratuberculosis
gaucagcaccguccacagccggc

SEQ ID NO: 3027865 - RNA, 24 nt, Mycobacterium avium subsp. paratuberculosis
gaucagcaccguccacagccggcg

SEQ ID NO: 3027866 - RNA, 11 nt, Mycobacterium avium subsp. paratuberculosis
gaucagcagca

SEQ ID NO: 3027867 - RNA, 13 nt, Mycobacterium avium subsp. paratuberculosis
gaucagcagcacc

SEQ ID NO: 3027868 - RNA, 15 nt, Mycobacterium avium subsp. paratuberculosis
gaucagcagcacccg

SEQ ID NO: 3027869 - RNA, 14 nt, Mycobacterium avium subsp. paratuberculosis
gaucagcagcaccg

SEQ ID NO: 3027870 - RNA, 13 nt, Mycobacterium avium subsp. paratuberculosis
gaucagcagcagg

SEQ ID NO: 3027871 - RNA, 14 nt, Mycobacterium avium subsp. paratuberculosis
gaucagcagccggg

SEQ ID NO: 3027872 - RNA, 16 nt, Mycobacterium avium subsp. paratuberculosis
gaucagcagccgggcc

SEQ ID NO: 3027873 - RNA, 17 nt, Mycobacterium avium subsp. paratuberculosis
gaucagcaggcccucgg

SEQ ID NO: 3027874 - RNA, 22 nt, Mycobacterium avium subsp. paratuberculosis
gaucagcaggcccucggccagc

SEQ ID NO: 3027875 - RNA, 22 nt, Mycobacterium avium subsp. paratuberculosis
gaucagcaggcuggcggcgauc

SEQ ID NO: 3027876 - RNA, 21 nt, Mycobacterium avium subsp. paratuberculosis
gaucagcagguugauccgcgc

SEQ ID NO: 3027877 - RNA, 24 nt, Mycobacterium avium subsp. paratuberculosis
gaucagcagguugauccgcgcguc

SEQ ID NO: 3027878 - RNA, 15 nt, Mycobacterium avium subsp. paratuberculosis
gaucagcaugccggu

SEQ ID NO: 3027879 - RNA, 17 nt, Mycobacterium avium subsp. paratuberculosis
gaucagccacaccgccg

SEQ ID NO: 3027880 - RNA, 19 nt, Mycobacterium avium subsp. paratuberculosis
gaucagccacaccgccggc

SEQ ID NO: 3027881 - RNA, 23 nt, Mycobacterium avium subsp. paratuberculosis
gaucagccacaccgccggcgcgg

SEQ ID NO: 3027882 - RNA, 23 nt, Mycobacterium avium subsp. paratuberculosis
gaucagccaguugaucagcccga

SEQ ID NO: 3027883 - RNA, 15 nt, Mycobacterium avium subsp. paratuberculosis
gaucagcccgcccac

SEQ ID NO: 3027884 - RNA, 18 nt, Mycobacterium avium subsp. paratuberculosis
gaucagcccgcccaccac

SEQ ID NO: 3027885 - RNA, 13 nt, Mycobacterium avium subsp. paratuberculosis
gaucagcccggcc

SEQ ID NO: 3027886 - RNA, 15 nt, Mycobacterium avium subsp. paratuberculosis
gaucagcccggcccg

SEQ ID NO: 3027887 - RNA, 17 nt, Mycobacterium avium subsp. paratuberculosis
gaucagcccggcccgca

SEQ ID NO: 3027888 - RNA, 15 nt, Mycobacterium avium subsp. paratuberculosis
gaucagccguaccga

SEQ ID NO: 3027889 - RNA, 17 nt, Mycobacterium avium subsp. paratuberculosis
gaucagccguaccgauc

SEQ ID NO: 3027890 - RNA, 14 nt, Mycobacterium avium subsp. paratuberculosis
gaucagcgaaggca

SEQ ID NO: 3027891 - RNA, 14 nt, Mycobacterium avium subsp. paratuberculosis
gaucagcgacggcc

SEQ ID NO: 3027892 - RNA, 17 nt, Mycobacterium avium subsp. paratuberculosis
gaucagcgacggcccgc

SEQ ID NO: 3027893 - RNA, 19 nt, Mycobacterium avium subsp. paratuberculosis
gaucagcgacucgaccccg

SEQ ID NO: 3027894 - RNA, 21 nt, Mycobacterium avium subsp. paratuberculosis
gaucagcgccagcaacaccca

SEQ ID NO: 3027895 - RNA, 23 nt, Mycobacterium avium subsp. paratuberculosis
gaucagcgccgucuccucgacca

SEQ ID NO: 3027896 - RNA, 23 nt, Mycobacterium avium subsp. paratuberculosis
gaucagcgccguggcccggucgg

SEQ ID NO: 3027897 - RNA, 16 nt, Mycobacterium avium subsp. paratuberculosis
gaucagcgccuggucc

SEQ ID NO: 3027898 - RNA, 23 nt, Mycobacterium avium subsp. paratuberculosis
gaucagcgccugguccucccggg

SEQ ID NO: 3027899 - RNA, 12 nt, Mycobacterium avium subsp. paratuberculosis
gaucagcgcgca

SEQ ID NO: 3027900 - RNA, 18 nt, Mycobacterium avium subsp. paratuberculosis
gaucagcgcgcacagcgc

SEQ ID NO: 3027901 - RNA, 16 nt, Mycobacterium avium subsp. paratuberculosis
gaucagcgcgcccagg

SEQ ID NO: 3027902 - RNA, 19 nt, Mycobacterium avium subsp. paratuberculosis
gaucagcgcgccgcccagc

SEQ ID NO: 3027903 - RNA, 17 nt, Mycobacterium avium subsp. paratuberculosis
gaucagcgcguccaacc

SEQ ID NO: 3027904 - RNA, 20 nt, Mycobacterium avium subsp. paratuberculosis
gaucagcgcguccaaccgcg

SEQ ID NO: 3027905 - RNA, 14 nt, Mycobacterium avium subsp. paratuberculosis
gaucagcgcgucgg

SEQ ID NO: 3027906 - RNA, 22 nt, Mycobacterium avium subsp. paratuberculosis
gaucagcggauagaggcggcgc

SEQ ID NO: 3027907 - RNA, 12 nt, Mycobacterium avium subsp. paratuberculosis
gaucagcggcgg

SEQ ID NO: 3027908 - RNA, 14 nt, Mycobacterium avium subsp. paratuberculosis
gaucagcggcgggc

SEQ ID NO: 3027909 - RNA, 19 nt, Mycobacterium avium subsp. paratuberculosis
gaucagcgggcuguccgcg

SEQ ID NO: 3027910 - RNA, 15 nt, Mycobacterium avium subsp. paratuberculosis
gaucagcgguccacc

SEQ ID NO: 3027911 - RNA, 15 nt, Mycobacterium avium subsp. paratuberculosis
gaucagcgucgcgau

SEQ ID NO: 3027912 - RNA, 13 nt, Mycobacterium avium subsp. paratuberculosis
gaucagcgugguc

SEQ ID NO: 3027913 - RNA, 19 nt, Mycobacterium avium subsp. paratuberculosis
gaucagcguuccggcggcc

SEQ ID NO: 3027914 - RNA, 12 nt, Mycobacterium avium subsp. paratuberculosis
gaucagcuccuc

SEQ ID NO: 3027915 - RNA, 14 nt, Mycobacterium avium subsp. paratuberculosis
gaucagcucgccga

SEQ ID NO: 3027916 - RNA, 16 nt, Mycobacterium avium subsp. paratuberculosis
gaucagcucgcgcauc

SEQ ID NO: 3027917 - RNA, 13 nt, Mycobacterium avium subsp. paratuberculosis
gaucagcucgugg

SEQ ID NO: 3027918 - RNA, 16 nt, Mycobacterium avium subsp. paratuberculosis
gaucagcucguggcgg

SEQ ID NO: 3027919 - RNA, 15 nt, Mycobacterium avium subsp. paratuberculosis
gaucagcucuucgau

SEQ ID NO: 3027920 - RNA, 16 nt, Mycobacterium avium subsp. paratuberculosis
gaucagcugaccggcg

SEQ ID NO: 3027921 - RNA, 19 nt, Mycobacterium avium subsp. paratuberculosis
gaucaggaucggcgggcgc

SEQ ID NO: 3027922 - RNA, 17 nt, Mycobacterium avium subsp. paratuberculosis
gaucaggccccacccgc

SEQ ID NO: 3027923 - RNA, 18 nt, Mycobacterium avium subsp. paratuberculosis
gaucaggccccacccgca

SEQ ID NO: 3027924 - RNA, 17 nt, Mycobacterium avium subsp. paratuberculosis
gaucaggcccucgucgg

SEQ ID NO: 3027925 - RNA, 17 nt, Mycobacterium avium subsp. paratuberculosis
gaucagggcccacagca

SEQ ID NO: 3027926 - RNA, 20 nt, Mycobacterium avium subsp. paratuberculosis
gaucagggcccacagcagcc

SEQ ID NO: 3027927 - RNA, 17 nt, Mycobacterium avium subsp. paratuberculosis
gaucagggccgcggccg

SEQ ID NO: 3027928 - RNA, 22 nt, Mycobacterium avium subsp. paratuberculosis
gaucagggccgcggccgccgcg

SEQ ID NO: 3027929 - RNA, 13 nt, Mycobacterium avium subsp. paratuberculosis
gaucagggcggcg

SEQ ID NO: 3027930 - RNA, 14 nt, Mycobacterium avium subsp. paratuberculosis
gaucagggcggcgc

SEQ ID NO: 3027931 - RNA, 15 nt, Mycobacterium avium subsp. paratuberculosis
gaucagggcggcgcc

SEQ ID NO: 3027932 - RNA, 16 nt, Mycobacterium avium subsp. paratuberculosis
gaucagggcggcgcgc

SEQ ID NO: 3027933 - RNA, 16 nt, Mycobacterium avium subsp. paratuberculosis
gaucagggugcucagc

SEQ ID NO: 3027934 - RNA, 20 nt, Mycobacterium avium subsp. paratuberculosis
gaucagggugcucagccgca

SEQ ID NO: 3027935 - RNA, 22 nt, Mycobacterium avium subsp. paratuberculosis
gaucagggugucgaacagcagg

SEQ ID NO: 3027936 - RNA, 23 nt, Mycobacterium avium subsp. paratuberculosis
gaucagguaccgguuccgggcga

SEQ ID NO: 3027937 - RNA, 23 nt, Mycobacterium avium subsp. paratuberculosis
gaucagguagaggcuguccagca

SEQ ID NO: 3027938 - RNA, 24 nt, Mycobacterium avium subsp. paratuberculosis
gaucagguccggaaucaccuugcc

SEQ ID NO: 3027939 - RNA, 23 nt, Mycobacterium avium subsp. paratuberculosis
gaucagguccuugcgcgccgcga

SEQ ID NO: 3027940 - RNA, 16 nt, Mycobacterium avium subsp. paratuberculosis
gaucaggucgccgauc

SEQ ID NO: 3027941 - RNA, 20 nt, Mycobacterium avium subsp. paratuberculosis
gaucaggucgccgauccagc

SEQ ID NO: 3027942 - RNA, 13 nt, Mycobacterium avium subsp. paratuberculosis
gaucagguggggc

SEQ ID NO: 3027943 - RNA, 16 nt, Mycobacterium avium subsp. paratuberculosis
gaucagugccgcgcca

SEQ ID NO: 3027944 - RNA, 16 nt, Mycobacterium avium subsp. paratuberculosis
gaucaucaccaccgcc

SEQ ID NO: 3027945 - RNA, 19 nt, Mycobacterium avium subsp. paratuberculosis
gaucaucaccaccgccgcc

SEQ ID NO: 3027946 - RNA, 23 nt, Mycobacterium avium subsp. paratuberculosis
gaucauccaggugaacagcagcc

SEQ ID NO: 3027947 - RNA, 19 nt, Mycobacterium avium subsp. paratuberculosis
gaucaucccggccaccccg

SEQ ID NO: 3027948 - RNA, 17 nt, Mycobacterium avium subsp. paratuberculosis
gaucauccggcggggga

SEQ ID NO: 3027949 - RNA, 19 nt, Mycobacterium avium subsp. paratuberculosis
gaucauccggcgggggauc

SEQ ID NO: 3027950 - RNA, 19 nt, Mycobacterium avium subsp. paratuberculosis
gaucaucgagggcguccuu

SEQ ID NO: 3027951 - RNA, 13 nt, Mycobacterium avium subsp. paratuberculosis
gaucaucgccucg

SEQ ID NO: 3027952 - RNA, 16 nt, Mycobacterium avium subsp. paratuberculosis
gaucaucgccucgguc

SEQ ID NO: 3027953 - RNA, 15 nt, Mycobacterium avium subsp. paratuberculosis
gaucaucgcgucggu

SEQ ID NO: 3027954 - RNA, 13 nt, Mycobacterium avium subsp. paratuberculosis
gaucaugccggcg

SEQ ID NO: 3027955 - RNA, 19 nt, Mycobacterium avium subsp. paratuberculosis
gaucaugcgcgucauggcc

SEQ ID NO: 3027956 - RNA, 15 nt, Mycobacterium avium subsp. paratuberculosis
gaucauggucggcga

SEQ ID NO: 3027957 - RNA, 16 nt, Mycobacterium avium subsp. paratuberculosis
gaucauggucggcgac

SEQ ID NO: 3027958 - RNA, 17 nt, Mycobacterium avium subsp. paratuberculosis
gaucauguagcgcuggu

SEQ ID NO: 3027959 - RNA, 22 nt, Mycobacterium avium subsp. paratuberculosis
gaucaugucgguaaggcaggca

SEQ ID NO: 3027960 - RNA, 23 nt, Mycobacterium avium subsp. paratuberculosis
gaucaugucgguaaggcaggcac

SEQ ID NO: 3027961 - RNA, 13 nt, Mycobacterium avium subsp. paratuberculosis
gaucaugucgucc

SEQ ID NO: 3027962 - RNA, 20 nt, Mycobacterium avium subsp. paratuberculosis
gaucaugucguugaugccgu

SEQ ID NO: 3027963 - RNA, 23 nt, Mycobacterium avium subsp. paratuberculosis
gaucauuccgccgaaacccgcug

SEQ ID NO: 3027964 - RNA, 17 nt, Mycobacterium avium subsp. paratuberculosis
gaucauuugaccgcaca

SEQ ID NO: 3027965 - RNA, 20 nt, Mycobacterium avium subsp. paratuberculosis
gauccaccaauucgcgcugc

SEQ ID NO: 3027966 - RNA, 17 nt, Mycobacterium avium subsp. paratuberculosis
gauccaccaucuuccau

SEQ ID NO: 3027967 - RNA, 12 nt, Mycobacterium avium subsp. paratuberculosis
gauccaccgcgc

SEQ ID NO: 3027968 - RNA, 16 nt, Mycobacterium avium subsp. paratuberculosis
gauccaccgcgcggcc

SEQ ID NO: 3027969 - RNA, 14 nt, Mycobacterium avium subsp. paratuberculosis
gauccacggcgacc

SEQ ID NO: 3027970 - RNA, 15 nt, Mycobacterium avium subsp. paratuberculosis
gauccacuccagcac

SEQ ID NO: 3027971 - RNA, 17 nt, Mycobacterium avium subsp. paratuberculosis
gauccacuccagcaccg

SEQ ID NO: 3027972 - RNA, 15 nt, Mycobacterium avium subsp. paratuberculosis
gauccacucccgcgc

SEQ ID NO: 3027973 - RNA, 20 nt, Mycobacterium avium subsp. paratuberculosis
gauccacucccgcgcgcugu

SEQ ID NO: 3027974 - RNA, 15 nt, Mycobacterium avium subsp. paratuberculosis
gauccagagcaucag

SEQ ID NO: 3027975 - RNA, 18 nt, Mycobacterium avium subsp. paratuberculosis
gauccagaugccgggugg

SEQ ID NO: 3027976 - RNA, 14 nt, Mycobacterium avium subsp. paratuberculosis
gauccagcaccgcc

SEQ ID NO: 3027977 - RNA, 16 nt, Mycobacterium avium subsp. paratuberculosis
gauccagcaccgccac

SEQ ID NO: 3027978 - RNA, 12 nt, Mycobacterium avium subsp. paratuberculosis
gauccagcagcg

SEQ ID NO: 3027979 - RNA, 14 nt, Mycobacterium avium subsp. paratuberculosis
gauccagcagcgcc

SEQ ID NO: 3027980 - RNA, 15 nt, Mycobacterium avium subsp. paratuberculosis
gauccagcagcgccu

SEQ ID NO: 3027981 - RNA, 22 nt, Mycobacterium avium subsp. paratuberculosis
gauccagcccugcucggccagc

SEQ ID NO: 3027982 - RNA, 19 nt, Mycobacterium avium subsp. paratuberculosis
gauccagcgcuggccggcc

SEQ ID NO: 3027983 - RNA, 22 nt, Mycobacterium avium subsp. paratuberculosis
gauccagcgcuggccggccacc

SEQ ID NO: 3027984 - RNA, 14 nt, Mycobacterium avium subsp. paratuberculosis
gauccagcggcgca

SEQ ID NO: 3027985 - RNA, 15 nt, Mycobacterium avium subsp. paratuberculosis
gauccagcggcggcc

SEQ ID NO: 3027986 - RNA, 16 nt, Mycobacterium avium subsp. paratuberculosis
gauccagcggcggccu

SEQ ID NO: 3027987 - RNA, 17 nt, Mycobacterium avium subsp. paratuberculosis
gauccaggaauucgggc

SEQ ID NO: 3027988 - RNA, 18 nt, Mycobacterium avium subsp. paratuberculosis
gauccaggaauucgggca

SEQ ID NO: 3027989 - RNA, 21 nt, Mycobacterium avium subsp. paratuberculosis
gauccagguacugggcguggu

SEQ ID NO: 3027990 - RNA, 17 nt, Mycobacterium avium subsp. paratuberculosis
gauccagguggggcacg

SEQ ID NO: 3027991 - RNA, 21 nt, Mycobacterium avium subsp. paratuberculosis
gauccagguggggcacgggcg

SEQ ID NO: 3027992 - RNA, 23 nt, Mycobacterium avium subsp. paratuberculosis
gaucccagaauucgccggggcac

SEQ ID NO: 3027993 - RNA, 15 nt, Mycobacterium avium subsp. paratuberculosis
gaucccagacccagc

SEQ ID NO: 3027994 - RNA, 15 nt, Mycobacterium avium subsp. paratuberculosis
gaucccagcgggaca

SEQ ID NO: 3027995 - RNA, 15 nt, Mycobacterium avium subsp. paratuberculosis
gauccccaccgugac

SEQ ID NO: 3027996 - RNA, 13 nt, Mycobacterium avium subsp. paratuberculosis
gauccccagcggc

SEQ ID NO: 3027997 - RNA, 13 nt, Mycobacterium avium subsp. paratuberculosis
gauccccgcagcu

SEQ ID NO: 3027998 - RNA, 16 nt, Mycobacterium avium subsp. paratuberculosis
gauccccgcagcuccc

SEQ ID NO: 3027999 - RNA, 23 nt, Mycobacterium avium subsp. paratuberculosis
gauccccgcgcugggcuggccgu

SEQ ID NO: 3028000 - RNA, 19 nt, Mycobacterium avium subsp. paratuberculosis
gaucccgaaaccgucgacc

SEQ ID NO: 3028001 - RNA, 20 nt, Mycobacterium avium subsp. paratuberculosis
gaucccgaaaccgucgacca

SEQ ID NO: 3028002 - RNA, 17 nt, Mycobacterium avium subsp. paratuberculosis
gaucccgaacugccgcg

SEQ ID NO: 3028003 - RNA, 18 nt, Mycobacterium avium subsp. paratuberculosis
gaucccgaacugccgcgc

SEQ ID NO: 3028004 - RNA, 19 nt, Mycobacterium avium subsp. paratuberculosis
gaucccgaggaugccgccc

SEQ ID NO: 3028005 - RNA, 17 nt, Mycobacterium avium subsp. paratuberculosis
gaucccgcagccgcgac

SEQ ID NO: 3028006 - RNA, 12 nt, Mycobacterium avium subsp. paratuberculosis
gaucccgcagcu

SEQ ID NO: 3028007 - RNA, 13 nt, Mycobacterium avium subsp. paratuberculosis
gaucccgccgccc

SEQ ID NO: 3028008 - RNA, 14 nt, Mycobacterium avium subsp. paratuberculosis
gaucccgccgcccg

SEQ ID NO: 3028009 - RNA, 15 nt, Mycobacterium avium subsp. paratuberculosis
gaucccgccgcccgc

SEQ ID NO: 3028010 - RNA, 22 nt, Mycobacterium avium subsp. paratuberculosis
gaucccgccgcccgcccgagcg

SEQ ID NO: 3028011 - RNA, 16 nt, Mycobacterium avium subsp. paratuberculosis
gaucccgccggcggcc

SEQ ID NO: 3028012 - RNA, 17 nt, Mycobacterium avium subsp. paratuberculosis
gaucccgccggcggcca

SEQ ID NO: 3028013 - RNA, 21 nt, Mycobacterium avium subsp. paratuberculosis
gaucccgccggcggccacgau

SEQ ID NO: 3028014 - RNA, 14 nt, Mycobacterium avium subsp. paratuberculosis
gaucccgcuggcca

SEQ ID NO: 3028015 - RNA, 23 nt, Mycobacterium avium subsp. paratuberculosis
gaucccggacuccucgguggccu

SEQ ID NO: 3028016 - RNA, 14 nt, Mycobacterium avium subsp. paratuberculosis
gaucccggccagca

SEQ ID NO: 3028017 - RNA, 20 nt, Mycobacterium avium subsp. paratuberculosis
gaucccggcgagcacgccgc

SEQ ID NO: 3028018 - RNA, 22 nt, Mycobacterium avium subsp. paratuberculosis
gaucccggcgagcacgccgccg

SEQ ID NO: 3028019 - RNA, 13 nt, Mycobacterium avium subsp. paratuberculosis
gaucccggggcgc

SEQ ID NO: 3028020 - RNA, 16 nt, Mycobacterium avium subsp. paratuberculosis
gaucccggggcgcgcu

SEQ ID NO: 3028021 - RNA, 18 nt, Mycobacterium avium subsp. paratuberculosis
gaucccggggcgcgcugg

SEQ ID NO: 3028022 - RNA, 13 nt, Mycobacterium avium subsp. paratuberculosis
gaucccggugaug

SEQ ID NO: 3028023 - RNA, 19 nt, Mycobacterium avium subsp. paratuberculosis
gaucccguaggucgccucc

SEQ ID NO: 3028024 - RNA, 21 nt, Mycobacterium avium subsp. paratuberculosis
gaucccgucgucggcgccgcg

SEQ ID NO: 3028025 - RNA, 17 nt, Mycobacterium avium subsp. paratuberculosis
gaucccuuggcggcggc

SEQ ID NO: 3028026 - RNA, 20 nt, Mycobacterium avium subsp. paratuberculosis
gaucccuuggcggcggccag

SEQ ID NO: 3028027 - RNA, 17 nt, Mycobacterium avium subsp. paratuberculosis
gauccgaggguucggug

SEQ ID NO: 3028028 - RNA, 16 nt, Mycobacterium avium subsp. paratuberculosis
gauccgaucagcagca

SEQ ID NO: 3028029 - RNA, 17 nt, Mycobacterium avium subsp. paratuberculosis
gauccgaucagcagcac

SEQ ID NO: 3028030 - RNA, 14 nt, Mycobacterium avium subsp. paratuberculosis
gauccgaugcaggg

SEQ ID NO: 3028031 - RNA, 17 nt, Mycobacterium avium subsp. paratuberculosis
gauccgaugcagggccg

SEQ ID NO: 3028032 - RNA, 22 nt, Mycobacterium avium subsp. paratuberculosis
gauccgcaccggacgcagcgau

SEQ ID NO: 3028033 - RNA, 14 nt, Mycobacterium avium subsp. paratuberculosis
gauccgcccgccgg

SEQ ID NO: 3028034 - RNA, 23 nt, Mycobacterium avium subsp. paratuberculosis
gauccgcccgccgguggccgcga

SEQ ID NO: 3028035 - RNA, 17 nt, Mycobacterium avium subsp. paratuberculosis
gauccgcccggcccgca

SEQ ID NO: 3028036 - RNA, 21 nt, Mycobacterium avium subsp. paratuberculosis
gauccgcccggcccgcaugca

SEQ ID NO: 3028037 - RNA, 19 nt, Mycobacterium avium subsp. paratuberculosis
gauccgccggugccguuga

SEQ ID NO: 3028038 - RNA, 15 nt, Mycobacterium avium subsp. paratuberculosis
gauccgccugcgcgg

SEQ ID NO: 3028039 - RNA, 19 nt, Mycobacterium avium subsp. paratuberculosis
gauccgccugcgcgggcgc

SEQ ID NO: 3028040 - RNA, 21 nt, Mycobacterium avium subsp. paratuberculosis
gauccgcgccgccgccagcca

SEQ ID NO: 3028041 - RNA, 13 nt, Mycobacterium avium subsp. paratuberculosis
gauccgcgccgcg

SEQ ID NO: 3028042 - RNA, 17 nt, Mycobacterium avium subsp. paratuberculosis
gauccgcgcggccacca

SEQ ID NO: 3028043 - RNA, 20 nt, Mycobacterium avium subsp. paratuberculosis
gauccgcgcggccaccagcg

SEQ ID NO: 3028044 - RNA, 21 nt, Mycobacterium avium subsp. paratuberculosis
gauccgcgcggccaccagcgc

SEQ ID NO: 3028045 - RNA, 16 nt, Mycobacterium avium subsp. paratuberculosis
gauccgcggcgccggg

SEQ ID NO: 3028046 - RNA, 19 nt, Mycobacterium avium subsp. paratuberculosis
gauccgcggcgccgggcgg

SEQ ID NO: 3028047 - RNA, 20 nt, Mycobacterium avium subsp. paratuberculosis
gauccgcggcgccgggcggc

SEQ ID NO: 3028048 - RNA, 22 nt, Mycobacterium avium subsp. paratuberculosis
gauccgcggcgccgggcggccc

SEQ ID NO: 3028049 - RNA, 24 nt, Mycobacterium avium subsp. paratuberculosis
gauccgcggcgccgggcggcccgc

SEQ ID NO: 3028050 - RNA, 13 nt, Mycobacterium avium subsp. paratuberculosis
gauccgcgggccg

SEQ ID NO: 3028051 - RNA, 15 nt, Mycobacterium avium subsp. paratuberculosis
gauccgcgggccggc

SEQ ID NO: 3028052 - RNA, 16 nt, Mycobacterium avium subsp. paratuberculosis
gauccgcgggccggca

SEQ ID NO: 3028053 - RNA, 20 nt, Mycobacterium avium subsp. paratuberculosis
gauccgcggguacggucggc

SEQ ID NO: 3028054 - RNA, 21 nt, Mycobacterium avium subsp. paratuberculosis
gauccgcggguacggucggcc

SEQ ID NO: 3028055 - RNA, 22 nt, Mycobacterium avium subsp. paratuberculosis
gauccgcggguacggucggccg

SEQ ID NO: 3028056 - RNA, 24 nt, Mycobacterium avium subsp. paratuberculosis
gauccgcggguacggucggccgua

SEQ ID NO: 3028057 - RNA, 13 nt, Mycobacterium avium subsp. paratuberculosis
gauccggacgacc

SEQ ID NO: 3028058 - RNA, 22 nt, Mycobacterium avium subsp. paratuberculosis
gauccggacgaccugggcgccg

SEQ ID NO: 3028059 - RNA, 15 nt, Mycobacterium avium subsp. paratuberculosis
gauccggaucgggcg

SEQ ID NO: 3028060 - RNA, 16 nt, Mycobacterium avium subsp. paratuberculosis
gauccggaucgggcgg

SEQ ID NO: 3028061 - RNA, 12 nt, Mycobacterium avium subsp. paratuberculosis
gauccggccgcu

SEQ ID NO: 3028062 - RNA, 13 nt, Mycobacterium avium subsp. paratuberculosis
gauccggccggcg

SEQ ID NO: 3028063 - RNA, 14 nt, Mycobacterium avium subsp. paratuberculosis
gauccggccggcgg

SEQ ID NO: 3028064 - RNA, 15 nt, Mycobacterium avium subsp. paratuberculosis
gauccggcgcccgau

SEQ ID NO: 3028065 - RNA, 14 nt, Mycobacterium avium subsp. paratuberculosis
gauccggcgccgcg

SEQ ID NO: 3028066 - RNA, 17 nt, Mycobacterium avium subsp. paratuberculosis
gauccggcgccgcgggc

SEQ ID NO: 3028067 - RNA, 18 nt, Mycobacterium avium subsp. paratuberculosis
gauccggcgccgcgggcg

SEQ ID NO: 3028068 - RNA, 19 nt, Mycobacterium avium subsp. paratuberculosis
gauccggcgccgcgggcgc

SEQ ID NO: 3028069 - RNA, 17 nt, Mycobacterium avium subsp. paratuberculosis
gauccggcgcgccgcga

SEQ ID NO: 3028070 - RNA, 23 nt, Mycobacterium avium subsp. paratuberculosis
gauccggcgcgccgcgauuuccg

SEQ ID NO: 3028071 - RNA, 21 nt, Mycobacterium avium subsp. paratuberculosis
gauccggcgucucagucggcc

SEQ ID NO: 3028072 - RNA, 16 nt, Mycobacterium avium subsp. paratuberculosis
gauccggcugagcagc

SEQ ID NO: 3028073 - RNA, 18 nt, Mycobacterium avium subsp. paratuberculosis
gauccggcugagcagcuc

SEQ ID NO: 3028074 - RNA, 19 nt, Mycobacterium avium subsp. paratuberculosis
gauccggcugagcagcucg

SEQ ID NO: 3028075 - RNA, 21 nt, Mycobacterium avium subsp. paratuberculosis
gauccggcugagcagcucgcg

SEQ ID NO: 3028076 - RNA, 17 nt, Mycobacterium avium subsp. paratuberculosis
gauccgggcacgcagcg

SEQ ID NO: 3028077 - RNA, 21 nt, Mycobacterium avium subsp. paratuberculosis
gauccgggcauggucaccgga

SEQ ID NO: 3028078 - RNA, 13 nt, Mycobacterium avium subsp. paratuberculosis
gauccgggccggc

SEQ ID NO: 3028079 - RNA, 16 nt, Mycobacterium avium subsp. paratuberculosis
gauccgggccggucgg

SEQ ID NO: 3028080 - RNA, 14 nt, Mycobacterium avium subsp. paratuberculosis
gauccgggcgccgg

SEQ ID NO: 3028081 - RNA, 15 nt, Mycobacterium avium subsp. paratuberculosis
gauccgggcgccggc

SEQ ID NO: 3028082 - RNA, 15 nt, Mycobacterium avium subsp. paratuberculosis
gauccgggcgccggu

SEQ ID NO: 3028083 - RNA, 14 nt, Mycobacterium avium subsp. paratuberculosis
gauccgggcggcag

SEQ ID NO: 3028084 - RNA, 22 nt, Mycobacterium avium subsp. paratuberculosis
gauccgggcggcagguggggca

SEQ ID NO: 3028085 - RNA, 13 nt, Mycobacterium avium subsp. paratuberculosis
gauccggggcacg

SEQ ID NO: 3028086 - RNA, 16 nt, Mycobacterium avium subsp. paratuberculosis
gauccggggcagcagc

SEQ ID NO: 3028087 - RNA, 13 nt, Mycobacterium avium subsp. paratuberculosis
gauccggggggcg

SEQ ID NO: 3028088 - RNA, 17 nt, Mycobacterium avium subsp. paratuberculosis
gauccggggggcggggu

SEQ ID NO: 3028089 - RNA, 18 nt, Mycobacterium avium subsp. paratuberculosis
gauccggucgaucaccuc

SEQ ID NO: 3028090 - RNA, 22 nt, Mycobacterium avium subsp. paratuberculosis
gauccggucgaucaccucgucg

SEQ ID NO: 3028091 - RNA, 12 nt, Mycobacterium avium subsp. paratuberculosis
gauccggugacc

SEQ ID NO: 3028092 - RNA, 16 nt, Mycobacterium avium subsp. paratuberculosis
gauccggugaccgcga

SEQ ID NO: 3028093 - RNA, 17 nt, Mycobacterium avium subsp. paratuberculosis
gauccggugaccgcgac

SEQ ID NO: 3028094 - RNA, 18 nt, Mycobacterium avium subsp. paratuberculosis
gauccggugaccgcgacg

SEQ ID NO: 3028095 - RNA, 15 nt, Mycobacterium avium subsp. paratuberculosis
gauccgucgccccgc

SEQ ID NO: 3028096 - RNA, 22 nt, Mycobacterium avium subsp. paratuberculosis
gauccucagcagcuagcccaga

SEQ ID NO: 3028097 - RNA, 14 nt, Mycobacterium avium subsp. paratuberculosis
gauccucgccgcgg

SEQ ID NO: 3028098 - RNA, 17 nt, Mycobacterium avium subsp. paratuberculosis
gauccucgccgcgggcc

SEQ ID NO: 3028099 - RNA, 23 nt, Mycobacterium avium subsp. paratuberculosis
gauccucgccgcgggccagccag

SEQ ID NO: 3028100 - RNA, 19 nt, Mycobacterium avium subsp. paratuberculosis
gauccucgucuccggcggc

SEQ ID NO: 3028101 - RNA, 14 nt, Mycobacterium avium subsp. paratuberculosis
gauccuggccuggu

SEQ ID NO: 3028102 - RNA, 19 nt, Mycobacterium avium subsp. paratuberculosis
gauccugguuucagguggc

SEQ ID NO: 3028103 - RNA, 18 nt, Mycobacterium avium subsp. paratuberculosis
gauccuuugcggccccaa

SEQ ID NO: 3028104 - RNA, 19 nt, Mycobacterium avium subsp. paratuberculosis
gauccuuugcggccccaau

SEQ ID NO: 3028105 - RNA, 12 nt, Mycobacterium avium subsp. paratuberculosis
gaucgaaaggac

SEQ ID NO: 3028106 - RNA, 15 nt, Mycobacterium avium subsp. paratuberculosis
gaucgaaaggacggg

SEQ ID NO: 3028107 - RNA, 19 nt, Mycobacterium avium subsp. paratuberculosis
gaucgaaaggacgggcgug

SEQ ID NO: 3028108 - RNA, 13 nt, Mycobacterium avium subsp. paratuberculosis
gaucgaaaugacc

SEQ ID NO: 3028109 - RNA, 17 nt, Mycobacterium avium subsp. paratuberculosis
gaucgaaaugaccgcgc

SEQ ID NO: 3028110 - RNA, 18 nt, Mycobacterium avium subsp. paratuberculosis
gaucgaaaugaccgcgcc

SEQ ID NO: 3028111 - RNA, 13 nt, Mycobacterium avium subsp. paratuberculosis
gaucgaacagggc

SEQ ID NO: 3028112 - RNA, 14 nt, Mycobacterium avium subsp. paratuberculosis
gaucgaacagggcg

SEQ ID NO: 3028113 - RNA, 19 nt, Mycobacterium avium subsp. paratuberculosis
gaucgaacagggcggcggg

SEQ ID NO: 3028114 - RNA, 15 nt, Mycobacterium avium subsp. paratuberculosis
gaucgaacggcaccu

SEQ ID NO: 3028115 - RNA, 19 nt, Mycobacterium avium subsp. paratuberculosis
gaucgaacggcaccucgau

SEQ ID NO: 3028116 - RNA, 22 nt, Mycobacterium avium subsp. paratuberculosis
gaucgaacggcaccucgaucac

SEQ ID NO: 3028117 - RNA, 15 nt, Mycobacterium avium subsp. paratuberculosis
gaucgaacggcggaa

SEQ ID NO: 3028118 - RNA, 22 nt, Mycobacterium avium subsp. paratuberculosis
gaucgaacuugaucaccgcgua

SEQ ID NO: 3028119 - RNA, 22 nt, Mycobacterium avium subsp. paratuberculosis
gaucgaaggcgugcucgaucgc

SEQ ID NO: 3028120 - RNA, 23 nt, Mycobacterium avium subsp. paratuberculosis
gaucgaauccggcggcgcucagc

SEQ ID NO: 3028121 - RNA, 18 nt, Mycobacterium avium subsp. paratuberculosis
gaucgacaacgcgugaug

SEQ ID NO: 3028122 - RNA, 22 nt, Mycobacterium avium subsp. paratuberculosis
gaucgacagcuccaacagccgg

SEQ ID NO: 3028123 - RNA, 12 nt, Mycobacterium avium subsp. paratuberculosis
gaucgaccccca

SEQ ID NO: 3028124 - RNA, 16 nt, Mycobacterium avium subsp. paratuberculosis
gaucgacccccaccgc

SEQ ID NO: 3028125 - RNA, 18 nt, Mycobacterium avium subsp. paratuberculosis
gaucgacccccaccgcga

SEQ ID NO: 3028126 - RNA, 21 nt, Mycobacterium avium subsp. paratuberculosis
gaucgacccgcuccgacgcgg

SEQ ID NO: 3028127 - RNA, 14 nt, Mycobacterium avium subsp. paratuberculosis
gaucgaccggacga

SEQ ID NO: 3028128 - RNA, 16 nt, Mycobacterium avium subsp. paratuberculosis
gaucgacgacgccagc

SEQ ID NO: 3028129 - RNA, 23 nt, Mycobacterium avium subsp. paratuberculosis
gaucgacgacgccagcugccgcg

SEQ ID NO: 3028130 - RNA, 17 nt, Mycobacterium avium subsp. paratuberculosis
gaucgacgagccgggcc

SEQ ID NO: 3028131 - RNA, 18 nt, Mycobacterium avium subsp. paratuberculosis
gaucgacgagccgggcca

SEQ ID NO: 3028132 - RNA, 14 nt, Mycobacterium avium subsp. paratuberculosis
gaucgacgccgaca

SEQ ID NO: 3028133 - RNA, 19 nt, Mycobacterium avium subsp. paratuberculosis
gaucgacgccgacaucgcg

SEQ ID NO: 3028134 - RNA, 16 nt, Mycobacterium avium subsp. paratuberculosis
gaucgacgccgaccgc

SEQ ID NO: 3028135 - RNA, 22 nt, Mycobacterium avium subsp. paratuberculosis
gaucgacgucaccaccgggucg

SEQ ID NO: 3028136 - RNA, 23 nt, Mycobacterium avium subsp. paratuberculosis
gaucgacgucagcucccccgaca

SEQ ID NO: 3028137 - RNA, 16 nt, Mycobacterium avium subsp. paratuberculosis
gaucgagcaccagcgu

SEQ ID NO: 3028138 - RNA, 18 nt, Mycobacterium avium subsp. paratuberculosis
gaucgagcaccagcgucg

SEQ ID NO: 3028139 - RNA, 19 nt, Mycobacterium avium subsp. paratuberculosis
gaucgagcaccagcgucga

SEQ ID NO: 3028140 - RNA, 20 nt, Mycobacterium avium subsp. paratuberculosis
gaucgagcaccagcgucgac

SEQ ID NO: 3028141 - RNA, 22 nt, Mycobacterium avium subsp. paratuberculosis
gaucgagcaccagcgucgacgc

SEQ ID NO: 3028142 - RNA, 18 nt, Mycobacterium avium subsp. paratuberculosis
gaucgagcacccggcggg

SEQ ID NO: 3028143 - RNA, 14 nt, Mycobacterium avium subsp. paratuberculosis
gaucgagccgcggc

SEQ ID NO: 3028144 - RNA, 15 nt, Mycobacterium avium subsp. paratuberculosis
gaucgagccgcggcc

SEQ ID NO: 3028145 - RNA, 16 nt, Mycobacterium avium subsp. paratuberculosis
gaucgagccgcggccc

SEQ ID NO: 3028146 - RNA, 13 nt, Mycobacterium avium subsp. paratuberculosis
gaucgagccggcc

SEQ ID NO: 3028147 - RNA, 13 nt, Mycobacterium avium subsp. paratuberculosis
gaucgagccggug

SEQ ID NO: 3028148 - RNA, 16 nt, Mycobacterium avium subsp. paratuberculosis
gaucgagcgcaccgcc

SEQ ID NO: 3028149 - RNA, 16 nt, Mycobacterium avium subsp. paratuberculosis
gaucgaggccagcgcg

SEQ ID NO: 3028150 - RNA, 19 nt, Mycobacterium avium subsp. paratuberculosis
gaucgaggccagcgcgauc

SEQ ID NO: 3028151 - RNA, 21 nt, Mycobacterium avium subsp. paratuberculosis
gaucgaggccagcgcgaucgc

SEQ ID NO: 3028152 - RNA, 19 nt, Mycobacterium avium subsp. paratuberculosis
gaucgagguagcgugcgcc

SEQ ID NO: 3028153 - RNA, 22 nt, Mycobacterium avium subsp. paratuberculosis
gaucgagguagcgugcgcccga

SEQ ID NO: 3028154 - RNA, 20 nt, Mycobacterium avium subsp. paratuberculosis
gaucgaggugauguuggccg

SEQ ID NO: 3028155 - RNA, 19 nt, Mycobacterium avium subsp. paratuberculosis
gaucgagucccgcgcggcg

SEQ ID NO: 3028156 - RNA, 20 nt, Mycobacterium avium subsp. paratuberculosis
gaucgagucccgcgcggcgc

SEQ ID NO: 3028157 - RNA, 16 nt, Mycobacterium avium subsp. paratuberculosis
gaucgaguucacccga

SEQ ID NO: 3028158 - RNA, 18 nt, Mycobacterium avium subsp. paratuberculosis
gaucgaguucagcgucga

SEQ ID NO: 3028159 - RNA, 21 nt, Mycobacterium avium subsp. paratuberculosis
gaucgaucaucgccucggucg

SEQ ID NO: 3028160 - RNA, 17 nt, Mycobacterium avium subsp. paratuberculosis
gaucgaucccgucggcc

SEQ ID NO: 3028161 - RNA, 21 nt, Mycobacterium avium subsp. paratuberculosis
gaucgaucccgucggccauca

SEQ ID NO: 3028162 - RNA, 20 nt, Mycobacterium avium subsp. paratuberculosis
gaucgaucccuuggcggcgg

SEQ ID NO: 3028163 - RNA, 22 nt, Mycobacterium avium subsp. paratuberculosis
gaucgaucccuuggcggcggcc

SEQ ID NO: 3028164 - RNA, 13 nt, Mycobacterium avium subsp. paratuberculosis
gaucgaugcccag

SEQ ID NO: 3028165 - RNA, 19 nt, Mycobacterium avium subsp. paratuberculosis
gaucgaugcccagcgcgcg

SEQ ID NO: 3028166 - RNA, 17 nt, Mycobacterium avium subsp. paratuberculosis
gaucgauggggauggug

SEQ ID NO: 3028167 - RNA, 16 nt, Mycobacterium avium subsp. paratuberculosis
gaucgcaucgggcgac

SEQ ID NO: 3028168 - RNA, 14 nt, Mycobacterium avium subsp. paratuberculosis
gaucgccaacgcgc

SEQ ID NO: 3028169 - RNA, 15 nt, Mycobacterium avium subsp. paratuberculosis
gaucgccaccaccag

SEQ ID NO: 3028170 - RNA, 18 nt, Mycobacterium avium subsp. paratuberculosis
gaucgccaccaccagcgg

SEQ ID NO: 3028171 - RNA, 12 nt, Mycobacterium avium subsp. paratuberculosis
gaucgccagcac

SEQ ID NO: 3028172 - RNA, 17 nt, Mycobacterium avium subsp. paratuberculosis
gaucgccagcaccggcg

SEQ ID NO: 3028173 - RNA, 12 nt, Mycobacterium avium subsp. paratuberculosis
gaucgccagccc

SEQ ID NO: 3028174 - RNA, 13 nt, Mycobacterium avium subsp. paratuberculosis
gaucgccagcccg

SEQ ID NO: 3028175 - RNA, 17 nt, Mycobacterium avium subsp. paratuberculosis
gaucgccagcccggcgu

SEQ ID NO: 3028176 - RNA, 19 nt, Mycobacterium avium subsp. paratuberculosis
gaucgccagcccggcguac

SEQ ID NO: 3028177 - RNA, 13 nt, Mycobacterium avium subsp. paratuberculosis
gaucgccagcgcc

SEQ ID NO: 3028178 - RNA, 16 nt, Mycobacterium avium subsp. paratuberculosis
gaucgccagcgccccc

SEQ ID NO: 3028179 - RNA, 19 nt, Mycobacterium avium subsp. paratuberculosis
gaucgccagcgcccccagc

SEQ ID NO: 3028180 - RNA, 16 nt, Mycobacterium avium subsp. paratuberculosis
gaucgccagcgcccga

SEQ ID NO: 3028181 - RNA, 14 nt, Mycobacterium avium subsp. paratuberculosis
gaucgccagcgcgc

SEQ ID NO: 3028182 - RNA, 16 nt, Mycobacterium avium subsp. paratuberculosis
gaucgccagcgcggug

SEQ ID NO: 3028183 - RNA, 12 nt, Mycobacterium avium subsp. paratuberculosis
gaucgccaggcg

SEQ ID NO: 3028184 - RNA, 20 nt, Mycobacterium avium subsp. paratuberculosis
gaucgccaggcguugcaccg

SEQ ID NO: 3028185 - RNA, 17 nt, Mycobacterium avium subsp. paratuberculosis
gaucgccaguccggcgc

SEQ ID NO: 3028186 - RNA, 18 nt, Mycobacterium avium subsp. paratuberculosis
gaucgccaguccggcgcc

SEQ ID NO: 3028187 - RNA, 21 nt, Mycobacterium avium subsp. paratuberculosis
gaucgccaguccggcgccgac

SEQ ID NO: 3028188 - RNA, 15 nt, Mycobacterium avium subsp. paratuberculosis
gaucgccaugcuggc

SEQ ID NO: 3028189 - RNA, 13 nt, Mycobacterium avium subsp. paratuberculosis
gaucgcccacccg

SEQ ID NO: 3028190 - RNA, 19 nt, Mycobacterium avium subsp. paratuberculosis
gaucgcccacccgcacgcc

SEQ ID NO: 3028191 - RNA, 14 nt, Mycobacterium avium subsp. paratuberculosis
gaucgcccagcacc

SEQ ID NO: 3028192 - RNA, 19 nt, Mycobacterium avium subsp. paratuberculosis
gaucgcccagcaccgcgac

SEQ ID NO: 3028193 - RNA, 20 nt, Mycobacterium avium subsp. paratuberculosis
gaucgcccagugcgcgccgu

SEQ ID NO: 3028194 - RNA, 15 nt, Mycobacterium avium subsp. paratuberculosis
gaucgcccaucaccg

SEQ ID NO: 3028195 - RNA, 16 nt, Mycobacterium avium subsp. paratuberculosis
gaucgcccaucaccgc

SEQ ID NO: 3028196 - RNA, 12 nt, Mycobacterium avium subsp. paratuberculosis
gaucgccccgcc

SEQ ID NO: 3028197 - RNA, 13 nt, Mycobacterium avium subsp. paratuberculosis
gaucgccccgccg

SEQ ID NO: 3028198 - RNA, 14 nt, Mycobacterium avium subsp. paratuberculosis
gaucgccccggggg

SEQ ID NO: 3028199 - RNA, 13 nt, Mycobacterium avium subsp. paratuberculosis
gaucgcccgccgc

SEQ ID NO: 3028200 - RNA, 18 nt, Mycobacterium avium subsp. paratuberculosis
gaucgcccgccgcgagcc

SEQ ID NO: 3028201 - RNA, 14 nt, Mycobacterium avium subsp. paratuberculosis
gaucgcccgcuccg

SEQ ID NO: 3028202 - RNA, 21 nt, Mycobacterium avium subsp. paratuberculosis
gaucgcccgcuccgcggugcu

SEQ ID NO: 3028203 - RNA, 15 nt, Mycobacterium avium subsp. paratuberculosis
gaucgcccgggcggc

SEQ ID NO: 3028204 - RNA, 16 nt, Mycobacterium avium subsp. paratuberculosis
gaucgcccgggcggcg

SEQ ID NO: 3028205 - RNA, 18 nt, Mycobacterium avium subsp. paratuberculosis
gaucgcccgggcggcggg

SEQ ID NO: 3028206 - RNA, 23 nt, Mycobacterium avium subsp. paratuberculosis
gaucgcccgggcggcggggcugc

SEQ ID NO: 3028207 - RNA, 23 nt, Mycobacterium avium subsp. paratuberculosis
gaucgcccgguaggccgccgcga

SEQ ID NO: 3028208 - RNA, 23 nt, Mycobacterium avium subsp. paratuberculosis
gaucgcccuggcauccgucggcc

SEQ ID NO: 3028209 - RNA, 17 nt, Mycobacterium avium subsp. paratuberculosis
gaucgccgacgccagca

SEQ ID NO: 3028210 - RNA, 15 nt, Mycobacterium avium subsp. paratuberculosis
gaucgccgacgucug

SEQ ID NO: 3028211 - RNA, 24 nt, Mycobacterium avium subsp. paratuberculosis
gaucgccgagucgaucgccagcgc

SEQ ID NO: 3028212 - RNA, 15 nt, Mycobacterium avium subsp. paratuberculosis
gaucgccgcccaucg

SEQ ID NO: 3028213 - RNA, 13 nt, Mycobacterium avium subsp. paratuberculosis
gaucgccgcgcau

SEQ ID NO: 3028214 - RNA, 23 nt, Mycobacterium avium subsp. paratuberculosis
gaucgccgcgcauucaccagcug

SEQ ID NO: 3028215 - RNA, 19 nt, Mycobacterium avium subsp. paratuberculosis
gaucgccgcgcccagcacg

SEQ ID NO: 3028216 - RNA, 14 nt, Mycobacterium avium subsp. paratuberculosis
gaucgccgcggacc

SEQ ID NO: 3028217 - RNA, 16 nt, Mycobacterium avium subsp. paratuberculosis
gaucgccggacagcgg

SEQ ID NO: 3028218 - RNA, 19 nt, Mycobacterium avium subsp. paratuberculosis
gaucgccggaucgccgagg

SEQ ID NO: 3028219 - RNA, 14 nt, Mycobacterium avium subsp. paratuberculosis
gaucgccggcgccg

SEQ ID NO: 3028220 - RNA, 14 nt, Mycobacterium avium subsp. paratuberculosis
gaucgccgggaugg

SEQ ID NO: 3028221 - RNA, 15 nt, Mycobacterium avium subsp. paratuberculosis
gaucgccggugcggc

SEQ ID NO: 3028222 - RNA, 13 nt, Mycobacterium avium subsp. paratuberculosis
gaucgccuccguc

SEQ ID NO: 3028223 - RNA, 20 nt, Mycobacterium avium subsp. paratuberculosis
gaucgccucggccuuggcca

SEQ ID NO: 3028224 - RNA, 20 nt, Mycobacterium avium subsp. paratuberculosis
gaucgccugauacgacgucc

SEQ ID NO: 3028225 - RNA, 20 nt, Mycobacterium avium subsp. paratuberculosis
gaucgccuggcagcugccga

SEQ ID NO: 3028226 - RNA, 16 nt, Mycobacterium avium subsp. paratuberculosis
gaucgcgaacgcgccg

SEQ ID NO: 3028227 - RNA, 18 nt, Mycobacterium avium subsp. paratuberculosis
gaucgcgaagaccagcgu

SEQ ID NO: 3028228 - RNA, 16 nt, Mycobacterium avium subsp. paratuberculosis
gaucgcgaccaccggc

SEQ ID NO: 3028229 - RNA, 18 nt, Mycobacterium avium subsp. paratuberculosis
gaucgcgaccaccggccg

SEQ ID NO: 3028230 - RNA, 13 nt, Mycobacterium avium subsp. paratuberculosis
gaucgcgacggcc

SEQ ID NO: 3028231 - RNA, 14 nt, Mycobacterium avium subsp. paratuberculosis
gaucgcgacggccg

SEQ ID NO: 3028232 - RNA, 16 nt, Mycobacterium avium subsp. paratuberculosis
gaucgcgacggccggg

SEQ ID NO: 3028233 - RNA, 17 nt, Mycobacterium avium subsp. paratuberculosis
gaucgcgagcagggcgg

SEQ ID NO: 3028234 - RNA, 20 nt, Mycobacterium avium subsp. paratuberculosis
gaucgcgagcagggcgggca

SEQ ID NO: 3028235 - RNA, 21 nt, Mycobacterium avium subsp. paratuberculosis
gaucgcgagcagggcgggcag

SEQ ID NO: 3028236 - RNA, 23 nt, Mycobacterium avium subsp. paratuberculosis
gaucgcgaucaccgcggccacca

SEQ ID NO: 3028237 - RNA, 16 nt, Mycobacterium avium subsp. paratuberculosis
gaucgcgauccgggcg

SEQ ID NO: 3028238 - RNA, 17 nt, Mycobacterium avium subsp. paratuberculosis
gaucgcgaugucgacgg

SEQ ID NO: 3028239 - RNA, 15 nt, Mycobacterium avium subsp. paratuberculosis
gaucgcgcagccgcg

SEQ ID NO: 3028240 - RNA, 19 nt, Mycobacterium avium subsp. paratuberculosis
gaucgcgcagccgcggugg

SEQ ID NO: 3028241 - RNA, 20 nt, Mycobacterium avium subsp. paratuberculosis
gaucgcgcagccgcgguggc

SEQ ID NO: 3028242 - RNA, 21 nt, Mycobacterium avium subsp. paratuberculosis
gaucgcgcagccgcgguggcg

SEQ ID NO: 3028243 - RNA, 13 nt, Mycobacterium avium subsp. paratuberculosis
gaucgcgccgauc

SEQ ID NO: 3028244 - RNA, 16 nt, Mycobacterium avium subsp. paratuberculosis
gaucgcgccggccgcc

SEQ ID NO: 3028245 - RNA, 20 nt, Mycobacterium avium subsp. paratuberculosis
gaucgcgccggccgccgcga

SEQ ID NO: 3028246 - RNA, 19 nt, Mycobacterium avium subsp. paratuberculosis
gaucgcgccuugggccauc

SEQ ID NO: 3028247 - RNA, 19 nt, Mycobacterium avium subsp. paratuberculosis
gaucgcgcugaccaggccg

SEQ ID NO: 3028248 - RNA, 22 nt, Mycobacterium avium subsp. paratuberculosis
gaucgcgcugaccaggccgucc

SEQ ID NO: 3028249 - RNA, 13 nt, Mycobacterium avium subsp. paratuberculosis
gaucgcggccagc

SEQ ID NO: 3028250 - RNA, 15 nt, Mycobacterium avium subsp. paratuberculosis
gaucgcggccagcgu

SEQ ID NO: 3028251 - RNA, 19 nt, Mycobacterium avium subsp. paratuberculosis
gaucgcggcccacccgcag

SEQ ID NO: 3028252 - RNA, 20 nt, Mycobacterium avium subsp. paratuberculosis
gaucgcggcccgcggggcgu

SEQ ID NO: 3028253 - RNA, 13 nt, Mycobacterium avium subsp. paratuberculosis
gaucgcggccggc

SEQ ID NO: 3028254 - RNA, 19 nt, Mycobacterium avium subsp. paratuberculosis
gaucgcggcgagcagcgcg

SEQ ID NO: 3028255 - RNA, 16 nt, Mycobacterium avium subsp. paratuberculosis
gaucgcggcgaucagc

SEQ ID NO: 3028256 - RNA, 19 nt, Mycobacterium avium subsp. paratuberculosis
gaucgcggcgaucagcccg

SEQ ID NO: 3028257 - RNA, 22 nt, Mycobacterium avium subsp. paratuberculosis
gaucgcggcgcugccgccggcc

SEQ ID NO: 3028258 - RNA, 13 nt, Mycobacterium avium subsp. paratuberculosis
gaucgcggcggcg

SEQ ID NO: 3028259 - RNA, 14 nt, Mycobacterium avium subsp. paratuberculosis
gaucgcggcggcgu

SEQ ID NO: 3028260 - RNA, 17 nt, Mycobacterium avium subsp. paratuberculosis
gaucgcggcggcguacg

SEQ ID NO: 3028261 - RNA, 12 nt, Mycobacterium avium subsp. paratuberculosis
gaucgcggcgua

SEQ ID NO: 3028262 - RNA, 17 nt, Mycobacterium avium subsp. paratuberculosis
gaucgcgggcgacccgc

SEQ ID NO: 3028263 - RNA, 16 nt, Mycobacterium avium subsp. paratuberculosis
gaucgcggugaccgcc

SEQ ID NO: 3028264 - RNA, 19 nt, Mycobacterium avium subsp. paratuberculosis
gaucgcggugaccgccgcc

SEQ ID NO: 3028265 - RNA, 16 nt, Mycobacterium avium subsp. paratuberculosis
gaucgcggugacgcgc

SEQ ID NO: 3028266 - RNA, 19 nt, Mycobacterium avium subsp. paratuberculosis
gaucgcggugacgcgccgg

SEQ ID NO: 3028267 - RNA, 18 nt, Mycobacterium avium subsp. paratuberculosis
gaucgcggugcggggccg

SEQ ID NO: 3028268 - RNA, 22 nt, Mycobacterium avium subsp. paratuberculosis
gaucgcggugcggggccgcggc

SEQ ID NO: 3028269 - RNA, 23 nt, Mycobacterium avium subsp. paratuberculosis
gaucgcggugcggggccgcggcc

SEQ ID NO: 3028270 - RNA, 16 nt, Mycobacterium avium subsp. paratuberculosis
gaucgcggugcugcag

SEQ ID NO: 3028271 - RNA, 14 nt, Mycobacterium avium subsp. paratuberculosis
gaucgcgguggccg

SEQ ID NO: 3028272 - RNA, 14 nt, Mycobacterium avium subsp. paratuberculosis
gaucgcgguggcgc

SEQ ID NO: 3028273 - RNA, 17 nt, Mycobacterium avium subsp. paratuberculosis
gaucgcgguggcgcccg

SEQ ID NO: 3028274 - RNA, 21 nt, Mycobacterium avium subsp. paratuberculosis
gaucgcgguggcuuccagccc

SEQ ID NO: 3028275 - RNA, 17 nt, Mycobacterium avium subsp. paratuberculosis
gaucgcguagcgccggu

SEQ ID NO: 3028276 - RNA, 13 nt, Mycobacterium avium subsp. paratuberculosis
gaucgcguagucc

SEQ ID NO: 3028277 - RNA, 19 nt, Mycobacterium avium subsp. paratuberculosis
gaucgcguaguccagcacg

SEQ ID NO: 3028278 - RNA, 23 nt, Mycobacterium avium subsp. paratuberculosis
gaucgcgucaaccaccggcaucg

SEQ ID NO: 3028279 - RNA, 13 nt, Mycobacterium avium subsp. paratuberculosis
gaucgcgucgacg

SEQ ID NO: 3028280 - RNA, 14 nt, Mycobacterium avium subsp. paratuberculosis
gaucgcgucgacgg

SEQ ID NO: 3028281 - RNA, 20 nt, Mycobacterium avium subsp. paratuberculosis
gaucgcgucgacggcgccgg

SEQ ID NO: 3028282 - RNA, 21 nt, Mycobacterium avium subsp. paratuberculosis
gaucgcgucgacggcgccgga

SEQ ID NO: 3028283 - RNA, 18 nt, Mycobacterium avium subsp. paratuberculosis
gaucgcgugcgucacgcu

SEQ ID NO: 3028284 - RNA, 18 nt, Mycobacterium avium subsp. paratuberculosis
gaucgcguucugcaccag

SEQ ID NO: 3028285 - RNA, 17 nt, Mycobacterium avium subsp. paratuberculosis
gaucgcugaugcgcaac

SEQ ID NO: 3028286 - RNA, 18 nt, Mycobacterium avium subsp. paratuberculosis
gaucgcuucggccagcgc

SEQ ID NO: 3028287 - RNA, 19 nt, Mycobacterium avium subsp. paratuberculosis
gaucgcuucggccagcgcg

SEQ ID NO: 3028288 - RNA, 13 nt, Mycobacterium avium subsp. paratuberculosis
gaucggaccgcac

SEQ ID NO: 3028289 - RNA, 20 nt, Mycobacterium avium subsp. paratuberculosis
gaucggaccgcaccaccacg

SEQ ID NO: 3028290 - RNA, 19 nt, Mycobacterium avium subsp. paratuberculosis
gaucggagacguccucggu

SEQ ID NO: 3028291 - RNA, 16 nt, Mycobacterium avium subsp. paratuberculosis
gaucggauucgggugg

SEQ ID NO: 3028292 - RNA, 17 nt, Mycobacterium avium subsp. paratuberculosis
gaucggauucggguggc

SEQ ID NO: 3028293 - RNA, 17 nt, Mycobacterium avium subsp. paratuberculosis
gaucggcacccgcaaca

SEQ ID NO: 3028294 - RNA, 23 nt, Mycobacterium avium subsp. paratuberculosis
gaucggcacccgcaacaccacgu

SEQ ID NO: 3028295 - RNA, 17 nt, Mycobacterium avium subsp. paratuberculosis
gaucggcagcgccaaca

SEQ ID NO: 3028296 - RNA, 13 nt, Mycobacterium avium subsp. paratuberculosis
gaucggcagcgcg

SEQ ID NO: 3028297 - RNA, 19 nt, Mycobacterium avium subsp. paratuberculosis
gaucggcaggucgucgacg

SEQ ID NO: 3028298 - RNA, 20 nt, Mycobacterium avium subsp. paratuberculosis
gaucggcaggucgucgacgu

SEQ ID NO: 3028299 - RNA, 19 nt, Mycobacterium avium subsp. paratuberculosis
gaucggcaugacgcccagc

SEQ ID NO: 3028300 - RNA, 15 nt, Mycobacterium avium subsp. paratuberculosis
gaucggccagcaggu

SEQ ID NO: 3028301 - RNA, 16 nt, Mycobacterium avium subsp. paratuberculosis
gaucggccagcagguc

SEQ ID NO: 3028302 - RNA, 16 nt, Mycobacterium avium subsp. paratuberculosis
gaucggccagcgcggc

SEQ ID NO: 3028303 - RNA, 20 nt, Mycobacterium avium subsp. paratuberculosis
gaucggccagcgcggccggg

SEQ ID NO: 3028304 - RNA, 21 nt, Mycobacterium avium subsp. paratuberculosis
gaucggccagcgcggccgggc

SEQ ID NO: 3028305 - RNA, 17 nt, Mycobacterium avium subsp. paratuberculosis
gaucggccaggcgccca

SEQ ID NO: 3028306 - RNA, 15 nt, Mycobacterium avium subsp. paratuberculosis
gaucggccauggugc

SEQ ID NO: 3028307 - RNA, 20 nt, Mycobacterium avium subsp. paratuberculosis
gaucggccauggugccgccg

SEQ ID NO: 3028308 - RNA, 21 nt, Mycobacterium avium subsp. paratuberculosis
gaucggccauggugccgccgu

SEQ ID NO: 3028309 - RNA, 16 nt, Mycobacterium avium subsp. paratuberculosis
gaucggcccccgggcc

SEQ ID NO: 3028310 - RNA, 17 nt, Mycobacterium avium subsp. paratuberculosis
gaucggcccccgggccc

SEQ ID NO: 3028311 - RNA, 22 nt, Mycobacterium avium subsp. paratuberculosis
gaucggcccgacggguucgcgc

SEQ ID NO: 3028312 - RNA, 23 nt, Mycobacterium avium subsp. paratuberculosis
gaucggcccgaucucgcgcgggu

SEQ ID NO: 3028313 - RNA, 12 nt, Mycobacterium avium subsp. paratuberculosis
gaucggccgcgu

SEQ ID NO: 3028314 - RNA, 15 nt, Mycobacterium avium subsp. paratuberculosis
gaucggccgcgucgg

SEQ ID NO: 3028315 - RNA, 18 nt, Mycobacterium avium subsp. paratuberculosis
gaucggccgcgucgggca

SEQ ID NO: 3028316 - RNA, 19 nt, Mycobacterium avium subsp. paratuberculosis
gaucggccgcugcccgggc

SEQ ID NO: 3028317 - RNA, 20 nt, Mycobacterium avium subsp. paratuberculosis
gaucggccgcugcccgggca

SEQ ID NO: 3028318 - RNA, 14 nt, Mycobacterium avium subsp. paratuberculosis
gaucggccgggaga

SEQ ID NO: 3028319 - RNA, 15 nt, Mycobacterium avium subsp. paratuberculosis
gaucggcgagccggg

SEQ ID NO: 3028320 - RNA, 20 nt, Mycobacterium avium subsp. paratuberculosis
gaucggcgccacgaccagcg

SEQ ID NO: 3028321 - RNA, 15 nt, Mycobacterium avium subsp. paratuberculosis
gaucggcgcccaccg

SEQ ID NO: 3028322 - RNA, 16 nt, Mycobacterium avium subsp. paratuberculosis
gaucggcgcccaccgc

SEQ ID NO: 3028323 - RNA, 18 nt, Mycobacterium avium subsp. paratuberculosis
gaucggcgcccaccgcgg

SEQ ID NO: 3028324 - RNA, 19 nt, Mycobacterium avium subsp. paratuberculosis
gaucggcgcccaccgcggc

SEQ ID NO: 3028325 - RNA, 14 nt, Mycobacterium avium subsp. paratuberculosis
gaucggcgcgccga

SEQ ID NO: 3028326 - RNA, 17 nt, Mycobacterium avium subsp. paratuberculosis
gaucggcgcgucggcgu

SEQ ID NO: 3028327 - RNA, 12 nt, Mycobacterium avium subsp. paratuberculosis
gaucggcggcca

SEQ ID NO: 3028328 - RNA, 15 nt, Mycobacterium avium subsp. paratuberculosis
gaucggcggccacca

SEQ ID NO: 3028329 - RNA, 22 nt, Mycobacterium avium subsp. paratuberculosis
gaucggcggccaccagccggcc

SEQ ID NO: 3028330 - RNA, 12 nt, Mycobacterium avium subsp. paratuberculosis
gaucggcggccu

SEQ ID NO: 3028331 - RNA, 13 nt, Mycobacterium avium subsp. paratuberculosis
gaucggcggccug

SEQ ID NO: 3028332 - RNA, 16 nt, Mycobacterium avium subsp. paratuberculosis
gaucggcggccugcgg

SEQ ID NO: 3028333 - RNA, 18 nt, Mycobacterium avium subsp. paratuberculosis
gaucggcggccugcggcg

SEQ ID NO: 3028334 - RNA, 17 nt, Mycobacterium avium subsp. paratuberculosis
gaucggcggcgacggcg

SEQ ID NO: 3028335 - RNA, 15 nt, Mycobacterium avium subsp. paratuberculosis
gaucggcggcggggu

SEQ ID NO: 3028336 - RNA, 17 nt, Mycobacterium avium subsp. paratuberculosis
gaucggcggcucgccgg

SEQ ID NO: 3028337 - RNA, 18 nt, Mycobacterium avium subsp. paratuberculosis
gaucggcggcucgccggc

SEQ ID NO: 3028338 - RNA, 20 nt, Mycobacterium avium subsp. paratuberculosis
gaucggcggcucgccggcgu

SEQ ID NO: 3028339 - RNA, 20 nt, Mycobacterium avium subsp. paratuberculosis
gaucggcgggcgccgaaucg

SEQ ID NO: 3028340 - RNA, 22 nt, Mycobacterium avium subsp. paratuberculosis
gaucggcgggcgccgaaucggc

SEQ ID NO: 3028341 - RNA, 14 nt, Mycobacterium avium subsp. paratuberculosis
gaucggcggggcgc

SEQ ID NO: 3028342 - RNA, 21 nt, Mycobacterium avium subsp. paratuberculosis
gaucggcggggcgcguucggg

SEQ ID NO: 3028343 - RNA, 19 nt, Mycobacterium avium subsp. paratuberculosis
gaucggcgggugcgggcgc

SEQ ID NO: 3028344 - RNA, 20 nt, Mycobacterium avium subsp. paratuberculosis
gaucggcggucccgugcgcc

SEQ ID NO: 3028345 - RNA, 23 nt, Mycobacterium avium subsp. paratuberculosis
gaucggcgguccgccgcagcggc

SEQ ID NO: 3028346 - RNA, 16 nt, Mycobacterium avium subsp. paratuberculosis
gaucggcgucacugcc

SEQ ID NO: 3028347 - RNA, 17 nt, Mycobacterium avium subsp. paratuberculosis
gaucggcguuggcggcg

SEQ ID NO: 3028348 - RNA, 19 nt, Mycobacterium avium subsp. paratuberculosis
gaucggcucgagcucgucg

SEQ ID NO: 3028349 - RNA, 18 nt, Mycobacterium avium subsp. paratuberculosis
gaucggcucggcgcccca

SEQ ID NO: 3028350 - RNA, 13 nt, Mycobacterium avium subsp. paratuberculosis
gaucgggaccggg

SEQ ID NO: 3028351 - RNA, 14 nt, Mycobacterium avium subsp. paratuberculosis
gaucgggaucggcu

SEQ ID NO: 3028352 - RNA, 24 nt, Mycobacterium avium subsp. paratuberculosis
gaucgggaugucgugggcgugccg

SEQ ID NO: 3028353 - RNA, 18 nt, Mycobacterium avium subsp. paratuberculosis
gaucgggaugugcguggu

SEQ ID NO: 3028354 - RNA, 12 nt, Mycobacterium avium subsp. paratuberculosis
gaucgggcgguc

SEQ ID NO: 3028355 - RNA, 20 nt, Mycobacterium avium subsp. paratuberculosis
gaucgggcgguccaccgacg

SEQ ID NO: 3028356 - RNA, 18 nt, Mycobacterium avium subsp. paratuberculosis
gaucgggcgucgcagauc

SEQ ID NO: 3028357 - RNA, 18 nt, Mycobacterium avium subsp. paratuberculosis
gaucggggaauccuggcc

SEQ ID NO: 3028358 - RNA, 13 nt, Mycobacterium avium subsp. paratuberculosis
gaucggggcgacc

SEQ ID NO: 3028359 - RNA, 14 nt, Mycobacterium avium subsp. paratuberculosis
gaucggggcgaccu

SEQ ID NO: 3028360 - RNA, 17 nt, Mycobacterium avium subsp. paratuberculosis
gaucggggcgcagcccg

SEQ ID NO: 3028361 - RNA, 21 nt, Mycobacterium avium subsp. paratuberculosis
gaucggggcgcagcccggcgg

SEQ ID NO: 3028362 - RNA, 14 nt, Mycobacterium avium subsp. paratuberculosis
gaucgggguggacg

SEQ ID NO: 3028363 - RNA, 16 nt, Mycobacterium avium subsp. paratuberculosis
gaucgggucaccggcc

SEQ ID NO: 3028364 - RNA, 20 nt, Mycobacterium avium subsp. paratuberculosis
gaucgggucaccggccgagc

SEQ ID NO: 3028365 - RNA, 16 nt, Mycobacterium avium subsp. paratuberculosis
gaucgggucgcccggg

SEQ ID NO: 3028366 - RNA, 19 nt, Mycobacterium avium subsp. paratuberculosis
gaucgggugagacggccag

SEQ ID NO: 3028367 - RNA, 20 nt, Mycobacterium avium subsp. paratuberculosis
gaucgggugagacggccagc

SEQ ID NO: 3028368 - RNA, 20 nt, Mycobacterium avium subsp. paratuberculosis
gaucgguaacugcguguggc

SEQ ID NO: 3028369 - RNA, 16 nt, Mycobacterium avium subsp. paratuberculosis
gaucggucucggugga

SEQ ID NO: 3028370 - RNA, 18 nt, Mycobacterium avium subsp. paratuberculosis
gaucggugcaggccgcga

SEQ ID NO: 3028371 - RNA, 20 nt, Mycobacterium avium subsp. paratuberculosis
gaucggugcccgcggguagc

SEQ ID NO: 3028372 - RNA, 20 nt, Mycobacterium avium subsp. paratuberculosis
gaucggugccucuucgucgg

SEQ ID NO: 3028373 - RNA, 15 nt, Mycobacterium avium subsp. paratuberculosis
gaucggugcgcggcg

SEQ ID NO: 3028374 - RNA, 16 nt, Mycobacterium avium subsp. paratuberculosis
gaucggugcgcggcga

SEQ ID NO: 3028375 - RNA, 18 nt, Mycobacterium avium subsp. paratuberculosis
gaucgguguagcccggug

SEQ ID NO: 3028376 - RNA, 18 nt, Mycobacterium avium subsp. paratuberculosis
gaucgguguccagccgca

SEQ ID NO: 3028377 - RNA, 22 nt, Mycobacterium avium subsp. paratuberculosis
gaucgguucgucguggccgacg

SEQ ID NO: 3028378 - RNA, 23 nt, Mycobacterium avium subsp. paratuberculosis
gaucgguucgucguggccgacgg

SEQ ID NO: 3028379 - RNA, 15 nt, Mycobacterium avium subsp. paratuberculosis
gaucgguuucuccac

SEQ ID NO: 3028380 - RNA, 16 nt, Mycobacterium avium subsp. paratuberculosis
gaucguagggcucggc

SEQ ID NO: 3028381 - RNA, 14 nt, Mycobacterium avium subsp. paratuberculosis
gaucgucaccgacc

SEQ ID NO: 3028382 - RNA, 16 nt, Mycobacterium avium subsp. paratuberculosis
gaucgucaccgacccc

SEQ ID NO: 3028383 - RNA, 18 nt, Mycobacterium avium subsp. paratuberculosis
gaucgucaccgugccguc

SEQ ID NO: 3028384 - RNA, 19 nt, Mycobacterium avium subsp. paratuberculosis
gaucguccgaggccccgcc

SEQ ID NO: 3028385 - RNA, 19 nt, Mycobacterium avium subsp. paratuberculosis
gaucgucgaacucgggccc

SEQ ID NO: 3028386 - RNA, 23 nt, Mycobacterium avium subsp. paratuberculosis
gaucgucgaacucgggcccgagg

SEQ ID NO: 3028387 - RNA, 15 nt, Mycobacterium avium subsp. paratuberculosis
gaucgucgaccacca

SEQ ID NO: 3028388 - RNA, 18 nt, Mycobacterium avium subsp. paratuberculosis
gaucgucgaccaccacga

SEQ ID NO: 3028389 - RNA, 20 nt, Mycobacterium avium subsp. paratuberculosis
gaucgucgaccaccacgacc

SEQ ID NO: 3028390 - RNA, 17 nt, Mycobacterium avium subsp. paratuberculosis
gaucgucgaccugcucg

SEQ ID NO: 3028391 - RNA, 18 nt, Mycobacterium avium subsp. paratuberculosis
gaucgucgaccugcucgu

SEQ ID NO: 3028392 - RNA, 14 nt, Mycobacterium avium subsp. paratuberculosis
gaucgucgccgcca

SEQ ID NO: 3028393 - RNA, 20 nt, Mycobacterium avium subsp. paratuberculosis
gaucgucgccgccaacgcga

SEQ ID NO: 3028394 - RNA, 14 nt, Mycobacterium avium subsp. paratuberculosis
gaucgucgccgggc

SEQ ID NO: 3028395 - RNA, 13 nt, Mycobacterium avium subsp. paratuberculosis
gaucgucgccguc

SEQ ID NO: 3028396 - RNA, 17 nt, Mycobacterium avium subsp. paratuberculosis
gaucgucgccgucaccu

SEQ ID NO: 3028397 - RNA, 15 nt, Mycobacterium avium subsp. paratuberculosis
gaucgucggcacugc

SEQ ID NO: 3028398 - RNA, 22 nt, Mycobacterium avium subsp. paratuberculosis
gaucgucggcagcgacgcggug

SEQ ID NO: 3028399 - RNA, 15 nt, Mycobacterium avium subsp. paratuberculosis
gaucgucucggccag

SEQ ID NO: 3028400 - RNA, 16 nt, Mycobacterium avium subsp. paratuberculosis
gaucgucucggccagc

SEQ ID NO: 3028401 - RNA, 18 nt, Mycobacterium avium subsp. paratuberculosis
gaucgucucggccagccg

SEQ ID NO: 3028402 - RNA, 18 nt, Mycobacterium avium subsp. paratuberculosis
gaucgucuugaccgcccg

SEQ ID NO: 3028403 - RNA, 19 nt, Mycobacterium avium subsp. paratuberculosis
gaucgugaauucggccggg

SEQ ID NO: 3028404 - RNA, 16 nt, Mycobacterium avium subsp. paratuberculosis
gaucgugacgccgucc

SEQ ID NO: 3028405 - RNA, 16 nt, Mycobacterium avium subsp. paratuberculosis
gaucgugcgcccaucc

SEQ ID NO: 3028406 - RNA, 17 nt, Mycobacterium avium subsp. paratuberculosis
gaucgugcuguggaaca

SEQ ID NO: 3028407 - RNA, 23 nt, Mycobacterium avium subsp. paratuberculosis
gaucgugcuguggaacacgucgg

SEQ ID NO: 3028408 - RNA, 22 nt, Mycobacterium avium subsp. paratuberculosis
gaucgugggcaacacgucgucc

SEQ ID NO: 3028409 - RNA, 20 nt, Mycobacterium avium subsp. paratuberculosis
gaucgugucccggcgcccuu

SEQ ID NO: 3028410 - RNA, 19 nt, Mycobacterium avium subsp. paratuberculosis
gaucgugucuggccccguc

SEQ ID NO: 3028411 - RNA, 15 nt, Mycobacterium avium subsp. paratuberculosis
gaucguguggccgcc

SEQ ID NO: 3028412 - RNA, 18 nt, Mycobacterium avium subsp. paratuberculosis
gaucguguggccgcccuc

SEQ ID NO: 3028413 - RNA, 21 nt, Mycobacterium avium subsp. paratuberculosis
gaucguugaugucgguggugu

SEQ ID NO: 3028414 - RNA, 15 nt, Mycobacterium avium subsp. paratuberculosis
gaucucaccggcggc

SEQ ID NO: 3028415 - RNA, 15 nt, Mycobacterium avium subsp. paratuberculosis
gaucucaucgucgag

SEQ ID NO: 3028416 - RNA, 15 nt, Mycobacterium avium subsp. paratuberculosis
gaucuccagcagcuu

SEQ ID NO: 3028417 - RNA, 15 nt, Mycobacterium avium subsp. paratuberculosis
gaucuccagcggccg

SEQ ID NO: 3028418 - RNA, 18 nt, Mycobacterium avium subsp. paratuberculosis
gaucuccagcggccgggc

SEQ ID NO: 3028419 - RNA, 15 nt, Mycobacterium avium subsp. paratuberculosis
gaucuccaggcucga

SEQ ID NO: 3028420 - RNA, 15 nt, Mycobacterium avium subsp. paratuberculosis
gaucuccaucccgcu

SEQ ID NO: 3028421 - RNA, 23 nt, Mycobacterium avium subsp. paratuberculosis
gaucuccaucccgcugaagccga

SEQ ID NO: 3028422 - RNA, 20 nt, Mycobacterium avium subsp. paratuberculosis
gaucucccaacgcagcgcau

SEQ ID NO: 3028423 - RNA, 22 nt, Mycobacterium avium subsp. paratuberculosis
gaucuccgcggcgaugaccgga

SEQ ID NO: 3028424 - RNA, 14 nt, Mycobacterium avium subsp. paratuberculosis
gaucuccggccggu

SEQ ID NO: 3028425 - RNA, 17 nt, Mycobacterium avium subsp. paratuberculosis
gaucuccucgcgcggca

SEQ ID NO: 3028426 - RNA, 14 nt, Mycobacterium avium subsp. paratuberculosis
gaucucgaccaggc

SEQ ID NO: 3028427 - RNA, 16 nt, Mycobacterium avium subsp. paratuberculosis
gaucucgaccucgucg

SEQ ID NO: 3028428 - RNA, 21 nt, Mycobacterium avium subsp. paratuberculosis
gaucucgaccucgucggcggc

SEQ ID NO: 3028429 - RNA, 20 nt, Mycobacterium avium subsp. paratuberculosis
gaucucgaccuucuugucca

SEQ ID NO: 3028430 - RNA, 22 nt, Mycobacterium avium subsp. paratuberculosis
gaucucgacgguggccucggcg

SEQ ID NO: 3028431 - RNA, 19 nt, Mycobacterium avium subsp. paratuberculosis
gaucucgagcauccggugc

SEQ ID NO: 3028432 - RNA, 19 nt, Mycobacterium avium subsp. paratuberculosis
gaucucgauggacgcggug

SEQ ID NO: 3028433 - RNA, 23 nt, Mycobacterium avium subsp. paratuberculosis
gaucucgccgaaggccgggucgg

SEQ ID NO: 3028434 - RNA, 13 nt, Mycobacterium avium subsp. paratuberculosis
gaucucgccgagc

SEQ ID NO: 3028435 - RNA, 23 nt, Mycobacterium avium subsp. paratuberculosis
gaucucgccgagcacaccgucgc

SEQ ID NO: 3028436 - RNA, 14 nt, Mycobacterium avium subsp. paratuberculosis
gaucucgccgagcg

SEQ ID NO: 3028437 - RNA, 16 nt, Mycobacterium avium subsp. paratuberculosis
gaucucgccgcggugg

SEQ ID NO: 3028438 - RNA, 13 nt, Mycobacterium avium subsp. paratuberculosis
gaucucgcgccgc

SEQ ID NO: 3028439 - RNA, 16 nt, Mycobacterium avium subsp. paratuberculosis
gaucucgcgccgcgca

SEQ ID NO: 3028440 - RNA, 20 nt, Mycobacterium avium subsp. paratuberculosis
gaucucgcggucgaagggug

SEQ ID NO: 3028441 - RNA, 14 nt, Mycobacterium avium subsp. paratuberculosis
gaucucggagaccu

SEQ ID NO: 3028442 - RNA, 13 nt, Mycobacterium avium subsp. paratuberculosis
gaucucggccacc

SEQ ID NO: 3028443 - RNA, 15 nt, Mycobacterium avium subsp. paratuberculosis
gaucucggccagcgg

SEQ ID NO: 3028444 - RNA, 20 nt, Mycobacterium avium subsp. paratuberculosis
gaucucggccagcgggcggc

SEQ ID NO: 3028445 - RNA, 17 nt, Mycobacterium avium subsp. paratuberculosis
gaucucggcggccgcgu

SEQ ID NO: 3028446 - RNA, 14 nt, Mycobacterium avium subsp. paratuberculosis
gaucucggcggcga

SEQ ID NO: 3028447 - RNA, 13 nt, Mycobacterium avium subsp. paratuberculosis
gaucucggcguac

SEQ ID NO: 3028448 - RNA, 16 nt, Mycobacterium avium subsp. paratuberculosis
gaucucggcguacagc

SEQ ID NO: 3028449 - RNA, 18 nt, Mycobacterium avium subsp. paratuberculosis
gaucucggggaucagcag

SEQ ID NO: 3028450 - RNA, 17 nt, Mycobacterium avium subsp. paratuberculosis
gaucucggucgccagca

SEQ ID NO: 3028451 - RNA, 18 nt, Mycobacterium avium subsp. paratuberculosis
gaucucggucgccagcac

SEQ ID NO: 3028452 - RNA, 19 nt, Mycobacterium avium subsp. paratuberculosis
gaucucggucgccagcacc

SEQ ID NO: 3028453 - RNA, 20 nt, Mycobacterium avium subsp. paratuberculosis
gaucucggucgccagcaccg

SEQ ID NO: 3028454 - RNA, 17 nt, Mycobacterium avium subsp. paratuberculosis
gaucucggugagcagaa

SEQ ID NO: 3028455 - RNA, 13 nt, Mycobacterium avium subsp. paratuberculosis
gaucucggugccg

SEQ ID NO: 3028456 - RNA, 20 nt, Mycobacterium avium subsp. paratuberculosis
gaucucggugccggugauga

SEQ ID NO: 3028457 - RNA, 19 nt, Mycobacterium avium subsp. paratuberculosis
gaucucguagguggccagc

SEQ ID NO: 3028458 - RNA, 22 nt, Mycobacterium avium subsp. paratuberculosis
gaucucguagguggccagcacg

SEQ ID NO: 3028459 - RNA, 13 nt, Mycobacterium avium subsp. paratuberculosis
gaucucgucgaug

SEQ ID NO: 3028460 - RNA, 18 nt, Mycobacterium avium subsp. paratuberculosis
gaucucgucgaugacgau

SEQ ID NO: 3028461 - RNA, 16 nt, Mycobacterium avium subsp. paratuberculosis
gaucucgucgcgcagc

SEQ ID NO: 3028462 - RNA, 17 nt, Mycobacterium avium subsp. paratuberculosis
gaucucgucgcggcugc

SEQ ID NO: 3028463 - RNA, 15 nt, Mycobacterium avium subsp. paratuberculosis
gaucucgucggcggc

SEQ ID NO: 3028464 - RNA, 14 nt, Mycobacterium avium subsp. paratuberculosis
gaucucgugccgca

SEQ ID NO: 3028465 - RNA, 21 nt, Mycobacterium avium subsp. paratuberculosis
gaucucuucgaugccgguggc

SEQ ID NO: 3028466 - RNA, 22 nt, Mycobacterium avium subsp. paratuberculosis
gaucucuucgaugccgguggcc

SEQ ID NO: 3028467 - RNA, 19 nt, Mycobacterium avium subsp. paratuberculosis
gaucucuucgccggacagc

SEQ ID NO: 3028468 - RNA, 17 nt, Mycobacterium avium subsp. paratuberculosis
gaucugaccgagcagcg

SEQ ID NO: 3028469 - RNA, 12 nt, Mycobacterium avium subsp. paratuberculosis
gaucugcaccag

SEQ ID NO: 3028470 - RNA, 15 nt, Mycobacterium avium subsp. paratuberculosis
gaucugcaccagcgu

SEQ ID NO: 3028471 - RNA, 23 nt, Mycobacterium avium subsp. paratuberculosis
gaucugcaccagcguggugcgcc

SEQ ID NO: 3028472 - RNA, 15 nt, Mycobacterium avium subsp. paratuberculosis
gaucugcagccggcg

SEQ ID NO: 3028473 - RNA, 20 nt, Mycobacterium avium subsp. paratuberculosis
gaucugcagccggcgcggca

SEQ ID NO: 3028474 - RNA, 11 nt, Mycobacterium avium subsp. paratuberculosis
gaucugcaggc

SEQ ID NO: 3028475 - RNA, 16 nt, Mycobacterium avium subsp. paratuberculosis
gaucugcccgaccuga

SEQ ID NO: 3028476 - RNA, 13 nt, Mycobacterium avium subsp. paratuberculosis
gaucugccggugc

SEQ ID NO: 3028477 - RNA, 16 nt, Mycobacterium avium subsp. paratuberculosis
gaucugccggugccgc

SEQ ID NO: 3028478 - RNA, 12 nt, Mycobacterium avium subsp. paratuberculosis
gaucugcgccgc

SEQ ID NO: 3028479 - RNA, 17 nt, Mycobacterium avium subsp. paratuberculosis
gaucugcgccgccuccg

SEQ ID NO: 3028480 - RNA, 14 nt, Mycobacterium avium subsp. paratuberculosis
gaucugcgccguga

SEQ ID NO: 3028481 - RNA, 17 nt, Mycobacterium avium subsp. paratuberculosis
gaucugcggcaccacgc

SEQ ID NO: 3028482 - RNA, 19 nt, Mycobacterium avium subsp. paratuberculosis
gaucugcggcaccacgcug

SEQ ID NO: 3028483 - RNA, 17 nt, Mycobacterium avium subsp. paratuberculosis
gaucugcggcacggugc

SEQ ID NO: 3028484 - RNA, 17 nt, Mycobacterium avium subsp. paratuberculosis
gaucugcuccggggugg

SEQ ID NO: 3028485 - RNA, 22 nt, Mycobacterium avium subsp. paratuberculosis
gaucugcuccucggucagcggc

SEQ ID NO: 3028486 - RNA, 11 nt, Mycobacterium avium subsp. paratuberculosis
gaucugcucgg

SEQ ID NO: 3028487 - RNA, 14 nt, Mycobacterium avium subsp. paratuberculosis
gaucugcucggcug

SEQ ID NO: 3028488 - RNA, 20 nt, Mycobacterium avium subsp. paratuberculosis
gaucugcuuggucaccugac

SEQ ID NO: 3028489 - RNA, 20 nt, Mycobacterium avium subsp. paratuberculosis
gaucuggaugcggcccuggc

SEQ ID NO: 3028490 - RNA, 14 nt, Mycobacterium avium subsp. paratuberculosis
gaucuggcccuggc

SEQ ID NO: 3028491 - RNA, 19 nt, Mycobacterium avium subsp. paratuberculosis
gaucuggccggugagcgga

SEQ ID NO: 3028492 - RNA, 16 nt, Mycobacterium avium subsp. paratuberculosis
gaucuggcgcagcguc

SEQ ID NO: 3028493 - RNA, 16 nt, Mycobacterium avium subsp. paratuberculosis
gaucuggcgcaucagc

SEQ ID NO: 3028494 - RNA, 21 nt, Mycobacterium avium subsp. paratuberculosis
gaucuggcgcaucagcggggc

SEQ ID NO: 3028495 - RNA, 14 nt, Mycobacterium avium subsp. paratuberculosis
gaucugggccagga

SEQ ID NO: 3028496 - RNA, 19 nt, Mycobacterium avium subsp. paratuberculosis
gaucugggccaggaucucg

SEQ ID NO: 3028497 - RNA, 13 nt, Mycobacterium avium subsp. paratuberculosis
gaucugggcggcg

SEQ ID NO: 3028498 - RNA, 16 nt, Mycobacterium avium subsp. paratuberculosis
gaucugggugccgcgg

SEQ ID NO: 3028499 - RNA, 16 nt, Mycobacterium avium subsp. paratuberculosis
gaucugguccagcgug

SEQ ID NO: 3028500 - RNA, 19 nt, Mycobacterium avium subsp. paratuberculosis
gaucuggugggcgggcacc

SEQ ID NO: 3028501 - RNA, 18 nt, Mycobacterium avium subsp. paratuberculosis
gaucugguucaccgccac

SEQ ID NO: 3028502 - RNA, 23 nt, Mycobacterium avium subsp. paratuberculosis
gaucugguuccacagcugcaggc

SEQ ID NO: 3028503 - RNA, 19 nt, Mycobacterium avium subsp. paratuberculosis
gaucugucgcgcucagugc

SEQ ID NO: 3028504 - RNA, 16 nt, Mycobacterium avium subsp. paratuberculosis
gaucuguucggcggcg

SEQ ID NO: 3028505 - RNA, 17 nt, Mycobacterium avium subsp. paratuberculosis
gaucuguucggcggcga

SEQ ID NO: 3028506 - RNA, 20 nt, Mycobacterium avium subsp. paratuberculosis
gaucuguucggcggcgaucc

SEQ ID NO: 3028507 - RNA, 22 nt, Mycobacterium avium subsp. paratuberculosis
gaucuucgagacacgcgccggc

SEQ ID NO: 3028508 - RNA, 16 nt, Mycobacterium avium subsp. paratuberculosis
gaucuucgcggcguac

SEQ ID NO: 3028509 - RNA, 16 nt, Mycobacterium avium subsp. paratuberculosis
gaucuucucgauggug

SEQ ID NO: 3028510 - RNA, 19 nt, Mycobacterium avium subsp. paratuberculosis
gaucuucucgcugcucugc

SEQ ID NO: 3028511 - RNA, 20 nt, Mycobacterium avium subsp. paratuberculosis
gaucuucucggugucgucga

SEQ ID NO: 3028512 - RNA, 14 nt, Mycobacterium avium subsp. paratuberculosis
gaucuugaucgcga

SEQ ID NO: 3028513 - RNA, 19 nt, Mycobacterium avium subsp. paratuberculosis
gaucuugaugucggggcgu

SEQ ID NO: 3028514 - RNA, 17 nt, Mycobacterium avium subsp. paratuberculosis
gaucuugcccagccacg

SEQ ID NO: 3028515 - RNA, 18 nt, Mycobacterium avium subsp. paratuberculosis
gaucuugccgucggccgc

SEQ ID NO: 3028516 - RNA, 22 nt, Mycobacterium avium subsp. paratuberculosis
gaucuugcguuccucgacggcg

SEQ ID NO: 3028517 - RNA, 19 nt, Mycobacterium avium subsp. paratuberculosis
gaucuuggcacgggcccgc

SEQ ID NO: 3028518 - RNA, 18 nt, Mycobacterium avium subsp. paratuberculosis
gaucuuggcgagcugacc

SEQ ID NO: 3028519 - RNA, 17 nt, Mycobacterium avium subsp. paratuberculosis
gaucuugucggcggccu

SEQ ID NO: 3028520 - RNA, 22 nt, Mycobacterium avium subsp. paratuberculosis
gaucuugucguccagugacgcc

SEQ ID NO: 3028521 - RNA, 15 nt, Mycobacterium avium subsp. paratuberculosis
gaucuugugccagcc

SEQ ID NO: 3028522 - RNA, 14 nt, Mycobacterium avium subsp. paratuberculosis
gaucuugugcucga

SEQ ID NO: 3028523 - RNA, 20 nt, Mycobacterium avium subsp. paratuberculosis
gaucuuguuguuggugccgc

SEQ ID NO: 3028524 - RNA, 20 nt, Mycobacterium avium subsp. paratuberculosis
gaugaaaccggccagcagca

SEQ ID NO: 3028525 - RNA, 22 nt, Mycobacterium avium subsp. paratuberculosis
gaugaaauccgggaccggcguc

SEQ ID NO: 3028526 - RNA, 23 nt, Mycobacterium avium subsp. paratuberculosis
gaugaacagcacgugcccgccgu

SEQ ID NO: 3028527 - RNA, 12 nt, Mycobacterium avium subsp. paratuberculosis
gaugaacaucgc

SEQ ID NO: 3028528 - RNA, 22 nt, Mycobacterium avium subsp. paratuberculosis
gaugaacgggauggagccgccc

SEQ ID NO: 3028529 - RNA, 18 nt, Mycobacterium avium subsp. paratuberculosis
gaugaacgucccguuggu

SEQ ID NO: 3028530 - RNA, 19 nt, Mycobacterium avium subsp. paratuberculosis
gaugaacucgugcggcgcc

SEQ ID NO: 3028531 - RNA, 23 nt, Mycobacterium avium subsp. paratuberculosis
gaugaacucgugcggcgccgccc

SEQ ID NO: 3028532 - RNA, 18 nt, Mycobacterium avium subsp. paratuberculosis
gaugaagaauuccauguc

SEQ ID NO: 3028533 - RNA, 17 nt, Mycobacterium avium subsp. paratuberculosis
gaugaagacccgccgga

SEQ ID NO: 3028534 - RNA, 12 nt, Mycobacterium avium subsp. paratuberculosis
gaugaagccccg

SEQ ID NO: 3028535 - RNA, 18 nt, Mycobacterium avium subsp. paratuberculosis
gaugaagccgugcccgcg

SEQ ID NO: 3028536 - RNA, 20 nt, Mycobacterium avium subsp. paratuberculosis
gaugaagugcgccagcgacg

SEQ ID NO: 3028537 - RNA, 18 nt, Mycobacterium avium subsp. paratuberculosis
gaugaauucggcgaucuc

SEQ ID NO: 3028538 - RNA, 15 nt, Mycobacterium avium subsp. paratuberculosis
gaugacaccgcggac

SEQ ID NO: 3028539 - RNA, 23 nt, Mycobacterium avium subsp. paratuberculosis
gaugaccaggguggucagcgucu

SEQ ID NO: 3028540 - RNA, 19 nt, Mycobacterium avium subsp. paratuberculosis
gaugaccaggucgccggcg

SEQ ID NO: 3028541 - RNA, 20 nt, Mycobacterium avium subsp. paratuberculosis
gaugaccaggucgccggcgg

SEQ ID NO: 3028542 - RNA, 21 nt, Mycobacterium avium subsp. paratuberculosis
gaugaccaggucgccggcggc

SEQ ID NO: 3028543 - RNA, 24 nt, Mycobacterium avium subsp. paratuberculosis
gaugaccaggucgccggcggccga

SEQ ID NO: 3028544 - RNA, 17 nt, Mycobacterium avium subsp. paratuberculosis
gaugacccaccagccga

SEQ ID NO: 3028545 - RNA, 14 nt, Mycobacterium avium subsp. paratuberculosis
gaugacccagccca

SEQ ID NO: 3028546 - RNA, 12 nt, Mycobacterium avium subsp. paratuberculosis
gaugaccgacau

SEQ ID NO: 3028547 - RNA, 14 nt, Mycobacterium avium subsp. paratuberculosis
gaugaccgcccagg

SEQ ID NO: 3028548 - RNA, 15 nt, Mycobacterium avium subsp. paratuberculosis
gaugaccgcccagga

SEQ ID NO: 3028549 - RNA, 16 nt, Mycobacterium avium subsp. paratuberculosis
gaugaccgcccaggac

SEQ ID NO: 3028550 - RNA, 16 nt, Mycobacterium avium subsp. paratuberculosis
gaugaccgccugcggc

SEQ ID NO: 3028551 - RNA, 14 nt, Mycobacterium avium subsp. paratuberculosis
gaugaccgcgucgg

SEQ ID NO: 3028552 - RNA, 20 nt, Mycobacterium avium subsp. paratuberculosis
gaugaccgcgucggcgccgu

SEQ ID NO: 3028553 - RNA, 15 nt, Mycobacterium avium subsp. paratuberculosis
gaugaccggcccggc

SEQ ID NO: 3028554 - RNA, 16 nt, Mycobacterium avium subsp. paratuberculosis
gaugaccggcccggcg

SEQ ID NO: 3028555 - RNA, 21 nt, Mycobacterium avium subsp. paratuberculosis
gaugaccggccugcagcgcgg

SEQ ID NO: 3028556 - RNA, 22 nt, Mycobacterium avium subsp. paratuberculosis
gaugaccuccuugcccagcgcg

SEQ ID NO: 3028557 - RNA, 23 nt, Mycobacterium avium subsp. paratuberculosis
gaugaccuccuugcccagcgcgg

SEQ ID NO: 3028558 - RNA, 17 nt, Mycobacterium avium subsp. paratuberculosis
gaugaccucgcgcagcc

SEQ ID NO: 3028559 - RNA, 19 nt, Mycobacterium avium subsp. paratuberculosis
gaugaccucgcgcagcccc

SEQ ID NO: 3028560 - RNA, 20 nt, Mycobacterium avium subsp. paratuberculosis
gaugaccucgcgcagccccc

SEQ ID NO: 3028561 - RNA, 22 nt, Mycobacterium avium subsp. paratuberculosis
gaugaccucgcgcagcccccgg

SEQ ID NO: 3028562 - RNA, 15 nt, Mycobacterium avium subsp. paratuberculosis
gaugaccucgcgccc

SEQ ID NO: 3028563 - RNA, 19 nt, Mycobacterium avium subsp. paratuberculosis
gaugaccucgcgcccggcg

SEQ ID NO: 3028564 - RNA, 22 nt, Mycobacterium avium subsp. paratuberculosis
gaugacgaauuccgcaccgguc

SEQ ID NO: 3028565 - RNA, 14 nt, Mycobacterium avium subsp. paratuberculosis
gaugacgaugcccg

SEQ ID NO: 3028566 - RNA, 16 nt, Mycobacterium avium subsp. paratuberculosis
gaugacgaugcccggg

SEQ ID NO: 3028567 - RNA, 13 nt, Mycobacterium avium subsp. paratuberculosis
gaugacgccgcgg

SEQ ID NO: 3028568 - RNA, 20 nt, Mycobacterium avium subsp. paratuberculosis
gaugacgccggacagcuggc

SEQ ID NO: 3028569 - RNA, 13 nt, Mycobacterium avium subsp. paratuberculosis
gaugacgcgcuug

SEQ ID NO: 3028570 - RNA, 15 nt, Mycobacterium avium subsp. paratuberculosis
gaugacggcggcgcc

SEQ ID NO: 3028571 - RNA, 17 nt, Mycobacterium avium subsp. paratuberculosis
gaugacggggcguuggu

SEQ ID NO: 3028572 - RNA, 19 nt, Mycobacterium avium subsp. paratuberculosis
gaugacggucugcaccggg

SEQ ID NO: 3028573 - RNA, 17 nt, Mycobacterium avium subsp. paratuberculosis
gaugacguccaccaggg

SEQ ID NO: 3028574 - RNA, 16 nt, Mycobacterium avium subsp. paratuberculosis
gaugacgucgcccacc

SEQ ID NO: 3028575 - RNA, 21 nt, Mycobacterium avium subsp. paratuberculosis
gaugacgucgcgcugccggcc

SEQ ID NO: 3028576 - RNA, 16 nt, Mycobacterium avium subsp. paratuberculosis
gaugacgugcaccacc

SEQ ID NO: 3028577 - RNA, 17 nt, Mycobacterium avium subsp. paratuberculosis
gaugacgugcaccaccg

SEQ ID NO: 3028578 - RNA, 19 nt, Mycobacterium avium subsp. paratuberculosis
gaugagcgagaugaucagc

SEQ ID NO: 3028579 - RNA, 21 nt, Mycobacterium avium subsp. paratuberculosis
gaugagcgagaugaucagccg

SEQ ID NO: 3028580 - RNA, 15 nt, Mycobacterium avium subsp. paratuberculosis
gaugagcucgcgcug

SEQ ID NO: 3028581 - RNA, 18 nt, Mycobacterium avium subsp. paratuberculosis
gaugagcugggcggcgcg

SEQ ID NO: 3028582 - RNA, 21 nt, Mycobacterium avium subsp. paratuberculosis
gaugagcugggcggcgcgcug

SEQ ID NO: 3028583 - RNA, 17 nt, Mycobacterium avium subsp. paratuberculosis
gaugaucaacacgucgu

SEQ ID NO: 3028584 - RNA, 14 nt, Mycobacterium avium subsp. paratuberculosis
gaugaucagccgcc

SEQ ID NO: 3028585 - RNA, 15 nt, Mycobacterium avium subsp. paratuberculosis
gaugauccgcggcgc

SEQ ID NO: 3028586 - RNA, 20 nt, Mycobacterium avium subsp. paratuberculosis
gaugauccgcggcgccgggc

SEQ ID NO: 3028587 - RNA, 22 nt, Mycobacterium avium subsp. paratuberculosis
gaugauccgcggcgccgggcgg

SEQ ID NO: 3028588 - RNA, 22 nt, Mycobacterium avium subsp. paratuberculosis
gaugauccuggccuggucggcc

SEQ ID NO: 3028589 - RNA, 17 nt, Mycobacterium avium subsp. paratuberculosis
gaugaucgagccgcggc

SEQ ID NO: 3028590 - RNA, 18 nt, Mycobacterium avium subsp. paratuberculosis
gaugaucgagccgcggcc

SEQ ID NO: 3028591 - RNA, 21 nt, Mycobacterium avium subsp. paratuberculosis
gaugaucgagccgcggcccgc

SEQ ID NO: 3028592 - RNA, 12 nt, Mycobacterium avium subsp. paratuberculosis
gaugaucgggau

SEQ ID NO: 3028593 - RNA, 13 nt, Mycobacterium avium subsp. paratuberculosis
gaugaucgggaug

SEQ ID NO: 3028594 - RNA, 23 nt, Mycobacterium avium subsp. paratuberculosis
gaugaucgucucggccgcggugc

SEQ ID NO: 3028595 - RNA, 16 nt, Mycobacterium avium subsp. paratuberculosis
gaugaucucgccgagc

SEQ ID NO: 3028596 - RNA, 18 nt, Mycobacterium avium subsp. paratuberculosis
gaugaucucgccgagcgg

SEQ ID NO: 3028597 - RNA, 23 nt, Mycobacterium avium subsp. paratuberculosis
gaugaucugguuccacagcugca

SEQ ID NO: 3028598 - RNA, 19 nt, Mycobacterium avium subsp. paratuberculosis
gaugaugaaaccggccagc

SEQ ID NO: 3028599 - RNA, 15 nt, Mycobacterium avium subsp. paratuberculosis
gaugaugaccgacau

SEQ ID NO: 3028600 - RNA, 21 nt, Mycobacterium avium subsp. paratuberculosis
gaugaugccgcccaucagcag

SEQ ID NO: 3028601 - RNA, 13 nt, Mycobacterium avium subsp. paratuberculosis
gaugaugccggcc

SEQ ID NO: 3028602 - RNA, 15 nt, Mycobacterium avium subsp. paratuberculosis
gaugaugcugucggu

SEQ ID NO: 3028603 - RNA, 16 nt, Mycobacterium avium subsp. paratuberculosis
gaugauggcgucgacg

SEQ ID NO: 3028604 - RNA, 14 nt, Mycobacterium avium subsp. paratuberculosis
gaugaugggcgauc

SEQ ID NO: 3028605 - RNA, 16 nt, Mycobacterium avium subsp. paratuberculosis
gaugaugguggcggcc

SEQ ID NO: 3028606 - RNA, 18 nt, Mycobacterium avium subsp. paratuberculosis
gaugaugguggcggccac

SEQ ID NO: 3028607 - RNA, 16 nt, Mycobacterium avium subsp. paratuberculosis
gaugaugucgcccggc

SEQ ID NO: 3028608 - RNA, 18 nt, Mycobacterium avium subsp. paratuberculosis
gaugaugucgcccggcgg

SEQ ID NO: 3028609 - RNA, 21 nt, Mycobacterium avium subsp. paratuberculosis
gaugaugucgcccggcggcac

SEQ ID NO: 3028610 - RNA, 16 nt, Mycobacterium avium subsp. paratuberculosis
gaugaugucggcggcc

SEQ ID NO: 3028611 - RNA, 17 nt, Mycobacterium avium subsp. paratuberculosis
gaugaugucggcggccg

SEQ ID NO: 3028612 - RNA, 21 nt, Mycobacterium avium subsp. paratuberculosis
gaugauguucuccggcccggc

SEQ ID NO: 3028613 - RNA, 22 nt, Mycobacterium avium subsp. paratuberculosis
gaugcacccggacgugaucgcg

SEQ ID NO: 3028614 - RNA, 12 nt, Mycobacterium avium subsp. paratuberculosis
gaugcaccggca

SEQ ID NO: 3028615 - RNA, 17 nt, Mycobacterium avium subsp. paratuberculosis
gaugcaccucgcccugc

SEQ ID NO: 3028616 - RNA, 14 nt, Mycobacterium avium subsp. paratuberculosis
gaugcacggucggc

SEQ ID NO: 3028617 - RNA, 21 nt, Mycobacterium avium subsp. paratuberculosis
gaugcacggucggccccgcgc

SEQ ID NO: 3028618 - RNA, 22 nt, Mycobacterium avium subsp. paratuberculosis
gaugcacggucggccccgcgca

SEQ ID NO: 3028619 - RNA, 15 nt, Mycobacterium avium subsp. paratuberculosis
gaugcagaacagccg

SEQ ID NO: 3028620 - RNA, 16 nt, Mycobacterium avium subsp. paratuberculosis
gaugcagaucaccacg

SEQ ID NO: 3028621 - RNA, 20 nt, Mycobacterium avium subsp. paratuberculosis
gaugcagcacauccagcccu

SEQ ID NO: 3028622 - RNA, 20 nt, Mycobacterium avium subsp. paratuberculosis
gaugcagcagguugcggugu

SEQ ID NO: 3028623 - RNA, 21 nt, Mycobacterium avium subsp. paratuberculosis
gaugcagugguugagcagcag

SEQ ID NO: 3028624 - RNA, 20 nt, Mycobacterium avium subsp. paratuberculosis
gaugcauucguccauccgcu

SEQ ID NO: 3028625 - RNA, 20 nt, Mycobacterium avium subsp. paratuberculosis
gaugccagacgaacgcggcc

SEQ ID NO: 3028626 - RNA, 22 nt, Mycobacterium avium subsp. paratuberculosis
gaugccagacgaacgcggccgc

SEQ ID NO: 3028627 - RNA, 15 nt, Mycobacterium avium subsp. paratuberculosis
gaugccaguuuuugg

SEQ ID NO: 3028628 - RNA, 17 nt, Mycobacterium avium subsp. paratuberculosis
gaugcccaagccggcca

SEQ ID NO: 3028629 - RNA, 20 nt, Mycobacterium avium subsp. paratuberculosis
gaugcccaagccggccaggc

SEQ ID NO: 3028630 - RNA, 21 nt, Mycobacterium avium subsp. paratuberculosis
gaugcccaagccggccaggcc

SEQ ID NO: 3028631 - RNA, 15 nt, Mycobacterium avium subsp. paratuberculosis
gaugcccacccgcuc

SEQ ID NO: 3028632 - RNA, 17 nt, Mycobacterium avium subsp. paratuberculosis
gaugcccacccgcucgg

SEQ ID NO: 3028633 - RNA, 16 nt, Mycobacterium avium subsp. paratuberculosis
gaugcccagcaccacu

SEQ ID NO: 3028634 - RNA, 15 nt, Mycobacterium avium subsp. paratuberculosis
gaugcccagcagcgg

SEQ ID NO: 3028635 - RNA, 18 nt, Mycobacterium avium subsp. paratuberculosis
gaugcccagcagcggggc

SEQ ID NO: 3028636 - RNA, 22 nt, Mycobacterium avium subsp. paratuberculosis
gaugcccagccccucgacgucc

SEQ ID NO: 3028637 - RNA, 14 nt, Mycobacterium avium subsp. paratuberculosis
gaugcccagcgcgc

SEQ ID NO: 3028638 - RNA, 21 nt, Mycobacterium avium subsp. paratuberculosis
gaugcccagcgcgcggugcgc

SEQ ID NO: 3028639 - RNA, 16 nt, Mycobacterium avium subsp. paratuberculosis
gaugcccagcggcaug

SEQ ID NO: 3028640 - RNA, 16 nt, Mycobacterium avium subsp. paratuberculosis
gaugcccaggcccacc

SEQ ID NO: 3028641 - RNA, 14 nt, Mycobacterium avium subsp. paratuberculosis
gaugcccagggcgc

SEQ ID NO: 3028642 - RNA, 18 nt, Mycobacterium avium subsp. paratuberculosis
gaugcccaucacgcccca

SEQ ID NO: 3028643 - RNA, 15 nt, Mycobacterium avium subsp. paratuberculosis
gaugcccgacaccgc

SEQ ID NO: 3028644 - RNA, 20 nt, Mycobacterium avium subsp. paratuberculosis
gaugcccgacaccgccccgc

SEQ ID NO: 3028645 - RNA, 23 nt, Mycobacterium avium subsp. paratuberculosis
gaugcccgacaccgccccgccgc

SEQ ID NO: 3028646 - RNA, 14 nt, Mycobacterium avium subsp. paratuberculosis
gaugcccgccccgc

SEQ ID NO: 3028647 - RNA, 17 nt, Mycobacterium avium subsp. paratuberculosis
gaugcccgccccgcccg

SEQ ID NO: 3028648 - RNA, 22 nt, Mycobacterium avium subsp. paratuberculosis
gaugcccgccccgcccggcggc

SEQ ID NO: 3028649 - RNA, 22 nt, Mycobacterium avium subsp. paratuberculosis
gaugcccgccccggacauccau

SEQ ID NO: 3028650 - RNA, 13 nt, Mycobacterium avium subsp. paratuberculosis
gaugcccgccggc

SEQ ID NO: 3028651 - RNA, 14 nt, Mycobacterium avium subsp. paratuberculosis
gaugcccgccggcg

SEQ ID NO: 3028652 - RNA, 19 nt, Mycobacterium avium subsp. paratuberculosis
gaugcccgccggcgucugc

SEQ ID NO: 3028653 - RNA, 13 nt, Mycobacterium avium subsp. paratuberculosis
gaugcccgcgccg

SEQ ID NO: 3028654 - RNA, 17 nt, Mycobacterium avium subsp. paratuberculosis
gaugcccgcgccgacca

SEQ ID NO: 3028655 - RNA, 21 nt, Mycobacterium avium subsp. paratuberculosis
gaugcccgcgccgaccagcgc

SEQ ID NO: 3028656 - RNA, 21 nt, Mycobacterium avium subsp. paratuberculosis
gaugcccgcguccugcagcgc

SEQ ID NO: 3028657 - RNA, 13 nt, Mycobacterium avium subsp. paratuberculosis
gaugcccgggccg

SEQ ID NO: 3028658 - RNA, 14 nt, Mycobacterium avium subsp. paratuberculosis
gaugcccgggccgu

SEQ ID NO: 3028659 - RNA, 19 nt, Mycobacterium avium subsp. paratuberculosis
gaugcccgggccguccggg

SEQ ID NO: 3028660 - RNA, 17 nt, Mycobacterium avium subsp. paratuberculosis
gaugcccuagcgguggc

SEQ ID NO: 3028661 - RNA, 19 nt, Mycobacterium avium subsp. paratuberculosis
gaugcccucgccggucagc

SEQ ID NO: 3028662 - RNA, 16 nt, Mycobacterium avium subsp. paratuberculosis
gaugcccuuggccagc

SEQ ID NO: 3028663 - RNA, 18 nt, Mycobacterium avium subsp. paratuberculosis
gaugcccuuggccagcag

SEQ ID NO: 3028664 - RNA, 20 nt, Mycobacterium avium subsp. paratuberculosis
gaugcccuuggcggccacga

SEQ ID NO: 3028665 - RNA, 13 nt, Mycobacterium avium subsp. paratuberculosis
gaugccgaacgcg

SEQ ID NO: 3028666 - RNA, 19 nt, Mycobacterium avium subsp. paratuberculosis
gaugccgaacgucaccaac

SEQ ID NO: 3028667 - RNA, 20 nt, Mycobacterium avium subsp. paratuberculosis
gaugccgaacgucaccaaca

SEQ ID NO: 3028668 - RNA, 21 nt, Mycobacterium avium subsp. paratuberculosis
gaugccgaacgucaccaacau

SEQ ID NO: 3028669 - RNA, 15 nt, Mycobacterium avium subsp. paratuberculosis
gaugccgaacuccgc

SEQ ID NO: 3028670 - RNA, 16 nt, Mycobacterium avium subsp. paratuberculosis
gaugccgaagccguug

SEQ ID NO: 3028671 - RNA, 12 nt, Mycobacterium avium subsp. paratuberculosis
gaugccgacacc

SEQ ID NO: 3028672 - RNA, 13 nt, Mycobacterium avium subsp. paratuberculosis
gaugccgacaccc

SEQ ID NO: 3028673 - RNA, 14 nt, Mycobacterium avium subsp. paratuberculosis
gaugccgaccgaca

SEQ ID NO: 3028674 - RNA, 17 nt, Mycobacterium avium subsp. paratuberculosis
gaugccgaccgacagcc

SEQ ID NO: 3028675 - RNA, 18 nt, Mycobacterium avium subsp. paratuberculosis
gaugccgaccgacagccg

SEQ ID NO: 3028676 - RNA, 22 nt, Mycobacterium avium subsp. paratuberculosis
gaugccgaccgacagccgcacc

SEQ ID NO: 3028677 - RNA, 23 nt, Mycobacterium avium subsp. paratuberculosis
gaugccgaccgacagccgcacca

SEQ ID NO: 3028678 - RNA, 16 nt, Mycobacterium avium subsp. paratuberculosis
gaugccgagcagcucg

SEQ ID NO: 3028679 - RNA, 17 nt, Mycobacterium avium subsp. paratuberculosis
gaugccgagcagcucgg

SEQ ID NO: 3028680 - RNA, 14 nt, Mycobacterium avium subsp. paratuberculosis
gaugccgagccggc

SEQ ID NO: 3028681 - RNA, 21 nt, Mycobacterium avium subsp. paratuberculosis
gaugccgagccggccgaagcg

SEQ ID NO: 3028682 - RNA, 16 nt, Mycobacterium avium subsp. paratuberculosis
gaugccgagcgccgcg

SEQ ID NO: 3028683 - RNA, 24 nt, Mycobacterium avium subsp. paratuberculosis
gaugccgaguuccugcgaccgccg

SEQ ID NO: 3028684 - RNA, 14 nt, Mycobacterium avium subsp. paratuberculosis
gaugccgaucacgg

SEQ ID NO: 3028685 - RNA, 22 nt, Mycobacterium avium subsp. paratuberculosis
gaugccgaucacggugaucgcc

SEQ ID NO: 3028686 - RNA, 13 nt, Mycobacterium avium subsp. paratuberculosis
gaugccgaucagg

SEQ ID NO: 3028687 - RNA, 23 nt, Mycobacterium avium subsp. paratuberculosis
gaugccgaucggggcgcagcccg

SEQ ID NO: 3028688 - RNA, 12 nt, Mycobacterium avium subsp. paratuberculosis
gaugccgcccac

SEQ ID NO: 3028689 - RNA, 13 nt, Mycobacterium avium subsp. paratuberculosis
gaugccgcccacc

SEQ ID NO: 3028690 - RNA, 16 nt, Mycobacterium avium subsp. paratuberculosis
gaugccgcccaccacc

SEQ ID NO: 3028691 - RNA, 17 nt, Mycobacterium avium subsp. paratuberculosis
gaugccgcccaccaccg

SEQ ID NO: 3028692 - RNA, 19 nt, Mycobacterium avium subsp. paratuberculosis
gaugccgcccaccaccggc

SEQ ID NO: 3028693 - RNA, 20 nt, Mycobacterium avium subsp. paratuberculosis
gaugccgcccaccaccggcu

SEQ ID NO: 3028694 - RNA, 13 nt, Mycobacterium avium subsp. paratuberculosis
gaugccgcccagc

SEQ ID NO: 3028695 - RNA, 14 nt, Mycobacterium avium subsp. paratuberculosis
gaugccgcccagca

SEQ ID NO: 3028696 - RNA, 18 nt, Mycobacterium avium subsp. paratuberculosis
gaugccgcccagcagcgg

SEQ ID NO: 3028697 - RNA, 18 nt, Mycobacterium avium subsp. paratuberculosis
gaugccgcccaucagcag

SEQ ID NO: 3028698 - RNA, 16 nt, Mycobacterium avium subsp. paratuberculosis
gaugccgccccugcug

SEQ ID NO: 3028699 - RNA, 20 nt, Mycobacterium avium subsp. paratuberculosis
gaugccgccgaagcggcgca

SEQ ID NO: 3028700 - RNA, 20 nt, Mycobacterium avium subsp. paratuberculosis
gaugccgccgagggccagca

SEQ ID NO: 3028701 - RNA, 16 nt, Mycobacterium avium subsp. paratuberculosis
gaugccgccggggugc

SEQ ID NO: 3028702 - RNA, 13 nt, Mycobacterium avium subsp. paratuberculosis
gaugccgcgcggc

SEQ ID NO: 3028703 - RNA, 15 nt, Mycobacterium avium subsp. paratuberculosis
gaugccgcgcggcgc

SEQ ID NO: 3028704 - RNA, 17 nt, Mycobacterium avium subsp. paratuberculosis
gaugccgcgcggcgcca

SEQ ID NO: 3028705 - RNA, 13 nt, Mycobacterium avium subsp. paratuberculosis
gaugccgcgcugc

SEQ ID NO: 3028706 - RNA, 14 nt, Mycobacterium avium subsp. paratuberculosis
gaugccgcgcugcg

SEQ ID NO: 3028707 - RNA, 16 nt, Mycobacterium avium subsp. paratuberculosis
gaugccgcgcugcgcc

SEQ ID NO: 3028708 - RNA, 20 nt, Mycobacterium avium subsp. paratuberculosis
gaugccgcgcugcgccgggu

SEQ ID NO: 3028709 - RNA, 13 nt, Mycobacterium avium subsp. paratuberculosis
gaugccgcggcgu

SEQ ID NO: 3028710 - RNA, 13 nt, Mycobacterium avium subsp. paratuberculosis
gaugccgcucggc

SEQ ID NO: 3028711 - RNA, 15 nt, Mycobacterium avium subsp. paratuberculosis
gaugccgcucggcgc

SEQ ID NO: 3028712 - RNA, 21 nt, Mycobacterium avium subsp. paratuberculosis
gaugccggacuugaugcugcc

SEQ ID NO: 3028713 - RNA, 18 nt, Mycobacterium avium subsp. paratuberculosis
gaugccggaggcgccgua

SEQ ID NO: 3028714 - RNA, 13 nt, Mycobacterium avium subsp. paratuberculosis
gaugccggccagc

SEQ ID NO: 3028715 - RNA, 14 nt, Mycobacterium avium subsp. paratuberculosis
gaugccggccagcc

SEQ ID NO: 3028716 - RNA, 17 nt, Mycobacterium avium subsp. paratuberculosis
gaugccggccagccgcg

SEQ ID NO: 3028717 - RNA, 18 nt, Mycobacterium avium subsp. paratuberculosis
gaugccggccagccgcgc

SEQ ID NO: 3028718 - RNA, 15 nt, Mycobacterium avium subsp. paratuberculosis
gaugccggccagcgg

SEQ ID NO: 3028719 - RNA, 16 nt, Mycobacterium avium subsp. paratuberculosis
gaugccggccagcggc

SEQ ID NO: 3028720 - RNA, 17 nt, Mycobacterium avium subsp. paratuberculosis
gaugccggccagcggcc

SEQ ID NO: 3028721 - RNA, 19 nt, Mycobacterium avium subsp. paratuberculosis
gaugccggccagcggccag

SEQ ID NO: 3028722 - RNA, 21 nt, Mycobacterium avium subsp. paratuberculosis
gaugccggccagcggccagcc

SEQ ID NO: 3028723 - RNA, 22 nt, Mycobacterium avium subsp. paratuberculosis
gaugccggccagcggccagccc

SEQ ID NO: 3028724 - RNA, 23 nt, Mycobacterium avium subsp. paratuberculosis
gaugccggccagcggccagcccg

SEQ ID NO: 3028725 - RNA, 12 nt, Mycobacterium avium subsp. paratuberculosis
gaugccggccgc

SEQ ID NO: 3028726 - RNA, 14 nt, Mycobacterium avium subsp. paratuberculosis
gaugccggccgcgu

SEQ ID NO: 3028727 - RNA, 17 nt, Mycobacterium avium subsp. paratuberculosis
gaugccggccgcguacu

SEQ ID NO: 3028728 - RNA, 15 nt, Mycobacterium avium subsp. paratuberculosis
gaugccggcgcccag

SEQ ID NO: 3028729 - RNA, 16 nt, Mycobacterium avium subsp. paratuberculosis
gaugccggcgcccagc

SEQ ID NO: 3028730 - RNA, 17 nt, Mycobacterium avium subsp. paratuberculosis
gaugccggcgcccagcg

SEQ ID NO: 3028731 - RNA, 15 nt, Mycobacterium avium subsp. paratuberculosis
gaugccggcggacag

SEQ ID NO: 3028732 - RNA, 18 nt, Mycobacterium avium subsp. paratuberculosis
gaugccggcggacagccc

SEQ ID NO: 3028733 - RNA, 20 nt, Mycobacterium avium subsp. paratuberculosis
gaugccggcggacagccccg

SEQ ID NO: 3028734 - RNA, 13 nt, Mycobacterium avium subsp. paratuberculosis
gaugccggcggug

SEQ ID NO: 3028735 - RNA, 14 nt, Mycobacterium avium subsp. paratuberculosis
gaugccggcggugu

SEQ ID NO: 3028736 - RNA, 19 nt, Mycobacterium avium subsp. paratuberculosis
gaugccggcuugggcgaau

SEQ ID NO: 3028737 - RNA, 18 nt, Mycobacterium avium subsp. paratuberculosis
gaugccgggaagcgaagc

SEQ ID NO: 3028738 - RNA, 16 nt, Mycobacterium avium subsp. paratuberculosis
gaugccggggcagcac

SEQ ID NO: 3028739 - RNA, 18 nt, Mycobacterium avium subsp. paratuberculosis
gaugccggggcagcaccc

SEQ ID NO: 3028740 - RNA, 20 nt, Mycobacterium avium subsp. paratuberculosis
gaugccgggugggcagcccc

SEQ ID NO: 3028741 - RNA, 17 nt, Mycobacterium avium subsp. paratuberculosis
gaugccgguacggccga

SEQ ID NO: 3028742 - RNA, 20 nt, Mycobacterium avium subsp. paratuberculosis
gaugccgguacggccgacgc

SEQ ID NO: 3028743 - RNA, 21 nt, Mycobacterium avium subsp. paratuberculosis
gaugccgguacggccgacgcc

SEQ ID NO: 3028744 - RNA, 22 nt, Mycobacterium avium subsp. paratuberculosis
gaugccgguacggccgacgccc

SEQ ID NO: 3028745 - RNA, 17 nt, Mycobacterium avium subsp. paratuberculosis
gaugccgguggccuugc

SEQ ID NO: 3028746 - RNA, 19 nt, Mycobacterium avium subsp. paratuberculosis
gaugccgucacugucggcg

SEQ ID NO: 3028747 - RNA, 20 nt, Mycobacterium avium subsp. paratuberculosis
gaugccguccagcaacgccg

SEQ ID NO: 3028748 - RNA, 22 nt, Mycobacterium avium subsp. paratuberculosis
gaugccguccagcaacgccgac

SEQ ID NO: 3028749 - RNA, 22 nt, Mycobacterium avium subsp. paratuberculosis
gaugccguccuugucgcgcacc

SEQ ID NO: 3028750 - RNA, 15 nt, Mycobacterium avium subsp. paratuberculosis
gaugccgucgguggu

SEQ ID NO: 3028751 - RNA, 14 nt, Mycobacterium avium subsp. paratuberculosis
gaugccgugcgcgc

SEQ ID NO: 3028752 - RNA, 20 nt, Mycobacterium avium subsp. paratuberculosis
gaugccgugcgcgcuggugc

SEQ ID NO: 3028753 - RNA, 16 nt, Mycobacterium avium subsp. paratuberculosis
gaugccguggucggcg

SEQ ID NO: 3028754 - RNA, 17 nt, Mycobacterium avium subsp. paratuberculosis
gaugccguggucggcga

SEQ ID NO: 3028755 - RNA, 16 nt, Mycobacterium avium subsp. paratuberculosis
gaugccguggugcccu

SEQ ID NO: 3028756 - RNA, 15 nt, Mycobacterium avium subsp. paratuberculosis
gaugccguucgcgcc

SEQ ID NO: 3028757 - RNA, 13 nt, Mycobacterium avium subsp. paratuberculosis
gaugccugcccag

SEQ ID NO: 3028758 - RNA, 15 nt, Mycobacterium avium subsp. paratuberculosis
gaugccugcccagcg

SEQ ID NO: 3028759 - RNA, 17 nt, Mycobacterium avium subsp. paratuberculosis
gaugccugcccagcggc

SEQ ID NO: 3028760 - RNA, 21 nt, Mycobacterium avium subsp. paratuberculosis
gaugcgcaagcaccggcuggc

SEQ ID NO: 3028761 - RNA, 20 nt, Mycobacterium avium subsp. paratuberculosis
gaugcgcacccccggggccu

SEQ ID NO: 3028762 - RNA, 20 nt, Mycobacterium avium subsp. paratuberculosis
gaugcgcaccgugccgcccg

SEQ ID NO: 3028763 - RNA, 18 nt, Mycobacterium avium subsp. paratuberculosis
gaugcgcacgucggccgc

SEQ ID NO: 3028764 - RNA, 14 nt, Mycobacterium avium subsp. paratuberculosis
gaugcgcagcagcg

SEQ ID NO: 3028765 - RNA, 18 nt, Mycobacterium avium subsp. paratuberculosis
gaugcgcagcagcggcuu

SEQ ID NO: 3028766 - RNA, 14 nt, Mycobacterium avium subsp. paratuberculosis
gaugcgccaccgac

SEQ ID NO: 3028767 - RNA, 16 nt, Mycobacterium avium subsp. paratuberculosis
gaugcgccaccgacac

SEQ ID NO: 3028768 - RNA, 19 nt, Mycobacterium avium subsp. paratuberculosis
gaugcgccaccgacaccac

SEQ ID NO: 3028769 - RNA, 15 nt, Mycobacterium avium subsp. paratuberculosis
gaugcgcccgcgcca

SEQ ID NO: 3028770 - RNA, 20 nt, Mycobacterium avium subsp. paratuberculosis
gaugcgcccgcgccaccccg

SEQ ID NO: 3028771 - RNA, 21 nt, Mycobacterium avium subsp. paratuberculosis
gaugcgcccgcgccaccccga

SEQ ID NO: 3028772 - RNA, 20 nt, Mycobacterium avium subsp. paratuberculosis
gaugcgcccgcugcggcgca

SEQ ID NO: 3028773 - RNA, 12 nt, Mycobacterium avium subsp. paratuberculosis
gaugcgcccggu

SEQ ID NO: 3028774 - RNA, 12 nt, Mycobacterium avium subsp. paratuberculosis
gaugcgccgcac

SEQ ID NO: 3028775 - RNA, 22 nt, Mycobacterium avium subsp. paratuberculosis
gaugcgccggguccagccgcgg

SEQ ID NO: 3028776 - RNA, 20 nt, Mycobacterium avium subsp. paratuberculosis
gaugcgcgacggccucgccg

SEQ ID NO: 3028777 - RNA, 17 nt, Mycobacterium avium subsp. paratuberculosis
gaugcgcgccagcagcg

SEQ ID NO: 3028778 - RNA, 16 nt, Mycobacterium avium subsp. paratuberculosis
gaugcgcgccgacgac

SEQ ID NO: 3028779 - RNA, 13 nt, Mycobacterium avium subsp. paratuberculosis
gaugcgcggcccg

SEQ ID NO: 3028780 - RNA, 14 nt, Mycobacterium avium subsp. paratuberculosis
gaugcgcggcccgu

SEQ ID NO: 3028781 - RNA, 17 nt, Mycobacterium avium subsp. paratuberculosis
gaugcgcggcgacggcg

SEQ ID NO: 3028782 - RNA, 17 nt, Mycobacterium avium subsp. paratuberculosis
gaugcgcgguaacagag

SEQ ID NO: 3028783 - RNA, 23 nt, Mycobacterium avium subsp. paratuberculosis
gaugcgcgguaacagagcgggau

SEQ ID NO: 3028784 - RNA, 15 nt, Mycobacterium avium subsp. paratuberculosis
gaugcgcucggcgac

SEQ ID NO: 3028785 - RNA, 21 nt, Mycobacterium avium subsp. paratuberculosis
gaugcgcuggugcacccgaug

SEQ ID NO: 3028786 - RNA, 21 nt, Mycobacterium avium subsp. paratuberculosis
gaugcggacaccagucgcaca

SEQ ID NO: 3028787 - RNA, 16 nt, Mycobacterium avium subsp. paratuberculosis
gaugcggaucucggug

SEQ ID NO: 3028788 - RNA, 18 nt, Mycobacterium avium subsp. paratuberculosis
gaugcggaugcccgccgg

SEQ ID NO: 3028789 - RNA, 20 nt, Mycobacterium avium subsp. paratuberculosis
gaugcggaugcccgccggcg

SEQ ID NO: 3028790 - RNA, 18 nt, Mycobacterium avium subsp. paratuberculosis
gaugcggcaccagcccgc

SEQ ID NO: 3028791 - RNA, 20 nt, Mycobacterium avium subsp. paratuberculosis
gaugcggcaccagcccgccg

SEQ ID NO: 3028792 - RNA, 21 nt, Mycobacterium avium subsp. paratuberculosis
gaugcggcaccagcccgccgu

SEQ ID NO: 3028793 - RNA, 14 nt, Mycobacterium avium subsp. paratuberculosis
gaugcggcccagcc

SEQ ID NO: 3028794 - RNA, 15 nt, Mycobacterium avium subsp. paratuberculosis
gaugcggcccagccc

SEQ ID NO: 3028795 - RNA, 16 nt, Mycobacterium avium subsp. paratuberculosis
gaugcggcccagcccg

SEQ ID NO: 3028796 - RNA, 22 nt, Mycobacterium avium subsp. paratuberculosis
gaugcggcccagcccggccagc

SEQ ID NO: 3028797 - RNA, 14 nt, Mycobacterium avium subsp. paratuberculosis
gaugcggcccggcc

SEQ ID NO: 3028798 - RNA, 20 nt, Mycobacterium avium subsp. paratuberculosis
gaugcggccggcgggcagca

SEQ ID NO: 3028799 - RNA, 14 nt, Mycobacterium avium subsp. paratuberculosis
gaugcggcgcccac

SEQ ID NO: 3028800 - RNA, 18 nt, Mycobacterium avium subsp. paratuberculosis
gaugcggcgcccacagca

SEQ ID NO: 3028801 - RNA, 12 nt, Mycobacterium avium subsp. paratuberculosis
gaugcggcuccc

SEQ ID NO: 3028802 - RNA, 16 nt, Mycobacterium avium subsp. paratuberculosis
gaugcggcucccaccg

SEQ ID NO: 3028803 - RNA, 13 nt, Mycobacterium avium subsp. paratuberculosis
gaugcgggccaca

SEQ ID NO: 3028804 - RNA, 16 nt, Mycobacterium avium subsp. paratuberculosis
gaugcgggccacacac

SEQ ID NO: 3028805 - RNA, 14 nt, Mycobacterium avium subsp. paratuberculosis
gaugcgggccagga

SEQ ID NO: 3028806 - RNA, 16 nt, Mycobacterium avium subsp. paratuberculosis
gaugcggggccggcgg

SEQ ID NO: 3028807 - RNA, 14 nt, Mycobacterium avium subsp. paratuberculosis
gaugcggggcggcg

SEQ ID NO: 3028808 - RNA, 17 nt, Mycobacterium avium subsp. paratuberculosis
gaugcggggcggcggga

SEQ ID NO: 3028809 - RNA, 18 nt, Mycobacterium avium subsp. paratuberculosis
gaugcggguguugcgcag

SEQ ID NO: 3028810 - RNA, 21 nt, Mycobacterium avium subsp. paratuberculosis
gaugcggguguugcgcagcgu

SEQ ID NO: 3028811 - RNA, 15 nt, Mycobacterium avium subsp. paratuberculosis
gaugcggucccgcgg

SEQ ID NO: 3028812 - RNA, 15 nt, Mycobacterium avium subsp. paratuberculosis
gaugcggucggcgcg

SEQ ID NO: 3028813 - RNA, 19 nt, Mycobacterium avium subsp. paratuberculosis
gaugcggucggcgcggggc

SEQ ID NO: 3028814 - RNA, 23 nt, Mycobacterium avium subsp. paratuberculosis
gaugcggugccgggccaggucga

SEQ ID NO: 3028815 - RNA, 16 nt, Mycobacterium avium subsp. paratuberculosis
gaugcggugccgggug

SEQ ID NO: 3028816 - RNA, 15 nt, Mycobacterium avium subsp. paratuberculosis
gaugcgugcgguggu

SEQ ID NO: 3028817 - RNA, 22 nt, Mycobacterium avium subsp. paratuberculosis
gaugcguuccaggugugccgcu

SEQ ID NO: 3028818 - RNA, 12 nt, Mycobacterium avium subsp. paratuberculosis
gaugcguucggc

SEQ ID NO: 3028819 - RNA, 17 nt, Mycobacterium avium subsp. paratuberculosis
gaugcguucggccgcag

SEQ ID NO: 3028820 - RNA, 21 nt, Mycobacterium avium subsp. paratuberculosis
gaugcguucggccgcagcggg

SEQ ID NO: 3028821 - RNA, 20 nt, Mycobacterium avium subsp. paratuberculosis
gaugcguugcgccagcaccg

SEQ ID NO: 3028822 - RNA, 17 nt, Mycobacterium avium subsp. paratuberculosis
gaugcguuggccgagca

SEQ ID NO: 3028823 - RNA, 20 nt, Mycobacterium avium subsp. paratuberculosis
gaugcguuggccgagcagcc

SEQ ID NO: 3028824 - RNA, 21 nt, Mycobacterium avium subsp. paratuberculosis
gaugcguuggccgagcagccg

SEQ ID NO: 3028825 - RNA, 18 nt, Mycobacterium avium subsp. paratuberculosis
gaugcuaccucacaaccg

SEQ ID NO: 3028826 - RNA, 14 nt, Mycobacterium avium subsp. paratuberculosis
gaugcucccggucg

SEQ ID NO: 3028827 - RNA, 12 nt, Mycobacterium avium subsp. paratuberculosis
gaugcucgucgg

SEQ ID NO: 3028828 - RNA, 16 nt, Mycobacterium avium subsp. paratuberculosis
gaugcugagcgggucg

SEQ ID NO: 3028829 - RNA, 17 nt, Mycobacterium avium subsp. paratuberculosis
gaugcugauacccgcgc

SEQ ID NO: 3028830 - RNA, 14 nt, Mycobacterium avium subsp. paratuberculosis
gaugcugcccggcg

SEQ ID NO: 3028831 - RNA, 17 nt, Mycobacterium avium subsp. paratuberculosis
gaugcugcgggucagca

SEQ ID NO: 3028832 - RNA, 20 nt, Mycobacterium avium subsp. paratuberculosis
gaugcuggccaucgccgagc

SEQ ID NO: 3028833 - RNA, 16 nt, Mycobacterium avium subsp. paratuberculosis
gaugcuggggucggcc

SEQ ID NO: 3028834 - RNA, 16 nt, Mycobacterium avium subsp. paratuberculosis
gaugcuggugacgccg

SEQ ID NO: 3028835 - RNA, 18 nt, Mycobacterium avium subsp. paratuberculosis
gaugcuggugacgccgcu

SEQ ID NO: 3028836 - RNA, 22 nt, Mycobacterium avium subsp. paratuberculosis
gaugcugucgcgggucuggcuc

SEQ ID NO: 3028837 - RNA, 14 nt, Mycobacterium avium subsp. paratuberculosis
gaugcugugcgcuu

SEQ ID NO: 3028838 - RNA, 16 nt, Mycobacterium avium subsp. paratuberculosis
gaugcugugcgcuugg

SEQ ID NO: 3028839 - RNA, 14 nt, Mycobacterium avium subsp. paratuberculosis
gauggaagcgguga

SEQ ID NO: 3028840 - RNA, 21 nt, Mycobacterium avium subsp. paratuberculosis
gauggaauucgucggcggugu

SEQ ID NO: 3028841 - RNA, 13 nt, Mycobacterium avium subsp. paratuberculosis
gauggacacgcug

SEQ ID NO: 3028842 - RNA, 23 nt, Mycobacterium avium subsp. paratuberculosis
gauggacagcagccagguccggg

SEQ ID NO: 3028843 - RNA, 22 nt, Mycobacterium avium subsp. paratuberculosis
gauggacagggcgacaucggca

SEQ ID NO: 3028844 - RNA, 15 nt, Mycobacterium avium subsp. paratuberculosis
gauggacgacgugcc

SEQ ID NO: 3028845 - RNA, 14 nt, Mycobacterium avium subsp. paratuberculosis
gauggacgcccaga

SEQ ID NO: 3028846 - RNA, 15 nt, Mycobacterium avium subsp. paratuberculosis
gauggacgcgguggu

SEQ ID NO: 3028847 - RNA, 17 nt, Mycobacterium avium subsp. paratuberculosis
gauggacgcgguggugc

SEQ ID NO: 3028848 - RNA, 14 nt, Mycobacterium avium subsp. paratuberculosis
gauggacggggcga

SEQ ID NO: 3028849 - RNA, 19 nt, Mycobacterium avium subsp. paratuberculosis
gauggacggggcgaugccg

SEQ ID NO: 3028850 - RNA, 18 nt, Mycobacterium avium subsp. paratuberculosis
gauggacguccagcggcc

SEQ ID NO: 3028851 - RNA, 16 nt, Mycobacterium avium subsp. paratuberculosis
gauggaggucccgagg

SEQ ID NO: 3028852 - RNA, 16 nt, Mycobacterium avium subsp. paratuberculosis
gauggaggugccgcgc

SEQ ID NO: 3028853 - RNA, 15 nt, Mycobacterium avium subsp. paratuberculosis
gauggcaacgccggu

SEQ ID NO: 3028854 - RNA, 14 nt, Mycobacterium avium subsp. paratuberculosis
gauggccaccaggu

SEQ ID NO: 3028855 - RNA, 16 nt, Mycobacterium avium subsp. paratuberculosis
gauggccaccaggucc

SEQ ID NO: 3028856 - RNA, 13 nt, Mycobacterium avium subsp. paratuberculosis
gauggccaccauc

SEQ ID NO: 3028857 - RNA, 20 nt, Mycobacterium avium subsp. paratuberculosis
gauggccaccaucaggccgg

SEQ ID NO: 3028858 - RNA, 21 nt, Mycobacterium avium subsp. paratuberculosis
gauggccaccaucaggccggc

SEQ ID NO: 3028859 - RNA, 21 nt, Mycobacterium avium subsp. paratuberculosis
gauggccacgcucucgccggu

SEQ ID NO: 3028860 - RNA, 13 nt, Mycobacterium avium subsp. paratuberculosis
gauggccagcacc

SEQ ID NO: 3028861 - RNA, 12 nt, Mycobacterium avium subsp. paratuberculosis
gauggccagcag

SEQ ID NO: 3028862 - RNA, 14 nt, Mycobacterium avium subsp. paratuberculosis
gauggccagcaggu

SEQ ID NO: 3028863 - RNA, 13 nt, Mycobacterium avium subsp. paratuberculosis
gauggccagcgcg

SEQ ID NO: 3028864 - RNA, 15 nt, Mycobacterium avium subsp. paratuberculosis
gauggccagcgcggc

SEQ ID NO: 3028865 - RNA, 12 nt, Mycobacterium avium subsp. paratuberculosis
gauggccaggcc

SEQ ID NO: 3028866 - RNA, 14 nt, Mycobacterium avium subsp. paratuberculosis
gauggccaggccca

SEQ ID NO: 3028867 - RNA, 19 nt, Mycobacterium avium subsp. paratuberculosis
gauggccaggcccagcccg

SEQ ID NO: 3028868 - RNA, 19 nt, Mycobacterium avium subsp. paratuberculosis
gauggccagguaguggugg

SEQ ID NO: 3028869 - RNA, 16 nt, Mycobacterium avium subsp. paratuberculosis
gauggccaucuggccg

SEQ ID NO: 3028870 - RNA, 18 nt, Mycobacterium avium subsp. paratuberculosis
gauggccaucuggccgcg

SEQ ID NO: 3028871 - RNA, 19 nt, Mycobacterium avium subsp. paratuberculosis
gauggccaucuggccgcgg

SEQ ID NO: 3028872 - RNA, 18 nt, Mycobacterium avium subsp. paratuberculosis
gauggccauggccaggaa

SEQ ID NO: 3028873 - RNA, 23 nt, Mycobacterium avium subsp. paratuberculosis
gauggccauggccaggaacggcg

SEQ ID NO: 3028874 - RNA, 16 nt, Mycobacterium avium subsp. paratuberculosis
gauggcccaggccgcg

SEQ ID NO: 3028875 - RNA, 18 nt, Mycobacterium avium subsp. paratuberculosis
gauggcccaggccgcggu

SEQ ID NO: 3028876 - RNA, 14 nt, Mycobacterium avium subsp. paratuberculosis
gauggccccggcga

SEQ ID NO: 3028877 - RNA, 16 nt, Mycobacterium avium subsp. paratuberculosis
gauggcccgcugcgcc

SEQ ID NO: 3028878 - RNA, 20 nt, Mycobacterium avium subsp. paratuberculosis
gauggcccgcugcgccgacu

SEQ ID NO: 3028879 - RNA, 18 nt, Mycobacterium avium subsp. paratuberculosis
gauggcccggaccgccgc

SEQ ID NO: 3028880 - RNA, 20 nt, Mycobacterium avium subsp. paratuberculosis
gauggcccggaccgccgcgg

SEQ ID NO: 3028881 - RNA, 18 nt, Mycobacterium avium subsp. paratuberculosis
gauggcccgggccacacc

SEQ ID NO: 3028882 - RNA, 23 nt, Mycobacterium avium subsp. paratuberculosis
gauggccgacaacauccgcgacg

SEQ ID NO: 3028883 - RNA, 13 nt, Mycobacterium avium subsp. paratuberculosis
gauggccgcccgc

SEQ ID NO: 3028884 - RNA, 19 nt, Mycobacterium avium subsp. paratuberculosis
gauggccgccgcaggcgaa

SEQ ID NO: 3028885 - RNA, 20 nt, Mycobacterium avium subsp. paratuberculosis
gauggccgcuucgggguggu

SEQ ID NO: 3028886 - RNA, 15 nt, Mycobacterium avium subsp. paratuberculosis
gauggccggccgggu

SEQ ID NO: 3028887 - RNA, 23 nt, Mycobacterium avium subsp. paratuberculosis
gauggccggcuaccgcgcggaga

SEQ ID NO: 3028888 - RNA, 16 nt, Mycobacterium avium subsp. paratuberculosis
gauggccuccgacccg

SEQ ID NO: 3028889 - RNA, 17 nt, Mycobacterium avium subsp. paratuberculosis
gauggccucggcgaugc

SEQ ID NO: 3028890 - RNA, 18 nt, Mycobacterium avium subsp. paratuberculosis
gauggccucggcgaugcc

SEQ ID NO: 3028891 - RNA, 14 nt, Mycobacterium avium subsp. paratuberculosis
gauggccugcacgg

SEQ ID NO: 3028892 - RNA, 17 nt, Mycobacterium avium subsp. paratuberculosis
gauggcgaaccagcgcc

SEQ ID NO: 3028893 - RNA, 13 nt, Mycobacterium avium subsp. paratuberculosis
gauggcgaccgcg

SEQ ID NO: 3028894 - RNA, 23 nt, Mycobacterium avium subsp. paratuberculosis
gauggcgaccgcgcaggcggcga

SEQ ID NO: 3028895 - RNA, 15 nt, Mycobacterium avium subsp. paratuberculosis
gauggcgacgcacga

SEQ ID NO: 3028896 - RNA, 13 nt, Mycobacterium avium subsp. paratuberculosis
gauggcgacggcg

SEQ ID NO: 3028897 - RNA, 20 nt, Mycobacterium avium subsp. paratuberculosis
gauggcgacggcgacgaccg

SEQ ID NO: 3028898 - RNA, 17 nt, Mycobacterium avium subsp. paratuberculosis
gauggcgacggucugcc

SEQ ID NO: 3028899 - RNA, 22 nt, Mycobacterium avium subsp. paratuberculosis
gauggcgaucagaugcucgucg

SEQ ID NO: 3028900 - RNA, 23 nt, Mycobacterium avium subsp. paratuberculosis
gauggcgaucagaugcucgucgg

SEQ ID NO: 3028901 - RNA, 16 nt, Mycobacterium avium subsp. paratuberculosis
gauggcgcccagcccg

SEQ ID NO: 3028902 - RNA, 20 nt, Mycobacterium avium subsp. paratuberculosis
gauggcgcccagcgucucgg

SEQ ID NO: 3028903 - RNA, 22 nt, Mycobacterium avium subsp. paratuberculosis
gauggcgcccagcgucucggcg

SEQ ID NO: 3028904 - RNA, 14 nt, Mycobacterium avium subsp. paratuberculosis
gauggcgcccggca

SEQ ID NO: 3028905 - RNA, 14 nt, Mycobacterium avium subsp. paratuberculosis
gauggcgccgaucg

SEQ ID NO: 3028906 - RNA, 22 nt, Mycobacterium avium subsp. paratuberculosis
gauggcgccgaucgcgcgcagg

SEQ ID NO: 3028907 - RNA, 16 nt, Mycobacterium avium subsp. paratuberculosis
gauggcgccgucgagg

SEQ ID NO: 3028908 - RNA, 23 nt, Mycobacterium avium subsp. paratuberculosis
gauggcgcggcccaguucgcacc

SEQ ID NO: 3028909 - RNA, 15 nt, Mycobacterium avium subsp. paratuberculosis
gauggcgcggccggc

SEQ ID NO: 3028910 - RNA, 14 nt, Mycobacterium avium subsp. paratuberculosis
gauggcgcggcgca

SEQ ID NO: 3028911 - RNA, 19 nt, Mycobacterium avium subsp. paratuberculosis
gauggcgcggcgcaccgcc

SEQ ID NO: 3028912 - RNA, 14 nt, Mycobacterium avium subsp. paratuberculosis
gauggcgcuggccg

SEQ ID NO: 3028913 - RNA, 17 nt, Mycobacterium avium subsp. paratuberculosis
gauggcgcuggccgcga

SEQ ID NO: 3028914 - RNA, 10 nt, Mycobacterium avium subsp. paratuberculosis
gauggcggcg

SEQ ID NO: 3028915 - RNA, 14 nt, Mycobacterium avium subsp. paratuberculosis
gauggcggcgcgga

SEQ ID NO: 3028916 - RNA, 12 nt, Mycobacterium avium subsp. paratuberculosis
gauggcggcggc

SEQ ID NO: 3028917 - RNA, 12 nt, Mycobacterium avium subsp. paratuberculosis
gauggcggcguc

SEQ ID NO: 3028918 - RNA, 22 nt, Mycobacterium avium subsp. paratuberculosis
gauggcggcgugcagucccaga

SEQ ID NO: 3028919 - RNA, 16 nt, Mycobacterium avium subsp. paratuberculosis
gauggcggcguugcgg

SEQ ID NO: 3028920 - RNA, 21 nt, Mycobacterium avium subsp. paratuberculosis
gauggcggcguugcgggugga

SEQ ID NO: 3028921 - RNA, 18 nt, Mycobacterium avium subsp. paratuberculosis
gauggcgggcgcgccggc

SEQ ID NO: 3028922 - RNA, 19 nt, Mycobacterium avium subsp. paratuberculosis
gauggcggguuggugucga

SEQ ID NO: 3028923 - RNA, 19 nt, Mycobacterium avium subsp. paratuberculosis
gauggcgguccaccaccac

SEQ ID NO: 3028924 - RNA, 20 nt, Mycobacterium avium subsp. paratuberculosis
gauggcgguccaccaccaca

SEQ ID NO: 3028925 - RNA, 22 nt, Mycobacterium avium subsp. paratuberculosis
gauggcgguccaccaccacacc

SEQ ID NO: 3028926 - RNA, 19 nt, Mycobacterium avium subsp. paratuberculosis
gauggcggucgcgccagac

SEQ ID NO: 3028927 - RNA, 23 nt, Mycobacterium avium subsp. paratuberculosis
gauggcggucgcgccagacgucc

SEQ ID NO: 3028928 - RNA, 23 nt, Mycobacterium avium subsp. paratuberculosis
gauggcguagcgggucagcucca

SEQ ID NO: 3028929 - RNA, 14 nt, Mycobacterium avium subsp. paratuberculosis
gauggcgucgacgu

SEQ ID NO: 3028930 - RNA, 22 nt, Mycobacterium avium subsp. paratuberculosis
gauggcgucgacgugcgcggcg

SEQ ID NO: 3028931 - RNA, 17 nt, Mycobacterium avium subsp. paratuberculosis
gauggcuguggaugacg

SEQ ID NO: 3028932 - RNA, 13 nt, Mycobacterium avium subsp. paratuberculosis
gaugggcagcgcc

SEQ ID NO: 3028933 - RNA, 23 nt, Mycobacterium avium subsp. paratuberculosis
gaugggcauugcccaucgccacg

SEQ ID NO: 3028934 - RNA, 13 nt, Mycobacterium avium subsp. paratuberculosis
gaugggccgcccg

SEQ ID NO: 3028935 - RNA, 18 nt, Mycobacterium avium subsp. paratuberculosis
gaugggggugccgcagcg

SEQ ID NO: 3028936 - RNA, 20 nt, Mycobacterium avium subsp. paratuberculosis
gaugggggugccgcagcggc

SEQ ID NO: 3028937 - RNA, 14 nt, Mycobacterium avium subsp. paratuberculosis
gaugggucugcgcc

SEQ ID NO: 3028938 - RNA, 15 nt, Mycobacterium avium subsp. paratuberculosis
gaugggugcgguuga

SEQ ID NO: 3028939 - RNA, 18 nt, Mycobacterium avium subsp. paratuberculosis
gaugggugggcagcucgg

SEQ ID NO: 3028940 - RNA, 21 nt, Mycobacterium avium subsp. paratuberculosis
gaugggugggcagcucggugg

SEQ ID NO: 3028941 - RNA, 17 nt, Mycobacterium avium subsp. paratuberculosis
gauggguguggcgucga

SEQ ID NO: 3028942 - RNA, 12 nt, Mycobacterium avium subsp. paratuberculosis
gauggguguggu

SEQ ID NO: 3028943 - RNA, 14 nt, Mycobacterium avium subsp. paratuberculosis
gaugggugugguca

SEQ ID NO: 3028944 - RNA, 12 nt, Mycobacterium avium subsp. paratuberculosis
gauggguuggcc

SEQ ID NO: 3028945 - RNA, 16 nt, Mycobacterium avium subsp. paratuberculosis
gauggguuggccgucg

SEQ ID NO: 3028946 - RNA, 17 nt, Mycobacterium avium subsp. paratuberculosis
gauggguuggccgucgc

SEQ ID NO: 3028947 - RNA, 15 nt, Mycobacterium avium subsp. paratuberculosis
gauggucaccggggu

SEQ ID NO: 3028948 - RNA, 23 nt, Mycobacterium avium subsp. paratuberculosis
gauggucaccgugucggcgggcg

SEQ ID NO: 3028949 - RNA, 15 nt, Mycobacterium avium subsp. paratuberculosis
gauggucagccgcac

SEQ ID NO: 3028950 - RNA, 16 nt, Mycobacterium avium subsp. paratuberculosis
gauggucagcugccgc

SEQ ID NO: 3028951 - RNA, 15 nt, Mycobacterium avium subsp. paratuberculosis
gaugguccagcaccg

SEQ ID NO: 3028952 - RNA, 18 nt, Mycobacterium avium subsp. paratuberculosis
gaugguccagcaccggcg

SEQ ID NO: 3028953 - RNA, 19 nt, Mycobacterium avium subsp. paratuberculosis
gaugguccagcaccggcgc

SEQ ID NO: 3028954 - RNA, 16 nt, Mycobacterium avium subsp. paratuberculosis
gaugguccccgggccc

SEQ ID NO: 3028955 - RNA, 21 nt, Mycobacterium avium subsp. paratuberculosis
gaugguccccgggcccagcac

SEQ ID NO: 3028956 - RNA, 15 nt, Mycobacterium avium subsp. paratuberculosis
gauggucgcgccgcg

SEQ ID NO: 3028957 - RNA, 18 nt, Mycobacterium avium subsp. paratuberculosis
gauggucgcgccgcggcg

SEQ ID NO: 3028958 - RNA, 13 nt, Mycobacterium avium subsp. paratuberculosis
gauggucgucggg

SEQ ID NO: 3028959 - RNA, 16 nt, Mycobacterium avium subsp. paratuberculosis
gauggucgucguggug

SEQ ID NO: 3028960 - RNA, 17 nt, Mycobacterium avium subsp. paratuberculosis
gauggucgucgugguga

SEQ ID NO: 3028961 - RNA, 18 nt, Mycobacterium avium subsp. paratuberculosis
gauggucgucguggugac

SEQ ID NO: 3028962 - RNA, 17 nt, Mycobacterium avium subsp. paratuberculosis
gauggucucccgggcgg

SEQ ID NO: 3028963 - RNA, 19 nt, Mycobacterium avium subsp. paratuberculosis
gauggucucccgggcgguc

SEQ ID NO: 3028964 - RNA, 17 nt, Mycobacterium avium subsp. paratuberculosis
gauggucugcagcgacg

SEQ ID NO: 3028965 - RNA, 19 nt, Mycobacterium avium subsp. paratuberculosis
gauggucugcagcgacgga

SEQ ID NO: 3028966 - RNA, 14 nt, Mycobacterium avium subsp. paratuberculosis
gauggucugcccgc

SEQ ID NO: 3028967 - RNA, 22 nt, Mycobacterium avium subsp. paratuberculosis
gauggugaacuccgucucgccg

SEQ ID NO: 3028968 - RNA, 14 nt, Mycobacterium avium subsp. paratuberculosis
gauggugaagccgu

SEQ ID NO: 3028969 - RNA, 20 nt, Mycobacterium avium subsp. paratuberculosis
gauggugaagccgugcacgc

SEQ ID NO: 3028970 - RNA, 20 nt, Mycobacterium avium subsp. paratuberculosis
gauggugaccaaccacagcu

SEQ ID NO: 3028971 - RNA, 14 nt, Mycobacterium avium subsp. paratuberculosis
gauggugaccucgg

SEQ ID NO: 3028972 - RNA, 16 nt, Mycobacterium avium subsp. paratuberculosis
gauggugaccucgguc

SEQ ID NO: 3028973 - RNA, 19 nt, Mycobacterium avium subsp. paratuberculosis
gauggugacgauccggucg

SEQ ID NO: 3028974 - RNA, 17 nt, Mycobacterium avium subsp. paratuberculosis
gauggugacggccguga

SEQ ID NO: 3028975 - RNA, 16 nt, Mycobacterium avium subsp. paratuberculosis
gauggugaucgaccgg

SEQ ID NO: 3028976 - RNA, 18 nt, Mycobacterium avium subsp. paratuberculosis
gauggugaucgaccggac

SEQ ID NO: 3028977 - RNA, 19 nt, Mycobacterium avium subsp. paratuberculosis
gauggugaucucgccgcgg

SEQ ID NO: 3028978 - RNA, 22 nt, Mycobacterium avium subsp. paratuberculosis
gauggugaugugcggcgcggcg

SEQ ID NO: 3028979 - RNA, 15 nt, Mycobacterium avium subsp. paratuberculosis
gauggugcccaccgg

SEQ ID NO: 3028980 - RNA, 16 nt, Mycobacterium avium subsp. paratuberculosis
gauggugcccaccggg

SEQ ID NO: 3028981 - RNA, 19 nt, Mycobacterium avium subsp. paratuberculosis
gauggugcccaccgggcag

SEQ ID NO: 3028982 - RNA, 14 nt, Mycobacterium avium subsp. paratuberculosis
gauggugcccgggg

SEQ ID NO: 3028983 - RNA, 22 nt, Mycobacterium avium subsp. paratuberculosis
gauggugccgaagcgccgcaug

SEQ ID NO: 3028984 - RNA, 17 nt, Mycobacterium avium subsp. paratuberculosis
gauggugccgccgguga

SEQ ID NO: 3028985 - RNA, 15 nt, Mycobacterium avium subsp. paratuberculosis
gauggugccgucggc

SEQ ID NO: 3028986 - RNA, 23 nt, Mycobacterium avium subsp. paratuberculosis
gauggugcgccgggucgcggugg

SEQ ID NO: 3028987 - RNA, 17 nt, Mycobacterium avium subsp. paratuberculosis
gauggugcugcccggcg

SEQ ID NO: 3028988 - RNA, 13 nt, Mycobacterium avium subsp. paratuberculosis
gaugguggcgcgc

SEQ ID NO: 3028989 - RNA, 20 nt, Mycobacterium avium subsp. paratuberculosis
gaugguggcgcugccgagca

SEQ ID NO: 3028990 - RNA, 14 nt, Mycobacterium avium subsp. paratuberculosis
gaugguggcggcca

SEQ ID NO: 3028991 - RNA, 14 nt, Mycobacterium avium subsp. paratuberculosis
gauggugggcaccg

SEQ ID NO: 3028992 - RNA, 15 nt, Mycobacterium avium subsp. paratuberculosis
gauggugggcaccgc

SEQ ID NO: 3028993 - RNA, 16 nt, Mycobacterium avium subsp. paratuberculosis
gauggugguaccgacc

SEQ ID NO: 3028994 - RNA, 18 nt, Mycobacterium avium subsp. paratuberculosis
gaugguggucgccgucgu

SEQ ID NO: 3028995 - RNA, 18 nt, Mycobacterium avium subsp. paratuberculosis
gaugguggugcaggcgaa

SEQ ID NO: 3028996 - RNA, 19 nt, Mycobacterium avium subsp. paratuberculosis
gaugguguacacgucgcgg

SEQ ID NO: 3028997 - RNA, 22 nt, Mycobacterium avium subsp. paratuberculosis
gaugguguacacgucgcgggug

SEQ ID NO: 3028998 - RNA, 18 nt, Mycobacterium avium subsp. paratuberculosis
gaugguguaguccugcuu

SEQ ID NO: 3028999 - RNA, 14 nt, Mycobacterium avium subsp. paratuberculosis
gauggugugcagca

SEQ ID NO: 3029000 - RNA, 23 nt, Mycobacterium avium subsp. paratuberculosis
gaugguguggaucgcuucggcca

SEQ ID NO: 3029001 - RNA, 23 nt, Mycobacterium avium subsp. paratuberculosis
gaugguguugcucuggccgaucu

SEQ ID NO: 3029002 - RNA, 17 nt, Mycobacterium avium subsp. paratuberculosis
gaugguuuccacugcca

SEQ ID NO: 3029003 - RNA, 23 nt, Mycobacterium avium subsp. paratuberculosis
gauguacugggccgucgcccgga

SEQ ID NO: 3029004 - RNA, 16 nt, Mycobacterium avium subsp. paratuberculosis
gauguacuugaugacg

SEQ ID NO: 3029005 - RNA, 17 nt, Mycobacterium avium subsp. paratuberculosis
gauguagccgccggugg

SEQ ID NO: 3029006 - RNA, 14 nt, Mycobacterium avium subsp. paratuberculosis
gauguagcggcggu

SEQ ID NO: 3029007 - RNA, 15 nt, Mycobacterium avium subsp. paratuberculosis
gauguagcggcgguc

SEQ ID NO: 3029008 - RNA, 18 nt, Mycobacterium avium subsp. paratuberculosis
gauguagcggcggucggc

SEQ ID NO: 3029009 - RNA, 12 nt, Mycobacterium avium subsp. paratuberculosis
gauguaucagga

SEQ ID NO: 3029010 - RNA, 21 nt, Mycobacterium avium subsp. paratuberculosis
gaugucacccucgaggccgac

SEQ ID NO: 3029011 - RNA, 15 nt, Mycobacterium avium subsp. paratuberculosis
gaugucacguugaug

SEQ ID NO: 3029012 - RNA, 15 nt, Mycobacterium avium subsp. paratuberculosis
gauguccaggccguc

SEQ ID NO: 3029013 - RNA, 19 nt, Mycobacterium avium subsp. paratuberculosis
gauguccaggccgucgagg

SEQ ID NO: 3029014 - RNA, 21 nt, Mycobacterium avium subsp. paratuberculosis
gauguccaggccgucgaggcg

SEQ ID NO: 3029015 - RNA, 19 nt, Mycobacterium avium subsp. paratuberculosis
gaugucccauugcacaucc

SEQ ID NO: 3029016 - RNA, 15 nt, Mycobacterium avium subsp. paratuberculosis
gauguccccgcgggu

SEQ ID NO: 3029017 - RNA, 19 nt, Mycobacterium avium subsp. paratuberculosis
gauguccccgcgggugacg

SEQ ID NO: 3029018 - RNA, 21 nt, Mycobacterium avium subsp. paratuberculosis
gauguccccgcgggugacgcu

SEQ ID NO: 3029019 - RNA, 22 nt, Mycobacterium avium subsp. paratuberculosis
gauguccccgcgggugacgcug

SEQ ID NO: 3029020 - RNA, 15 nt, Mycobacterium avium subsp. paratuberculosis
gauguccgacagccc

SEQ ID NO: 3029021 - RNA, 16 nt, Mycobacterium avium subsp. paratuberculosis
gauguccgacagcccg

SEQ ID NO: 3029022 - RNA, 15 nt, Mycobacterium avium subsp. paratuberculosis
gauguccuacggcgg

SEQ ID NO: 3029023 - RNA, 13 nt, Mycobacterium avium subsp. paratuberculosis
gaugucgacccgc

SEQ ID NO: 3029024 - RNA, 15 nt, Mycobacterium avium subsp. paratuberculosis
gaugucgacccgcgg

SEQ ID NO: 3029025 - RNA, 21 nt, Mycobacterium avium subsp. paratuberculosis
gaugucgacccgcggcgccgc

SEQ ID NO: 3029026 - RNA, 23 nt, Mycobacterium avium subsp. paratuberculosis
gaugucgacccgcggcgccgcgg

SEQ ID NO: 3029027 - RNA, 17 nt, Mycobacterium avium subsp. paratuberculosis
gaugucgacgaugcgcu

SEQ ID NO: 3029028 - RNA, 20 nt, Mycobacterium avium subsp. paratuberculosis
gaugucgacgccgugcugcc

SEQ ID NO: 3029029 - RNA, 22 nt, Mycobacterium avium subsp. paratuberculosis
gaugucgacgucgucgacccgc

SEQ ID NO: 3029030 - RNA, 13 nt, Mycobacterium avium subsp. paratuberculosis
gaugucgaugacg

SEQ ID NO: 3029031 - RNA, 20 nt, Mycobacterium avium subsp. paratuberculosis
gaugucgaugacggcggcgc

SEQ ID NO: 3029032 - RNA, 14 nt, Mycobacterium avium subsp. paratuberculosis
gaugucgcccggcg

SEQ ID NO: 3029033 - RNA, 15 nt, Mycobacterium avium subsp. paratuberculosis
gaugucgcccggcgc

SEQ ID NO: 3029034 - RNA, 13 nt, Mycobacterium avium subsp. paratuberculosis
gaugucgccgacc

SEQ ID NO: 3029035 - RNA, 16 nt, Mycobacterium avium subsp. paratuberculosis
gaugucgccggcgacc

SEQ ID NO: 3029036 - RNA, 17 nt, Mycobacterium avium subsp. paratuberculosis
gaugucgccggcggcga

SEQ ID NO: 3029037 - RNA, 16 nt, Mycobacterium avium subsp. paratuberculosis
gaugucgcgcggcugc

SEQ ID NO: 3029038 - RNA, 20 nt, Mycobacterium avium subsp. paratuberculosis
gaugucgcgcggcugcucga

SEQ ID NO: 3029039 - RNA, 22 nt, Mycobacterium avium subsp. paratuberculosis
gaugucgcgcggcugcucgaac

SEQ ID NO: 3029040 - RNA, 18 nt, Mycobacterium avium subsp. paratuberculosis
gaugucgcggcgcacggu

SEQ ID NO: 3029041 - RNA, 20 nt, Mycobacterium avium subsp. paratuberculosis
gaugucgcggcgcacggugc

SEQ ID NO: 3029042 - RNA, 17 nt, Mycobacterium avium subsp. paratuberculosis
gaugucgcugccgccgc

SEQ ID NO: 3029043 - RNA, 24 nt, Mycobacterium avium subsp. paratuberculosis
gaugucgcugccgccgccggcggu

SEQ ID NO: 3029044 - RNA, 19 nt, Mycobacterium avium subsp. paratuberculosis
gaugucggccagcgcggcg

SEQ ID NO: 3029045 - RNA, 14 nt, Mycobacterium avium subsp. paratuberculosis
gaugucggccagga

SEQ ID NO: 3029046 - RNA, 17 nt, Mycobacterium avium subsp. paratuberculosis
gaugucggccaggaucg

SEQ ID NO: 3029047 - RNA, 13 nt, Mycobacterium avium subsp. paratuberculosis
gaugucggccggc

SEQ ID NO: 3029048 - RNA, 16 nt, Mycobacterium avium subsp. paratuberculosis
gaugucggccggcagu

SEQ ID NO: 3029049 - RNA, 13 nt, Mycobacterium avium subsp. paratuberculosis
gaugucggccggu

SEQ ID NO: 3029050 - RNA, 23 nt, Mycobacterium avium subsp. paratuberculosis
gaugucggccgguccgugcacgg

SEQ ID NO: 3029051 - RNA, 20 nt, Mycobacterium avium subsp. paratuberculosis
gaugucggcgaaccagggca

SEQ ID NO: 3029052 - RNA, 13 nt, Mycobacterium avium subsp. paratuberculosis
gaugucggcggcc

SEQ ID NO: 3029053 - RNA, 16 nt, Mycobacterium avium subsp. paratuberculosis
gaugucggcggcccgg

SEQ ID NO: 3029054 - RNA, 14 nt, Mycobacterium avium subsp. paratuberculosis
gaugucggcggccg

SEQ ID NO: 3029055 - RNA, 14 nt, Mycobacterium avium subsp. paratuberculosis
gaugucgggcgagg

SEQ ID NO: 3029056 - RNA, 18 nt, Mycobacterium avium subsp. paratuberculosis
gaugucggugcggccgca

SEQ ID NO: 3029057 - RNA, 19 nt, Mycobacterium avium subsp. paratuberculosis
gaugucgguggcgcgcagu

SEQ ID NO: 3029058 - RNA, 17 nt, Mycobacterium avium subsp. paratuberculosis
gaugucggugggccgca

SEQ ID NO: 3029059 - RNA, 15 nt, Mycobacterium avium subsp. paratuberculosis
gaugucggugguggg

SEQ ID NO: 3029060 - RNA, 20 nt, Mycobacterium avium subsp. paratuberculosis
gaugucggugugcagcagcu

SEQ ID NO: 3029061 - RNA, 17 nt, Mycobacterium avium subsp. paratuberculosis
gaugucguaggcgcggu

SEQ ID NO: 3029062 - RNA, 15 nt, Mycobacterium avium subsp. paratuberculosis
gaugucgucgccggu

SEQ ID NO: 3029063 - RNA, 16 nt, Mycobacterium avium subsp. paratuberculosis
gaugucgucgucgacg

SEQ ID NO: 3029064 - RNA, 18 nt, Mycobacterium avium subsp. paratuberculosis
gaugucuagccgccgagc

SEQ ID NO: 3029065 - RNA, 14 nt, Mycobacterium avium subsp. paratuberculosis
gaugucuccgcgca

SEQ ID NO: 3029066 - RNA, 18 nt, Mycobacterium avium subsp. paratuberculosis
gaugucugaucgcguagc

SEQ ID NO: 3029067 - RNA, 15 nt, Mycobacterium avium subsp. paratuberculosis
gaugugaucgcggcc

SEQ ID NO: 3029068 - RNA, 16 nt, Mycobacterium avium subsp. paratuberculosis
gaugugcggcgcggcg

SEQ ID NO: 3029069 - RNA, 13 nt, Mycobacterium avium subsp. paratuberculosis
gaugugcucgguc

SEQ ID NO: 3029070 - RNA, 21 nt, Mycobacterium avium subsp. paratuberculosis
gaugugcucggucaacccgau

SEQ ID NO: 3029071 - RNA, 16 nt, Mycobacterium avium subsp. paratuberculosis
gauguggaggcgagca

SEQ ID NO: 3029072 - RNA, 13 nt, Mycobacterium avium subsp. paratuberculosis
gauguggccggcg

SEQ ID NO: 3029073 - RNA, 20 nt, Mycobacterium avium subsp. paratuberculosis
gauguggcgggcguccugcg

SEQ ID NO: 3029074 - RNA, 16 nt, Mycobacterium avium subsp. paratuberculosis
gaugugggccgcagca

SEQ ID NO: 3029075 - RNA, 23 nt, Mycobacterium avium subsp. paratuberculosis
gaugugggccgcagcagcgaggc

SEQ ID NO: 3029076 - RNA, 14 nt, Mycobacterium avium subsp. paratuberculosis
gaugugggugguca

SEQ ID NO: 3029077 - RNA, 19 nt, Mycobacterium avium subsp. paratuberculosis
gauguucaccccggcgcgg

SEQ ID NO: 3029078 - RNA, 22 nt, Mycobacterium avium subsp. paratuberculosis
gauguucaguucguccagcccg

SEQ ID NO: 3029079 - RNA, 23 nt, Mycobacterium avium subsp. paratuberculosis
gauguucaguucguccagcccga

SEQ ID NO: 3029080 - RNA, 13 nt, Mycobacterium avium subsp. paratuberculosis
gauguucuccggc

SEQ ID NO: 3029081 - RNA, 17 nt, Mycobacterium avium subsp. paratuberculosis
gauguucuccggcccgg

SEQ ID NO: 3029082 - RNA, 20 nt, Mycobacterium avium subsp. paratuberculosis
gauguugaccacccgcagcg

SEQ ID NO: 3029083 - RNA, 16 nt, Mycobacterium avium subsp. paratuberculosis
gauguugaugucgcgc

SEQ ID NO: 3029084 - RNA, 15 nt, Mycobacterium avium subsp. paratuberculosis
gauguugccgccacu

SEQ ID NO: 3029085 - RNA, 13 nt, Mycobacterium avium subsp. paratuberculosis
gauguugcggccg

SEQ ID NO: 3029086 - RNA, 15 nt, Mycobacterium avium subsp. paratuberculosis
gauguugcggccggc

SEQ ID NO: 3029087 - RNA, 15 nt, Mycobacterium avium subsp. paratuberculosis
gauguugcggcggcc

SEQ ID NO: 3029088 - RNA, 16 nt, Mycobacterium avium subsp. paratuberculosis
gauguugcggcggccg

SEQ ID NO: 3029089 - RNA, 11 nt, Mycobacterium avium subsp. paratuberculosis
gauuacuccuc

SEQ ID NO: 3029090 - RNA, 17 nt, Mycobacterium avium subsp. paratuberculosis
gauuacucgccggcggc

SEQ ID NO: 3029091 - RNA, 23 nt, Mycobacterium avium subsp. paratuberculosis
gauuacucgccggcggcgccgga

SEQ ID NO: 3029092 - RNA, 18 nt, Mycobacterium avium subsp. paratuberculosis
gauucaaccccgcgcgcg

SEQ ID NO: 3029093 - RNA, 23 nt, Mycobacterium avium subsp. paratuberculosis
gauucaaccccgcgcgcgggcca

SEQ ID NO: 3029094 - RNA, 20 nt, Mycobacterium avium subsp. paratuberculosis
gauucacccagcgagcucag

SEQ ID NO: 3029095 - RNA, 17 nt, Mycobacterium avium subsp. paratuberculosis
gauucagccggcgggcg

SEQ ID NO: 3029096 - RNA, 22 nt, Mycobacterium avium subsp. paratuberculosis
gauucagccggcgggcgcucga

SEQ ID NO: 3029097 - RNA, 23 nt, Mycobacterium avium subsp. paratuberculosis
gauuccagcgcguagucggcguc

SEQ ID NO: 3029098 - RNA, 19 nt, Mycobacterium avium subsp. paratuberculosis
gauucccaugucgcgggcg

SEQ ID NO: 3029099 - RNA, 23 nt, Mycobacterium avium subsp. paratuberculosis
gauucccgaccccgccagcaccg

SEQ ID NO: 3029100 - RNA, 12 nt, Mycobacterium avium subsp. paratuberculosis
gauucccgccgg

SEQ ID NO: 3029101 - RNA, 14 nt, Mycobacterium avium subsp. paratuberculosis
gauuccgccgggcg

SEQ ID NO: 3029102 - RNA, 15 nt, Mycobacterium avium subsp. paratuberculosis
gauuccgccgggcgg

SEQ ID NO: 3029103 - RNA, 20 nt, Mycobacterium avium subsp. paratuberculosis
gauuccgcgucuugcgccga

SEQ ID NO: 3029104 - RNA, 21 nt, Mycobacterium avium subsp. paratuberculosis
gauuccggcacccgccagccc

SEQ ID NO: 3029105 - RNA, 13 nt, Mycobacterium avium subsp. paratuberculosis
gauuccggcaucg

SEQ ID NO: 3029106 - RNA, 14 nt, Mycobacterium avium subsp. paratuberculosis
gauuccggccggcc

SEQ ID NO: 3029107 - RNA, 17 nt, Mycobacterium avium subsp. paratuberculosis
gauuccggccggccgcc

SEQ ID NO: 3029108 - RNA, 23 nt, Mycobacterium avium subsp. paratuberculosis
gauuccggccggccgccggcggc

SEQ ID NO: 3029109 - RNA, 15 nt, Mycobacterium avium subsp. paratuberculosis
gauuccgucggcggc

SEQ ID NO: 3029110 - RNA, 20 nt, Mycobacterium avium subsp. paratuberculosis
gauuccgucggcggccgacc

SEQ ID NO: 3029111 - RNA, 16 nt, Mycobacterium avium subsp. paratuberculosis
gauucgaggucaucga

SEQ ID NO: 3029112 - RNA, 22 nt, Mycobacterium avium subsp. paratuberculosis
gauucgaucaaaucccgcagcu

SEQ ID NO: 3029113 - RNA, 23 nt, Mycobacterium avium subsp. paratuberculosis
gauucgaucaaaucccgcagcuc

SEQ ID NO: 3029114 - RNA, 17 nt, Mycobacterium avium subsp. paratuberculosis
gauucgcgcggcgccca

SEQ ID NO: 3029115 - RNA, 14 nt, Mycobacterium avium subsp. paratuberculosis
gauucgcggcggcg

SEQ ID NO: 3029116 - RNA, 15 nt, Mycobacterium avium subsp. paratuberculosis
gauucgcggcggcgc

SEQ ID NO: 3029117 - RNA, 13 nt, Mycobacterium avium subsp. paratuberculosis
gauucggcgccgc

SEQ ID NO: 3029118 - RNA, 14 nt, Mycobacterium avium subsp. paratuberculosis
gauucggcgccgcg

SEQ ID NO: 3029119 - RNA, 15 nt, Mycobacterium avium subsp. paratuberculosis
gauucggcgccgcga

SEQ ID NO: 3029120 - RNA, 22 nt, Mycobacterium avium subsp. paratuberculosis
gauucggcuccugccguucggc

SEQ ID NO: 3029121 - RNA, 21 nt, Mycobacterium avium subsp. paratuberculosis
gauucggguggcgucgccgcc

SEQ ID NO: 3029122 - RNA, 19 nt, Mycobacterium avium subsp. paratuberculosis
gauucggguuucgcgggcu

SEQ ID NO: 3029123 - RNA, 16 nt, Mycobacterium avium subsp. paratuberculosis
gauucgguaccagggc

SEQ ID NO: 3029124 - RNA, 16 nt, Mycobacterium avium subsp. paratuberculosis
gauucgucggucaccc

SEQ ID NO: 3029125 - RNA, 19 nt, Mycobacterium avium subsp. paratuberculosis
gauucgucggucacccggu

SEQ ID NO: 3029126 - RNA, 21 nt, Mycobacterium avium subsp. paratuberculosis
gauucguucgugagcgguggc

SEQ ID NO: 3029127 - RNA, 18 nt, Mycobacterium avium subsp. paratuberculosis
gauucucgcugcggcgca

SEQ ID NO: 3029128 - RNA, 22 nt, Mycobacterium avium subsp. paratuberculosis
gauucugguucagccguucuag

SEQ ID NO: 3029129 - RNA, 17 nt, Mycobacterium avium subsp. paratuberculosis
gauucuguugccggaca

SEQ ID NO: 3029130 - RNA, 21 nt, Mycobacterium avium subsp. paratuberculosis
gauugcccuuggacaccugca

SEQ ID NO: 3029131 - RNA, 17 nt, Mycobacterium avium subsp. paratuberculosis
gauugccgggcaccagc

SEQ ID NO: 3029132 - RNA, 21 nt, Mycobacterium avium subsp. paratuberculosis
gauugccgggcaccagcgaca

SEQ ID NO: 3029133 - RNA, 15 nt, Mycobacterium avium subsp. paratuberculosis
gauugcgcggcgccg

SEQ ID NO: 3029134 - RNA, 20 nt, Mycobacterium avium subsp. paratuberculosis
gauugcgcggcgccggaugg

SEQ ID NO: 3029135 - RNA, 18 nt, Mycobacterium avium subsp. paratuberculosis
gauugcggccgccggcca

SEQ ID NO: 3029136 - RNA, 22 nt, Mycobacterium avium subsp. paratuberculosis
gauugcggccgccggccagcuc

SEQ ID NO: 3029137 - RNA, 16 nt, Mycobacterium avium subsp. paratuberculosis
gauuggaagagggcca

SEQ ID NO: 3029138 - RNA, 20 nt, Mycobacterium avium subsp. paratuberculosis
gauuggauuuaucucggcga

SEQ ID NO: 3029139 - RNA, 19 nt, Mycobacterium avium subsp. paratuberculosis
gauuggcgccacugccgcc

SEQ ID NO: 3029140 - RNA, 23 nt, Mycobacterium avium subsp. paratuberculosis
gauuggcgccacugccgccgccc

SEQ ID NO: 3029141 - RNA, 20 nt, Mycobacterium avium subsp. paratuberculosis
gauuggcgucgguggcggcg

SEQ ID NO: 3029142 - RNA, 21 nt, Mycobacterium avium subsp. paratuberculosis
gauuggcgucgguggcggcgg

SEQ ID NO: 3029143 - RNA, 17 nt, Mycobacterium avium subsp. paratuberculosis
gauuggucgggcacagc

SEQ ID NO: 3029144 - RNA, 14 nt, Mycobacterium avium subsp. paratuberculosis
gauugucggccgcc

SEQ ID NO: 3029145 - RNA, 21 nt, Mycobacterium avium subsp. paratuberculosis
gauugucggccgcccguccgg

SEQ ID NO: 3029146 - RNA, 16 nt, Mycobacterium avium subsp. paratuberculosis
gauuucacgucugcuc

SEQ ID NO: 3029147 - RNA, 22 nt, Mycobacterium avium subsp. paratuberculosis
gauuuccgguugcggcagcaca

SEQ ID NO: 3029148 - RNA, 17 nt, Mycobacterium avium subsp. paratuberculosis
gauuucgccagugccgc

SEQ ID NO: 3029149 - RNA, 21 nt, Mycobacterium avium subsp. paratuberculosis
gauuucgccagugccgcgcgg

SEQ ID NO: 3029150 - RNA, 12 nt, Mycobacterium avium subsp. paratuberculosis
gauuucgccugc

SEQ ID NO: 3029151 - RNA, 23 nt, Mycobacterium avium subsp. paratuberculosis
gauuucgcuguagagcaguucga

SEQ ID NO: 3029152 - RNA, 14 nt, Mycobacterium avium subsp. paratuberculosis
gauuucggccagcc

SEQ ID NO: 3029153 - RNA, 17 nt, Mycobacterium avium subsp. paratuberculosis
gauuucggccagccggg

SEQ ID NO: 3029154 - RNA, 19 nt, Mycobacterium avium subsp. paratuberculosis
gauuugaaauucaccucgc

SEQ ID NO: 3029155 - RNA, 18 nt, Mycobacterium avium subsp. paratuberculosis
gauuuggccgucaucucc

SEQ ID NO: 3029156 - RNA, 20 nt, Mycobacterium avium subsp. paratuberculosis
gauuuuuuggggcggggcgu

SEQ ID NO: 3029157 - RNA, 16 nt, Mycobacterium avium subsp. paratuberculosis
gcaaaaccccgccguu

SEQ ID NO: 3029158 - RNA, 15 nt, Mycobacterium avium subsp. paratuberculosis
gcaaaacgcugggcg

SEQ ID NO: 3029159 - RNA, 19 nt, Mycobacterium avium subsp. paratuberculosis
gcaaaacggugcggccucg

SEQ ID NO: 3029160 - RNA, 20 nt, Mycobacterium avium subsp. paratuberculosis
gcaaaacggugcggccucga

SEQ ID NO: 3029161 - RNA, 16 nt, Mycobacterium avium subsp. paratuberculosis
gcaaaauagcugcgac

SEQ ID NO: 3029162 - RNA, 21 nt, Mycobacterium avium subsp. paratuberculosis
gcaaacccagcaccaacagcg

SEQ ID NO: 3029163 - RNA, 16 nt, Mycobacterium avium subsp. paratuberculosis
gcaaaccgaccgccgc

SEQ ID NO: 3029164 - RNA, 19 nt, Mycobacterium avium subsp. paratuberculosis
gcaaaccgaccgccgcggc

SEQ ID NO: 3029165 - RNA, 20 nt, Mycobacterium avium subsp. paratuberculosis
gcaaaccggaccgccgcggc

SEQ ID NO: 3029166 - RNA, 20 nt, Mycobacterium avium subsp. paratuberculosis
gcaaacgaaucgagccgccu

SEQ ID NO: 3029167 - RNA, 23 nt, Mycobacterium avium subsp. paratuberculosis
gcaaacgaaucgagccgccugcg

SEQ ID NO: 3029168 - RNA, 15 nt, Mycobacterium avium subsp. paratuberculosis
gcaaagacgacggcu

SEQ ID NO: 3029169 - RNA, 19 nt, Mycobacterium avium subsp. paratuberculosis
gcaaagaucaaggaaccgg

SEQ ID NO: 3029170 - RNA, 20 nt, Mycobacterium avium subsp. paratuberculosis
gcaaagaucaaggaaccggc

SEQ ID NO: 3029171 - RNA, 16 nt, Mycobacterium avium subsp. paratuberculosis
gcaaagaucggugccu

SEQ ID NO: 3029172 - RNA, 14 nt, Mycobacterium avium subsp. paratuberculosis
gcaaagcaccgcga

SEQ ID NO: 3029173 - RNA, 15 nt, Mycobacterium avium subsp. paratuberculosis
gcaaaguuugggagu

SEQ ID NO: 3029174 - RNA, 19 nt, Mycobacterium avium subsp. paratuberculosis
gcaacacagccaaucgccg

SEQ ID NO: 3029175 - RNA, 23 nt, Mycobacterium avium subsp. paratuberculosis
gcaacacagccaaucgccgauga

SEQ ID NO: 3029176 - RNA, 18 nt, Mycobacterium avium subsp. paratuberculosis
gcaacacaugguccugca

SEQ ID NO: 3029177 - RNA, 20 nt, Mycobacterium avium subsp. paratuberculosis
gcaacacaugguccugcacc

SEQ ID NO: 3029178 - RNA, 21 nt, Mycobacterium avium subsp. paratuberculosis
gcaacaccaccuugguggccg

SEQ ID NO: 3029179 - RNA, 21 nt, Mycobacterium avium subsp. paratuberculosis
gcaacaccagggugcgcagcg

SEQ ID NO: 3029180 - RNA, 16 nt, Mycobacterium avium subsp. paratuberculosis
gcaacaccgaaagccg

SEQ ID NO: 3029181 - RNA, 22 nt, Mycobacterium avium subsp. paratuberculosis
gcaacaccgaaagccgacaccu

SEQ ID NO: 3029182 - RNA, 20 nt, Mycobacterium avium subsp. paratuberculosis
gcaacaccggauuucgccag

SEQ ID NO: 3029183 - RNA, 22 nt, Mycobacterium avium subsp. paratuberculosis
gcaacaccggauuucgccagug

SEQ ID NO: 3029184 - RNA, 15 nt, Mycobacterium avium subsp. paratuberculosis
gcaacaccggcggcg

SEQ ID NO: 3029185 - RNA, 16 nt, Mycobacterium avium subsp. paratuberculosis
gcaacaccucggcgac

SEQ ID NO: 3029186 - RNA, 17 nt, Mycobacterium avium subsp. paratuberculosis
gcaacaccucggcgacg

SEQ ID NO: 3029187 - RNA, 20 nt, Mycobacterium avium subsp. paratuberculosis
gcaacaccuuucggccgcgg

SEQ ID NO: 3029188 - RNA, 14 nt, Mycobacterium avium subsp. paratuberculosis
gcaacacgaccagg

SEQ ID NO: 3029189 - RNA, 14 nt, Mycobacterium avium subsp. paratuberculosis
gcaacacgccggcg

SEQ ID NO: 3029190 - RNA, 17 nt, Mycobacterium avium subsp. paratuberculosis
gcaacacgccggcggcc

SEQ ID NO: 3029191 - RNA, 15 nt, Mycobacterium avium subsp. paratuberculosis
gcaacacggccucga

SEQ ID NO: 3029192 - RNA, 18 nt, Mycobacterium avium subsp. paratuberculosis
gcaacacgucguccggcg

SEQ ID NO: 3029193 - RNA, 21 nt, Mycobacterium avium subsp. paratuberculosis
gcaacacguugagucccucgg

SEQ ID NO: 3029194 - RNA, 14 nt, Mycobacterium avium subsp. paratuberculosis
gcaacacucgagcg

SEQ ID NO: 3029195 - RNA, 17 nt, Mycobacterium avium subsp. paratuberculosis
gcaacacucgagcgcgc

SEQ ID NO: 3029196 - RNA, 14 nt, Mycobacterium avium subsp. paratuberculosis
gcaacagcaccagc

SEQ ID NO: 3029197 - RNA, 16 nt, Mycobacterium avium subsp. paratuberculosis
gcaacagcaccagcac

SEQ ID NO: 3029198 - RNA, 19 nt, Mycobacterium avium subsp. paratuberculosis
gcaacagcaccagcaccac

SEQ ID NO: 3029199 - RNA, 21 nt, Mycobacterium avium subsp. paratuberculosis
gcaacagcaccagcaccaccg

SEQ ID NO: 3029200 - RNA, 17 nt, Mycobacterium avium subsp. paratuberculosis
gcaacagcagcggcaug

SEQ ID NO: 3029201 - RNA, 20 nt, Mycobacterium avium subsp. paratuberculosis
gcaacagcauuucgcgcggc

SEQ ID NO: 3029202 - RNA, 15 nt, Mycobacterium avium subsp. paratuberculosis
gcaacagcccgaccg

SEQ ID NO: 3029203 - RNA, 15 nt, Mycobacterium avium subsp. paratuberculosis
gcaacagccggcccg

SEQ ID NO: 3029204 - RNA, 16 nt, Mycobacterium avium subsp. paratuberculosis
gcaacagccggcccga

SEQ ID NO: 3029205 - RNA, 18 nt, Mycobacterium avium subsp. paratuberculosis
gcaacagccggcccgagc

SEQ ID NO: 3029206 - RNA, 15 nt, Mycobacterium avium subsp. paratuberculosis
gcaacagcgagucgg

SEQ ID NO: 3029207 - RNA, 16 nt, Mycobacterium avium subsp. paratuberculosis
gcaacagcgagucggu

SEQ ID NO: 3029208 - RNA, 12 nt, Mycobacterium avium subsp. paratuberculosis
gcaacagcgcgc

SEQ ID NO: 3029209 - RNA, 16 nt, Mycobacterium avium subsp. paratuberculosis
gcaacagcgcgccggc

SEQ ID NO: 3029210 - RNA, 20 nt, Mycobacterium avium subsp. paratuberculosis
gcaacagcgcgccggccggc

SEQ ID NO: 3029211 - RNA, 15 nt, Mycobacterium avium subsp. paratuberculosis
gcaacagcgucucga

SEQ ID NO: 3029212 - RNA, 19 nt, Mycobacterium avium subsp. paratuberculosis
gcaacagcgucucgacggc

SEQ ID NO: 3029213 - RNA, 19 nt, Mycobacterium avium subsp. paratuberculosis
gcaacagcgugcacacccg

SEQ ID NO: 3029214 - RNA, 14 nt, Mycobacterium avium subsp. paratuberculosis
gcaacagggccacc

SEQ ID NO: 3029215 - RNA, 21 nt, Mycobacterium avium subsp. paratuberculosis
gcaacauccugguccggcgcc

SEQ ID NO: 3029216 - RNA, 23 nt, Mycobacterium avium subsp. paratuberculosis
gcaacauccugguccggcgcccg

SEQ ID NO: 3029217 - RNA, 19 nt, Mycobacterium avium subsp. paratuberculosis
gcaacaugauuccgccggg

SEQ ID NO: 3029218 - RNA, 20 nt, Mycobacterium avium subsp. paratuberculosis
gcaacaugauuccgccgggc

SEQ ID NO: 3029219 - RNA, 22 nt, Mycobacterium avium subsp. paratuberculosis
gcaaccaaaaagcuagcgggag

SEQ ID NO: 3029220 - RNA, 14 nt, Mycobacterium avium subsp. paratuberculosis
gcaaccaacucgcg

SEQ ID NO: 3029221 - RNA, 22 nt, Mycobacterium avium subsp. paratuberculosis
gcaaccacuuucgcgagcgcgc

SEQ ID NO: 3029222 - RNA, 15 nt, Mycobacterium avium subsp. paratuberculosis
gcaaccccgcggugc

SEQ ID NO: 3029223 - RNA, 16 nt, Mycobacterium avium subsp. paratuberculosis
gcaacccgaaagcccc

SEQ ID NO: 3029224 - RNA, 18 nt, Mycobacterium avium subsp. paratuberculosis
gcaacccgaaagccccca

SEQ ID NO: 3029225 - RNA, 19 nt, Mycobacterium avium subsp. paratuberculosis
gcaacccgaaagcccccag

SEQ ID NO: 3029226 - RNA, 22 nt, Mycobacterium avium subsp. paratuberculosis
gcaacccgaaagcccccagcuc

SEQ ID NO: 3029227 - RNA, 23 nt, Mycobacterium avium subsp. paratuberculosis
gcaacccgaccucgucgacggcg

SEQ ID NO: 3029228 - RNA, 15 nt, Mycobacterium avium subsp. paratuberculosis
gcaacccgaucgccg

SEQ ID NO: 3029229 - RNA, 15 nt, Mycobacterium avium subsp. paratuberculosis
gcaacccgccgagcg

SEQ ID NO: 3029230 - RNA, 19 nt, Mycobacterium avium subsp. paratuberculosis
gcaacccgccgagcgugaa

SEQ ID NO: 3029231 - RNA, 15 nt, Mycobacterium avium subsp. paratuberculosis
gcaacccggugcccg

SEQ ID NO: 3029232 - RNA, 19 nt, Mycobacterium avium subsp. paratuberculosis
gcaaccgccacgacgcggc

SEQ ID NO: 3029233 - RNA, 20 nt, Mycobacterium avium subsp. paratuberculosis
gcaaccgccacgacgcggcg

SEQ ID NO: 3029234 - RNA, 12 nt, Mycobacterium avium subsp. paratuberculosis
gcaaccgccggc

SEQ ID NO: 3029235 - RNA, 13 nt, Mycobacterium avium subsp. paratuberculosis
gcaaccgccggca

SEQ ID NO: 3029236 - RNA, 20 nt, Mycobacterium avium subsp. paratuberculosis
gcaaccgccggcagcggcug

SEQ ID NO: 3029237 - RNA, 21 nt, Mycobacterium avium subsp. paratuberculosis
gcaaccgccggcagcggcugc

SEQ ID NO: 3029238 - RNA, 12 nt, Mycobacterium avium subsp. paratuberculosis
gcaaccgccgug

SEQ ID NO: 3029239 - RNA, 22 nt, Mycobacterium avium subsp. paratuberculosis
gcaaccgcgaaaacagcgacca

SEQ ID NO: 3029240 - RNA, 15 nt, Mycobacterium avium subsp. paratuberculosis
gcaaccgcggcggcg

SEQ ID NO: 3029241 - RNA, 20 nt, Mycobacterium avium subsp. paratuberculosis
gcaaccgcggcggcggcccg

SEQ ID NO: 3029242 - RNA, 20 nt, Mycobacterium avium subsp. paratuberculosis
gcaaccggaauggcagcagc

SEQ ID NO: 3029243 - RNA, 13 nt, Mycobacterium avium subsp. paratuberculosis
gcaaccggcggcu

SEQ ID NO: 3029244 - RNA, 16 nt, Mycobacterium avium subsp. paratuberculosis
gcaaccggcggcuggg

SEQ ID NO: 3029245 - RNA, 20 nt, Mycobacterium avium subsp. paratuberculosis
gcaaccggcggcugggcagc

SEQ ID NO: 3029246 - RNA, 23 nt, Mycobacterium avium subsp. paratuberculosis
gcaaccggcggcugggcagccgc

SEQ ID NO: 3029247 - RNA, 22 nt, Mycobacterium avium subsp. paratuberculosis
gcaaccgggauaccgcgaccgc

SEQ ID NO: 3029248 - RNA, 15 nt, Mycobacterium avium subsp. paratuberculosis
gcaaccgggccgcac

SEQ ID NO: 3029249 - RNA, 19 nt, Mycobacterium avium subsp. paratuberculosis
gcaaccgggccgcaccccc

SEQ ID NO: 3029250 - RNA, 21 nt, Mycobacterium avium subsp. paratuberculosis
gcaaccgggccgcacccccuc

SEQ ID NO: 3029251 - RNA, 19 nt, Mycobacterium avium subsp. paratuberculosis
gcaaccgguccaguccggc

SEQ ID NO: 3029252 - RNA, 16 nt, Mycobacterium avium subsp. paratuberculosis
gcaaccgguccgccgu

SEQ ID NO: 3029253 - RNA, 17 nt, Mycobacterium avium subsp. paratuberculosis
gcaaccgguccgccguc

SEQ ID NO: 3029254 - RNA, 18 nt, Mycobacterium avium subsp. paratuberculosis
gcaaccgguccgccgucg

SEQ ID NO: 3029255 - RNA, 18 nt, Mycobacterium avium subsp. paratuberculosis
gcaaccgguucggacacg

SEQ ID NO: 3029256 - RNA, 19 nt, Mycobacterium avium subsp. paratuberculosis
gcaaccgucuuggcuggca

SEQ ID NO: 3029257 - RNA, 16 nt, Mycobacterium avium subsp. paratuberculosis
gcaaccguucaacggc

SEQ ID NO: 3029258 - RNA, 22 nt, Mycobacterium avium subsp. paratuberculosis
gcaaccucuucggggguggcca

SEQ ID NO: 3029259 - RNA, 15 nt, Mycobacterium avium subsp. paratuberculosis
gcaaccugggcggcg

SEQ ID NO: 3029260 - RNA, 16 nt, Mycobacterium avium subsp. paratuberculosis
gcaaccugggcggcgg

SEQ ID NO: 3029261 - RNA, 17 nt, Mycobacterium avium subsp. paratuberculosis
gcaaccugggcggcggc

SEQ ID NO: 3029262 - RNA, 15 nt, Mycobacterium avium subsp. paratuberculosis
gcaacgacauccaga

SEQ ID NO: 3029263 - RNA, 16 nt, Mycobacterium avium subsp. paratuberculosis
gcaacgacauccagau

SEQ ID NO: 3029264 - RNA, 13 nt, Mycobacterium avium subsp. paratuberculosis
gcaacgacccggc

SEQ ID NO: 3029265 - RNA, 16 nt, Mycobacterium avium subsp. paratuberculosis
gcaacgacccggccac

SEQ ID NO: 3029266 - RNA, 22 nt, Mycobacterium avium subsp. paratuberculosis
gcaacgacccggccaccgccgc

SEQ ID NO: 3029267 - RNA, 17 nt, Mycobacterium avium subsp. paratuberculosis
gcaacgaggccagggcc

SEQ ID NO: 3029268 - RNA, 21 nt, Mycobacterium avium subsp. paratuberculosis
gcaacgaggccagggcccgca

SEQ ID NO: 3029269 - RNA, 15 nt, Mycobacterium avium subsp. paratuberculosis
gcaacgaggcggugg

SEQ ID NO: 3029270 - RNA, 17 nt, Mycobacterium avium subsp. paratuberculosis
gcaacgauucacccagc

SEQ ID NO: 3029271 - RNA, 22 nt, Mycobacterium avium subsp. paratuberculosis
gcaacgauucacccagcgagcu

SEQ ID NO: 3029272 - RNA, 17 nt, Mycobacterium avium subsp. paratuberculosis
gcaacgcacgggcggcg

SEQ ID NO: 3029273 - RNA, 19 nt, Mycobacterium avium subsp. paratuberculosis
gcaacgcacgggcggcggg

SEQ ID NO: 3029274 - RNA, 14 nt, Mycobacterium avium subsp. paratuberculosis
gcaacgccagcgcg

SEQ ID NO: 3029275 - RNA, 17 nt, Mycobacterium avium subsp. paratuberculosis
gcaacgccagcgcgacc

SEQ ID NO: 3029276 - RNA, 20 nt, Mycobacterium avium subsp. paratuberculosis
gcaacgccagcgcgacccgc

SEQ ID NO: 3029277 - RNA, 17 nt, Mycobacterium avium subsp. paratuberculosis
gcaacgccgccgacagc

SEQ ID NO: 3029278 - RNA, 14 nt, Mycobacterium avium subsp. paratuberculosis
gcaacgccggcgug

SEQ ID NO: 3029279 - RNA, 14 nt, Mycobacterium avium subsp. paratuberculosis
gcaacgcgauucgg

SEQ ID NO: 3029280 - RNA, 15 nt, Mycobacterium avium subsp. paratuberculosis
gcaacgcgccggcgg

SEQ ID NO: 3029281 - RNA, 18 nt, Mycobacterium avium subsp. paratuberculosis
gcaacgcgcgcgacggcg

SEQ ID NO: 3029282 - RNA, 11 nt, Mycobacterium avium subsp. paratuberculosis
gcaacgcggcg

SEQ ID NO: 3029283 - RNA, 13 nt, Mycobacterium avium subsp. paratuberculosis
gcaacgcggcggu

SEQ ID NO: 3029284 - RNA, 20 nt, Mycobacterium avium subsp. paratuberculosis
gcaacgcgguguuggcggcg

SEQ ID NO: 3029285 - RNA, 15 nt, Mycobacterium avium subsp. paratuberculosis
gcaacgcgucggcgc

SEQ ID NO: 3029286 - RNA, 17 nt, Mycobacterium avium subsp. paratuberculosis
gcaacgcgucggcgccg

SEQ ID NO: 3029287 - RNA, 22 nt, Mycobacterium avium subsp. paratuberculosis
gcaacgcgucggcgccggaucg

SEQ ID NO: 3029288 - RNA, 20 nt, Mycobacterium avium subsp. paratuberculosis
gcaacggauuggucagagcc

SEQ ID NO: 3029289 - RNA, 13 nt, Mycobacterium avium subsp. paratuberculosis
gcaacggcggcgg

SEQ ID NO: 3029290 - RNA, 13 nt, Mycobacterium avium subsp. paratuberculosis
gcaacggcggucg

SEQ ID NO: 3029291 - RNA, 15 nt, Mycobacterium avium subsp. paratuberculosis
gcaacggcggucgug

SEQ ID NO: 3029292 - RNA, 17 nt, Mycobacterium avium subsp. paratuberculosis
gcaacggcggucgugcg

SEQ ID NO: 3029293 - RNA, 18 nt, Mycobacterium avium subsp. paratuberculosis
gcaacggcggucgugcgg

SEQ ID NO: 3029294 - RNA, 22 nt, Mycobacterium avium subsp. paratuberculosis
gcaacggcggucgugcggcugc

SEQ ID NO: 3029295 - RNA, 15 nt, Mycobacterium avium subsp. paratuberculosis
gcaacggcgucgaca

SEQ ID NO: 3029296 - RNA, 19 nt, Mycobacterium avium subsp. paratuberculosis
gcaacggcgucgacacccg

SEQ ID NO: 3029297 - RNA, 18 nt, Mycobacterium avium subsp. paratuberculosis
gcaacggcuggcgcaggu

SEQ ID NO: 3029298 - RNA, 15 nt, Mycobacterium avium subsp. paratuberculosis
gcaacgggccgcagc

SEQ ID NO: 3029299 - RNA, 14 nt, Mycobacterium avium subsp. paratuberculosis
gcaacgugcgccgg

SEQ ID NO: 3029300 - RNA, 15 nt, Mycobacterium avium subsp. paratuberculosis
gcaacgugcgccggc

SEQ ID NO: 3029301 - RNA, 17 nt, Mycobacterium avium subsp. paratuberculosis
gcaacguguacucggcg

SEQ ID NO: 3029302 - RNA, 18 nt, Mycobacterium avium subsp. paratuberculosis
gcaacguguacucggcgu

SEQ ID NO: 3029303 - RNA, 16 nt, Mycobacterium avium subsp. paratuberculosis
gcaacuagcgacggcc

SEQ ID NO: 3029304 - RNA, 17 nt, Mycobacterium avium subsp. paratuberculosis
gcaacuagcgacggccg

SEQ ID NO: 3029305 - RNA, 16 nt, Mycobacterium avium subsp. paratuberculosis
gcaacucaguccucgc

SEQ ID NO: 3029306 - RNA, 19 nt, Mycobacterium avium subsp. paratuberculosis
gcaacuccacaaccagcga

SEQ ID NO: 3029307 - RNA, 13 nt, Mycobacterium avium subsp. paratuberculosis
gcaacucccgcgc

SEQ ID NO: 3029308 - RNA, 14 nt, Mycobacterium avium subsp. paratuberculosis
gcaacucccgcgcc

SEQ ID NO: 3029309 - RNA, 15 nt, Mycobacterium avium subsp. paratuberculosis
gcaacucccgcgccg

SEQ ID NO: 3029310 - RNA, 16 nt, Mycobacterium avium subsp. paratuberculosis
gcaacucccgcgccgc

SEQ ID NO: 3029311 - RNA, 17 nt, Mycobacterium avium subsp. paratuberculosis
gcaacucccgcgccgcg

SEQ ID NO: 3029312 - RNA, 18 nt, Mycobacterium avium subsp. paratuberculosis
gcaacucccgcgccgcgg

SEQ ID NO: 3029313 - RNA, 13 nt, Mycobacterium avium subsp. paratuberculosis
gcaacucgcgcuc

SEQ ID NO: 3029314 - RNA, 18 nt, Mycobacterium avium subsp. paratuberculosis
gcaacucguccaccagcu

SEQ ID NO: 3029315 - RNA, 17 nt, Mycobacterium avium subsp. paratuberculosis
gcaacucguccagcguc

SEQ ID NO: 3029316 - RNA, 19 nt, Mycobacterium avium subsp. paratuberculosis
gcaacucguccagcgucgc

SEQ ID NO: 3029317 - RNA, 21 nt, Mycobacterium avium subsp. paratuberculosis
gcaacugcucgaccagccccc

SEQ ID NO: 3029318 - RNA, 16 nt, Mycobacterium avium subsp. paratuberculosis
gcaacuggcaacgcgu

SEQ ID NO: 3029319 - RNA, 16 nt, Mycobacterium avium subsp. paratuberculosis
gcaacugggcggccug

SEQ ID NO: 3029320 - RNA, 18 nt, Mycobacterium avium subsp. paratuberculosis
gcaacugggcggccugca

SEQ ID NO: 3029321 - RNA, 20 nt, Mycobacterium avium subsp. paratuberculosis
gcaacugggcggccugcacc

SEQ ID NO: 3029322 - RNA, 17 nt, Mycobacterium avium subsp. paratuberculosis
gcaacuguucgcggcug

SEQ ID NO: 3029323 - RNA, 21 nt, Mycobacterium avium subsp. paratuberculosis
gcaacuguucgcggcuggccg

SEQ ID NO: 3029324 - RNA, 18 nt, Mycobacterium avium subsp. paratuberculosis
gcaacuugcccgacggcg

SEQ ID NO: 3029325 - RNA, 22 nt, Mycobacterium avium subsp. paratuberculosis
gcaagaugugggcgucgucgau

SEQ ID NO: 3029326 - RNA, 13 nt, Mycobacterium avium subsp. paratuberculosis
gcaagcaccggcu

SEQ ID NO: 3029327 - RNA, 14 nt, Mycobacterium avium subsp. paratuberculosis
gcaagcaccggcug

SEQ ID NO: 3029328 - RNA, 18 nt, Mycobacterium avium subsp. paratuberculosis
gcaagcaccggcuggccg

SEQ ID NO: 3029329 - RNA, 15 nt, Mycobacterium avium subsp. paratuberculosis
gcaagcagagcagcg

SEQ ID NO: 3029330 - RNA, 18 nt, Mycobacterium avium subsp. paratuberculosis
gcaagcagagcagcgaga

SEQ ID NO: 3029331 - RNA, 16 nt, Mycobacterium avium subsp. paratuberculosis
gcaagcagcggcagcc

SEQ ID NO: 3029332 - RNA, 22 nt, Mycobacterium avium subsp. paratuberculosis
gcaagcagcggcagccacggca

SEQ ID NO: 3029333 - RNA, 20 nt, Mycobacterium avium subsp. paratuberculosis
gcaagcccuuuggcggccag

SEQ ID NO: 3029334 - RNA, 19 nt, Mycobacterium avium subsp. paratuberculosis
gcaagcgaagccgugaccc

SEQ ID NO: 3029335 - RNA, 15 nt, Mycobacterium avium subsp. paratuberculosis
gcaagcucgccagga

SEQ ID NO: 3029336 - RNA, 16 nt, Mycobacterium avium subsp. paratuberculosis
gcaaggccagcaaccg

SEQ ID NO: 3029337 - RNA, 18 nt, Mycobacterium avium subsp. paratuberculosis
gcaaggcccccgccucgc

SEQ ID NO: 3029338 - RNA, 12 nt, Mycobacterium avium subsp. paratuberculosis
gcaaggccgcca

SEQ ID NO: 3029339 - RNA, 14 nt, Mycobacterium avium subsp. paratuberculosis
gcaaggccugcgcc

SEQ ID NO: 3029340 - RNA, 19 nt, Mycobacterium avium subsp. paratuberculosis
gcaaggccugcgccuuggc

SEQ ID NO: 3029341 - RNA, 19 nt, Mycobacterium avium subsp. paratuberculosis
gcaaggcgagcacggcacg

SEQ ID NO: 3029342 - RNA, 23 nt, Mycobacterium avium subsp. paratuberculosis
gcaagggcuugggcgcgaucggc

SEQ ID NO: 3029343 - RNA, 13 nt, Mycobacterium avium subsp. paratuberculosis
gcaaggucgucgc

SEQ ID NO: 3029344 - RNA, 14 nt, Mycobacterium avium subsp. paratuberculosis
gcaaggucgucgcg

SEQ ID NO: 3029345 - RNA, 15 nt, Mycobacterium avium subsp. paratuberculosis
gcaaggucgucgcgg

SEQ ID NO: 3029346 - RNA, 13 nt, Mycobacterium avium subsp. paratuberculosis
gcaaggugauucg

SEQ ID NO: 3029347 - RNA, 19 nt, Mycobacterium avium subsp. paratuberculosis
gcaaggugccguccggguc

SEQ ID NO: 3029348 - RNA, 14 nt, Mycobacterium avium subsp. paratuberculosis
gcaagucggcggug

SEQ ID NO: 3029349 - RNA, 13 nt, Mycobacterium avium subsp. paratuberculosis
gcaauacaccgcg

SEQ ID NO: 3029350 - RNA, 18 nt, Mycobacterium avium subsp. paratuberculosis
gcaauacccgaccagcac

SEQ ID NO: 3029351 - RNA, 20 nt, Mycobacterium avium subsp. paratuberculosis
gcaauacccgaccagcaccg

SEQ ID NO: 3029352 - RNA, 13 nt, Mycobacterium avium subsp. paratuberculosis
gcaauaccggcag

SEQ ID NO: 3029353 - RNA, 18 nt, Mycobacterium avium subsp. paratuberculosis
gcaauaccggcagcaggu

SEQ ID NO: 3029354 - RNA, 22 nt, Mycobacterium avium subsp. paratuberculosis
gcaauaccggcagcaggugcac

SEQ ID NO: 3029355 - RNA, 18 nt, Mycobacterium avium subsp. paratuberculosis
gcaauacggugcccgccg

SEQ ID NO: 3029356 - RNA, 23 nt, Mycobacterium avium subsp. paratuberculosis
gcaauacggugcccgccgcgacc

SEQ ID NO: 3029357 - RNA, 16 nt, Mycobacterium avium subsp. paratuberculosis
gcaaucaggcggucga

SEQ ID NO: 3029358 - RNA, 20 nt, Mycobacterium avium subsp. paratuberculosis
gcaauccgcugaacgggcag

SEQ ID NO: 3029359 - RNA, 21 nt, Mycobacterium avium subsp. paratuberculosis
gcaauccgcugaacgggcagc

SEQ ID NO: 3029360 - RNA, 19 nt, Mycobacterium avium subsp. paratuberculosis
gcaauccuguuccccggcg

SEQ ID NO: 3029361 - RNA, 21 nt, Mycobacterium avium subsp. paratuberculosis
gcaaucgcugcgcccgccgcc

SEQ ID NO: 3029362 - RNA, 18 nt, Mycobacterium avium subsp. paratuberculosis
gcaaucggacccagcccg

SEQ ID NO: 3029363 - RNA, 16 nt, Mycobacterium avium subsp. paratuberculosis
gcaaucgggacgccac

SEQ ID NO: 3029364 - RNA, 15 nt, Mycobacterium avium subsp. paratuberculosis
gcaaugaugucggcg

SEQ ID NO: 3029365 - RNA, 15 nt, Mycobacterium avium subsp. paratuberculosis
gcaaugccgccgcga

SEQ ID NO: 3029366 - RNA, 17 nt, Mycobacterium avium subsp. paratuberculosis
gcaaugcgucgcggcgg

SEQ ID NO: 3029367 - RNA, 18 nt, Mycobacterium avium subsp. paratuberculosis
gcaaugcgucgcggcggc

SEQ ID NO: 3029368 - RNA, 13 nt, Mycobacterium avium subsp. paratuberculosis
gcaauggccgcga

SEQ ID NO: 3029369 - RNA, 16 nt, Mycobacterium avium subsp. paratuberculosis
gcaaugguugcggcgg

SEQ ID NO: 3029370 - RNA, 20 nt, Mycobacterium avium subsp. paratuberculosis
gcaaugguugcggcgggccg

SEQ ID NO: 3029371 - RNA, 15 nt, Mycobacterium avium subsp. paratuberculosis
gcaauugacgccgac

SEQ ID NO: 3029372 - RNA, 15 nt, Mycobacterium avium subsp. paratuberculosis
gcaauugcgccagca

SEQ ID NO: 3029373 - RNA, 17 nt, Mycobacterium avium subsp. paratuberculosis
gcaauugcgccagcagc

SEQ ID NO: 3029374 - RNA, 18 nt, Mycobacterium avium subsp. paratuberculosis
gcaauugcgccagcagca

SEQ ID NO: 3029375 - RNA, 21 nt, Mycobacterium avium subsp. paratuberculosis
gcacaaaagggcccaugccgc

SEQ ID NO: 3029376 - RNA, 22 nt, Mycobacterium avium subsp. paratuberculosis
gcacaaaagggcccaugccgcc

SEQ ID NO: 3029377 - RNA, 19 nt, Mycobacterium avium subsp. paratuberculosis
gcacaacagccaugccggu

SEQ ID NO: 3029378 - RNA, 21 nt, Mycobacterium avium subsp. paratuberculosis
gcacaacagccaugccggugg

SEQ ID NO: 3029379 - RNA, 22 nt, Mycobacterium avium subsp. paratuberculosis
gcacaacagccaugccggugga

SEQ ID NO: 3029380 - RNA, 15 nt, Mycobacterium avium subsp. paratuberculosis
gcacaacccgcccgg

SEQ ID NO: 3029381 - RNA, 23 nt, Mycobacterium avium subsp. paratuberculosis
gcacaacccgcccgggucgucgg

SEQ ID NO: 3029382 - RNA, 19 nt, Mycobacterium avium subsp. paratuberculosis
gcacaacccggacagcgcg

SEQ ID NO: 3029383 - RNA, 18 nt, Mycobacterium avium subsp. paratuberculosis
gcacaaccgggccaacgg

SEQ ID NO: 3029384 - RNA, 13 nt, Mycobacterium avium subsp. paratuberculosis
gcacaacgccucc

SEQ ID NO: 3029385 - RNA, 15 nt, Mycobacterium avium subsp. paratuberculosis
gcacaauucggucag

SEQ ID NO: 3029386 - RNA, 17 nt, Mycobacterium avium subsp. paratuberculosis
gcacaauucggucagcg

SEQ ID NO: 3029387 - RNA, 19 nt, Mycobacterium avium subsp. paratuberculosis
gcacaauucggucagcgcg

SEQ ID NO: 3029388 - RNA, 18 nt, Mycobacterium avium subsp. paratuberculosis
gcacacacaggucgcccg

SEQ ID NO: 3029389 - RNA, 20 nt, Mycobacterium avium subsp. paratuberculosis
gcacacacaggucgcccggc

SEQ ID NO: 3029390 - RNA, 13 nt, Mycobacterium avium subsp. paratuberculosis
gcacacagcagca

SEQ ID NO: 3029391 - RNA, 18 nt, Mycobacterium avium subsp. paratuberculosis
gcacacagcagcagcacc

SEQ ID NO: 3029392 - RNA, 20 nt, Mycobacterium avium subsp. paratuberculosis
gcacacagcagcagcaccag

SEQ ID NO: 3029393 - RNA, 11 nt, Mycobacterium avium subsp. paratuberculosis
gcacaccacca

SEQ ID NO: 3029394 - RNA, 14 nt, Mycobacterium avium subsp. paratuberculosis
gcacaccaccacgu

SEQ ID NO: 3029395 - RNA, 16 nt, Mycobacterium avium subsp. paratuberculosis
gcacaccaccagcgag

SEQ ID NO: 3029396 - RNA, 18 nt, Mycobacterium avium subsp. paratuberculosis
gcacaccagcacggcggc

SEQ ID NO: 3029397 - RNA, 19 nt, Mycobacterium avium subsp. paratuberculosis
gcacaccagcacggcggcg

SEQ ID NO: 3029398 - RNA, 19 nt, Mycobacterium avium subsp. paratuberculosis
gcacaccagcguucgucgc

SEQ ID NO: 3029399 - RNA, 20 nt, Mycobacterium avium subsp. paratuberculosis
gcacaccagcguucgucgcc

SEQ ID NO: 3029400 - RNA, 21 nt, Mycobacterium avium subsp. paratuberculosis
gcacaccagguaggcgguggc

SEQ ID NO: 3029401 - RNA, 22 nt, Mycobacterium avium subsp. paratuberculosis
gcacaccagguaggcgguggcg

SEQ ID NO: 3029402 - RNA, 16 nt, Mycobacterium avium subsp. paratuberculosis
gcacacccagcgagcc

SEQ ID NO: 3029403 - RNA, 18 nt, Mycobacterium avium subsp. paratuberculosis
gcacacccgcagcgaccg

SEQ ID NO: 3029404 - RNA, 19 nt, Mycobacterium avium subsp. paratuberculosis
gcacacccgcagcgaccgc

SEQ ID NO: 3029405 - RNA, 12 nt, Mycobacterium avium subsp. paratuberculosis
gcacacccggug

SEQ ID NO: 3029406 - RNA, 13 nt, Mycobacterium avium subsp. paratuberculosis
gcacacccggugc

SEQ ID NO: 3029407 - RNA, 16 nt, Mycobacterium avium subsp. paratuberculosis
gcacacccggugcgcc

SEQ ID NO: 3029408 - RNA, 17 nt, Mycobacterium avium subsp. paratuberculosis
gcacacccggugcgccg

SEQ ID NO: 3029409 - RNA, 19 nt, Mycobacterium avium subsp. paratuberculosis
gcacacccggugcgccggu

SEQ ID NO: 3029410 - RNA, 22 nt, Mycobacterium avium subsp. paratuberculosis
gcacacccucaccccgcccagc

SEQ ID NO: 3029411 - RNA, 16 nt, Mycobacterium avium subsp. paratuberculosis
gcacacccucgacccg

SEQ ID NO: 3029412 - RNA, 17 nt, Mycobacterium avium subsp. paratuberculosis
gcacacccucgacccgu

SEQ ID NO: 3029413 - RNA, 23 nt, Mycobacterium avium subsp. paratuberculosis
gcacacccucgacccguuccggc

SEQ ID NO: 3029414 - RNA, 23 nt, Mycobacterium avium subsp. paratuberculosis
gcacacccuuuuccaucugggcg

SEQ ID NO: 3029415 - RNA, 14 nt, Mycobacterium avium subsp. paratuberculosis
gcacaccgagcgag

SEQ ID NO: 3029416 - RNA, 14 nt, Mycobacterium avium subsp. paratuberculosis
gcacaccgcgcaga

SEQ ID NO: 3029417 - RNA, 19 nt, Mycobacterium avium subsp. paratuberculosis
gcacaccgcgcagaaccgc

SEQ ID NO: 3029418 - RNA, 12 nt, Mycobacterium avium subsp. paratuberculosis
gcacaccgcgcg

SEQ ID NO: 3029419 - RNA, 16 nt, Mycobacterium avium subsp. paratuberculosis
gcacaccgcgcgcagg

SEQ ID NO: 3029420 - RNA, 18 nt, Mycobacterium avium subsp. paratuberculosis
gcacaccgcgcgcaggcc

SEQ ID NO: 3029421 - RNA, 19 nt, Mycobacterium avium subsp. paratuberculosis
gcacaccgcgcgcaggccc

SEQ ID NO: 3029422 - RNA, 14 nt, Mycobacterium avium subsp. paratuberculosis
gcacaccgcggcgg

SEQ ID NO: 3029423 - RNA, 20 nt, Mycobacterium avium subsp. paratuberculosis
gcacaccgcggcggcgucgg

SEQ ID NO: 3029424 - RNA, 19 nt, Mycobacterium avium subsp. paratuberculosis
gcacaccggaucggcugcg

SEQ ID NO: 3029425 - RNA, 23 nt, Mycobacterium avium subsp. paratuberculosis
gcacaccggaucggcugcgggcc

SEQ ID NO: 3029426 - RNA, 12 nt, Mycobacterium avium subsp. paratuberculosis
gcacaccggcca

SEQ ID NO: 3029427 - RNA, 14 nt, Mycobacterium avium subsp. paratuberculosis
gcacaccggccuuc

SEQ ID NO: 3029428 - RNA, 17 nt, Mycobacterium avium subsp. paratuberculosis
gcacaccggccuucacc

SEQ ID NO: 3029429 - RNA, 18 nt, Mycobacterium avium subsp. paratuberculosis
gcacaccggccuucacca

SEQ ID NO: 3029430 - RNA, 16 nt, Mycobacterium avium subsp. paratuberculosis
gcacaccggugcucuc

SEQ ID NO: 3029431 - RNA, 17 nt, Mycobacterium avium subsp. paratuberculosis
gcacaccgucgcccgcc

SEQ ID NO: 3029432 - RNA, 15 nt, Mycobacterium avium subsp. paratuberculosis
gcacaccgucgucca

SEQ ID NO: 3029433 - RNA, 22 nt, Mycobacterium avium subsp. paratuberculosis
gcacaccgucguccacgcccag

SEQ ID NO: 3029434 - RNA, 16 nt, Mycobacterium avium subsp. paratuberculosis
gcacaccgucucccac

SEQ ID NO: 3029435 - RNA, 20 nt, Mycobacterium avium subsp. paratuberculosis
gcacaccguucccaccggcu

SEQ ID NO: 3029436 - RNA, 15 nt, Mycobacterium avium subsp. paratuberculosis
gcacaccuuccacca

SEQ ID NO: 3029437 - RNA, 20 nt, Mycobacterium avium subsp. paratuberculosis
gcacaccuuccaccaccgcg

SEQ ID NO: 3029438 - RNA, 21 nt, Mycobacterium avium subsp. paratuberculosis
gcacaccuuccaccaccgcgg

SEQ ID NO: 3029439 - RNA, 16 nt, Mycobacterium avium subsp. paratuberculosis
gcacacgaacaccggc

SEQ ID NO: 3029440 - RNA, 19 nt, Mycobacterium avium subsp. paratuberculosis
gcacacgaacaccggcgga

SEQ ID NO: 3029441 - RNA, 20 nt, Mycobacterium avium subsp. paratuberculosis
gcacacgaucucguaggugg

SEQ ID NO: 3029442 - RNA, 23 nt, Mycobacterium avium subsp. paratuberculosis
gcacacgaucucguagguggcca

SEQ ID NO: 3029443 - RNA, 23 nt, Mycobacterium avium subsp. paratuberculosis
gcacacgcgguccacuuccgcgc

SEQ ID NO: 3029444 - RNA, 15 nt, Mycobacterium avium subsp. paratuberculosis
gcacacggccucgcc

SEQ ID NO: 3029445 - RNA, 22 nt, Mycobacterium avium subsp. paratuberculosis
gcacacggccucgcccagcgcc

SEQ ID NO: 3029446 - RNA, 22 nt, Mycobacterium avium subsp. paratuberculosis
gcacacggccuugccgaucagc

SEQ ID NO: 3029447 - RNA, 15 nt, Mycobacterium avium subsp. paratuberculosis
gcacacgggcccguc

SEQ ID NO: 3029448 - RNA, 22 nt, Mycobacterium avium subsp. paratuberculosis
gcacacgggcccguccgcgaau

SEQ ID NO: 3029449 - RNA, 15 nt, Mycobacterium avium subsp. paratuberculosis
gcacacuuccgggaa

SEQ ID NO: 3029450 - RNA, 17 nt, Mycobacterium avium subsp. paratuberculosis
gcacagaucgucucggc

SEQ ID NO: 3029451 - RNA, 23 nt, Mycobacterium avium subsp. paratuberculosis
gcacagcaccaguugcaccggca

SEQ ID NO: 3029452 - RNA, 16 nt, Mycobacterium avium subsp. paratuberculosis
gcacagcacggcaucg

SEQ ID NO: 3029453 - RNA, 20 nt, Mycobacterium avium subsp. paratuberculosis
gcacagcacggcaucgaugg

SEQ ID NO: 3029454 - RNA, 22 nt, Mycobacterium avium subsp. paratuberculosis
gcacagcacggcaucgauggcg

SEQ ID NO: 3029455 - RNA, 23 nt, Mycobacterium avium subsp. paratuberculosis
gcacagcagggcaccgacggccg

SEQ ID NO: 3029456 - RNA, 21 nt, Mycobacterium avium subsp. paratuberculosis
gcacagcauguccucggggug

SEQ ID NO: 3029457 - RNA, 19 nt, Mycobacterium avium subsp. paratuberculosis
gcacagccagcgcccggcg

SEQ ID NO: 3029458 - RNA, 23 nt, Mycobacterium avium subsp. paratuberculosis
gcacagccagcgcccggcgacca

SEQ ID NO: 3029459 - RNA, 13 nt, Mycobacterium avium subsp. paratuberculosis
gcacagccgcagc

SEQ ID NO: 3029460 - RNA, 17 nt, Mycobacterium avium subsp. paratuberculosis
gcacagccgcagcagcc

SEQ ID NO: 3029461 - RNA, 18 nt, Mycobacterium avium subsp. paratuberculosis
gcacagccggcgcgcggu

SEQ ID NO: 3029462 - RNA, 23 nt, Mycobacterium avium subsp. paratuberculosis
gcacagcgaggcgacgucgaacg

SEQ ID NO: 3029463 - RNA, 16 nt, Mycobacterium avium subsp. paratuberculosis
gcacagcgccacaccg

SEQ ID NO: 3029464 - RNA, 15 nt, Mycobacterium avium subsp. paratuberculosis
gcacagcgccgcguu

SEQ ID NO: 3029465 - RNA, 11 nt, Mycobacterium avium subsp. paratuberculosis
gcacagcggcg

SEQ ID NO: 3029466 - RNA, 22 nt, Mycobacterium avium subsp. paratuberculosis
gcacagcguuauccaccagguu

SEQ ID NO: 3029467 - RNA, 19 nt, Mycobacterium avium subsp. paratuberculosis
gcacagcuaggucguggcg

SEQ ID NO: 3029468 - RNA, 20 nt, Mycobacterium avium subsp. paratuberculosis
gcacagcuaggucguggcgc

SEQ ID NO: 3029469 - RNA, 22 nt, Mycobacterium avium subsp. paratuberculosis
gcacagcuaggucguggcgccg

SEQ ID NO: 3029470 - RNA, 16 nt, Mycobacterium avium subsp. paratuberculosis
gcacagcuucggcgcc

SEQ ID NO: 3029471 - RNA, 17 nt, Mycobacterium avium subsp. paratuberculosis
gcacagcuucggcgccg

SEQ ID NO: 3029472 - RNA, 20 nt, Mycobacterium avium subsp. paratuberculosis
gcacagcuucggcgccgagc

SEQ ID NO: 3029473 - RNA, 21 nt, Mycobacterium avium subsp. paratuberculosis
gcacagcuucggcgccgagca

SEQ ID NO: 3029474 - RNA, 16 nt, Mycobacterium avium subsp. paratuberculosis
gcacagcuuucgggcg

SEQ ID NO: 3029475 - RNA, 19 nt, Mycobacterium avium subsp. paratuberculosis
gcacagcuuucgggcggcc

SEQ ID NO: 3029476 - RNA, 21 nt, Mycobacterium avium subsp. paratuberculosis
gcacagcuuucgggcggccug

SEQ ID NO: 3029477 - RNA, 22 nt, Mycobacterium avium subsp. paratuberculosis
gcacagcuuucgggcggccugc

SEQ ID NO: 3029478 - RNA, 16 nt, Mycobacterium avium subsp. paratuberculosis
gcacaggaacgcgacg

SEQ ID NO: 3029479 - RNA, 17 nt, Mycobacterium avium subsp. paratuberculosis
gcacaggaacgcgucga

SEQ ID NO: 3029480 - RNA, 19 nt, Mycobacterium avium subsp. paratuberculosis
gcacaggaugcccaacagc

SEQ ID NO: 3029481 - RNA, 13 nt, Mycobacterium avium subsp. paratuberculosis
gcacaggggcgcg

SEQ ID NO: 3029482 - RNA, 14 nt, Mycobacterium avium subsp. paratuberculosis
gcacaggggcgcgu

SEQ ID NO: 3029483 - RNA, 14 nt, Mycobacterium avium subsp. paratuberculosis
gcacaggucgaugg

SEQ ID NO: 3029484 - RNA, 23 nt, Mycobacterium avium subsp. paratuberculosis
gcacagugcgucgcccaucacca

SEQ ID NO: 3029485 - RNA, 15 nt, Mycobacterium avium subsp. paratuberculosis
gcacauagcgcagcu

SEQ ID NO: 3029486 - RNA, 13 nt, Mycobacterium avium subsp. paratuberculosis
gcacauagcucag

SEQ ID NO: 3029487 - RNA, 22 nt, Mycobacterium avium subsp. paratuberculosis
gcacauagcucaggugcgacgc

SEQ ID NO: 3029488 - RNA, 14 nt, Mycobacterium avium subsp. paratuberculosis
gcacaucacggugg

SEQ ID NO: 3029489 - RNA, 23 nt, Mycobacterium avium subsp. paratuberculosis
gcacaucacgguggccgccacca

SEQ ID NO: 3029490 - RNA, 17 nt, Mycobacterium avium subsp. paratuberculosis
gcacaucguggcgacga

SEQ ID NO: 3029491 - RNA, 21 nt, Mycobacterium avium subsp. paratuberculosis
gcacaucguggcgacgacgcc

SEQ ID NO: 3029492 - RNA, 15 nt, Mycobacterium avium subsp. paratuberculosis
gcacaugcccgucgg

SEQ ID NO: 3029493 - RNA, 15 nt, Mycobacterium avium subsp. paratuberculosis
gcaccaacacgucga

SEQ ID NO: 3029494 - RNA, 18 nt, Mycobacterium avium subsp. paratuberculosis
gcaccaacacgucgaguu

SEQ ID NO: 3029495 - RNA, 18 nt, Mycobacterium avium subsp. paratuberculosis
gcaccaacagcggcccga

SEQ ID NO: 3029496 - RNA, 19 nt, Mycobacterium avium subsp. paratuberculosis
gcaccaacagcggcccgau

SEQ ID NO: 3029497 - RNA, 16 nt, Mycobacterium avium subsp. paratuberculosis
gcaccaacccgaucgg

SEQ ID NO: 3029498 - RNA, 17 nt, Mycobacterium avium subsp. paratuberculosis
gcaccaacccgaucggc

SEQ ID NO: 3029499 - RNA, 16 nt, Mycobacterium avium subsp. paratuberculosis
gcaccaaccggccccg

SEQ ID NO: 3029500 - RNA, 18 nt, Mycobacterium avium subsp. paratuberculosis
gcaccaaccggccccgag

SEQ ID NO: 3029501 - RNA, 21 nt, Mycobacterium avium subsp. paratuberculosis
gcaccaaccggccccgagcgu

SEQ ID NO: 3029502 - RNA, 22 nt, Mycobacterium avium subsp. paratuberculosis
gcaccaaccggccccgagcguc

SEQ ID NO: 3029503 - RNA, 22 nt, Mycobacterium avium subsp. paratuberculosis
gcaccacaucggauucgucggu

SEQ ID NO: 3029504 - RNA, 23 nt, Mycobacterium avium subsp. paratuberculosis
gcaccacaucgguugcuccggcg

SEQ ID NO: 3029505 - RNA, 14 nt, Mycobacterium avium subsp. paratuberculosis
gcaccaccaacagc

SEQ ID NO: 3029506 - RNA, 18 nt, Mycobacterium avium subsp. paratuberculosis
gcaccaccaacagcagcg

SEQ ID NO: 3029507 - RNA, 17 nt, Mycobacterium avium subsp. paratuberculosis
gcaccaccacacccagc

SEQ ID NO: 3029508 - RNA, 22 nt, Mycobacterium avium subsp. paratuberculosis
gcaccaccacacccagcgccag

SEQ ID NO: 3029509 - RNA, 15 nt, Mycobacterium avium subsp. paratuberculosis
gcaccaccacccccg

SEQ ID NO: 3029510 - RNA, 18 nt, Mycobacterium avium subsp. paratuberculosis
gcaccaccacccccgacc

SEQ ID NO: 3029511 - RNA, 17 nt, Mycobacterium avium subsp. paratuberculosis
gcaccaccaccgacacc

SEQ ID NO: 3029512 - RNA, 16 nt, Mycobacterium avium subsp. paratuberculosis
gcaccaccacgcuggc

SEQ ID NO: 3029513 - RNA, 17 nt, Mycobacterium avium subsp. paratuberculosis
gcaccaccacgcuggcc

SEQ ID NO: 3029514 - RNA, 18 nt, Mycobacterium avium subsp. paratuberculosis
gcaccaccacgguggcgc

SEQ ID NO: 3029515 - RNA, 13 nt, Mycobacterium avium subsp. paratuberculosis
gcaccaccagcgu

SEQ ID NO: 3029516 - RNA, 14 nt, Mycobacterium avium subsp. paratuberculosis
gcaccaccagcgug

SEQ ID NO: 3029517 - RNA, 22 nt, Mycobacterium avium subsp. paratuberculosis
gcaccaccagcucgucgccgac

SEQ ID NO: 3029518 - RNA, 22 nt, Mycobacterium avium subsp. paratuberculosis
gcaccaccaggucuccgucggc

SEQ ID NO: 3029519 - RNA, 14 nt, Mycobacterium avium subsp. paratuberculosis
gcaccacccagccc

SEQ ID NO: 3029520 - RNA, 15 nt, Mycobacterium avium subsp. paratuberculosis
gcaccacccagcccu

SEQ ID NO: 3029521 - RNA, 13 nt, Mycobacterium avium subsp. paratuberculosis
gcaccacccaggc

SEQ ID NO: 3029522 - RNA, 21 nt, Mycobacterium avium subsp. paratuberculosis
gcaccacccaggccacccggg

SEQ ID NO: 3029523 - RNA, 18 nt, Mycobacterium avium subsp. paratuberculosis
gcaccacccgcaccucgc

SEQ ID NO: 3029524 - RNA, 14 nt, Mycobacterium avium subsp. paratuberculosis
gcaccacccgcggc

SEQ ID NO: 3029525 - RNA, 15 nt, Mycobacterium avium subsp. paratuberculosis
gcaccacccgcggcc

SEQ ID NO: 3029526 - RNA, 18 nt, Mycobacterium avium subsp. paratuberculosis
gcaccacccgcggccggc

SEQ ID NO: 3029527 - RNA, 19 nt, Mycobacterium avium subsp. paratuberculosis
gcaccacccgcggccggcc

SEQ ID NO: 3029528 - RNA, 19 nt, Mycobacterium avium subsp. paratuberculosis
gcaccacccggucgaugug

SEQ ID NO: 3029529 - RNA, 14 nt, Mycobacterium avium subsp. paratuberculosis
gcaccaccgcccgg

SEQ ID NO: 3029530 - RNA, 15 nt, Mycobacterium avium subsp. paratuberculosis
gcaccaccgcccgga

SEQ ID NO: 3029531 - RNA, 17 nt, Mycobacterium avium subsp. paratuberculosis
gcaccaccgcccggacc

SEQ ID NO: 3029532 - RNA, 18 nt, Mycobacterium avium subsp. paratuberculosis
gcaccaccgcccggaccg

SEQ ID NO: 3029533 - RNA, 19 nt, Mycobacterium avium subsp. paratuberculosis
gcaccaccgcccggaccgg

SEQ ID NO: 3029534 - RNA, 14 nt, Mycobacterium avium subsp. paratuberculosis
gcaccaccgcgagc

SEQ ID NO: 3029535 - RNA, 16 nt, Mycobacterium avium subsp. paratuberculosis
gcaccaccgcgagcgg

SEQ ID NO: 3029536 - RNA, 14 nt, Mycobacterium avium subsp. paratuberculosis
gcaccaccgcggug

SEQ ID NO: 3029537 - RNA, 15 nt, Mycobacterium avium subsp. paratuberculosis
gcaccaccgcgguga

SEQ ID NO: 3029538 - RNA, 22 nt, Mycobacterium avium subsp. paratuberculosis
gcaccaccgcggugagcggccg

SEQ ID NO: 3029539 - RNA, 14 nt, Mycobacterium avium subsp. paratuberculosis
gcaccaccgcguug

SEQ ID NO: 3029540 - RNA, 19 nt, Mycobacterium avium subsp. paratuberculosis
gcaccaccgucaccgccgc

SEQ ID NO: 3029541 - RNA, 23 nt, Mycobacterium avium subsp. paratuberculosis
gcaccaccgucaccgccgcaccg

SEQ ID NO: 3029542 - RNA, 14 nt, Mycobacterium avium subsp. paratuberculosis
gcaccaccgugccg

SEQ ID NO: 3029543 - RNA, 14 nt, Mycobacterium avium subsp. paratuberculosis
gcaccaccguggcg

SEQ ID NO: 3029544 - RNA, 15 nt, Mycobacterium avium subsp. paratuberculosis
gcaccaccucgcgcg

SEQ ID NO: 3029545 - RNA, 23 nt, Mycobacterium avium subsp. paratuberculosis
gcaccaccucgcgcggggcggcc

SEQ ID NO: 3029546 - RNA, 15 nt, Mycobacterium avium subsp. paratuberculosis
gcaccaccucggcga

SEQ ID NO: 3029547 - RNA, 16 nt, Mycobacterium avium subsp. paratuberculosis
gcaccaccucggcgau

SEQ ID NO: 3029548 - RNA, 18 nt, Mycobacterium avium subsp. paratuberculosis
gcaccaccuugucaccga

SEQ ID NO: 3029549 - RNA, 18 nt, Mycobacterium avium subsp. paratuberculosis
gcaccacgaacgcugcca

SEQ ID NO: 3029550 - RNA, 17 nt, Mycobacterium avium subsp. paratuberculosis
gcaccacgaagcgggcg

SEQ ID NO: 3029551 - RNA, 18 nt, Mycobacterium avium subsp. paratuberculosis
gcaccacgaagcgggcgg

SEQ ID NO: 3029552 - RNA, 19 nt, Mycobacterium avium subsp. paratuberculosis
gcaccacgaagcgggcggc

SEQ ID NO: 3029553 - RNA, 14 nt, Mycobacterium avium subsp. paratuberculosis
gcaccacgacgucg

SEQ ID NO: 3029554 - RNA, 16 nt, Mycobacterium avium subsp. paratuberculosis
gcaccacgacgucgag

SEQ ID NO: 3029555 - RNA, 22 nt, Mycobacterium avium subsp. paratuberculosis
gcaccacgacgucgagccagcg

SEQ ID NO: 3029556 - RNA, 21 nt, Mycobacterium avium subsp. paratuberculosis
gcaccacgaggcugugggcca

SEQ ID NO: 3029557 - RNA, 17 nt, Mycobacterium avium subsp. paratuberculosis
gcaccacgaucaccaga

SEQ ID NO: 3029558 - RNA, 20 nt, Mycobacterium avium subsp. paratuberculosis
gcaccacgaucaccagaccg

SEQ ID NO: 3029559 - RNA, 20 nt, Mycobacterium avium subsp. paratuberculosis
gcaccacgaugaagccgugc

SEQ ID NO: 3029560 - RNA, 23 nt, Mycobacterium avium subsp. paratuberculosis
gcaccacgaugaagccgugcccg

SEQ ID NO: 3029561 - RNA, 17 nt, Mycobacterium avium subsp. paratuberculosis
gcaccacgcccgacgac

SEQ ID NO: 3029562 - RNA, 12 nt, Mycobacterium avium subsp. paratuberculosis
gcaccacgccga

SEQ ID NO: 3029563 - RNA, 13 nt, Mycobacterium avium subsp. paratuberculosis
gcaccacgccgac

SEQ ID NO: 3029564 - RNA, 23 nt, Mycobacterium avium subsp. paratuberculosis
gcaccacgccgacguggguggug

SEQ ID NO: 3029565 - RNA, 17 nt, Mycobacterium avium subsp. paratuberculosis
gcaccacggcccgcgcc

SEQ ID NO: 3029566 - RNA, 22 nt, Mycobacterium avium subsp. paratuberculosis
gcaccacggcccgcgccccggc

SEQ ID NO: 3029567 - RNA, 21 nt, Mycobacterium avium subsp. paratuberculosis
gcaccacggcggcauguucga

SEQ ID NO: 3029568 - RNA, 14 nt, Mycobacterium avium subsp. paratuberculosis
gcaccacgguggcg

SEQ ID NO: 3029569 - RNA, 15 nt, Mycobacterium avium subsp. paratuberculosis
gcaccacgguggcgc

SEQ ID NO: 3029570 - RNA, 18 nt, Mycobacterium avium subsp. paratuberculosis
gcaccacgguggcgccgc

SEQ ID NO: 3029571 - RNA, 19 nt, Mycobacterium avium subsp. paratuberculosis
gcaccacgguggcgccgcg

SEQ ID NO: 3029572 - RNA, 22 nt, Mycobacterium avium subsp. paratuberculosis
gcaccacgguggcgccgcgcag

SEQ ID NO: 3029573 - RNA, 23 nt, Mycobacterium avium subsp. paratuberculosis
gcaccacgguggcgccgcgcagc

SEQ ID NO: 3029574 - RNA, 24 nt, Mycobacterium avium subsp. paratuberculosis
gcaccacgguggcgccgcgcagcc

SEQ ID NO: 3029575 - RNA, 20 nt, Mycobacterium avium subsp. paratuberculosis
gcaccacguccaccagcacc

SEQ ID NO: 3029576 - RNA, 22 nt, Mycobacterium avium subsp. paratuberculosis
gcaccacguccgcggugagcac

SEQ ID NO: 3029577 - RNA, 12 nt, Mycobacterium avium subsp. paratuberculosis
gcaccacgucgg

SEQ ID NO: 3029578 - RNA, 22 nt, Mycobacterium avium subsp. paratuberculosis
gcaccacgucggguucgccggu

SEQ ID NO: 3029579 - RNA, 15 nt, Mycobacterium avium subsp. paratuberculosis
gcaccacgugcgcga

SEQ ID NO: 3029580 - RNA, 18 nt, Mycobacterium avium subsp. paratuberculosis
gcaccacguugcgcccgg

SEQ ID NO: 3029581 - RNA, 19 nt, Mycobacterium avium subsp. paratuberculosis
gcaccacguugcgcccggc

SEQ ID NO: 3029582 - RNA, 16 nt, Mycobacterium avium subsp. paratuberculosis
gcaccacuuccagcac

SEQ ID NO: 3029583 - RNA, 20 nt, Mycobacterium avium subsp. paratuberculosis
gcaccacuuccagcaccggc

SEQ ID NO: 3029584 - RNA, 21 nt, Mycobacterium avium subsp. paratuberculosis
gcaccacuuccagcaccggcu

SEQ ID NO: 3029585 - RNA, 16 nt, Mycobacterium avium subsp. paratuberculosis
gcaccagaacacguuu

SEQ ID NO: 3029586 - RNA, 14 nt, Mycobacterium avium subsp. paratuberculosis
gcaccagagcgccg

SEQ ID NO: 3029587 - RNA, 16 nt, Mycobacterium avium subsp. paratuberculosis
gcaccagagcgccgga

SEQ ID NO: 3029588 - RNA, 21 nt, Mycobacterium avium subsp. paratuberculosis
gcaccagaucgucgggcaccu

SEQ ID NO: 3029589 - RNA, 19 nt, Mycobacterium avium subsp. paratuberculosis
gcaccagaugcaccucgcc

SEQ ID NO: 3029590 - RNA, 20 nt, Mycobacterium avium subsp. paratuberculosis
gcaccagaugcaccucgccc

SEQ ID NO: 3029591 - RNA, 13 nt, Mycobacterium avium subsp. paratuberculosis
gcaccagcaccac

SEQ ID NO: 3029592 - RNA, 16 nt, Mycobacterium avium subsp. paratuberculosis
gcaccagcaccaccgu

SEQ ID NO: 3029593 - RNA, 14 nt, Mycobacterium avium subsp. paratuberculosis
gcaccagcaccccg

SEQ ID NO: 3029594 - RNA, 16 nt, Mycobacterium avium subsp. paratuberculosis
gcaccagcaccccgcc

SEQ ID NO: 3029595 - RNA, 18 nt, Mycobacterium avium subsp. paratuberculosis
gcaccagcaccccgccgc

SEQ ID NO: 3029596 - RNA, 21 nt, Mycobacterium avium subsp. paratuberculosis
gcaccagcaccccgccgcagc

SEQ ID NO: 3029597 - RNA, 12 nt, Mycobacterium avium subsp. paratuberculosis
gcaccagcaccg

SEQ ID NO: 3029598 - RNA, 15 nt, Mycobacterium avium subsp. paratuberculosis
gcaccagcaccgaga

SEQ ID NO: 3029599 - RNA, 11 nt, Mycobacterium avium subsp. paratuberculosis
gcaccagcacg

SEQ ID NO: 3029600 - RNA, 15 nt, Mycobacterium avium subsp. paratuberculosis
gcaccagcacgacac

SEQ ID NO: 3029601 - RNA, 17 nt, Mycobacterium avium subsp. paratuberculosis
gcaccagcacgacaccg

SEQ ID NO: 3029602 - RNA, 24 nt, Mycobacterium avium subsp. paratuberculosis
gcaccagcacgacaccgacgacca

SEQ ID NO: 3029603 - RNA, 14 nt, Mycobacterium avium subsp. paratuberculosis
gcaccagcacggcg

SEQ ID NO: 3029604 - RNA, 16 nt, Mycobacterium avium subsp. paratuberculosis
gcaccagcacggcgac

SEQ ID NO: 3029605 - RNA, 17 nt, Mycobacterium avium subsp. paratuberculosis
gcaccagcacggcgacc

SEQ ID NO: 3029606 - RNA, 21 nt, Mycobacterium avium subsp. paratuberculosis
gcaccagcacggcgaccagcg

SEQ ID NO: 3029607 - RNA, 24 nt, Mycobacterium avium subsp. paratuberculosis
gcaccagcacggcgaccagcgagc

SEQ ID NO: 3029608 - RNA, 12 nt, Mycobacterium avium subsp. paratuberculosis
gcaccagcagcc

SEQ ID NO: 3029609 - RNA, 16 nt, Mycobacterium avium subsp. paratuberculosis
gcaccagcagccagcc

SEQ ID NO: 3029610 - RNA, 20 nt, Mycobacterium avium subsp. paratuberculosis
gcaccagcagccagcccagc

SEQ ID NO: 3029611 - RNA, 15 nt, Mycobacterium avium subsp. paratuberculosis
gcaccagcagccgca

SEQ ID NO: 3029612 - RNA, 15 nt, Mycobacterium avium subsp. paratuberculosis
gcaccagcagcgcga

SEQ ID NO: 3029613 - RNA, 20 nt, Mycobacterium avium subsp. paratuberculosis
gcaccagcagcgcgacgccg

SEQ ID NO: 3029614 - RNA, 11 nt, Mycobacterium avium subsp. paratuberculosis
gcaccagcagg

SEQ ID NO: 3029615 - RNA, 14 nt, Mycobacterium avium subsp. paratuberculosis
gcaccagcaggccc

SEQ ID NO: 3029616 - RNA, 15 nt, Mycobacterium avium subsp. paratuberculosis
gcaccagcaggcccc

SEQ ID NO: 3029617 - RNA, 15 nt, Mycobacterium avium subsp. paratuberculosis
gcaccagcccgaugc

SEQ ID NO: 3029618 - RNA, 21 nt, Mycobacterium avium subsp. paratuberculosis
gcaccagcccgaugccgccga

SEQ ID NO: 3029619 - RNA, 22 nt, Mycobacterium avium subsp. paratuberculosis
gcaccagcccgaugccgccgag

SEQ ID NO: 3029620 - RNA, 18 nt, Mycobacterium avium subsp. paratuberculosis
gcaccagcccgccgucgg

SEQ ID NO: 3029621 - RNA, 19 nt, Mycobacterium avium subsp. paratuberculosis
gcaccagcccgccgucggc

SEQ ID NO: 3029622 - RNA, 13 nt, Mycobacterium avium subsp. paratuberculosis
gcaccagcccggc

SEQ ID NO: 3029623 - RNA, 14 nt, Mycobacterium avium subsp. paratuberculosis
gcaccagcccggcc

SEQ ID NO: 3029624 - RNA, 16 nt, Mycobacterium avium subsp. paratuberculosis
gcaccagcccggccag

SEQ ID NO: 3029625 - RNA, 18 nt, Mycobacterium avium subsp. paratuberculosis
gcaccagcccggccagcg

SEQ ID NO: 3029626 - RNA, 19 nt, Mycobacterium avium subsp. paratuberculosis
gcaccagcccggccagcgg

SEQ ID NO: 3029627 - RNA, 20 nt, Mycobacterium avium subsp. paratuberculosis
gcaccagcccggccagcggc

SEQ ID NO: 3029628 - RNA, 16 nt, Mycobacterium avium subsp. paratuberculosis
gcaccagcccgucggc

SEQ ID NO: 3029629 - RNA, 14 nt, Mycobacterium avium subsp. paratuberculosis
gcaccagcgacagc

SEQ ID NO: 3029630 - RNA, 18 nt, Mycobacterium avium subsp. paratuberculosis
gcaccagcgacagcaccc

SEQ ID NO: 3029631 - RNA, 20 nt, Mycobacterium avium subsp. paratuberculosis
gcaccagcgacagcacccgc

SEQ ID NO: 3029632 - RNA, 21 nt, Mycobacterium avium subsp. paratuberculosis
gcaccagcgacagcacccgcu

SEQ ID NO: 3029633 - RNA, 18 nt, Mycobacterium avium subsp. paratuberculosis
gcaccagcgauccggcgc

SEQ ID NO: 3029634 - RNA, 15 nt, Mycobacterium avium subsp. paratuberculosis
gcaccagcgccgcga

SEQ ID NO: 3029635 - RNA, 12 nt, Mycobacterium avium subsp. paratuberculosis
gcaccagcgcga

SEQ ID NO: 3029636 - RNA, 14 nt, Mycobacterium avium subsp. paratuberculosis
gcaccagcgcgacg

SEQ ID NO: 3029637 - RNA, 15 nt, Mycobacterium avium subsp. paratuberculosis
gcaccagcgcgacgg

SEQ ID NO: 3029638 - RNA, 17 nt, Mycobacterium avium subsp. paratuberculosis
gcaccagcgcgacggug

SEQ ID NO: 3029639 - RNA, 14 nt, Mycobacterium avium subsp. paratuberculosis
gcaccagcgcgcgg

SEQ ID NO: 3029640 - RNA, 16 nt, Mycobacterium avium subsp. paratuberculosis
gcaccagcgcgcgggu

SEQ ID NO: 3029641 - RNA, 17 nt, Mycobacterium avium subsp. paratuberculosis
gcaccagcgcgcgggug

SEQ ID NO: 3029642 - RNA, 12 nt, Mycobacterium avium subsp. paratuberculosis
gcaccagcgcgg

SEQ ID NO: 3029643 - RNA, 20 nt, Mycobacterium avium subsp. paratuberculosis
gcaccagcgcuuucgcgcac

SEQ ID NO: 3029644 - RNA, 15 nt, Mycobacterium avium subsp. paratuberculosis
gcaccagcggaucgg

SEQ ID NO: 3029645 - RNA, 20 nt, Mycobacterium avium subsp. paratuberculosis
gcaccagcggaucggcgguc

SEQ ID NO: 3029646 - RNA, 13 nt, Mycobacterium avium subsp. paratuberculosis
gcaccagcggcac

SEQ ID NO: 3029647 - RNA, 21 nt, Mycobacterium avium subsp. paratuberculosis
gcaccagcggcaucgccgcca

SEQ ID NO: 3029648 - RNA, 15 nt, Mycobacterium avium subsp. paratuberculosis
gcaccagcgucgacg

SEQ ID NO: 3029649 - RNA, 17 nt, Mycobacterium avium subsp. paratuberculosis
gcaccagcgucgacgcg

SEQ ID NO: 3029650 - RNA, 20 nt, Mycobacterium avium subsp. paratuberculosis
gcaccagcgucgacgcggug

SEQ ID NO: 3029651 - RNA, 18 nt, Mycobacterium avium subsp. paratuberculosis
gcaccagcguggccggca

SEQ ID NO: 3029652 - RNA, 18 nt, Mycobacterium avium subsp. paratuberculosis
gcaccagcucgaggccgc

SEQ ID NO: 3029653 - RNA, 23 nt, Mycobacterium avium subsp. paratuberculosis
gcaccagcucgaggccgcgggcg

SEQ ID NO: 3029654 - RNA, 14 nt, Mycobacterium avium subsp. paratuberculosis
gcaccagcucggcg

SEQ ID NO: 3029655 - RNA, 17 nt, Mycobacterium avium subsp. paratuberculosis
gcaccagcucggcgcug

SEQ ID NO: 3029656 - RNA, 13 nt, Mycobacterium avium subsp. paratuberculosis
gcaccagcucggu

SEQ ID NO: 3029657 - RNA, 18 nt, Mycobacterium avium subsp. paratuberculosis
gcaccaggaaggcgaccg

SEQ ID NO: 3029658 - RNA, 16 nt, Mycobacterium avium subsp. paratuberculosis
gcaccaggacgcgacc

SEQ ID NO: 3029659 - RNA, 17 nt, Mycobacterium avium subsp. paratuberculosis
gcaccaggacgcgaccg

SEQ ID NO: 3029660 - RNA, 19 nt, Mycobacterium avium subsp. paratuberculosis
gcaccaggacgcgaccggc

SEQ ID NO: 3029661 - RNA, 16 nt, Mycobacterium avium subsp. paratuberculosis
gcaccaggcccucgcc

SEQ ID NO: 3029662 - RNA, 17 nt, Mycobacterium avium subsp. paratuberculosis
gcaccaggcccucgccg

SEQ ID NO: 3029663 - RNA, 16 nt, Mycobacterium avium subsp. paratuberculosis
gcaccaggccgacgcu

SEQ ID NO: 3029664 - RNA, 19 nt, Mycobacterium avium subsp. paratuberculosis
gcaccaggccgacgcuggc

SEQ ID NO: 3029665 - RNA, 15 nt, Mycobacterium avium subsp. paratuberculosis
gcaccaggcgcacca

SEQ ID NO: 3029666 - RNA, 17 nt, Mycobacterium avium subsp. paratuberculosis
gcaccaggcgcaccagc

SEQ ID NO: 3029667 - RNA, 18 nt, Mycobacterium avium subsp. paratuberculosis
gcaccaggcgcaccagcu

SEQ ID NO: 3029668 - RNA, 19 nt, Mycobacterium avium subsp. paratuberculosis
gcaccaggcgcaccagcug

SEQ ID NO: 3029669 - RNA, 14 nt, Mycobacterium avium subsp. paratuberculosis
gcaccaggcgccac

SEQ ID NO: 3029670 - RNA, 16 nt, Mycobacterium avium subsp. paratuberculosis
gcaccaggcgccacag

SEQ ID NO: 3029671 - RNA, 17 nt, Mycobacterium avium subsp. paratuberculosis
gcaccaggcgccacagc

SEQ ID NO: 3029672 - RNA, 18 nt, Mycobacterium avium subsp. paratuberculosis
gcaccaggcgccacagca

SEQ ID NO: 3029673 - RNA, 21 nt, Mycobacterium avium subsp. paratuberculosis
gcaccaggcgccacagcagca

SEQ ID NO: 3029674 - RNA, 12 nt, Mycobacterium avium subsp. paratuberculosis
gcaccaggcggg

SEQ ID NO: 3029675 - RNA, 17 nt, Mycobacterium avium subsp. paratuberculosis
gcaccaggcgggucacc

SEQ ID NO: 3029676 - RNA, 19 nt, Mycobacterium avium subsp. paratuberculosis
gcaccaggcugaccagcgc

SEQ ID NO: 3029677 - RNA, 22 nt, Mycobacterium avium subsp. paratuberculosis
gcaccaggcugaccagcgccuc

SEQ ID NO: 3029678 - RNA, 20 nt, Mycobacterium avium subsp. paratuberculosis
gcaccagggccugcagcacc

SEQ ID NO: 3029679 - RNA, 16 nt, Mycobacterium avium subsp. paratuberculosis
gcaccagggcgucgag

SEQ ID NO: 3029680 - RNA, 23 nt, Mycobacterium avium subsp. paratuberculosis
gcaccagggcguguugcaggcgg

SEQ ID NO: 3029681 - RNA, 21 nt, Mycobacterium avium subsp. paratuberculosis
gcaccagggucuucagcccgc

SEQ ID NO: 3029682 - RNA, 13 nt, Mycobacterium avium subsp. paratuberculosis
gcaccaggguguc

SEQ ID NO: 3029683 - RNA, 19 nt, Mycobacterium avium subsp. paratuberculosis
gcaccagggugucgucgcg

SEQ ID NO: 3029684 - RNA, 16 nt, Mycobacterium avium subsp. paratuberculosis
gcaccagguaccggcg

SEQ ID NO: 3029685 - RNA, 18 nt, Mycobacterium avium subsp. paratuberculosis
gcaccagguaccggcggg

SEQ ID NO: 3029686 - RNA, 22 nt, Mycobacterium avium subsp. paratuberculosis
gcaccagguagauggugaucga

SEQ ID NO: 3029687 - RNA, 17 nt, Mycobacterium avium subsp. paratuberculosis
gcaccaggucguugccg

SEQ ID NO: 3029688 - RNA, 18 nt, Mycobacterium avium subsp. paratuberculosis
gcaccagguggcccgacc

SEQ ID NO: 3029689 - RNA, 21 nt, Mycobacterium avium subsp. paratuberculosis
gcaccagguggcccgacccgu

SEQ ID NO: 3029690 - RNA, 18 nt, Mycobacterium avium subsp. paratuberculosis
gcaccagguucacgucgg

SEQ ID NO: 3029691 - RNA, 21 nt, Mycobacterium avium subsp. paratuberculosis
gcaccagguugucgccgcgcc

SEQ ID NO: 3029692 - RNA, 22 nt, Mycobacterium avium subsp. paratuberculosis
gcaccagguugucgccgcgcca

SEQ ID NO: 3029693 - RNA, 20 nt, Mycobacterium avium subsp. paratuberculosis
gcaccaguaggucacccggu

SEQ ID NO: 3029694 - RNA, 15 nt, Mycobacterium avium subsp. paratuberculosis
gcaccagucgcgcag

SEQ ID NO: 3029695 - RNA, 20 nt, Mycobacterium avium subsp. paratuberculosis
gcaccagucgcgcagcguca

SEQ ID NO: 3029696 - RNA, 15 nt, Mycobacterium avium subsp. paratuberculosis
gcaccagucggccau

SEQ ID NO: 3029697 - RNA, 23 nt, Mycobacterium avium subsp. paratuberculosis
gcaccagucggccaucagcaccg

SEQ ID NO: 3029698 - RNA, 18 nt, Mycobacterium avium subsp. paratuberculosis
gcaccaguuccugcaugc

SEQ ID NO: 3029699 - RNA, 14 nt, Mycobacterium avium subsp. paratuberculosis
gcaccauccgcgac

SEQ ID NO: 3029700 - RNA, 18 nt, Mycobacterium avium subsp. paratuberculosis
gcaccauccgcgacgcca

SEQ ID NO: 3029701 - RNA, 21 nt, Mycobacterium avium subsp. paratuberculosis
gcaccauccgcgacgccagca

SEQ ID NO: 3029702 - RNA, 13 nt, Mycobacterium avium subsp. paratuberculosis
gcaccauccgcgc

SEQ ID NO: 3029703 - RNA, 21 nt, Mycobacterium avium subsp. paratuberculosis
gcaccauccgcgcgagcgcgc

SEQ ID NO: 3029704 - RNA, 22 nt, Mycobacterium avium subsp. paratuberculosis
gcaccauccgcgcgagcgcgcu

SEQ ID NO: 3029705 - RNA, 20 nt, Mycobacterium avium subsp. paratuberculosis
gcaccaugaucaggccccac

SEQ ID NO: 3029706 - RNA, 18 nt, Mycobacterium avium subsp. paratuberculosis
gcacccaaaacaucggcg

SEQ ID NO: 3029707 - RNA, 12 nt, Mycobacterium avium subsp. paratuberculosis
gcacccaccggc

SEQ ID NO: 3029708 - RNA, 16 nt, Mycobacterium avium subsp. paratuberculosis
gcacccaccggcccag

SEQ ID NO: 3029709 - RNA, 13 nt, Mycobacterium avium subsp. paratuberculosis
gcacccaccggcg

SEQ ID NO: 3029710 - RNA, 14 nt, Mycobacterium avium subsp. paratuberculosis
gcacccaccggcgc

SEQ ID NO: 3029711 - RNA, 15 nt, Mycobacterium avium subsp. paratuberculosis
gcacccaccggcgca

SEQ ID NO: 3029712 - RNA, 21 nt, Mycobacterium avium subsp. paratuberculosis
gcacccaccggcgcagcgcgu

SEQ ID NO: 3029713 - RNA, 15 nt, Mycobacterium avium subsp. paratuberculosis
gcacccacgccagcc

SEQ ID NO: 3029714 - RNA, 17 nt, Mycobacterium avium subsp. paratuberculosis
gcacccacgccagccgg

SEQ ID NO: 3029715 - RNA, 18 nt, Mycobacterium avium subsp. paratuberculosis
gcacccacgccagccggg

SEQ ID NO: 3029716 - RNA, 22 nt, Mycobacterium avium subsp. paratuberculosis
gcacccacgccagccggguggc

SEQ ID NO: 3029717 - RNA, 19 nt, Mycobacterium avium subsp. paratuberculosis
gcacccagaaacgacauca

SEQ ID NO: 3029718 - RNA, 17 nt, Mycobacterium avium subsp. paratuberculosis
gcacccagcacagcgag

SEQ ID NO: 3029719 - RNA, 20 nt, Mycobacterium avium subsp. paratuberculosis
gcacccagcacagcgaggcg

SEQ ID NO: 3029720 - RNA, 15 nt, Mycobacterium avium subsp. paratuberculosis
gcacccagccgugcc

SEQ ID NO: 3029721 - RNA, 13 nt, Mycobacterium avium subsp. paratuberculosis
gcacccagcgggc

SEQ ID NO: 3029722 - RNA, 20 nt, Mycobacterium avium subsp. paratuberculosis
gcacccagcgggcgacgucg

SEQ ID NO: 3029723 - RNA, 19 nt, Mycobacterium avium subsp. paratuberculosis
gcacccaggaaaaccagcg

SEQ ID NO: 3029724 - RNA, 21 nt, Mycobacterium avium subsp. paratuberculosis
gcacccaggaaaaccagcgac

SEQ ID NO: 3029725 - RNA, 14 nt, Mycobacterium avium subsp. paratuberculosis
gcacccaggucacc

SEQ ID NO: 3029726 - RNA, 18 nt, Mycobacterium avium subsp. paratuberculosis
gcacccaggucaccgagg

SEQ ID NO: 3029727 - RNA, 20 nt, Mycobacterium avium subsp. paratuberculosis
gcacccaggucaugguggcg

SEQ ID NO: 3029728 - RNA, 13 nt, Mycobacterium avium subsp. paratuberculosis
gcacccaggugcu

SEQ ID NO: 3029729 - RNA, 17 nt, Mycobacterium avium subsp. paratuberculosis
gcacccaggugcugccc

SEQ ID NO: 3029730 - RNA, 15 nt, Mycobacterium avium subsp. paratuberculosis
gcaccccacccgcgc

SEQ ID NO: 3029731 - RNA, 21 nt, Mycobacterium avium subsp. paratuberculosis
gcaccccacccgcgcgacauc

SEQ ID NO: 3029732 - RNA, 16 nt, Mycobacterium avium subsp. paratuberculosis
gcaccccaccgacagc

SEQ ID NO: 3029733 - RNA, 20 nt, Mycobacterium avium subsp. paratuberculosis
gcaccccaccgacagccgga

SEQ ID NO: 3029734 - RNA, 13 nt, Mycobacterium avium subsp. paratuberculosis
gcaccccaucggc

SEQ ID NO: 3029735 - RNA, 21 nt, Mycobacterium avium subsp. paratuberculosis
gcacccccaauugccgggcca

SEQ ID NO: 3029736 - RNA, 22 nt, Mycobacterium avium subsp. paratuberculosis
gcacccccaauugccgggccag

SEQ ID NO: 3029737 - RNA, 18 nt, Mycobacterium avium subsp. paratuberculosis
gcacccccagcucgacga

SEQ ID NO: 3029738 - RNA, 13 nt, Mycobacterium avium subsp. paratuberculosis
gcacccccggggc

SEQ ID NO: 3029739 - RNA, 14 nt, Mycobacterium avium subsp. paratuberculosis
gcacccccggggcc

SEQ ID NO: 3029740 - RNA, 23 nt, Mycobacterium avium subsp. paratuberculosis
gcacccccggggccuccagccag

SEQ ID NO: 3029741 - RNA, 17 nt, Mycobacterium avium subsp. paratuberculosis
gcacccccucggcgccg

SEQ ID NO: 3029742 - RNA, 19 nt, Mycobacterium avium subsp. paratuberculosis
gcacccccucggcgccggu

SEQ ID NO: 3029743 - RNA, 17 nt, Mycobacterium avium subsp. paratuberculosis
gcaccccgaaccaguuc

SEQ ID NO: 3029744 - RNA, 19 nt, Mycobacterium avium subsp. paratuberculosis
gcaccccgaaccgcccgcc

SEQ ID NO: 3029745 - RNA, 15 nt, Mycobacterium avium subsp. paratuberculosis
gcaccccgccgcagc

SEQ ID NO: 3029746 - RNA, 17 nt, Mycobacterium avium subsp. paratuberculosis
gcaccccgccgcagccc

SEQ ID NO: 3029747 - RNA, 22 nt, Mycobacterium avium subsp. paratuberculosis
gcaccccgccgcagcccaggcc

SEQ ID NO: 3029748 - RNA, 15 nt, Mycobacterium avium subsp. paratuberculosis
gcaccccgcgccggg

SEQ ID NO: 3029749 - RNA, 17 nt, Mycobacterium avium subsp. paratuberculosis
gcaccccgcgccgggcg

SEQ ID NO: 3029750 - RNA, 20 nt, Mycobacterium avium subsp. paratuberculosis
gcaccccgcggucggcggcg

SEQ ID NO: 3029751 - RNA, 13 nt, Mycobacterium avium subsp. paratuberculosis
gcaccccggcggc

SEQ ID NO: 3029752 - RNA, 15 nt, Mycobacterium avium subsp. paratuberculosis
gcaccccggcggccg

SEQ ID NO: 3029753 - RNA, 17 nt, Mycobacterium avium subsp. paratuberculosis
gcaccccggucaccggu

SEQ ID NO: 3029754 - RNA, 20 nt, Mycobacterium avium subsp. paratuberculosis
gcaccccgucgagcagccgc

SEQ ID NO: 3029755 - RNA, 21 nt, Mycobacterium avium subsp. paratuberculosis
gcaccccgucgagcagccgca

SEQ ID NO: 3029756 - RNA, 15 nt, Mycobacterium avium subsp. paratuberculosis
gcaccccgucgcgga

SEQ ID NO: 3029757 - RNA, 17 nt, Mycobacterium avium subsp. paratuberculosis
gcaccccgucgcggacc

SEQ ID NO: 3029758 - RNA, 19 nt, Mycobacterium avium subsp. paratuberculosis
gcaccccgucgcggacccu

SEQ ID NO: 3029759 - RNA, 19 nt, Mycobacterium avium subsp. paratuberculosis
gcaccccguugccgccggc

SEQ ID NO: 3029760 - RNA, 14 nt, Mycobacterium avium subsp. paratuberculosis
gcaccccugccgcc

SEQ ID NO: 3029761 - RNA, 15 nt, Mycobacterium avium subsp. paratuberculosis
gcaccccugccgcca

SEQ ID NO: 3029762 - RNA, 18 nt, Mycobacterium avium subsp. paratuberculosis
gcaccccugccgccaccg

SEQ ID NO: 3029763 - RNA, 20 nt, Mycobacterium avium subsp. paratuberculosis
gcaccccugccgccaccgcg

SEQ ID NO: 3029764 - RNA, 22 nt, Mycobacterium avium subsp. paratuberculosis
gcaccccugccgccaccgcgaa

SEQ ID NO: 3029765 - RNA, 18 nt, Mycobacterium avium subsp. paratuberculosis
gcacccgaacggaccggg

SEQ ID NO: 3029766 - RNA, 21 nt, Mycobacterium avium subsp. paratuberculosis
gcacccgaacggaccgggcgg

SEQ ID NO: 3029767 - RNA, 17 nt, Mycobacterium avium subsp. paratuberculosis
gcacccgacacgccgau

SEQ ID NO: 3029768 - RNA, 18 nt, Mycobacterium avium subsp. paratuberculosis
gcacccgacacgccgauc

SEQ ID NO: 3029769 - RNA, 15 nt, Mycobacterium avium subsp. paratuberculosis
gcacccgaccgacgc

SEQ ID NO: 3029770 - RNA, 12 nt, Mycobacterium avium subsp. paratuberculosis
gcacccgacguc

SEQ ID NO: 3029771 - RNA, 21 nt, Mycobacterium avium subsp. paratuberculosis
gcacccgacgucgacgcgggc

SEQ ID NO: 3029772 - RNA, 22 nt, Mycobacterium avium subsp. paratuberculosis
gcacccgacgucgacgcgggcg

SEQ ID NO: 3029773 - RNA, 19 nt, Mycobacterium avium subsp. paratuberculosis
gcacccgacuucggcucgg

SEQ ID NO: 3029774 - RNA, 17 nt, Mycobacterium avium subsp. paratuberculosis
gcacccgauccacggcg

SEQ ID NO: 3029775 - RNA, 18 nt, Mycobacterium avium subsp. paratuberculosis
gcacccgauccacggcga

SEQ ID NO: 3029776 - RNA, 20 nt, Mycobacterium avium subsp. paratuberculosis
gcacccgauccacggcgacc

SEQ ID NO: 3029777 - RNA, 22 nt, Mycobacterium avium subsp. paratuberculosis
gcacccgauccacggcgacccc

SEQ ID NO: 3029778 - RNA, 18 nt, Mycobacterium avium subsp. paratuberculosis
gcacccgaugcucccggu

SEQ ID NO: 3029779 - RNA, 13 nt, Mycobacterium avium subsp. paratuberculosis
gcacccgcaacac

SEQ ID NO: 3029780 - RNA, 21 nt, Mycobacterium avium subsp. paratuberculosis
gcacccgcaacaccacgucgg

SEQ ID NO: 3029781 - RNA, 23 nt, Mycobacterium avium subsp. paratuberculosis
gcacccgcaacgcgcgcgacggc

SEQ ID NO: 3029782 - RNA, 15 nt, Mycobacterium avium subsp. paratuberculosis
gcacccgcagcucca

SEQ ID NO: 3029783 - RNA, 17 nt, Mycobacterium avium subsp. paratuberculosis
gcacccgcagcuccagc

SEQ ID NO: 3029784 - RNA, 15 nt, Mycobacterium avium subsp. paratuberculosis
gcacccgccagcccg

SEQ ID NO: 3029785 - RNA, 12 nt, Mycobacterium avium subsp. paratuberculosis
gcacccgccaug

SEQ ID NO: 3029786 - RNA, 13 nt, Mycobacterium avium subsp. paratuberculosis
gcacccgcccgga

SEQ ID NO: 3029787 - RNA, 17 nt, Mycobacterium avium subsp. paratuberculosis
gcacccgcccggacgcg

SEQ ID NO: 3029788 - RNA, 12 nt, Mycobacterium avium subsp. paratuberculosis
gcacccgccgcc

SEQ ID NO: 3029789 - RNA, 15 nt, Mycobacterium avium subsp. paratuberculosis
gcacccgccgcccga

SEQ ID NO: 3029790 - RNA, 13 nt, Mycobacterium avium subsp. paratuberculosis
gcacccgcggcgc

SEQ ID NO: 3029791 - RNA, 15 nt, Mycobacterium avium subsp. paratuberculosis
gcacccgcggcgcga

SEQ ID NO: 3029792 - RNA, 20 nt, Mycobacterium avium subsp. paratuberculosis
gcacccgcgggucgucgggc

SEQ ID NO: 3029793 - RNA, 13 nt, Mycobacterium avium subsp. paratuberculosis
gcacccgcucgcc

SEQ ID NO: 3029794 - RNA, 15 nt, Mycobacterium avium subsp. paratuberculosis
gcacccgcucgccga

SEQ ID NO: 3029795 - RNA, 15 nt, Mycobacterium avium subsp. paratuberculosis
gcacccgcucgcggg

SEQ ID NO: 3029796 - RNA, 20 nt, Mycobacterium avium subsp. paratuberculosis
gcacccgcugauccagcagc

SEQ ID NO: 3029797 - RNA, 18 nt, Mycobacterium avium subsp. paratuberculosis
gcacccgcugcaccagcc

SEQ ID NO: 3029798 - RNA, 19 nt, Mycobacterium avium subsp. paratuberculosis
gcacccgcugcaccagccc

SEQ ID NO: 3029799 - RNA, 20 nt, Mycobacterium avium subsp. paratuberculosis
gcacccgcugcaccagcccg

SEQ ID NO: 3029800 - RNA, 15 nt, Mycobacterium avium subsp. paratuberculosis
gcacccgcugcagcc

SEQ ID NO: 3029801 - RNA, 20 nt, Mycobacterium avium subsp. paratuberculosis
gcacccgcugcagccggucc

SEQ ID NO: 3029802 - RNA, 18 nt, Mycobacterium avium subsp. paratuberculosis
gcacccgcuuuugccguc

SEQ ID NO: 3029803 - RNA, 22 nt, Mycobacterium avium subsp. paratuberculosis
gcacccgcuuuugccgucggug

SEQ ID NO: 3029804 - RNA, 16 nt, Mycobacterium avium subsp. paratuberculosis
gcacccggacgugauc

SEQ ID NO: 3029805 - RNA, 18 nt, Mycobacterium avium subsp. paratuberculosis
gcacccggacgugaucgc

SEQ ID NO: 3029806 - RNA, 22 nt, Mycobacterium avium subsp. paratuberculosis
gcacccggacgugaucgcggug

SEQ ID NO: 3029807 - RNA, 23 nt, Mycobacterium avium subsp. paratuberculosis
gcacccggacgugaucgcggugg

SEQ ID NO: 3029808 - RNA, 13 nt, Mycobacterium avium subsp. paratuberculosis
gcacccggauggu

SEQ ID NO: 3029809 - RNA, 18 nt, Mycobacterium avium subsp. paratuberculosis
gcacccggccacgccggg

SEQ ID NO: 3029810 - RNA, 19 nt, Mycobacterium avium subsp. paratuberculosis
gcacccggccacgccgggu

SEQ ID NO: 3029811 - RNA, 16 nt, Mycobacterium avium subsp. paratuberculosis
gcacccggcccacgcc

SEQ ID NO: 3029812 - RNA, 19 nt, Mycobacterium avium subsp. paratuberculosis
gcacccggcccacgccguc

SEQ ID NO: 3029813 - RNA, 20 nt, Mycobacterium avium subsp. paratuberculosis
gcacccggcccacgccgucg

SEQ ID NO: 3029814 - RNA, 16 nt, Mycobacterium avium subsp. paratuberculosis
gcacccggcccccuga

SEQ ID NO: 3029815 - RNA, 13 nt, Mycobacterium avium subsp. paratuberculosis
gcacccggcccua

SEQ ID NO: 3029816 - RNA, 13 nt, Mycobacterium avium subsp. paratuberculosis
gcacccggccggc

SEQ ID NO: 3029817 - RNA, 14 nt, Mycobacterium avium subsp. paratuberculosis
gcacccggccggcg

SEQ ID NO: 3029818 - RNA, 15 nt, Mycobacterium avium subsp. paratuberculosis
gcacccggcgcggcc

SEQ ID NO: 3029819 - RNA, 17 nt, Mycobacterium avium subsp. paratuberculosis
gcacccggcgcggccgc

SEQ ID NO: 3029820 - RNA, 18 nt, Mycobacterium avium subsp. paratuberculosis
gcacccggcgcggccgcc

SEQ ID NO: 3029821 - RNA, 23 nt, Mycobacterium avium subsp. paratuberculosis
gcacccggcgcggccgcccagcc

SEQ ID NO: 3029822 - RNA, 12 nt, Mycobacterium avium subsp. paratuberculosis
gcacccggcggg

SEQ ID NO: 3029823 - RNA, 15 nt, Mycobacterium avium subsp. paratuberculosis
gcacccggcggggac

SEQ ID NO: 3029824 - RNA, 16 nt, Mycobacterium avium subsp. paratuberculosis
gcacccggcggggacc

SEQ ID NO: 3029825 - RNA, 13 nt, Mycobacterium avium subsp. paratuberculosis
gcacccgggcccg

SEQ ID NO: 3029826 - RNA, 19 nt, Mycobacterium avium subsp. paratuberculosis
gcacccgggccugcggcgg

SEQ ID NO: 3029827 - RNA, 21 nt, Mycobacterium avium subsp. paratuberculosis
gcacccgggccugcggcggcc

SEQ ID NO: 3029828 - RNA, 22 nt, Mycobacterium avium subsp. paratuberculosis
gcacccgggccugcggcggccg

SEQ ID NO: 3029829 - RNA, 23 nt, Mycobacterium avium subsp. paratuberculosis
gcacccgggccugcggcggccgc

SEQ ID NO: 3029830 - RNA, 22 nt, Mycobacterium avium subsp. paratuberculosis
gcacccgggccuugacggccug

SEQ ID NO: 3029831 - RNA, 23 nt, Mycobacterium avium subsp. paratuberculosis
gcacccgggccuuguugcggcgc

SEQ ID NO: 3029832 - RNA, 12 nt, Mycobacterium avium subsp. paratuberculosis
gcacccgggcga

SEQ ID NO: 3029833 - RNA, 17 nt, Mycobacterium avium subsp. paratuberculosis
gcacccgggcgacaugc

SEQ ID NO: 3029834 - RNA, 17 nt, Mycobacterium avium subsp. paratuberculosis
gcacccgggcgcgacgg

SEQ ID NO: 3029835 - RNA, 19 nt, Mycobacterium avium subsp. paratuberculosis
gcacccgggcgcgacgguc

SEQ ID NO: 3029836 - RNA, 21 nt, Mycobacterium avium subsp. paratuberculosis
gcacccgggugaucaacgcgg

SEQ ID NO: 3029837 - RNA, 17 nt, Mycobacterium avium subsp. paratuberculosis
gcacccgggugcccggc

SEQ ID NO: 3029838 - RNA, 20 nt, Mycobacterium avium subsp. paratuberculosis
gcacccgguccggcuggucg

SEQ ID NO: 3029839 - RNA, 19 nt, Mycobacterium avium subsp. paratuberculosis
gcacccggucggugagcug

SEQ ID NO: 3029840 - RNA, 23 nt, Mycobacterium avium subsp. paratuberculosis
gcacccggucggugagcuggccg

SEQ ID NO: 3029841 - RNA, 23 nt, Mycobacterium avium subsp. paratuberculosis
gcacccgguuccaccgggccgcc

SEQ ID NO: 3029842 - RNA, 15 nt, Mycobacterium avium subsp. paratuberculosis
gcacccgguucuggg

SEQ ID NO: 3029843 - RNA, 20 nt, Mycobacterium avium subsp. paratuberculosis
gcacccgguucugggcgggc

SEQ ID NO: 3029844 - RNA, 15 nt, Mycobacterium avium subsp. paratuberculosis
gcacccguaacacga

SEQ ID NO: 3029845 - RNA, 22 nt, Mycobacterium avium subsp. paratuberculosis
gcacccguaacacgaucacccc

SEQ ID NO: 3029846 - RNA, 17 nt, Mycobacterium avium subsp. paratuberculosis
gcacccguucggcgucg

SEQ ID NO: 3029847 - RNA, 19 nt, Mycobacterium avium subsp. paratuberculosis
gcacccucugccacggcgg

SEQ ID NO: 3029848 - RNA, 23 nt, Mycobacterium avium subsp. paratuberculosis
gcacccuugacuaccgcgcccag

SEQ ID NO: 3029849 - RNA, 16 nt, Mycobacterium avium subsp. paratuberculosis
gcaccgaaaucguaga

SEQ ID NO: 3029850 - RNA, 14 nt, Mycobacterium avium subsp. paratuberculosis
gcaccgaaccggcg

SEQ ID NO: 3029851 - RNA, 19 nt, Mycobacterium avium subsp. paratuberculosis
gcaccgaaccggcgggguc

SEQ ID NO: 3029852 - RNA, 17 nt, Mycobacterium avium subsp. paratuberculosis
gcaccgaacgccagcag

SEQ ID NO: 3029853 - RNA, 15 nt, Mycobacterium avium subsp. paratuberculosis
gcaccgaaucgccga

SEQ ID NO: 3029854 - RNA, 16 nt, Mycobacterium avium subsp. paratuberculosis
gcaccgacaucagauc

SEQ ID NO: 3029855 - RNA, 14 nt, Mycobacterium avium subsp. paratuberculosis
gcaccgaccagcgg

SEQ ID NO: 3029856 - RNA, 21 nt, Mycobacterium avium subsp. paratuberculosis
gcaccgacgaaaucgucgggc

SEQ ID NO: 3029857 - RNA, 15 nt, Mycobacterium avium subsp. paratuberculosis
gcaccgacgaggaga

SEQ ID NO: 3029858 - RNA, 14 nt, Mycobacterium avium subsp. paratuberculosis
gcaccgacgcggcg

SEQ ID NO: 3029859 - RNA, 17 nt, Mycobacterium avium subsp. paratuberculosis
gcaccgacgcggcgacc

SEQ ID NO: 3029860 - RNA, 15 nt, Mycobacterium avium subsp. paratuberculosis
gcaccgacggagccg

SEQ ID NO: 3029861 - RNA, 22 nt, Mycobacterium avium subsp. paratuberculosis
gcaccgacggagccgagcacca

SEQ ID NO: 3029862 - RNA, 17 nt, Mycobacterium avium subsp. paratuberculosis
gcaccgacggccgcacc

SEQ ID NO: 3029863 - RNA, 19 nt, Mycobacterium avium subsp. paratuberculosis
gcaccgacggccgcacccc

SEQ ID NO: 3029864 - RNA, 20 nt, Mycobacterium avium subsp. paratuberculosis
gcaccgacuccuccggcccg

SEQ ID NO: 3029865 - RNA, 22 nt, Mycobacterium avium subsp. paratuberculosis
gcaccgacuccuccggcccgau

SEQ ID NO: 3029866 - RNA, 15 nt, Mycobacterium avium subsp. paratuberculosis
gcaccgacugcggcg

SEQ ID NO: 3029867 - RNA, 19 nt, Mycobacterium avium subsp. paratuberculosis
gcaccgacuguuugaugcc

SEQ ID NO: 3029868 - RNA, 18 nt, Mycobacterium avium subsp. paratuberculosis
gcaccgagaucucgucga

SEQ ID NO: 3029869 - RNA, 20 nt, Mycobacterium avium subsp. paratuberculosis
gcaccgagaucucgucgaug

SEQ ID NO: 3029870 - RNA, 23 nt, Mycobacterium avium subsp. paratuberculosis
gcaccgagaucucgucgaugggc

SEQ ID NO: 3029871 - RNA, 22 nt, Mycobacterium avium subsp. paratuberculosis
gcaccgauaguagccagcaucg

SEQ ID NO: 3029872 - RNA, 15 nt, Mycobacterium avium subsp. paratuberculosis
gcaccgaucggcacg

SEQ ID NO: 3029873 - RNA, 24 nt, Mycobacterium avium subsp. paratuberculosis
gcaccgauggguuggccgucgcgu

SEQ ID NO: 3029874 - RNA, 19 nt, Mycobacterium avium subsp. paratuberculosis
gcaccgcaaagcaccgcga

SEQ ID NO: 3029875 - RNA, 20 nt, Mycobacterium avium subsp. paratuberculosis
gcaccgcaaagcaccgcgaa

SEQ ID NO: 3029876 - RNA, 20 nt, Mycobacterium avium subsp. paratuberculosis
gcaccgcaacguuguuccac

SEQ ID NO: 3029877 - RNA, 23 nt, Mycobacterium avium subsp. paratuberculosis
gcaccgcagucuuguugaccuuc

SEQ ID NO: 3029878 - RNA, 22 nt, Mycobacterium avium subsp. paratuberculosis
gcaccgcauagcgggagccggc

SEQ ID NO: 3029879 - RNA, 16 nt, Mycobacterium avium subsp. paratuberculosis
gcaccgcaucccccuc

SEQ ID NO: 3029880 - RNA, 11 nt, Mycobacterium avium subsp. paratuberculosis
gcaccgccacc

SEQ ID NO: 3029881 - RNA, 15 nt, Mycobacterium avium subsp. paratuberculosis
gcaccgccaccggcc

SEQ ID NO: 3029882 - RNA, 17 nt, Mycobacterium avium subsp. paratuberculosis
gcaccgccaccggcccg

SEQ ID NO: 3029883 - RNA, 18 nt, Mycobacterium avium subsp. paratuberculosis
gcaccgccaccggcccgg

SEQ ID NO: 3029884 - RNA, 19 nt, Mycobacterium avium subsp. paratuberculosis
gcaccgccaccggcccggc

SEQ ID NO: 3029885 - RNA, 21 nt, Mycobacterium avium subsp. paratuberculosis
gcaccgccaccggcccggccg

SEQ ID NO: 3029886 - RNA, 14 nt, Mycobacterium avium subsp. paratuberculosis
gcaccgccacggcg

SEQ ID NO: 3029887 - RNA, 15 nt, Mycobacterium avium subsp. paratuberculosis
gcaccgccacggcga

SEQ ID NO: 3029888 - RNA, 16 nt, Mycobacterium avium subsp. paratuberculosis
gcaccgccacggcgac

SEQ ID NO: 3029889 - RNA, 14 nt, Mycobacterium avium subsp. paratuberculosis
gcaccgccagcacc

SEQ ID NO: 3029890 - RNA, 19 nt, Mycobacterium avium subsp. paratuberculosis
gcaccgccagcaccgacgc

SEQ ID NO: 3029891 - RNA, 16 nt, Mycobacterium avium subsp. paratuberculosis
gcaccgccagcauccg

SEQ ID NO: 3029892 - RNA, 17 nt, Mycobacterium avium subsp. paratuberculosis
gcaccgccagcauccgc

SEQ ID NO: 3029893 - RNA, 14 nt, Mycobacterium avium subsp. paratuberculosis
gcaccgccagccac

SEQ ID NO: 3029894 - RNA, 16 nt, Mycobacterium avium subsp. paratuberculosis
gcaccgccagccacca

SEQ ID NO: 3029895 - RNA, 13 nt, Mycobacterium avium subsp. paratuberculosis
gcaccgccagcgc

SEQ ID NO: 3029896 - RNA, 15 nt, Mycobacterium avium subsp. paratuberculosis
gcaccgccagcgccg

SEQ ID NO: 3029897 - RNA, 16 nt, Mycobacterium avium subsp. paratuberculosis
gcaccgccagcgccgg

SEQ ID NO: 3029898 - RNA, 17 nt, Mycobacterium avium subsp. paratuberculosis
gcaccgccagcgccggc

SEQ ID NO: 3029899 - RNA, 14 nt, Mycobacterium avium subsp. paratuberculosis
gcaccgccagcgcg

SEQ ID NO: 3029900 - RNA, 16 nt, Mycobacterium avium subsp. paratuberculosis
gcaccgccagcgcggc

SEQ ID NO: 3029901 - RNA, 17 nt, Mycobacterium avium subsp. paratuberculosis
gcaccgccagcgcggcg

SEQ ID NO: 3029902 - RNA, 21 nt, Mycobacterium avium subsp. paratuberculosis
gcaccgccagcgcggcggcgc

SEQ ID NO: 3029903 - RNA, 12 nt, Mycobacterium avium subsp. paratuberculosis
gcaccgccaggc

SEQ ID NO: 3029904 - RNA, 19 nt, Mycobacterium avium subsp. paratuberculosis
gcaccgccaggcuggccag

SEQ ID NO: 3029905 - RNA, 15 nt, Mycobacterium avium subsp. paratuberculosis
gcaccgccaucgcgg

SEQ ID NO: 3029906 - RNA, 17 nt, Mycobacterium avium subsp. paratuberculosis
gcaccgccaucgcggcg

SEQ ID NO: 3029907 - RNA, 19 nt, Mycobacterium avium subsp. paratuberculosis
gcaccgccaucgcggcguu

SEQ ID NO: 3029908 - RNA, 16 nt, Mycobacterium avium subsp. paratuberculosis
gcaccgccaucggcau

SEQ ID NO: 3029909 - RNA, 18 nt, Mycobacterium avium subsp. paratuberculosis
gcaccgccaucggcaucg

SEQ ID NO: 3029910 - RNA, 15 nt, Mycobacterium avium subsp. paratuberculosis
gcaccgcccccgcgg

SEQ ID NO: 3029911 - RNA, 19 nt, Mycobacterium avium subsp. paratuberculosis
gcaccgcccccgcggcggc

SEQ ID NO: 3029912 - RNA, 21 nt, Mycobacterium avium subsp. paratuberculosis
gcaccgcccccgcggcggcca

SEQ ID NO: 3029913 - RNA, 13 nt, Mycobacterium avium subsp. paratuberculosis
gcaccgccccggu

SEQ ID NO: 3029914 - RNA, 16 nt, Mycobacterium avium subsp. paratuberculosis
gcaccgccccggucac

SEQ ID NO: 3029915 - RNA, 14 nt, Mycobacterium avium subsp. paratuberculosis
gcaccgcccgcggu

SEQ ID NO: 3029916 - RNA, 15 nt, Mycobacterium avium subsp. paratuberculosis
gcaccgcccgcggug

SEQ ID NO: 3029917 - RNA, 22 nt, Mycobacterium avium subsp. paratuberculosis
gcaccgcccggguugucgacgu

SEQ ID NO: 3029918 - RNA, 15 nt, Mycobacterium avium subsp. paratuberculosis
gcaccgccgacaucg

SEQ ID NO: 3029919 - RNA, 18 nt, Mycobacterium avium subsp. paratuberculosis
gcaccgccgagccgucgu

SEQ ID NO: 3029920 - RNA, 19 nt, Mycobacterium avium subsp. paratuberculosis
gcaccgccgagccgucguc

SEQ ID NO: 3029921 - RNA, 21 nt, Mycobacterium avium subsp. paratuberculosis
gcaccgccgagccgucgucgc

SEQ ID NO: 3029922 - RNA, 22 nt, Mycobacterium avium subsp. paratuberculosis
gcaccgccgagccgucgucgcu

SEQ ID NO: 3029923 - RNA, 14 nt, Mycobacterium avium subsp. paratuberculosis
gcaccgccgcgcgg

SEQ ID NO: 3029924 - RNA, 16 nt, Mycobacterium avium subsp. paratuberculosis
gcaccgccgcgcggcc

SEQ ID NO: 3029925 - RNA, 15 nt, Mycobacterium avium subsp. paratuberculosis
gcaccgccgcggccg

SEQ ID NO: 3029926 - RNA, 18 nt, Mycobacterium avium subsp. paratuberculosis
gcaccgccgcggccgcga

SEQ ID NO: 3029927 - RNA, 14 nt, Mycobacterium avium subsp. paratuberculosis
gcaccgccgcggga

SEQ ID NO: 3029928 - RNA, 14 nt, Mycobacterium avium subsp. paratuberculosis
gcaccgccgcgggc

SEQ ID NO: 3029929 - RNA, 13 nt, Mycobacterium avium subsp. paratuberculosis
gcaccgccgcggu

SEQ ID NO: 3029930 - RNA, 14 nt, Mycobacterium avium subsp. paratuberculosis
gcaccgccggcgcc

SEQ ID NO: 3029931 - RNA, 14 nt, Mycobacterium avium subsp. paratuberculosis
gcaccgccggcggc

SEQ ID NO: 3029932 - RNA, 15 nt, Mycobacterium avium subsp. paratuberculosis
gcaccgccggcggcc

SEQ ID NO: 3029933 - RNA, 21 nt, Mycobacterium avium subsp. paratuberculosis
gcaccgccggcggccuccgcc

SEQ ID NO: 3029934 - RNA, 17 nt, Mycobacterium avium subsp. paratuberculosis
gcaccgccgggcauccg

SEQ ID NO: 3029935 - RNA, 22 nt, Mycobacterium avium subsp. paratuberculosis
gcaccgccgggcauccgggccg

SEQ ID NO: 3029936 - RNA, 14 nt, Mycobacterium avium subsp. paratuberculosis
gcaccgccgucccg

SEQ ID NO: 3029937 - RNA, 14 nt, Mycobacterium avium subsp. paratuberculosis
gcaccgccgucggg

SEQ ID NO: 3029938 - RNA, 16 nt, Mycobacterium avium subsp. paratuberculosis
gcaccgccgucggggc

SEQ ID NO: 3029939 - RNA, 21 nt, Mycobacterium avium subsp. paratuberculosis
gcaccgccgucggggcgucgg

SEQ ID NO: 3029940 - RNA, 22 nt, Mycobacterium avium subsp. paratuberculosis
gcaccgccgucggggcgucggc

SEQ ID NO: 3029941 - RNA, 24 nt, Mycobacterium avium subsp. paratuberculosis
gcaccgccgucggggcgucggcgg

SEQ ID NO: 3029942 - RNA, 22 nt, Mycobacterium avium subsp. paratuberculosis
gcaccgccucaugccagacgcg

SEQ ID NO: 3029943 - RNA, 23 nt, Mycobacterium avium subsp. paratuberculosis
gcaccgccucaugccagacgcgc

SEQ ID NO: 3029944 - RNA, 17 nt, Mycobacterium avium subsp. paratuberculosis
gcaccgccuccucgaug

SEQ ID NO: 3029945 - RNA, 19 nt, Mycobacterium avium subsp. paratuberculosis
gcaccgccuccucgauguc

SEQ ID NO: 3029946 - RNA, 15 nt, Mycobacterium avium subsp. paratuberculosis
gcaccgccucggcca

SEQ ID NO: 3029947 - RNA, 17 nt, Mycobacterium avium subsp. paratuberculosis
gcaccgccucggccacc

SEQ ID NO: 3029948 - RNA, 21 nt, Mycobacterium avium subsp. paratuberculosis
gcaccgccugggucucgggau

SEQ ID NO: 3029949 - RNA, 19 nt, Mycobacterium avium subsp. paratuberculosis
gcaccgccugugcgacggc

SEQ ID NO: 3029950 - RNA, 20 nt, Mycobacterium avium subsp. paratuberculosis
gcaccgccugugcgacggcg

SEQ ID NO: 3029951 - RNA, 23 nt, Mycobacterium avium subsp. paratuberculosis
gcaccgccugugcgacggcgucg

SEQ ID NO: 3029952 - RNA, 17 nt, Mycobacterium avium subsp. paratuberculosis
gcaccgcgaaacgcaac

SEQ ID NO: 3029953 - RNA, 21 nt, Mycobacterium avium subsp. paratuberculosis
gcaccgcgaaagugcaacugg

SEQ ID NO: 3029954 - RNA, 23 nt, Mycobacterium avium subsp. paratuberculosis
gcaccgcgaaagugcaacuggca

SEQ ID NO: 3029955 - RNA, 14 nt, Mycobacterium avium subsp. paratuberculosis
gcaccgcgaacauc

SEQ ID NO: 3029956 - RNA, 18 nt, Mycobacterium avium subsp. paratuberculosis
gcaccgcgaacaucgcca

SEQ ID NO: 3029957 - RNA, 21 nt, Mycobacterium avium subsp. paratuberculosis
gcaccgcgaacaucgccagca

SEQ ID NO: 3029958 - RNA, 23 nt, Mycobacterium avium subsp. paratuberculosis
gcaccgcgaacaucgccagcaac

SEQ ID NO: 3029959 - RNA, 17 nt, Mycobacterium avium subsp. paratuberculosis
gcaccgcgaccacgccg

SEQ ID NO: 3029960 - RNA, 23 nt, Mycobacterium avium subsp. paratuberculosis
gcaccgcgaccacgccgcggucg

SEQ ID NO: 3029961 - RNA, 14 nt, Mycobacterium avium subsp. paratuberculosis
gcaccgcgaccagc

SEQ ID NO: 3029962 - RNA, 15 nt, Mycobacterium avium subsp. paratuberculosis
gcaccgcgaccagcu

SEQ ID NO: 3029963 - RNA, 18 nt, Mycobacterium avium subsp. paratuberculosis
gcaccgcgaccagcucgg

SEQ ID NO: 3029964 - RNA, 16 nt, Mycobacterium avium subsp. paratuberculosis
gcaccgcgacccaggc

SEQ ID NO: 3029965 - RNA, 17 nt, Mycobacterium avium subsp. paratuberculosis
gcaccgcgacccaggcc

SEQ ID NO: 3029966 - RNA, 18 nt, Mycobacterium avium subsp. paratuberculosis
gcaccgcgacccaggccg

SEQ ID NO: 3029967 - RNA, 19 nt, Mycobacterium avium subsp. paratuberculosis
gcaccgcgacccaggccgc

SEQ ID NO: 3029968 - RNA, 20 nt, Mycobacterium avium subsp. paratuberculosis
gcaccgcgacccaggccgcc

SEQ ID NO: 3029969 - RNA, 17 nt, Mycobacterium avium subsp. paratuberculosis
gcaccgcgaccgguccg

SEQ ID NO: 3029970 - RNA, 17 nt, Mycobacterium avium subsp. paratuberculosis
gcaccgcgacgaucgcg

SEQ ID NO: 3029971 - RNA, 15 nt, Mycobacterium avium subsp. paratuberculosis
gcaccgcgagcaccg

SEQ ID NO: 3029972 - RNA, 15 nt, Mycobacterium avium subsp. paratuberculosis
gcaccgcgaucgccg

SEQ ID NO: 3029973 - RNA, 16 nt, Mycobacterium avium subsp. paratuberculosis
gcaccgcgaucgccga

SEQ ID NO: 3029974 - RNA, 22 nt, Mycobacterium avium subsp. paratuberculosis
gcaccgcgaucgccgacgucgg

SEQ ID NO: 3029975 - RNA, 17 nt, Mycobacterium avium subsp. paratuberculosis
gcaccgcgaucugcucg

SEQ ID NO: 3029976 - RNA, 19 nt, Mycobacterium avium subsp. paratuberculosis
gcaccgcgaucugcucggu

SEQ ID NO: 3029977 - RNA, 14 nt, Mycobacterium avium subsp. paratuberculosis
gcaccgcgauggcc

SEQ ID NO: 3029978 - RNA, 13 nt, Mycobacterium avium subsp. paratuberculosis
gcaccgcgcccgc

SEQ ID NO: 3029979 - RNA, 15 nt, Mycobacterium avium subsp. paratuberculosis
gcaccgcgcgcacca

SEQ ID NO: 3029980 - RNA, 13 nt, Mycobacterium avium subsp. paratuberculosis
gcaccgcgcgcca

SEQ ID NO: 3029981 - RNA, 16 nt, Mycobacterium avium subsp. paratuberculosis
gcaccgcgcgccaggu

SEQ ID NO: 3029982 - RNA, 13 nt, Mycobacterium avium subsp. paratuberculosis
gcaccgcgcggcg

SEQ ID NO: 3029983 - RNA, 17 nt, Mycobacterium avium subsp. paratuberculosis
gcaccgcgcggcggugc

SEQ ID NO: 3029984 - RNA, 19 nt, Mycobacterium avium subsp. paratuberculosis
gcaccgcgcguucgaguuc

SEQ ID NO: 3029985 - RNA, 18 nt, Mycobacterium avium subsp. paratuberculosis
gcaccgcgcucaccgcgg

SEQ ID NO: 3029986 - RNA, 17 nt, Mycobacterium avium subsp. paratuberculosis
gcaccgcggagcgcaac

SEQ ID NO: 3029987 - RNA, 22 nt, Mycobacterium avium subsp. paratuberculosis
gcaccgcggaggaauucgccga

SEQ ID NO: 3029988 - RNA, 23 nt, Mycobacterium avium subsp. paratuberculosis
gcaccgcggaggaauucgccgac

SEQ ID NO: 3029989 - RNA, 20 nt, Mycobacterium avium subsp. paratuberculosis
gcaccgcggauuccagcgcg

SEQ ID NO: 3029990 - RNA, 20 nt, Mycobacterium avium subsp. paratuberculosis
gcaccgcggccgucgcggcg

SEQ ID NO: 3029991 - RNA, 13 nt, Mycobacterium avium subsp. paratuberculosis
gcaccgcggccuc

SEQ ID NO: 3029992 - RNA, 16 nt, Mycobacterium avium subsp. paratuberculosis
gcaccgcggccucggc

SEQ ID NO: 3029993 - RNA, 17 nt, Mycobacterium avium subsp. paratuberculosis
gcaccgcggccucggcg

SEQ ID NO: 3029994 - RNA, 18 nt, Mycobacterium avium subsp. paratuberculosis
gcaccgcggccucggcgu

SEQ ID NO: 3029995 - RNA, 22 nt, Mycobacterium avium subsp. paratuberculosis
gcaccgcggcgaucgccguggu

SEQ ID NO: 3029996 - RNA, 15 nt, Mycobacterium avium subsp. paratuberculosis
gcaccgcggcgauga

SEQ ID NO: 3029997 - RNA, 22 nt, Mycobacterium avium subsp. paratuberculosis
gcaccgcggcgaugauccgcgg

SEQ ID NO: 3029998 - RNA, 23 nt, Mycobacterium avium subsp. paratuberculosis
gcaccgcggcgaugauccgcggc

SEQ ID NO: 3029999 - RNA, 14 nt, Mycobacterium avium subsp. paratuberculosis
gcaccgcggcgcgc

SEQ ID NO: 3030000 - RNA, 13 nt, Mycobacterium avium subsp. paratuberculosis
gcaccgcggcggg

SEQ ID NO: 3030001 - RNA, 20 nt, Mycobacterium avium subsp. paratuberculosis
gcaccgcggcguagcgccag

SEQ ID NO: 3030002 - RNA, 20 nt, Mycobacterium avium subsp. paratuberculosis
gcaccgcggcgugcgccagu

SEQ ID NO: 3030003 - RNA, 18 nt, Mycobacterium avium subsp. paratuberculosis
gcaccgcgggggcggccg

SEQ ID NO: 3030004 - RNA, 22 nt, Mycobacterium avium subsp. paratuberculosis
gcaccgcgggggcggccgggcc

SEQ ID NO: 3030005 - RNA, 23 nt, Mycobacterium avium subsp. paratuberculosis
gcaccgcgggggcggccgggccg

SEQ ID NO: 3030006 - RNA, 18 nt, Mycobacterium avium subsp. paratuberculosis
gcaccgcggucugcgcca

SEQ ID NO: 3030007 - RNA, 21 nt, Mycobacterium avium subsp. paratuberculosis
gcaccgcggucugcgccagcu

SEQ ID NO: 3030008 - RNA, 12 nt, Mycobacterium avium subsp. paratuberculosis
gcaccgcguccg

SEQ ID NO: 3030009 - RNA, 16 nt, Mycobacterium avium subsp. paratuberculosis
gcaccgcguccgcguc

SEQ ID NO: 3030010 - RNA, 12 nt, Mycobacterium avium subsp. paratuberculosis
gcaccgcgucga

SEQ ID NO: 3030011 - RNA, 14 nt, Mycobacterium avium subsp. paratuberculosis
gcaccgcgucgacc

SEQ ID NO: 3030012 - RNA, 21 nt, Mycobacterium avium subsp. paratuberculosis
gcaccgcgucgaccaccgccg

SEQ ID NO: 3030013 - RNA, 23 nt, Mycobacterium avium subsp. paratuberculosis
gcaccgcgucgaccaccgccggc

SEQ ID NO: 3030014 - RNA, 14 nt, Mycobacterium avium subsp. paratuberculosis
gcaccgcgucgaug

SEQ ID NO: 3030015 - RNA, 15 nt, Mycobacterium avium subsp. paratuberculosis
gcaccgcgucgaugc

SEQ ID NO: 3030016 - RNA, 17 nt, Mycobacterium avium subsp. paratuberculosis
gcaccgcgucgaugcgg

SEQ ID NO: 3030017 - RNA, 19 nt, Mycobacterium avium subsp. paratuberculosis
gcaccgcgucgaugcgggc

SEQ ID NO: 3030018 - RNA, 20 nt, Mycobacterium avium subsp. paratuberculosis
gcaccgcgucgaugucgucg

SEQ ID NO: 3030019 - RNA, 13 nt, Mycobacterium avium subsp. paratuberculosis
gcaccgcgucggc

SEQ ID NO: 3030020 - RNA, 15 nt, Mycobacterium avium subsp. paratuberculosis
gcaccgcgucggcgc

SEQ ID NO: 3030021 - RNA, 16 nt, Mycobacterium avium subsp. paratuberculosis
gcaccgcgucggcgcu

SEQ ID NO: 3030022 - RNA, 19 nt, Mycobacterium avium subsp. paratuberculosis
gcaccgcgucggcgcuggc

SEQ ID NO: 3030023 - RNA, 20 nt, Mycobacterium avium subsp. paratuberculosis
gcaccgcgucggcgcuggcc

SEQ ID NO: 3030024 - RNA, 12 nt, Mycobacterium avium subsp. paratuberculosis
gcaccgcgucgu

SEQ ID NO: 3030025 - RNA, 15 nt, Mycobacterium avium subsp. paratuberculosis
gcaccggaccgccga

SEQ ID NO: 3030026 - RNA, 17 nt, Mycobacterium avium subsp. paratuberculosis
gcaccggaccgccgaga

SEQ ID NO: 3030027 - RNA, 20 nt, Mycobacterium avium subsp. paratuberculosis
gcaccggacgcagcgaucgg

SEQ ID NO: 3030028 - RNA, 16 nt, Mycobacterium avium subsp. paratuberculosis
gcaccggagccuuggu

SEQ ID NO: 3030029 - RNA, 19 nt, Mycobacterium avium subsp. paratuberculosis
gcaccggagccuuggucgc

SEQ ID NO: 3030030 - RNA, 18 nt, Mycobacterium avium subsp. paratuberculosis
gcaccggaugcucaccgg

SEQ ID NO: 3030031 - RNA, 15 nt, Mycobacterium avium subsp. paratuberculosis
gcaccggcaccgcca

SEQ ID NO: 3030032 - RNA, 18 nt, Mycobacterium avium subsp. paratuberculosis
gcaccggcaccgccagcc

SEQ ID NO: 3030033 - RNA, 21 nt, Mycobacterium avium subsp. paratuberculosis
gcaccggcaccgccagccacc

SEQ ID NO: 3030034 - RNA, 15 nt, Mycobacterium avium subsp. paratuberculosis
gcaccggcaccgccc

SEQ ID NO: 3030035 - RNA, 16 nt, Mycobacterium avium subsp. paratuberculosis
gcaccggcaccgcccc

SEQ ID NO: 3030036 - RNA, 19 nt, Mycobacterium avium subsp. paratuberculosis
gcaccggcaccgcccccgc

SEQ ID NO: 3030037 - RNA, 14 nt, Mycobacterium avium subsp. paratuberculosis
gcaccggcaccgcg

SEQ ID NO: 3030038 - RNA, 15 nt, Mycobacterium avium subsp. paratuberculosis
gcaccggcaccgcgg

SEQ ID NO: 3030039 - RNA, 17 nt, Mycobacterium avium subsp. paratuberculosis
gcaccggcaccgcggcg

SEQ ID NO: 3030040 - RNA, 16 nt, Mycobacterium avium subsp. paratuberculosis
gcaccggcaccgcggu

SEQ ID NO: 3030041 - RNA, 15 nt, Mycobacterium avium subsp. paratuberculosis
gcaccggcagcaccg

SEQ ID NO: 3030042 - RNA, 19 nt, Mycobacterium avium subsp. paratuberculosis
gcaccggcagcaccgccga

SEQ ID NO: 3030043 - RNA, 14 nt, Mycobacterium avium subsp. paratuberculosis
gcaccggcagccgc

SEQ ID NO: 3030044 - RNA, 17 nt, Mycobacterium avium subsp. paratuberculosis
gcaccggcagccgcagc

SEQ ID NO: 3030045 - RNA, 21 nt, Mycobacterium avium subsp. paratuberculosis
gcaccggcagugaucggcgga

SEQ ID NO: 3030046 - RNA, 12 nt, Mycobacterium avium subsp. paratuberculosis
gcaccggccggc

SEQ ID NO: 3030047 - RNA, 15 nt, Mycobacterium avium subsp. paratuberculosis
gcaccggccggcccc

SEQ ID NO: 3030048 - RNA, 16 nt, Mycobacterium avium subsp. paratuberculosis
gcaccggccggccccg

SEQ ID NO: 3030049 - RNA, 14 nt, Mycobacterium avium subsp. paratuberculosis
gcaccggcgacggc

SEQ ID NO: 3030050 - RNA, 15 nt, Mycobacterium avium subsp. paratuberculosis
gcaccggcgacggcg

SEQ ID NO: 3030051 - RNA, 20 nt, Mycobacterium avium subsp. paratuberculosis
gcaccggcgacggcgguucg

SEQ ID NO: 3030052 - RNA, 16 nt, Mycobacterium avium subsp. paratuberculosis
gcaccggcgaguccgc

SEQ ID NO: 3030053 - RNA, 20 nt, Mycobacterium avium subsp. paratuberculosis
gcaccggcgaguccgcggag

SEQ ID NO: 3030054 - RNA, 13 nt, Mycobacterium avium subsp. paratuberculosis
gcaccggcgccau

SEQ ID NO: 3030055 - RNA, 12 nt, Mycobacterium avium subsp. paratuberculosis
gcaccggcgccg

SEQ ID NO: 3030056 - RNA, 15 nt, Mycobacterium avium subsp. paratuberculosis
gcaccggcgccgcca

SEQ ID NO: 3030057 - RNA, 16 nt, Mycobacterium avium subsp. paratuberculosis
gcaccggcgccgccac

SEQ ID NO: 3030058 - RNA, 12 nt, Mycobacterium avium subsp. paratuberculosis
gcaccggcgccu

SEQ ID NO: 3030059 - RNA, 15 nt, Mycobacterium avium subsp. paratuberculosis
gcaccggcgcgccgc

SEQ ID NO: 3030060 - RNA, 21 nt, Mycobacterium avium subsp. paratuberculosis
gcaccggcgcgccgcguucgg

SEQ ID NO: 3030061 - RNA, 13 nt, Mycobacterium avium subsp. paratuberculosis
gcaccggcgcugg

SEQ ID NO: 3030062 - RNA, 23 nt, Mycobacterium avium subsp. paratuberculosis
gcaccggcgcugguaguggcgug

SEQ ID NO: 3030063 - RNA, 19 nt, Mycobacterium avium subsp. paratuberculosis
gcaccggcggcagcgacuc

SEQ ID NO: 3030064 - RNA, 15 nt, Mycobacterium avium subsp. paratuberculosis
gcaccggcgucgaca

SEQ ID NO: 3030065 - RNA, 18 nt, Mycobacterium avium subsp. paratuberculosis
gcaccggcgucgacagcc

SEQ ID NO: 3030066 - RNA, 17 nt, Mycobacterium avium subsp. paratuberculosis
gcaccggcugccccagg

SEQ ID NO: 3030067 - RNA, 18 nt, Mycobacterium avium subsp. paratuberculosis
gcaccggcugccccaggg

SEQ ID NO: 3030068 - RNA, 13 nt, Mycobacterium avium subsp. paratuberculosis
gcaccggcuggcc

SEQ ID NO: 3030069 - RNA, 15 nt, Mycobacterium avium subsp. paratuberculosis
gcaccggcuggccga

SEQ ID NO: 3030070 - RNA, 20 nt, Mycobacterium avium subsp. paratuberculosis
gcaccggcuggccgagcggc

SEQ ID NO: 3030071 - RNA, 22 nt, Mycobacterium avium subsp. paratuberculosis
gcaccggcuggccgagcggcug

SEQ ID NO: 3030072 - RNA, 15 nt, Mycobacterium avium subsp. paratuberculosis
gcaccggcuggucgg

SEQ ID NO: 3030073 - RNA, 14 nt, Mycobacterium avium subsp. paratuberculosis
gcaccggcuggugc

SEQ ID NO: 3030074 - RNA, 17 nt, Mycobacterium avium subsp. paratuberculosis
gcaccggcuggugcagc

SEQ ID NO: 3030075 - RNA, 21 nt, Mycobacterium avium subsp. paratuberculosis
gcaccgggaaggugucggccg

SEQ ID NO: 3030076 - RNA, 15 nt, Mycobacterium avium subsp. paratuberculosis
gcaccgggaccagcg

SEQ ID NO: 3030077 - RNA, 19 nt, Mycobacterium avium subsp. paratuberculosis
gcaccgggaccagcgcggu

SEQ ID NO: 3030078 - RNA, 23 nt, Mycobacterium avium subsp. paratuberculosis
gcaccgggacgggucggugguuc

SEQ ID NO: 3030079 - RNA, 14 nt, Mycobacterium avium subsp. paratuberculosis
gcaccgggcccagc

SEQ ID NO: 3030080 - RNA, 16 nt, Mycobacterium avium subsp. paratuberculosis
gcaccgggcccagcuc

SEQ ID NO: 3030081 - RNA, 21 nt, Mycobacterium avium subsp. paratuberculosis
gcaccgggcccagcucgguga

SEQ ID NO: 3030082 - RNA, 14 nt, Mycobacterium avium subsp. paratuberculosis
gcaccgggcccgcc

SEQ ID NO: 3030083 - RNA, 20 nt, Mycobacterium avium subsp. paratuberculosis
gcaccgggcccgcccgcagc

SEQ ID NO: 3030084 - RNA, 23 nt, Mycobacterium avium subsp. paratuberculosis
gcaccgggccgaaggcggcgccg

SEQ ID NO: 3030085 - RNA, 13 nt, Mycobacterium avium subsp. paratuberculosis
gcaccgggcgucg

SEQ ID NO: 3030086 - RNA, 19 nt, Mycobacterium avium subsp. paratuberculosis
gcaccgggcgucggggccc

SEQ ID NO: 3030087 - RNA, 19 nt, Mycobacterium avium subsp. paratuberculosis
gcaccgggcugucgggcag

SEQ ID NO: 3030088 - RNA, 23 nt, Mycobacterium avium subsp. paratuberculosis
gcaccgggcugucgggcaggccg

SEQ ID NO: 3030089 - RNA, 20 nt, Mycobacterium avium subsp. paratuberculosis
gcaccggggccaacuccggc

SEQ ID NO: 3030090 - RNA, 21 nt, Mycobacterium avium subsp. paratuberculosis
gcaccggggccaacuccggcg

SEQ ID NO: 3030091 - RNA, 22 nt, Mycobacterium avium subsp. paratuberculosis
gcaccggggucugcacgaugcc

SEQ ID NO: 3030092 - RNA, 23 nt, Mycobacterium avium subsp. paratuberculosis
gcaccggggucugcacgaugccg

SEQ ID NO: 3030093 - RNA, 19 nt, Mycobacterium avium subsp. paratuberculosis
gcaccggguacaccggcuc

SEQ ID NO: 3030094 - RNA, 22 nt, Mycobacterium avium subsp. paratuberculosis
gcaccggguacaccggcucgcu

SEQ ID NO: 3030095 - RNA, 22 nt, Mycobacterium avium subsp. paratuberculosis
gcaccgggugauaccggcccag

SEQ ID NO: 3030096 - RNA, 23 nt, Mycobacterium avium subsp. paratuberculosis
gcaccgggugauaccggcccagc

SEQ ID NO: 3030097 - RNA, 14 nt, Mycobacterium avium subsp. paratuberculosis
gcaccggucagcgc

SEQ ID NO: 3030098 - RNA, 17 nt, Mycobacterium avium subsp. paratuberculosis
gcaccggugcaccgcgc

SEQ ID NO: 3030099 - RNA, 19 nt, Mycobacterium avium subsp. paratuberculosis
gcaccggugcaccgcgcgc

SEQ ID NO: 3030100 - RNA, 20 nt, Mycobacterium avium subsp. paratuberculosis
gcaccggugcaccgcgcgca

SEQ ID NO: 3030101 - RNA, 18 nt, Mycobacterium avium subsp. paratuberculosis
gcaccggugcggcgguga

SEQ ID NO: 3030102 - RNA, 21 nt, Mycobacterium avium subsp. paratuberculosis
gcaccgucaccgccuccuggc

SEQ ID NO: 3030103 - RNA, 16 nt, Mycobacterium avium subsp. paratuberculosis
gcaccgucagccaggu

SEQ ID NO: 3030104 - RNA, 17 nt, Mycobacterium avium subsp. paratuberculosis
gcaccgucaucgcggcg

SEQ ID NO: 3030105 - RNA, 21 nt, Mycobacterium avium subsp. paratuberculosis
gcaccgucaucgcggcgaaca

SEQ ID NO: 3030106 - RNA, 14 nt, Mycobacterium avium subsp. paratuberculosis
gcaccguccacagc

SEQ ID NO: 3030107 - RNA, 16 nt, Mycobacterium avium subsp. paratuberculosis
gcaccguccacagccg

SEQ ID NO: 3030108 - RNA, 20 nt, Mycobacterium avium subsp. paratuberculosis
gcaccguccacagccggcgg

SEQ ID NO: 3030109 - RNA, 13 nt, Mycobacterium avium subsp. paratuberculosis
gcaccgucgccgg

SEQ ID NO: 3030110 - RNA, 15 nt, Mycobacterium avium subsp. paratuberculosis
gcaccgucgccggcg

SEQ ID NO: 3030111 - RNA, 17 nt, Mycobacterium avium subsp. paratuberculosis
gcaccgucgccggcggg

SEQ ID NO: 3030112 - RNA, 20 nt, Mycobacterium avium subsp. paratuberculosis
gcaccgucgccggcggggcg

SEQ ID NO: 3030113 - RNA, 15 nt, Mycobacterium avium subsp. paratuberculosis
gcaccgucgucgcac

SEQ ID NO: 3030114 - RNA, 17 nt, Mycobacterium avium subsp. paratuberculosis
gcaccgucgucgcaccg

SEQ ID NO: 3030115 - RNA, 19 nt, Mycobacterium avium subsp. paratuberculosis
gcaccgucgucgcaccggc

SEQ ID NO: 3030116 - RNA, 17 nt, Mycobacterium avium subsp. paratuberculosis
gcaccgucgugccagcg

SEQ ID NO: 3030117 - RNA, 18 nt, Mycobacterium avium subsp. paratuberculosis
gcaccgucgugccagcgc

SEQ ID NO: 3030118 - RNA, 14 nt, Mycobacterium avium subsp. paratuberculosis
gcaccgucugcgcc

SEQ ID NO: 3030119 - RNA, 21 nt, Mycobacterium avium subsp. paratuberculosis
gcaccgucugcgccgucaccg

SEQ ID NO: 3030120 - RNA, 22 nt, Mycobacterium avium subsp. paratuberculosis
gcaccgucugcgccgucaccgg

SEQ ID NO: 3030121 - RNA, 14 nt, Mycobacterium avium subsp. paratuberculosis
gcaccgugccgccc

SEQ ID NO: 3030122 - RNA, 14 nt, Mycobacterium avium subsp. paratuberculosis
gcaccgugccgcgc

SEQ ID NO: 3030123 - RNA, 15 nt, Mycobacterium avium subsp. paratuberculosis
gcaccgugccgcgcg

SEQ ID NO: 3030124 - RNA, 17 nt, Mycobacterium avium subsp. paratuberculosis
gcaccgugccgcgcggc

SEQ ID NO: 3030125 - RNA, 19 nt, Mycobacterium avium subsp. paratuberculosis
gcaccgugccgcgcggcgg

SEQ ID NO: 3030126 - RNA, 20 nt, Mycobacterium avium subsp. paratuberculosis
gcaccgugccgcgcggcggu

SEQ ID NO: 3030127 - RNA, 13 nt, Mycobacterium avium subsp. paratuberculosis
gcaccgugccguc

SEQ ID NO: 3030128 - RNA, 17 nt, Mycobacterium avium subsp. paratuberculosis
gcaccgugccgucggcg

SEQ ID NO: 3030129 - RNA, 20 nt, Mycobacterium avium subsp. paratuberculosis
gcaccgugcugauccacgcc

SEQ ID NO: 3030130 - RNA, 17 nt, Mycobacterium avium subsp. paratuberculosis
gcaccgugcugugcugc

SEQ ID NO: 3030131 - RNA, 18 nt, Mycobacterium avium subsp. paratuberculosis
gcaccguggugacccgga

SEQ ID NO: 3030132 - RNA, 15 nt, Mycobacterium avium subsp. paratuberculosis
gcaccguguagccga

SEQ ID NO: 3030133 - RNA, 17 nt, Mycobacterium avium subsp. paratuberculosis
gcaccguguagccgacc

SEQ ID NO: 3030134 - RNA, 18 nt, Mycobacterium avium subsp. paratuberculosis
gcaccgugucgucgcuga

SEQ ID NO: 3030135 - RNA, 24 nt, Mycobacterium avium subsp. paratuberculosis
gcaccguugugacccgcucgggcg

SEQ ID NO: 3030136 - RNA, 16 nt, Mycobacterium avium subsp. paratuberculosis
gcaccguuuccggugc

SEQ ID NO: 3030137 - RNA, 14 nt, Mycobacterium avium subsp. paratuberculosis
gcaccuccagcccg

SEQ ID NO: 3030138 - RNA, 20 nt, Mycobacterium avium subsp. paratuberculosis
gcaccuccaguugcgacccc

SEQ ID NO: 3030139 - RNA, 21 nt, Mycobacterium avium subsp. paratuberculosis
gcaccuccaguugcgaccccg

SEQ ID NO: 3030140 - RNA, 15 nt, Mycobacterium avium subsp. paratuberculosis
gcaccuccgacagcc

SEQ ID NO: 3030141 - RNA, 20 nt, Mycobacterium avium subsp. paratuberculosis
gcaccuccgacaucaggccc

SEQ ID NO: 3030142 - RNA, 15 nt, Mycobacterium avium subsp. paratuberculosis
gcaccuccugcaccc

SEQ ID NO: 3030143 - RNA, 14 nt, Mycobacterium avium subsp. paratuberculosis
gcaccucgaagccg

SEQ ID NO: 3030144 - RNA, 15 nt, Mycobacterium avium subsp. paratuberculosis
gcaccucgaagccga

SEQ ID NO: 3030145 - RNA, 23 nt, Mycobacterium avium subsp. paratuberculosis
gcaccucgaagggcgccagccgu

SEQ ID NO: 3030146 - RNA, 12 nt, Mycobacterium avium subsp. paratuberculosis
gcaccucgacga

SEQ ID NO: 3030147 - RNA, 21 nt, Mycobacterium avium subsp. paratuberculosis
gcaccucgaucaccgggcggc

SEQ ID NO: 3030148 - RNA, 14 nt, Mycobacterium avium subsp. paratuberculosis
gcaccucgaugccg

SEQ ID NO: 3030149 - RNA, 21 nt, Mycobacterium avium subsp. paratuberculosis
gcaccucgaugccgugccggu

SEQ ID NO: 3030150 - RNA, 14 nt, Mycobacterium avium subsp. paratuberculosis
gcaccucgcccggc

SEQ ID NO: 3030151 - RNA, 14 nt, Mycobacterium avium subsp. paratuberculosis
gcaccucgcccugc

SEQ ID NO: 3030152 - RNA, 16 nt, Mycobacterium avium subsp. paratuberculosis
gcaccucgcccugcag

SEQ ID NO: 3030153 - RNA, 19 nt, Mycobacterium avium subsp. paratuberculosis
gcaccucgcccugcagcgc

SEQ ID NO: 3030154 - RNA, 21 nt, Mycobacterium avium subsp. paratuberculosis
gcaccucgcccugcagcgcga

SEQ ID NO: 3030155 - RNA, 21 nt, Mycobacterium avium subsp. paratuberculosis
gcaccucgccgaucucgacca

SEQ ID NO: 3030156 - RNA, 13 nt, Mycobacterium avium subsp. paratuberculosis
gcaccucgccggc

SEQ ID NO: 3030157 - RNA, 17 nt, Mycobacterium avium subsp. paratuberculosis
gcaccucgccggccgcc

SEQ ID NO: 3030158 - RNA, 13 nt, Mycobacterium avium subsp. paratuberculosis
gcaccucgcgcag

SEQ ID NO: 3030159 - RNA, 19 nt, Mycobacterium avium subsp. paratuberculosis
gcaccucgcgcagcaccga

SEQ ID NO: 3030160 - RNA, 23 nt, Mycobacterium avium subsp. paratuberculosis
gcaccucgcgcagcaccgaugcc

SEQ ID NO: 3030161 - RNA, 12 nt, Mycobacterium avium subsp. paratuberculosis
gcaccucgcgcg

SEQ ID NO: 3030162 - RNA, 17 nt, Mycobacterium avium subsp. paratuberculosis
gcaccucgcgcgcgagc

SEQ ID NO: 3030163 - RNA, 15 nt, Mycobacterium avium subsp. paratuberculosis
gcaccucgcggcagc

SEQ ID NO: 3030164 - RNA, 17 nt, Mycobacterium avium subsp. paratuberculosis
gcaccucgcggcagccu

SEQ ID NO: 3030165 - RNA, 18 nt, Mycobacterium avium subsp. paratuberculosis
gcaccucgcggcagccuu

SEQ ID NO: 3030166 - RNA, 19 nt, Mycobacterium avium subsp. paratuberculosis
gcaccucgcucagcccgga

SEQ ID NO: 3030167 - RNA, 21 nt, Mycobacterium avium subsp. paratuberculosis
gcaccucgcuggcggcgcggu

SEQ ID NO: 3030168 - RNA, 12 nt, Mycobacterium avium subsp. paratuberculosis
gcaccucggccg

SEQ ID NO: 3030169 - RNA, 14 nt, Mycobacterium avium subsp. paratuberculosis
gcaccucggcgacc

SEQ ID NO: 3030170 - RNA, 18 nt, Mycobacterium avium subsp. paratuberculosis
gcaccucgggaugggcau

SEQ ID NO: 3030171 - RNA, 12 nt, Mycobacterium avium subsp. paratuberculosis
gcaccucgucgc

SEQ ID NO: 3030172 - RNA, 13 nt, Mycobacterium avium subsp. paratuberculosis
gcaccucgucgcc

SEQ ID NO: 3030173 - RNA, 18 nt, Mycobacterium avium subsp. paratuberculosis
gcaccucgucgcccggcg

SEQ ID NO: 3030174 - RNA, 15 nt, Mycobacterium avium subsp. paratuberculosis
gcaccucgucgccgu

SEQ ID NO: 3030175 - RNA, 17 nt, Mycobacterium avium subsp. paratuberculosis
gcaccucgucgccgucg

SEQ ID NO: 3030176 - RNA, 19 nt, Mycobacterium avium subsp. paratuberculosis
gcaccucgucgccgucggg

SEQ ID NO: 3030177 - RNA, 23 nt, Mycobacterium avium subsp. paratuberculosis
gcaccucucgggaaacgcgucgc

SEQ ID NO: 3030178 - RNA, 23 nt, Mycobacterium avium subsp. paratuberculosis
gcaccucuucgaaagccacccgc

SEQ ID NO: 3030179 - RNA, 17 nt, Mycobacterium avium subsp. paratuberculosis
gcaccugaaccgcgcac

SEQ ID NO: 3030180 - RNA, 21 nt, Mycobacterium avium subsp. paratuberculosis
gcaccugaaccgcgcacucga

SEQ ID NO: 3030181 - RNA, 19 nt, Mycobacterium avium subsp. paratuberculosis
gcaccugaccgucggccag

SEQ ID NO: 3030182 - RNA, 20 nt, Mycobacterium avium subsp. paratuberculosis
gcaccugaccgucggccaga

SEQ ID NO: 3030183 - RNA, 21 nt, Mycobacterium avium subsp. paratuberculosis
gcaccugauaggggucggcga

SEQ ID NO: 3030184 - RNA, 22 nt, Mycobacterium avium subsp. paratuberculosis
gcaccugauaggggucggcgaa

SEQ ID NO: 3030185 - RNA, 16 nt, Mycobacterium avium subsp. paratuberculosis
gcaccugaucgaugcc

SEQ ID NO: 3030186 - RNA, 21 nt, Mycobacterium avium subsp. paratuberculosis
gcaccugaucgaugccguggu

SEQ ID NO: 3030187 - RNA, 15 nt, Mycobacterium avium subsp. paratuberculosis
gcaccugcagccggu

SEQ ID NO: 3030188 - RNA, 18 nt, Mycobacterium avium subsp. paratuberculosis
gcaccugcagccggucgg

SEQ ID NO: 3030189 - RNA, 12 nt, Mycobacterium avium subsp. paratuberculosis
gcaccugccguc

SEQ ID NO: 3030190 - RNA, 19 nt, Mycobacterium avium subsp. paratuberculosis
gcaccugcgcgccguuggu

SEQ ID NO: 3030191 - RNA, 13 nt, Mycobacterium avium subsp. paratuberculosis
gcaccugcggcag

SEQ ID NO: 3030192 - RNA, 19 nt, Mycobacterium avium subsp. paratuberculosis
gcaccugcucgaugcgcgc

SEQ ID NO: 3030193 - RNA, 21 nt, Mycobacterium avium subsp. paratuberculosis
gcaccugcucgaugcgcgcca

SEQ ID NO: 3030194 - RNA, 21 nt, Mycobacterium avium subsp. paratuberculosis
gcaccugcuuggucuccggcc

SEQ ID NO: 3030195 - RNA, 23 nt, Mycobacterium avium subsp. paratuberculosis
gcaccugcuuggucuccggcccc

SEQ ID NO: 3030196 - RNA, 14 nt, Mycobacterium avium subsp. paratuberculosis
gcaccuggauccag

SEQ ID NO: 3030197 - RNA, 17 nt, Mycobacterium avium subsp. paratuberculosis
gcaccuggauccaguuc

SEQ ID NO: 3030198 - RNA, 17 nt, Mycobacterium avium subsp. paratuberculosis
gcaccuggcagcauccg

SEQ ID NO: 3030199 - RNA, 18 nt, Mycobacterium avium subsp. paratuberculosis
gcaccuggcagcauccgc

SEQ ID NO: 3030200 - RNA, 12 nt, Mycobacterium avium subsp. paratuberculosis
gcaccuggccgu

SEQ ID NO: 3030201 - RNA, 16 nt, Mycobacterium avium subsp. paratuberculosis
gcaccuggccgucggu

SEQ ID NO: 3030202 - RNA, 21 nt, Mycobacterium avium subsp. paratuberculosis
gcaccuggccgucgguggccg

SEQ ID NO: 3030203 - RNA, 18 nt, Mycobacterium avium subsp. paratuberculosis
gcaccuggcgcaccgccg

SEQ ID NO: 3030204 - RNA, 14 nt, Mycobacterium avium subsp. paratuberculosis
gcaccuggcgcagc

SEQ ID NO: 3030205 - RNA, 15 nt, Mycobacterium avium subsp. paratuberculosis
gcaccuggcgcagca

SEQ ID NO: 3030206 - RNA, 17 nt, Mycobacterium avium subsp. paratuberculosis
gcaccuggcgcagcacc

SEQ ID NO: 3030207 - RNA, 19 nt, Mycobacterium avium subsp. paratuberculosis
gcaccuggcgcagcaccga

SEQ ID NO: 3030208 - RNA, 21 nt, Mycobacterium avium subsp. paratuberculosis
gcaccuggucggucagcucga

SEQ ID NO: 3030209 - RNA, 22 nt, Mycobacterium avium subsp. paratuberculosis
gcaccugugaggcaccgaacgc

SEQ ID NO: 3030210 - RNA, 16 nt, Mycobacterium avium subsp. paratuberculosis
gcaccuucaccgacca

SEQ ID NO: 3030211 - RNA, 15 nt, Mycobacterium avium subsp. paratuberculosis
gcaccuucagcgggc

SEQ ID NO: 3030212 - RNA, 18 nt, Mycobacterium avium subsp. paratuberculosis
gcaccuucagcgggcgca

SEQ ID NO: 3030213 - RNA, 19 nt, Mycobacterium avium subsp. paratuberculosis
gcaccuucagcgggcgcag

SEQ ID NO: 3030214 - RNA, 15 nt, Mycobacterium avium subsp. paratuberculosis
gcaccuugcgcccgu

SEQ ID NO: 3030215 - RNA, 16 nt, Mycobacterium avium subsp. paratuberculosis
gcaccuuggucagcuc

SEQ ID NO: 3030216 - RNA, 18 nt, Mycobacterium avium subsp. paratuberculosis
gcaccuuggucagcuccc

SEQ ID NO: 3030217 - RNA, 16 nt, Mycobacterium avium subsp. paratuberculosis
gcacgaaaccgcgugg

SEQ ID NO: 3030218 - RNA, 21 nt, Mycobacterium avium subsp. paratuberculosis
gcacgaaaccguggaagucgc

SEQ ID NO: 3030219 - RNA, 22 nt, Mycobacterium avium subsp. paratuberculosis
gcacgaaauaaccgcgcggcgc

SEQ ID NO: 3030220 - RNA, 20 nt, Mycobacterium avium subsp. paratuberculosis
gcacgaaaugcgggcgaugg

SEQ ID NO: 3030221 - RNA, 13 nt, Mycobacterium avium subsp. paratuberculosis
gcacgaacaacug

SEQ ID NO: 3030222 - RNA, 13 nt, Mycobacterium avium subsp. paratuberculosis
gcacgaacaccac

SEQ ID NO: 3030223 - RNA, 15 nt, Mycobacterium avium subsp. paratuberculosis
gcacgaacaccacgu

SEQ ID NO: 3030224 - RNA, 15 nt, Mycobacterium avium subsp. paratuberculosis
gcacgaacagcagcg

SEQ ID NO: 3030225 - RNA, 18 nt, Mycobacterium avium subsp. paratuberculosis
gcacgaacagcagcggga

SEQ ID NO: 3030226 - RNA, 22 nt, Mycobacterium avium subsp. paratuberculosis
gcacgaaccgcucgaacacccg

SEQ ID NO: 3030227 - RNA, 21 nt, Mycobacterium avium subsp. paratuberculosis
gcacgaacgcggccagcgggc

SEQ ID NO: 3030228 - RNA, 15 nt, Mycobacterium avium subsp. paratuberculosis
gcacgaacgcggccg

SEQ ID NO: 3030229 - RNA, 18 nt, Mycobacterium avium subsp. paratuberculosis
gcacgaacgcggccgcca

SEQ ID NO: 3030230 - RNA, 19 nt, Mycobacterium avium subsp. paratuberculosis
gcacgaacgcggccgccau

SEQ ID NO: 3030231 - RNA, 17 nt, Mycobacterium avium subsp. paratuberculosis
gcacgaagaaggcuccg

SEQ ID NO: 3030232 - RNA, 14 nt, Mycobacterium avium subsp. paratuberculosis
gcacgaaggccgcc

SEQ ID NO: 3030233 - RNA, 16 nt, Mycobacterium avium subsp. paratuberculosis
gcacgaaguacagcgu

SEQ ID NO: 3030234 - RNA, 13 nt, Mycobacterium avium subsp. paratuberculosis
gcacgaagucgac

SEQ ID NO: 3030235 - RNA, 18 nt, Mycobacterium avium subsp. paratuberculosis
gcacgaagucgaccgcgg

SEQ ID NO: 3030236 - RNA, 20 nt, Mycobacterium avium subsp. paratuberculosis
gcacgaagucgaccgcggcu

SEQ ID NO: 3030237 - RNA, 21 nt, Mycobacterium avium subsp. paratuberculosis
gcacgaagucgaccgcggcuc

SEQ ID NO: 3030238 - RNA, 23 nt, Mycobacterium avium subsp. paratuberculosis
gcacgaagucgaccgcggcuccg

SEQ ID NO: 3030239 - RNA, 22 nt, Mycobacterium avium subsp. paratuberculosis
gcacgaauucgguggcgauggu

SEQ ID NO: 3030240 - RNA, 12 nt, Mycobacterium avium subsp. paratuberculosis
gcacgacaccga

SEQ ID NO: 3030241 - RNA, 16 nt, Mycobacterium avium subsp. paratuberculosis
gcacgacaccgacgac

SEQ ID NO: 3030242 - RNA, 17 nt, Mycobacterium avium subsp. paratuberculosis
gcacgacaccgacgacc

SEQ ID NO: 3030243 - RNA, 18 nt, Mycobacterium avium subsp. paratuberculosis
gcacgacaccgacgacca

SEQ ID NO: 3030244 - RNA, 16 nt, Mycobacterium avium subsp. paratuberculosis
gcacgaccacacccgc

SEQ ID NO: 3030245 - RNA, 19 nt, Mycobacterium avium subsp. paratuberculosis
gcacgaccaugucggcgac

SEQ ID NO: 3030246 - RNA, 22 nt, Mycobacterium avium subsp. paratuberculosis
gcacgaccaugucggcgacccg

SEQ ID NO: 3030247 - RNA, 18 nt, Mycobacterium avium subsp. paratuberculosis
gcacgaccccgcccacga

SEQ ID NO: 3030248 - RNA, 14 nt, Mycobacterium avium subsp. paratuberculosis
gcacgaccgccagc

SEQ ID NO: 3030249 - RNA, 18 nt, Mycobacterium avium subsp. paratuberculosis
gcacgacgaacaccaccg

SEQ ID NO: 3030250 - RNA, 20 nt, Mycobacterium avium subsp. paratuberculosis
gcacgacgaacaccaccggc

SEQ ID NO: 3030251 - RNA, 21 nt, Mycobacterium avium subsp. paratuberculosis
gcacgacgaacaccaccggca

SEQ ID NO: 3030252 - RNA, 19 nt, Mycobacterium avium subsp. paratuberculosis
gcacgacgaccgcgacggc

SEQ ID NO: 3030253 - RNA, 15 nt, Mycobacterium avium subsp. paratuberculosis
gcacgacgaccgcgu

SEQ ID NO: 3030254 - RNA, 14 nt, Mycobacterium avium subsp. paratuberculosis
gcacgacgccgccg

SEQ ID NO: 3030255 - RNA, 15 nt, Mycobacterium avium subsp. paratuberculosis
gcacgacgccgccga

SEQ ID NO: 3030256 - RNA, 16 nt, Mycobacterium avium subsp. paratuberculosis
gcacgacgccgccgag

SEQ ID NO: 3030257 - RNA, 18 nt, Mycobacterium avium subsp. paratuberculosis
gcacgacgccgcugggcg

SEQ ID NO: 3030258 - RNA, 17 nt, Mycobacterium avium subsp. paratuberculosis
gcacgacggucagcacg

SEQ ID NO: 3030259 - RNA, 13 nt, Mycobacterium avium subsp. paratuberculosis
gcacgacgucgac

SEQ ID NO: 3030260 - RNA, 21 nt, Mycobacterium avium subsp. paratuberculosis
gcacgagcgaacacgugcagc

SEQ ID NO: 3030261 - RNA, 23 nt, Mycobacterium avium subsp. paratuberculosis
gcacgagcgucgugcgggcuccg

SEQ ID NO: 3030262 - RNA, 18 nt, Mycobacterium avium subsp. paratuberculosis
gcacgaucagggugucga

SEQ ID NO: 3030263 - RNA, 19 nt, Mycobacterium avium subsp. paratuberculosis
gcacgaucccgccgcccgc

SEQ ID NO: 3030264 - RNA, 22 nt, Mycobacterium avium subsp. paratuberculosis
gcacgaucgcggugacgcgccg

SEQ ID NO: 3030265 - RNA, 13 nt, Mycobacterium avium subsp. paratuberculosis
gcacgaucggcag

SEQ ID NO: 3030266 - RNA, 17 nt, Mycobacterium avium subsp. paratuberculosis
gcacgaucggcagcgcc

SEQ ID NO: 3030267 - RNA, 20 nt, Mycobacterium avium subsp. paratuberculosis
gcacgaucggcagcgccaac

SEQ ID NO: 3030268 - RNA, 21 nt, Mycobacterium avium subsp. paratuberculosis
gcacgaucggcagcgccaaca

SEQ ID NO: 3030269 - RNA, 23 nt, Mycobacterium avium subsp. paratuberculosis
gcacgaucggguagacgucgggc

SEQ ID NO: 3030270 - RNA, 18 nt, Mycobacterium avium subsp. paratuberculosis
gcacgaucgucgccgcca

SEQ ID NO: 3030271 - RNA, 23 nt, Mycobacterium avium subsp. paratuberculosis
gcacgaucgucgccgccaacgcg

SEQ ID NO: 3030272 - RNA, 15 nt, Mycobacterium avium subsp. paratuberculosis
gcacgaucucgacca

SEQ ID NO: 3030273 - RNA, 16 nt, Mycobacterium avium subsp. paratuberculosis
gcacgaucucgaccag

SEQ ID NO: 3030274 - RNA, 15 nt, Mycobacterium avium subsp. paratuberculosis
gcacgaucucggcgg

SEQ ID NO: 3030275 - RNA, 16 nt, Mycobacterium avium subsp. paratuberculosis
gcacgaucucggcggu

SEQ ID NO: 3030276 - RNA, 17 nt, Mycobacterium avium subsp. paratuberculosis
gcacgaucucggcgguc

SEQ ID NO: 3030277 - RNA, 22 nt, Mycobacterium avium subsp. paratuberculosis
gcacgaucucggcggucuuugc

SEQ ID NO: 3030278 - RNA, 16 nt, Mycobacterium avium subsp. paratuberculosis
gcacgaucugcaggcc

SEQ ID NO: 3030279 - RNA, 17 nt, Mycobacterium avium subsp. paratuberculosis
gcacgaucugcaggccg

SEQ ID NO: 3030280 - RNA, 16 nt, Mycobacterium avium subsp. paratuberculosis
gcacgaugaacuccuc

SEQ ID NO: 3030281 - RNA, 16 nt, Mycobacterium avium subsp. paratuberculosis
gcacgaugacgaccgg

SEQ ID NO: 3030282 - RNA, 17 nt, Mycobacterium avium subsp. paratuberculosis
gcacgaugacgaccggg

SEQ ID NO: 3030283 - RNA, 18 nt, Mycobacterium avium subsp. paratuberculosis
gcacgaugacgaccgggu

SEQ ID NO: 3030284 - RNA, 17 nt, Mycobacterium avium subsp. paratuberculosis
gcacgaugccgcgcucg

SEQ ID NO: 3030285 - RNA, 15 nt, Mycobacterium avium subsp. paratuberculosis
gcacgauggacgccc

SEQ ID NO: 3030286 - RNA, 17 nt, Mycobacterium avium subsp. paratuberculosis
gcacgauggcgcggcgc

SEQ ID NO: 3030287 - RNA, 20 nt, Mycobacterium avium subsp. paratuberculosis
gcacgcaaaaaccaugccag

SEQ ID NO: 3030288 - RNA, 22 nt, Mycobacterium avium subsp. paratuberculosis
gcacgcaaaaaccaugccaguc

SEQ ID NO: 3030289 - RNA, 13 nt, Mycobacterium avium subsp. paratuberculosis
gcacgcacggcga

SEQ ID NO: 3030290 - RNA, 18 nt, Mycobacterium avium subsp. paratuberculosis
gcacgcacggcgaacggc

SEQ ID NO: 3030291 - RNA, 13 nt, Mycobacterium avium subsp. paratuberculosis
gcacgcagccgcg

SEQ ID NO: 3030292 - RNA, 15 nt, Mycobacterium avium subsp. paratuberculosis
gcacgcagccgcgcc

SEQ ID NO: 3030293 - RNA, 15 nt, Mycobacterium avium subsp. paratuberculosis
gcacgcagcggcguc

SEQ ID NO: 3030294 - RNA, 16 nt, Mycobacterium avium subsp. paratuberculosis
gcacgcaggcguggcc

SEQ ID NO: 3030295 - RNA, 21 nt, Mycobacterium avium subsp. paratuberculosis
gcacgcaggcguggcccagcc

SEQ ID NO: 3030296 - RNA, 15 nt, Mycobacterium avium subsp. paratuberculosis
gcacgcagugccgca

SEQ ID NO: 3030297 - RNA, 19 nt, Mycobacterium avium subsp. paratuberculosis
gcacgcagugccgcaccag

SEQ ID NO: 3030298 - RNA, 11 nt, Mycobacterium avium subsp. paratuberculosis
gcacgccagca

SEQ ID NO: 3030299 - RNA, 13 nt, Mycobacterium avium subsp. paratuberculosis
gcacgccagcauc

SEQ ID NO: 3030300 - RNA, 19 nt, Mycobacterium avium subsp. paratuberculosis
gcacgccaucgccucggcc

SEQ ID NO: 3030301 - RNA, 15 nt, Mycobacterium avium subsp. paratuberculosis
gcacgcccacagcug

SEQ ID NO: 3030302 - RNA, 17 nt, Mycobacterium avium subsp. paratuberculosis
gcacgcccagaucgacg

SEQ ID NO: 3030303 - RNA, 20 nt, Mycobacterium avium subsp. paratuberculosis
gcacgcccagaucgacgccg

SEQ ID NO: 3030304 - RNA, 21 nt, Mycobacterium avium subsp. paratuberculosis
gcacgcccagaucgacgccga

SEQ ID NO: 3030305 - RNA, 17 nt, Mycobacterium avium subsp. paratuberculosis
gcacgcccagaucgccg

SEQ ID NO: 3030306 - RNA, 19 nt, Mycobacterium avium subsp. paratuberculosis
gcacgcccagaucgccgac

SEQ ID NO: 3030307 - RNA, 22 nt, Mycobacterium avium subsp. paratuberculosis
gcacgcccagaucgccgacccg

SEQ ID NO: 3030308 - RNA, 23 nt, Mycobacterium avium subsp. paratuberculosis
gcacgcccagaucgccgacccgg

SEQ ID NO: 3030309 - RNA, 17 nt, Mycobacterium avium subsp. paratuberculosis
gcacgcccagcccgcgg

SEQ ID NO: 3030310 - RNA, 20 nt, Mycobacterium avium subsp. paratuberculosis
gcacgcccagcccgcgggcg

SEQ ID NO: 3030311 - RNA, 14 nt, Mycobacterium avium subsp. paratuberculosis
gcacgcccaugauc

SEQ ID NO: 3030312 - RNA, 16 nt, Mycobacterium avium subsp. paratuberculosis
gcacgcccaugaucac

SEQ ID NO: 3030313 - RNA, 19 nt, Mycobacterium avium subsp. paratuberculosis
gcacgcccaugaucacacc

SEQ ID NO: 3030314 - RNA, 17 nt, Mycobacterium avium subsp. paratuberculosis
gcacgcccccgcuggcc

SEQ ID NO: 3030315 - RNA, 22 nt, Mycobacterium avium subsp. paratuberculosis
gcacgcccccgcuggcccggcg

SEQ ID NO: 3030316 - RNA, 17 nt, Mycobacterium avium subsp. paratuberculosis
gcacgcccgggcaugcc

SEQ ID NO: 3030317 - RNA, 14 nt, Mycobacterium avium subsp. paratuberculosis
gcacgcccguagcg

SEQ ID NO: 3030318 - RNA, 21 nt, Mycobacterium avium subsp. paratuberculosis
gcacgcccguagcggugggcg

SEQ ID NO: 3030319 - RNA, 23 nt, Mycobacterium avium subsp. paratuberculosis
gcacgcccguucgagcgccggac

SEQ ID NO: 3030320 - RNA, 18 nt, Mycobacterium avium subsp. paratuberculosis
gcacgcccucggcuuccg

SEQ ID NO: 3030321 - RNA, 13 nt, Mycobacterium avium subsp. paratuberculosis
gcacgcccugcgg

SEQ ID NO: 3030322 - RNA, 20 nt, Mycobacterium avium subsp. paratuberculosis
gcacgcccuggaaggcgauc

SEQ ID NO: 3030323 - RNA, 22 nt, Mycobacterium avium subsp. paratuberculosis
gcacgccgaccacccccagccc

SEQ ID NO: 3030324 - RNA, 14 nt, Mycobacterium avium subsp. paratuberculosis
gcacgccgagcagc

SEQ ID NO: 3030325 - RNA, 20 nt, Mycobacterium avium subsp. paratuberculosis
gcacgccgagcagcaccggc

SEQ ID NO: 3030326 - RNA, 15 nt, Mycobacterium avium subsp. paratuberculosis
gcacgccgaggcgug

SEQ ID NO: 3030327 - RNA, 18 nt, Mycobacterium avium subsp. paratuberculosis
gcacgccgaggcgugccg

SEQ ID NO: 3030328 - RNA, 23 nt, Mycobacterium avium subsp. paratuberculosis
gcacgccgaggcgugccgcuggg

SEQ ID NO: 3030329 - RNA, 13 nt, Mycobacterium avium subsp. paratuberculosis
gcacgccgccggu

SEQ ID NO: 3030330 - RNA, 20 nt, Mycobacterium avium subsp. paratuberculosis
gcacgccgccgguggagaug

SEQ ID NO: 3030331 - RNA, 21 nt, Mycobacterium avium subsp. paratuberculosis
gcacgccgcggaaggccagcu

SEQ ID NO: 3030332 - RNA, 22 nt, Mycobacterium avium subsp. paratuberculosis
gcacgccgcggaaggccagcuc

SEQ ID NO: 3030333 - RNA, 15 nt, Mycobacterium avium subsp. paratuberculosis
gcacgccggaaucga

SEQ ID NO: 3030334 - RNA, 12 nt, Mycobacterium avium subsp. paratuberculosis
gcacgccggccg

SEQ ID NO: 3030335 - RNA, 15 nt, Mycobacterium avium subsp. paratuberculosis
gcacgccggccggcg

SEQ ID NO: 3030336 - RNA, 17 nt, Mycobacterium avium subsp. paratuberculosis
gcacgccggccggcgug

SEQ ID NO: 3030337 - RNA, 12 nt, Mycobacterium avium subsp. paratuberculosis
gcacgccggcgg

SEQ ID NO: 3030338 - RNA, 12 nt, Mycobacterium avium subsp. paratuberculosis
gcacgccggggc

SEQ ID NO: 3030339 - RNA, 14 nt, Mycobacterium avium subsp. paratuberculosis
gcacgccggggccc

SEQ ID NO: 3030340 - RNA, 15 nt, Mycobacterium avium subsp. paratuberculosis
gcacgccggggcccu

SEQ ID NO: 3030341 - RNA, 23 nt, Mycobacterium avium subsp. paratuberculosis
gcacgccggguugggcggcggcc

SEQ ID NO: 3030342 - RNA, 15 nt, Mycobacterium avium subsp. paratuberculosis
gcacgccgguagccg

SEQ ID NO: 3030343 - RNA, 17 nt, Mycobacterium avium subsp. paratuberculosis
gcacgccggucagcacc

SEQ ID NO: 3030344 - RNA, 23 nt, Mycobacterium avium subsp. paratuberculosis
gcacgccguccuuggccgccagc

SEQ ID NO: 3030345 - RNA, 15 nt, Mycobacterium avium subsp. paratuberculosis
gcacgccgucgugcu

SEQ ID NO: 3030346 - RNA, 18 nt, Mycobacterium avium subsp. paratuberculosis
gcacgccgucgugcucgg

SEQ ID NO: 3030347 - RNA, 20 nt, Mycobacterium avium subsp. paratuberculosis
gcacgccgucgugcucggcg

SEQ ID NO: 3030348 - RNA, 14 nt, Mycobacterium avium subsp. paratuberculosis
gcacgccguggcgg

SEQ ID NO: 3030349 - RNA, 18 nt, Mycobacterium avium subsp. paratuberculosis
gcacgccguggcggcggg

SEQ ID NO: 3030350 - RNA, 19 nt, Mycobacterium avium subsp. paratuberculosis
gcacgccguggcggcgggc

SEQ ID NO: 3030351 - RNA, 20 nt, Mycobacterium avium subsp. paratuberculosis
gcacgccguggcggcgggcc

SEQ ID NO: 3030352 - RNA, 21 nt, Mycobacterium avium subsp. paratuberculosis
gcacgccguggcggcgggcca

SEQ ID NO: 3030353 - RNA, 22 nt, Mycobacterium avium subsp. paratuberculosis
gcacgccguggcggcgggccag

SEQ ID NO: 3030354 - RNA, 19 nt, Mycobacterium avium subsp. paratuberculosis
gcacgccuuccacgaccug

SEQ ID NO: 3030355 - RNA, 21 nt, Mycobacterium avium subsp. paratuberculosis
gcacgccuuccacgaccuggc

SEQ ID NO: 3030356 - RNA, 22 nt, Mycobacterium avium subsp. paratuberculosis
gcacgccuuccacgaccuggcg

SEQ ID NO: 3030357 - RNA, 21 nt, Mycobacterium avium subsp. paratuberculosis
gcacgcgaccgcgucgacggc

SEQ ID NO: 3030358 - RNA, 23 nt, Mycobacterium avium subsp. paratuberculosis
gcacgcgaccgcgucgacggcgu

SEQ ID NO: 3030359 - RNA, 18 nt, Mycobacterium avium subsp. paratuberculosis
gcacgcgagacgagccgc

SEQ ID NO: 3030360 - RNA, 22 nt, Mycobacterium avium subsp. paratuberculosis
gcacgcgagacgagccgccgcg

SEQ ID NO: 3030361 - RNA, 14 nt, Mycobacterium avium subsp. paratuberculosis
gcacgcgcgcccgg

SEQ ID NO: 3030362 - RNA, 14 nt, Mycobacterium avium subsp. paratuberculosis
gcacgcgcgccgga

SEQ ID NO: 3030363 - RNA, 19 nt, Mycobacterium avium subsp. paratuberculosis
gcacgcgcgggucgucggc

SEQ ID NO: 3030364 - RNA, 19 nt, Mycobacterium avium subsp. paratuberculosis
gcacgcggacacgaacgac

SEQ ID NO: 3030365 - RNA, 24 nt, Mycobacterium avium subsp. paratuberculosis
gcacgcggacacgaacgacgcggc

SEQ ID NO: 3030366 - RNA, 21 nt, Mycobacterium avium subsp. paratuberculosis
gcacgcggaccuuggugucgg

SEQ ID NO: 3030367 - RNA, 14 nt, Mycobacterium avium subsp. paratuberculosis
gcacgcggaucgcg

SEQ ID NO: 3030368 - RNA, 16 nt, Mycobacterium avium subsp. paratuberculosis
gcacgcggaucgcgcu

SEQ ID NO: 3030369 - RNA, 21 nt, Mycobacterium avium subsp. paratuberculosis
gcacgcggaucgcgcugacca

SEQ ID NO: 3030370 - RNA, 13 nt, Mycobacterium avium subsp. paratuberculosis
gcacgcggccgcg

SEQ ID NO: 3030371 - RNA, 13 nt, Mycobacterium avium subsp. paratuberculosis
gcacgcguucgga

SEQ ID NO: 3030372 - RNA, 16 nt, Mycobacterium avium subsp. paratuberculosis
gcacgcguugcagcgc

SEQ ID NO: 3030373 - RNA, 14 nt, Mycobacterium avium subsp. paratuberculosis
gcacgcucgcggug

SEQ ID NO: 3030374 - RNA, 17 nt, Mycobacterium avium subsp. paratuberculosis
gcacgcucgcggugcgc

SEQ ID NO: 3030375 - RNA, 17 nt, Mycobacterium avium subsp. paratuberculosis
gcacgcucggcgcgacg

SEQ ID NO: 3030376 - RNA, 13 nt, Mycobacterium avium subsp. paratuberculosis
gcacgcucggcgg

SEQ ID NO: 3030377 - RNA, 18 nt, Mycobacterium avium subsp. paratuberculosis
gcacgcugaagcacaccg

SEQ ID NO: 3030378 - RNA, 19 nt, Mycobacterium avium subsp. paratuberculosis
gcacgcugaagcacaccgu

SEQ ID NO: 3030379 - RNA, 17 nt, Mycobacterium avium subsp. paratuberculosis
gcacgcugcgcacccgg

SEQ ID NO: 3030380 - RNA, 23 nt, Mycobacterium avium subsp. paratuberculosis
gcacgcugcgcacccgguccggc

SEQ ID NO: 3030381 - RNA, 18 nt, Mycobacterium avium subsp. paratuberculosis
gcacgcugcgccagccgu

SEQ ID NO: 3030382 - RNA, 18 nt, Mycobacterium avium subsp. paratuberculosis
gcacgcugcggaugucgg

SEQ ID NO: 3030383 - RNA, 23 nt, Mycobacterium avium subsp. paratuberculosis
gcacgcugcuggucuugccgugc

SEQ ID NO: 3030384 - RNA, 16 nt, Mycobacterium avium subsp. paratuberculosis
gcacgcuggccggcag

SEQ ID NO: 3030385 - RNA, 19 nt, Mycobacterium avium subsp. paratuberculosis
gcacgcuggccggcagcgu

SEQ ID NO: 3030386 - RNA, 21 nt, Mycobacterium avium subsp. paratuberculosis
gcacgcugucggggucgcggc

SEQ ID NO: 3030387 - RNA, 20 nt, Mycobacterium avium subsp. paratuberculosis
gcacgcuguuggaaccggcc

SEQ ID NO: 3030388 - RNA, 21 nt, Mycobacterium avium subsp. paratuberculosis
gcacgcuguuggaaccggcca

SEQ ID NO: 3030389 - RNA, 21 nt, Mycobacterium avium subsp. paratuberculosis
gcacgcuuuuucgcgaacuuc

SEQ ID NO: 3030390 - RNA, 12 nt, Mycobacterium avium subsp. paratuberculosis
gcacggacagcu

SEQ ID NO: 3030391 - RNA, 19 nt, Mycobacterium avium subsp. paratuberculosis
gcacggacagcucaccggg

SEQ ID NO: 3030392 - RNA, 22 nt, Mycobacterium avium subsp. paratuberculosis
gcacggcaaugguugcggcggg

SEQ ID NO: 3030393 - RNA, 23 nt, Mycobacterium avium subsp. paratuberculosis
gcacggcaaugguugcggcgggc

SEQ ID NO: 3030394 - RNA, 17 nt, Mycobacterium avium subsp. paratuberculosis
gcacggcaccgcgagca

SEQ ID NO: 3030395 - RNA, 16 nt, Mycobacterium avium subsp. paratuberculosis
gcacggcacgcccguu

SEQ ID NO: 3030396 - RNA, 16 nt, Mycobacterium avium subsp. paratuberculosis
gcacggcagcccgacg

SEQ ID NO: 3030397 - RNA, 18 nt, Mycobacterium avium subsp. paratuberculosis
gcacggcagcccgacguc

SEQ ID NO: 3030398 - RNA, 18 nt, Mycobacterium avium subsp. paratuberculosis
gcacggcauggcgaacac

SEQ ID NO: 3030399 - RNA, 22 nt, Mycobacterium avium subsp. paratuberculosis
gcacggccaacugcaucgccag

SEQ ID NO: 3030400 - RNA, 14 nt, Mycobacterium avium subsp. paratuberculosis
gcacggccaccagc

SEQ ID NO: 3030401 - RNA, 15 nt, Mycobacterium avium subsp. paratuberculosis
gcacggccaccagca

SEQ ID NO: 3030402 - RNA, 16 nt, Mycobacterium avium subsp. paratuberculosis
gcacggccaccagcag

SEQ ID NO: 3030403 - RNA, 21 nt, Mycobacterium avium subsp. paratuberculosis
gcacggccaccagcagcgaga

SEQ ID NO: 3030404 - RNA, 14 nt, Mycobacterium avium subsp. paratuberculosis
gcacggccacugcc

SEQ ID NO: 3030405 - RNA, 17 nt, Mycobacterium avium subsp. paratuberculosis
gcacggccacugccccg

SEQ ID NO: 3030406 - RNA, 20 nt, Mycobacterium avium subsp. paratuberculosis
gcacggccacugccccggcg

SEQ ID NO: 3030407 - RNA, 16 nt, Mycobacterium avium subsp. paratuberculosis
gcacggccagccagcc

SEQ ID NO: 3030408 - RNA, 19 nt, Mycobacterium avium subsp. paratuberculosis
gcacggccagccagccgcc

SEQ ID NO: 3030409 - RNA, 23 nt, Mycobacterium avium subsp. paratuberculosis
gcacggccagccagccgcccagc

SEQ ID NO: 3030410 - RNA, 16 nt, Mycobacterium avium subsp. paratuberculosis
gcacggcccaucacca

SEQ ID NO: 3030411 - RNA, 19 nt, Mycobacterium avium subsp. paratuberculosis
gcacggcccaucaccagcg

SEQ ID NO: 3030412 - RNA, 20 nt, Mycobacterium avium subsp. paratuberculosis
gcacggcccaucaccagcgg

SEQ ID NO: 3030413 - RNA, 14 nt, Mycobacterium avium subsp. paratuberculosis
gcacggccgccagg

SEQ ID NO: 3030414 - RNA, 14 nt, Mycobacterium avium subsp. paratuberculosis
gcacggccgcggcc

SEQ ID NO: 3030415 - RNA, 15 nt, Mycobacterium avium subsp. paratuberculosis
gcacggccgcggcca

SEQ ID NO: 3030416 - RNA, 16 nt, Mycobacterium avium subsp. paratuberculosis
gcacggccgcggccag

SEQ ID NO: 3030417 - RNA, 19 nt, Mycobacterium avium subsp. paratuberculosis
gcacggccgcggccagcga

SEQ ID NO: 3030418 - RNA, 13 nt, Mycobacterium avium subsp. paratuberculosis
gcacggccggccg

SEQ ID NO: 3030419 - RNA, 15 nt, Mycobacterium avium subsp. paratuberculosis
gcacggccggccggc

SEQ ID NO: 3030420 - RNA, 12 nt, Mycobacterium avium subsp. paratuberculosis
gcacggccucgg

SEQ ID NO: 3030421 - RNA, 20 nt, Mycobacterium avium subsp. paratuberculosis
gcacggccucggucacgguc

SEQ ID NO: 3030422 - RNA, 14 nt, Mycobacterium avium subsp. paratuberculosis
gcacggcgaacggc

SEQ ID NO: 3030423 - RNA, 21 nt, Mycobacterium avium subsp. paratuberculosis
gcacggcgaacggccgcgaug

SEQ ID NO: 3030424 - RNA, 22 nt, Mycobacterium avium subsp. paratuberculosis
gcacggcgaacggccgcgaugu

SEQ ID NO: 3030425 - RNA, 15 nt, Mycobacterium avium subsp. paratuberculosis
gcacggcgaccagcg

SEQ ID NO: 3030426 - RNA, 16 nt, Mycobacterium avium subsp. paratuberculosis
gcacggcgaccagcga

SEQ ID NO: 3030427 - RNA, 19 nt, Mycobacterium avium subsp. paratuberculosis
gcacggcgaccagcgagcc

SEQ ID NO: 3030428 - RNA, 23 nt, Mycobacterium avium subsp. paratuberculosis
gcacggcgaccagcgagcccagc

SEQ ID NO: 3030429 - RNA, 15 nt, Mycobacterium avium subsp. paratuberculosis
gcacggcgaggucgg

SEQ ID NO: 3030430 - RNA, 23 nt, Mycobacterium avium subsp. paratuberculosis
gcacggcgauguaggacgccgca

SEQ ID NO: 3030431 - RNA, 13 nt, Mycobacterium avium subsp. paratuberculosis
gcacggcgccacc

SEQ ID NO: 3030432 - RNA, 17 nt, Mycobacterium avium subsp. paratuberculosis
gcacggcgccaccagcc

SEQ ID NO: 3030433 - RNA, 16 nt, Mycobacterium avium subsp. paratuberculosis
gcacggcgcccagguc

SEQ ID NO: 3030434 - RNA, 17 nt, Mycobacterium avium subsp. paratuberculosis
gcacggcgccgugccgc

SEQ ID NO: 3030435 - RNA, 23 nt, Mycobacterium avium subsp. paratuberculosis
gcacggcgccgugccgcgcggcg

SEQ ID NO: 3030436 - RNA, 17 nt, Mycobacterium avium subsp. paratuberculosis
gcacggcgcgcaccgcg

SEQ ID NO: 3030437 - RNA, 14 nt, Mycobacterium avium subsp. paratuberculosis
gcacggcgcuggcg

SEQ ID NO: 3030438 - RNA, 17 nt, Mycobacterium avium subsp. paratuberculosis
gcacggcgcuggcgacc

SEQ ID NO: 3030439 - RNA, 11 nt, Mycobacterium avium subsp. paratuberculosis
gcacggcggcg

SEQ ID NO: 3030440 - RNA, 12 nt, Mycobacterium avium subsp. paratuberculosis
gcacggcggcga

SEQ ID NO: 3030441 - RNA, 14 nt, Mycobacterium avium subsp. paratuberculosis
gcacggcggcgaac

SEQ ID NO: 3030442 - RNA, 23 nt, Mycobacterium avium subsp. paratuberculosis
gcacggcggcgaacgccgccgug

SEQ ID NO: 3030443 - RNA, 14 nt, Mycobacterium avium subsp. paratuberculosis
gcacggcucgucca

SEQ ID NO: 3030444 - RNA, 17 nt, Mycobacterium avium subsp. paratuberculosis
gcacggcugcucccgaa

SEQ ID NO: 3030445 - RNA, 21 nt, Mycobacterium avium subsp. paratuberculosis
gcacgggaugaucggcgccuu

SEQ ID NO: 3030446 - RNA, 15 nt, Mycobacterium avium subsp. paratuberculosis
gcacgggcaccgacg

SEQ ID NO: 3030447 - RNA, 15 nt, Mycobacterium avium subsp. paratuberculosis
gcacgggcccgcggg

SEQ ID NO: 3030448 - RNA, 22 nt, Mycobacterium avium subsp. paratuberculosis
gcacgggcccgcgggaucagcg

SEQ ID NO: 3030449 - RNA, 14 nt, Mycobacterium avium subsp. paratuberculosis
gcacgggcggcggg

SEQ ID NO: 3030450 - RNA, 22 nt, Mycobacterium avium subsp. paratuberculosis
gcacggggacgcugaacagccc

SEQ ID NO: 3030451 - RNA, 15 nt, Mycobacterium avium subsp. paratuberculosis
gcacggggacgucgu

SEQ ID NO: 3030452 - RNA, 17 nt, Mycobacterium avium subsp. paratuberculosis
gcacggggacgucgucg

SEQ ID NO: 3030453 - RNA, 14 nt, Mycobacterium avium subsp. paratuberculosis
gcacggucagcggc

SEQ ID NO: 3030454 - RNA, 17 nt, Mycobacterium avium subsp. paratuberculosis
gcacggucagcggccag

SEQ ID NO: 3030455 - RNA, 17 nt, Mycobacterium avium subsp. paratuberculosis
gcacggucccguccauc

SEQ ID NO: 3030456 - RNA, 21 nt, Mycobacterium avium subsp. paratuberculosis
gcacggucccguccaucgccg

SEQ ID NO: 3030457 - RNA, 22 nt, Mycobacterium avium subsp. paratuberculosis
gcacggucccguccaucgccgc

SEQ ID NO: 3030458 - RNA, 11 nt, Mycobacterium avium subsp. paratuberculosis
gcacggucgcg

SEQ ID NO: 3030459 - RNA, 21 nt, Mycobacterium avium subsp. paratuberculosis
gcacggucgcggugucggcgu

SEQ ID NO: 3030460 - RNA, 23 nt, Mycobacterium avium subsp. paratuberculosis
gcacggucgcggugucggcgucg

SEQ ID NO: 3030461 - RNA, 15 nt, Mycobacterium avium subsp. paratuberculosis
gcacggucggccccg

SEQ ID NO: 3030462 - RNA, 20 nt, Mycobacterium avium subsp. paratuberculosis
gcacggucggccccgcgcau

SEQ ID NO: 3030463 - RNA, 16 nt, Mycobacterium avium subsp. paratuberculosis
gcacggucugguggca

SEQ ID NO: 3030464 - RNA, 16 nt, Mycobacterium avium subsp. paratuberculosis
gcacggugaugcgggu

SEQ ID NO: 3030465 - RNA, 18 nt, Mycobacterium avium subsp. paratuberculosis
gcacggugcacacgccga

SEQ ID NO: 3030466 - RNA, 19 nt, Mycobacterium avium subsp. paratuberculosis
gcacggugcacacgccgag

SEQ ID NO: 3030467 - RNA, 20 nt, Mycobacterium avium subsp. paratuberculosis
gcacggugcacacgccgagg

SEQ ID NO: 3030468 - RNA, 15 nt, Mycobacterium avium subsp. paratuberculosis
gcacggugcagcagc

SEQ ID NO: 3030469 - RNA, 18 nt, Mycobacterium avium subsp. paratuberculosis
gcacggugcagcagcgcc

SEQ ID NO: 3030470 - RNA, 20 nt, Mycobacterium avium subsp. paratuberculosis
gcacggugcagcagcgccgc

SEQ ID NO: 3030471 - RNA, 17 nt, Mycobacterium avium subsp. paratuberculosis
gcacggugcccgucggc

SEQ ID NO: 3030472 - RNA, 20 nt, Mycobacterium avium subsp. paratuberculosis
gcacggugcccgucggcaac

SEQ ID NO: 3030473 - RNA, 21 nt, Mycobacterium avium subsp. paratuberculosis
gcacggugcgccggcagcggc

SEQ ID NO: 3030474 - RNA, 22 nt, Mycobacterium avium subsp. paratuberculosis
gcacggugcgccggcagcggcc

SEQ ID NO: 3030475 - RNA, 23 nt, Mycobacterium avium subsp. paratuberculosis
gcacggugcgccggcagcggccg

SEQ ID NO: 3030476 - RNA, 16 nt, Mycobacterium avium subsp. paratuberculosis
gcacggugggacggcg

SEQ ID NO: 3030477 - RNA, 17 nt, Mycobacterium avium subsp. paratuberculosis
gcacggugggacggcgg

SEQ ID NO: 3030478 - RNA, 15 nt, Mycobacterium avium subsp. paratuberculosis
gcacggugggcgccg

SEQ ID NO: 3030479 - RNA, 20 nt, Mycobacterium avium subsp. paratuberculosis
gcacggugggcgccggguca

SEQ ID NO: 3030480 - RNA, 17 nt, Mycobacterium avium subsp. paratuberculosis
gcacgguguagacgcgg

SEQ ID NO: 3030481 - RNA, 19 nt, Mycobacterium avium subsp. paratuberculosis
gcacgguguagacgcgggc

SEQ ID NO: 3030482 - RNA, 22 nt, Mycobacterium avium subsp. paratuberculosis
gcacgguguugcgcacccgcgg

SEQ ID NO: 3030483 - RNA, 15 nt, Mycobacterium avium subsp. paratuberculosis
gcacgguuggccggc

SEQ ID NO: 3030484 - RNA, 16 nt, Mycobacterium avium subsp. paratuberculosis
gcacgguuggccggcc

SEQ ID NO: 3030485 - RNA, 19 nt, Mycobacterium avium subsp. paratuberculosis
gcacgguuggccggcccgc

SEQ ID NO: 3030486 - RNA, 20 nt, Mycobacterium avium subsp. paratuberculosis
gcacguaccgguacagcgac

SEQ ID NO: 3030487 - RNA, 21 nt, Mycobacterium avium subsp. paratuberculosis
gcacguaccgguacagcgacu

SEQ ID NO: 3030488 - RNA, 14 nt, Mycobacterium avium subsp. paratuberculosis
gcacguacgcgcug

SEQ ID NO: 3030489 - RNA, 21 nt, Mycobacterium avium subsp. paratuberculosis
gcacguagacggugucgcccu

SEQ ID NO: 3030490 - RNA, 17 nt, Mycobacterium avium subsp. paratuberculosis
gcacguagcccagcgcg

SEQ ID NO: 3030491 - RNA, 18 nt, Mycobacterium avium subsp. paratuberculosis
gcacguagcccagcgcgu

SEQ ID NO: 3030492 - RNA, 14 nt, Mycobacterium avium subsp. paratuberculosis
gcacguaggcggcg

SEQ ID NO: 3030493 - RNA, 14 nt, Mycobacterium avium subsp. paratuberculosis
gcacguauccgcgg

SEQ ID NO: 3030494 - RNA, 12 nt, Mycobacterium avium subsp. paratuberculosis
gcacgucaccgc

SEQ ID NO: 3030495 - RNA, 19 nt, Mycobacterium avium subsp. paratuberculosis
gcacgucaccgcgcuugcc

SEQ ID NO: 3030496 - RNA, 14 nt, Mycobacterium avium subsp. paratuberculosis
gcacgucaccgcug

SEQ ID NO: 3030497 - RNA, 23 nt, Mycobacterium avium subsp. paratuberculosis
gcacgucaccgcugaugccgccg

SEQ ID NO: 3030498 - RNA, 15 nt, Mycobacterium avium subsp. paratuberculosis
gcacgucacgggcca

SEQ ID NO: 3030499 - RNA, 19 nt, Mycobacterium avium subsp. paratuberculosis
gcacgucacgggccaggcg

SEQ ID NO: 3030500 - RNA, 18 nt, Mycobacterium avium subsp. paratuberculosis
gcacguccagcccgcgcc

SEQ ID NO: 3030501 - RNA, 20 nt, Mycobacterium avium subsp. paratuberculosis
gcacguccccgggcaccccg

SEQ ID NO: 3030502 - RNA, 21 nt, Mycobacterium avium subsp. paratuberculosis
gcacguccccgggcaccccgg

SEQ ID NO: 3030503 - RNA, 15 nt, Mycobacterium avium subsp. paratuberculosis
gcacguccccgugca

SEQ ID NO: 3030504 - RNA, 17 nt, Mycobacterium avium subsp. paratuberculosis
gcacguccccgugcagc

SEQ ID NO: 3030505 - RNA, 18 nt, Mycobacterium avium subsp. paratuberculosis
gcacguccccgugcagcc

SEQ ID NO: 3030506 - RNA, 21 nt, Mycobacterium avium subsp. paratuberculosis
gcacguccccgugcagccggg

SEQ ID NO: 3030507 - RNA, 23 nt, Mycobacterium avium subsp. paratuberculosis
gcacguccccgugcagccgggcc

SEQ ID NO: 3030508 - RNA, 16 nt, Mycobacterium avium subsp. paratuberculosis
gcacgucccgcccggc

SEQ ID NO: 3030509 - RNA, 23 nt, Mycobacterium avium subsp. paratuberculosis
gcacgucccgcccggcgccggcc

SEQ ID NO: 3030510 - RNA, 18 nt, Mycobacterium avium subsp. paratuberculosis
gcacguccgccuccgacc

SEQ ID NO: 3030511 - RNA, 20 nt, Mycobacterium avium subsp. paratuberculosis
gcacguccgccuccgaccag

SEQ ID NO: 3030512 - RNA, 15 nt, Mycobacterium avium subsp. paratuberculosis
gcacguccucgucgg

SEQ ID NO: 3030513 - RNA, 16 nt, Mycobacterium avium subsp. paratuberculosis
gcacguccucgucggu

SEQ ID NO: 3030514 - RNA, 19 nt, Mycobacterium avium subsp. paratuberculosis
gcacguccucgucggucca

SEQ ID NO: 3030515 - RNA, 20 nt, Mycobacterium avium subsp. paratuberculosis
gcacguccucgucgguccag

SEQ ID NO: 3030516 - RNA, 21 nt, Mycobacterium avium subsp. paratuberculosis
gcacgucgacgccggucucga

SEQ ID NO: 3030517 - RNA, 17 nt, Mycobacterium avium subsp. paratuberculosis
gcacgucgagcaccgcg

SEQ ID NO: 3030518 - RNA, 22 nt, Mycobacterium avium subsp. paratuberculosis
gcacgucgagcuccucggccag

SEQ ID NO: 3030519 - RNA, 18 nt, Mycobacterium avium subsp. paratuberculosis
gcacgucgaggucggacg

SEQ ID NO: 3030520 - RNA, 13 nt, Mycobacterium avium subsp. paratuberculosis
gcacgucgccgcc

SEQ ID NO: 3030521 - RNA, 14 nt, Mycobacterium avium subsp. paratuberculosis
gcacgucgccgccg

SEQ ID NO: 3030522 - RNA, 17 nt, Mycobacterium avium subsp. paratuberculosis
gcacgucgccggcgacc

SEQ ID NO: 3030523 - RNA, 19 nt, Mycobacterium avium subsp. paratuberculosis
gcacgucgccggcgaccgc

SEQ ID NO: 3030524 - RNA, 13 nt, Mycobacterium avium subsp. paratuberculosis
gcacgucgcgcgg

SEQ ID NO: 3030525 - RNA, 20 nt, Mycobacterium avium subsp. paratuberculosis
gcacgucgcgcggggucggg

SEQ ID NO: 3030526 - RNA, 14 nt, Mycobacterium avium subsp. paratuberculosis
gcacgucgcggccc

SEQ ID NO: 3030527 - RNA, 12 nt, Mycobacterium avium subsp. paratuberculosis
gcacgucggcag

SEQ ID NO: 3030528 - RNA, 14 nt, Mycobacterium avium subsp. paratuberculosis
gcacgucggccacg

SEQ ID NO: 3030529 - RNA, 15 nt, Mycobacterium avium subsp. paratuberculosis
gcacgucggccacgc

SEQ ID NO: 3030530 - RNA, 17 nt, Mycobacterium avium subsp. paratuberculosis
gcacgucggccacgccg

SEQ ID NO: 3030531 - RNA, 20 nt, Mycobacterium avium subsp. paratuberculosis
gcacgucggccacgccgggc

SEQ ID NO: 3030532 - RNA, 13 nt, Mycobacterium avium subsp. paratuberculosis
gcacgucggccag

SEQ ID NO: 3030533 - RNA, 17 nt, Mycobacterium avium subsp. paratuberculosis
gcacgucggccgccagg

SEQ ID NO: 3030534 - RNA, 17 nt, Mycobacterium avium subsp. paratuberculosis
gcacgucggcggccgcg

SEQ ID NO: 3030535 - RNA, 17 nt, Mycobacterium avium subsp. paratuberculosis
gcacgucggucagcgag

SEQ ID NO: 3030536 - RNA, 21 nt, Mycobacterium avium subsp. paratuberculosis
gcacgucggucagcgagcggu

SEQ ID NO: 3030537 - RNA, 13 nt, Mycobacterium avium subsp. paratuberculosis
gcacgugaugcag

SEQ ID NO: 3030538 - RNA, 15 nt, Mycobacterium avium subsp. paratuberculosis
gcacgugcaccgcgg

SEQ ID NO: 3030539 - RNA, 18 nt, Mycobacterium avium subsp. paratuberculosis
gcacgugcaccgcggcca

SEQ ID NO: 3030540 - RNA, 17 nt, Mycobacterium avium subsp. paratuberculosis
gcacgugcccagcccgc

SEQ ID NO: 3030541 - RNA, 18 nt, Mycobacterium avium subsp. paratuberculosis
gcacgugcccagcccgcg

SEQ ID NO: 3030542 - RNA, 14 nt, Mycobacterium avium subsp. paratuberculosis
gcacgugcccgccg

SEQ ID NO: 3030543 - RNA, 16 nt, Mycobacterium avium subsp. paratuberculosis
gcacgugcccgccgug

SEQ ID NO: 3030544 - RNA, 18 nt, Mycobacterium avium subsp. paratuberculosis
gcacgugcccgccgugcg

SEQ ID NO: 3030545 - RNA, 14 nt, Mycobacterium avium subsp. paratuberculosis
gcacgugcgcgccg

SEQ ID NO: 3030546 - RNA, 18 nt, Mycobacterium avium subsp. paratuberculosis
gcacgugcgcgccgaccg

SEQ ID NO: 3030547 - RNA, 21 nt, Mycobacterium avium subsp. paratuberculosis
gcacgugcgcgccgaccgcga

SEQ ID NO: 3030548 - RNA, 24 nt, Mycobacterium avium subsp. paratuberculosis
gcacgugcgcgccgaccgcgagca

SEQ ID NO: 3030549 - RNA, 13 nt, Mycobacterium avium subsp. paratuberculosis
gcacgugcggguu

SEQ ID NO: 3030550 - RNA, 20 nt, Mycobacterium avium subsp. paratuberculosis
gcacgugcggguuggcgccg

SEQ ID NO: 3030551 - RNA, 14 nt, Mycobacterium avium subsp. paratuberculosis
gcacguggccgggc

SEQ ID NO: 3030552 - RNA, 18 nt, Mycobacterium avium subsp. paratuberculosis
gcacguggccgggcucga

SEQ ID NO: 3030553 - RNA, 23 nt, Mycobacterium avium subsp. paratuberculosis
gcacguggcugaccgacggcgac

SEQ ID NO: 3030554 - RNA, 20 nt, Mycobacterium avium subsp. paratuberculosis
gcacgugggucaaccgguag

SEQ ID NO: 3030555 - RNA, 24 nt, Mycobacterium avium subsp. paratuberculosis
gcacgugguguugaucauccggcg

SEQ ID NO: 3030556 - RNA, 16 nt, Mycobacterium avium subsp. paratuberculosis
gcacguguucgggauc

SEQ ID NO: 3030557 - RNA, 22 nt, Mycobacterium avium subsp. paratuberculosis
gcacguguucgggaucggcgcc

SEQ ID NO: 3030558 - RNA, 18 nt, Mycobacterium avium subsp. paratuberculosis
gcacguguucucacggcg

SEQ ID NO: 3030559 - RNA, 20 nt, Mycobacterium avium subsp. paratuberculosis
gcacguguucucacggcgaa

SEQ ID NO: 3030560 - RNA, 14 nt, Mycobacterium avium subsp. paratuberculosis
gcacguugcccagg

SEQ ID NO: 3030561 - RNA, 15 nt, Mycobacterium avium subsp. paratuberculosis
gcacguugcccagga

SEQ ID NO: 3030562 - RNA, 16 nt, Mycobacterium avium subsp. paratuberculosis
gcacguuggcggccag

SEQ ID NO: 3030563 - RNA, 17 nt, Mycobacterium avium subsp. paratuberculosis
gcacguuggcggccagc

SEQ ID NO: 3030564 - RNA, 18 nt, Mycobacterium avium subsp. paratuberculosis
gcacguuggcggccagcg

SEQ ID NO: 3030565 - RNA, 14 nt, Mycobacterium avium subsp. paratuberculosis
gcacguugugcucg

SEQ ID NO: 3030566 - RNA, 21 nt, Mycobacterium avium subsp. paratuberculosis
gcacguugugcucgucgaugu

SEQ ID NO: 3030567 - RNA, 17 nt, Mycobacterium avium subsp. paratuberculosis
gcacguugugcuucugg

SEQ ID NO: 3030568 - RNA, 21 nt, Mycobacterium avium subsp. paratuberculosis
gcacguugugcuucuggcuca

SEQ ID NO: 3030569 - RNA, 18 nt, Mycobacterium avium subsp. paratuberculosis
gcacguugugggcgggcg

SEQ ID NO: 3030570 - RNA, 20 nt, Mycobacterium avium subsp. paratuberculosis
gcacguugugggcgggcgcg

SEQ ID NO: 3030571 - RNA, 16 nt, Mycobacterium avium subsp. paratuberculosis
gcacuaccgccucgcc

SEQ ID NO: 3030572 - RNA, 19 nt, Mycobacterium avium subsp. paratuberculosis
gcacuaccgccucgccagc

SEQ ID NO: 3030573 - RNA, 18 nt, Mycobacterium avium subsp. paratuberculosis
gcacuagguccggcgcga

SEQ ID NO: 3030574 - RNA, 18 nt, Mycobacterium avium subsp. paratuberculosis
gcacucagagcagcgccu

SEQ ID NO: 3030575 - RNA, 16 nt, Mycobacterium avium subsp. paratuberculosis
gcacuccgucgcgauc

SEQ ID NO: 3030576 - RNA, 16 nt, Mycobacterium avium subsp. paratuberculosis
gcacuccugguuucgg

SEQ ID NO: 3030577 - RNA, 13 nt, Mycobacterium avium subsp. paratuberculosis
gcacucgaacggc

SEQ ID NO: 3030578 - RNA, 13 nt, Mycobacterium avium subsp. paratuberculosis
gcacucgagcguc

SEQ ID NO: 3030579 - RNA, 17 nt, Mycobacterium avium subsp. paratuberculosis
gcacucgaucagcaccg

SEQ ID NO: 3030580 - RNA, 22 nt, Mycobacterium avium subsp. paratuberculosis
gcacucgaucagcaccgccacg

SEQ ID NO: 3030581 - RNA, 16 nt, Mycobacterium avium subsp. paratuberculosis
gcacucgauggcggcg

SEQ ID NO: 3030582 - RNA, 17 nt, Mycobacterium avium subsp. paratuberculosis
gcacucgccucggaggc

SEQ ID NO: 3030583 - RNA, 12 nt, Mycobacterium avium subsp. paratuberculosis
gcacucgcgcag

SEQ ID NO: 3030584 - RNA, 14 nt, Mycobacterium avium subsp. paratuberculosis
gcacucgcgggacg

SEQ ID NO: 3030585 - RNA, 22 nt, Mycobacterium avium subsp. paratuberculosis
gcacucgcgggacggcggcgag

SEQ ID NO: 3030586 - RNA, 13 nt, Mycobacterium avium subsp. paratuberculosis
gcacucggcgaug

SEQ ID NO: 3030587 - RNA, 15 nt, Mycobacterium avium subsp. paratuberculosis
gcacucgguguggcc

SEQ ID NO: 3030588 - RNA, 16 nt, Mycobacterium avium subsp. paratuberculosis
gcacucgucguggcgg

SEQ ID NO: 3030589 - RNA, 21 nt, Mycobacterium avium subsp. paratuberculosis
gcacucucgcggcaaggcgca

SEQ ID NO: 3030590 - RNA, 18 nt, Mycobacterium avium subsp. paratuberculosis
gcacugagcggcagaagu

SEQ ID NO: 3030591 - RNA, 19 nt, Mycobacterium avium subsp. paratuberculosis
gcacugaucccuccgucga

SEQ ID NO: 3030592 - RNA, 12 nt, Mycobacterium avium subsp. paratuberculosis
gcacugcacggc

SEQ ID NO: 3030593 - RNA, 15 nt, Mycobacterium avium subsp. paratuberculosis
gcacugcacggccuc

SEQ ID NO: 3030594 - RNA, 19 nt, Mycobacterium avium subsp. paratuberculosis
gcacugcacggccucgguc

SEQ ID NO: 3030595 - RNA, 18 nt, Mycobacterium avium subsp. paratuberculosis
gcacugcaucucgaccug

SEQ ID NO: 3030596 - RNA, 15 nt, Mycobacterium avium subsp. paratuberculosis
gcacugcccgcaucg

SEQ ID NO: 3030597 - RNA, 22 nt, Mycobacterium avium subsp. paratuberculosis
gcacugcccgcaucgcacagau

SEQ ID NO: 3030598 - RNA, 16 nt, Mycobacterium avium subsp. paratuberculosis
gcacugccgacccggc

SEQ ID NO: 3030599 - RNA, 17 nt, Mycobacterium avium subsp. paratuberculosis
gcacugccgacccggcg

SEQ ID NO: 3030600 - RNA, 20 nt, Mycobacterium avium subsp. paratuberculosis
gcacugcugcccgcgacggc

SEQ ID NO: 3030601 - RNA, 21 nt, Mycobacterium avium subsp. paratuberculosis
gcacugcugcccgcgacggcg

SEQ ID NO: 3030602 - RNA, 22 nt, Mycobacterium avium subsp. paratuberculosis
gcacugcugcccgcgacggcga

SEQ ID NO: 3030603 - RNA, 20 nt, Mycobacterium avium subsp. paratuberculosis
gcacuggucgugcuggagcg

SEQ ID NO: 3030604 - RNA, 16 nt, Mycobacterium avium subsp. paratuberculosis
gcacuucgaucaucuc

SEQ ID NO: 3030605 - RNA, 21 nt, Mycobacterium avium subsp. paratuberculosis
gcacuucgaucaucuccaccc

SEQ ID NO: 3030606 - RNA, 23 nt, Mycobacterium avium subsp. paratuberculosis
gcacuucgaucaucuccacccgg

SEQ ID NO: 3030607 - RNA, 15 nt, Mycobacterium avium subsp. paratuberculosis
gcacuucgcgggcgg

SEQ ID NO: 3030608 - RNA, 18 nt, Mycobacterium avium subsp. paratuberculosis
gcacuucgcgggcggcgc

SEQ ID NO: 3030609 - RNA, 18 nt, Mycobacterium avium subsp. paratuberculosis
gcagaaaaaggccgccgc

SEQ ID NO: 3030610 - RNA, 20 nt, Mycobacterium avium subsp. paratuberculosis
gcagaaaauagcccagccag

SEQ ID NO: 3030611 - RNA, 16 nt, Mycobacterium avium subsp. paratuberculosis
gcagaacaccaccgcc

SEQ ID NO: 3030612 - RNA, 19 nt, Mycobacterium avium subsp. paratuberculosis
gcagaacaccacgguguag

SEQ ID NO: 3030613 - RNA, 20 nt, Mycobacterium avium subsp. paratuberculosis
gcagaacaccacgguguagc

SEQ ID NO: 3030614 - RNA, 14 nt, Mycobacterium avium subsp. paratuberculosis
gcagaacaccagcg

SEQ ID NO: 3030615 - RNA, 14 nt, Mycobacterium avium subsp. paratuberculosis
gcagaacagccggu

SEQ ID NO: 3030616 - RNA, 18 nt, Mycobacterium avium subsp. paratuberculosis
gcagaacagccgguccga

SEQ ID NO: 3030617 - RNA, 22 nt, Mycobacterium avium subsp. paratuberculosis
gcagaacagccgguccgaccgc

SEQ ID NO: 3030618 - RNA, 16 nt, Mycobacterium avium subsp. paratuberculosis
gcagaaccagcaccgc

SEQ ID NO: 3030619 - RNA, 18 nt, Mycobacterium avium subsp. paratuberculosis
gcagaaccagcaccgccg

SEQ ID NO: 3030620 - RNA, 19 nt, Mycobacterium avium subsp. paratuberculosis
gcagaaccagcaccgccgc

SEQ ID NO: 3030621 - RNA, 15 nt, Mycobacterium avium subsp. paratuberculosis
gcagaaccgcacccc

SEQ ID NO: 3030622 - RNA, 17 nt, Mycobacterium avium subsp. paratuberculosis
gcagaaccgcaccccgu

SEQ ID NO: 3030623 - RNA, 21 nt, Mycobacterium avium subsp. paratuberculosis
gcagaaccgcaccccgucgcg

SEQ ID NO: 3030624 - RNA, 22 nt, Mycobacterium avium subsp. paratuberculosis
gcagaaccgcaccccgucgcgg

SEQ ID NO: 3030625 - RNA, 13 nt, Mycobacterium avium subsp. paratuberculosis
gcagaacgacgcc

SEQ ID NO: 3030626 - RNA, 14 nt, Mycobacterium avium subsp. paratuberculosis
gcagaacgccauca

SEQ ID NO: 3030627 - RNA, 20 nt, Mycobacterium avium subsp. paratuberculosis
gcagaacgccaucaccagcg

SEQ ID NO: 3030628 - RNA, 14 nt, Mycobacterium avium subsp. paratuberculosis
gcagaacucgucgc

SEQ ID NO: 3030629 - RNA, 17 nt, Mycobacterium avium subsp. paratuberculosis
gcagaacucgucgccac

SEQ ID NO: 3030630 - RNA, 18 nt, Mycobacterium avium subsp. paratuberculosis
gcagaacuucuccgccgg

SEQ ID NO: 3030631 - RNA, 19 nt, Mycobacterium avium subsp. paratuberculosis
gcagaacuucuccgccggc

SEQ ID NO: 3030632 - RNA, 17 nt, Mycobacterium avium subsp. paratuberculosis
gcagaagcuccacgccg

SEQ ID NO: 3030633 - RNA, 19 nt, Mycobacterium avium subsp. paratuberculosis
gcagaagcuccacgccgcc

SEQ ID NO: 3030634 - RNA, 16 nt, Mycobacterium avium subsp. paratuberculosis
gcagaaguugacgguc

SEQ ID NO: 3030635 - RNA, 19 nt, Mycobacterium avium subsp. paratuberculosis
gcagacacaaaagcaccca

SEQ ID NO: 3030636 - RNA, 19 nt, Mycobacterium avium subsp. paratuberculosis
gcagacacaaaagcgcccg

SEQ ID NO: 3030637 - RNA, 22 nt, Mycobacterium avium subsp. paratuberculosis
gcagacccagcagcggccggcg

SEQ ID NO: 3030638 - RNA, 14 nt, Mycobacterium avium subsp. paratuberculosis
gcagacccccagca

SEQ ID NO: 3030639 - RNA, 20 nt, Mycobacterium avium subsp. paratuberculosis
gcagacccccagcagcgggg

SEQ ID NO: 3030640 - RNA, 21 nt, Mycobacterium avium subsp. paratuberculosis
gcagaccccggcguccaguag

SEQ ID NO: 3030641 - RNA, 13 nt, Mycobacterium avium subsp. paratuberculosis
gcagacccgccgc

SEQ ID NO: 3030642 - RNA, 14 nt, Mycobacterium avium subsp. paratuberculosis
gcagacccgccgcg

SEQ ID NO: 3030643 - RNA, 19 nt, Mycobacterium avium subsp. paratuberculosis
gcagacccgguggccgagg

SEQ ID NO: 3030644 - RNA, 18 nt, Mycobacterium avium subsp. paratuberculosis
gcagaccgaacccgggcg

SEQ ID NO: 3030645 - RNA, 17 nt, Mycobacterium avium subsp. paratuberculosis
gcagaccgccggugcgc

SEQ ID NO: 3030646 - RNA, 20 nt, Mycobacterium avium subsp. paratuberculosis
gcagaccgccggugcgcagc

SEQ ID NO: 3030647 - RNA, 21 nt, Mycobacterium avium subsp. paratuberculosis
gcagaccgccggugcgcagcu

SEQ ID NO: 3030648 - RNA, 18 nt, Mycobacterium avium subsp. paratuberculosis
gcagaccgcgaucagccc

SEQ ID NO: 3030649 - RNA, 14 nt, Mycobacterium avium subsp. paratuberculosis
gcagaccggacagc

SEQ ID NO: 3030650 - RNA, 20 nt, Mycobacterium avium subsp. paratuberculosis
gcagaccggacagcugggcg

SEQ ID NO: 3030651 - RNA, 14 nt, Mycobacterium avium subsp. paratuberculosis
gcagaccggugagc

SEQ ID NO: 3030652 - RNA, 20 nt, Mycobacterium avium subsp. paratuberculosis
gcagaccggugagcaccggg

SEQ ID NO: 3030653 - RNA, 18 nt, Mycobacterium avium subsp. paratuberculosis
gcagaccguccgguucgg

SEQ ID NO: 3030654 - RNA, 20 nt, Mycobacterium avium subsp. paratuberculosis
gcagaccguccgguucggcg

SEQ ID NO: 3030655 - RNA, 23 nt, Mycobacterium avium subsp. paratuberculosis
gcagacgaauucggagaccaggu

SEQ ID NO: 3030656 - RNA, 18 nt, Mycobacterium avium subsp. paratuberculosis
gcagacgcaaaaaccccc

SEQ ID NO: 3030657 - RNA, 19 nt, Mycobacterium avium subsp. paratuberculosis
gcagacgcaaaagccccca

SEQ ID NO: 3030658 - RNA, 18 nt, Mycobacterium avium subsp. paratuberculosis
gcagacgcgaaagcaccc

SEQ ID NO: 3030659 - RNA, 19 nt, Mycobacterium avium subsp. paratuberculosis
gcagacgcgaaagcacccg

SEQ ID NO: 3030660 - RNA, 17 nt, Mycobacterium avium subsp. paratuberculosis
gcagacggacacccgcg

SEQ ID NO: 3030661 - RNA, 21 nt, Mycobacterium avium subsp. paratuberculosis
gcagacggacacccgcgcggu

SEQ ID NO: 3030662 - RNA, 20 nt, Mycobacterium avium subsp. paratuberculosis
gcagacgguaugcccgccgc

SEQ ID NO: 3030663 - RNA, 22 nt, Mycobacterium avium subsp. paratuberculosis
gcagacgguaugcccgccgcgu

SEQ ID NO: 3030664 - RNA, 17 nt, Mycobacterium avium subsp. paratuberculosis
gcagacguagcaccagu

SEQ ID NO: 3030665 - RNA, 18 nt, Mycobacterium avium subsp. paratuberculosis
gcagacguagcaccaguc

SEQ ID NO: 3030666 - RNA, 21 nt, Mycobacterium avium subsp. paratuberculosis
gcagacguagcaccagucggc

SEQ ID NO: 3030667 - RNA, 18 nt, Mycobacterium avium subsp. paratuberculosis
gcagacgugaaauccccc

SEQ ID NO: 3030668 - RNA, 20 nt, Mycobacterium avium subsp. paratuberculosis
gcagacgugaaaucccccga

SEQ ID NO: 3030669 - RNA, 22 nt, Mycobacterium avium subsp. paratuberculosis
gcagacgugaaaucccccgacc

SEQ ID NO: 3030670 - RNA, 20 nt, Mycobacterium avium subsp. paratuberculosis
gcagagcgaugggcgcgauc

SEQ ID NO: 3030671 - RNA, 22 nt, Mycobacterium avium subsp. paratuberculosis
gcagagcggugacaucgccacc

SEQ ID NO: 3030672 - RNA, 16 nt, Mycobacterium avium subsp. paratuberculosis
gcagaggcguuuucgg

SEQ ID NO: 3030673 - RNA, 18 nt, Mycobacterium avium subsp. paratuberculosis
gcagauacaucucggugg

SEQ ID NO: 3030674 - RNA, 17 nt, Mycobacterium avium subsp. paratuberculosis
gcagauagaucgacgcg

SEQ ID NO: 3030675 - RNA, 14 nt, Mycobacterium avium subsp. paratuberculosis
gcagauagcccagc

SEQ ID NO: 3030676 - RNA, 17 nt, Mycobacterium avium subsp. paratuberculosis
gcagauagcccagccag

SEQ ID NO: 3030677 - RNA, 22 nt, Mycobacterium avium subsp. paratuberculosis
gcagauagcccagccagccggu

SEQ ID NO: 3030678 - RNA, 17 nt, Mycobacterium avium subsp. paratuberculosis
gcagauaggacccggcg

SEQ ID NO: 3030679 - RNA, 15 nt, Mycobacterium avium subsp. paratuberculosis
gcagauaggcggcga

SEQ ID NO: 3030680 - RNA, 16 nt, Mycobacterium avium subsp. paratuberculosis
gcagauaggcggcgac

SEQ ID NO: 3030681 - RNA, 14 nt, Mycobacterium avium subsp. paratuberculosis
gcagaucaccacgg

SEQ ID NO: 3030682 - RNA, 16 nt, Mycobacterium avium subsp. paratuberculosis
gcagaucaccacggug

SEQ ID NO: 3030683 - RNA, 20 nt, Mycobacterium avium subsp. paratuberculosis
gcagaucaccacgguggccg

SEQ ID NO: 3030684 - RNA, 19 nt, Mycobacterium avium subsp. paratuberculosis
gcagaucagggcgauggcc

SEQ ID NO: 3030685 - RNA, 20 nt, Mycobacterium avium subsp. paratuberculosis
gcagaucaucgagggcgucc

SEQ ID NO: 3030686 - RNA, 21 nt, Mycobacterium avium subsp. paratuberculosis
gcagaucaucgagggcguccu

SEQ ID NO: 3030687 - RNA, 16 nt, Mycobacterium avium subsp. paratuberculosis
gcagauccagaugccg

SEQ ID NO: 3030688 - RNA, 17 nt, Mycobacterium avium subsp. paratuberculosis
gcagauccagaugccgg

SEQ ID NO: 3030689 - RNA, 15 nt, Mycobacterium avium subsp. paratuberculosis
gcagaucccgccggc

SEQ ID NO: 3030690 - RNA, 16 nt, Mycobacterium avium subsp. paratuberculosis
gcagaucccgccggcg

SEQ ID NO: 3030691 - RNA, 18 nt, Mycobacterium avium subsp. paratuberculosis
gcagaucccgccggcggc

SEQ ID NO: 3030692 - RNA, 20 nt, Mycobacterium avium subsp. paratuberculosis
gcagaucccgccggcggcca

SEQ ID NO: 3030693 - RNA, 23 nt, Mycobacterium avium subsp. paratuberculosis
gcagaucccgccggcggccacga

SEQ ID NO: 3030694 - RNA, 17 nt, Mycobacterium avium subsp. paratuberculosis
gcagauccgcucgccgu

SEQ ID NO: 3030695 - RNA, 16 nt, Mycobacterium avium subsp. paratuberculosis
gcagauccugcagcug

SEQ ID NO: 3030696 - RNA, 19 nt, Mycobacterium avium subsp. paratuberculosis
gcagaucgagaucagggcg

SEQ ID NO: 3030697 - RNA, 22 nt, Mycobacterium avium subsp. paratuberculosis
gcagaucgcgcaucacccggcg

SEQ ID NO: 3030698 - RNA, 16 nt, Mycobacterium avium subsp. paratuberculosis
gcagaucgcggcccgc

SEQ ID NO: 3030699 - RNA, 23 nt, Mycobacterium avium subsp. paratuberculosis
gcagaucgcggcccgccgcucac

SEQ ID NO: 3030700 - RNA, 14 nt, Mycobacterium avium subsp. paratuberculosis
gcagaucggguccc

SEQ ID NO: 3030701 - RNA, 21 nt, Mycobacterium avium subsp. paratuberculosis
gcagaucgggucccagaugcg

SEQ ID NO: 3030702 - RNA, 17 nt, Mycobacterium avium subsp. paratuberculosis
gcagaucguccaucgcg

SEQ ID NO: 3030703 - RNA, 21 nt, Mycobacterium avium subsp. paratuberculosis
gcagaucguccaucgcgucgu

SEQ ID NO: 3030704 - RNA, 16 nt, Mycobacterium avium subsp. paratuberculosis
gcagaucgucgaacuc

SEQ ID NO: 3030705 - RNA, 14 nt, Mycobacterium avium subsp. paratuberculosis
gcagaucgucgacc

SEQ ID NO: 3030706 - RNA, 14 nt, Mycobacterium avium subsp. paratuberculosis
gcagaucguugggc

SEQ ID NO: 3030707 - RNA, 16 nt, Mycobacterium avium subsp. paratuberculosis
gcagaugaccggccug

SEQ ID NO: 3030708 - RNA, 16 nt, Mycobacterium avium subsp. paratuberculosis
gcagaugaugccguca

SEQ ID NO: 3030709 - RNA, 21 nt, Mycobacterium avium subsp. paratuberculosis
gcagaugcccgcugacaaagc

SEQ ID NO: 3030710 - RNA, 15 nt, Mycobacterium avium subsp. paratuberculosis
gcagaugccgcccag

SEQ ID NO: 3030711 - RNA, 23 nt, Mycobacterium avium subsp. paratuberculosis
gcagaugcgugcgguggucggcg

SEQ ID NO: 3030712 - RNA, 17 nt, Mycobacterium avium subsp. paratuberculosis
gcagauggucgccgacg

SEQ ID NO: 3030713 - RNA, 18 nt, Mycobacterium avium subsp. paratuberculosis
gcagauggucgccgacgg

SEQ ID NO: 3030714 - RNA, 20 nt, Mycobacterium avium subsp. paratuberculosis
gcagauucgaggucaucgag

SEQ ID NO: 3030715 - RNA, 21 nt, Mycobacterium avium subsp. paratuberculosis
gcagcaacaugauuccgccgg

SEQ ID NO: 3030716 - RNA, 13 nt, Mycobacterium avium subsp. paratuberculosis
gcagcaaccggcg

SEQ ID NO: 3030717 - RNA, 15 nt, Mycobacterium avium subsp. paratuberculosis
gcagcaaccggcggc

SEQ ID NO: 3030718 - RNA, 16 nt, Mycobacterium avium subsp. paratuberculosis
gcagcaaccggcggcu

SEQ ID NO: 3030719 - RNA, 17 nt, Mycobacterium avium subsp. paratuberculosis
gcagcaaccggcggcug

SEQ ID NO: 3030720 - RNA, 15 nt, Mycobacterium avium subsp. paratuberculosis
gcagcaaccggguca

SEQ ID NO: 3030721 - RNA, 14 nt, Mycobacterium avium subsp. paratuberculosis
gcagcaacgcggug

SEQ ID NO: 3030722 - RNA, 14 nt, Mycobacterium avium subsp. paratuberculosis
gcagcaacggcggc

SEQ ID NO: 3030723 - RNA, 15 nt, Mycobacterium avium subsp. paratuberculosis
gcagcaacggcggcg

SEQ ID NO: 3030724 - RNA, 20 nt, Mycobacterium avium subsp. paratuberculosis
gcagcaacggcggcggcacc

SEQ ID NO: 3030725 - RNA, 17 nt, Mycobacterium avium subsp. paratuberculosis
gcagcaacuccaccucg

SEQ ID NO: 3030726 - RNA, 20 nt, Mycobacterium avium subsp. paratuberculosis
gcagcaacuccaccucgggc

SEQ ID NO: 3030727 - RNA, 18 nt, Mycobacterium avium subsp. paratuberculosis
gcagcaacucgcgcuccc

SEQ ID NO: 3030728 - RNA, 20 nt, Mycobacterium avium subsp. paratuberculosis
gcagcaacucgcgcucccgg

SEQ ID NO: 3030729 - RNA, 15 nt, Mycobacterium avium subsp. paratuberculosis
gcagcaagagcaggc

SEQ ID NO: 3030730 - RNA, 17 nt, Mycobacterium avium subsp. paratuberculosis
gcagcaauugacgccga

SEQ ID NO: 3030731 - RNA, 18 nt, Mycobacterium avium subsp. paratuberculosis
gcagcaauugacgccgac

SEQ ID NO: 3030732 - RNA, 13 nt, Mycobacterium avium subsp. paratuberculosis
gcagcacaccggc

SEQ ID NO: 3030733 - RNA, 14 nt, Mycobacterium avium subsp. paratuberculosis
gcagcacaccggca

SEQ ID NO: 3030734 - RNA, 20 nt, Mycobacterium avium subsp. paratuberculosis
gcagcacaccuuccaccacc

SEQ ID NO: 3030735 - RNA, 22 nt, Mycobacterium avium subsp. paratuberculosis
gcagcacauccagcccugcuug

SEQ ID NO: 3030736 - RNA, 12 nt, Mycobacterium avium subsp. paratuberculosis
gcagcaccaccc

SEQ ID NO: 3030737 - RNA, 22 nt, Mycobacterium avium subsp. paratuberculosis
gcagcaccacccgcaccucgcc

SEQ ID NO: 3030738 - RNA, 17 nt, Mycobacterium avium subsp. paratuberculosis
gcagcaccaccucgugc

SEQ ID NO: 3030739 - RNA, 13 nt, Mycobacterium avium subsp. paratuberculosis
gcagcaccacgaa

SEQ ID NO: 3030740 - RNA, 22 nt, Mycobacterium avium subsp. paratuberculosis
gcagcaccagaugcaccucgcc

SEQ ID NO: 3030741 - RNA, 23 nt, Mycobacterium avium subsp. paratuberculosis
gcagcaccagaugcaccucgccc

SEQ ID NO: 3030742 - RNA, 12 nt, Mycobacterium avium subsp. paratuberculosis
gcagcaccagcg

SEQ ID NO: 3030743 - RNA, 14 nt, Mycobacterium avium subsp. paratuberculosis
gcagcaccagcgcc

SEQ ID NO: 3030744 - RNA, 15 nt, Mycobacterium avium subsp. paratuberculosis
gcagcaccagcgccg

SEQ ID NO: 3030745 - RNA, 20 nt, Mycobacterium avium subsp. paratuberculosis
gcagcaccagcgccgcgaug

SEQ ID NO: 3030746 - RNA, 14 nt, Mycobacterium avium subsp. paratuberculosis
gcagcaccagcggc

SEQ ID NO: 3030747 - RNA, 15 nt, Mycobacterium avium subsp. paratuberculosis
gcagcaccagcgugg

SEQ ID NO: 3030748 - RNA, 18 nt, Mycobacterium avium subsp. paratuberculosis
gcagcaccagcguggccg

SEQ ID NO: 3030749 - RNA, 20 nt, Mycobacterium avium subsp. paratuberculosis
gcagcaccagcguggccggc

SEQ ID NO: 3030750 - RNA, 12 nt, Mycobacterium avium subsp. paratuberculosis
gcagcaccaggc

SEQ ID NO: 3030751 - RNA, 13 nt, Mycobacterium avium subsp. paratuberculosis
gcagcaccaggcc

SEQ ID NO: 3030752 - RNA, 16 nt, Mycobacterium avium subsp. paratuberculosis
gcagcaccaggcccuc

SEQ ID NO: 3030753 - RNA, 20 nt, Mycobacterium avium subsp. paratuberculosis
gcagcaccaggcccuccugg

SEQ ID NO: 3030754 - RNA, 21 nt, Mycobacterium avium subsp. paratuberculosis
gcagcaccaggcccucgccgc

SEQ ID NO: 3030755 - RNA, 23 nt, Mycobacterium avium subsp. paratuberculosis
gcagcaccaggcccucgccgcgg

SEQ ID NO: 3030756 - RNA, 15 nt, Mycobacterium avium subsp. paratuberculosis
gcagcaccaggcuga

SEQ ID NO: 3030757 - RNA, 21 nt, Mycobacterium avium subsp. paratuberculosis
gcagcaccaggcugaccagcg

SEQ ID NO: 3030758 - RNA, 14 nt, Mycobacterium avium subsp. paratuberculosis
gcagcaccagggcg

SEQ ID NO: 3030759 - RNA, 16 nt, Mycobacterium avium subsp. paratuberculosis
gcagcaccauccgcgc

SEQ ID NO: 3030760 - RNA, 17 nt, Mycobacterium avium subsp. paratuberculosis
gcagcaccccgaucgcg

SEQ ID NO: 3030761 - RNA, 16 nt, Mycobacterium avium subsp. paratuberculosis
gcagcacccgacuucg

SEQ ID NO: 3030762 - RNA, 15 nt, Mycobacterium avium subsp. paratuberculosis
gcagcacccgcaccg

SEQ ID NO: 3030763 - RNA, 16 nt, Mycobacterium avium subsp. paratuberculosis
gcagcacccgcaccgu

SEQ ID NO: 3030764 - RNA, 14 nt, Mycobacterium avium subsp. paratuberculosis
gcagcacccgggcc

SEQ ID NO: 3030765 - RNA, 20 nt, Mycobacterium avium subsp. paratuberculosis
gcagcacccgggccugcggc

SEQ ID NO: 3030766 - RNA, 23 nt, Mycobacterium avium subsp. paratuberculosis
gcagcacccgggccugcggcggc

SEQ ID NO: 3030767 - RNA, 15 nt, Mycobacterium avium subsp. paratuberculosis
gcagcacccggguga

SEQ ID NO: 3030768 - RNA, 20 nt, Mycobacterium avium subsp. paratuberculosis
gcagcacccggucgccggug

SEQ ID NO: 3030769 - RNA, 16 nt, Mycobacterium avium subsp. paratuberculosis
gcagcaccgaaccggc

SEQ ID NO: 3030770 - RNA, 17 nt, Mycobacterium avium subsp. paratuberculosis
gcagcaccgaaccggcg

SEQ ID NO: 3030771 - RNA, 18 nt, Mycobacterium avium subsp. paratuberculosis
gcagcaccgaaccggcgg

SEQ ID NO: 3030772 - RNA, 22 nt, Mycobacterium avium subsp. paratuberculosis
gcagcaccgaaccggcgggguc

SEQ ID NO: 3030773 - RNA, 14 nt, Mycobacterium avium subsp. paratuberculosis
gcagcaccgccagc

SEQ ID NO: 3030774 - RNA, 13 nt, Mycobacterium avium subsp. paratuberculosis
gcagcaccgccga

SEQ ID NO: 3030775 - RNA, 14 nt, Mycobacterium avium subsp. paratuberculosis
gcagcaccgccgac

SEQ ID NO: 3030776 - RNA, 15 nt, Mycobacterium avium subsp. paratuberculosis
gcagcaccgccgagc

SEQ ID NO: 3030777 - RNA, 16 nt, Mycobacterium avium subsp. paratuberculosis
gcagcaccgccgagcc

SEQ ID NO: 3030778 - RNA, 14 nt, Mycobacterium avium subsp. paratuberculosis
gcagcaccgcgacc

SEQ ID NO: 3030779 - RNA, 19 nt, Mycobacterium avium subsp. paratuberculosis
gcagcaccgcgaccggucc

SEQ ID NO: 3030780 - RNA, 17 nt, Mycobacterium avium subsp. paratuberculosis
gcagcaccgcgucggcg

SEQ ID NO: 3030781 - RNA, 18 nt, Mycobacterium avium subsp. paratuberculosis
gcagcaccgcgucggcgc

SEQ ID NO: 3030782 - RNA, 19 nt, Mycobacterium avium subsp. paratuberculosis
gcagcaccgcgucggcgcu

SEQ ID NO: 3030783 - RNA, 12 nt, Mycobacterium avium subsp. paratuberculosis
gcagcaccggca

SEQ ID NO: 3030784 - RNA, 17 nt, Mycobacterium avium subsp. paratuberculosis
gcagcaccggcaccgcg

SEQ ID NO: 3030785 - RNA, 18 nt, Mycobacterium avium subsp. paratuberculosis
gcagcaccggcaccgcgg

SEQ ID NO: 3030786 - RNA, 19 nt, Mycobacterium avium subsp. paratuberculosis
gcagcaccggcaccgcggc

SEQ ID NO: 3030787 - RNA, 13 nt, Mycobacterium avium subsp. paratuberculosis
gcagcaccggcag

SEQ ID NO: 3030788 - RNA, 13 nt, Mycobacterium avium subsp. paratuberculosis
gcagcaccggcgc

SEQ ID NO: 3030789 - RNA, 15 nt, Mycobacterium avium subsp. paratuberculosis
gcagcaccggcgccu

SEQ ID NO: 3030790 - RNA, 15 nt, Mycobacterium avium subsp. paratuberculosis
gcagcaccuccgaca

SEQ ID NO: 3030791 - RNA, 22 nt, Mycobacterium avium subsp. paratuberculosis
gcagcaccuccgacagcccccg

SEQ ID NO: 3030792 - RNA, 23 nt, Mycobacterium avium subsp. paratuberculosis
gcagcaccuccgacagcccccgc

SEQ ID NO: 3030793 - RNA, 14 nt, Mycobacterium avium subsp. paratuberculosis
gcagcaccucgcgc

SEQ ID NO: 3030794 - RNA, 18 nt, Mycobacterium avium subsp. paratuberculosis
gcagcaccucgcgcgcga

SEQ ID NO: 3030795 - RNA, 20 nt, Mycobacterium avium subsp. paratuberculosis
gcagcaccuugccggucggg

SEQ ID NO: 3030796 - RNA, 14 nt, Mycobacterium avium subsp. paratuberculosis
gcagcacgaugauc

SEQ ID NO: 3030797 - RNA, 12 nt, Mycobacterium avium subsp. paratuberculosis
gcagcacgccca

SEQ ID NO: 3030798 - RNA, 14 nt, Mycobacterium avium subsp. paratuberculosis
gcagcacgcccaga

SEQ ID NO: 3030799 - RNA, 19 nt, Mycobacterium avium subsp. paratuberculosis
gcagcacgcccagcccgcg

SEQ ID NO: 3030800 - RNA, 21 nt, Mycobacterium avium subsp. paratuberculosis
gcagcacgcccagcccgcggg

SEQ ID NO: 3030801 - RNA, 17 nt, Mycobacterium avium subsp. paratuberculosis
gcagcacgcccguagcg

SEQ ID NO: 3030802 - RNA, 16 nt, Mycobacterium avium subsp. paratuberculosis
gcagcacgcccucggc

SEQ ID NO: 3030803 - RNA, 19 nt, Mycobacterium avium subsp. paratuberculosis
gcagcacgccgcggaaggc

SEQ ID NO: 3030804 - RNA, 22 nt, Mycobacterium avium subsp. paratuberculosis
gcagcacggccacugccccggc

SEQ ID NO: 3030805 - RNA, 15 nt, Mycobacterium avium subsp. paratuberculosis
gcagcacguccccgg

SEQ ID NO: 3030806 - RNA, 21 nt, Mycobacterium avium subsp. paratuberculosis
gcagcacguccccgggcaccc

SEQ ID NO: 3030807 - RNA, 15 nt, Mycobacterium avium subsp. paratuberculosis
gcagcacgucguagg

SEQ ID NO: 3030808 - RNA, 23 nt, Mycobacterium avium subsp. paratuberculosis
gcagcacguguucgggaucggcg

SEQ ID NO: 3030809 - RNA, 16 nt, Mycobacterium avium subsp. paratuberculosis
gcagcacugagcggca

SEQ ID NO: 3030810 - RNA, 18 nt, Mycobacterium avium subsp. paratuberculosis
gcagcagaaccagcaccg

SEQ ID NO: 3030811 - RNA, 19 nt, Mycobacterium avium subsp. paratuberculosis
gcagcagaaccagcaccgc

SEQ ID NO: 3030812 - RNA, 21 nt, Mycobacterium avium subsp. paratuberculosis
gcagcagaaccagcaccgccg

SEQ ID NO: 3030813 - RNA, 22 nt, Mycobacterium avium subsp. paratuberculosis
gcagcagaaccagcaccgccgc

SEQ ID NO: 3030814 - RNA, 15 nt, Mycobacterium avium subsp. paratuberculosis
gcagcagaccgccgg

SEQ ID NO: 3030815 - RNA, 18 nt, Mycobacterium avium subsp. paratuberculosis
gcagcagaccgccggugc

SEQ ID NO: 3030816 - RNA, 23 nt, Mycobacterium avium subsp. paratuberculosis
gcagcagaccgcgaucagcccca

SEQ ID NO: 3030817 - RNA, 19 nt, Mycobacterium avium subsp. paratuberculosis
gcagcagauccucagcagc

SEQ ID NO: 3030818 - RNA, 23 nt, Mycobacterium avium subsp. paratuberculosis
gcagcagaucggcgucacugccc

SEQ ID NO: 3030819 - RNA, 12 nt, Mycobacterium avium subsp. paratuberculosis
gcagcagcacca

SEQ ID NO: 3030820 - RNA, 13 nt, Mycobacterium avium subsp. paratuberculosis
gcagcagcaccag

SEQ ID NO: 3030821 - RNA, 14 nt, Mycobacterium avium subsp. paratuberculosis
gcagcagcaccagg

SEQ ID NO: 3030822 - RNA, 16 nt, Mycobacterium avium subsp. paratuberculosis
gcagcagcaccaggcu

SEQ ID NO: 3030823 - RNA, 15 nt, Mycobacterium avium subsp. paratuberculosis
gcagcagcaccccga

SEQ ID NO: 3030824 - RNA, 12 nt, Mycobacterium avium subsp. paratuberculosis
gcagcagcagcg

SEQ ID NO: 3030825 - RNA, 13 nt, Mycobacterium avium subsp. paratuberculosis
gcagcagcagcgg

SEQ ID NO: 3030826 - RNA, 15 nt, Mycobacterium avium subsp. paratuberculosis
gcagcagcagcggca

SEQ ID NO: 3030827 - RNA, 18 nt, Mycobacterium avium subsp. paratuberculosis
gcagcagcaggucgucga

SEQ ID NO: 3030828 - RNA, 14 nt, Mycobacterium avium subsp. paratuberculosis
gcagcagcaucggu

SEQ ID NO: 3030829 - RNA, 16 nt, Mycobacterium avium subsp. paratuberculosis
gcagcagccacgccag

SEQ ID NO: 3030830 - RNA, 19 nt, Mycobacterium avium subsp. paratuberculosis
gcagcagccacgccagcca

SEQ ID NO: 3030831 - RNA, 22 nt, Mycobacterium avium subsp. paratuberculosis
gcagcagccacgccagccaggc

SEQ ID NO: 3030832 - RNA, 23 nt, Mycobacterium avium subsp. paratuberculosis
gcagcagcccgaacagccgggcg

SEQ ID NO: 3030833 - RNA, 24 nt, Mycobacterium avium subsp. paratuberculosis
gcagcagcccgaacagccgggcgg

SEQ ID NO: 3030834 - RNA, 13 nt, Mycobacterium avium subsp. paratuberculosis
gcagcagcccgau

SEQ ID NO: 3030835 - RNA, 20 nt, Mycobacterium avium subsp. paratuberculosis
gcagcagcccgaucaccccc

SEQ ID NO: 3030836 - RNA, 13 nt, Mycobacterium avium subsp. paratuberculosis
gcagcagcccgcc

SEQ ID NO: 3030837 - RNA, 19 nt, Mycobacterium avium subsp. paratuberculosis
gcagcagcccgucccggcc

SEQ ID NO: 3030838 - RNA, 13 nt, Mycobacterium avium subsp. paratuberculosis
gcagcagccgccg

SEQ ID NO: 3030839 - RNA, 14 nt, Mycobacterium avium subsp. paratuberculosis
gcagcagccgccgg

SEQ ID NO: 3030840 - RNA, 14 nt, Mycobacterium avium subsp. paratuberculosis
gcagcagccggacc

SEQ ID NO: 3030841 - RNA, 22 nt, Mycobacterium avium subsp. paratuberculosis
gcagcagcgacuugaccagcag

SEQ ID NO: 3030842 - RNA, 23 nt, Mycobacterium avium subsp. paratuberculosis
gcagcagcgacuugaccagcagc

SEQ ID NO: 3030843 - RNA, 13 nt, Mycobacterium avium subsp. paratuberculosis
gcagcagcgccag

SEQ ID NO: 3030844 - RNA, 15 nt, Mycobacterium avium subsp. paratuberculosis
gcagcagcgccagca

SEQ ID NO: 3030845 - RNA, 17 nt, Mycobacterium avium subsp. paratuberculosis
gcagcagcgccagcagc

SEQ ID NO: 3030846 - RNA, 18 nt, Mycobacterium avium subsp. paratuberculosis
gcagcagcgccagcagcg

SEQ ID NO: 3030847 - RNA, 20 nt, Mycobacterium avium subsp. paratuberculosis
gcagcagcgccagcagcggc

SEQ ID NO: 3030848 - RNA, 14 nt, Mycobacterium avium subsp. paratuberculosis
gcagcagcgcccac

SEQ ID NO: 3030849 - RNA, 23 nt, Mycobacterium avium subsp. paratuberculosis
gcagcagcgcccaccgcucgucg

SEQ ID NO: 3030850 - RNA, 15 nt, Mycobacterium avium subsp. paratuberculosis
gcagcagcgccgcca

SEQ ID NO: 3030851 - RNA, 15 nt, Mycobacterium avium subsp. paratuberculosis
gcagcagcgcgcggu

SEQ ID NO: 3030852 - RNA, 14 nt, Mycobacterium avium subsp. paratuberculosis
gcagcagcgcggca

SEQ ID NO: 3030853 - RNA, 13 nt, Mycobacterium avium subsp. paratuberculosis
gcagcagcgcggu

SEQ ID NO: 3030854 - RNA, 14 nt, Mycobacterium avium subsp. paratuberculosis
gcagcagcgcggug

SEQ ID NO: 3030855 - RNA, 15 nt, Mycobacterium avium subsp. paratuberculosis
gcagcagcgcggugc

SEQ ID NO: 3030856 - RNA, 21 nt, Mycobacterium avium subsp. paratuberculosis
gcagcagcgcggugccgaccu

SEQ ID NO: 3030857 - RNA, 15 nt, Mycobacterium avium subsp. paratuberculosis
gcagcagcgcgucgu

SEQ ID NO: 3030858 - RNA, 16 nt, Mycobacterium avium subsp. paratuberculosis
gcagcagcgcgucgug

SEQ ID NO: 3030859 - RNA, 19 nt, Mycobacterium avium subsp. paratuberculosis
gcagcagcguuccgucggc

SEQ ID NO: 3030860 - RNA, 19 nt, Mycobacterium avium subsp. paratuberculosis
gcagcagcucgauggaccg

SEQ ID NO: 3030861 - RNA, 16 nt, Mycobacterium avium subsp. paratuberculosis
gcagcagcugcacccg

SEQ ID NO: 3030862 - RNA, 21 nt, Mycobacterium avium subsp. paratuberculosis
gcagcagcugcgucggcacca

SEQ ID NO: 3030863 - RNA, 23 nt, Mycobacterium avium subsp. paratuberculosis
gcagcagcugcgucggcaccagc

SEQ ID NO: 3030864 - RNA, 14 nt, Mycobacterium avium subsp. paratuberculosis
gcagcagcuggaac

SEQ ID NO: 3030865 - RNA, 15 nt, Mycobacterium avium subsp. paratuberculosis
gcagcaggcgccggu

SEQ ID NO: 3030866 - RNA, 16 nt, Mycobacterium avium subsp. paratuberculosis
gcagcaggcgccgguc

SEQ ID NO: 3030867 - RNA, 21 nt, Mycobacterium avium subsp. paratuberculosis
gcagcaggcggacggcgaccu

SEQ ID NO: 3030868 - RNA, 22 nt, Mycobacterium avium subsp. paratuberculosis
gcagcagggcgcgcaucugcuc

SEQ ID NO: 3030869 - RNA, 14 nt, Mycobacterium avium subsp. paratuberculosis
gcagcagggugccg

SEQ ID NO: 3030870 - RNA, 19 nt, Mycobacterium avium subsp. paratuberculosis
gcagcagggugccgccgcc

SEQ ID NO: 3030871 - RNA, 20 nt, Mycobacterium avium subsp. paratuberculosis
gcagcagguaaaccagcagc

SEQ ID NO: 3030872 - RNA, 21 nt, Mycobacterium avium subsp. paratuberculosis
gcagcagguaaaccagcagcg

SEQ ID NO: 3030873 - RNA, 18 nt, Mycobacterium avium subsp. paratuberculosis
gcagcaggucggccagcu

SEQ ID NO: 3030874 - RNA, 14 nt, Mycobacterium avium subsp. paratuberculosis
gcagcaggucggcg

SEQ ID NO: 3030875 - RNA, 15 nt, Mycobacterium avium subsp. paratuberculosis
gcagcaggucggcgu

SEQ ID NO: 3030876 - RNA, 16 nt, Mycobacterium avium subsp. paratuberculosis
gcagcaggucggcgug

SEQ ID NO: 3030877 - RNA, 19 nt, Mycobacterium avium subsp. paratuberculosis
gcagcaggucggcgugcuc

SEQ ID NO: 3030878 - RNA, 21 nt, Mycobacterium avium subsp. paratuberculosis
gcagcaggucggcgugcucgu

SEQ ID NO: 3030879 - RNA, 14 nt, Mycobacterium avium subsp. paratuberculosis
gcagcaggucgucg

SEQ ID NO: 3030880 - RNA, 15 nt, Mycobacterium avium subsp. paratuberculosis
gcagcaggucgucga

SEQ ID NO: 3030881 - RNA, 18 nt, Mycobacterium avium subsp. paratuberculosis
gcagcaggugcaucgcca

SEQ ID NO: 3030882 - RNA, 19 nt, Mycobacterium avium subsp. paratuberculosis
gcagcaggugcaucgccac

SEQ ID NO: 3030883 - RNA, 21 nt, Mycobacterium avium subsp. paratuberculosis
gcagcaggugcaucgccaccg

SEQ ID NO: 3030884 - RNA, 23 nt, Mycobacterium avium subsp. paratuberculosis
gcagcagguuguagucggcgccg

SEQ ID NO: 3030885 - RNA, 16 nt, Mycobacterium avium subsp. paratuberculosis
gcagcaguuccggagc

SEQ ID NO: 3030886 - RNA, 20 nt, Mycobacterium avium subsp. paratuberculosis
gcagcaguuccggagcgcgg

SEQ ID NO: 3030887 - RNA, 21 nt, Mycobacterium avium subsp. paratuberculosis
gcagcaguuccggagcgcggu

SEQ ID NO: 3030888 - RNA, 22 nt, Mycobacterium avium subsp. paratuberculosis
gcagcaguuccggagcgcgguc

SEQ ID NO: 3030889 - RNA, 20 nt, Mycobacterium avium subsp. paratuberculosis
gcagcaucaaauucaggaag

SEQ ID NO: 3030890 - RNA, 20 nt, Mycobacterium avium subsp. paratuberculosis
gcagcauccagguggcgccu

SEQ ID NO: 3030891 - RNA, 22 nt, Mycobacterium avium subsp. paratuberculosis
gcagcauccagguggcgccucc

SEQ ID NO: 3030892 - RNA, 15 nt, Mycobacterium avium subsp. paratuberculosis
gcagcauccgcacca

SEQ ID NO: 3030893 - RNA, 16 nt, Mycobacterium avium subsp. paratuberculosis
gcagcauccgcaccag

SEQ ID NO: 3030894 - RNA, 14 nt, Mycobacterium avium subsp. paratuberculosis
gcagcauccgccga

SEQ ID NO: 3030895 - RNA, 18 nt, Mycobacterium avium subsp. paratuberculosis
gcagcauccgccgacgau

SEQ ID NO: 3030896 - RNA, 13 nt, Mycobacterium avium subsp. paratuberculosis
gcagcaucggcag

SEQ ID NO: 3030897 - RNA, 15 nt, Mycobacterium avium subsp. paratuberculosis
gcagcaucggcagau

SEQ ID NO: 3030898 - RNA, 13 nt, Mycobacterium avium subsp. paratuberculosis
gcagcaucgggac

SEQ ID NO: 3030899 - RNA, 16 nt, Mycobacterium avium subsp. paratuberculosis
gcagcaucuccgaguc

SEQ ID NO: 3030900 - RNA, 20 nt, Mycobacterium avium subsp. paratuberculosis
gcagcaucuccgagucggcg

SEQ ID NO: 3030901 - RNA, 22 nt, Mycobacterium avium subsp. paratuberculosis
gcagcaucucuugaugcagcgc

SEQ ID NO: 3030902 - RNA, 16 nt, Mycobacterium avium subsp. paratuberculosis
gcagcaugccgagcac

SEQ ID NO: 3030903 - RNA, 22 nt, Mycobacterium avium subsp. paratuberculosis
gcagcaugccgagcaccuccga

SEQ ID NO: 3030904 - RNA, 23 nt, Mycobacterium avium subsp. paratuberculosis
gcagcauggacccgaagucgacg

SEQ ID NO: 3030905 - RNA, 19 nt, Mycobacterium avium subsp. paratuberculosis
gcagcauggcccacaggac

SEQ ID NO: 3030906 - RNA, 24 nt, Mycobacterium avium subsp. paratuberculosis
gcagcauguuggcguagugggucg

SEQ ID NO: 3030907 - RNA, 21 nt, Mycobacterium avium subsp. paratuberculosis
gcagcauucgccggggucgcg

SEQ ID NO: 3030908 - RNA, 20 nt, Mycobacterium avium subsp. paratuberculosis
gcagcauuuccgagcgacga

SEQ ID NO: 3030909 - RNA, 17 nt, Mycobacterium avium subsp. paratuberculosis
gcagccaaccgccgggg

SEQ ID NO: 3030910 - RNA, 14 nt, Mycobacterium avium subsp. paratuberculosis
gcagccacccgucg

SEQ ID NO: 3030911 - RNA, 12 nt, Mycobacterium avium subsp. paratuberculosis
gcagccaccgcc

SEQ ID NO: 3030912 - RNA, 13 nt, Mycobacterium avium subsp. paratuberculosis
gcagccaccgccc

SEQ ID NO: 3030913 - RNA, 15 nt, Mycobacterium avium subsp. paratuberculosis
gcagccaccgcccga

SEQ ID NO: 3030914 - RNA, 18 nt, Mycobacterium avium subsp. paratuberculosis
gcagccacgacaccagcg

SEQ ID NO: 3030915 - RNA, 18 nt, Mycobacterium avium subsp. paratuberculosis
gcagccacgagcccagcc

SEQ ID NO: 3030916 - RNA, 15 nt, Mycobacterium avium subsp. paratuberculosis
gcagccacgccagcc

SEQ ID NO: 3030917 - RNA, 17 nt, Mycobacterium avium subsp. paratuberculosis
gcagccacgccagccag

SEQ ID NO: 3030918 - RNA, 15 nt, Mycobacterium avium subsp. paratuberculosis
gcagccacggcagcu

SEQ ID NO: 3030919 - RNA, 19 nt, Mycobacterium avium subsp. paratuberculosis
gcagccagaccucgccgac

SEQ ID NO: 3030920 - RNA, 13 nt, Mycobacterium avium subsp. paratuberculosis
gcagccagcccag

SEQ ID NO: 3030921 - RNA, 14 nt, Mycobacterium avium subsp. paratuberculosis
gcagccagcccagc

SEQ ID NO: 3030922 - RNA, 15 nt, Mycobacterium avium subsp. paratuberculosis
gcagccagcccagcc

SEQ ID NO: 3030923 - RNA, 12 nt, Mycobacterium avium subsp. paratuberculosis
gcagccagcccg

SEQ ID NO: 3030924 - RNA, 15 nt, Mycobacterium avium subsp. paratuberculosis
gcagccagccuggcg

SEQ ID NO: 3030925 - RNA, 14 nt, Mycobacterium avium subsp. paratuberculosis
gcagccagcgcagc

SEQ ID NO: 3030926 - RNA, 15 nt, Mycobacterium avium subsp. paratuberculosis
gcagccagcgcagca

SEQ ID NO: 3030927 - RNA, 18 nt, Mycobacterium avium subsp. paratuberculosis
gcagccagcgcagcacug

SEQ ID NO: 3030928 - RNA, 13 nt, Mycobacterium avium subsp. paratuberculosis
gcagccagcgccg

SEQ ID NO: 3030929 - RNA, 15 nt, Mycobacterium avium subsp. paratuberculosis
gcagccagcucggcg

SEQ ID NO: 3030930 - RNA, 12 nt, Mycobacterium avium subsp. paratuberculosis
gcagccaggaca

SEQ ID NO: 3030931 - RNA, 14 nt, Mycobacterium avium subsp. paratuberculosis
gcagccaggacagc

SEQ ID NO: 3030932 - RNA, 17 nt, Mycobacterium avium subsp. paratuberculosis
gcagccaggacagcguc

SEQ ID NO: 3030933 - RNA, 21 nt, Mycobacterium avium subsp. paratuberculosis
gcagccaggcguuggucacca

SEQ ID NO: 3030934 - RNA, 15 nt, Mycobacterium avium subsp. paratuberculosis
gcagccagguccggg

SEQ ID NO: 3030935 - RNA, 12 nt, Mycobacterium avium subsp. paratuberculosis
gcagccagguga

SEQ ID NO: 3030936 - RNA, 22 nt, Mycobacterium avium subsp. paratuberculosis
gcagccagguggugaacucuuc

SEQ ID NO: 3030937 - RNA, 16 nt, Mycobacterium avium subsp. paratuberculosis
gcagccagucgccggc

SEQ ID NO: 3030938 - RNA, 22 nt, Mycobacterium avium subsp. paratuberculosis
gcagccagucgccggccaggcc

SEQ ID NO: 3030939 - RNA, 14 nt, Mycobacterium avium subsp. paratuberculosis
gcagcccagccagc

SEQ ID NO: 3030940 - RNA, 17 nt, Mycobacterium avium subsp. paratuberculosis
gcagcccaggcccagca

SEQ ID NO: 3030941 - RNA, 14 nt, Mycobacterium avium subsp. paratuberculosis
gcagcccccggacc

SEQ ID NO: 3030942 - RNA, 14 nt, Mycobacterium avium subsp. paratuberculosis
gcagccccgucggu

SEQ ID NO: 3030943 - RNA, 14 nt, Mycobacterium avium subsp. paratuberculosis
gcagccccugcacc

SEQ ID NO: 3030944 - RNA, 21 nt, Mycobacterium avium subsp. paratuberculosis
gcagccccugcaccacgaagc

SEQ ID NO: 3030945 - RNA, 16 nt, Mycobacterium avium subsp. paratuberculosis
gcagcccgaacagccg

SEQ ID NO: 3030946 - RNA, 18 nt, Mycobacterium avium subsp. paratuberculosis
gcagcccgaacagccggg

SEQ ID NO: 3030947 - RNA, 16 nt, Mycobacterium avium subsp. paratuberculosis
gcagcccgaccaccuc

SEQ ID NO: 3030948 - RNA, 23 nt, Mycobacterium avium subsp. paratuberculosis
gcagcccgaccaccuccccgcgg

SEQ ID NO: 3030949 - RNA, 19 nt, Mycobacterium avium subsp. paratuberculosis
gcagcccgaucacccccga

SEQ ID NO: 3030950 - RNA, 17 nt, Mycobacterium avium subsp. paratuberculosis
gcagcccgaucgccagc

SEQ ID NO: 3030951 - RNA, 18 nt, Mycobacterium avium subsp. paratuberculosis
gcagcccgaucgccagcg

SEQ ID NO: 3030952 - RNA, 19 nt, Mycobacterium avium subsp. paratuberculosis
gcagcccgaucgccagcgc

SEQ ID NO: 3030953 - RNA, 23 nt, Mycobacterium avium subsp. paratuberculosis
gcagcccgaucgccagcgcccga

SEQ ID NO: 3030954 - RNA, 19 nt, Mycobacterium avium subsp. paratuberculosis
gcagcccgaucucgcgguc

SEQ ID NO: 3030955 - RNA, 14 nt, Mycobacterium avium subsp. paratuberculosis
gcagcccgccagga

SEQ ID NO: 3030956 - RNA, 13 nt, Mycobacterium avium subsp. paratuberculosis
gcagcccgccgac

SEQ ID NO: 3030957 - RNA, 13 nt, Mycobacterium avium subsp. paratuberculosis
gcagcccgccgcg

SEQ ID NO: 3030958 - RNA, 12 nt, Mycobacterium avium subsp. paratuberculosis
gcagcccgccgg

SEQ ID NO: 3030959 - RNA, 13 nt, Mycobacterium avium subsp. paratuberculosis
gcagcccgccggg

SEQ ID NO: 3030960 - RNA, 18 nt, Mycobacterium avium subsp. paratuberculosis
gcagcccgcguccagcag

SEQ ID NO: 3030961 - RNA, 23 nt, Mycobacterium avium subsp. paratuberculosis
gcagcccggaggcgaugcggguc

SEQ ID NO: 3030962 - RNA, 13 nt, Mycobacterium avium subsp. paratuberculosis
gcagcccggccag

SEQ ID NO: 3030963 - RNA, 14 nt, Mycobacterium avium subsp. paratuberculosis
gcagcccggccagc

SEQ ID NO: 3030964 - RNA, 20 nt, Mycobacterium avium subsp. paratuberculosis
gcagcccggccagccgggcg

SEQ ID NO: 3030965 - RNA, 23 nt, Mycobacterium avium subsp. paratuberculosis
gcagcccggccagccgggcggcc

SEQ ID NO: 3030966 - RNA, 11 nt, Mycobacterium avium subsp. paratuberculosis
gcagcccggcg

SEQ ID NO: 3030967 - RNA, 13 nt, Mycobacterium avium subsp. paratuberculosis
gcagcccggcugc

SEQ ID NO: 3030968 - RNA, 14 nt, Mycobacterium avium subsp. paratuberculosis
gcagcccggcugcg

SEQ ID NO: 3030969 - RNA, 19 nt, Mycobacterium avium subsp. paratuberculosis
gcagcccggcugcgcagcg

SEQ ID NO: 3030970 - RNA, 15 nt, Mycobacterium avium subsp. paratuberculosis
gcagcccgggcugca

SEQ ID NO: 3030971 - RNA, 17 nt, Mycobacterium avium subsp. paratuberculosis
gcagcccggguccuggc

SEQ ID NO: 3030972 - RNA, 23 nt, Mycobacterium avium subsp. paratuberculosis
gcagcccgggucuagaucuccag

SEQ ID NO: 3030973 - RNA, 22 nt, Mycobacterium avium subsp. paratuberculosis
gcagcccgguuuccaguccggc

SEQ ID NO: 3030974 - RNA, 20 nt, Mycobacterium avium subsp. paratuberculosis
gcagcccgucccggcccaug

SEQ ID NO: 3030975 - RNA, 15 nt, Mycobacterium avium subsp. paratuberculosis
gcagcccgucgaucc

SEQ ID NO: 3030976 - RNA, 16 nt, Mycobacterium avium subsp. paratuberculosis
gcagccgaagaacugg

SEQ ID NO: 3030977 - RNA, 21 nt, Mycobacterium avium subsp. paratuberculosis
gcagccgaucucguagcccac

SEQ ID NO: 3030978 - RNA, 13 nt, Mycobacterium avium subsp. paratuberculosis
gcagccgaucugg

SEQ ID NO: 3030979 - RNA, 19 nt, Mycobacterium avium subsp. paratuberculosis
gcagccgaucuggcgggcg

SEQ ID NO: 3030980 - RNA, 20 nt, Mycobacterium avium subsp. paratuberculosis
gcagccgaucuggcgggcgg

SEQ ID NO: 3030981 - RNA, 22 nt, Mycobacterium avium subsp. paratuberculosis
gcagccgaugucgucgaacgcg

SEQ ID NO: 3030982 - RNA, 18 nt, Mycobacterium avium subsp. paratuberculosis
gcagccgcaacacggccu

SEQ ID NO: 3030983 - RNA, 15 nt, Mycobacterium avium subsp. paratuberculosis
gcagccgcacaccgc

SEQ ID NO: 3030984 - RNA, 18 nt, Mycobacterium avium subsp. paratuberculosis
gcagccgcacaccgcggc

SEQ ID NO: 3030985 - RNA, 19 nt, Mycobacterium avium subsp. paratuberculosis
gcagccgcacaccgcggcg

SEQ ID NO: 3030986 - RNA, 21 nt, Mycobacterium avium subsp. paratuberculosis
gcagccgcacaccgcggcggc

SEQ ID NO: 3030987 - RNA, 18 nt, Mycobacterium avium subsp. paratuberculosis
gcagccgcaccucggggc

SEQ ID NO: 3030988 - RNA, 19 nt, Mycobacterium avium subsp. paratuberculosis
gcagccgcaccucggggcg

SEQ ID NO: 3030989 - RNA, 17 nt, Mycobacterium avium subsp. paratuberculosis
gcagccgcagcggcggc

SEQ ID NO: 3030990 - RNA, 18 nt, Mycobacterium avium subsp. paratuberculosis
gcagccgcagcggcggcu

SEQ ID NO: 3030991 - RNA, 15 nt, Mycobacterium avium subsp. paratuberculosis
gcagccgccgcgcca

SEQ ID NO: 3030992 - RNA, 13 nt, Mycobacterium avium subsp. paratuberculosis
gcagccgccgcgg

SEQ ID NO: 3030993 - RNA, 20 nt, Mycobacterium avium subsp. paratuberculosis
gcagccgccgcggagcggcg

SEQ ID NO: 3030994 - RNA, 14 nt, Mycobacterium avium subsp. paratuberculosis
gcagccgccgggcc

SEQ ID NO: 3030995 - RNA, 15 nt, Mycobacterium avium subsp. paratuberculosis
gcagccgccgggcca

SEQ ID NO: 3030996 - RNA, 16 nt, Mycobacterium avium subsp. paratuberculosis
gcagccgccgggccac

SEQ ID NO: 3030997 - RNA, 22 nt, Mycobacterium avium subsp. paratuberculosis
gcagccgccgggccacgccgac

SEQ ID NO: 3030998 - RNA, 14 nt, Mycobacterium avium subsp. paratuberculosis
gcagccgccgggcu

SEQ ID NO: 3030999 - RNA, 14 nt, Mycobacterium avium subsp. paratuberculosis
gcagccgcgacggc

SEQ ID NO: 3031000 - RNA, 15 nt, Mycobacterium avium subsp. paratuberculosis
gcagccgcgacggcg

SEQ ID NO: 3031001 - RNA, 16 nt, Mycobacterium avium subsp. paratuberculosis
gcagccgcgacggcgg

SEQ ID NO: 3031002 - RNA, 17 nt, Mycobacterium avium subsp. paratuberculosis
gcagccgcgagucgagg

SEQ ID NO: 3031003 - RNA, 14 nt, Mycobacterium avium subsp. paratuberculosis
gcagccgcgccacc

SEQ ID NO: 3031004 - RNA, 17 nt, Mycobacterium avium subsp. paratuberculosis
gcagccgcgccaccgcg

SEQ ID NO: 3031005 - RNA, 21 nt, Mycobacterium avium subsp. paratuberculosis
gcagccgcgccaccgcggggc

SEQ ID NO: 3031006 - RNA, 22 nt, Mycobacterium avium subsp. paratuberculosis
gcagccgcgccaccgcggggcu

SEQ ID NO: 3031007 - RNA, 14 nt, Mycobacterium avium subsp. paratuberculosis
gcagccgcgcccac

SEQ ID NO: 3031008 - RNA, 19 nt, Mycobacterium avium subsp. paratuberculosis
gcagccgcgcccacccgcg

SEQ ID NO: 3031009 - RNA, 13 nt, Mycobacterium avium subsp. paratuberculosis
gcagccgcgcccg

SEQ ID NO: 3031010 - RNA, 15 nt, Mycobacterium avium subsp. paratuberculosis
gcagccgcgcccgau

SEQ ID NO: 3031011 - RNA, 19 nt, Mycobacterium avium subsp. paratuberculosis
gcagccgcgccgacgccca

SEQ ID NO: 3031012 - RNA, 20 nt, Mycobacterium avium subsp. paratuberculosis
gcagccgcgccgacgcccac

SEQ ID NO: 3031013 - RNA, 16 nt, Mycobacterium avium subsp. paratuberculosis
gcagccgcgccgccgc

SEQ ID NO: 3031014 - RNA, 17 nt, Mycobacterium avium subsp. paratuberculosis
gcagccgcgccgggcgg

SEQ ID NO: 3031015 - RNA, 14 nt, Mycobacterium avium subsp. paratuberculosis
gcagccgcgcgagc

SEQ ID NO: 3031016 - RNA, 23 nt, Mycobacterium avium subsp. paratuberculosis
gcagccgcgcgagcaucaccguc

SEQ ID NO: 3031017 - RNA, 14 nt, Mycobacterium avium subsp. paratuberculosis
gcagccgcgcggcc

SEQ ID NO: 3031018 - RNA, 16 nt, Mycobacterium avium subsp. paratuberculosis
gcagccgcgcggccgg

SEQ ID NO: 3031019 - RNA, 19 nt, Mycobacterium avium subsp. paratuberculosis
gcagccgcgcgugcagccg

SEQ ID NO: 3031020 - RNA, 21 nt, Mycobacterium avium subsp. paratuberculosis
gcagccgcgcgugcagccggg

SEQ ID NO: 3031021 - RNA, 19 nt, Mycobacterium avium subsp. paratuberculosis
gcagccgcucggggauccc

SEQ ID NO: 3031022 - RNA, 15 nt, Mycobacterium avium subsp. paratuberculosis
gcagccgcucguagu

SEQ ID NO: 3031023 - RNA, 14 nt, Mycobacterium avium subsp. paratuberculosis
gcagccgcugcagc

SEQ ID NO: 3031024 - RNA, 15 nt, Mycobacterium avium subsp. paratuberculosis
gcagccgcugcagcg

SEQ ID NO: 3031025 - RNA, 13 nt, Mycobacterium avium subsp. paratuberculosis
gcagccgcugccg

SEQ ID NO: 3031026 - RNA, 17 nt, Mycobacterium avium subsp. paratuberculosis
gcagccgcugccgcacc

SEQ ID NO: 3031027 - RNA, 20 nt, Mycobacterium avium subsp. paratuberculosis
gcagccgcugccgcaccccg

SEQ ID NO: 3031028 - RNA, 14 nt, Mycobacterium avium subsp. paratuberculosis
gcagccgcugcugg

SEQ ID NO: 3031029 - RNA, 15 nt, Mycobacterium avium subsp. paratuberculosis
gcagccgcugcuggg

SEQ ID NO: 3031030 - RNA, 16 nt, Mycobacterium avium subsp. paratuberculosis
gcagccgcugcugggu

SEQ ID NO: 3031031 - RNA, 18 nt, Mycobacterium avium subsp. paratuberculosis
gcagccgcugcugggugc

SEQ ID NO: 3031032 - RNA, 20 nt, Mycobacterium avium subsp. paratuberculosis
gcagccgcugcugggugccg

SEQ ID NO: 3031033 - RNA, 14 nt, Mycobacterium avium subsp. paratuberculosis
gcagccgcuggccg

SEQ ID NO: 3031034 - RNA, 18 nt, Mycobacterium avium subsp. paratuberculosis
gcagccgcuggccgcgcc

SEQ ID NO: 3031035 - RNA, 15 nt, Mycobacterium avium subsp. paratuberculosis
gcagccgcuuggccg

SEQ ID NO: 3031036 - RNA, 19 nt, Mycobacterium avium subsp. paratuberculosis
gcagccgcuuggccgggcg

SEQ ID NO: 3031037 - RNA, 20 nt, Mycobacterium avium subsp. paratuberculosis
gcagccggaaggccaaggcc

SEQ ID NO: 3031038 - RNA, 23 nt, Mycobacterium avium subsp. paratuberculosis
gcagccggaaggccaaggccagc

SEQ ID NO: 3031039 - RNA, 13 nt, Mycobacterium avium subsp. paratuberculosis
gcagccggaucac

SEQ ID NO: 3031040 - RNA, 16 nt, Mycobacterium avium subsp. paratuberculosis
gcagccggaucaccug

SEQ ID NO: 3031041 - RNA, 18 nt, Mycobacterium avium subsp. paratuberculosis
gcagccggaucucgucgg

SEQ ID NO: 3031042 - RNA, 20 nt, Mycobacterium avium subsp. paratuberculosis
gcagccggaucucgucgggc

SEQ ID NO: 3031043 - RNA, 21 nt, Mycobacterium avium subsp. paratuberculosis
gcagccggaucucgucgggca

SEQ ID NO: 3031044 - RNA, 21 nt, Mycobacterium avium subsp. paratuberculosis
gcagccggcaacucccgaucg

SEQ ID NO: 3031045 - RNA, 22 nt, Mycobacterium avium subsp. paratuberculosis
gcagccggcagcauucgccggg

SEQ ID NO: 3031046 - RNA, 21 nt, Mycobacterium avium subsp. paratuberculosis
gcagccggccaccgccccagc

SEQ ID NO: 3031047 - RNA, 23 nt, Mycobacterium avium subsp. paratuberculosis
gcagccggccaccucgucccagc

SEQ ID NO: 3031048 - RNA, 20 nt, Mycobacterium avium subsp. paratuberculosis
gcagccggccaucucggcgg

SEQ ID NO: 3031049 - RNA, 14 nt, Mycobacterium avium subsp. paratuberculosis
gcagccggccgacc

SEQ ID NO: 3031050 - RNA, 13 nt, Mycobacterium avium subsp. paratuberculosis
gcagccggccggc

SEQ ID NO: 3031051 - RNA, 14 nt, Mycobacterium avium subsp. paratuberculosis
gcagccggccggca

SEQ ID NO: 3031052 - RNA, 14 nt, Mycobacterium avium subsp. paratuberculosis
gcagccggccggcg

SEQ ID NO: 3031053 - RNA, 14 nt, Mycobacterium avium subsp. paratuberculosis
gcagccggccgucc

SEQ ID NO: 3031054 - RNA, 21 nt, Mycobacterium avium subsp. paratuberculosis
gcagccggccguccacggcgg

SEQ ID NO: 3031055 - RNA, 13 nt, Mycobacterium avium subsp. paratuberculosis
gcagccggcgccc

SEQ ID NO: 3031056 - RNA, 15 nt, Mycobacterium avium subsp. paratuberculosis
gcagccggcgcccgc

SEQ ID NO: 3031057 - RNA, 15 nt, Mycobacterium avium subsp. paratuberculosis
gcagccggcgcggca

SEQ ID NO: 3031058 - RNA, 14 nt, Mycobacterium avium subsp. paratuberculosis
gcagccggcgcggu

SEQ ID NO: 3031059 - RNA, 13 nt, Mycobacterium avium subsp. paratuberculosis
gcagccggcggcg

SEQ ID NO: 3031060 - RNA, 17 nt, Mycobacterium avium subsp. paratuberculosis
gcagccggcggcgccuu

SEQ ID NO: 3031061 - RNA, 21 nt, Mycobacterium avium subsp. paratuberculosis
gcagccggcguacucgcacag

SEQ ID NO: 3031062 - RNA, 15 nt, Mycobacterium avium subsp. paratuberculosis
gcagccgggccagca

SEQ ID NO: 3031063 - RNA, 20 nt, Mycobacterium avium subsp. paratuberculosis
gcagccgggccagcaacagc

SEQ ID NO: 3031064 - RNA, 13 nt, Mycobacterium avium subsp. paratuberculosis
gcagccgggccug

SEQ ID NO: 3031065 - RNA, 17 nt, Mycobacterium avium subsp. paratuberculosis
gcagccgggccugcagc

SEQ ID NO: 3031066 - RNA, 19 nt, Mycobacterium avium subsp. paratuberculosis
gcagccgggccugcggcgc

SEQ ID NO: 3031067 - RNA, 22 nt, Mycobacterium avium subsp. paratuberculosis
gcagccgggccugcggcgcggc

SEQ ID NO: 3031068 - RNA, 23 nt, Mycobacterium avium subsp. paratuberculosis
gcagccgggccugcggcgcggcc

SEQ ID NO: 3031069 - RNA, 17 nt, Mycobacterium avium subsp. paratuberculosis
gcagccgggcgaucauc

SEQ ID NO: 3031070 - RNA, 20 nt, Mycobacterium avium subsp. paratuberculosis
gcagccgggcgaucauccag

SEQ ID NO: 3031071 - RNA, 13 nt, Mycobacterium avium subsp. paratuberculosis
gcagccgggcggc

SEQ ID NO: 3031072 - RNA, 14 nt, Mycobacterium avium subsp. paratuberculosis
gcagccgggcggcg

SEQ ID NO: 3031073 - RNA, 16 nt, Mycobacterium avium subsp. paratuberculosis
gcagccgggcggcgcc

SEQ ID NO: 3031074 - RNA, 18 nt, Mycobacterium avium subsp. paratuberculosis
gcagccgggcggcgccga

SEQ ID NO: 3031075 - RNA, 14 nt, Mycobacterium avium subsp. paratuberculosis
gcagccgggcggug

SEQ ID NO: 3031076 - RNA, 14 nt, Mycobacterium avium subsp. paratuberculosis
gcagccgggggcgg

SEQ ID NO: 3031077 - RNA, 15 nt, Mycobacterium avium subsp. paratuberculosis
gcagccgggggcggu

SEQ ID NO: 3031078 - RNA, 16 nt, Mycobacterium avium subsp. paratuberculosis
gcagccgggggcggug

SEQ ID NO: 3031079 - RNA, 19 nt, Mycobacterium avium subsp. paratuberculosis
gcagccgggggcggugcag

SEQ ID NO: 3031080 - RNA, 22 nt, Mycobacterium avium subsp. paratuberculosis
gcagccgggggcggugcagccg

SEQ ID NO: 3031081 - RNA, 13 nt, Mycobacterium avium subsp. paratuberculosis
gcagccggggguc

SEQ ID NO: 3031082 - RNA, 12 nt, Mycobacterium avium subsp. paratuberculosis
gcagccggggug

SEQ ID NO: 3031083 - RNA, 16 nt, Mycobacterium avium subsp. paratuberculosis
gcagccggggugcccg

SEQ ID NO: 3031084 - RNA, 19 nt, Mycobacterium avium subsp. paratuberculosis
gcagccggggugcccgggc

SEQ ID NO: 3031085 - RNA, 20 nt, Mycobacterium avium subsp. paratuberculosis
gcagccggggugcccgggcc

SEQ ID NO: 3031086 - RNA, 22 nt, Mycobacterium avium subsp. paratuberculosis
gcagccgggucaguucgcggcg

SEQ ID NO: 3031087 - RNA, 23 nt, Mycobacterium avium subsp. paratuberculosis
gcagccgggucaguucgcggcgc

SEQ ID NO: 3031088 - RNA, 14 nt, Mycobacterium avium subsp. paratuberculosis
gcagccgggugccc

SEQ ID NO: 3031089 - RNA, 17 nt, Mycobacterium avium subsp. paratuberculosis
gcagccgggugcgggcc

SEQ ID NO: 3031090 - RNA, 18 nt, Mycobacterium avium subsp. paratuberculosis
gcagccgggugcgggcca

SEQ ID NO: 3031091 - RNA, 19 nt, Mycobacterium avium subsp. paratuberculosis
gcagccgggugcgggccag

SEQ ID NO: 3031092 - RNA, 15 nt, Mycobacterium avium subsp. paratuberculosis
gcagccgggugcggu

SEQ ID NO: 3031093 - RNA, 19 nt, Mycobacterium avium subsp. paratuberculosis
gcagccgggugcggugcag

SEQ ID NO: 3031094 - RNA, 15 nt, Mycobacterium avium subsp. paratuberculosis
gcagccggguggccc

SEQ ID NO: 3031095 - RNA, 18 nt, Mycobacterium avium subsp. paratuberculosis
gcagccggguggcccgcc

SEQ ID NO: 3031096 - RNA, 19 nt, Mycobacterium avium subsp. paratuberculosis
gcagccggguggcccgccc

SEQ ID NO: 3031097 - RNA, 14 nt, Mycobacterium avium subsp. paratuberculosis
gcagccgggugggc

SEQ ID NO: 3031098 - RNA, 15 nt, Mycobacterium avium subsp. paratuberculosis
gcagccgggugggcg

SEQ ID NO: 3031099 - RNA, 18 nt, Mycobacterium avium subsp. paratuberculosis
gcagccgggugggcggca

SEQ ID NO: 3031100 - RNA, 12 nt, Mycobacterium avium subsp. paratuberculosis
gcagccgguaca

SEQ ID NO: 3031101 - RNA, 16 nt, Mycobacterium avium subsp. paratuberculosis
gcagccgguccaugug

SEQ ID NO: 3031102 - RNA, 12 nt, Mycobacterium avium subsp. paratuberculosis
gcagccgguccg

SEQ ID NO: 3031103 - RNA, 14 nt, Mycobacterium avium subsp. paratuberculosis
gcagccgguccggc

SEQ ID NO: 3031104 - RNA, 16 nt, Mycobacterium avium subsp. paratuberculosis
gcagccgguccggcgg

SEQ ID NO: 3031105 - RNA, 21 nt, Mycobacterium avium subsp. paratuberculosis
gcagccgguccggcggcacca

SEQ ID NO: 3031106 - RNA, 19 nt, Mycobacterium avium subsp. paratuberculosis
gcagccggucgaggucgcc

SEQ ID NO: 3031107 - RNA, 22 nt, Mycobacterium avium subsp. paratuberculosis
gcagccggucgaggucgccgac

SEQ ID NO: 3031108 - RNA, 15 nt, Mycobacterium avium subsp. paratuberculosis
gcagccgucccagga

SEQ ID NO: 3031109 - RNA, 17 nt, Mycobacterium avium subsp. paratuberculosis
gcagccgucgaucuuga

SEQ ID NO: 3031110 - RNA, 16 nt, Mycobacterium avium subsp. paratuberculosis
gcagccgucgaugccg

SEQ ID NO: 3031111 - RNA, 19 nt, Mycobacterium avium subsp. paratuberculosis
gcagccgucgaugccggcg

SEQ ID NO: 3031112 - RNA, 23 nt, Mycobacterium avium subsp. paratuberculosis
gcagccgucgaugccggcgacga

SEQ ID NO: 3031113 - RNA, 21 nt, Mycobacterium avium subsp. paratuberculosis
gcagccgucgcaucagcucgg

SEQ ID NO: 3031114 - RNA, 13 nt, Mycobacterium avium subsp. paratuberculosis
gcagccgugccca

SEQ ID NO: 3031115 - RNA, 22 nt, Mycobacterium avium subsp. paratuberculosis
gcagccguuccaucgggcccag

SEQ ID NO: 3031116 - RNA, 23 nt, Mycobacterium avium subsp. paratuberculosis
gcagccguuccaucgggcccagc

SEQ ID NO: 3031117 - RNA, 18 nt, Mycobacterium avium subsp. paratuberculosis
gcagccuucuucgccggg

SEQ ID NO: 3031118 - RNA, 21 nt, Mycobacterium avium subsp. paratuberculosis
gcagccuucuucgccggggcc

SEQ ID NO: 3031119 - RNA, 19 nt, Mycobacterium avium subsp. paratuberculosis
gcagccuucuuggcgggcg

SEQ ID NO: 3031120 - RNA, 23 nt, Mycobacterium avium subsp. paratuberculosis
gcagcgaaaccuccggagaucgc

SEQ ID NO: 3031121 - RNA, 19 nt, Mycobacterium avium subsp. paratuberculosis
gcagcgaacccgccagggc

SEQ ID NO: 3031122 - RNA, 22 nt, Mycobacterium avium subsp. paratuberculosis
gcagcgaacccgccagggcgac

SEQ ID NO: 3031123 - RNA, 18 nt, Mycobacterium avium subsp. paratuberculosis
gcagcgaacgucaggauc

SEQ ID NO: 3031124 - RNA, 20 nt, Mycobacterium avium subsp. paratuberculosis
gcagcgaagcgaggcgccac

SEQ ID NO: 3031125 - RNA, 17 nt, Mycobacterium avium subsp. paratuberculosis
gcagcgaauacaccguc

SEQ ID NO: 3031126 - RNA, 19 nt, Mycobacterium avium subsp. paratuberculosis
gcagcgaauacaccgucca

SEQ ID NO: 3031127 - RNA, 21 nt, Mycobacterium avium subsp. paratuberculosis
gcagcgaauacaccguccagc

SEQ ID NO: 3031128 - RNA, 23 nt, Mycobacterium avium subsp. paratuberculosis
gcagcgacagcgcgucggccagc

SEQ ID NO: 3031129 - RNA, 21 nt, Mycobacterium avium subsp. paratuberculosis
gcagcgacaugaccaccgcgu

SEQ ID NO: 3031130 - RNA, 22 nt, Mycobacterium avium subsp. paratuberculosis
gcagcgaccugguccaccgcgg

SEQ ID NO: 3031131 - RNA, 21 nt, Mycobacterium avium subsp. paratuberculosis
gcagcgacgcggugagcgcgc

SEQ ID NO: 3031132 - RNA, 16 nt, Mycobacterium avium subsp. paratuberculosis
gcagcgacggaucggc

SEQ ID NO: 3031133 - RNA, 22 nt, Mycobacterium avium subsp. paratuberculosis
gcagcgacggaucggccgcguc

SEQ ID NO: 3031134 - RNA, 14 nt, Mycobacterium avium subsp. paratuberculosis
gcagcgacucgggc

SEQ ID NO: 3031135 - RNA, 16 nt, Mycobacterium avium subsp. paratuberculosis
gcagcgacucgggcag

SEQ ID NO: 3031136 - RNA, 22 nt, Mycobacterium avium subsp. paratuberculosis
gcagcgacucgggcaggauggu

SEQ ID NO: 3031137 - RNA, 23 nt, Mycobacterium avium subsp. paratuberculosis
gcagcgacucgggcaggaugguc

SEQ ID NO: 3031138 - RNA, 21 nt, Mycobacterium avium subsp. paratuberculosis
gcagcgacucguuggccggcu

SEQ ID NO: 3031139 - RNA, 22 nt, Mycobacterium avium subsp. paratuberculosis
gcagcgacucguuggccggcuc

SEQ ID NO: 3031140 - RNA, 23 nt, Mycobacterium avium subsp. paratuberculosis
gcagcgacugcacccgggucagg

SEQ ID NO: 3031141 - RNA, 17 nt, Mycobacterium avium subsp. paratuberculosis
gcagcgacuggaccacc

SEQ ID NO: 3031142 - RNA, 23 nt, Mycobacterium avium subsp. paratuberculosis
gcagcgacuggcccucggaggug

SEQ ID NO: 3031143 - RNA, 17 nt, Mycobacterium avium subsp. paratuberculosis
gcagcgacuugaccagc

SEQ ID NO: 3031144 - RNA, 18 nt, Mycobacterium avium subsp. paratuberculosis
gcagcgacuugaccagca

SEQ ID NO: 3031145 - RNA, 22 nt, Mycobacterium avium subsp. paratuberculosis
gcagcgacuugaccagcagcug

SEQ ID NO: 3031146 - RNA, 14 nt, Mycobacterium avium subsp. paratuberculosis
gcagcgagaaccgg

SEQ ID NO: 3031147 - RNA, 18 nt, Mycobacterium avium subsp. paratuberculosis
gcagcgagaaccggcgca

SEQ ID NO: 3031148 - RNA, 24 nt, Mycobacterium avium subsp. paratuberculosis
gcagcgagaccggcacggugcaca

SEQ ID NO: 3031149 - RNA, 22 nt, Mycobacterium avium subsp. paratuberculosis
gcagcgagaccucccggcgcca

SEQ ID NO: 3031150 - RNA, 18 nt, Mycobacterium avium subsp. paratuberculosis
gcagcgagcacagcggcg

SEQ ID NO: 3031151 - RNA, 12 nt, Mycobacterium avium subsp. paratuberculosis
gcagcgaggcgc

SEQ ID NO: 3031152 - RNA, 17 nt, Mycobacterium avium subsp. paratuberculosis
gcagcgaggcgcgcagg

SEQ ID NO: 3031153 - RNA, 18 nt, Mycobacterium avium subsp. paratuberculosis
gcagcgaggcguccagcg

SEQ ID NO: 3031154 - RNA, 20 nt, Mycobacterium avium subsp. paratuberculosis
gcagcgaggcguccagcgcg

SEQ ID NO: 3031155 - RNA, 15 nt, Mycobacterium avium subsp. paratuberculosis
gcagcgaucggcggc

SEQ ID NO: 3031156 - RNA, 12 nt, Mycobacterium avium subsp. paratuberculosis
gcagcgcaccgg

SEQ ID NO: 3031157 - RNA, 14 nt, Mycobacterium avium subsp. paratuberculosis
gcagcgcaccggcg

SEQ ID NO: 3031158 - RNA, 18 nt, Mycobacterium avium subsp. paratuberculosis
gcagcgcacgucgccgcc

SEQ ID NO: 3031159 - RNA, 22 nt, Mycobacterium avium subsp. paratuberculosis
gcagcgcacgucgccgccgcaa

SEQ ID NO: 3031160 - RNA, 23 nt, Mycobacterium avium subsp. paratuberculosis
gcagcgcagcaccauccgcgcga

SEQ ID NO: 3031161 - RNA, 20 nt, Mycobacterium avium subsp. paratuberculosis
gcagcgcagcgucggcgugc

SEQ ID NO: 3031162 - RNA, 19 nt, Mycobacterium avium subsp. paratuberculosis
gcagcgcauccgacaccgc

SEQ ID NO: 3031163 - RNA, 17 nt, Mycobacterium avium subsp. paratuberculosis
gcagcgcaucgccggcg

SEQ ID NO: 3031164 - RNA, 19 nt, Mycobacterium avium subsp. paratuberculosis
gcagcgcaucgccggcgau

SEQ ID NO: 3031165 - RNA, 13 nt, Mycobacterium avium subsp. paratuberculosis
gcagcgcaucggu

SEQ ID NO: 3031166 - RNA, 19 nt, Mycobacterium avium subsp. paratuberculosis
gcagcgcaucguugccggc

SEQ ID NO: 3031167 - RNA, 22 nt, Mycobacterium avium subsp. paratuberculosis
gcagcgcaucguugccggcggc

SEQ ID NO: 3031168 - RNA, 15 nt, Mycobacterium avium subsp. paratuberculosis
gcagcgccacaaugg

SEQ ID NO: 3031169 - RNA, 14 nt, Mycobacterium avium subsp. paratuberculosis
gcagcgccaccagc

SEQ ID NO: 3031170 - RNA, 15 nt, Mycobacterium avium subsp. paratuberculosis
gcagcgccaccagcu

SEQ ID NO: 3031171 - RNA, 16 nt, Mycobacterium avium subsp. paratuberculosis
gcagcgccaccagcuc

SEQ ID NO: 3031172 - RNA, 17 nt, Mycobacterium avium subsp. paratuberculosis
gcagcgccaccagcucc

SEQ ID NO: 3031173 - RNA, 12 nt, Mycobacterium avium subsp. paratuberculosis
gcagcgccagca

SEQ ID NO: 3031174 - RNA, 15 nt, Mycobacterium avium subsp. paratuberculosis
gcagcgccagcaccg

SEQ ID NO: 3031175 - RNA, 20 nt, Mycobacterium avium subsp. paratuberculosis
gcagcgccagcaccgccugg

SEQ ID NO: 3031176 - RNA, 18 nt, Mycobacterium avium subsp. paratuberculosis
gcagcgccagcaccgggc

SEQ ID NO: 3031177 - RNA, 19 nt, Mycobacterium avium subsp. paratuberculosis
gcagcgccagcaccgggcc

SEQ ID NO: 3031178 - RNA, 22 nt, Mycobacterium avium subsp. paratuberculosis
gcagcgccagcaccgggcccag

SEQ ID NO: 3031179 - RNA, 13 nt, Mycobacterium avium subsp. paratuberculosis
gcagcgccagcag

SEQ ID NO: 3031180 - RNA, 15 nt, Mycobacterium avium subsp. paratuberculosis
gcagcgccagcgcgc

SEQ ID NO: 3031181 - RNA, 19 nt, Mycobacterium avium subsp. paratuberculosis
gcagcgccagcgcgcccgc

SEQ ID NO: 3031182 - RNA, 20 nt, Mycobacterium avium subsp. paratuberculosis
gcagcgccagcgcgcccgcc

SEQ ID NO: 3031183 - RNA, 21 nt, Mycobacterium avium subsp. paratuberculosis
gcagcgcccaccgcucgucgg

SEQ ID NO: 3031184 - RNA, 13 nt, Mycobacterium avium subsp. paratuberculosis
gcagcgcccagcc

SEQ ID NO: 3031185 - RNA, 16 nt, Mycobacterium avium subsp. paratuberculosis
gcagcgcccagccgag

SEQ ID NO: 3031186 - RNA, 18 nt, Mycobacterium avium subsp. paratuberculosis
gcagcgcccagccgagcc

SEQ ID NO: 3031187 - RNA, 20 nt, Mycobacterium avium subsp. paratuberculosis
gcagcgcccagccgagccgg

SEQ ID NO: 3031188 - RNA, 22 nt, Mycobacterium avium subsp. paratuberculosis
gcagcgcccagccgagccgggc

SEQ ID NO: 3031189 - RNA, 15 nt, Mycobacterium avium subsp. paratuberculosis
gcagcgcccaggcgu

SEQ ID NO: 3031190 - RNA, 21 nt, Mycobacterium avium subsp. paratuberculosis
gcagcgcccaggcgugcgcgu

SEQ ID NO: 3031191 - RNA, 17 nt, Mycobacterium avium subsp. paratuberculosis
gcagcgccccgguccgg

SEQ ID NO: 3031192 - RNA, 13 nt, Mycobacterium avium subsp. paratuberculosis
gcagcgcccggcg

SEQ ID NO: 3031193 - RNA, 15 nt, Mycobacterium avium subsp. paratuberculosis
gcagcgcccggcgau

SEQ ID NO: 3031194 - RNA, 13 nt, Mycobacterium avium subsp. paratuberculosis
gcagcgcccgggc

SEQ ID NO: 3031195 - RNA, 14 nt, Mycobacterium avium subsp. paratuberculosis
gcagcgcccgggcc

SEQ ID NO: 3031196 - RNA, 15 nt, Mycobacterium avium subsp. paratuberculosis
gcagcgcccgggugc

SEQ ID NO: 3031197 - RNA, 15 nt, Mycobacterium avium subsp. paratuberculosis
gcagcgccgaggcca

SEQ ID NO: 3031198 - RNA, 16 nt, Mycobacterium avium subsp. paratuberculosis
gcagcgccgaggccag

SEQ ID NO: 3031199 - RNA, 19 nt, Mycobacterium avium subsp. paratuberculosis
gcagcgccgaggccagcac

SEQ ID NO: 3031200 - RNA, 14 nt, Mycobacterium avium subsp. paratuberculosis
gcagcgccgccacc

SEQ ID NO: 3031201 - RNA, 16 nt, Mycobacterium avium subsp. paratuberculosis
gcagcgccgccaccgg

SEQ ID NO: 3031202 - RNA, 18 nt, Mycobacterium avium subsp. paratuberculosis
gcagcgccgccaccggcc

SEQ ID NO: 3031203 - RNA, 21 nt, Mycobacterium avium subsp. paratuberculosis
gcagcgccgccaccggccggu

SEQ ID NO: 3031204 - RNA, 23 nt, Mycobacterium avium subsp. paratuberculosis
gcagcgccgccaccggccggucc

SEQ ID NO: 3031205 - RNA, 12 nt, Mycobacterium avium subsp. paratuberculosis
gcagcgccgccc

SEQ ID NO: 3031206 - RNA, 14 nt, Mycobacterium avium subsp. paratuberculosis
gcagcgccgcccgc

SEQ ID NO: 3031207 - RNA, 22 nt, Mycobacterium avium subsp. paratuberculosis
gcagcgccgcccgcaccugcgc

SEQ ID NO: 3031208 - RNA, 12 nt, Mycobacterium avium subsp. paratuberculosis
gcagcgccgcga

SEQ ID NO: 3031209 - RNA, 14 nt, Mycobacterium avium subsp. paratuberculosis
gcagcgccgcgacg

SEQ ID NO: 3031210 - RNA, 15 nt, Mycobacterium avium subsp. paratuberculosis
gcagcgccgcgccga

SEQ ID NO: 3031211 - RNA, 18 nt, Mycobacterium avium subsp. paratuberculosis
gcagcgccgcgccgaccu

SEQ ID NO: 3031212 - RNA, 12 nt, Mycobacterium avium subsp. paratuberculosis
gcagcgccgcgg

SEQ ID NO: 3031213 - RNA, 13 nt, Mycobacterium avium subsp. paratuberculosis
gcagcgccgcggc

SEQ ID NO: 3031214 - RNA, 16 nt, Mycobacterium avium subsp. paratuberculosis
gcagcgccgcggccgg

SEQ ID NO: 3031215 - RNA, 17 nt, Mycobacterium avium subsp. paratuberculosis
gcagcgccgcggccggu

SEQ ID NO: 3031216 - RNA, 19 nt, Mycobacterium avium subsp. paratuberculosis
gcagcgccgcggccggugc

SEQ ID NO: 3031217 - RNA, 23 nt, Mycobacterium avium subsp. paratuberculosis
gcagcgccgcuucgucgccggcc

SEQ ID NO: 3031218 - RNA, 13 nt, Mycobacterium avium subsp. paratuberculosis
gcagcgccggcag

SEQ ID NO: 3031219 - RNA, 14 nt, Mycobacterium avium subsp. paratuberculosis
gcagcgccggcagc

SEQ ID NO: 3031220 - RNA, 12 nt, Mycobacterium avium subsp. paratuberculosis
gcagcgccgucc

SEQ ID NO: 3031221 - RNA, 13 nt, Mycobacterium avium subsp. paratuberculosis
gcagcgccguccg

SEQ ID NO: 3031222 - RNA, 16 nt, Mycobacterium avium subsp. paratuberculosis
gcagcgccguccgcac

SEQ ID NO: 3031223 - RNA, 17 nt, Mycobacterium avium subsp. paratuberculosis
gcagcgccguccgcacc

SEQ ID NO: 3031224 - RNA, 21 nt, Mycobacterium avium subsp. paratuberculosis
gcagcgccguccgcaccgcga

SEQ ID NO: 3031225 - RNA, 23 nt, Mycobacterium avium subsp. paratuberculosis
gcagcgccguccgcaccgcgacg

SEQ ID NO: 3031226 - RNA, 23 nt, Mycobacterium avium subsp. paratuberculosis
gcagcgccgucucgacccgggcc

SEQ ID NO: 3031227 - RNA, 15 nt, Mycobacterium avium subsp. paratuberculosis
gcagcgccucgccgg

SEQ ID NO: 3031228 - RNA, 18 nt, Mycobacterium avium subsp. paratuberculosis
gcagcgccucgccgggcc

SEQ ID NO: 3031229 - RNA, 12 nt, Mycobacterium avium subsp. paratuberculosis
gcagcgccucgg

SEQ ID NO: 3031230 - RNA, 14 nt, Mycobacterium avium subsp. paratuberculosis
gcagcgccucggcg

SEQ ID NO: 3031231 - RNA, 21 nt, Mycobacterium avium subsp. paratuberculosis
gcagcgccucggcgaucggcc

SEQ ID NO: 3031232 - RNA, 22 nt, Mycobacterium avium subsp. paratuberculosis
gcagcgccucggcgaucggccg

SEQ ID NO: 3031233 - RNA, 23 nt, Mycobacterium avium subsp. paratuberculosis
gcagcgccucggcgaucggccgc

SEQ ID NO: 3031234 - RNA, 18 nt, Mycobacterium avium subsp. paratuberculosis
gcagcgccucggcggccc

SEQ ID NO: 3031235 - RNA, 21 nt, Mycobacterium avium subsp. paratuberculosis
gcagcgccucggcggccccuu

SEQ ID NO: 3031236 - RNA, 20 nt, Mycobacterium avium subsp. paratuberculosis
gcagcgccucggcgggccgc

SEQ ID NO: 3031237 - RNA, 21 nt, Mycobacterium avium subsp. paratuberculosis
gcagcgccucggcgggccgcc

SEQ ID NO: 3031238 - RNA, 15 nt, Mycobacterium avium subsp. paratuberculosis
gcagcgccucggcgu

SEQ ID NO: 3031239 - RNA, 16 nt, Mycobacterium avium subsp. paratuberculosis
gcagcgccucggcgug

SEQ ID NO: 3031240 - RNA, 17 nt, Mycobacterium avium subsp. paratuberculosis
gcagcgccucggcgugg

SEQ ID NO: 3031241 - RNA, 21 nt, Mycobacterium avium subsp. paratuberculosis
gcagcgccucggugaagccgc

SEQ ID NO: 3031242 - RNA, 22 nt, Mycobacterium avium subsp. paratuberculosis
gcagcgccucggugaagccgcg

SEQ ID NO: 3031243 - RNA, 15 nt, Mycobacterium avium subsp. paratuberculosis
gcagcgccugcugcc

SEQ ID NO: 3031244 - RNA, 19 nt, Mycobacterium avium subsp. paratuberculosis
gcagcgccugcugccagga

SEQ ID NO: 3031245 - RNA, 12 nt, Mycobacterium avium subsp. paratuberculosis
gcagcgccuuga

SEQ ID NO: 3031246 - RNA, 19 nt, Mycobacterium avium subsp. paratuberculosis
gcagcgccuugccgacgac

SEQ ID NO: 3031247 - RNA, 14 nt, Mycobacterium avium subsp. paratuberculosis
gcagcgcgacaccg

SEQ ID NO: 3031248 - RNA, 20 nt, Mycobacterium avium subsp. paratuberculosis
gcagcgcgaccagcccggcc

SEQ ID NO: 3031249 - RNA, 14 nt, Mycobacterium avium subsp. paratuberculosis
gcagcgcgacgcau

SEQ ID NO: 3031250 - RNA, 15 nt, Mycobacterium avium subsp. paratuberculosis
gcagcgcgacgccga

SEQ ID NO: 3031251 - RNA, 17 nt, Mycobacterium avium subsp. paratuberculosis
gcagcgcgauccggggg

SEQ ID NO: 3031252 - RNA, 19 nt, Mycobacterium avium subsp. paratuberculosis
gcagcgcgauccggggggc

SEQ ID NO: 3031253 - RNA, 14 nt, Mycobacterium avium subsp. paratuberculosis
gcagcgcgaugccg

SEQ ID NO: 3031254 - RNA, 15 nt, Mycobacterium avium subsp. paratuberculosis
gcagcgcgaugccgg

SEQ ID NO: 3031255 - RNA, 19 nt, Mycobacterium avium subsp. paratuberculosis
gcagcgcgaugccggccag

SEQ ID NO: 3031256 - RNA, 20 nt, Mycobacterium avium subsp. paratuberculosis
gcagcgcgaugccggccagg

SEQ ID NO: 3031257 - RNA, 15 nt, Mycobacterium avium subsp. paratuberculosis
gcagcgcgauguccg

SEQ ID NO: 3031258 - RNA, 14 nt, Mycobacterium avium subsp. paratuberculosis
gcagcgcgcccagg

SEQ ID NO: 3031259 - RNA, 19 nt, Mycobacterium avium subsp. paratuberculosis
gcagcgcgcccaggcugaa

SEQ ID NO: 3031260 - RNA, 12 nt, Mycobacterium avium subsp. paratuberculosis
gcagcgcgccga

SEQ ID NO: 3031261 - RNA, 14 nt, Mycobacterium avium subsp. paratuberculosis
gcagcgcgcgaccg

SEQ ID NO: 3031262 - RNA, 15 nt, Mycobacterium avium subsp. paratuberculosis
gcagcgcgcgaccgc

SEQ ID NO: 3031263 - RNA, 13 nt, Mycobacterium avium subsp. paratuberculosis
gcagcgcgcgaga

SEQ ID NO: 3031264 - RNA, 17 nt, Mycobacterium avium subsp. paratuberculosis
gcagcgcgcgagacacc

SEQ ID NO: 3031265 - RNA, 15 nt, Mycobacterium avium subsp. paratuberculosis
gcagcgcgcgcucgg

SEQ ID NO: 3031266 - RNA, 15 nt, Mycobacterium avium subsp. paratuberculosis
gcagcgcgcggcgca

SEQ ID NO: 3031267 - RNA, 14 nt, Mycobacterium avium subsp. paratuberculosis
gcagcgcgcgggug

SEQ ID NO: 3031268 - RNA, 14 nt, Mycobacterium avium subsp. paratuberculosis
gcagcgcgcgguuc

SEQ ID NO: 3031269 - RNA, 19 nt, Mycobacterium avium subsp. paratuberculosis
gcagcgcggauuccagcgc

SEQ ID NO: 3031270 - RNA, 20 nt, Mycobacterium avium subsp. paratuberculosis
gcagcgcggcauggcuggcg

SEQ ID NO: 3031271 - RNA, 12 nt, Mycobacterium avium subsp. paratuberculosis
gcagcgcggcca

SEQ ID NO: 3031272 - RNA, 16 nt, Mycobacterium avium subsp. paratuberculosis
gcagcgcggccagcac

SEQ ID NO: 3031273 - RNA, 11 nt, Mycobacterium avium subsp. paratuberculosis
gcagcgcggcg

SEQ ID NO: 3031274 - RNA, 13 nt, Mycobacterium avium subsp. paratuberculosis
gcagcgcggcgau

SEQ ID NO: 3031275 - RNA, 15 nt, Mycobacterium avium subsp. paratuberculosis
gcagcgcggcgauca

SEQ ID NO: 3031276 - RNA, 14 nt, Mycobacterium avium subsp. paratuberculosis
gcagcgcggcgaug

SEQ ID NO: 3031277 - RNA, 13 nt, Mycobacterium avium subsp. paratuberculosis
gcagcgcggcgga

SEQ ID NO: 3031278 - RNA, 19 nt, Mycobacterium avium subsp. paratuberculosis
gcagcgcggcguucagcag

SEQ ID NO: 3031279 - RNA, 17 nt, Mycobacterium avium subsp. paratuberculosis
gcagcgcggcuuggcca

SEQ ID NO: 3031280 - RNA, 21 nt, Mycobacterium avium subsp. paratuberculosis
gcagcgcggucaacaccggga

SEQ ID NO: 3031281 - RNA, 15 nt, Mycobacterium avium subsp. paratuberculosis
gcagcgcggugccga

SEQ ID NO: 3031282 - RNA, 13 nt, Mycobacterium avium subsp. paratuberculosis
gcagcgcgguggu

SEQ ID NO: 3031283 - RNA, 20 nt, Mycobacterium avium subsp. paratuberculosis
gcagcgcgguggucagcacc

SEQ ID NO: 3031284 - RNA, 20 nt, Mycobacterium avium subsp. paratuberculosis
gcagcgcgguuuccggcgau

SEQ ID NO: 3031285 - RNA, 18 nt, Mycobacterium avium subsp. paratuberculosis
gcagcgcguaggugcggu

SEQ ID NO: 3031286 - RNA, 14 nt, Mycobacterium avium subsp. paratuberculosis
gcagcgcgucgcgc

SEQ ID NO: 3031287 - RNA, 19 nt, Mycobacterium avium subsp. paratuberculosis
gcagcgcgucgcgcccggc

SEQ ID NO: 3031288 - RNA, 20 nt, Mycobacterium avium subsp. paratuberculosis
gcagcgcgucgcgcccggcg

SEQ ID NO: 3031289 - RNA, 22 nt, Mycobacterium avium subsp. paratuberculosis
gcagcgcgucgcgggcccgggc

SEQ ID NO: 3031290 - RNA, 18 nt, Mycobacterium avium subsp. paratuberculosis
gcagcgcgucgggcucgg

SEQ ID NO: 3031291 - RNA, 22 nt, Mycobacterium avium subsp. paratuberculosis
gcagcgcgucgggcucggccgc

SEQ ID NO: 3031292 - RNA, 23 nt, Mycobacterium avium subsp. paratuberculosis
gcagcgcgucgggcucggccgcc

SEQ ID NO: 3031293 - RNA, 15 nt, Mycobacterium avium subsp. paratuberculosis
gcagcgcgucgucgg

SEQ ID NO: 3031294 - RNA, 20 nt, Mycobacterium avium subsp. paratuberculosis
gcagcgcgucgucggucagg

SEQ ID NO: 3031295 - RNA, 23 nt, Mycobacterium avium subsp. paratuberculosis
gcagcgcgucgugcaacucccgc

SEQ ID NO: 3031296 - RNA, 16 nt, Mycobacterium avium subsp. paratuberculosis
gcagcgcuaaccgcgg

SEQ ID NO: 3031297 - RNA, 19 nt, Mycobacterium avium subsp. paratuberculosis
gcagcgcuccugcagcgcg

SEQ ID NO: 3031298 - RNA, 20 nt, Mycobacterium avium subsp. paratuberculosis
gcagcgcuccugcagcgcgg

SEQ ID NO: 3031299 - RNA, 14 nt, Mycobacterium avium subsp. paratuberculosis
gcagcgcucgucgu

SEQ ID NO: 3031300 - RNA, 23 nt, Mycobacterium avium subsp. paratuberculosis
gcagcggaaacgacgucgccacc

SEQ ID NO: 3031301 - RNA, 19 nt, Mycobacterium avium subsp. paratuberculosis
gcagcggaaucgcccgggc

SEQ ID NO: 3031302 - RNA, 22 nt, Mycobacterium avium subsp. paratuberculosis
gcagcggaaugaacgcggccag

SEQ ID NO: 3031303 - RNA, 23 nt, Mycobacterium avium subsp. paratuberculosis
gcagcggaaugaacgcggccagg

SEQ ID NO: 3031304 - RNA, 15 nt, Mycobacterium avium subsp. paratuberculosis
gcagcggacccgguc

SEQ ID NO: 3031305 - RNA, 18 nt, Mycobacterium avium subsp. paratuberculosis
gcagcggacccggucggc

SEQ ID NO: 3031306 - RNA, 22 nt, Mycobacterium avium subsp. paratuberculosis
gcagcggacccggucggccgcg

SEQ ID NO: 3031307 - RNA, 23 nt, Mycobacterium avium subsp. paratuberculosis
gcagcggacccggucggccgcgu

SEQ ID NO: 3031308 - RNA, 15 nt, Mycobacterium avium subsp. paratuberculosis
gcagcggcaccaacc

SEQ ID NO: 3031309 - RNA, 23 nt, Mycobacterium avium subsp. paratuberculosis
gcagcggcaccaacccgaucggc

SEQ ID NO: 3031310 - RNA, 20 nt, Mycobacterium avium subsp. paratuberculosis
gcagcggcacccgguccggc

SEQ ID NO: 3031311 - RNA, 21 nt, Mycobacterium avium subsp. paratuberculosis
gcagcggcagccacggcagcu

SEQ ID NO: 3031312 - RNA, 16 nt, Mycobacterium avium subsp. paratuberculosis
gcagcggcaugccccc

SEQ ID NO: 3031313 - RNA, 13 nt, Mycobacterium avium subsp. paratuberculosis
gcagcggcccgaa

SEQ ID NO: 3031314 - RNA, 15 nt, Mycobacterium avium subsp. paratuberculosis
gcagcggccggcgca

SEQ ID NO: 3031315 - RNA, 19 nt, Mycobacterium avium subsp. paratuberculosis
gcagcggcgccgcagcucg

SEQ ID NO: 3031316 - RNA, 14 nt, Mycobacterium avium subsp. paratuberculosis
gcagcggcgccggg

SEQ ID NO: 3031317 - RNA, 14 nt, Mycobacterium avium subsp. paratuberculosis
gcagcggcggcacg

SEQ ID NO: 3031318 - RNA, 23 nt, Mycobacterium avium subsp. paratuberculosis
gcagcggcggccaguugacguug

SEQ ID NO: 3031319 - RNA, 13 nt, Mycobacterium avium subsp. paratuberculosis
gcagcggcggcuc

SEQ ID NO: 3031320 - RNA, 22 nt, Mycobacterium avium subsp. paratuberculosis
gcagcggcgguugcucgucggc

SEQ ID NO: 3031321 - RNA, 21 nt, Mycobacterium avium subsp. paratuberculosis
gcagcggcgucacgcccucuu

SEQ ID NO: 3031322 - RNA, 23 nt, Mycobacterium avium subsp. paratuberculosis
gcagcggcuccgagcggaugccg

SEQ ID NO: 3031323 - RNA, 21 nt, Mycobacterium avium subsp. paratuberculosis
gcagcggcugcugcagcgccc

SEQ ID NO: 3031324 - RNA, 18 nt, Mycobacterium avium subsp. paratuberculosis
gcagcggcuugaccggcu

SEQ ID NO: 3031325 - RNA, 23 nt, Mycobacterium avium subsp. paratuberculosis
gcagcggcuugaccggcucgccg

SEQ ID NO: 3031326 - RNA, 16 nt, Mycobacterium avium subsp. paratuberculosis
gcagcggcuugagcgc

SEQ ID NO: 3031327 - RNA, 22 nt, Mycobacterium avium subsp. paratuberculosis
gcagcggcuugagcgccagcgc

SEQ ID NO: 3031328 - RNA, 23 nt, Mycobacterium avium subsp. paratuberculosis
gcagcggcuugagcgccagcgcg

SEQ ID NO: 3031329 - RNA, 18 nt, Mycobacterium avium subsp. paratuberculosis
gcagcgggacgaucugcg

SEQ ID NO: 3031330 - RNA, 18 nt, Mycobacterium avium subsp. paratuberculosis
gcagcgggaucagcuccu

SEQ ID NO: 3031331 - RNA, 19 nt, Mycobacterium avium subsp. paratuberculosis
gcagcgggauuggcgccac

SEQ ID NO: 3031332 - RNA, 15 nt, Mycobacterium avium subsp. paratuberculosis
gcagcgggccgaaga

SEQ ID NO: 3031333 - RNA, 16 nt, Mycobacterium avium subsp. paratuberculosis
gcagcgggccgaagac

SEQ ID NO: 3031334 - RNA, 14 nt, Mycobacterium avium subsp. paratuberculosis
gcagcgggcuggcg

SEQ ID NO: 3031335 - RNA, 15 nt, Mycobacterium avium subsp. paratuberculosis
gcagcggggaggccc

SEQ ID NO: 3031336 - RNA, 19 nt, Mycobacterium avium subsp. paratuberculosis
gcagcggggaggcccagcc

SEQ ID NO: 3031337 - RNA, 22 nt, Mycobacterium avium subsp. paratuberculosis
gcagcggggaggcccagcccgc

SEQ ID NO: 3031338 - RNA, 14 nt, Mycobacterium avium subsp. paratuberculosis
gcagcggggcgagc

SEQ ID NO: 3031339 - RNA, 16 nt, Mycobacterium avium subsp. paratuberculosis
gcagcggggcgagcug

SEQ ID NO: 3031340 - RNA, 17 nt, Mycobacterium avium subsp. paratuberculosis
gcagcggggcgagcugg

SEQ ID NO: 3031341 - RNA, 22 nt, Mycobacterium avium subsp. paratuberculosis
gcagcggggcgagcuggccgcc

SEQ ID NO: 3031342 - RNA, 14 nt, Mycobacterium avium subsp. paratuberculosis
gcagcggggcgcgc

SEQ ID NO: 3031343 - RNA, 16 nt, Mycobacterium avium subsp. paratuberculosis
gcagcggggcgcgcag

SEQ ID NO: 3031344 - RNA, 23 nt, Mycobacterium avium subsp. paratuberculosis
gcagcggggcgcgcaggcgcacc

SEQ ID NO: 3031345 - RNA, 16 nt, Mycobacterium avium subsp. paratuberculosis
gcagcggggcgcuguc

SEQ ID NO: 3031346 - RNA, 20 nt, Mycobacterium avium subsp. paratuberculosis
gcagcggggugagcaccgcg

SEQ ID NO: 3031347 - RNA, 22 nt, Mycobacterium avium subsp. paratuberculosis
gcagcggggugugcucggcggc

SEQ ID NO: 3031348 - RNA, 22 nt, Mycobacterium avium subsp. paratuberculosis
gcagcgggucgucgggccgggg

SEQ ID NO: 3031349 - RNA, 21 nt, Mycobacterium avium subsp. paratuberculosis
gcagcggguugcgguccccgg

SEQ ID NO: 3031350 - RNA, 19 nt, Mycobacterium avium subsp. paratuberculosis
gcagcggguuuggccgcgg

SEQ ID NO: 3031351 - RNA, 22 nt, Mycobacterium avium subsp. paratuberculosis
gcagcggguuuggccgcgggcg

SEQ ID NO: 3031352 - RNA, 14 nt, Mycobacterium avium subsp. paratuberculosis
gcagcggucggcgg

SEQ ID NO: 3031353 - RNA, 16 nt, Mycobacterium avium subsp. paratuberculosis
gcagcggucggcggcu

SEQ ID NO: 3031354 - RNA, 17 nt, Mycobacterium avium subsp. paratuberculosis
gcagcggucggcggcug

SEQ ID NO: 3031355 - RNA, 20 nt, Mycobacterium avium subsp. paratuberculosis
gcagcggugcagccccgcac

SEQ ID NO: 3031356 - RNA, 13 nt, Mycobacterium avium subsp. paratuberculosis
gcagcggugccgc

SEQ ID NO: 3031357 - RNA, 15 nt, Mycobacterium avium subsp. paratuberculosis
gcagcggugccgccc

SEQ ID NO: 3031358 - RNA, 16 nt, Mycobacterium avium subsp. paratuberculosis
gcagcggugccgcccg

SEQ ID NO: 3031359 - RNA, 18 nt, Mycobacterium avium subsp. paratuberculosis
gcagcggugccgcccgga

SEQ ID NO: 3031360 - RNA, 22 nt, Mycobacterium avium subsp. paratuberculosis
gcagcggugucaccgacgccag

SEQ ID NO: 3031361 - RNA, 21 nt, Mycobacterium avium subsp. paratuberculosis
gcagcgucaacggcuugcgca

SEQ ID NO: 3031362 - RNA, 14 nt, Mycobacterium avium subsp. paratuberculosis
gcagcgucacgucg

SEQ ID NO: 3031363 - RNA, 17 nt, Mycobacterium avium subsp. paratuberculosis
gcagcgucacgucgacg

SEQ ID NO: 3031364 - RNA, 19 nt, Mycobacterium avium subsp. paratuberculosis
gcagcgucacgucgacggc

SEQ ID NO: 3031365 - RNA, 22 nt, Mycobacterium avium subsp. paratuberculosis
gcagcgucacgucgacggccgc

SEQ ID NO: 3031366 - RNA, 20 nt, Mycobacterium avium subsp. paratuberculosis
gcagcgucaucgcguagugg

SEQ ID NO: 3031367 - RNA, 16 nt, Mycobacterium avium subsp. paratuberculosis
gcagcgucccgucggc

SEQ ID NO: 3031368 - RNA, 13 nt, Mycobacterium avium subsp. paratuberculosis
gcagcgucgccag

SEQ ID NO: 3031369 - RNA, 15 nt, Mycobacterium avium subsp. paratuberculosis
gcagcgucgccagcc

SEQ ID NO: 3031370 - RNA, 20 nt, Mycobacterium avium subsp. paratuberculosis
gcagcgucgccagccgccgg

SEQ ID NO: 3031371 - RNA, 22 nt, Mycobacterium avium subsp. paratuberculosis
gcagcgucgccagccgccggcu

SEQ ID NO: 3031372 - RNA, 22 nt, Mycobacterium avium subsp. paratuberculosis
gcagcgucggguacaccgagcc

SEQ ID NO: 3031373 - RNA, 21 nt, Mycobacterium avium subsp. paratuberculosis
gcagcgucgucaggccgugau

SEQ ID NO: 3031374 - RNA, 22 nt, Mycobacterium avium subsp. paratuberculosis
gcagcgucucccgggugcgcgu

SEQ ID NO: 3031375 - RNA, 14 nt, Mycobacterium avium subsp. paratuberculosis
gcagcgucuccucg

SEQ ID NO: 3031376 - RNA, 19 nt, Mycobacterium avium subsp. paratuberculosis
gcagcgucuccucgaccgc

SEQ ID NO: 3031377 - RNA, 14 nt, Mycobacterium avium subsp. paratuberculosis
gcagcgucugcgcc

SEQ ID NO: 3031378 - RNA, 16 nt, Mycobacterium avium subsp. paratuberculosis
gcagcgucugcgccag

SEQ ID NO: 3031379 - RNA, 17 nt, Mycobacterium avium subsp. paratuberculosis
gcagcgucugcgccagc

SEQ ID NO: 3031380 - RNA, 17 nt, Mycobacterium avium subsp. paratuberculosis
gcagcgucugcgccccg

SEQ ID NO: 3031381 - RNA, 20 nt, Mycobacterium avium subsp. paratuberculosis
gcagcgucugcgccccggcg

SEQ ID NO: 3031382 - RNA, 23 nt, Mycobacterium avium subsp. paratuberculosis
gcagcgucuucuucucgccgucc

SEQ ID NO: 3031383 - RNA, 23 nt, Mycobacterium avium subsp. paratuberculosis
gcagcgucuugcccagcggggcg

SEQ ID NO: 3031384 - RNA, 21 nt, Mycobacterium avium subsp. paratuberculosis
gcagcgucuuggacgcccggu

SEQ ID NO: 3031385 - RNA, 18 nt, Mycobacterium avium subsp. paratuberculosis
gcagcgugggcaccggca

SEQ ID NO: 3031386 - RNA, 21 nt, Mycobacterium avium subsp. paratuberculosis
gcagcgugggcaccggcaccg

SEQ ID NO: 3031387 - RNA, 18 nt, Mycobacterium avium subsp. paratuberculosis
gcagcgugguccagcacg

SEQ ID NO: 3031388 - RNA, 19 nt, Mycobacterium avium subsp. paratuberculosis
gcagcgugguccagcacgu

SEQ ID NO: 3031389 - RNA, 22 nt, Mycobacterium avium subsp. paratuberculosis
gcagcguggucuccuggccgcc

SEQ ID NO: 3031390 - RNA, 23 nt, Mycobacterium avium subsp. paratuberculosis
gcagcguggucuccuggccgccg

SEQ ID NO: 3031391 - RNA, 18 nt, Mycobacterium avium subsp. paratuberculosis
gcagcgugucccgguaca

SEQ ID NO: 3031392 - RNA, 22 nt, Mycobacterium avium subsp. paratuberculosis
gcagcgugucccgguacagguc

SEQ ID NO: 3031393 - RNA, 20 nt, Mycobacterium avium subsp. paratuberculosis
gcagcgugucggggucggcg

SEQ ID NO: 3031394 - RNA, 23 nt, Mycobacterium avium subsp. paratuberculosis
gcagcgugucggggucggcgccg

SEQ ID NO: 3031395 - RNA, 17 nt, Mycobacterium avium subsp. paratuberculosis
gcagcguuccgucggcg

SEQ ID NO: 3031396 - RNA, 20 nt, Mycobacterium avium subsp. paratuberculosis
gcagcguucggucagcacga

SEQ ID NO: 3031397 - RNA, 14 nt, Mycobacterium avium subsp. paratuberculosis
gcagcuagcccaga

SEQ ID NO: 3031398 - RNA, 13 nt, Mycobacterium avium subsp. paratuberculosis
gcagcucagccgc

SEQ ID NO: 3031399 - RNA, 16 nt, Mycobacterium avium subsp. paratuberculosis
gcagcucagccgccug

SEQ ID NO: 3031400 - RNA, 18 nt, Mycobacterium avium subsp. paratuberculosis
gcagcucagccgccuggc

SEQ ID NO: 3031401 - RNA, 18 nt, Mycobacterium avium subsp. paratuberculosis
gcagcucauacagcggcg

SEQ ID NO: 3031402 - RNA, 19 nt, Mycobacterium avium subsp. paratuberculosis
gcagcucauacagcggcgc

SEQ ID NO: 3031403 - RNA, 12 nt, Mycobacterium avium subsp. paratuberculosis
gcagcuccagcg

SEQ ID NO: 3031404 - RNA, 15 nt, Mycobacterium avium subsp. paratuberculosis
gcagcucccccggcg

SEQ ID NO: 3031405 - RNA, 18 nt, Mycobacterium avium subsp. paratuberculosis
gcagcucccccggcguga

SEQ ID NO: 3031406 - RNA, 15 nt, Mycobacterium avium subsp. paratuberculosis
gcagcuccggucggc

SEQ ID NO: 3031407 - RNA, 17 nt, Mycobacterium avium subsp. paratuberculosis
gcagcuccggucggcgc

SEQ ID NO: 3031408 - RNA, 15 nt, Mycobacterium avium subsp. paratuberculosis
gcagcuccucggcgg

SEQ ID NO: 3031409 - RNA, 18 nt, Mycobacterium avium subsp. paratuberculosis
gcagcuccucggcggccu

SEQ ID NO: 3031410 - RNA, 19 nt, Mycobacterium avium subsp. paratuberculosis
gcagcuccucggcggccuc

SEQ ID NO: 3031411 - RNA, 23 nt, Mycobacterium avium subsp. paratuberculosis
gcagcuccuugagccgccgcggc

SEQ ID NO: 3031412 - RNA, 22 nt, Mycobacterium avium subsp. paratuberculosis
gcagcucgacaucggccgccuu

SEQ ID NO: 3031413 - RNA, 14 nt, Mycobacterium avium subsp. paratuberculosis
gcagcucgacgacc

SEQ ID NO: 3031414 - RNA, 18 nt, Mycobacterium avium subsp. paratuberculosis
gcagcucgaucacccagg

SEQ ID NO: 3031415 - RNA, 14 nt, Mycobacterium avium subsp. paratuberculosis
gcagcucgcccagc

SEQ ID NO: 3031416 - RNA, 15 nt, Mycobacterium avium subsp. paratuberculosis
gcagcucgcccagca

SEQ ID NO: 3031417 - RNA, 22 nt, Mycobacterium avium subsp. paratuberculosis
gcagcucgcccagcaccgucug

SEQ ID NO: 3031418 - RNA, 14 nt, Mycobacterium avium subsp. paratuberculosis
gcagcucgccgagc

SEQ ID NO: 3031419 - RNA, 15 nt, Mycobacterium avium subsp. paratuberculosis
gcagcucgccggcgc

SEQ ID NO: 3031420 - RNA, 17 nt, Mycobacterium avium subsp. paratuberculosis
gcagcucgccgguggcg

SEQ ID NO: 3031421 - RNA, 14 nt, Mycobacterium avium subsp. paratuberculosis
gcagcucgcgcagc

SEQ ID NO: 3031422 - RNA, 20 nt, Mycobacterium avium subsp. paratuberculosis
gcagcucgcgcagccggccg

SEQ ID NO: 3031423 - RNA, 19 nt, Mycobacterium avium subsp. paratuberculosis
gcagcucgcgcagcuggcc

SEQ ID NO: 3031424 - RNA, 19 nt, Mycobacterium avium subsp. paratuberculosis
gcagcucgcggauccgcag

SEQ ID NO: 3031425 - RNA, 21 nt, Mycobacterium avium subsp. paratuberculosis
gcagcucgcggauccgcagcu

SEQ ID NO: 3031426 - RNA, 17 nt, Mycobacterium avium subsp. paratuberculosis
gcagcucgcugagcggg

SEQ ID NO: 3031427 - RNA, 18 nt, Mycobacterium avium subsp. paratuberculosis
gcagcucgcugagcggga

SEQ ID NO: 3031428 - RNA, 14 nt, Mycobacterium avium subsp. paratuberculosis
gcagcucggcggcc

SEQ ID NO: 3031429 - RNA, 20 nt, Mycobacterium avium subsp. paratuberculosis
gcagcucggcggcccgccgg

SEQ ID NO: 3031430 - RNA, 14 nt, Mycobacterium avium subsp. paratuberculosis
gcagcucggcgggc

SEQ ID NO: 3031431 - RNA, 15 nt, Mycobacterium avium subsp. paratuberculosis
gcagcucggcgggcu

SEQ ID NO: 3031432 - RNA, 14 nt, Mycobacterium avium subsp. paratuberculosis
gcagcucgggcagc

SEQ ID NO: 3031433 - RNA, 16 nt, Mycobacterium avium subsp. paratuberculosis
gcagcucgggcagccc

SEQ ID NO: 3031434 - RNA, 17 nt, Mycobacterium avium subsp. paratuberculosis
gcagcucgggcagcccg

SEQ ID NO: 3031435 - RNA, 13 nt, Mycobacterium avium subsp. paratuberculosis
gcagcucgggguc

SEQ ID NO: 3031436 - RNA, 17 nt, Mycobacterium avium subsp. paratuberculosis
gcagcucggggucggcg

SEQ ID NO: 3031437 - RNA, 15 nt, Mycobacterium avium subsp. paratuberculosis
gcagcucggucacca

SEQ ID NO: 3031438 - RNA, 17 nt, Mycobacterium avium subsp. paratuberculosis
gcagcucggucaccagc

SEQ ID NO: 3031439 - RNA, 18 nt, Mycobacterium avium subsp. paratuberculosis
gcagcucggucaccagcg

SEQ ID NO: 3031440 - RNA, 14 nt, Mycobacterium avium subsp. paratuberculosis
gcagcucggugcag

SEQ ID NO: 3031441 - RNA, 23 nt, Mycobacterium avium subsp. paratuberculosis
gcagcucggugcagaccccggcg

SEQ ID NO: 3031442 - RNA, 16 nt, Mycobacterium avium subsp. paratuberculosis
gcagcucggugcgcac

SEQ ID NO: 3031443 - RNA, 15 nt, Mycobacterium avium subsp. paratuberculosis
gcagcucgguggccg

SEQ ID NO: 3031444 - RNA, 19 nt, Mycobacterium avium subsp. paratuberculosis
gcagcucgguggcgucggc

SEQ ID NO: 3031445 - RNA, 21 nt, Mycobacterium avium subsp. paratuberculosis
gcagcucgguggcgucggcgg

SEQ ID NO: 3031446 - RNA, 22 nt, Mycobacterium avium subsp. paratuberculosis
gcagcucgguggcgucggcggc

SEQ ID NO: 3031447 - RNA, 22 nt, Mycobacterium avium subsp. paratuberculosis
gcagcucgucgacguccucgcc

SEQ ID NO: 3031448 - RNA, 23 nt, Mycobacterium avium subsp. paratuberculosis
gcagcucgucgacguccucgccc

SEQ ID NO: 3031449 - RNA, 12 nt, Mycobacterium avium subsp. paratuberculosis
gcagcucgucgg

SEQ ID NO: 3031450 - RNA, 14 nt, Mycobacterium avium subsp. paratuberculosis
gcagcucgucggcg

SEQ ID NO: 3031451 - RNA, 17 nt, Mycobacterium avium subsp. paratuberculosis
gcagcucgucggcgcgc

SEQ ID NO: 3031452 - RNA, 19 nt, Mycobacterium avium subsp. paratuberculosis
gcagcucgucggcgcgcca

SEQ ID NO: 3031453 - RNA, 21 nt, Mycobacterium avium subsp. paratuberculosis
gcagcucgucggcgcgccacc

SEQ ID NO: 3031454 - RNA, 13 nt, Mycobacterium avium subsp. paratuberculosis
gcagcucguugug

SEQ ID NO: 3031455 - RNA, 23 nt, Mycobacterium avium subsp. paratuberculosis
gcagcucguugugaauccagccg

SEQ ID NO: 3031456 - RNA, 23 nt, Mycobacterium avium subsp. paratuberculosis
gcagcugaagugcacucggcgau

SEQ ID NO: 3031457 - RNA, 17 nt, Mycobacterium avium subsp. paratuberculosis
gcagcugauagcccgcc

SEQ ID NO: 3031458 - RNA, 19 nt, Mycobacterium avium subsp. paratuberculosis
gcagcugauagcccgccgc

SEQ ID NO: 3031459 - RNA, 23 nt, Mycobacterium avium subsp. paratuberculosis
gcagcugauagcccgccgcggcg

SEQ ID NO: 3031460 - RNA, 16 nt, Mycobacterium avium subsp. paratuberculosis
gcagcugaucggggcc

SEQ ID NO: 3031461 - RNA, 19 nt, Mycobacterium avium subsp. paratuberculosis
gcagcugcagcgucgggua

SEQ ID NO: 3031462 - RNA, 14 nt, Mycobacterium avium subsp. paratuberculosis
gcagcugcaucucc

SEQ ID NO: 3031463 - RNA, 21 nt, Mycobacterium avium subsp. paratuberculosis
gcagcugcaucuccguggacg

SEQ ID NO: 3031464 - RNA, 13 nt, Mycobacterium avium subsp. paratuberculosis
gcagcugcccgag

SEQ ID NO: 3031465 - RNA, 15 nt, Mycobacterium avium subsp. paratuberculosis
gcagcugcccgagcg

SEQ ID NO: 3031466 - RNA, 13 nt, Mycobacterium avium subsp. paratuberculosis
gcagcugcgggac

SEQ ID NO: 3031467 - RNA, 17 nt, Mycobacterium avium subsp. paratuberculosis
gcagcugcgggaccagc

SEQ ID NO: 3031468 - RNA, 21 nt, Mycobacterium avium subsp. paratuberculosis
gcagcugcgucggcaccagcg

SEQ ID NO: 3031469 - RNA, 22 nt, Mycobacterium avium subsp. paratuberculosis
gcagcugcgucggcaccagcgg

SEQ ID NO: 3031470 - RNA, 12 nt, Mycobacterium avium subsp. paratuberculosis
gcagcugcucgu

SEQ ID NO: 3031471 - RNA, 16 nt, Mycobacterium avium subsp. paratuberculosis
gcagcugcugcggccg

SEQ ID NO: 3031472 - RNA, 17 nt, Mycobacterium avium subsp. paratuberculosis
gcagcugcugcggccgg

SEQ ID NO: 3031473 - RNA, 18 nt, Mycobacterium avium subsp. paratuberculosis
gcagcugcugcggccgga

SEQ ID NO: 3031474 - RNA, 23 nt, Mycobacterium avium subsp. paratuberculosis
gcagcugcugggacgggucggcg

SEQ ID NO: 3031475 - RNA, 18 nt, Mycobacterium avium subsp. paratuberculosis
gcagcuggaacaccacgg

SEQ ID NO: 3031476 - RNA, 20 nt, Mycobacterium avium subsp. paratuberculosis
gcagcuggaacaccacggcc

SEQ ID NO: 3031477 - RNA, 21 nt, Mycobacterium avium subsp. paratuberculosis
gcagcuggaacaccacggccg

SEQ ID NO: 3031478 - RNA, 12 nt, Mycobacterium avium subsp. paratuberculosis
gcagcuggccaa

SEQ ID NO: 3031479 - RNA, 15 nt, Mycobacterium avium subsp. paratuberculosis
gcagcuggccgugca

SEQ ID NO: 3031480 - RNA, 21 nt, Mycobacterium avium subsp. paratuberculosis
gcagcuggccgugcaccgucg

SEQ ID NO: 3031481 - RNA, 22 nt, Mycobacterium avium subsp. paratuberculosis
gcagcuggccgugcaccgucgc

SEQ ID NO: 3031482 - RNA, 22 nt, Mycobacterium avium subsp. paratuberculosis
gcagcugggacagcgucaccaa

SEQ ID NO: 3031483 - RNA, 23 nt, Mycobacterium avium subsp. paratuberculosis
gcagcuguuccugguagucgucg

SEQ ID NO: 3031484 - RNA, 17 nt, Mycobacterium avium subsp. paratuberculosis
gcagcuguugcggcguc

SEQ ID NO: 3031485 - RNA, 18 nt, Mycobacterium avium subsp. paratuberculosis
gcagcuucaugcccgcga

SEQ ID NO: 3031486 - RNA, 19 nt, Mycobacterium avium subsp. paratuberculosis
gcagcuucaugcccgcgaa

SEQ ID NO: 3031487 - RNA, 18 nt, Mycobacterium avium subsp. paratuberculosis
gcagcuucgugucaccgc

SEQ ID NO: 3031488 - RNA, 19 nt, Mycobacterium avium subsp. paratuberculosis
gcagcuucgugucaccgcc

SEQ ID NO: 3031489 - RNA, 21 nt, Mycobacterium avium subsp. paratuberculosis
gcagcuucgugucaccgccca

SEQ ID NO: 3031490 - RNA, 17 nt, Mycobacterium avium subsp. paratuberculosis
gcagcuucugcagcucg

SEQ ID NO: 3031491 - RNA, 16 nt, Mycobacterium avium subsp. paratuberculosis
gcagcuucuggucaug

SEQ ID NO: 3031492 - RNA, 14 nt, Mycobacterium avium subsp. paratuberculosis
gcagcuugaucgcc

SEQ ID NO: 3031493 - RNA, 20 nt, Mycobacterium avium subsp. paratuberculosis
gcagcuugaucgccggggcg

SEQ ID NO: 3031494 - RNA, 22 nt, Mycobacterium avium subsp. paratuberculosis
gcagcuugaugcuggcaacguc

SEQ ID NO: 3031495 - RNA, 21 nt, Mycobacterium avium subsp. paratuberculosis
gcaggaacagacacagcacgc

SEQ ID NO: 3031496 - RNA, 22 nt, Mycobacterium avium subsp. paratuberculosis
gcaggaaccgcgagcagacgcg

SEQ ID NO: 3031497 - RNA, 19 nt, Mycobacterium avium subsp. paratuberculosis
gcaggaaccgggucagcac

SEQ ID NO: 3031498 - RNA, 20 nt, Mycobacterium avium subsp. paratuberculosis
gcaggaaccgggucagcacc

SEQ ID NO: 3031499 - RNA, 22 nt, Mycobacterium avium subsp. paratuberculosis
gcaggaaccgggucagcaccac

SEQ ID NO: 3031500 - RNA, 14 nt, Mycobacterium avium subsp. paratuberculosis
gcaggaacuccagc

SEQ ID NO: 3031501 - RNA, 16 nt, Mycobacterium avium subsp. paratuberculosis
gcaggaacuccagcag

SEQ ID NO: 3031502 - RNA, 22 nt, Mycobacterium avium subsp. paratuberculosis
gcaggaacuccagcagcuguug

SEQ ID NO: 3031503 - RNA, 21 nt, Mycobacterium avium subsp. paratuberculosis
gcaggaacucccgcgccgcau

SEQ ID NO: 3031504 - RNA, 20 nt, Mycobacterium avium subsp. paratuberculosis
gcaggaagcgaauccgggug

SEQ ID NO: 3031505 - RNA, 14 nt, Mycobacterium avium subsp. paratuberculosis
gcaggaaguagccc

SEQ ID NO: 3031506 - RNA, 15 nt, Mycobacterium avium subsp. paratuberculosis
gcaggaauuccagcg

SEQ ID NO: 3031507 - RNA, 17 nt, Mycobacterium avium subsp. paratuberculosis
gcaggacccguugucgg

SEQ ID NO: 3031508 - RNA, 14 nt, Mycobacterium avium subsp. paratuberculosis
gcaggaccgagccg

SEQ ID NO: 3031509 - RNA, 15 nt, Mycobacterium avium subsp. paratuberculosis
gcaggaccgagccgc

SEQ ID NO: 3031510 - RNA, 17 nt, Mycobacterium avium subsp. paratuberculosis
gcaggaccgagccgcgc

SEQ ID NO: 3031511 - RNA, 19 nt, Mycobacterium avium subsp. paratuberculosis
gcaggaccgagccgcgcgc

SEQ ID NO: 3031512 - RNA, 20 nt, Mycobacterium avium subsp. paratuberculosis
gcaggaccgagccgcgcgcc

SEQ ID NO: 3031513 - RNA, 22 nt, Mycobacterium avium subsp. paratuberculosis
gcaggaccgagccgcgcgccga

SEQ ID NO: 3031514 - RNA, 18 nt, Mycobacterium avium subsp. paratuberculosis
gcaggaccuugucgggcc

SEQ ID NO: 3031515 - RNA, 22 nt, Mycobacterium avium subsp. paratuberculosis
gcaggaccuugucgggccgcgg

SEQ ID NO: 3031516 - RNA, 20 nt, Mycobacterium avium subsp. paratuberculosis
gcaggacgcgcccggcgacg

SEQ ID NO: 3031517 - RNA, 23 nt, Mycobacterium avium subsp. paratuberculosis
gcaggacgcgcccggcgacgcgg

SEQ ID NO: 3031518 - RNA, 13 nt, Mycobacterium avium subsp. paratuberculosis
gcaggacgggggc

SEQ ID NO: 3031519 - RNA, 20 nt, Mycobacterium avium subsp. paratuberculosis
gcaggacgggggccggugcg

SEQ ID NO: 3031520 - RNA, 16 nt, Mycobacterium avium subsp. paratuberculosis
gcaggacgguggccgu

SEQ ID NO: 3031521 - RNA, 16 nt, Mycobacterium avium subsp. paratuberculosis
gcaggagaucggcgcg

SEQ ID NO: 3031522 - RNA, 21 nt, Mycobacterium avium subsp. paratuberculosis
gcaggagaucggcgcggagcg

SEQ ID NO: 3031523 - RNA, 19 nt, Mycobacterium avium subsp. paratuberculosis
gcaggaggcggccaacaac

SEQ ID NO: 3031524 - RNA, 22 nt, Mycobacterium avium subsp. paratuberculosis
gcaggaucagcacuucaugguc

SEQ ID NO: 3031525 - RNA, 23 nt, Mycobacterium avium subsp. paratuberculosis
gcaggaucagcacuucauggucg

SEQ ID NO: 3031526 - RNA, 20 nt, Mycobacterium avium subsp. paratuberculosis
gcaggauccgcucgacgagu

SEQ ID NO: 3031527 - RNA, 15 nt, Mycobacterium avium subsp. paratuberculosis
gcaggauccggucga

SEQ ID NO: 3031528 - RNA, 18 nt, Mycobacterium avium subsp. paratuberculosis
gcaggaucgagccggccg

SEQ ID NO: 3031529 - RNA, 13 nt, Mycobacterium avium subsp. paratuberculosis
gcaggaucgcggu

SEQ ID NO: 3031530 - RNA, 22 nt, Mycobacterium avium subsp. paratuberculosis
gcaggaucgcggugaccgccgc

SEQ ID NO: 3031531 - RNA, 14 nt, Mycobacterium avium subsp. paratuberculosis
gcaggaucggcuug

SEQ ID NO: 3031532 - RNA, 14 nt, Mycobacterium avium subsp. paratuberculosis
gcaggaucuggugc

SEQ ID NO: 3031533 - RNA, 22 nt, Mycobacterium avium subsp. paratuberculosis
gcaggaucuuugcauacagcag

SEQ ID NO: 3031534 - RNA, 18 nt, Mycobacterium avium subsp. paratuberculosis
gcaggaugaccgcgucgg

SEQ ID NO: 3031535 - RNA, 20 nt, Mycobacterium avium subsp. paratuberculosis
gcaggaugaccgcgucggcg

SEQ ID NO: 3031536 - RNA, 17 nt, Mycobacterium avium subsp. paratuberculosis
gcaggaugaugaccgac

SEQ ID NO: 3031537 - RNA, 20 nt, Mycobacterium avium subsp. paratuberculosis
gcaggaugaugaccgacaug

SEQ ID NO: 3031538 - RNA, 17 nt, Mycobacterium avium subsp. paratuberculosis
gcaggaugcccagcacc

SEQ ID NO: 3031539 - RNA, 15 nt, Mycobacterium avium subsp. paratuberculosis
gcaggaugccgaugu

SEQ ID NO: 3031540 - RNA, 19 nt, Mycobacterium avium subsp. paratuberculosis
gcaggaugccgaugucgga

SEQ ID NO: 3031541 - RNA, 15 nt, Mycobacterium avium subsp. paratuberculosis
gcaggaugcguuggc

SEQ ID NO: 3031542 - RNA, 23 nt, Mycobacterium avium subsp. paratuberculosis
gcaggaugcguuggccgagcagc

SEQ ID NO: 3031543 - RNA, 16 nt, Mycobacterium avium subsp. paratuberculosis
gcaggcacggugucga

SEQ ID NO: 3031544 - RNA, 20 nt, Mycobacterium avium subsp. paratuberculosis
gcaggcacugaucccuccgu

SEQ ID NO: 3031545 - RNA, 13 nt, Mycobacterium avium subsp. paratuberculosis
gcaggcagcagca

SEQ ID NO: 3031546 - RNA, 17 nt, Mycobacterium avium subsp. paratuberculosis
gcaggcaggccccucca

SEQ ID NO: 3031547 - RNA, 16 nt, Mycobacterium avium subsp. paratuberculosis
gcaggcaggccggcag

SEQ ID NO: 3031548 - RNA, 15 nt, Mycobacterium avium subsp. paratuberculosis
gcaggccacgcccac

SEQ ID NO: 3031549 - RNA, 16 nt, Mycobacterium avium subsp. paratuberculosis
gcaggccacgcccacg

SEQ ID NO: 3031550 - RNA, 19 nt, Mycobacterium avium subsp. paratuberculosis
gcaggccacgcccacgccg

SEQ ID NO: 3031551 - RNA, 22 nt, Mycobacterium avium subsp. paratuberculosis
gcaggccaggugcagcugcauc

SEQ ID NO: 3031552 - RNA, 17 nt, Mycobacterium avium subsp. paratuberculosis
gcaggccaucagcccgg

SEQ ID NO: 3031553 - RNA, 19 nt, Mycobacterium avium subsp. paratuberculosis
gcaggccaucagcccggcg

SEQ ID NO: 3031554 - RNA, 23 nt, Mycobacterium avium subsp. paratuberculosis
gcaggccaucagcccggcguccu

SEQ ID NO: 3031555 - RNA, 13 nt, Mycobacterium avium subsp. paratuberculosis
gcaggcccagcug

SEQ ID NO: 3031556 - RNA, 16 nt, Mycobacterium avium subsp. paratuberculosis
gcaggccccggauccg

SEQ ID NO: 3031557 - RNA, 12 nt, Mycobacterium avium subsp. paratuberculosis
gcaggccccggc

SEQ ID NO: 3031558 - RNA, 13 nt, Mycobacterium avium subsp. paratuberculosis
gcaggccccggcg

SEQ ID NO: 3031559 - RNA, 14 nt, Mycobacterium avium subsp. paratuberculosis
gcaggccccggcgc

SEQ ID NO: 3031560 - RNA, 16 nt, Mycobacterium avium subsp. paratuberculosis
gcaggccccggcgcgc

SEQ ID NO: 3031561 - RNA, 22 nt, Mycobacterium avium subsp. paratuberculosis
gcaggccccguucgguggccac

SEQ ID NO: 3031562 - RNA, 20 nt, Mycobacterium avium subsp. paratuberculosis
gcaggcccgagcccgacggc

SEQ ID NO: 3031563 - RNA, 16 nt, Mycobacterium avium subsp. paratuberculosis
gcaggcccgggcggcg

SEQ ID NO: 3031564 - RNA, 17 nt, Mycobacterium avium subsp. paratuberculosis
gcaggcccgggcggcga

SEQ ID NO: 3031565 - RNA, 18 nt, Mycobacterium avium subsp. paratuberculosis
gcaggcccgggcggcgag

SEQ ID NO: 3031566 - RNA, 20 nt, Mycobacterium avium subsp. paratuberculosis
gcaggcccggguagcgcagc

SEQ ID NO: 3031567 - RNA, 16 nt, Mycobacterium avium subsp. paratuberculosis
gcaggcccucggccag

SEQ ID NO: 3031568 - RNA, 18 nt, Mycobacterium avium subsp. paratuberculosis
gcaggcccucggccagcc

SEQ ID NO: 3031569 - RNA, 20 nt, Mycobacterium avium subsp. paratuberculosis
gcaggccgaacaccgucauc

SEQ ID NO: 3031570 - RNA, 20 nt, Mycobacterium avium subsp. paratuberculosis
gcaggccgaagaacucagcc

SEQ ID NO: 3031571 - RNA, 12 nt, Mycobacterium avium subsp. paratuberculosis
gcaggccgagcc

SEQ ID NO: 3031572 - RNA, 18 nt, Mycobacterium avium subsp. paratuberculosis
gcaggccgagccgccgga

SEQ ID NO: 3031573 - RNA, 16 nt, Mycobacterium avium subsp. paratuberculosis
gcaggccgaggccaac

SEQ ID NO: 3031574 - RNA, 20 nt, Mycobacterium avium subsp. paratuberculosis
gcaggccgaggccaacucgc

SEQ ID NO: 3031575 - RNA, 20 nt, Mycobacterium avium subsp. paratuberculosis
gcaggccgaggcugucggag

SEQ ID NO: 3031576 - RNA, 15 nt, Mycobacterium avium subsp. paratuberculosis
gcaggccgcccgacc

SEQ ID NO: 3031577 - RNA, 17 nt, Mycobacterium avium subsp. paratuberculosis
gcaggccgcccgacccg

SEQ ID NO: 3031578 - RNA, 13 nt, Mycobacterium avium subsp. paratuberculosis
gcaggccgcccgg

SEQ ID NO: 3031579 - RNA, 16 nt, Mycobacterium avium subsp. paratuberculosis
gcaggccgcccggccc

SEQ ID NO: 3031580 - RNA, 20 nt, Mycobacterium avium subsp. paratuberculosis
gcaggccgccgacgacggcg

SEQ ID NO: 3031581 - RNA, 12 nt, Mycobacterium avium subsp. paratuberculosis
gcaggccgcgac

SEQ ID NO: 3031582 - RNA, 16 nt, Mycobacterium avium subsp. paratuberculosis
gcaggccgcgacgggc

SEQ ID NO: 3031583 - RNA, 15 nt, Mycobacterium avium subsp. paratuberculosis
gcaggccgcggccgu

SEQ ID NO: 3031584 - RNA, 17 nt, Mycobacterium avium subsp. paratuberculosis
gcaggccgcggccgucg

SEQ ID NO: 3031585 - RNA, 14 nt, Mycobacterium avium subsp. paratuberculosis
gcaggccgcgggug

SEQ ID NO: 3031586 - RNA, 15 nt, Mycobacterium avium subsp. paratuberculosis
gcaggccgcgggugg

SEQ ID NO: 3031587 - RNA, 16 nt, Mycobacterium avium subsp. paratuberculosis
gcaggccgcggguggc

SEQ ID NO: 3031588 - RNA, 14 nt, Mycobacterium avium subsp. paratuberculosis
gcaggccggcagcc

SEQ ID NO: 3031589 - RNA, 18 nt, Mycobacterium avium subsp. paratuberculosis
gcaggccggcagccggcg

SEQ ID NO: 3031590 - RNA, 22 nt, Mycobacterium avium subsp. paratuberculosis
gcaggccggcagccggcgcggu

SEQ ID NO: 3031591 - RNA, 21 nt, Mycobacterium avium subsp. paratuberculosis
gcaggccgggauagagcaccg

SEQ ID NO: 3031592 - RNA, 23 nt, Mycobacterium avium subsp. paratuberculosis
gcaggccgggauagagcaccgcg

SEQ ID NO: 3031593 - RNA, 13 nt, Mycobacterium avium subsp. paratuberculosis
gcaggccgucgcc

SEQ ID NO: 3031594 - RNA, 14 nt, Mycobacterium avium subsp. paratuberculosis
gcaggccgucgccg

SEQ ID NO: 3031595 - RNA, 17 nt, Mycobacterium avium subsp. paratuberculosis
gcaggccguuguggcca

SEQ ID NO: 3031596 - RNA, 15 nt, Mycobacterium avium subsp. paratuberculosis
gcaggcgagccgaca

SEQ ID NO: 3031597 - RNA, 17 nt, Mycobacterium avium subsp. paratuberculosis
gcaggcgagccgacagu

SEQ ID NO: 3031598 - RNA, 12 nt, Mycobacterium avium subsp. paratuberculosis
gcaggcgauggc

SEQ ID NO: 3031599 - RNA, 18 nt, Mycobacterium avium subsp. paratuberculosis
gcaggcgauggcgucggc

SEQ ID NO: 3031600 - RNA, 21 nt, Mycobacterium avium subsp. paratuberculosis
gcaggcgauggcgucggccag

SEQ ID NO: 3031601 - RNA, 19 nt, Mycobacterium avium subsp. paratuberculosis
gcaggcgaugugggugguc

SEQ ID NO: 3031602 - RNA, 23 nt, Mycobacterium avium subsp. paratuberculosis
gcaggcgauguggguggucagcg

SEQ ID NO: 3031603 - RNA, 14 nt, Mycobacterium avium subsp. paratuberculosis
gcaggcgcccagga

SEQ ID NO: 3031604 - RNA, 14 nt, Mycobacterium avium subsp. paratuberculosis
gcaggcgccccagc

SEQ ID NO: 3031605 - RNA, 21 nt, Mycobacterium avium subsp. paratuberculosis
gcaggcgccccagcuccucgg

SEQ ID NO: 3031606 - RNA, 14 nt, Mycobacterium avium subsp. paratuberculosis
gcaggcgccgcagc

SEQ ID NO: 3031607 - RNA, 14 nt, Mycobacterium avium subsp. paratuberculosis
gcaggcgccggucg

SEQ ID NO: 3031608 - RNA, 16 nt, Mycobacterium avium subsp. paratuberculosis
gcaggcgcgcaccauc

SEQ ID NO: 3031609 - RNA, 17 nt, Mycobacterium avium subsp. paratuberculosis
gcaggcgcgcagcaggc

SEQ ID NO: 3031610 - RNA, 12 nt, Mycobacterium avium subsp. paratuberculosis
gcaggcgcgccg

SEQ ID NO: 3031611 - RNA, 15 nt, Mycobacterium avium subsp. paratuberculosis
gcaggcgcgccgagc

SEQ ID NO: 3031612 - RNA, 18 nt, Mycobacterium avium subsp. paratuberculosis
gcaggcgcgcggccagcc

SEQ ID NO: 3031613 - RNA, 22 nt, Mycobacterium avium subsp. paratuberculosis
gcaggcgcuggguguuccccgg

SEQ ID NO: 3031614 - RNA, 18 nt, Mycobacterium avium subsp. paratuberculosis
gcaggcggaccugggugc

SEQ ID NO: 3031615 - RNA, 17 nt, Mycobacterium avium subsp. paratuberculosis
gcaggcggacggcgacc

SEQ ID NO: 3031616 - RNA, 17 nt, Mycobacterium avium subsp. paratuberculosis
gcaggcggaucggcccg

SEQ ID NO: 3031617 - RNA, 13 nt, Mycobacterium avium subsp. paratuberculosis
gcaggcggccagc

SEQ ID NO: 3031618 - RNA, 14 nt, Mycobacterium avium subsp. paratuberculosis
gcaggcggcccgcu

SEQ ID NO: 3031619 - RNA, 15 nt, Mycobacterium avium subsp. paratuberculosis
gcaggcggcgacggc

SEQ ID NO: 3031620 - RNA, 16 nt, Mycobacterium avium subsp. paratuberculosis
gcaggcggcgacggcc

SEQ ID NO: 3031621 - RNA, 17 nt, Mycobacterium avium subsp. paratuberculosis
gcaggcggcgacggccg

SEQ ID NO: 3031622 - RNA, 13 nt, Mycobacterium avium subsp. paratuberculosis
gcaggcggcgcgc

SEQ ID NO: 3031623 - RNA, 19 nt, Mycobacterium avium subsp. paratuberculosis
gcaggcggcgcgcagccgg

SEQ ID NO: 3031624 - RNA, 20 nt, Mycobacterium avium subsp. paratuberculosis
gcaggcggcgcgcagccggc

SEQ ID NO: 3031625 - RNA, 21 nt, Mycobacterium avium subsp. paratuberculosis
gcaggcggcgcgcagccggcc

SEQ ID NO: 3031626 - RNA, 19 nt, Mycobacterium avium subsp. paratuberculosis
gcaggcggggaaggacuca

SEQ ID NO: 3031627 - RNA, 16 nt, Mycobacterium avium subsp. paratuberculosis
gcaggcguccagggcc

SEQ ID NO: 3031628 - RNA, 21 nt, Mycobacterium avium subsp. paratuberculosis
gcaggcguccuugauccgggc

SEQ ID NO: 3031629 - RNA, 23 nt, Mycobacterium avium subsp. paratuberculosis
gcaggcguccuugauccgggcgc

SEQ ID NO: 3031630 - RNA, 17 nt, Mycobacterium avium subsp. paratuberculosis
gcaggcguggcccagcc

SEQ ID NO: 3031631 - RNA, 23 nt, Mycobacterium avium subsp. paratuberculosis
gcaggcguggcccagccggugcg

SEQ ID NO: 3031632 - RNA, 16 nt, Mycobacterium avium subsp. paratuberculosis
gcaggcucagcagcac

SEQ ID NO: 3031633 - RNA, 17 nt, Mycobacterium avium subsp. paratuberculosis
gcaggcucagcagcacc

SEQ ID NO: 3031634 - RNA, 21 nt, Mycobacterium avium subsp. paratuberculosis
gcaggcucagguaggcgcggg

SEQ ID NO: 3031635 - RNA, 16 nt, Mycobacterium avium subsp. paratuberculosis
gcaggcugacgcgacc

SEQ ID NO: 3031636 - RNA, 21 nt, Mycobacterium avium subsp. paratuberculosis
gcaggcugacgcgaccgcgcg

SEQ ID NO: 3031637 - RNA, 18 nt, Mycobacterium avium subsp. paratuberculosis
gcaggcugaucucggcgg

SEQ ID NO: 3031638 - RNA, 18 nt, Mycobacterium avium subsp. paratuberculosis
gcaggcuggcaucgucgg

SEQ ID NO: 3031639 - RNA, 22 nt, Mycobacterium avium subsp. paratuberculosis
gcaggcuggcaucgucggcgcc

SEQ ID NO: 3031640 - RNA, 17 nt, Mycobacterium avium subsp. paratuberculosis
gcaggcuggcaugccgg

SEQ ID NO: 3031641 - RNA, 19 nt, Mycobacterium avium subsp. paratuberculosis
gcaggcuggcaugccggaa

SEQ ID NO: 3031642 - RNA, 17 nt, Mycobacterium avium subsp. paratuberculosis
gcaggcuggcggcgauc

SEQ ID NO: 3031643 - RNA, 20 nt, Mycobacterium avium subsp. paratuberculosis
gcaggcuggcggcgaucacc

SEQ ID NO: 3031644 - RNA, 19 nt, Mycobacterium avium subsp. paratuberculosis
gcaggcuucgcagcagauc

SEQ ID NO: 3031645 - RNA, 17 nt, Mycobacterium avium subsp. paratuberculosis
gcagggauucggccaug

SEQ ID NO: 3031646 - RNA, 18 nt, Mycobacterium avium subsp. paratuberculosis
gcagggauucggccaugc

SEQ ID NO: 3031647 - RNA, 15 nt, Mycobacterium avium subsp. paratuberculosis
gcagggcaccgacgg

SEQ ID NO: 3031648 - RNA, 18 nt, Mycobacterium avium subsp. paratuberculosis
gcagggcaccgacggccg

SEQ ID NO: 3031649 - RNA, 19 nt, Mycobacterium avium subsp. paratuberculosis
gcagggcaccgacggccgc

SEQ ID NO: 3031650 - RNA, 18 nt, Mycobacterium avium subsp. paratuberculosis
gcagggcaucucccgcgc

SEQ ID NO: 3031651 - RNA, 19 nt, Mycobacterium avium subsp. paratuberculosis
gcagggcaucucccgcgcg

SEQ ID NO: 3031652 - RNA, 18 nt, Mycobacterium avium subsp. paratuberculosis
gcagggccaagacacgcu

SEQ ID NO: 3031653 - RNA, 11 nt, Mycobacterium avium subsp. paratuberculosis
gcagggccacc

SEQ ID NO: 3031654 - RNA, 17 nt, Mycobacterium avium subsp. paratuberculosis
gcagggccaccgucagg

SEQ ID NO: 3031655 - RNA, 20 nt, Mycobacterium avium subsp. paratuberculosis
gcagggccaccgucagggug

SEQ ID NO: 3031656 - RNA, 14 nt, Mycobacterium avium subsp. paratuberculosis
gcagggccagcacc

SEQ ID NO: 3031657 - RNA, 16 nt, Mycobacterium avium subsp. paratuberculosis
gcagggccagcagccc

SEQ ID NO: 3031658 - RNA, 14 nt, Mycobacterium avium subsp. paratuberculosis
gcagggccagcggc

SEQ ID NO: 3031659 - RNA, 15 nt, Mycobacterium avium subsp. paratuberculosis
gcagggccucgccgu

SEQ ID NO: 3031660 - RNA, 13 nt, Mycobacterium avium subsp. paratuberculosis
gcagggcgccgac

SEQ ID NO: 3031661 - RNA, 16 nt, Mycobacterium avium subsp. paratuberculosis
gcagggcgccgacgau

SEQ ID NO: 3031662 - RNA, 23 nt, Mycobacterium avium subsp. paratuberculosis
gcagggcgcgcaucugcucggcg

SEQ ID NO: 3031663 - RNA, 17 nt, Mycobacterium avium subsp. paratuberculosis
gcagggcggaaucgcgg

SEQ ID NO: 3031664 - RNA, 11 nt, Mycobacterium avium subsp. paratuberculosis
gcagggcggca

SEQ ID NO: 3031665 - RNA, 19 nt, Mycobacterium avium subsp. paratuberculosis
gcagggcggcaccgaucgg

SEQ ID NO: 3031666 - RNA, 14 nt, Mycobacterium avium subsp. paratuberculosis
gcagggcggccggc

SEQ ID NO: 3031667 - RNA, 16 nt, Mycobacterium avium subsp. paratuberculosis
gcagggcggcgaucga

SEQ ID NO: 3031668 - RNA, 17 nt, Mycobacterium avium subsp. paratuberculosis
gcagggcguucgacguc

SEQ ID NO: 3031669 - RNA, 13 nt, Mycobacterium avium subsp. paratuberculosis
gcagggggcgcag

SEQ ID NO: 3031670 - RNA, 14 nt, Mycobacterium avium subsp. paratuberculosis
gcagggggcgcagc

SEQ ID NO: 3031671 - RNA, 14 nt, Mycobacterium avium subsp. paratuberculosis
gcagggucagcagc

SEQ ID NO: 3031672 - RNA, 15 nt, Mycobacterium avium subsp. paratuberculosis
gcagggucagcagca

SEQ ID NO: 3031673 - RNA, 18 nt, Mycobacterium avium subsp. paratuberculosis
gcagggucagcagcaccc

SEQ ID NO: 3031674 - RNA, 21 nt, Mycobacterium avium subsp. paratuberculosis
gcagggucagcagcacccggu

SEQ ID NO: 3031675 - RNA, 12 nt, Mycobacterium avium subsp. paratuberculosis
gcagggucagcg

SEQ ID NO: 3031676 - RNA, 16 nt, Mycobacterium avium subsp. paratuberculosis
gcagggucagcgacaa

SEQ ID NO: 3031677 - RNA, 14 nt, Mycobacterium avium subsp. paratuberculosis
gcaggguccgccgu

SEQ ID NO: 3031678 - RNA, 20 nt, Mycobacterium avium subsp. paratuberculosis
gcagggucgagaucagcacc

SEQ ID NO: 3031679 - RNA, 15 nt, Mycobacterium avium subsp. paratuberculosis
gcagggugacgucgu

SEQ ID NO: 3031680 - RNA, 18 nt, Mycobacterium avium subsp. paratuberculosis
gcagggugacgucguuga

SEQ ID NO: 3031681 - RNA, 14 nt, Mycobacterium avium subsp. paratuberculosis
gcagggugccgccg

SEQ ID NO: 3031682 - RNA, 16 nt, Mycobacterium avium subsp. paratuberculosis
gcagggugccgccgcc

SEQ ID NO: 3031683 - RNA, 18 nt, Mycobacterium avium subsp. paratuberculosis
gcagggugccgccgcccg

SEQ ID NO: 3031684 - RNA, 17 nt, Mycobacterium avium subsp. paratuberculosis
gcaggguggccagcacc

SEQ ID NO: 3031685 - RNA, 20 nt, Mycobacterium avium subsp. paratuberculosis
gcaggguggccagcaccgcg

SEQ ID NO: 3031686 - RNA, 20 nt, Mycobacterium avium subsp. paratuberculosis
gcaggguuuucacgucgagc

SEQ ID NO: 3031687 - RNA, 23 nt, Mycobacterium avium subsp. paratuberculosis
gcaggguuuucacgucgagcggc

SEQ ID NO: 3031688 - RNA, 18 nt, Mycobacterium avium subsp. paratuberculosis
gcagguaaaccagcagcg

SEQ ID NO: 3031689 - RNA, 23 nt, Mycobacterium avium subsp. paratuberculosis
gcagguacugcuugccgccgggc

SEQ ID NO: 3031690 - RNA, 16 nt, Mycobacterium avium subsp. paratuberculosis
gcagguagaagccgcg

SEQ ID NO: 3031691 - RNA, 18 nt, Mycobacterium avium subsp. paratuberculosis
gcagguagaagccgcgac

SEQ ID NO: 3031692 - RNA, 19 nt, Mycobacterium avium subsp. paratuberculosis
gcagguagaucgccagcgc

SEQ ID NO: 3031693 - RNA, 20 nt, Mycobacterium avium subsp. paratuberculosis
gcagguagaucgccagcgcc

SEQ ID NO: 3031694 - RNA, 15 nt, Mycobacterium avium subsp. paratuberculosis
gcagguagguggcca

SEQ ID NO: 3031695 - RNA, 20 nt, Mycobacterium avium subsp. paratuberculosis
gcaggucacccuccucgcgg

SEQ ID NO: 3031696 - RNA, 21 nt, Mycobacterium avium subsp. paratuberculosis
gcaggucacccuccucgcggc

SEQ ID NO: 3031697 - RNA, 15 nt, Mycobacterium avium subsp. paratuberculosis
gcagguccacccgcc

SEQ ID NO: 3031698 - RNA, 20 nt, Mycobacterium avium subsp. paratuberculosis
gcagguccacccgccccgcc

SEQ ID NO: 3031699 - RNA, 22 nt, Mycobacterium avium subsp. paratuberculosis
gcagguccacccgccccgccgc

SEQ ID NO: 3031700 - RNA, 22 nt, Mycobacterium avium subsp. paratuberculosis
gcagguccaggaucacgcggcg

SEQ ID NO: 3031701 - RNA, 14 nt, Mycobacterium avium subsp. paratuberculosis
gcaggucccaggcc

SEQ ID NO: 3031702 - RNA, 13 nt, Mycobacterium avium subsp. paratuberculosis
gcagguccgccgg

SEQ ID NO: 3031703 - RNA, 14 nt, Mycobacterium avium subsp. paratuberculosis
gcagguccgccggu

SEQ ID NO: 3031704 - RNA, 15 nt, Mycobacterium avium subsp. paratuberculosis
gcagguccgccggug

SEQ ID NO: 3031705 - RNA, 16 nt, Mycobacterium avium subsp. paratuberculosis
gcagguccgccggugc

SEQ ID NO: 3031706 - RNA, 17 nt, Mycobacterium avium subsp. paratuberculosis
gcagguccgccggugcc

SEQ ID NO: 3031707 - RNA, 18 nt, Mycobacterium avium subsp. paratuberculosis
gcagguccgccggugcca

SEQ ID NO: 3031708 - RNA, 14 nt, Mycobacterium avium subsp. paratuberculosis
gcagguccggcagc

SEQ ID NO: 3031709 - RNA, 18 nt, Mycobacterium avium subsp. paratuberculosis
gcagguccggcagcgcgc

SEQ ID NO: 3031710 - RNA, 22 nt, Mycobacterium avium subsp. paratuberculosis
gcagguccguggugaucgccgc

SEQ ID NO: 3031711 - RNA, 13 nt, Mycobacterium avium subsp. paratuberculosis
gcagguccucgga

SEQ ID NO: 3031712 - RNA, 23 nt, Mycobacterium avium subsp. paratuberculosis
gcagguccucggacucgucgcug

SEQ ID NO: 3031713 - RNA, 18 nt, Mycobacterium avium subsp. paratuberculosis
gcaggucgaaggcggccg

SEQ ID NO: 3031714 - RNA, 21 nt, Mycobacterium avium subsp. paratuberculosis
gcaggucgaaggcggccgcga

SEQ ID NO: 3031715 - RNA, 22 nt, Mycobacterium avium subsp. paratuberculosis
gcaggucgaaggcggccgcgag

SEQ ID NO: 3031716 - RNA, 23 nt, Mycobacterium avium subsp. paratuberculosis
gcaggucgaggccggccagcggg

SEQ ID NO: 3031717 - RNA, 22 nt, Mycobacterium avium subsp. paratuberculosis
gcaggucgauggcguagcgggu

SEQ ID NO: 3031718 - RNA, 15 nt, Mycobacterium avium subsp. paratuberculosis
gcaggucgcgccgga

SEQ ID NO: 3031719 - RNA, 17 nt, Mycobacterium avium subsp. paratuberculosis
gcaggucgcgccggagc

SEQ ID NO: 3031720 - RNA, 21 nt, Mycobacterium avium subsp. paratuberculosis
gcaggucgcggugggcgcggg

SEQ ID NO: 3031721 - RNA, 13 nt, Mycobacterium avium subsp. paratuberculosis
gcaggucggccag

SEQ ID NO: 3031722 - RNA, 18 nt, Mycobacterium avium subsp. paratuberculosis
gcaggucggccagcgccg

SEQ ID NO: 3031723 - RNA, 20 nt, Mycobacterium avium subsp. paratuberculosis
gcaggucggccagcgccgcc

SEQ ID NO: 3031724 - RNA, 21 nt, Mycobacterium avium subsp. paratuberculosis
gcaggucggccagcgccgccc

SEQ ID NO: 3031725 - RNA, 16 nt, Mycobacterium avium subsp. paratuberculosis
gcaggucggccagcug

SEQ ID NO: 3031726 - RNA, 20 nt, Mycobacterium avium subsp. paratuberculosis
gcaggucggcgggagccggc

SEQ ID NO: 3031727 - RNA, 22 nt, Mycobacterium avium subsp. paratuberculosis
gcaggucggcgggagccggcgg

SEQ ID NO: 3031728 - RNA, 23 nt, Mycobacterium avium subsp. paratuberculosis
gcaggucggcgugcucgucgcgg

SEQ ID NO: 3031729 - RNA, 16 nt, Mycobacterium avium subsp. paratuberculosis
gcaggucgggccggcc

SEQ ID NO: 3031730 - RNA, 17 nt, Mycobacterium avium subsp. paratuberculosis
gcaggucgggccggccg

SEQ ID NO: 3031731 - RNA, 18 nt, Mycobacterium avium subsp. paratuberculosis
gcaggucgggccggccga

SEQ ID NO: 3031732 - RNA, 17 nt, Mycobacterium avium subsp. paratuberculosis
gcaggucggugcgcggg

SEQ ID NO: 3031733 - RNA, 23 nt, Mycobacterium avium subsp. paratuberculosis
gcaggucguaguaggcgccgaac

SEQ ID NO: 3031734 - RNA, 14 nt, Mycobacterium avium subsp. paratuberculosis
gcaggucgucgacg

SEQ ID NO: 3031735 - RNA, 15 nt, Mycobacterium avium subsp. paratuberculosis
gcaggucgucgacgu

SEQ ID NO: 3031736 - RNA, 16 nt, Mycobacterium avium subsp. paratuberculosis
gcaggucgucgacguc

SEQ ID NO: 3031737 - RNA, 21 nt, Mycobacterium avium subsp. paratuberculosis
gcaggucgucgacguccucga

SEQ ID NO: 3031738 - RNA, 17 nt, Mycobacterium avium subsp. paratuberculosis
gcaggucgucgacgucg

SEQ ID NO: 3031739 - RNA, 14 nt, Mycobacterium avium subsp. paratuberculosis
gcaggucgucgauc

SEQ ID NO: 3031740 - RNA, 16 nt, Mycobacterium avium subsp. paratuberculosis
gcaggucgucgucgcc

SEQ ID NO: 3031741 - RNA, 17 nt, Mycobacterium avium subsp. paratuberculosis
gcaggucgucgucgccg

SEQ ID NO: 3031742 - RNA, 23 nt, Mycobacterium avium subsp. paratuberculosis
gcaggugacggauguggucggcc

SEQ ID NO: 3031743 - RNA, 18 nt, Mycobacterium avium subsp. paratuberculosis
gcaggugagccgggugcc

SEQ ID NO: 3031744 - RNA, 22 nt, Mycobacterium avium subsp. paratuberculosis
gcaggugagccgggugcccgcg

SEQ ID NO: 3031745 - RNA, 22 nt, Mycobacterium avium subsp. paratuberculosis
gcaggugaucaaagccgguggc

SEQ ID NO: 3031746 - RNA, 23 nt, Mycobacterium avium subsp. paratuberculosis
gcaggugaucuugcccagccacg

SEQ ID NO: 3031747 - RNA, 20 nt, Mycobacterium avium subsp. paratuberculosis
gcaggugaugcggcccgacc

SEQ ID NO: 3031748 - RNA, 14 nt, Mycobacterium avium subsp. paratuberculosis
gcaggugcaccacc

SEQ ID NO: 3031749 - RNA, 15 nt, Mycobacterium avium subsp. paratuberculosis
gcaggugcaccaccc

SEQ ID NO: 3031750 - RNA, 16 nt, Mycobacterium avium subsp. paratuberculosis
gcaggugcaccaccca

SEQ ID NO: 3031751 - RNA, 19 nt, Mycobacterium avium subsp. paratuberculosis
gcaggugcaccacccaggc

SEQ ID NO: 3031752 - RNA, 15 nt, Mycobacterium avium subsp. paratuberculosis
gcaggugcagcuccu

SEQ ID NO: 3031753 - RNA, 17 nt, Mycobacterium avium subsp. paratuberculosis
gcaggugcaucgaccgg

SEQ ID NO: 3031754 - RNA, 21 nt, Mycobacterium avium subsp. paratuberculosis
gcaggugcaucgaccggcgga

SEQ ID NO: 3031755 - RNA, 17 nt, Mycobacterium avium subsp. paratuberculosis
gcaggugcaucgccacc

SEQ ID NO: 3031756 - RNA, 15 nt, Mycobacterium avium subsp. paratuberculosis
gcaggugcccgucgg

SEQ ID NO: 3031757 - RNA, 21 nt, Mycobacterium avium subsp. paratuberculosis
gcaggugcccgucggccucgg

SEQ ID NO: 3031758 - RNA, 23 nt, Mycobacterium avium subsp. paratuberculosis
gcaggugcccgucggccucggcg

SEQ ID NO: 3031759 - RNA, 14 nt, Mycobacterium avium subsp. paratuberculosis
gcaggugcgccaga

SEQ ID NO: 3031760 - RNA, 14 nt, Mycobacterium avium subsp. paratuberculosis
gcaggugcgccgcu

SEQ ID NO: 3031761 - RNA, 23 nt, Mycobacterium avium subsp. paratuberculosis
gcaggugcgccgcucgucggcca

SEQ ID NO: 3031762 - RNA, 16 nt, Mycobacterium avium subsp. paratuberculosis
gcaggugcgcggucag

SEQ ID NO: 3031763 - RNA, 21 nt, Mycobacterium avium subsp. paratuberculosis
gcaggugcggcaccuccagcc

SEQ ID NO: 3031764 - RNA, 16 nt, Mycobacterium avium subsp. paratuberculosis
gcaggugcucgccggc

SEQ ID NO: 3031765 - RNA, 18 nt, Mycobacterium avium subsp. paratuberculosis
gcagguggauugucggcc

SEQ ID NO: 3031766 - RNA, 14 nt, Mycobacterium avium subsp. paratuberculosis
gcagguggucggcg

SEQ ID NO: 3031767 - RNA, 16 nt, Mycobacterium avium subsp. paratuberculosis
gcagguggucggcgaa

SEQ ID NO: 3031768 - RNA, 14 nt, Mycobacterium avium subsp. paratuberculosis
gcagguggucggug

SEQ ID NO: 3031769 - RNA, 14 nt, Mycobacterium avium subsp. paratuberculosis
gcagguggugggcg

SEQ ID NO: 3031770 - RNA, 15 nt, Mycobacterium avium subsp. paratuberculosis
gcaggugugcggcaa

SEQ ID NO: 3031771 - RNA, 16 nt, Mycobacterium avium subsp. paratuberculosis
gcagguucgacacgcc

SEQ ID NO: 3031772 - RNA, 19 nt, Mycobacterium avium subsp. paratuberculosis
gcagguucugcacguggug

SEQ ID NO: 3031773 - RNA, 17 nt, Mycobacterium avium subsp. paratuberculosis
gcagguugauccgcgcg

SEQ ID NO: 3031774 - RNA, 19 nt, Mycobacterium avium subsp. paratuberculosis
gcagguugauccggauccg

SEQ ID NO: 3031775 - RNA, 18 nt, Mycobacterium avium subsp. paratuberculosis
gcagguugcgcuggauga

SEQ ID NO: 3031776 - RNA, 22 nt, Mycobacterium avium subsp. paratuberculosis
gcagguugcgguguugcgcagc

SEQ ID NO: 3031777 - RNA, 24 nt, Mycobacterium avium subsp. paratuberculosis
gcagguugcgguguugcgcagcga

SEQ ID NO: 3031778 - RNA, 17 nt, Mycobacterium avium subsp. paratuberculosis
gcagguuggggacggcg

SEQ ID NO: 3031779 - RNA, 17 nt, Mycobacterium avium subsp. paratuberculosis
gcagguuguccagccgg

SEQ ID NO: 3031780 - RNA, 18 nt, Mycobacterium avium subsp. paratuberculosis
gcagguuguccagccggu

SEQ ID NO: 3031781 - RNA, 19 nt, Mycobacterium avium subsp. paratuberculosis
gcagguuguccagccggug

SEQ ID NO: 3031782 - RNA, 14 nt, Mycobacterium avium subsp. paratuberculosis
gcagguugucggcc

SEQ ID NO: 3031783 - RNA, 16 nt, Mycobacterium avium subsp. paratuberculosis
gcagguugucggccaa

SEQ ID NO: 3031784 - RNA, 18 nt, Mycobacterium avium subsp. paratuberculosis
gcagguuguugacgacgu

SEQ ID NO: 3031785 - RNA, 20 nt, Mycobacterium avium subsp. paratuberculosis
gcagguuucucgaccaagaa

SEQ ID NO: 3031786 - RNA, 15 nt, Mycobacterium avium subsp. paratuberculosis
gcaguacgcaucggc

SEQ ID NO: 3031787 - RNA, 16 nt, Mycobacterium avium subsp. paratuberculosis
gcaguacgcgccggcc

SEQ ID NO: 3031788 - RNA, 16 nt, Mycobacterium avium subsp. paratuberculosis
gcaguagaacggcccg

SEQ ID NO: 3031789 - RNA, 17 nt, Mycobacterium avium subsp. paratuberculosis
gcaguagacgccgccgu

SEQ ID NO: 3031790 - RNA, 21 nt, Mycobacterium avium subsp. paratuberculosis
gcaguagcacuuucgcggcaa

SEQ ID NO: 3031791 - RNA, 14 nt, Mycobacterium avium subsp. paratuberculosis
gcaguagccgacgu

SEQ ID NO: 3031792 - RNA, 22 nt, Mycobacterium avium subsp. paratuberculosis
gcaguagccgaucuccaccgag

SEQ ID NO: 3031793 - RNA, 20 nt, Mycobacterium avium subsp. paratuberculosis
gcaguagccggccagcucga

SEQ ID NO: 3031794 - RNA, 22 nt, Mycobacterium avium subsp. paratuberculosis
gcaguagcgacgcgacgcgcuc

SEQ ID NO: 3031795 - RNA, 16 nt, Mycobacterium avium subsp. paratuberculosis
gcaguagcgcauaggc

SEQ ID NO: 3031796 - RNA, 19 nt, Mycobacterium avium subsp. paratuberculosis
gcaguagugguccaccgcc

SEQ ID NO: 3031797 - RNA, 14 nt, Mycobacterium avium subsp. paratuberculosis
gcaguccagggugg

SEQ ID NO: 3031798 - RNA, 23 nt, Mycobacterium avium subsp. paratuberculosis
gcaguccgcgccggucccgcggc

SEQ ID NO: 3031799 - RNA, 20 nt, Mycobacterium avium subsp. paratuberculosis
gcaguccggacacggccagc

SEQ ID NO: 3031800 - RNA, 23 nt, Mycobacterium avium subsp. paratuberculosis
gcaguccggacacggccagcgcc

SEQ ID NO: 3031801 - RNA, 23 nt, Mycobacterium avium subsp. paratuberculosis
gcaguccggcgaguacccgccgc

SEQ ID NO: 3031802 - RNA, 17 nt, Mycobacterium avium subsp. paratuberculosis
gcagucgaucaccgaga

SEQ ID NO: 3031803 - RNA, 18 nt, Mycobacterium avium subsp. paratuberculosis
gcagucgaucagcgacgg

SEQ ID NO: 3031804 - RNA, 13 nt, Mycobacterium avium subsp. paratuberculosis
gcagucgcagcag

SEQ ID NO: 3031805 - RNA, 20 nt, Mycobacterium avium subsp. paratuberculosis
gcagucgcagcagcagcccg

SEQ ID NO: 3031806 - RNA, 16 nt, Mycobacterium avium subsp. paratuberculosis
gcagucgcaggccccg

SEQ ID NO: 3031807 - RNA, 18 nt, Mycobacterium avium subsp. paratuberculosis
gcagucgcaggccccgga

SEQ ID NO: 3031808 - RNA, 13 nt, Mycobacterium avium subsp. paratuberculosis
gcagucggccgga

SEQ ID NO: 3031809 - RNA, 14 nt, Mycobacterium avium subsp. paratuberculosis
gcagucggccggau

SEQ ID NO: 3031810 - RNA, 16 nt, Mycobacterium avium subsp. paratuberculosis
gcagucggccugcagc

SEQ ID NO: 3031811 - RNA, 18 nt, Mycobacterium avium subsp. paratuberculosis
gcagucggccugcagcuc

SEQ ID NO: 3031812 - RNA, 18 nt, Mycobacterium avium subsp. paratuberculosis
gcagucggcgucgcggcg

SEQ ID NO: 3031813 - RNA, 22 nt, Mycobacterium avium subsp. paratuberculosis
gcagucggcgucgcggcgcacc

SEQ ID NO: 3031814 - RNA, 19 nt, Mycobacterium avium subsp. paratuberculosis
gcagucgugacgcggcguc

SEQ ID NO: 3031815 - RNA, 22 nt, Mycobacterium avium subsp. paratuberculosis
gcagucgugacgcggcgucggg

SEQ ID NO: 3031816 - RNA, 14 nt, Mycobacterium avium subsp. paratuberculosis
gcagucugccggug

SEQ ID NO: 3031817 - RNA, 19 nt, Mycobacterium avium subsp. paratuberculosis
gcagugcacgacgaccgcg

SEQ ID NO: 3031818 - RNA, 20 nt, Mycobacterium avium subsp. paratuberculosis
gcagugcacgacgaccgcgu

SEQ ID NO: 3031819 - RNA, 15 nt, Mycobacterium avium subsp. paratuberculosis
gcagugccaccacca

SEQ ID NO: 3031820 - RNA, 18 nt, Mycobacterium avium subsp. paratuberculosis
gcagugccaccaccacgg

SEQ ID NO: 3031821 - RNA, 20 nt, Mycobacterium avium subsp. paratuberculosis
gcagugccaccaccacggcc

SEQ ID NO: 3031822 - RNA, 17 nt, Mycobacterium avium subsp. paratuberculosis
gcagugccccguccggc

SEQ ID NO: 3031823 - RNA, 19 nt, Mycobacterium avium subsp. paratuberculosis
gcagugccccguccggcgc

SEQ ID NO: 3031824 - RNA, 21 nt, Mycobacterium avium subsp. paratuberculosis
gcagugccccguccggcgcca

SEQ ID NO: 3031825 - RNA, 19 nt, Mycobacterium avium subsp. paratuberculosis
gcagugccggcgcaccgcg

SEQ ID NO: 3031826 - RNA, 22 nt, Mycobacterium avium subsp. paratuberculosis
gcagugccggugcagcaccucg

SEQ ID NO: 3031827 - RNA, 14 nt, Mycobacterium avium subsp. paratuberculosis
gcagugcgccgucc

SEQ ID NO: 3031828 - RNA, 13 nt, Mycobacterium avium subsp. paratuberculosis
gcagugcgcggcg

SEQ ID NO: 3031829 - RNA, 15 nt, Mycobacterium avium subsp. paratuberculosis
gcagugcgcggcguc

SEQ ID NO: 3031830 - RNA, 12 nt, Mycobacterium avium subsp. paratuberculosis
gcaguggugcuc

SEQ ID NO: 3031831 - RNA, 19 nt, Mycobacterium avium subsp. paratuberculosis
gcagugguugagcagcaga

SEQ ID NO: 3031832 - RNA, 18 nt, Mycobacterium avium subsp. paratuberculosis
gcaguguccagucggccg

SEQ ID NO: 3031833 - RNA, 15 nt, Mycobacterium avium subsp. paratuberculosis
gcagugucggaaucg

SEQ ID NO: 3031834 - RNA, 21 nt, Mycobacterium avium subsp. paratuberculosis
gcagugucggaaucggcgccg

SEQ ID NO: 3031835 - RNA, 22 nt, Mycobacterium avium subsp. paratuberculosis
gcagugucggaaucggcgccga

SEQ ID NO: 3031836 - RNA, 15 nt, Mycobacterium avium subsp. paratuberculosis
gcaguuaccggcgua

SEQ ID NO: 3031837 - RNA, 21 nt, Mycobacterium avium subsp. paratuberculosis
gcaguuccaugucgacgacgu

SEQ ID NO: 3031838 - RNA, 13 nt, Mycobacterium avium subsp. paratuberculosis
gcaguuccucgcc

SEQ ID NO: 3031839 - RNA, 23 nt, Mycobacterium avium subsp. paratuberculosis
gcaguuccucgccggaguucagc

SEQ ID NO: 3031840 - RNA, 17 nt, Mycobacterium avium subsp. paratuberculosis
gcaguuccuugcgcagc

SEQ ID NO: 3031841 - RNA, 20 nt, Mycobacterium avium subsp. paratuberculosis
gcaguuccuugcgcagcacc

SEQ ID NO: 3031842 - RNA, 19 nt, Mycobacterium avium subsp. paratuberculosis
gcaguucgaugcgcucggc

SEQ ID NO: 3031843 - RNA, 21 nt, Mycobacterium avium subsp. paratuberculosis
gcaguucgaugcgcucggcga

SEQ ID NO: 3031844 - RNA, 23 nt, Mycobacterium avium subsp. paratuberculosis
gcaguucgaugcgcucggcgacc

SEQ ID NO: 3031845 - RNA, 22 nt, Mycobacterium avium subsp. paratuberculosis
gcaguugcgcguugcgcggacc

SEQ ID NO: 3031846 - RNA, 20 nt, Mycobacterium avium subsp. paratuberculosis
gcaguuguuccagucccagu

SEQ ID NO: 3031847 - RNA, 15 nt, Mycobacterium avium subsp. paratuberculosis
gcaguuuggucaucc

SEQ ID NO: 3031848 - RNA, 14 nt, Mycobacterium avium subsp. paratuberculosis
gcauacagcaggcu

SEQ ID NO: 3031849 - RNA, 16 nt, Mycobacterium avium subsp. paratuberculosis
gcauaccagcgcuggu

SEQ ID NO: 3031850 - RNA, 17 nt, Mycobacterium avium subsp. paratuberculosis
gcauaccgcccgcgcug

SEQ ID NO: 3031851 - RNA, 18 nt, Mycobacterium avium subsp. paratuberculosis
gcauaccgcccgcgcugg

SEQ ID NO: 3031852 - RNA, 19 nt, Mycobacterium avium subsp. paratuberculosis
gcauaccgcccgcgcuggu

SEQ ID NO: 3031853 - RNA, 19 nt, Mycobacterium avium subsp. paratuberculosis
gcauacugcuugccgucga

SEQ ID NO: 3031854 - RNA, 22 nt, Mycobacterium avium subsp. paratuberculosis
gcauacugcuugccgucgacgc

SEQ ID NO: 3031855 - RNA, 17 nt, Mycobacterium avium subsp. paratuberculosis
gcauagauaccggccag

SEQ ID NO: 3031856 - RNA, 22 nt, Mycobacterium avium subsp. paratuberculosis
gcauagauaccggccagcacga

SEQ ID NO: 3031857 - RNA, 20 nt, Mycobacterium avium subsp. paratuberculosis
gcauagcgggagccggccag

SEQ ID NO: 3031858 - RNA, 22 nt, Mycobacterium avium subsp. paratuberculosis
gcauagcgguccauccagcgcc

SEQ ID NO: 3031859 - RNA, 16 nt, Mycobacterium avium subsp. paratuberculosis
gcauaggccagcacca

SEQ ID NO: 3031860 - RNA, 15 nt, Mycobacterium avium subsp. paratuberculosis
gcauaggccgcgagg

SEQ ID NO: 3031861 - RNA, 19 nt, Mycobacterium avium subsp. paratuberculosis
gcaucaaaaacgaucccag

SEQ ID NO: 3031862 - RNA, 18 nt, Mycobacterium avium subsp. paratuberculosis
gcaucaacugcaccagcg

SEQ ID NO: 3031863 - RNA, 19 nt, Mycobacterium avium subsp. paratuberculosis
gcaucaacugcaccagcgg

SEQ ID NO: 3031864 - RNA, 15 nt, Mycobacterium avium subsp. paratuberculosis
gcaucacccggcgcg

SEQ ID NO: 3031865 - RNA, 20 nt, Mycobacterium avium subsp. paratuberculosis
gcaucaccgccuuccgccac

SEQ ID NO: 3031866 - RNA, 13 nt, Mycobacterium avium subsp. paratuberculosis
gcaucaccuucug

SEQ ID NO: 3031867 - RNA, 18 nt, Mycobacterium avium subsp. paratuberculosis
gcaucaccuucugcgcgc

SEQ ID NO: 3031868 - RNA, 16 nt, Mycobacterium avium subsp. paratuberculosis
gcaucacgucggcgag

SEQ ID NO: 3031869 - RNA, 17 nt, Mycobacterium avium subsp. paratuberculosis
gcaucacgucggcgagc

SEQ ID NO: 3031870 - RNA, 16 nt, Mycobacterium avium subsp. paratuberculosis
gcaucagcgagacgac

SEQ ID NO: 3031871 - RNA, 17 nt, Mycobacterium avium subsp. paratuberculosis
gcaucagcgagacgacc

SEQ ID NO: 3031872 - RNA, 24 nt, Mycobacterium avium subsp. paratuberculosis
gcaucagcgagacgaccaggaugc

SEQ ID NO: 3031873 - RNA, 15 nt, Mycobacterium avium subsp. paratuberculosis
gcaucagcgccacca

SEQ ID NO: 3031874 - RNA, 21 nt, Mycobacterium avium subsp. paratuberculosis
gcaucagcgccaccagcaccg

SEQ ID NO: 3031875 - RNA, 14 nt, Mycobacterium avium subsp. paratuberculosis
gcaucagcggagug

SEQ ID NO: 3031876 - RNA, 23 nt, Mycobacterium avium subsp. paratuberculosis
gcaucagcggagugaccgccagc

SEQ ID NO: 3031877 - RNA, 14 nt, Mycobacterium avium subsp. paratuberculosis
gcaucagcggggcg

SEQ ID NO: 3031878 - RNA, 23 nt, Mycobacterium avium subsp. paratuberculosis
gcaucagcggggcguccagcgag

SEQ ID NO: 3031879 - RNA, 13 nt, Mycobacterium avium subsp. paratuberculosis
gcaucagcgugau

SEQ ID NO: 3031880 - RNA, 15 nt, Mycobacterium avium subsp. paratuberculosis
gcaucagcucggcag

SEQ ID NO: 3031881 - RNA, 20 nt, Mycobacterium avium subsp. paratuberculosis
gcaucagcucggcagccccg

SEQ ID NO: 3031882 - RNA, 14 nt, Mycobacterium avium subsp. paratuberculosis
gcaucagcugccgu

SEQ ID NO: 3031883 - RNA, 23 nt, Mycobacterium avium subsp. paratuberculosis
gcaucagcugccguccggguccg

SEQ ID NO: 3031884 - RNA, 14 nt, Mycobacterium avium subsp. paratuberculosis
gcaucagggccagc

SEQ ID NO: 3031885 - RNA, 15 nt, Mycobacterium avium subsp. paratuberculosis
gcaucagggccagcc

SEQ ID NO: 3031886 - RNA, 15 nt, Mycobacterium avium subsp. paratuberculosis
gcaucaggucggugc

SEQ ID NO: 3031887 - RNA, 22 nt, Mycobacterium avium subsp. paratuberculosis
gcaucaguucguucauccgggu

SEQ ID NO: 3031888 - RNA, 23 nt, Mycobacterium avium subsp. paratuberculosis
gcaucaguucguucauccggguu

SEQ ID NO: 3031889 - RNA, 11 nt, Mycobacterium avium subsp. paratuberculosis
gcaucaucgcc

SEQ ID NO: 3031890 - RNA, 14 nt, Mycobacterium avium subsp. paratuberculosis
gcaucaucgcccag

SEQ ID NO: 3031891 - RNA, 20 nt, Mycobacterium avium subsp. paratuberculosis
gcaucaucgcccagcgcagc

SEQ ID NO: 3031892 - RNA, 22 nt, Mycobacterium avium subsp. paratuberculosis
gcaucaucgcuacaccccaccg

SEQ ID NO: 3031893 - RNA, 14 nt, Mycobacterium avium subsp. paratuberculosis
gcaucaucggcacg

SEQ ID NO: 3031894 - RNA, 20 nt, Mycobacterium avium subsp. paratuberculosis
gcaucaucggcacgccgggg

SEQ ID NO: 3031895 - RNA, 15 nt, Mycobacterium avium subsp. paratuberculosis
gcaucaucucggcga

SEQ ID NO: 3031896 - RNA, 16 nt, Mycobacterium avium subsp. paratuberculosis
gcaucaucucggcgaa

SEQ ID NO: 3031897 - RNA, 22 nt, Mycobacterium avium subsp. paratuberculosis
gcaucaugucgaagaagcggcc

SEQ ID NO: 3031898 - RNA, 15 nt, Mycobacterium avium subsp. paratuberculosis
gcauccaccagggcg

SEQ ID NO: 3031899 - RNA, 18 nt, Mycobacterium avium subsp. paratuberculosis
gcauccaccagggcggug

SEQ ID NO: 3031900 - RNA, 17 nt, Mycobacterium avium subsp. paratuberculosis
gcauccagcacggccgc

SEQ ID NO: 3031901 - RNA, 22 nt, Mycobacterium avium subsp. paratuberculosis
gcauccagcacggccgccagga

SEQ ID NO: 3031902 - RNA, 13 nt, Mycobacterium avium subsp. paratuberculosis
gcauccagccguc

SEQ ID NO: 3031903 - RNA, 15 nt, Mycobacterium avium subsp. paratuberculosis
gcauccagcgccgcc

SEQ ID NO: 3031904 - RNA, 16 nt, Mycobacterium avium subsp. paratuberculosis
gcauccagcgccgcca

SEQ ID NO: 3031905 - RNA, 18 nt, Mycobacterium avium subsp. paratuberculosis
gcauccagguggcgccuc

SEQ ID NO: 3031906 - RNA, 15 nt, Mycobacterium avium subsp. paratuberculosis
gcauccagucggcgc

SEQ ID NO: 3031907 - RNA, 23 nt, Mycobacterium avium subsp. paratuberculosis
gcauccccagcugggccgccagc

SEQ ID NO: 3031908 - RNA, 14 nt, Mycobacterium avium subsp. paratuberculosis
gcaucccgccgaac

SEQ ID NO: 3031909 - RNA, 17 nt, Mycobacterium avium subsp. paratuberculosis
gcaucccgccgaacccg

SEQ ID NO: 3031910 - RNA, 21 nt, Mycobacterium avium subsp. paratuberculosis
gcaucccgcuucuggcgggcg

SEQ ID NO: 3031911 - RNA, 18 nt, Mycobacterium avium subsp. paratuberculosis
gcaucccgucgaccagga

SEQ ID NO: 3031912 - RNA, 20 nt, Mycobacterium avium subsp. paratuberculosis
gcaucccugacacgaccgcc

SEQ ID NO: 3031913 - RNA, 16 nt, Mycobacterium avium subsp. paratuberculosis
gcaucccuggugaccg

SEQ ID NO: 3031914 - RNA, 13 nt, Mycobacterium avium subsp. paratuberculosis
gcauccgacaccg

SEQ ID NO: 3031915 - RNA, 22 nt, Mycobacterium avium subsp. paratuberculosis
gcauccgcaacgugcgccggcc

SEQ ID NO: 3031916 - RNA, 15 nt, Mycobacterium avium subsp. paratuberculosis
gcauccgcaccgaga

SEQ ID NO: 3031917 - RNA, 14 nt, Mycobacterium avium subsp. paratuberculosis
gcauccgcagcacc

SEQ ID NO: 3031918 - RNA, 20 nt, Mycobacterium avium subsp. paratuberculosis
gcauccgcagcaccaggguc

SEQ ID NO: 3031919 - RNA, 23 nt, Mycobacterium avium subsp. paratuberculosis
gcauccgcccguagaugcggccc

SEQ ID NO: 3031920 - RNA, 12 nt, Mycobacterium avium subsp. paratuberculosis
gcauccgccgac

SEQ ID NO: 3031921 - RNA, 14 nt, Mycobacterium avium subsp. paratuberculosis
gcauccgccgggcg

SEQ ID NO: 3031922 - RNA, 17 nt, Mycobacterium avium subsp. paratuberculosis
gcauccgccgggcggcg

SEQ ID NO: 3031923 - RNA, 18 nt, Mycobacterium avium subsp. paratuberculosis
gcauccgccgggcggcgu

SEQ ID NO: 3031924 - RNA, 12 nt, Mycobacterium avium subsp. paratuberculosis
gcauccgcgagc

SEQ ID NO: 3031925 - RNA, 18 nt, Mycobacterium avium subsp. paratuberculosis
gcauccgcucgccgcggg

SEQ ID NO: 3031926 - RNA, 20 nt, Mycobacterium avium subsp. paratuberculosis
gcauccgcucgccgcgggug

SEQ ID NO: 3031927 - RNA, 13 nt, Mycobacterium avium subsp. paratuberculosis
gcauccgcuggug

SEQ ID NO: 3031928 - RNA, 14 nt, Mycobacterium avium subsp. paratuberculosis
gcauccgcuggugc

SEQ ID NO: 3031929 - RNA, 16 nt, Mycobacterium avium subsp. paratuberculosis
gcauccgcuggugcgc

SEQ ID NO: 3031930 - RNA, 19 nt, Mycobacterium avium subsp. paratuberculosis
gcauccgcuggugcgcgcc

SEQ ID NO: 3031931 - RNA, 20 nt, Mycobacterium avium subsp. paratuberculosis
gcauccgcuggugcgcgccg

SEQ ID NO: 3031932 - RNA, 22 nt, Mycobacterium avium subsp. paratuberculosis
gcauccgcuggugcgcgccggc

SEQ ID NO: 3031933 - RNA, 23 nt, Mycobacterium avium subsp. paratuberculosis
gcauccgcuggugcgcgccggcg

SEQ ID NO: 3031934 - RNA, 14 nt, Mycobacterium avium subsp. paratuberculosis
gcauccggaaccgg

SEQ ID NO: 3031935 - RNA, 18 nt, Mycobacterium avium subsp. paratuberculosis
gcauccggaaccgggcac

SEQ ID NO: 3031936 - RNA, 23 nt, Mycobacterium avium subsp. paratuberculosis
gcauccggaaccgggcacccggc

SEQ ID NO: 3031937 - RNA, 12 nt, Mycobacterium avium subsp. paratuberculosis
gcauccggccgu

SEQ ID NO: 3031938 - RNA, 22 nt, Mycobacterium avium subsp. paratuberculosis
gcauccggccgucgucgggcag

SEQ ID NO: 3031939 - RNA, 16 nt, Mycobacterium avium subsp. paratuberculosis
gcauccggcgcacggc

SEQ ID NO: 3031940 - RNA, 18 nt, Mycobacterium avium subsp. paratuberculosis
gcauccggcgcacggcgc

SEQ ID NO: 3031941 - RNA, 19 nt, Mycobacterium avium subsp. paratuberculosis
gcauccggcgcacggcgcc

SEQ ID NO: 3031942 - RNA, 17 nt, Mycobacterium avium subsp. paratuberculosis
gcauccgggaggccagc

SEQ ID NO: 3031943 - RNA, 18 nt, Mycobacterium avium subsp. paratuberculosis
gcauccgggaggccagca

SEQ ID NO: 3031944 - RNA, 19 nt, Mycobacterium avium subsp. paratuberculosis
gcauccgggaggccagcac

SEQ ID NO: 3031945 - RNA, 21 nt, Mycobacterium avium subsp. paratuberculosis
gcauccgggaggccagcaccu

SEQ ID NO: 3031946 - RNA, 22 nt, Mycobacterium avium subsp. paratuberculosis
gcauccggucauccucgccgcg

SEQ ID NO: 3031947 - RNA, 13 nt, Mycobacterium avium subsp. paratuberculosis
gcauccggugccg

SEQ ID NO: 3031948 - RNA, 20 nt, Mycobacterium avium subsp. paratuberculosis
gcauccggugccgagcgcgc

SEQ ID NO: 3031949 - RNA, 13 nt, Mycobacterium avium subsp. paratuberculosis
gcauccgucggcc

SEQ ID NO: 3031950 - RNA, 17 nt, Mycobacterium avium subsp. paratuberculosis
gcauccucauagccggc

SEQ ID NO: 3031951 - RNA, 19 nt, Mycobacterium avium subsp. paratuberculosis
gcauccucauagccggccg

SEQ ID NO: 3031952 - RNA, 20 nt, Mycobacterium avium subsp. paratuberculosis
gcauccucauagccggccgc

SEQ ID NO: 3031953 - RNA, 19 nt, Mycobacterium avium subsp. paratuberculosis
gcauccucggcgcgucggu

SEQ ID NO: 3031954 - RNA, 19 nt, Mycobacterium avium subsp. paratuberculosis
gcauccugggcgucgagug

SEQ ID NO: 3031955 - RNA, 15 nt, Mycobacterium avium subsp. paratuberculosis
gcaucgaaccgccgc

SEQ ID NO: 3031956 - RNA, 16 nt, Mycobacterium avium subsp. paratuberculosis
gcaucgaaccgccgcg

SEQ ID NO: 3031957 - RNA, 18 nt, Mycobacterium avium subsp. paratuberculosis
gcaucgaaccgccgcgcu

SEQ ID NO: 3031958 - RNA, 24 nt, Mycobacterium avium subsp. paratuberculosis
gcaucgaaccgccgcgcucgcacc

SEQ ID NO: 3031959 - RNA, 18 nt, Mycobacterium avium subsp. paratuberculosis
gcaucgacaugcccggcg

SEQ ID NO: 3031960 - RNA, 23 nt, Mycobacterium avium subsp. paratuberculosis
gcaucgacaugcccggcgacggc

SEQ ID NO: 3031961 - RNA, 14 nt, Mycobacterium avium subsp. paratuberculosis
gcaucgacugcgac

SEQ ID NO: 3031962 - RNA, 21 nt, Mycobacterium avium subsp. paratuberculosis
gcaucgacugcgacacccgcu

SEQ ID NO: 3031963 - RNA, 16 nt, Mycobacterium avium subsp. paratuberculosis
gcaucgagaugcugug

SEQ ID NO: 3031964 - RNA, 18 nt, Mycobacterium avium subsp. paratuberculosis
gcaucgaggaccggcgcc

SEQ ID NO: 3031965 - RNA, 19 nt, Mycobacterium avium subsp. paratuberculosis
gcaucgaggaccggcgccg

SEQ ID NO: 3031966 - RNA, 22 nt, Mycobacterium avium subsp. paratuberculosis
gcaucgaggaccggcgccggcc

SEQ ID NO: 3031967 - RNA, 14 nt, Mycobacterium avium subsp. paratuberculosis
gcaucgaugccggc

SEQ ID NO: 3031968 - RNA, 19 nt, Mycobacterium avium subsp. paratuberculosis
gcaucgauggcgggcgcgc

SEQ ID NO: 3031969 - RNA, 22 nt, Mycobacterium avium subsp. paratuberculosis
gcaucgcacagauacgcgacga

SEQ ID NO: 3031970 - RNA, 13 nt, Mycobacterium avium subsp. paratuberculosis
gcaucgcagcgcg

SEQ ID NO: 3031971 - RNA, 14 nt, Mycobacterium avium subsp. paratuberculosis
gcaucgcagcgcgc

SEQ ID NO: 3031972 - RNA, 16 nt, Mycobacterium avium subsp. paratuberculosis
gcaucgcagcgcgcgg

SEQ ID NO: 3031973 - RNA, 14 nt, Mycobacterium avium subsp. paratuberculosis
gcaucgccgaaccg

SEQ ID NO: 3031974 - RNA, 18 nt, Mycobacterium avium subsp. paratuberculosis
gcaucgccgaaccgggcg

SEQ ID NO: 3031975 - RNA, 16 nt, Mycobacterium avium subsp. paratuberculosis
gcaucgccgagcgcau

SEQ ID NO: 3031976 - RNA, 19 nt, Mycobacterium avium subsp. paratuberculosis
gcaucgccgagcgcaucga

SEQ ID NO: 3031977 - RNA, 20 nt, Mycobacterium avium subsp. paratuberculosis
gcaucgccgagcgcaucgac

SEQ ID NO: 3031978 - RNA, 17 nt, Mycobacterium avium subsp. paratuberculosis
gcaucgccgcgacccgg

SEQ ID NO: 3031979 - RNA, 13 nt, Mycobacterium avium subsp. paratuberculosis
gcaucgccgcggu

SEQ ID NO: 3031980 - RNA, 14 nt, Mycobacterium avium subsp. paratuberculosis
gcaucgccgcggug

SEQ ID NO: 3031981 - RNA, 15 nt, Mycobacterium avium subsp. paratuberculosis
gcaucgccgcggugc

SEQ ID NO: 3031982 - RNA, 13 nt, Mycobacterium avium subsp. paratuberculosis
gcaucgccggcga

SEQ ID NO: 3031983 - RNA, 22 nt, Mycobacterium avium subsp. paratuberculosis
gcaucgccggcgaugcgcgccu

SEQ ID NO: 3031984 - RNA, 16 nt, Mycobacterium avium subsp. paratuberculosis
gcaucgccggcgcgcu

SEQ ID NO: 3031985 - RNA, 14 nt, Mycobacterium avium subsp. paratuberculosis
gcaucgccgucguc

SEQ ID NO: 3031986 - RNA, 20 nt, Mycobacterium avium subsp. paratuberculosis
gcaucgccgucgucagccgg

SEQ ID NO: 3031987 - RNA, 16 nt, Mycobacterium avium subsp. paratuberculosis
gcaucgccucggcggc

SEQ ID NO: 3031988 - RNA, 17 nt, Mycobacterium avium subsp. paratuberculosis
gcaucgccucggcggcc

SEQ ID NO: 3031989 - RNA, 18 nt, Mycobacterium avium subsp. paratuberculosis
gcaucgccucggcggccg

SEQ ID NO: 3031990 - RNA, 20 nt, Mycobacterium avium subsp. paratuberculosis
gcaucgccucggcggccgcc

SEQ ID NO: 3031991 - RNA, 21 nt, Mycobacterium avium subsp. paratuberculosis
gcaucgccucggcggccgccc

SEQ ID NO: 3031992 - RNA, 15 nt, Mycobacterium avium subsp. paratuberculosis
gcaucgcgcgcggcg

SEQ ID NO: 3031993 - RNA, 19 nt, Mycobacterium avium subsp. paratuberculosis
gcaucgcgcgcggcggcca

SEQ ID NO: 3031994 - RNA, 21 nt, Mycobacterium avium subsp. paratuberculosis
gcaucgcgcgcggcggccacc

SEQ ID NO: 3031995 - RNA, 23 nt, Mycobacterium avium subsp. paratuberculosis
gcaucgcugguggccgacgugcc

SEQ ID NO: 3031996 - RNA, 16 nt, Mycobacterium avium subsp. paratuberculosis
gcaucggaugccgggg

SEQ ID NO: 3031997 - RNA, 23 nt, Mycobacterium avium subsp. paratuberculosis
gcaucggaugccggggcagcacc

SEQ ID NO: 3031998 - RNA, 18 nt, Mycobacterium avium subsp. paratuberculosis
gcaucggcagaucguugg

SEQ ID NO: 3031999 - RNA, 20 nt, Mycobacterium avium subsp. paratuberculosis
gcaucggcaguccgcgccgg

SEQ ID NO: 3032000 - RNA, 14 nt, Mycobacterium avium subsp. paratuberculosis
gcaucggcgacgcc

SEQ ID NO: 3032001 - RNA, 15 nt, Mycobacterium avium subsp. paratuberculosis
gcaucggcgacgccg

SEQ ID NO: 3032002 - RNA, 17 nt, Mycobacterium avium subsp. paratuberculosis
gcaucggcgacgccgcc

SEQ ID NO: 3032003 - RNA, 19 nt, Mycobacterium avium subsp. paratuberculosis
gcaucggcgacgccgccgu

SEQ ID NO: 3032004 - RNA, 17 nt, Mycobacterium avium subsp. paratuberculosis
gcaucggcgcccucgcc

SEQ ID NO: 3032005 - RNA, 21 nt, Mycobacterium avium subsp. paratuberculosis
gcaucggcgcccucgccgacc

SEQ ID NO: 3032006 - RNA, 23 nt, Mycobacterium avium subsp. paratuberculosis
gcaucggcgcccucgccgaccug

SEQ ID NO: 3032007 - RNA, 16 nt, Mycobacterium avium subsp. paratuberculosis
gcaucggcuggucggc

SEQ ID NO: 3032008 - RNA, 18 nt, Mycobacterium avium subsp. paratuberculosis
gcaucgggacgccugccg

SEQ ID NO: 3032009 - RNA, 14 nt, Mycobacterium avium subsp. paratuberculosis
gcaucgggcgcagg

SEQ ID NO: 3032010 - RNA, 15 nt, Mycobacterium avium subsp. paratuberculosis
gcaucgggcgcucgg

SEQ ID NO: 3032011 - RNA, 17 nt, Mycobacterium avium subsp. paratuberculosis
gcaucgggcgcucggcc

SEQ ID NO: 3032012 - RNA, 18 nt, Mycobacterium avium subsp. paratuberculosis
gcaucgggcgcucggcca

SEQ ID NO: 3032013 - RNA, 20 nt, Mycobacterium avium subsp. paratuberculosis
gcaucgggcgcucggccagc

SEQ ID NO: 3032014 - RNA, 20 nt, Mycobacterium avium subsp. paratuberculosis
gcaucggguugccggcggcc

SEQ ID NO: 3032015 - RNA, 16 nt, Mycobacterium avium subsp. paratuberculosis
gcaucggucaccagcu

SEQ ID NO: 3032016 - RNA, 19 nt, Mycobacterium avium subsp. paratuberculosis
gcaucggucaccagcuccc

SEQ ID NO: 3032017 - RNA, 12 nt, Mycobacterium avium subsp. paratuberculosis
gcaucggucagc

SEQ ID NO: 3032018 - RNA, 14 nt, Mycobacterium avium subsp. paratuberculosis
gcaucggucccagu

SEQ ID NO: 3032019 - RNA, 17 nt, Mycobacterium avium subsp. paratuberculosis
gcaucggugagacgacc

SEQ ID NO: 3032020 - RNA, 18 nt, Mycobacterium avium subsp. paratuberculosis
gcaucggugagacgaccc

SEQ ID NO: 3032021 - RNA, 12 nt, Mycobacterium avium subsp. paratuberculosis
gcaucgguggca

SEQ ID NO: 3032022 - RNA, 21 nt, Mycobacterium avium subsp. paratuberculosis
gcaucgguggcaccccgcgcc

SEQ ID NO: 3032023 - RNA, 14 nt, Mycobacterium avium subsp. paratuberculosis
gcaucgucgcggcg

SEQ ID NO: 3032024 - RNA, 23 nt, Mycobacterium avium subsp. paratuberculosis
gcaucgucgcggcgcuaaagcca

SEQ ID NO: 3032025 - RNA, 17 nt, Mycobacterium avium subsp. paratuberculosis
gcaucgucgcggcgguc

SEQ ID NO: 3032026 - RNA, 17 nt, Mycobacterium avium subsp. paratuberculosis
gcaucgugaugcgggua

SEQ ID NO: 3032027 - RNA, 22 nt, Mycobacterium avium subsp. paratuberculosis
gcaucguggcuuuggucgccag

SEQ ID NO: 3032028 - RNA, 17 nt, Mycobacterium avium subsp. paratuberculosis
gcaucguugccggcggc

SEQ ID NO: 3032029 - RNA, 20 nt, Mycobacterium avium subsp. paratuberculosis
gcaucguugccggcggcgaa

SEQ ID NO: 3032030 - RNA, 17 nt, Mycobacterium avium subsp. paratuberculosis
gcaucguugguccaggc

SEQ ID NO: 3032031 - RNA, 18 nt, Mycobacterium avium subsp. paratuberculosis
gcaucguugguccaggcg

SEQ ID NO: 3032032 - RNA, 23 nt, Mycobacterium avium subsp. paratuberculosis
gcaucguugguccaggcguucga

SEQ ID NO: 3032033 - RNA, 18 nt, Mycobacterium avium subsp. paratuberculosis
gcaucuccagccggcgaa

SEQ ID NO: 3032034 - RNA, 20 nt, Mycobacterium avium subsp. paratuberculosis
gcaucuccagccggcgaaug

SEQ ID NO: 3032035 - RNA, 21 nt, Mycobacterium avium subsp. paratuberculosis
gcaucucgaaugcggcugccg

SEQ ID NO: 3032036 - RNA, 23 nt, Mycobacterium avium subsp. paratuberculosis
gcaucucgaaugcggcugccggc

SEQ ID NO: 3032037 - RNA, 19 nt, Mycobacterium avium subsp. paratuberculosis
gcaucucgacccgggccag

SEQ ID NO: 3032038 - RNA, 14 nt, Mycobacterium avium subsp. paratuberculosis
gcaucucgaccugg

SEQ ID NO: 3032039 - RNA, 14 nt, Mycobacterium avium subsp. paratuberculosis
gcaucucggccgga

SEQ ID NO: 3032040 - RNA, 14 nt, Mycobacterium avium subsp. paratuberculosis
gcaucucggugccg

SEQ ID NO: 3032041 - RNA, 22 nt, Mycobacterium avium subsp. paratuberculosis
gcaucucggugccgucgaucgc

SEQ ID NO: 3032042 - RNA, 21 nt, Mycobacterium avium subsp. paratuberculosis
gcaucucuugaugcagcgccu

SEQ ID NO: 3032043 - RNA, 22 nt, Mycobacterium avium subsp. paratuberculosis
gcaucugcucggcguccagcaa

SEQ ID NO: 3032044 - RNA, 20 nt, Mycobacterium avium subsp. paratuberculosis
gcaucugguauucgauggug

SEQ ID NO: 3032045 - RNA, 20 nt, Mycobacterium avium subsp. paratuberculosis
gcaugaaccaggccgcgcug

SEQ ID NO: 3032046 - RNA, 24 nt, Mycobacterium avium subsp. paratuberculosis
gcaugaaccaggccgcgcuggcgc

SEQ ID NO: 3032047 - RNA, 17 nt, Mycobacterium avium subsp. paratuberculosis
gcaugaagaucagcacc

SEQ ID NO: 3032048 - RNA, 18 nt, Mycobacterium avium subsp. paratuberculosis
gcaugaccgauccgccgg

SEQ ID NO: 3032049 - RNA, 21 nt, Mycobacterium avium subsp. paratuberculosis
gcaugacggccugcaccacca

SEQ ID NO: 3032050 - RNA, 16 nt, Mycobacterium avium subsp. paratuberculosis
gcaugaucaccgccag

SEQ ID NO: 3032051 - RNA, 19 nt, Mycobacterium avium subsp. paratuberculosis
gcaugaucgcccgcuccgc

SEQ ID NO: 3032052 - RNA, 19 nt, Mycobacterium avium subsp. paratuberculosis
gcaugcaccggugcaccgc

SEQ ID NO: 3032053 - RNA, 22 nt, Mycobacterium avium subsp. paratuberculosis
gcaugcaccggugcaccgcgcg

SEQ ID NO: 3032054 - RNA, 15 nt, Mycobacterium avium subsp. paratuberculosis
gcaugcccacgccgu

SEQ ID NO: 3032055 - RNA, 16 nt, Mycobacterium avium subsp. paratuberculosis
gcaugcccgggcgacu

SEQ ID NO: 3032056 - RNA, 21 nt, Mycobacterium avium subsp. paratuberculosis
gcaugccgaacaacagggccg

SEQ ID NO: 3032057 - RNA, 13 nt, Mycobacterium avium subsp. paratuberculosis
gcaugccggccgg

SEQ ID NO: 3032058 - RNA, 18 nt, Mycobacterium avium subsp. paratuberculosis
gcaugccggccggcacga

SEQ ID NO: 3032059 - RNA, 21 nt, Mycobacterium avium subsp. paratuberculosis
gcaugccggccuucucgcgca

SEQ ID NO: 3032060 - RNA, 13 nt, Mycobacterium avium subsp. paratuberculosis
gcaugccgggcag

SEQ ID NO: 3032061 - RNA, 15 nt, Mycobacterium avium subsp. paratuberculosis
gcaugccgggcagga

SEQ ID NO: 3032062 - RNA, 14 nt, Mycobacterium avium subsp. paratuberculosis
gcaugccgggccag

SEQ ID NO: 3032063 - RNA, 21 nt, Mycobacterium avium subsp. paratuberculosis
gcaugccgggccagccggccc

SEQ ID NO: 3032064 - RNA, 18 nt, Mycobacterium avium subsp. paratuberculosis
gcaugccggugucggugc

SEQ ID NO: 3032065 - RNA, 16 nt, Mycobacterium avium subsp. paratuberculosis
gcaugccgucggcgcc

SEQ ID NO: 3032066 - RNA, 19 nt, Mycobacterium avium subsp. paratuberculosis
gcaugccguucagcgcggc

SEQ ID NO: 3032067 - RNA, 13 nt, Mycobacterium avium subsp. paratuberculosis
gcaugcgccagag

SEQ ID NO: 3032068 - RNA, 15 nt, Mycobacterium avium subsp. paratuberculosis
gcaugcgccagagcg

SEQ ID NO: 3032069 - RNA, 14 nt, Mycobacterium avium subsp. paratuberculosis
gcauggacagcgau

SEQ ID NO: 3032070 - RNA, 21 nt, Mycobacterium avium subsp. paratuberculosis
gcauggacccgaagucgacgc

SEQ ID NO: 3032071 - RNA, 15 nt, Mycobacterium avium subsp. paratuberculosis
gcauggccggcgaac

SEQ ID NO: 3032072 - RNA, 22 nt, Mycobacterium avium subsp. paratuberculosis
gcauggccuugagaacgucgcg

SEQ ID NO: 3032073 - RNA, 18 nt, Mycobacterium avium subsp. paratuberculosis
gcauggcgaucaccccgg

SEQ ID NO: 3032074 - RNA, 22 nt, Mycobacterium avium subsp. paratuberculosis
gcauggcgaucaccccggcgac

SEQ ID NO: 3032075 - RNA, 20 nt, Mycobacterium avium subsp. paratuberculosis
gcauggcgaugaccagcgcg

SEQ ID NO: 3032076 - RNA, 17 nt, Mycobacterium avium subsp. paratuberculosis
gcauggcgaugacgucg

SEQ ID NO: 3032077 - RNA, 20 nt, Mycobacterium avium subsp. paratuberculosis
gcauggcgaugacgucgucg

SEQ ID NO: 3032078 - RNA, 14 nt, Mycobacterium avium subsp. paratuberculosis
gcauggcuggcggc

SEQ ID NO: 3032079 - RNA, 17 nt, Mycobacterium avium subsp. paratuberculosis
gcauggcuggcggcaac

SEQ ID NO: 3032080 - RNA, 17 nt, Mycobacterium avium subsp. paratuberculosis
gcaugggaucagcagca

SEQ ID NO: 3032081 - RNA, 19 nt, Mycobacterium avium subsp. paratuberculosis
gcaugggaucagcagcacc

SEQ ID NO: 3032082 - RNA, 20 nt, Mycobacterium avium subsp. paratuberculosis
gcaugggcggcaagccgagu

SEQ ID NO: 3032083 - RNA, 14 nt, Mycobacterium avium subsp. paratuberculosis
gcaugggcgugccg

SEQ ID NO: 3032084 - RNA, 17 nt, Mycobacterium avium subsp. paratuberculosis
gcaugggcgugccggcc

SEQ ID NO: 3032085 - RNA, 15 nt, Mycobacterium avium subsp. paratuberculosis
gcauggucaccggag

SEQ ID NO: 3032086 - RNA, 19 nt, Mycobacterium avium subsp. paratuberculosis
gcauggugaagcccagcgc

SEQ ID NO: 3032087 - RNA, 23 nt, Mycobacterium avium subsp. paratuberculosis
gcauggugcggguguccgagcgg

SEQ ID NO: 3032088 - RNA, 21 nt, Mycobacterium avium subsp. paratuberculosis
gcauguagguggcgaccaccg

SEQ ID NO: 3032089 - RNA, 21 nt, Mycobacterium avium subsp. paratuberculosis
gcauguccgccgucaucggcg

SEQ ID NO: 3032090 - RNA, 18 nt, Mycobacterium avium subsp. paratuberculosis
gcauguccggggugagca

SEQ ID NO: 3032091 - RNA, 22 nt, Mycobacterium avium subsp. paratuberculosis
gcaugucgaccucggccaccac

SEQ ID NO: 3032092 - RNA, 14 nt, Mycobacterium avium subsp. paratuberculosis
gcaugucgcccgcg

SEQ ID NO: 3032093 - RNA, 17 nt, Mycobacterium avium subsp. paratuberculosis
gcaugucgcccgcgucg

SEQ ID NO: 3032094 - RNA, 14 nt, Mycobacterium avium subsp. paratuberculosis
gcaugucgccgaac

SEQ ID NO: 3032095 - RNA, 14 nt, Mycobacterium avium subsp. paratuberculosis
gcaugugccacagg

SEQ ID NO: 3032096 - RNA, 13 nt, Mycobacterium avium subsp. paratuberculosis
gcaugugcucggc

SEQ ID NO: 3032097 - RNA, 15 nt, Mycobacterium avium subsp. paratuberculosis
gcauguggccgucgc

SEQ ID NO: 3032098 - RNA, 16 nt, Mycobacterium avium subsp. paratuberculosis
gcauguggccgucgcc

SEQ ID NO: 3032099 - RNA, 21 nt, Mycobacterium avium subsp. paratuberculosis
gcauguucaaucccguugcgg

SEQ ID NO: 3032100 - RNA, 18 nt, Mycobacterium avium subsp. paratuberculosis
gcauguugaacgccgcgu

SEQ ID NO: 3032101 - RNA, 17 nt, Mycobacterium avium subsp. paratuberculosis
gcauguuggugaucagc

SEQ ID NO: 3032102 - RNA, 21 nt, Mycobacterium avium subsp. paratuberculosis
gcauucaccagcugucccagu

SEQ ID NO: 3032103 - RNA, 14 nt, Mycobacterium avium subsp. paratuberculosis
gcauuccaccgcgc

SEQ ID NO: 3032104 - RNA, 16 nt, Mycobacterium avium subsp. paratuberculosis
gcauuccaccgcgcgg

SEQ ID NO: 3032105 - RNA, 17 nt, Mycobacterium avium subsp. paratuberculosis
gcauuccaccgcgcggc

SEQ ID NO: 3032106 - RNA, 17 nt, Mycobacterium avium subsp. paratuberculosis
gcauuccgucuuggcca

SEQ ID NO: 3032107 - RNA, 19 nt, Mycobacterium avium subsp. paratuberculosis
gcauucgccggggucgcgc

SEQ ID NO: 3032108 - RNA, 14 nt, Mycobacterium avium subsp. paratuberculosis
gcauucggccgcca

SEQ ID NO: 3032109 - RNA, 16 nt, Mycobacterium avium subsp. paratuberculosis
gcauucggccgccacc

SEQ ID NO: 3032110 - RNA, 18 nt, Mycobacterium avium subsp. paratuberculosis
gcauucggccgccaccga

SEQ ID NO: 3032111 - RNA, 21 nt, Mycobacterium avium subsp. paratuberculosis
gcauugcccaucgccacgccg

SEQ ID NO: 3032112 - RNA, 22 nt, Mycobacterium avium subsp. paratuberculosis
gcauugcccaucgccacgccgu

SEQ ID NO: 3032113 - RNA, 15 nt, Mycobacterium avium subsp. paratuberculosis
gcauuggcaccgucg

SEQ ID NO: 3032114 - RNA, 17 nt, Mycobacterium avium subsp. paratuberculosis
gcauuggcagcucgggc

SEQ ID NO: 3032115 - RNA, 19 nt, Mycobacterium avium subsp. paratuberculosis
gcauuggcagcucgggcag

SEQ ID NO: 3032116 - RNA, 20 nt, Mycobacterium avium subsp. paratuberculosis
gcauuggcagcucgggcagc

SEQ ID NO: 3032117 - RNA, 14 nt, Mycobacterium avium subsp. paratuberculosis
gcauuggcgauggc

SEQ ID NO: 3032118 - RNA, 14 nt, Mycobacterium avium subsp. paratuberculosis
gcauuucggcgucc

SEQ ID NO: 3032119 - RNA, 14 nt, Mycobacterium avium subsp. paratuberculosis
gcauuugcccuccu

SEQ ID NO: 3032120 - RNA, 15 nt, Mycobacterium avium subsp. paratuberculosis
gcauuugccgacaug

SEQ ID NO: 3032121 - RNA, 15 nt, Mycobacterium avium subsp. paratuberculosis
gccaaacagguuggc

SEQ ID NO: 3032122 - RNA, 15 nt, Mycobacterium avium subsp. paratuberculosis
gccaaagagcuuggc

SEQ ID NO: 3032123 - RNA, 21 nt, Mycobacterium avium subsp. paratuberculosis
gccaaagagcuuggcauuucc

SEQ ID NO: 3032124 - RNA, 20 nt, Mycobacterium avium subsp. paratuberculosis
gccaaagccuacggcgccgg

SEQ ID NO: 3032125 - RNA, 19 nt, Mycobacterium avium subsp. paratuberculosis
gccaaaguuggcaucccgc

SEQ ID NO: 3032126 - RNA, 21 nt, Mycobacterium avium subsp. paratuberculosis
gccaaaguuggcaucccgcgc

SEQ ID NO: 3032127 - RNA, 14 nt, Mycobacterium avium subsp. paratuberculosis
gccaaaucgaucac

SEQ ID NO: 3032128 - RNA, 17 nt, Mycobacterium avium subsp. paratuberculosis
gccaaaucgcuugcgcc

SEQ ID NO: 3032129 - RNA, 20 nt, Mycobacterium avium subsp. paratuberculosis
gccaacaacucagaacaggu

SEQ ID NO: 3032130 - RNA, 15 nt, Mycobacterium avium subsp. paratuberculosis
gccaacaacucgacg

SEQ ID NO: 3032131 - RNA, 22 nt, Mycobacterium avium subsp. paratuberculosis
gccaacaccagggugucgauga

SEQ ID NO: 3032132 - RNA, 16 nt, Mycobacterium avium subsp. paratuberculosis
gccaacacggcggcgc

SEQ ID NO: 3032133 - RNA, 13 nt, Mycobacterium avium subsp. paratuberculosis
gccaacagcagca

SEQ ID NO: 3032134 - RNA, 14 nt, Mycobacterium avium subsp. paratuberculosis
gccaacagcagcag

SEQ ID NO: 3032135 - RNA, 16 nt, Mycobacterium avium subsp. paratuberculosis
gccaacagcagcgccg

SEQ ID NO: 3032136 - RNA, 18 nt, Mycobacterium avium subsp. paratuberculosis
gccaacagcagcgccgcg

SEQ ID NO: 3032137 - RNA, 20 nt, Mycobacterium avium subsp. paratuberculosis
gccaacagcagcgccgcggc

SEQ ID NO: 3032138 - RNA, 24 nt, Mycobacterium avium subsp. paratuberculosis
gccaacagcagcgccgcggccggu

SEQ ID NO: 3032139 - RNA, 14 nt, Mycobacterium avium subsp. paratuberculosis
gccaaccacuugaa

SEQ ID NO: 3032140 - RNA, 17 nt, Mycobacterium avium subsp. paratuberculosis
gccaaccaggucgcggc

SEQ ID NO: 3032141 - RNA, 19 nt, Mycobacterium avium subsp. paratuberculosis
gccaaccaggucgcggcgc

SEQ ID NO: 3032142 - RNA, 12 nt, Mycobacterium avium subsp. paratuberculosis
gccaacccgggc

SEQ ID NO: 3032143 - RNA, 13 nt, Mycobacterium avium subsp. paratuberculosis
gccaacccgggcg

SEQ ID NO: 3032144 - RNA, 14 nt, Mycobacterium avium subsp. paratuberculosis
gccaacccgggcgc

SEQ ID NO: 3032145 - RNA, 15 nt, Mycobacterium avium subsp. paratuberculosis
gccaacccgggcgcc

SEQ ID NO: 3032146 - RNA, 16 nt, Mycobacterium avium subsp. paratuberculosis
gccaacccgggcgcca

SEQ ID NO: 3032147 - RNA, 21 nt, Mycobacterium avium subsp. paratuberculosis
gccaacccgggcgccauccgc

SEQ ID NO: 3032148 - RNA, 15 nt, Mycobacterium avium subsp. paratuberculosis
gccaaccgcccggcg

SEQ ID NO: 3032149 - RNA, 16 nt, Mycobacterium avium subsp. paratuberculosis
gccaaccgcccggcgc

SEQ ID NO: 3032150 - RNA, 20 nt, Mycobacterium avium subsp. paratuberculosis
gccaaccgcccggcgccgau

SEQ ID NO: 3032151 - RNA, 16 nt, Mycobacterium avium subsp. paratuberculosis
gccaaccgggcaggca

SEQ ID NO: 3032152 - RNA, 18 nt, Mycobacterium avium subsp. paratuberculosis
gccaacgaggcacggccc

SEQ ID NO: 3032153 - RNA, 20 nt, Mycobacterium avium subsp. paratuberculosis
gccaacgccucgucgaccgc

SEQ ID NO: 3032154 - RNA, 23 nt, Mycobacterium avium subsp. paratuberculosis
gccaacgccucgucgaccgcggc

SEQ ID NO: 3032155 - RNA, 12 nt, Mycobacterium avium subsp. paratuberculosis
gccaacgcgacg

SEQ ID NO: 3032156 - RNA, 21 nt, Mycobacterium avium subsp. paratuberculosis
gccaacgcgauucucgcugcg

SEQ ID NO: 3032157 - RNA, 21 nt, Mycobacterium avium subsp. paratuberculosis
gccaacggauagcguccgccc

SEQ ID NO: 3032158 - RNA, 22 nt, Mycobacterium avium subsp. paratuberculosis
gccaacggauucagcgucgcca

SEQ ID NO: 3032159 - RNA, 18 nt, Mycobacterium avium subsp. paratuberculosis
gccaacgguucggccgcu

SEQ ID NO: 3032160 - RNA, 19 nt, Mycobacterium avium subsp. paratuberculosis
gccaacgguucggccgcuc

SEQ ID NO: 3032161 - RNA, 20 nt, Mycobacterium avium subsp. paratuberculosis
gccaacgguuuccaccacca

SEQ ID NO: 3032162 - RNA, 22 nt, Mycobacterium avium subsp. paratuberculosis
gccaacuccggcggcagccagg

SEQ ID NO: 3032163 - RNA, 22 nt, Mycobacterium avium subsp. paratuberculosis
gccaacucgaccugcccgggcc

SEQ ID NO: 3032164 - RNA, 18 nt, Mycobacterium avium subsp. paratuberculosis
gccaacugguccugcggc

SEQ ID NO: 3032165 - RNA, 19 nt, Mycobacterium avium subsp. paratuberculosis
gccaacugguccugcggcu

SEQ ID NO: 3032166 - RNA, 13 nt, Mycobacterium avium subsp. paratuberculosis
gccaagacacgcu

SEQ ID NO: 3032167 - RNA, 16 nt, Mycobacterium avium subsp. paratuberculosis
gccaagacguccgcgu

SEQ ID NO: 3032168 - RNA, 18 nt, Mycobacterium avium subsp. paratuberculosis
gccaagacguccgcgucg

SEQ ID NO: 3032169 - RNA, 19 nt, Mycobacterium avium subsp. paratuberculosis
gccaagacguccgcgucgg

SEQ ID NO: 3032170 - RNA, 20 nt, Mycobacterium avium subsp. paratuberculosis
gccaagacguccgcgucggc

SEQ ID NO: 3032171 - RNA, 22 nt, Mycobacterium avium subsp. paratuberculosis
gccaagacguccgcgucggcgc

SEQ ID NO: 3032172 - RNA, 13 nt, Mycobacterium avium subsp. paratuberculosis
gccaagcaccggg

SEQ ID NO: 3032173 - RNA, 19 nt, Mycobacterium avium subsp. paratuberculosis
gccaagccauuucagcagc

SEQ ID NO: 3032174 - RNA, 22 nt, Mycobacterium avium subsp. paratuberculosis
gccaagccauuucagcagcgcg

SEQ ID NO: 3032175 - RNA, 19 nt, Mycobacterium avium subsp. paratuberculosis
gccaagcgguuccagaccg

SEQ ID NO: 3032176 - RNA, 21 nt, Mycobacterium avium subsp. paratuberculosis
gccaagcgguuccagaccggc

SEQ ID NO: 3032177 - RNA, 21 nt, Mycobacterium avium subsp. paratuberculosis
gccaagcguauccggccagcc

SEQ ID NO: 3032178 - RNA, 22 nt, Mycobacterium avium subsp. paratuberculosis
gccaagcguauccggccagccg

SEQ ID NO: 3032179 - RNA, 18 nt, Mycobacterium avium subsp. paratuberculosis
gccaaggcaagucgucgg

SEQ ID NO: 3032180 - RNA, 13 nt, Mycobacterium avium subsp. paratuberculosis
gccaaggccagca

SEQ ID NO: 3032181 - RNA, 15 nt, Mycobacterium avium subsp. paratuberculosis
gccaaggccagcaac

SEQ ID NO: 3032182 - RNA, 18 nt, Mycobacterium avium subsp. paratuberculosis
gccaaggccagcaaccgc

SEQ ID NO: 3032183 - RNA, 22 nt, Mycobacterium avium subsp. paratuberculosis
gccaaggccagcaaccgccgug

SEQ ID NO: 3032184 - RNA, 19 nt, Mycobacterium avium subsp. paratuberculosis
gccaaggggaacaacgcgc

SEQ ID NO: 3032185 - RNA, 14 nt, Mycobacterium avium subsp. paratuberculosis
gccaaggucgccgg

SEQ ID NO: 3032186 - RNA, 16 nt, Mycobacterium avium subsp. paratuberculosis
gccaaggucgccggug

SEQ ID NO: 3032187 - RNA, 21 nt, Mycobacterium avium subsp. paratuberculosis
gccaaguagacucagcgucga

SEQ ID NO: 3032188 - RNA, 23 nt, Mycobacterium avium subsp. paratuberculosis
gccaaguagacucagcgucgaug

SEQ ID NO: 3032189 - RNA, 16 nt, Mycobacterium avium subsp. paratuberculosis
gccaagugcggucggu

SEQ ID NO: 3032190 - RNA, 13 nt, Mycobacterium avium subsp. paratuberculosis
gccaauaaagcgg

SEQ ID NO: 3032191 - RNA, 14 nt, Mycobacterium avium subsp. paratuberculosis
gccaauacacuucg

SEQ ID NO: 3032192 - RNA, 14 nt, Mycobacterium avium subsp. paratuberculosis
gccaaucaccgcgg

SEQ ID NO: 3032193 - RNA, 13 nt, Mycobacterium avium subsp. paratuberculosis
gccaaucgccgau

SEQ ID NO: 3032194 - RNA, 17 nt, Mycobacterium avium subsp. paratuberculosis
gccaaucgccgaugacc

SEQ ID NO: 3032195 - RNA, 20 nt, Mycobacterium avium subsp. paratuberculosis
gccaaucgcugugcgaacuc

SEQ ID NO: 3032196 - RNA, 17 nt, Mycobacterium avium subsp. paratuberculosis
gccaaugaaauucaggc

SEQ ID NO: 3032197 - RNA, 19 nt, Mycobacterium avium subsp. paratuberculosis
gccaaugaaauucaggcca

SEQ ID NO: 3032198 - RNA, 23 nt, Mycobacterium avium subsp. paratuberculosis
gccaaugaaauucaggccacgca

SEQ ID NO: 3032199 - RNA, 18 nt, Mycobacterium avium subsp. paratuberculosis
gccaaugguuuucgucga

SEQ ID NO: 3032200 - RNA, 16 nt, Mycobacterium avium subsp. paratuberculosis
gccaauuacgcugcgg

SEQ ID NO: 3032201 - RNA, 15 nt, Mycobacterium avium subsp. paratuberculosis
gccacaaacagcgcg

SEQ ID NO: 3032202 - RNA, 17 nt, Mycobacterium avium subsp. paratuberculosis
gccacaaacagcgcggc

SEQ ID NO: 3032203 - RNA, 21 nt, Mycobacterium avium subsp. paratuberculosis
gccacaaacagcgcggccgga

SEQ ID NO: 3032204 - RNA, 22 nt, Mycobacterium avium subsp. paratuberculosis
gccacaacaugucccgggcacg

SEQ ID NO: 3032205 - RNA, 22 nt, Mycobacterium avium subsp. paratuberculosis
gccacaacgucucugucgucga

SEQ ID NO: 3032206 - RNA, 15 nt, Mycobacterium avium subsp. paratuberculosis
gccacaacuggucgu

SEQ ID NO: 3032207 - RNA, 21 nt, Mycobacterium avium subsp. paratuberculosis
gccacaacuggucgugcucgu

SEQ ID NO: 3032208 - RNA, 20 nt, Mycobacterium avium subsp. paratuberculosis
gccacaauggauccgaucag

SEQ ID NO: 3032209 - RNA, 18 nt, Mycobacterium avium subsp. paratuberculosis
gccacacacugcugcgca

SEQ ID NO: 3032210 - RNA, 22 nt, Mycobacterium avium subsp. paratuberculosis
gccacacacugcugcgcagacc

SEQ ID NO: 3032211 - RNA, 16 nt, Mycobacterium avium subsp. paratuberculosis
gccacacccgucgacu

SEQ ID NO: 3032212 - RNA, 20 nt, Mycobacterium avium subsp. paratuberculosis
gccacacccgucgacucggc

SEQ ID NO: 3032213 - RNA, 13 nt, Mycobacterium avium subsp. paratuberculosis
gccacaccgccgc

SEQ ID NO: 3032214 - RNA, 14 nt, Mycobacterium avium subsp. paratuberculosis
gccacaccgccgcg

SEQ ID NO: 3032215 - RNA, 15 nt, Mycobacterium avium subsp. paratuberculosis
gccacaccgccgcgg

SEQ ID NO: 3032216 - RNA, 19 nt, Mycobacterium avium subsp. paratuberculosis
gccacaccgccgcggcggu

SEQ ID NO: 3032217 - RNA, 14 nt, Mycobacterium avium subsp. paratuberculosis
gccacaccgccggc

SEQ ID NO: 3032218 - RNA, 15 nt, Mycobacterium avium subsp. paratuberculosis
gccacaccgccggcg

SEQ ID NO: 3032219 - RNA, 14 nt, Mycobacterium avium subsp. paratuberculosis
gccacaccucggcg

SEQ ID NO: 3032220 - RNA, 14 nt, Mycobacterium avium subsp. paratuberculosis
gccacacuggccau

SEQ ID NO: 3032221 - RNA, 17 nt, Mycobacterium avium subsp. paratuberculosis
gccacacuggccaugcu

SEQ ID NO: 3032222 - RNA, 15 nt, Mycobacterium avium subsp. paratuberculosis
gccacacuggcguga

SEQ ID NO: 3032223 - RNA, 17 nt, Mycobacterium avium subsp. paratuberculosis
gccacacuggcgugacg

SEQ ID NO: 3032224 - RNA, 22 nt, Mycobacterium avium subsp. paratuberculosis
gccacacuggcgugacgcucgg

SEQ ID NO: 3032225 - RNA, 17 nt, Mycobacterium avium subsp. paratuberculosis
gccacagcagcaccagc

SEQ ID NO: 3032226 - RNA, 12 nt, Mycobacterium avium subsp. paratuberculosis
gccacagccgca

SEQ ID NO: 3032227 - RNA, 20 nt, Mycobacterium avium subsp. paratuberculosis
gccacagcgacagggugccg

SEQ ID NO: 3032228 - RNA, 21 nt, Mycobacterium avium subsp. paratuberculosis
gccacagcgacagggugccga

SEQ ID NO: 3032229 - RNA, 22 nt, Mycobacterium avium subsp. paratuberculosis
gccacagcgacagggugccgaa

SEQ ID NO: 3032230 - RNA, 17 nt, Mycobacterium avium subsp. paratuberculosis
gccacagcgccucgcgg

SEQ ID NO: 3032231 - RNA, 13 nt, Mycobacterium avium subsp. paratuberculosis
gccacagcggcga

SEQ ID NO: 3032232 - RNA, 16 nt, Mycobacterium avium subsp. paratuberculosis
gccacagcggcgacag

SEQ ID NO: 3032233 - RNA, 21 nt, Mycobacterium avium subsp. paratuberculosis
gccacagcgucucgaccgcgg

SEQ ID NO: 3032234 - RNA, 22 nt, Mycobacterium avium subsp. paratuberculosis
gccacagcgucucgaccgcggu

SEQ ID NO: 3032235 - RNA, 23 nt, Mycobacterium avium subsp. paratuberculosis
gccacagcgucucgaccgcggug

SEQ ID NO: 3032236 - RNA, 17 nt, Mycobacterium avium subsp. paratuberculosis
gccacagcucgggcagc

SEQ ID NO: 3032237 - RNA, 15 nt, Mycobacterium avium subsp. paratuberculosis
gccacaggccgaaca

SEQ ID NO: 3032238 - RNA, 21 nt, Mycobacterium avium subsp. paratuberculosis
gccacaggccgaacagcagcg

SEQ ID NO: 3032239 - RNA, 20 nt, Mycobacterium avium subsp. paratuberculosis
gccacaucagcucggcggcc

SEQ ID NO: 3032240 - RNA, 21 nt, Mycobacterium avium subsp. paratuberculosis
gccacaucagcucggcggccu

SEQ ID NO: 3032241 - RNA, 16 nt, Mycobacterium avium subsp. paratuberculosis
gccacaugggccacgg

SEQ ID NO: 3032242 - RNA, 24 nt, Mycobacterium avium subsp. paratuberculosis
gccaccaacaggucggcgugcagc

SEQ ID NO: 3032243 - RNA, 17 nt, Mycobacterium avium subsp. paratuberculosis
gccaccaacaucgacgu

SEQ ID NO: 3032244 - RNA, 18 nt, Mycobacterium avium subsp. paratuberculosis
gccaccaacaucgacgug

SEQ ID NO: 3032245 - RNA, 14 nt, Mycobacterium avium subsp. paratuberculosis
gccaccaccacgga

SEQ ID NO: 3032246 - RNA, 20 nt, Mycobacterium avium subsp. paratuberculosis
gccaccaccacggagcgccc

SEQ ID NO: 3032247 - RNA, 24 nt, Mycobacterium avium subsp. paratuberculosis
gccaccaccacggagcgcccggcc

SEQ ID NO: 3032248 - RNA, 20 nt, Mycobacterium avium subsp. paratuberculosis
gccaccaccacggccgccga

SEQ ID NO: 3032249 - RNA, 23 nt, Mycobacterium avium subsp. paratuberculosis
gccaccaccacggccgccgaggc

SEQ ID NO: 3032250 - RNA, 15 nt, Mycobacterium avium subsp. paratuberculosis
gccaccaccacgggg

SEQ ID NO: 3032251 - RNA, 14 nt, Mycobacterium avium subsp. paratuberculosis
gccaccaccagcgg

SEQ ID NO: 3032252 - RNA, 23 nt, Mycobacterium avium subsp. paratuberculosis
gccaccaccagcgggcugugccg

SEQ ID NO: 3032253 - RNA, 15 nt, Mycobacterium avium subsp. paratuberculosis
gccaccacccggcga

SEQ ID NO: 3032254 - RNA, 13 nt, Mycobacterium avium subsp. paratuberculosis
gccaccaccgagg

SEQ ID NO: 3032255 - RNA, 23 nt, Mycobacterium avium subsp. paratuberculosis
gccaccaccgagguggcccagcc

SEQ ID NO: 3032256 - RNA, 13 nt, Mycobacterium avium subsp. paratuberculosis
gccaccaccgcca

SEQ ID NO: 3032257 - RNA, 14 nt, Mycobacterium avium subsp. paratuberculosis
gccaccaccgccac

SEQ ID NO: 3032258 - RNA, 17 nt, Mycobacterium avium subsp. paratuberculosis
gccaccaccgcgccguc

SEQ ID NO: 3032259 - RNA, 20 nt, Mycobacterium avium subsp. paratuberculosis
gccaccaccgcgccgucguc

SEQ ID NO: 3032260 - RNA, 22 nt, Mycobacterium avium subsp. paratuberculosis
gccaccaccgcgccgucgucgu

SEQ ID NO: 3032261 - RNA, 14 nt, Mycobacterium avium subsp. paratuberculosis
gccaccaccuccuc

SEQ ID NO: 3032262 - RNA, 18 nt, Mycobacterium avium subsp. paratuberculosis
gccaccaccucgcgggcg

SEQ ID NO: 3032263 - RNA, 19 nt, Mycobacterium avium subsp. paratuberculosis
gccaccaccucgcgggcga

SEQ ID NO: 3032264 - RNA, 15 nt, Mycobacterium avium subsp. paratuberculosis
gccaccaccuucauc

SEQ ID NO: 3032265 - RNA, 21 nt, Mycobacterium avium subsp. paratuberculosis
gccaccaccuucaucgccguc

SEQ ID NO: 3032266 - RNA, 22 nt, Mycobacterium avium subsp. paratuberculosis
gccaccaccuucaucgccgucg

SEQ ID NO: 3032267 - RNA, 23 nt, Mycobacterium avium subsp. paratuberculosis
gccaccaccuucaucgccgucgc

SEQ ID NO: 3032268 - RNA, 16 nt, Mycobacterium avium subsp. paratuberculosis
gccaccacgacgccgg

SEQ ID NO: 3032269 - RNA, 18 nt, Mycobacterium avium subsp. paratuberculosis
gccaccacgacgccgggc

SEQ ID NO: 3032270 - RNA, 21 nt, Mycobacterium avium subsp. paratuberculosis
gccaccacgacgccgggcgcc

SEQ ID NO: 3032271 - RNA, 22 nt, Mycobacterium avium subsp. paratuberculosis
gccaccacgacgccgggcgccc

SEQ ID NO: 3032272 - RNA, 16 nt, Mycobacterium avium subsp. paratuberculosis
gccaccacgacgggga

SEQ ID NO: 3032273 - RNA, 14 nt, Mycobacterium avium subsp. paratuberculosis
gccaccacgccagc

SEQ ID NO: 3032274 - RNA, 16 nt, Mycobacterium avium subsp. paratuberculosis
gccaccacgccagccu

SEQ ID NO: 3032275 - RNA, 17 nt, Mycobacterium avium subsp. paratuberculosis
gccaccacggcaccgcc

SEQ ID NO: 3032276 - RNA, 18 nt, Mycobacterium avium subsp. paratuberculosis
gccaccacggcaccgccg

SEQ ID NO: 3032277 - RNA, 20 nt, Mycobacterium avium subsp. paratuberculosis
gccaccacggcaccgccgcg

SEQ ID NO: 3032278 - RNA, 17 nt, Mycobacterium avium subsp. paratuberculosis
gccaccacggcgucgcu

SEQ ID NO: 3032279 - RNA, 14 nt, Mycobacterium avium subsp. paratuberculosis
gccaccacgggucg

SEQ ID NO: 3032280 - RNA, 20 nt, Mycobacterium avium subsp. paratuberculosis
gccaccacgggucggucggc

SEQ ID NO: 3032281 - RNA, 20 nt, Mycobacterium avium subsp. paratuberculosis
gccaccacgguggugucguc

SEQ ID NO: 3032282 - RNA, 22 nt, Mycobacterium avium subsp. paratuberculosis
gccaccacgguggugucgucgg

SEQ ID NO: 3032283 - RNA, 18 nt, Mycobacterium avium subsp. paratuberculosis
gccaccacguacuccugc

SEQ ID NO: 3032284 - RNA, 19 nt, Mycobacterium avium subsp. paratuberculosis
gccaccacguacuccugcg

SEQ ID NO: 3032285 - RNA, 22 nt, Mycobacterium avium subsp. paratuberculosis
gccaccacgugcgcguugguca

SEQ ID NO: 3032286 - RNA, 13 nt, Mycobacterium avium subsp. paratuberculosis
gccaccacugcgc

SEQ ID NO: 3032287 - RNA, 16 nt, Mycobacterium avium subsp. paratuberculosis
gccaccacugcgccgu

SEQ ID NO: 3032288 - RNA, 18 nt, Mycobacterium avium subsp. paratuberculosis
gccaccacugcgccguca

SEQ ID NO: 3032289 - RNA, 22 nt, Mycobacterium avium subsp. paratuberculosis
gccaccacugcgccgucaucga

SEQ ID NO: 3032290 - RNA, 16 nt, Mycobacterium avium subsp. paratuberculosis
gccaccagaaccauuu

SEQ ID NO: 3032291 - RNA, 15 nt, Mycobacterium avium subsp. paratuberculosis
gccaccagaccggcg

SEQ ID NO: 3032292 - RNA, 14 nt, Mycobacterium avium subsp. paratuberculosis
gccaccagaucgug

SEQ ID NO: 3032293 - RNA, 23 nt, Mycobacterium avium subsp. paratuberculosis
gccaccagaucguguccgcgccg

SEQ ID NO: 3032294 - RNA, 17 nt, Mycobacterium avium subsp. paratuberculosis
gccaccagaugccgggc

SEQ ID NO: 3032295 - RNA, 18 nt, Mycobacterium avium subsp. paratuberculosis
gccaccagaugccgggcu

SEQ ID NO: 3032296 - RNA, 15 nt, Mycobacterium avium subsp. paratuberculosis
gccaccagcaccggg

SEQ ID NO: 3032297 - RNA, 16 nt, Mycobacterium avium subsp. paratuberculosis
gccaccagcaccggga

SEQ ID NO: 3032298 - RNA, 13 nt, Mycobacterium avium subsp. paratuberculosis
gccaccagcagca

SEQ ID NO: 3032299 - RNA, 14 nt, Mycobacterium avium subsp. paratuberculosis
gccaccagcagcag

SEQ ID NO: 3032300 - RNA, 14 nt, Mycobacterium avium subsp. paratuberculosis
gccaccagcagcga

SEQ ID NO: 3032301 - RNA, 12 nt, Mycobacterium avium subsp. paratuberculosis
gccaccagcagg

SEQ ID NO: 3032302 - RNA, 14 nt, Mycobacterium avium subsp. paratuberculosis
gccaccagcaggcc

SEQ ID NO: 3032303 - RNA, 16 nt, Mycobacterium avium subsp. paratuberculosis
gccaccagccacaccg

SEQ ID NO: 3032304 - RNA, 17 nt, Mycobacterium avium subsp. paratuberculosis
gccaccagccacaccgc

SEQ ID NO: 3032305 - RNA, 20 nt, Mycobacterium avium subsp. paratuberculosis
gccaccagccacaccgccgc

SEQ ID NO: 3032306 - RNA, 21 nt, Mycobacterium avium subsp. paratuberculosis
gccaccagccacaccgccgcg

SEQ ID NO: 3032307 - RNA, 22 nt, Mycobacterium avium subsp. paratuberculosis
gccaccagccacaccgccgcgg

SEQ ID NO: 3032308 - RNA, 16 nt, Mycobacterium avium subsp. paratuberculosis
gccaccagccggccgg

SEQ ID NO: 3032309 - RNA, 10 nt, Mycobacterium avium subsp. paratuberculosis
gccaccagcg

SEQ ID NO: 3032310 - RNA, 11 nt, Mycobacterium avium subsp. paratuberculosis
gccaccagcgc

SEQ ID NO: 3032311 - RNA, 13 nt, Mycobacterium avium subsp. paratuberculosis
gccaccagcgcac

SEQ ID NO: 3032312 - RNA, 15 nt, Mycobacterium avium subsp. paratuberculosis
gccaccagcgcaggu

SEQ ID NO: 3032313 - RNA, 13 nt, Mycobacterium avium subsp. paratuberculosis
gccaccagcgccc

SEQ ID NO: 3032314 - RNA, 17 nt, Mycobacterium avium subsp. paratuberculosis
gccaccagcgcccgccc

SEQ ID NO: 3032315 - RNA, 15 nt, Mycobacterium avium subsp. paratuberculosis
gccaccagcgcggcc

SEQ ID NO: 3032316 - RNA, 16 nt, Mycobacterium avium subsp. paratuberculosis
gccaccaggccgaaga

SEQ ID NO: 3032317 - RNA, 18 nt, Mycobacterium avium subsp. paratuberculosis
gccaccaggccgaagacg

SEQ ID NO: 3032318 - RNA, 12 nt, Mycobacterium avium subsp. paratuberculosis
gccaccaggcgc

SEQ ID NO: 3032319 - RNA, 16 nt, Mycobacterium avium subsp. paratuberculosis
gccaccaggcgccguc

SEQ ID NO: 3032320 - RNA, 17 nt, Mycobacterium avium subsp. paratuberculosis
gccaccaggcgccgucg

SEQ ID NO: 3032321 - RNA, 19 nt, Mycobacterium avium subsp. paratuberculosis
gccaccaggcgguccgaca

SEQ ID NO: 3032322 - RNA, 23 nt, Mycobacterium avium subsp. paratuberculosis
gccaccaggcgguccgacaccgc

SEQ ID NO: 3032323 - RNA, 21 nt, Mycobacterium avium subsp. paratuberculosis
gccaccaggcugaacgucguc

SEQ ID NO: 3032324 - RNA, 19 nt, Mycobacterium avium subsp. paratuberculosis
gccaccagggacaugccga

SEQ ID NO: 3032325 - RNA, 12 nt, Mycobacterium avium subsp. paratuberculosis
gccaccagggcg

SEQ ID NO: 3032326 - RNA, 13 nt, Mycobacterium avium subsp. paratuberculosis
gccaccagggcga

SEQ ID NO: 3032327 - RNA, 22 nt, Mycobacterium avium subsp. paratuberculosis
gccaccagggucucgcgcagca

SEQ ID NO: 3032328 - RNA, 23 nt, Mycobacterium avium subsp. paratuberculosis
gccaccagggucucgcgcagcac

SEQ ID NO: 3032329 - RNA, 19 nt, Mycobacterium avium subsp. paratuberculosis
gccaccaggucgcacacca

SEQ ID NO: 3032330 - RNA, 21 nt, Mycobacterium avium subsp. paratuberculosis
gccaccaggucgcacaccagc

SEQ ID NO: 3032331 - RNA, 15 nt, Mycobacterium avium subsp. paratuberculosis
gccaccaucaggccg

SEQ ID NO: 3032332 - RNA, 21 nt, Mycobacterium avium subsp. paratuberculosis
gccaccaucaggccggccugc

SEQ ID NO: 3032333 - RNA, 21 nt, Mycobacterium avium subsp. paratuberculosis
gccaccaucgaguaggcccag

SEQ ID NO: 3032334 - RNA, 17 nt, Mycobacterium avium subsp. paratuberculosis
gccaccaucuccgcggc

SEQ ID NO: 3032335 - RNA, 21 nt, Mycobacterium avium subsp. paratuberculosis
gccaccaucuccgcggcgcgg

SEQ ID NO: 3032336 - RNA, 22 nt, Mycobacterium avium subsp. paratuberculosis
gccaccaucuccgcggcgcggu

SEQ ID NO: 3032337 - RNA, 14 nt, Mycobacterium avium subsp. paratuberculosis
gccaccaugccggc

SEQ ID NO: 3032338 - RNA, 18 nt, Mycobacterium avium subsp. paratuberculosis
gccaccaugucggcgucg

SEQ ID NO: 3032339 - RNA, 24 nt, Mycobacterium avium subsp. paratuberculosis
gccaccaugucggcgucgccgagc

SEQ ID NO: 3032340 - RNA, 15 nt, Mycobacterium avium subsp. paratuberculosis
gccaccccaggcgau

SEQ ID NO: 3032341 - RNA, 18 nt, Mycobacterium avium subsp. paratuberculosis
gccaccccaggcgaugcc

SEQ ID NO: 3032342 - RNA, 22 nt, Mycobacterium avium subsp. paratuberculosis
gccaccccccaguuucccgucg

SEQ ID NO: 3032343 - RNA, 18 nt, Mycobacterium avium subsp. paratuberculosis
gccaccccgaacccggcc

SEQ ID NO: 3032344 - RNA, 21 nt, Mycobacterium avium subsp. paratuberculosis
gccaccccgaacccggccagc

SEQ ID NO: 3032345 - RNA, 13 nt, Mycobacterium avium subsp. paratuberculosis
gccaccccgagcu

SEQ ID NO: 3032346 - RNA, 21 nt, Mycobacterium avium subsp. paratuberculosis
gccaccccgagcucgggcgcg

SEQ ID NO: 3032347 - RNA, 16 nt, Mycobacterium avium subsp. paratuberculosis
gccaccccgcagaaca

SEQ ID NO: 3032348 - RNA, 22 nt, Mycobacterium avium subsp. paratuberculosis
gccaccccgcagaacaccagcg

SEQ ID NO: 3032349 - RNA, 12 nt, Mycobacterium avium subsp. paratuberculosis
gccaccccggga

SEQ ID NO: 3032350 - RNA, 14 nt, Mycobacterium avium subsp. paratuberculosis
gccacccgaggccg

SEQ ID NO: 3032351 - RNA, 14 nt, Mycobacterium avium subsp. paratuberculosis
gccacccgcaccuc

SEQ ID NO: 3032352 - RNA, 16 nt, Mycobacterium avium subsp. paratuberculosis
gccacccgcaccucgc

SEQ ID NO: 3032353 - RNA, 20 nt, Mycobacterium avium subsp. paratuberculosis
gccacccgcgaucggauggu

SEQ ID NO: 3032354 - RNA, 12 nt, Mycobacterium avium subsp. paratuberculosis
gccacccgcgcc

SEQ ID NO: 3032355 - RNA, 14 nt, Mycobacterium avium subsp. paratuberculosis
gccacccgcgccuc

SEQ ID NO: 3032356 - RNA, 16 nt, Mycobacterium avium subsp. paratuberculosis
gccacccgcgccucca

SEQ ID NO: 3032357 - RNA, 13 nt, Mycobacterium avium subsp. paratuberculosis
gccacccgggcgc

SEQ ID NO: 3032358 - RNA, 14 nt, Mycobacterium avium subsp. paratuberculosis
gccacccgggcgcc

SEQ ID NO: 3032359 - RNA, 17 nt, Mycobacterium avium subsp. paratuberculosis
gccacccgggcgccggc

SEQ ID NO: 3032360 - RNA, 15 nt, Mycobacterium avium subsp. paratuberculosis
gccacccucgccgcc

SEQ ID NO: 3032361 - RNA, 16 nt, Mycobacterium avium subsp. paratuberculosis
gccacccugcgcaccg

SEQ ID NO: 3032362 - RNA, 17 nt, Mycobacterium avium subsp. paratuberculosis
gccacccugcgcaccgc

SEQ ID NO: 3032363 - RNA, 18 nt, Mycobacterium avium subsp. paratuberculosis
gccaccgaagccgacguc

SEQ ID NO: 3032364 - RNA, 19 nt, Mycobacterium avium subsp. paratuberculosis
gccaccgaagccgacgucg

SEQ ID NO: 3032365 - RNA, 20 nt, Mycobacterium avium subsp. paratuberculosis
gccaccgaagccgacgucga

SEQ ID NO: 3032366 - RNA, 13 nt, Mycobacterium avium subsp. paratuberculosis
gccaccgacacca

SEQ ID NO: 3032367 - RNA, 15 nt, Mycobacterium avium subsp. paratuberculosis
gccaccgacaccacc

SEQ ID NO: 3032368 - RNA, 18 nt, Mycobacterium avium subsp. paratuberculosis
gccaccgacaccaccggc

SEQ ID NO: 3032369 - RNA, 19 nt, Mycobacterium avium subsp. paratuberculosis
gccaccgacaccaccggcc

SEQ ID NO: 3032370 - RNA, 20 nt, Mycobacterium avium subsp. paratuberculosis
gccaccgacaccaccggccg

SEQ ID NO: 3032371 - RNA, 17 nt, Mycobacterium avium subsp. paratuberculosis
gccaccgagaucaugcc

SEQ ID NO: 3032372 - RNA, 20 nt, Mycobacterium avium subsp. paratuberculosis
gccaccgagaucaugccggc

SEQ ID NO: 3032373 - RNA, 21 nt, Mycobacterium avium subsp. paratuberculosis
gccaccgagaucaugccggcg

SEQ ID NO: 3032374 - RNA, 16 nt, Mycobacterium avium subsp. paratuberculosis
gccaccgaggccagca

SEQ ID NO: 3032375 - RNA, 18 nt, Mycobacterium avium subsp. paratuberculosis
gccaccgaggccagcaga

SEQ ID NO: 3032376 - RNA, 17 nt, Mycobacterium avium subsp. paratuberculosis
gccaccgaggugacguc

SEQ ID NO: 3032377 - RNA, 18 nt, Mycobacterium avium subsp. paratuberculosis
gccaccgaggugacgucg

SEQ ID NO: 3032378 - RNA, 21 nt, Mycobacterium avium subsp. paratuberculosis
gccaccgaggugacgucgcgc

SEQ ID NO: 3032379 - RNA, 22 nt, Mycobacterium avium subsp. paratuberculosis
gccaccgaugcccgacaccgcc

SEQ ID NO: 3032380 - RNA, 16 nt, Mycobacterium avium subsp. paratuberculosis
gccaccgaugcgggcc

SEQ ID NO: 3032381 - RNA, 16 nt, Mycobacterium avium subsp. paratuberculosis
gccaccgcaucgccga

SEQ ID NO: 3032382 - RNA, 20 nt, Mycobacterium avium subsp. paratuberculosis
gccaccgcaucgccgagggc

SEQ ID NO: 3032383 - RNA, 17 nt, Mycobacterium avium subsp. paratuberculosis
gccaccgccaucucggg

SEQ ID NO: 3032384 - RNA, 14 nt, Mycobacterium avium subsp. paratuberculosis
gccaccgccccagc

SEQ ID NO: 3032385 - RNA, 16 nt, Mycobacterium avium subsp. paratuberculosis
gccaccgcccgaaccg

SEQ ID NO: 3032386 - RNA, 12 nt, Mycobacterium avium subsp. paratuberculosis
gccaccgcccgc

SEQ ID NO: 3032387 - RNA, 13 nt, Mycobacterium avium subsp. paratuberculosis
gccaccgcccgcu

SEQ ID NO: 3032388 - RNA, 22 nt, Mycobacterium avium subsp. paratuberculosis
gccaccgcccgcugaccgccgc

SEQ ID NO: 3032389 - RNA, 21 nt, Mycobacterium avium subsp. paratuberculosis
gccaccgccgauggcgacggu

SEQ ID NO: 3032390 - RNA, 15 nt, Mycobacterium avium subsp. paratuberculosis
gccaccgccgccagc

SEQ ID NO: 3032391 - RNA, 24 nt, Mycobacterium avium subsp. paratuberculosis
gccaccgccgccagcagcagcgcc

SEQ ID NO: 3032392 - RNA, 14 nt, Mycobacterium avium subsp. paratuberculosis
gccaccgccugcgc

SEQ ID NO: 3032393 - RNA, 15 nt, Mycobacterium avium subsp. paratuberculosis
gccaccgccugcgcg

SEQ ID NO: 3032394 - RNA, 16 nt, Mycobacterium avium subsp. paratuberculosis
gccaccgccugcgcga

SEQ ID NO: 3032395 - RNA, 22 nt, Mycobacterium avium subsp. paratuberculosis
gccaccgccugcgcgaucgccg

SEQ ID NO: 3032396 - RNA, 23 nt, Mycobacterium avium subsp. paratuberculosis
gccaccgccugcgcgaucgccgg

SEQ ID NO: 3032397 - RNA, 22 nt, Mycobacterium avium subsp. paratuberculosis
gccaccgcgaacgucucgcggg

SEQ ID NO: 3032398 - RNA, 12 nt, Mycobacterium avium subsp. paratuberculosis
gccaccgcgacg

SEQ ID NO: 3032399 - RNA, 17 nt, Mycobacterium avium subsp. paratuberculosis
gccaccgcgacgcccag

SEQ ID NO: 3032400 - RNA, 15 nt, Mycobacterium avium subsp. paratuberculosis
gccaccgcgacgcug

SEQ ID NO: 3032401 - RNA, 19 nt, Mycobacterium avium subsp. paratuberculosis
gccaccgcgcaaccgggcc

SEQ ID NO: 3032402 - RNA, 23 nt, Mycobacterium avium subsp. paratuberculosis
gccaccgcgcaaccgggccgcac

SEQ ID NO: 3032403 - RNA, 17 nt, Mycobacterium avium subsp. paratuberculosis
gccaccgcgccccggcg

SEQ ID NO: 3032404 - RNA, 12 nt, Mycobacterium avium subsp. paratuberculosis
gccaccgcgccg

SEQ ID NO: 3032405 - RNA, 13 nt, Mycobacterium avium subsp. paratuberculosis
gccaccgcgccgu

SEQ ID NO: 3032406 - RNA, 15 nt, Mycobacterium avium subsp. paratuberculosis
gccaccgcgccgugg

SEQ ID NO: 3032407 - RNA, 14 nt, Mycobacterium avium subsp. paratuberculosis
gccaccgcgcgcug

SEQ ID NO: 3032408 - RNA, 17 nt, Mycobacterium avium subsp. paratuberculosis
gccaccgcgcgcugccg

SEQ ID NO: 3032409 - RNA, 18 nt, Mycobacterium avium subsp. paratuberculosis
gccaccgcgcgcugccgc

SEQ ID NO: 3032410 - RNA, 14 nt, Mycobacterium avium subsp. paratuberculosis
gccaccgcgcggcg

SEQ ID NO: 3032411 - RNA, 16 nt, Mycobacterium avium subsp. paratuberculosis
gccaccgcgcggcggu

SEQ ID NO: 3032412 - RNA, 23 nt, Mycobacterium avium subsp. paratuberculosis
gccaccgcgcggugcaccaggac

SEQ ID NO: 3032413 - RNA, 17 nt, Mycobacterium avium subsp. paratuberculosis
gccaccgcggccagcug

SEQ ID NO: 3032414 - RNA, 18 nt, Mycobacterium avium subsp. paratuberculosis
gccaccgcggccagcugc

SEQ ID NO: 3032415 - RNA, 15 nt, Mycobacterium avium subsp. paratuberculosis
gccaccgcggcguug

SEQ ID NO: 3032416 - RNA, 22 nt, Mycobacterium avium subsp. paratuberculosis
gccaccgcggcguugcccgggu

SEQ ID NO: 3032417 - RNA, 18 nt, Mycobacterium avium subsp. paratuberculosis
gccaccgcggggcugggc

SEQ ID NO: 3032418 - RNA, 18 nt, Mycobacterium avium subsp. paratuberculosis
gccaccgcggucgacggg

SEQ ID NO: 3032419 - RNA, 13 nt, Mycobacterium avium subsp. paratuberculosis
gccaccgcguccg

SEQ ID NO: 3032420 - RNA, 12 nt, Mycobacterium avium subsp. paratuberculosis
gccaccgcgucg

SEQ ID NO: 3032421 - RNA, 17 nt, Mycobacterium avium subsp. paratuberculosis
gccaccgcugggcggcg

SEQ ID NO: 3032422 - RNA, 18 nt, Mycobacterium avium subsp. paratuberculosis
gccaccgcugggcggcgc

SEQ ID NO: 3032423 - RNA, 19 nt, Mycobacterium avium subsp. paratuberculosis
gccaccgcugggcggcgcg

SEQ ID NO: 3032424 - RNA, 14 nt, Mycobacterium avium subsp. paratuberculosis
gccaccggcccggc

SEQ ID NO: 3032425 - RNA, 16 nt, Mycobacterium avium subsp. paratuberculosis
gccaccggcccggccg

SEQ ID NO: 3032426 - RNA, 19 nt, Mycobacterium avium subsp. paratuberculosis
gccaccggcccggccggcg

SEQ ID NO: 3032427 - RNA, 20 nt, Mycobacterium avium subsp. paratuberculosis
gccaccggcccggccggcgc

SEQ ID NO: 3032428 - RNA, 15 nt, Mycobacterium avium subsp. paratuberculosis
gccaccggccggucc

SEQ ID NO: 3032429 - RNA, 13 nt, Mycobacterium avium subsp. paratuberculosis
gccaccggcuccu

SEQ ID NO: 3032430 - RNA, 22 nt, Mycobacterium avium subsp. paratuberculosis
gccaccggcuccuugcgccgca

SEQ ID NO: 3032431 - RNA, 12 nt, Mycobacterium avium subsp. paratuberculosis
gccaccgggccg

SEQ ID NO: 3032432 - RNA, 16 nt, Mycobacterium avium subsp. paratuberculosis
gccaccgggccgagga

SEQ ID NO: 3032433 - RNA, 12 nt, Mycobacterium avium subsp. paratuberculosis
gccaccgggucg

SEQ ID NO: 3032434 - RNA, 24 nt, Mycobacterium avium subsp. paratuberculosis
gccaccgggucguccgcgacgcug

SEQ ID NO: 3032435 - RNA, 22 nt, Mycobacterium avium subsp. paratuberculosis
gccaccgucaggguggugcccc

SEQ ID NO: 3032436 - RNA, 17 nt, Mycobacterium avium subsp. paratuberculosis
gccaccgucccgguguc

SEQ ID NO: 3032437 - RNA, 18 nt, Mycobacterium avium subsp. paratuberculosis
gccaccgucccggugucg

SEQ ID NO: 3032438 - RNA, 22 nt, Mycobacterium avium subsp. paratuberculosis
gccaccgucccggugucgccgu

SEQ ID NO: 3032439 - RNA, 15 nt, Mycobacterium avium subsp. paratuberculosis
gccaccgucgccggc

SEQ ID NO: 3032440 - RNA, 16 nt, Mycobacterium avium subsp. paratuberculosis
gccaccgucgccggcu

SEQ ID NO: 3032441 - RNA, 14 nt, Mycobacterium avium subsp. paratuberculosis
gccaccgucgucga

SEQ ID NO: 3032442 - RNA, 16 nt, Mycobacterium avium subsp. paratuberculosis
gccaccgucgucgagc

SEQ ID NO: 3032443 - RNA, 18 nt, Mycobacterium avium subsp. paratuberculosis
gccaccgucuucggggcc

SEQ ID NO: 3032444 - RNA, 19 nt, Mycobacterium avium subsp. paratuberculosis
gccaccgucuucggggccg

SEQ ID NO: 3032445 - RNA, 20 nt, Mycobacterium avium subsp. paratuberculosis
gccaccgugccuuacgccgg

SEQ ID NO: 3032446 - RNA, 22 nt, Mycobacterium avium subsp. paratuberculosis
gccaccgugccuuacgccgggg

SEQ ID NO: 3032447 - RNA, 23 nt, Mycobacterium avium subsp. paratuberculosis
gccaccgugccuuacgccggggu

SEQ ID NO: 3032448 - RNA, 22 nt, Mycobacterium avium subsp. paratuberculosis
gccaccguggccccacgggcca

SEQ ID NO: 3032449 - RNA, 15 nt, Mycobacterium avium subsp. paratuberculosis
gccaccuccagcccg

SEQ ID NO: 3032450 - RNA, 19 nt, Mycobacterium avium subsp. paratuberculosis
gccaccuccuccgguccgg

SEQ ID NO: 3032451 - RNA, 15 nt, Mycobacterium avium subsp. paratuberculosis
gccaccucgacggcg

SEQ ID NO: 3032452 - RNA, 18 nt, Mycobacterium avium subsp. paratuberculosis
gccaccucgaucagcggc

SEQ ID NO: 3032453 - RNA, 19 nt, Mycobacterium avium subsp. paratuberculosis
gccaccucgaucagcggca

SEQ ID NO: 3032454 - RNA, 22 nt, Mycobacterium avium subsp. paratuberculosis
gccaccucgaucagcggcaucg

SEQ ID NO: 3032455 - RNA, 18 nt, Mycobacterium avium subsp. paratuberculosis
gccaccucgccgcaggcg

SEQ ID NO: 3032456 - RNA, 16 nt, Mycobacterium avium subsp. paratuberculosis
gccaccucgucggcgg

SEQ ID NO: 3032457 - RNA, 19 nt, Mycobacterium avium subsp. paratuberculosis
gccaccucgucggcgguca

SEQ ID NO: 3032458 - RNA, 23 nt, Mycobacterium avium subsp. paratuberculosis
gccaccuggaagcgcaucgccgg

SEQ ID NO: 3032459 - RNA, 16 nt, Mycobacterium avium subsp. paratuberculosis
gccaccugggcggggc

SEQ ID NO: 3032460 - RNA, 18 nt, Mycobacterium avium subsp. paratuberculosis
gccaccugggcggggcug

SEQ ID NO: 3032461 - RNA, 12 nt, Mycobacterium avium subsp. paratuberculosis
gccaccuucacc

SEQ ID NO: 3032462 - RNA, 13 nt, Mycobacterium avium subsp. paratuberculosis
gccaccuucaccg

SEQ ID NO: 3032463 - RNA, 15 nt, Mycobacterium avium subsp. paratuberculosis
gccaccuucaccgcg

SEQ ID NO: 3032464 - RNA, 16 nt, Mycobacterium avium subsp. paratuberculosis
gccaccuucaccgcgc

SEQ ID NO: 3032465 - RNA, 21 nt, Mycobacterium avium subsp. paratuberculosis
gccaccuucaccgcgccgguc

SEQ ID NO: 3032466 - RNA, 16 nt, Mycobacterium avium subsp. paratuberculosis
gccaccuugcgcgggu

SEQ ID NO: 3032467 - RNA, 17 nt, Mycobacterium avium subsp. paratuberculosis
gccaccuuggacaggcc

SEQ ID NO: 3032468 - RNA, 21 nt, Mycobacterium avium subsp. paratuberculosis
gccaccuuggacaggcccagc

SEQ ID NO: 3032469 - RNA, 23 nt, Mycobacterium avium subsp. paratuberculosis
gccaccuuggacaggcccagcgg

SEQ ID NO: 3032470 - RNA, 16 nt, Mycobacterium avium subsp. paratuberculosis
gccaccuugucggcgc

SEQ ID NO: 3032471 - RNA, 17 nt, Mycobacterium avium subsp. paratuberculosis
gccaccuugucggcgcc

SEQ ID NO: 3032472 - RNA, 19 nt, Mycobacterium avium subsp. paratuberculosis
gccaccuugucggcgccca

SEQ ID NO: 3032473 - RNA, 13 nt, Mycobacterium avium subsp. paratuberculosis
gccacgacaccag

SEQ ID NO: 3032474 - RNA, 17 nt, Mycobacterium avium subsp. paratuberculosis
gccacgacaccagcguc

SEQ ID NO: 3032475 - RNA, 18 nt, Mycobacterium avium subsp. paratuberculosis
gccacgacaccagcgucg

SEQ ID NO: 3032476 - RNA, 23 nt, Mycobacterium avium subsp. paratuberculosis
gccacgacauccccgcaaacacg

SEQ ID NO: 3032477 - RNA, 13 nt, Mycobacterium avium subsp. paratuberculosis
gccacgaccagcg

SEQ ID NO: 3032478 - RNA, 21 nt, Mycobacterium avium subsp. paratuberculosis
gccacgaccagcggcagcacg

SEQ ID NO: 3032479 - RNA, 14 nt, Mycobacterium avium subsp. paratuberculosis
gccacgacgcgcca

SEQ ID NO: 3032480 - RNA, 15 nt, Mycobacterium avium subsp. paratuberculosis
gccacgacgcgccac

SEQ ID NO: 3032481 - RNA, 12 nt, Mycobacterium avium subsp. paratuberculosis
gccacgacgcgg

SEQ ID NO: 3032482 - RNA, 15 nt, Mycobacterium avium subsp. paratuberculosis
gccacgacgcggcga

SEQ ID NO: 3032483 - RNA, 12 nt, Mycobacterium avium subsp. paratuberculosis
gccacgacggcg

SEQ ID NO: 3032484 - RNA, 18 nt, Mycobacterium avium subsp. paratuberculosis
gccacgacguacccccgc

SEQ ID NO: 3032485 - RNA, 21 nt, Mycobacterium avium subsp. paratuberculosis
gccacgacugcgcggccggcg

SEQ ID NO: 3032486 - RNA, 14 nt, Mycobacterium avium subsp. paratuberculosis
gccacgagcccagc

SEQ ID NO: 3032487 - RNA, 16 nt, Mycobacterium avium subsp. paratuberculosis
gccacgagcccagccg

SEQ ID NO: 3032488 - RNA, 18 nt, Mycobacterium avium subsp. paratuberculosis
gccacgagcccagccguc

SEQ ID NO: 3032489 - RNA, 20 nt, Mycobacterium avium subsp. paratuberculosis
gccacgagcccagccgucgc

SEQ ID NO: 3032490 - RNA, 21 nt, Mycobacterium avium subsp. paratuberculosis
gccacgaucaccaccaccgcc

SEQ ID NO: 3032491 - RNA, 19 nt, Mycobacterium avium subsp. paratuberculosis
gccacgauccgcgcggcca

SEQ ID NO: 3032492 - RNA, 18 nt, Mycobacterium avium subsp. paratuberculosis
gccacgauccggggcagc

SEQ ID NO: 3032493 - RNA, 14 nt, Mycobacterium avium subsp. paratuberculosis
gccacgaucgcgau

SEQ ID NO: 3032494 - RNA, 16 nt, Mycobacterium avium subsp. paratuberculosis
gccacgaucgcggcca

SEQ ID NO: 3032495 - RNA, 18 nt, Mycobacterium avium subsp. paratuberculosis
gccacgaucgcggccagc

SEQ ID NO: 3032496 - RNA, 20 nt, Mycobacterium avium subsp. paratuberculosis
gccacgaucgcggccagcgu

SEQ ID NO: 3032497 - RNA, 17 nt, Mycobacterium avium subsp. paratuberculosis
gccacgaugaucgucgg

SEQ ID NO: 3032498 - RNA, 18 nt, Mycobacterium avium subsp. paratuberculosis
gccacgaugaucgucggc

SEQ ID NO: 3032499 - RNA, 19 nt, Mycobacterium avium subsp. paratuberculosis
gccacgaugaugcccccga

SEQ ID NO: 3032500 - RNA, 22 nt, Mycobacterium avium subsp. paratuberculosis
gccacgaugcugauacccgcgc

SEQ ID NO: 3032501 - RNA, 23 nt, Mycobacterium avium subsp. paratuberculosis
gccacgaugcugauacccgcgcg

SEQ ID NO: 3032502 - RNA, 21 nt, Mycobacterium avium subsp. paratuberculosis
gccacgauggggacgucgacg

SEQ ID NO: 3032503 - RNA, 11 nt, Mycobacterium avium subsp. paratuberculosis
gccacgcacac

SEQ ID NO: 3032504 - RNA, 16 nt, Mycobacterium avium subsp. paratuberculosis
gccacgcacaccgcgc

SEQ ID NO: 3032505 - RNA, 20 nt, Mycobacterium avium subsp. paratuberculosis
gccacgcacaccgcgcgcag

SEQ ID NO: 3032506 - RNA, 22 nt, Mycobacterium avium subsp. paratuberculosis
gccacgcaggcguccagggcca

SEQ ID NO: 3032507 - RNA, 19 nt, Mycobacterium avium subsp. paratuberculosis
gccacgccaacugguccug

SEQ ID NO: 3032508 - RNA, 12 nt, Mycobacterium avium subsp. paratuberculosis
gccacgccagcc

SEQ ID NO: 3032509 - RNA, 13 nt, Mycobacterium avium subsp. paratuberculosis
gccacgccagcca

SEQ ID NO: 3032510 - RNA, 12 nt, Mycobacterium avium subsp. paratuberculosis
gccacgcccacc

SEQ ID NO: 3032511 - RNA, 17 nt, Mycobacterium avium subsp. paratuberculosis
gccacgcccacgccgag

SEQ ID NO: 3032512 - RNA, 12 nt, Mycobacterium avium subsp. paratuberculosis
gccacgcccagg

SEQ ID NO: 3032513 - RNA, 13 nt, Mycobacterium avium subsp. paratuberculosis
gccacgcccaggg

SEQ ID NO: 3032514 - RNA, 16 nt, Mycobacterium avium subsp. paratuberculosis
gccacgcccagggcgc

SEQ ID NO: 3032515 - RNA, 21 nt, Mycobacterium avium subsp. paratuberculosis
gccacgcccagggcgccagau

SEQ ID NO: 3032516 - RNA, 23 nt, Mycobacterium avium subsp. paratuberculosis
gccacgcccagggcgccagauuc

SEQ ID NO: 3032517 - RNA, 23 nt, Mycobacterium avium subsp. paratuberculosis
gccacgccccauugccgcgccgg

SEQ ID NO: 3032518 - RNA, 14 nt, Mycobacterium avium subsp. paratuberculosis
gccacgccccggcg

SEQ ID NO: 3032519 - RNA, 20 nt, Mycobacterium avium subsp. paratuberculosis
gccacgccccggcgccgucg

SEQ ID NO: 3032520 - RNA, 22 nt, Mycobacterium avium subsp. paratuberculosis
gccacgccccggcgccgucguu

SEQ ID NO: 3032521 - RNA, 14 nt, Mycobacterium avium subsp. paratuberculosis
gccacgcccgcagc

SEQ ID NO: 3032522 - RNA, 16 nt, Mycobacterium avium subsp. paratuberculosis
gccacgcccgcagcgc

SEQ ID NO: 3032523 - RNA, 21 nt, Mycobacterium avium subsp. paratuberculosis
gccacgcccuggccgccggcc

SEQ ID NO: 3032524 - RNA, 17 nt, Mycobacterium avium subsp. paratuberculosis
gccacgccgacaccguc

SEQ ID NO: 3032525 - RNA, 19 nt, Mycobacterium avium subsp. paratuberculosis
gccacgccgacaccgucgc

SEQ ID NO: 3032526 - RNA, 22 nt, Mycobacterium avium subsp. paratuberculosis
gccacgccgacaccgucgccgu

SEQ ID NO: 3032527 - RNA, 14 nt, Mycobacterium avium subsp. paratuberculosis
gccacgccgaccag

SEQ ID NO: 3032528 - RNA, 16 nt, Mycobacterium avium subsp. paratuberculosis
gccacgccgaccaggu

SEQ ID NO: 3032529 - RNA, 17 nt, Mycobacterium avium subsp. paratuberculosis
gccacgccgaccagguc

SEQ ID NO: 3032530 - RNA, 21 nt, Mycobacterium avium subsp. paratuberculosis
gccacgccgaccagguccggu

SEQ ID NO: 3032531 - RNA, 21 nt, Mycobacterium avium subsp. paratuberculosis
gccacgccgacuagcgcggcg

SEQ ID NO: 3032532 - RNA, 13 nt, Mycobacterium avium subsp. paratuberculosis
gccacgccgaugg

SEQ ID NO: 3032533 - RNA, 12 nt, Mycobacterium avium subsp. paratuberculosis
gccacgccgccc

SEQ ID NO: 3032534 - RNA, 19 nt, Mycobacterium avium subsp. paratuberculosis
gccacgccgcccccgccgc

SEQ ID NO: 3032535 - RNA, 20 nt, Mycobacterium avium subsp. paratuberculosis
gccacgccgcccccgccgcg

SEQ ID NO: 3032536 - RNA, 21 nt, Mycobacterium avium subsp. paratuberculosis
gccacgccgcccccgccgcga

SEQ ID NO: 3032537 - RNA, 22 nt, Mycobacterium avium subsp. paratuberculosis
gccacgccgcccccgccgcgag

SEQ ID NO: 3032538 - RNA, 13 nt, Mycobacterium avium subsp. paratuberculosis
gccacgccgcgau

SEQ ID NO: 3032539 - RNA, 12 nt, Mycobacterium avium subsp. paratuberculosis
gccacgccggca

SEQ ID NO: 3032540 - RNA, 13 nt, Mycobacterium avium subsp. paratuberculosis
gccacgccggguu

SEQ ID NO: 3032541 - RNA, 14 nt, Mycobacterium avium subsp. paratuberculosis
gccacgccguggcc

SEQ ID NO: 3032542 - RNA, 21 nt, Mycobacterium avium subsp. paratuberculosis
gccacgccguggcccgcccag

SEQ ID NO: 3032543 - RNA, 15 nt, Mycobacterium avium subsp. paratuberculosis
gccacgccguugggc

SEQ ID NO: 3032544 - RNA, 22 nt, Mycobacterium avium subsp. paratuberculosis
gccacgcgcagggcgaacggcg

SEQ ID NO: 3032545 - RNA, 22 nt, Mycobacterium avium subsp. paratuberculosis
gccacgcggcgcgcaucgucgc

SEQ ID NO: 3032546 - RNA, 22 nt, Mycobacterium avium subsp. paratuberculosis
gccacgcggcuucauaugacgc

SEQ ID NO: 3032547 - RNA, 19 nt, Mycobacterium avium subsp. paratuberculosis
gccacgcgucaggcgucgu

SEQ ID NO: 3032548 - RNA, 20 nt, Mycobacterium avium subsp. paratuberculosis
gccacgcgucaggcgucgua

SEQ ID NO: 3032549 - RNA, 15 nt, Mycobacterium avium subsp. paratuberculosis
gccacgcuagcguga

SEQ ID NO: 3032550 - RNA, 17 nt, Mycobacterium avium subsp. paratuberculosis
gccacgcuagcgugacg

SEQ ID NO: 3032551 - RNA, 10 nt, Mycobacterium avium subsp. paratuberculosis
gccacgcuca

SEQ ID NO: 3032552 - RNA, 14 nt, Mycobacterium avium subsp. paratuberculosis
gccacgcucaugcc

SEQ ID NO: 3032553 - RNA, 13 nt, Mycobacterium avium subsp. paratuberculosis
gccacgcucgcca

SEQ ID NO: 3032554 - RNA, 15 nt, Mycobacterium avium subsp. paratuberculosis
gccacgcucgccaga

SEQ ID NO: 3032555 - RNA, 17 nt, Mycobacterium avium subsp. paratuberculosis
gccacgcucgccagacc

SEQ ID NO: 3032556 - RNA, 17 nt, Mycobacterium avium subsp. paratuberculosis
gccacgcucggcggcgc

SEQ ID NO: 3032557 - RNA, 20 nt, Mycobacterium avium subsp. paratuberculosis
gccacgcucggcggcgcgca

SEQ ID NO: 3032558 - RNA, 14 nt, Mycobacterium avium subsp. paratuberculosis
gccacgcucgggcc

SEQ ID NO: 3032559 - RNA, 18 nt, Mycobacterium avium subsp. paratuberculosis
gccacgcucgggccggcg

SEQ ID NO: 3032560 - RNA, 19 nt, Mycobacterium avium subsp. paratuberculosis
gccacgcuggcguccaggu

SEQ ID NO: 3032561 - RNA, 17 nt, Mycobacterium avium subsp. paratuberculosis
gccacgcuggcgugacg

SEQ ID NO: 3032562 - RNA, 22 nt, Mycobacterium avium subsp. paratuberculosis
gccacgcuggcgugacgcucgg

SEQ ID NO: 3032563 - RNA, 23 nt, Mycobacterium avium subsp. paratuberculosis
gccacgcuggcgugacgcucggc

SEQ ID NO: 3032564 - RNA, 20 nt, Mycobacterium avium subsp. paratuberculosis
gccacgcuggugugacgcuc

SEQ ID NO: 3032565 - RNA, 13 nt, Mycobacterium avium subsp. paratuberculosis
gccacggagucgg

SEQ ID NO: 3032566 - RNA, 23 nt, Mycobacterium avium subsp. paratuberculosis
gccacggagucgguuucgaccug

SEQ ID NO: 3032567 - RNA, 15 nt, Mycobacterium avium subsp. paratuberculosis
gccacggcacgucga

SEQ ID NO: 3032568 - RNA, 12 nt, Mycobacterium avium subsp. paratuberculosis
gccacggcagcu

SEQ ID NO: 3032569 - RNA, 17 nt, Mycobacterium avium subsp. paratuberculosis
gccacggcagcugcagc

SEQ ID NO: 3032570 - RNA, 18 nt, Mycobacterium avium subsp. paratuberculosis
gccacggcagcugcagcg

SEQ ID NO: 3032571 - RNA, 16 nt, Mycobacterium avium subsp. paratuberculosis
gccacggccagcaccg

SEQ ID NO: 3032572 - RNA, 17 nt, Mycobacterium avium subsp. paratuberculosis
gccacggccagcaccgc

SEQ ID NO: 3032573 - RNA, 20 nt, Mycobacterium avium subsp. paratuberculosis
gccacggccagcaccgccag

SEQ ID NO: 3032574 - RNA, 14 nt, Mycobacterium avium subsp. paratuberculosis
gccacggccgcggc

SEQ ID NO: 3032575 - RNA, 16 nt, Mycobacterium avium subsp. paratuberculosis
gccacggccgcggccc

SEQ ID NO: 3032576 - RNA, 20 nt, Mycobacterium avium subsp. paratuberculosis
gccacggccgcggcccggcc

SEQ ID NO: 3032577 - RNA, 23 nt, Mycobacterium avium subsp. paratuberculosis
gccacggccgcggcccggccacc

SEQ ID NO: 3032578 - RNA, 14 nt, Mycobacterium avium subsp. paratuberculosis
gccacggccggcag

SEQ ID NO: 3032579 - RNA, 16 nt, Mycobacterium avium subsp. paratuberculosis
gccacggcgacgacca

SEQ ID NO: 3032580 - RNA, 18 nt, Mycobacterium avium subsp. paratuberculosis
gccacggcgacgaccacc

SEQ ID NO: 3032581 - RNA, 22 nt, Mycobacterium avium subsp. paratuberculosis
gccacggcgccaugcgccgcgc

SEQ ID NO: 3032582 - RNA, 21 nt, Mycobacterium avium subsp. paratuberculosis
gccacggcggccgaauccggc

SEQ ID NO: 3032583 - RNA, 23 nt, Mycobacterium avium subsp. paratuberculosis
gccacggcggggucaagcggcag

SEQ ID NO: 3032584 - RNA, 13 nt, Mycobacterium avium subsp. paratuberculosis
gccacggcggugu

SEQ ID NO: 3032585 - RNA, 14 nt, Mycobacterium avium subsp. paratuberculosis
gccacggcgguguc

SEQ ID NO: 3032586 - RNA, 18 nt, Mycobacterium avium subsp. paratuberculosis
gccacggcggugucggcg

SEQ ID NO: 3032587 - RNA, 19 nt, Mycobacterium avium subsp. paratuberculosis
gccacggcguugaccaacg

SEQ ID NO: 3032588 - RNA, 22 nt, Mycobacterium avium subsp. paratuberculosis
gccacggcguugaccaacgccg

SEQ ID NO: 3032589 - RNA, 22 nt, Mycobacterium avium subsp. paratuberculosis
gccacgggcggucggacgcggg

SEQ ID NO: 3032590 - RNA, 12 nt, Mycobacterium avium subsp. paratuberculosis
gccacggggcgc

SEQ ID NO: 3032591 - RNA, 15 nt, Mycobacterium avium subsp. paratuberculosis
gccacggggucgaga

SEQ ID NO: 3032592 - RNA, 16 nt, Mycobacterium avium subsp. paratuberculosis
gccacggggucgagaa

SEQ ID NO: 3032593 - RNA, 18 nt, Mycobacterium avium subsp. paratuberculosis
gccacggguugagccaga

SEQ ID NO: 3032594 - RNA, 19 nt, Mycobacterium avium subsp. paratuberculosis
gccacggucaggcgcagcc

SEQ ID NO: 3032595 - RNA, 18 nt, Mycobacterium avium subsp. paratuberculosis
gccacgguccuuggcgua

SEQ ID NO: 3032596 - RNA, 12 nt, Mycobacterium avium subsp. paratuberculosis
gccacgguggcg

SEQ ID NO: 3032597 - RNA, 15 nt, Mycobacterium avium subsp. paratuberculosis
gccacgguggcgguc

SEQ ID NO: 3032598 - RNA, 18 nt, Mycobacterium avium subsp. paratuberculosis
gccacgguggcggucagg

SEQ ID NO: 3032599 - RNA, 22 nt, Mycobacterium avium subsp. paratuberculosis
gccacguacaccgggaucgggg

SEQ ID NO: 3032600 - RNA, 14 nt, Mycobacterium avium subsp. paratuberculosis
gccacguagcagca

SEQ ID NO: 3032601 - RNA, 17 nt, Mycobacterium avium subsp. paratuberculosis
gccacguagcagcagac

SEQ ID NO: 3032602 - RNA, 15 nt, Mycobacterium avium subsp. paratuberculosis
gccacguccggaugc

SEQ ID NO: 3032603 - RNA, 20 nt, Mycobacterium avium subsp. paratuberculosis
gccacguccggaugcggcgc

SEQ ID NO: 3032604 - RNA, 22 nt, Mycobacterium avium subsp. paratuberculosis
gccacguccggaugcggcgccc

SEQ ID NO: 3032605 - RNA, 15 nt, Mycobacterium avium subsp. paratuberculosis
gccacgucgaugccg

SEQ ID NO: 3032606 - RNA, 23 nt, Mycobacterium avium subsp. paratuberculosis
gccacgucguucaugaucggcag

SEQ ID NO: 3032607 - RNA, 13 nt, Mycobacterium avium subsp. paratuberculosis
gccacgugcggcu

SEQ ID NO: 3032608 - RNA, 22 nt, Mycobacterium avium subsp. paratuberculosis
gccacgugcggcugcgcguucg

SEQ ID NO: 3032609 - RNA, 23 nt, Mycobacterium avium subsp. paratuberculosis
gccacgugcggcugcgcguucgg

SEQ ID NO: 3032610 - RNA, 23 nt, Mycobacterium avium subsp. paratuberculosis
gccacguugccggguaucgacag

SEQ ID NO: 3032611 - RNA, 16 nt, Mycobacterium avium subsp. paratuberculosis
gccacuccaccaccgg

SEQ ID NO: 3032612 - RNA, 18 nt, Mycobacterium avium subsp. paratuberculosis
gccacuccaccaccggcc

SEQ ID NO: 3032613 - RNA, 20 nt, Mycobacterium avium subsp. paratuberculosis
gccacuccaccaccggccgc

SEQ ID NO: 3032614 - RNA, 21 nt, Mycobacterium avium subsp. paratuberculosis
gccacuccaccaccggccgcg

SEQ ID NO: 3032615 - RNA, 17 nt, Mycobacterium avium subsp. paratuberculosis
gccacuccauccggaac

SEQ ID NO: 3032616 - RNA, 20 nt, Mycobacterium avium subsp. paratuberculosis
gccacuccauccggaacacg

SEQ ID NO: 3032617 - RNA, 13 nt, Mycobacterium avium subsp. paratuberculosis
gccacucgccgcg

SEQ ID NO: 3032618 - RNA, 17 nt, Mycobacterium avium subsp. paratuberculosis
gccacucgccgcgaacg

SEQ ID NO: 3032619 - RNA, 14 nt, Mycobacterium avium subsp. paratuberculosis
gccacucgcguccc

SEQ ID NO: 3032620 - RNA, 17 nt, Mycobacterium avium subsp. paratuberculosis
gccacucgggcggccgc

SEQ ID NO: 3032621 - RNA, 14 nt, Mycobacterium avium subsp. paratuberculosis
gccacucgucgacg

SEQ ID NO: 3032622 - RNA, 14 nt, Mycobacterium avium subsp. paratuberculosis
gccacucgucgaug

SEQ ID NO: 3032623 - RNA, 14 nt, Mycobacterium avium subsp. paratuberculosis
gccacugccgccgc

SEQ ID NO: 3032624 - RNA, 15 nt, Mycobacterium avium subsp. paratuberculosis
gccacugccgccgcc

SEQ ID NO: 3032625 - RNA, 16 nt, Mycobacterium avium subsp. paratuberculosis
gccacugccgccgccc

SEQ ID NO: 3032626 - RNA, 14 nt, Mycobacterium avium subsp. paratuberculosis
gccacuggcgccac

SEQ ID NO: 3032627 - RNA, 14 nt, Mycobacterium avium subsp. paratuberculosis
gccacugggcgucg

SEQ ID NO: 3032628 - RNA, 20 nt, Mycobacterium avium subsp. paratuberculosis
gccacugggcgucggcgccc

SEQ ID NO: 3032629 - RNA, 20 nt, Mycobacterium avium subsp. paratuberculosis
gccacuucgacggcagcggc

SEQ ID NO: 3032630 - RNA, 17 nt, Mycobacterium avium subsp. paratuberculosis
gccacuucuccacgccg

SEQ ID NO: 3032631 - RNA, 19 nt, Mycobacterium avium subsp. paratuberculosis
gccacuucuccacgccgac

SEQ ID NO: 3032632 - RNA, 15 nt, Mycobacterium avium subsp. paratuberculosis
gccacuugcgcacgu

SEQ ID NO: 3032633 - RNA, 19 nt, Mycobacterium avium subsp. paratuberculosis
gccacuugcgcacguaccg

SEQ ID NO: 3032634 - RNA, 14 nt, Mycobacterium avium subsp. paratuberculosis
gccacuuguccacc

SEQ ID NO: 3032635 - RNA, 17 nt, Mycobacterium avium subsp. paratuberculosis
gccagaaaucgccggga

SEQ ID NO: 3032636 - RNA, 16 nt, Mycobacterium avium subsp. paratuberculosis
gccagaacacgccccg

SEQ ID NO: 3032637 - RNA, 18 nt, Mycobacterium avium subsp. paratuberculosis
gccagaacacgccccggc

SEQ ID NO: 3032638 - RNA, 20 nt, Mycobacterium avium subsp. paratuberculosis
gccagaacacgccccggcgg

SEQ ID NO: 3032639 - RNA, 21 nt, Mycobacterium avium subsp. paratuberculosis
gccagaacacgccccggcggg

SEQ ID NO: 3032640 - RNA, 19 nt, Mycobacterium avium subsp. paratuberculosis
gccagaaccggcaacacag

SEQ ID NO: 3032641 - RNA, 21 nt, Mycobacterium avium subsp. paratuberculosis
gccagaacgaguuucccgucg

SEQ ID NO: 3032642 - RNA, 15 nt, Mycobacterium avium subsp. paratuberculosis
gccagaacggcggca

SEQ ID NO: 3032643 - RNA, 21 nt, Mycobacterium avium subsp. paratuberculosis
gccagaacggcggcagcgagg

SEQ ID NO: 3032644 - RNA, 21 nt, Mycobacterium avium subsp. paratuberculosis
gccagaccgguugcggcgaac

SEQ ID NO: 3032645 - RNA, 23 nt, Mycobacterium avium subsp. paratuberculosis
gccagaccguucuccgaggcguc

SEQ ID NO: 3032646 - RNA, 14 nt, Mycobacterium avium subsp. paratuberculosis
gccagaccucgccg

SEQ ID NO: 3032647 - RNA, 20 nt, Mycobacterium avium subsp. paratuberculosis
gccagaccucgccgacggug

SEQ ID NO: 3032648 - RNA, 24 nt, Mycobacterium avium subsp. paratuberculosis
gccagaccucgccgacgguguccg

SEQ ID NO: 3032649 - RNA, 17 nt, Mycobacterium avium subsp. paratuberculosis
gccagacgaacgcggcc

SEQ ID NO: 3032650 - RNA, 21 nt, Mycobacterium avium subsp. paratuberculosis
gccagacgaacgcggccgcca

SEQ ID NO: 3032651 - RNA, 14 nt, Mycobacterium avium subsp. paratuberculosis
gccagacgcgcacc

SEQ ID NO: 3032652 - RNA, 15 nt, Mycobacterium avium subsp. paratuberculosis
gccagacgcgcaccg

SEQ ID NO: 3032653 - RNA, 16 nt, Mycobacterium avium subsp. paratuberculosis
gccagacgcgcaccgc

SEQ ID NO: 3032654 - RNA, 19 nt, Mycobacterium avium subsp. paratuberculosis
gccagacgcgcaccgccac

SEQ ID NO: 3032655 - RNA, 20 nt, Mycobacterium avium subsp. paratuberculosis
gccagacgcgcaccgccacc

SEQ ID NO: 3032656 - RNA, 15 nt, Mycobacterium avium subsp. paratuberculosis
gccagacgguggggc

SEQ ID NO: 3032657 - RNA, 14 nt, Mycobacterium avium subsp. paratuberculosis
gccagacguccagc

SEQ ID NO: 3032658 - RNA, 15 nt, Mycobacterium avium subsp. paratuberculosis
gccagacguccagcg

SEQ ID NO: 3032659 - RNA, 17 nt, Mycobacterium avium subsp. paratuberculosis
gccagacguccagcgcc

SEQ ID NO: 3032660 - RNA, 21 nt, Mycobacterium avium subsp. paratuberculosis
gccagacguccagcgccgcca

SEQ ID NO: 3032661 - RNA, 23 nt, Mycobacterium avium subsp. paratuberculosis
gccagacucacggcggcagcgcg

SEQ ID NO: 3032662 - RNA, 21 nt, Mycobacterium avium subsp. paratuberculosis
gccagacugaugcccucgccg

SEQ ID NO: 3032663 - RNA, 22 nt, Mycobacterium avium subsp. paratuberculosis
gccagacugaugcccucgccgg

SEQ ID NO: 3032664 - RNA, 13 nt, Mycobacterium avium subsp. paratuberculosis
gccagacugcgca

SEQ ID NO: 3032665 - RNA, 15 nt, Mycobacterium avium subsp. paratuberculosis
gccagacugcgcacc

SEQ ID NO: 3032666 - RNA, 17 nt, Mycobacterium avium subsp. paratuberculosis
gccagacugcgcaccgc

SEQ ID NO: 3032667 - RNA, 19 nt, Mycobacterium avium subsp. paratuberculosis
gccagacugcgcaccgcca

SEQ ID NO: 3032668 - RNA, 17 nt, Mycobacterium avium subsp. paratuberculosis
gccagauacuccucggu

SEQ ID NO: 3032669 - RNA, 18 nt, Mycobacterium avium subsp. paratuberculosis
gccagauacuccucggug

SEQ ID NO: 3032670 - RNA, 22 nt, Mycobacterium avium subsp. paratuberculosis
gccagauagaugagccgcagcc

SEQ ID NO: 3032671 - RNA, 15 nt, Mycobacterium avium subsp. paratuberculosis
gccagauagggcagc

SEQ ID NO: 3032672 - RNA, 21 nt, Mycobacterium avium subsp. paratuberculosis
gccagaucgacccccaccgcg

SEQ ID NO: 3032673 - RNA, 14 nt, Mycobacterium avium subsp. paratuberculosis
gccagaucgcugau

SEQ ID NO: 3032674 - RNA, 18 nt, Mycobacterium avium subsp. paratuberculosis
gccagaucgcugaugcgc

SEQ ID NO: 3032675 - RNA, 22 nt, Mycobacterium avium subsp. paratuberculosis
gccagaucuccgccuucgacga

SEQ ID NO: 3032676 - RNA, 15 nt, Mycobacterium avium subsp. paratuberculosis
gccagaugcccgccc

SEQ ID NO: 3032677 - RNA, 15 nt, Mycobacterium avium subsp. paratuberculosis
gccagaugcgccgcg

SEQ ID NO: 3032678 - RNA, 15 nt, Mycobacterium avium subsp. paratuberculosis
gccagcaacaccagc

SEQ ID NO: 3032679 - RNA, 16 nt, Mycobacterium avium subsp. paratuberculosis
gccagcaacaccagcu

SEQ ID NO: 3032680 - RNA, 16 nt, Mycobacterium avium subsp. paratuberculosis
gccagcaacacccagc

SEQ ID NO: 3032681 - RNA, 17 nt, Mycobacterium avium subsp. paratuberculosis
gccagcaacacccagcc

SEQ ID NO: 3032682 - RNA, 22 nt, Mycobacterium avium subsp. paratuberculosis
gccagcaacacccagccgcuga

SEQ ID NO: 3032683 - RNA, 15 nt, Mycobacterium avium subsp. paratuberculosis
gccagcaacagcagc

SEQ ID NO: 3032684 - RNA, 18 nt, Mycobacterium avium subsp. paratuberculosis
gccagcaacagcagcggc

SEQ ID NO: 3032685 - RNA, 15 nt, Mycobacterium avium subsp. paratuberculosis
gccagcaaccccgcg

SEQ ID NO: 3032686 - RNA, 17 nt, Mycobacterium avium subsp. paratuberculosis
gccagcaaccccgcggu

SEQ ID NO: 3032687 - RNA, 19 nt, Mycobacterium avium subsp. paratuberculosis
gccagcaaccccgcggugc

SEQ ID NO: 3032688 - RNA, 22 nt, Mycobacterium avium subsp. paratuberculosis
gccagcaaccccgcggugcacg

SEQ ID NO: 3032689 - RNA, 15 nt, Mycobacterium avium subsp. paratuberculosis
gccagcaaccgccgu

SEQ ID NO: 3032690 - RNA, 17 nt, Mycobacterium avium subsp. paratuberculosis
gccagcaacgacccggc

SEQ ID NO: 3032691 - RNA, 18 nt, Mycobacterium avium subsp. paratuberculosis
gccagcaacgacccggcc

SEQ ID NO: 3032692 - RNA, 20 nt, Mycobacterium avium subsp. paratuberculosis
gccagcaacgacccggccac

SEQ ID NO: 3032693 - RNA, 21 nt, Mycobacterium avium subsp. paratuberculosis
gccagcaacgacccggccacc

SEQ ID NO: 3032694 - RNA, 18 nt, Mycobacterium avium subsp. paratuberculosis
gccagcacacccucgacc

SEQ ID NO: 3032695 - RNA, 20 nt, Mycobacterium avium subsp. paratuberculosis
gccagcacacccucgacccg

SEQ ID NO: 3032696 - RNA, 11 nt, Mycobacterium avium subsp. paratuberculosis
gccagcaccac

SEQ ID NO: 3032697 - RNA, 12 nt, Mycobacterium avium subsp. paratuberculosis
gccagcaccacc

SEQ ID NO: 3032698 - RNA, 13 nt, Mycobacterium avium subsp. paratuberculosis
gccagcaccacca

SEQ ID NO: 3032699 - RNA, 13 nt, Mycobacterium avium subsp. paratuberculosis
gccagcaccaccg

SEQ ID NO: 3032700 - RNA, 17 nt, Mycobacterium avium subsp. paratuberculosis
gccagcaccaccgcgag

SEQ ID NO: 3032701 - RNA, 18 nt, Mycobacterium avium subsp. paratuberculosis
gccagcaccaccgcgagc

SEQ ID NO: 3032702 - RNA, 21 nt, Mycobacterium avium subsp. paratuberculosis
gccagcaccaccgcgagcggg

SEQ ID NO: 3032703 - RNA, 22 nt, Mycobacterium avium subsp. paratuberculosis
gccagcaccaccgcgagcgggu

SEQ ID NO: 3032704 - RNA, 16 nt, Mycobacterium avium subsp. paratuberculosis
gccagcaccaccguca

SEQ ID NO: 3032705 - RNA, 16 nt, Mycobacterium avium subsp. paratuberculosis
gccagcaccaccucgc

SEQ ID NO: 3032706 - RNA, 17 nt, Mycobacterium avium subsp. paratuberculosis
gccagcaccaccucgcg

SEQ ID NO: 3032707 - RNA, 21 nt, Mycobacterium avium subsp. paratuberculosis
gccagcaccaccucgcgcggg

SEQ ID NO: 3032708 - RNA, 16 nt, Mycobacterium avium subsp. paratuberculosis
gccagcaccacguccg

SEQ ID NO: 3032709 - RNA, 16 nt, Mycobacterium avium subsp. paratuberculosis
gccagcaccagcagcc

SEQ ID NO: 3032710 - RNA, 17 nt, Mycobacterium avium subsp. paratuberculosis
gccagcaccagcagccg

SEQ ID NO: 3032711 - RNA, 16 nt, Mycobacterium avium subsp. paratuberculosis
gccagcaccagcccga

SEQ ID NO: 3032712 - RNA, 18 nt, Mycobacterium avium subsp. paratuberculosis
gccagcaccagcccgaug

SEQ ID NO: 3032713 - RNA, 17 nt, Mycobacterium avium subsp. paratuberculosis
gccagcaccagcgcgcg

SEQ ID NO: 3032714 - RNA, 16 nt, Mycobacterium avium subsp. paratuberculosis
gccagcaccauccagu

SEQ ID NO: 3032715 - RNA, 12 nt, Mycobacterium avium subsp. paratuberculosis
gccagcacccgc

SEQ ID NO: 3032716 - RNA, 16 nt, Mycobacterium avium subsp. paratuberculosis
gccagcacccgcucgc

SEQ ID NO: 3032717 - RNA, 19 nt, Mycobacterium avium subsp. paratuberculosis
gccagcacccgcucgcggg

SEQ ID NO: 3032718 - RNA, 14 nt, Mycobacterium avium subsp. paratuberculosis
gccagcaccgacag

SEQ ID NO: 3032719 - RNA, 17 nt, Mycobacterium avium subsp. paratuberculosis
gccagcaccgacgcgcc

SEQ ID NO: 3032720 - RNA, 17 nt, Mycobacterium avium subsp. paratuberculosis
gccagcaccgccaccgg

SEQ ID NO: 3032721 - RNA, 21 nt, Mycobacterium avium subsp. paratuberculosis
gccagcaccgccaccggcccg

SEQ ID NO: 3032722 - RNA, 14 nt, Mycobacterium avium subsp. paratuberculosis
gccagcaccgccag

SEQ ID NO: 3032723 - RNA, 17 nt, Mycobacterium avium subsp. paratuberculosis
gccagcaccgccagcgc

SEQ ID NO: 3032724 - RNA, 21 nt, Mycobacterium avium subsp. paratuberculosis
gccagcaccgccagcgccggc

SEQ ID NO: 3032725 - RNA, 13 nt, Mycobacterium avium subsp. paratuberculosis
gccagcaccgccc

SEQ ID NO: 3032726 - RNA, 12 nt, Mycobacterium avium subsp. paratuberculosis
gccagcaccgcg

SEQ ID NO: 3032727 - RNA, 15 nt, Mycobacterium avium subsp. paratuberculosis
gccagcaccgcggcc

SEQ ID NO: 3032728 - RNA, 16 nt, Mycobacterium avium subsp. paratuberculosis
gccagcaccgcggccg

SEQ ID NO: 3032729 - RNA, 18 nt, Mycobacterium avium subsp. paratuberculosis
gccagcaccgcggccguc

SEQ ID NO: 3032730 - RNA, 21 nt, Mycobacterium avium subsp. paratuberculosis
gccagcaccgcggccgucgcg

SEQ ID NO: 3032731 - RNA, 17 nt, Mycobacterium avium subsp. paratuberculosis
gccagcaccgcggcgau

SEQ ID NO: 3032732 - RNA, 18 nt, Mycobacterium avium subsp. paratuberculosis
gccagcaccgcggcgauc

SEQ ID NO: 3032733 - RNA, 17 nt, Mycobacterium avium subsp. paratuberculosis
gccagcaccgcgggggc

SEQ ID NO: 3032734 - RNA, 13 nt, Mycobacterium avium subsp. paratuberculosis
gccagcaccgcgu

SEQ ID NO: 3032735 - RNA, 17 nt, Mycobacterium avium subsp. paratuberculosis
gccagcaccgcgucgau

SEQ ID NO: 3032736 - RNA, 14 nt, Mycobacterium avium subsp. paratuberculosis
gccagcaccggcgc

SEQ ID NO: 3032737 - RNA, 17 nt, Mycobacterium avium subsp. paratuberculosis
gccagcaccggcgcgcc

SEQ ID NO: 3032738 - RNA, 18 nt, Mycobacterium avium subsp. paratuberculosis
gccagcaccggcgcgccg

SEQ ID NO: 3032739 - RNA, 20 nt, Mycobacterium avium subsp. paratuberculosis
gccagcaccggcgcgccgcg

SEQ ID NO: 3032740 - RNA, 14 nt, Mycobacterium avium subsp. paratuberculosis
gccagcaccgggcc

SEQ ID NO: 3032741 - RNA, 20 nt, Mycobacterium avium subsp. paratuberculosis
gccagcaccgggcccagcuc

SEQ ID NO: 3032742 - RNA, 12 nt, Mycobacterium avium subsp. paratuberculosis
gccagcaccgug

SEQ ID NO: 3032743 - RNA, 13 nt, Mycobacterium avium subsp. paratuberculosis
gccagcaccgugc

SEQ ID NO: 3032744 - RNA, 21 nt, Mycobacterium avium subsp. paratuberculosis
gccagcaccgugcugauccac

SEQ ID NO: 3032745 - RNA, 13 nt, Mycobacterium avium subsp. paratuberculosis
gccagcaccucga

SEQ ID NO: 3032746 - RNA, 17 nt, Mycobacterium avium subsp. paratuberculosis
gccagcaccucgaacgc

SEQ ID NO: 3032747 - RNA, 19 nt, Mycobacterium avium subsp. paratuberculosis
gccagcaccucgaacgccg

SEQ ID NO: 3032748 - RNA, 20 nt, Mycobacterium avium subsp. paratuberculosis
gccagcaccucgaacgccgg

SEQ ID NO: 3032749 - RNA, 14 nt, Mycobacterium avium subsp. paratuberculosis
gccagcaccucgcg

SEQ ID NO: 3032750 - RNA, 16 nt, Mycobacterium avium subsp. paratuberculosis
gccagcaccucgcggc

SEQ ID NO: 3032751 - RNA, 17 nt, Mycobacterium avium subsp. paratuberculosis
gccagcaccucgcggca

SEQ ID NO: 3032752 - RNA, 20 nt, Mycobacterium avium subsp. paratuberculosis
gccagcaccucgcggcagcc

SEQ ID NO: 3032753 - RNA, 18 nt, Mycobacterium avium subsp. paratuberculosis
gccagcaccucggcgacc

SEQ ID NO: 3032754 - RNA, 21 nt, Mycobacterium avium subsp. paratuberculosis
gccagcaccucggcgaccacg

SEQ ID NO: 3032755 - RNA, 22 nt, Mycobacterium avium subsp. paratuberculosis
gccagcaccucggcgaccacgu

SEQ ID NO: 3032756 - RNA, 14 nt, Mycobacterium avium subsp. paratuberculosis
gccagcaccuggcg

SEQ ID NO: 3032757 - RNA, 18 nt, Mycobacterium avium subsp. paratuberculosis
gccagcaccuggcgcacc

SEQ ID NO: 3032758 - RNA, 20 nt, Mycobacterium avium subsp. paratuberculosis
gccagcaccuggcgcaccgc

SEQ ID NO: 3032759 - RNA, 21 nt, Mycobacterium avium subsp. paratuberculosis
gccagcaccuggcgcaccgcc

SEQ ID NO: 3032760 - RNA, 22 nt, Mycobacterium avium subsp. paratuberculosis
gccagcaccuggcgcaccgccg

SEQ ID NO: 3032761 - RNA, 23 nt, Mycobacterium avium subsp. paratuberculosis
gccagcaccuggcgcaccgccgc

SEQ ID NO: 3032762 - RNA, 19 nt, Mycobacterium avium subsp. paratuberculosis
gccagcaccuucagcgggc

SEQ ID NO: 3032763 - RNA, 18 nt, Mycobacterium avium subsp. paratuberculosis
gccagcaccuucgggccg

SEQ ID NO: 3032764 - RNA, 23 nt, Mycobacterium avium subsp. paratuberculosis
gccagcacgaacaccacguagcc

SEQ ID NO: 3032765 - RNA, 14 nt, Mycobacterium avium subsp. paratuberculosis
gccagcacgacccc

SEQ ID NO: 3032766 - RNA, 15 nt, Mycobacterium avium subsp. paratuberculosis
gccagcacgcaggcg

SEQ ID NO: 3032767 - RNA, 17 nt, Mycobacterium avium subsp. paratuberculosis
gccagcacgcaggcgug

SEQ ID NO: 3032768 - RNA, 13 nt, Mycobacterium avium subsp. paratuberculosis
gccagcacgccgg

SEQ ID NO: 3032769 - RNA, 14 nt, Mycobacterium avium subsp. paratuberculosis
gccagcacgccggu

SEQ ID NO: 3032770 - RNA, 23 nt, Mycobacterium avium subsp. paratuberculosis
gccagcacgccggucagcaccau

SEQ ID NO: 3032771 - RNA, 21 nt, Mycobacterium avium subsp. paratuberculosis
gccagcacggccaccagcagc

SEQ ID NO: 3032772 - RNA, 22 nt, Mycobacterium avium subsp. paratuberculosis
gccagcacggccaccagcagcg

SEQ ID NO: 3032773 - RNA, 14 nt, Mycobacterium avium subsp. paratuberculosis
gccagcacggccag

SEQ ID NO: 3032774 - RNA, 22 nt, Mycobacterium avium subsp. paratuberculosis
gccagcacggccagccagccgc

SEQ ID NO: 3032775 - RNA, 14 nt, Mycobacterium avium subsp. paratuberculosis
gccagcacggcggc

SEQ ID NO: 3032776 - RNA, 15 nt, Mycobacterium avium subsp. paratuberculosis
gccagcacggcggcg

SEQ ID NO: 3032777 - RNA, 19 nt, Mycobacterium avium subsp. paratuberculosis
gccagcacggucagcggcc

SEQ ID NO: 3032778 - RNA, 21 nt, Mycobacterium avium subsp. paratuberculosis
gccagcacgguguugcgcacc

SEQ ID NO: 3032779 - RNA, 15 nt, Mycobacterium avium subsp. paratuberculosis
gccagcacguggccg

SEQ ID NO: 3032780 - RNA, 18 nt, Mycobacterium avium subsp. paratuberculosis
gccagcacguggccgggc

SEQ ID NO: 3032781 - RNA, 22 nt, Mycobacterium avium subsp. paratuberculosis
gccagcacguggccgggcucga

SEQ ID NO: 3032782 - RNA, 21 nt, Mycobacterium avium subsp. paratuberculosis
gccagcagauacuccucgcgg

SEQ ID NO: 3032783 - RNA, 16 nt, Mycobacterium avium subsp. paratuberculosis
gccagcagaucggaga

SEQ ID NO: 3032784 - RNA, 23 nt, Mycobacterium avium subsp. paratuberculosis
gccagcagaucggagacguccuc

SEQ ID NO: 3032785 - RNA, 22 nt, Mycobacterium avium subsp. paratuberculosis
gccagcagaugccgcccaggug

SEQ ID NO: 3032786 - RNA, 11 nt, Mycobacterium avium subsp. paratuberculosis
gccagcagcac

SEQ ID NO: 3032787 - RNA, 13 nt, Mycobacterium avium subsp. paratuberculosis
gccagcagcacca

SEQ ID NO: 3032788 - RNA, 15 nt, Mycobacterium avium subsp. paratuberculosis
gccagcagcaccagg

SEQ ID NO: 3032789 - RNA, 15 nt, Mycobacterium avium subsp. paratuberculosis
gccagcagcaccgcg

SEQ ID NO: 3032790 - RNA, 13 nt, Mycobacterium avium subsp. paratuberculosis
gccagcagcaccu

SEQ ID NO: 3032791 - RNA, 12 nt, Mycobacterium avium subsp. paratuberculosis
gccagcagcacg

SEQ ID NO: 3032792 - RNA, 13 nt, Mycobacterium avium subsp. paratuberculosis
gccagcagcacgg

SEQ ID NO: 3032793 - RNA, 14 nt, Mycobacterium avium subsp. paratuberculosis
gccagcagcacggc

SEQ ID NO: 3032794 - RNA, 12 nt, Mycobacterium avium subsp. paratuberculosis
gccagcagcagc

SEQ ID NO: 3032795 - RNA, 16 nt, Mycobacterium avium subsp. paratuberculosis
gccagcagcagcccgc

SEQ ID NO: 3032796 - RNA, 18 nt, Mycobacterium avium subsp. paratuberculosis
gccagcagcagccgcgcc

SEQ ID NO: 3032797 - RNA, 20 nt, Mycobacterium avium subsp. paratuberculosis
gccagcagcagccgcgccgc

SEQ ID NO: 3032798 - RNA, 22 nt, Mycobacterium avium subsp. paratuberculosis
gccagcagcagccgcgccgccg

SEQ ID NO: 3032799 - RNA, 13 nt, Mycobacterium avium subsp. paratuberculosis
gccagcagcagcg

SEQ ID NO: 3032800 - RNA, 18 nt, Mycobacterium avium subsp. paratuberculosis
gccagcagcagcgccgcc

SEQ ID NO: 3032801 - RNA, 18 nt, Mycobacterium avium subsp. paratuberculosis
gccagcagcagcgcggca

SEQ ID NO: 3032802 - RNA, 17 nt, Mycobacterium avium subsp. paratuberculosis
gccagcagccagcuggu

SEQ ID NO: 3032803 - RNA, 12 nt, Mycobacterium avium subsp. paratuberculosis
gccagcagcccg

SEQ ID NO: 3032804 - RNA, 13 nt, Mycobacterium avium subsp. paratuberculosis
gccagcagccgcg

SEQ ID NO: 3032805 - RNA, 14 nt, Mycobacterium avium subsp. paratuberculosis
gccagcagccgcga

SEQ ID NO: 3032806 - RNA, 15 nt, Mycobacterium avium subsp. paratuberculosis
gccagcagccgcgcg

SEQ ID NO: 3032807 - RNA, 19 nt, Mycobacterium avium subsp. paratuberculosis
gccagcagccgcgcgagca

SEQ ID NO: 3032808 - RNA, 13 nt, Mycobacterium avium subsp. paratuberculosis
gccagcagccgcu

SEQ ID NO: 3032809 - RNA, 14 nt, Mycobacterium avium subsp. paratuberculosis
gccagcagccgggu

SEQ ID NO: 3032810 - RNA, 18 nt, Mycobacterium avium subsp. paratuberculosis
gccagcagccgguacagc

SEQ ID NO: 3032811 - RNA, 19 nt, Mycobacterium avium subsp. paratuberculosis
gccagcagccgguacagcg

SEQ ID NO: 3032812 - RNA, 12 nt, Mycobacterium avium subsp. paratuberculosis
gccagcagcgca

SEQ ID NO: 3032813 - RNA, 15 nt, Mycobacterium avium subsp. paratuberculosis
gccagcagcgcaagc

SEQ ID NO: 3032814 - RNA, 13 nt, Mycobacterium avium subsp. paratuberculosis
gccagcagcgccg

SEQ ID NO: 3032815 - RNA, 15 nt, Mycobacterium avium subsp. paratuberculosis
gccagcagcgccgcu

SEQ ID NO: 3032816 - RNA, 13 nt, Mycobacterium avium subsp. paratuberculosis
gccagcagcgcgc

SEQ ID NO: 3032817 - RNA, 14 nt, Mycobacterium avium subsp. paratuberculosis
gccagcagcgcgcc

SEQ ID NO: 3032818 - RNA, 17 nt, Mycobacterium avium subsp. paratuberculosis
gccagcagcgcgccgcg

SEQ ID NO: 3032819 - RNA, 18 nt, Mycobacterium avium subsp. paratuberculosis
gccagcagcgcgccgcgc

SEQ ID NO: 3032820 - RNA, 14 nt, Mycobacterium avium subsp. paratuberculosis
gccagcagcgcggc

SEQ ID NO: 3032821 - RNA, 15 nt, Mycobacterium avium subsp. paratuberculosis
gccagcagcgcggcg

SEQ ID NO: 3032822 - RNA, 16 nt, Mycobacterium avium subsp. paratuberculosis
gccagcagcgcggcga

SEQ ID NO: 3032823 - RNA, 15 nt, Mycobacterium avium subsp. paratuberculosis
gccagcagcgcgucg

SEQ ID NO: 3032824 - RNA, 16 nt, Mycobacterium avium subsp. paratuberculosis
gccagcagcgcgucgc

SEQ ID NO: 3032825 - RNA, 13 nt, Mycobacterium avium subsp. paratuberculosis
gccagcagcggca

SEQ ID NO: 3032826 - RNA, 22 nt, Mycobacterium avium subsp. paratuberculosis
gccagcagcggcacccgguccg

SEQ ID NO: 3032827 - RNA, 19 nt, Mycobacterium avium subsp. paratuberculosis
gccagcagcggcaguagcg

SEQ ID NO: 3032828 - RNA, 15 nt, Mycobacterium avium subsp. paratuberculosis
gccagcagcggcuug

SEQ ID NO: 3032829 - RNA, 14 nt, Mycobacterium avium subsp. paratuberculosis
gccagcagcguggg

SEQ ID NO: 3032830 - RNA, 21 nt, Mycobacterium avium subsp. paratuberculosis
gccagcagcgugggauccgag

SEQ ID NO: 3032831 - RNA, 19 nt, Mycobacterium avium subsp. paratuberculosis
gccagcagcuugacgucgg

SEQ ID NO: 3032832 - RNA, 13 nt, Mycobacterium avium subsp. paratuberculosis
gccagcaggaucu

SEQ ID NO: 3032833 - RNA, 18 nt, Mycobacterium avium subsp. paratuberculosis
gccagcaggaucuggugc

SEQ ID NO: 3032834 - RNA, 21 nt, Mycobacterium avium subsp. paratuberculosis
gccagcaggaucuggugcgcg

SEQ ID NO: 3032835 - RNA, 22 nt, Mycobacterium avium subsp. paratuberculosis
gccagcaggaugaugaccgaca

SEQ ID NO: 3032836 - RNA, 13 nt, Mycobacterium avium subsp. paratuberculosis
gccagcagggcgc

SEQ ID NO: 3032837 - RNA, 17 nt, Mycobacterium avium subsp. paratuberculosis
gccagcagggcgccgac

SEQ ID NO: 3032838 - RNA, 16 nt, Mycobacterium avium subsp. paratuberculosis
gccagcagggucagcg

SEQ ID NO: 3032839 - RNA, 17 nt, Mycobacterium avium subsp. paratuberculosis
gccagcagggucagcga

SEQ ID NO: 3032840 - RNA, 17 nt, Mycobacterium avium subsp. paratuberculosis
gccagcagguagaagcc

SEQ ID NO: 3032841 - RNA, 23 nt, Mycobacterium avium subsp. paratuberculosis
gccagcagguagaagccgcgacg

SEQ ID NO: 3032842 - RNA, 19 nt, Mycobacterium avium subsp. paratuberculosis
gccagcagguagaucgcca

SEQ ID NO: 3032843 - RNA, 17 nt, Mycobacterium avium subsp. paratuberculosis
gccagcagguccgccgg

SEQ ID NO: 3032844 - RNA, 18 nt, Mycobacterium avium subsp. paratuberculosis
gccagcagguccgccggu

SEQ ID NO: 3032845 - RNA, 19 nt, Mycobacterium avium subsp. paratuberculosis
gccagcagguccgccggug

SEQ ID NO: 3032846 - RNA, 20 nt, Mycobacterium avium subsp. paratuberculosis
gccagcagguccgccggugc

SEQ ID NO: 3032847 - RNA, 23 nt, Mycobacterium avium subsp. paratuberculosis
gccagcagguccgccggugccag

SEQ ID NO: 3032848 - RNA, 23 nt, Mycobacterium avium subsp. paratuberculosis
gccagcaggucgaaggcggccgc

SEQ ID NO: 3032849 - RNA, 15 nt, Mycobacterium avium subsp. paratuberculosis
gccagcaggucgucg

SEQ ID NO: 3032850 - RNA, 16 nt, Mycobacterium avium subsp. paratuberculosis
gccagcaggucgucga

SEQ ID NO: 3032851 - RNA, 18 nt, Mycobacterium avium subsp. paratuberculosis
gccagcaggucgucgacg

SEQ ID NO: 3032852 - RNA, 19 nt, Mycobacterium avium subsp. paratuberculosis
gccagcaggucgucgacgu

SEQ ID NO: 3032853 - RNA, 20 nt, Mycobacterium avium subsp. paratuberculosis
gccagcaggucgucgacguc

SEQ ID NO: 3032854 - RNA, 17 nt, Mycobacterium avium subsp. paratuberculosis
gccagcagucgugacgc

SEQ ID NO: 3032855 - RNA, 13 nt, Mycobacterium avium subsp. paratuberculosis
gccagcagugcca

SEQ ID NO: 3032856 - RNA, 18 nt, Mycobacterium avium subsp. paratuberculosis
gccagcagugccaccacc

SEQ ID NO: 3032857 - RNA, 21 nt, Mycobacterium avium subsp. paratuberculosis
gccagcagugccaccaccacg

SEQ ID NO: 3032858 - RNA, 17 nt, Mycobacterium avium subsp. paratuberculosis
gccagcaguguccaguc

SEQ ID NO: 3032859 - RNA, 23 nt, Mycobacterium avium subsp. paratuberculosis
gccagcauccgcuggugcgcgcc

SEQ ID NO: 3032860 - RNA, 22 nt, Mycobacterium avium subsp. paratuberculosis
gccagcaucgagaugcugugga

SEQ ID NO: 3032861 - RNA, 14 nt, Mycobacterium avium subsp. paratuberculosis
gccagcaucucggc

SEQ ID NO: 3032862 - RNA, 17 nt, Mycobacterium avium subsp. paratuberculosis
gccagcaucucggcgaa

SEQ ID NO: 3032863 - RNA, 15 nt, Mycobacterium avium subsp. paratuberculosis
gccagcaugaucacc

SEQ ID NO: 3032864 - RNA, 19 nt, Mycobacterium avium subsp. paratuberculosis
gccagcaugaucaccgcca

SEQ ID NO: 3032865 - RNA, 22 nt, Mycobacterium avium subsp. paratuberculosis
gccagcaugaucaccgccagcg

SEQ ID NO: 3032866 - RNA, 15 nt, Mycobacterium avium subsp. paratuberculosis
gccagcaugcgauga

SEQ ID NO: 3032867 - RNA, 16 nt, Mycobacterium avium subsp. paratuberculosis
gccagcaugcgaugac

SEQ ID NO: 3032868 - RNA, 20 nt, Mycobacterium avium subsp. paratuberculosis
gccagcaugcgaugaccacc

SEQ ID NO: 3032869 - RNA, 13 nt, Mycobacterium avium subsp. paratuberculosis
gccagccaccaca

SEQ ID NO: 3032870 - RNA, 22 nt, Mycobacterium avium subsp. paratuberculosis
gccagccaccacaucgcugggg

SEQ ID NO: 3032871 - RNA, 15 nt, Mycobacterium avium subsp. paratuberculosis
gccagccacgccgac

SEQ ID NO: 3032872 - RNA, 16 nt, Mycobacterium avium subsp. paratuberculosis
gccagccacgccgaca

SEQ ID NO: 3032873 - RNA, 19 nt, Mycobacterium avium subsp. paratuberculosis
gccagccacgccgacaccg

SEQ ID NO: 3032874 - RNA, 23 nt, Mycobacterium avium subsp. paratuberculosis
gccagccacgccgacaccgucgc

SEQ ID NO: 3032875 - RNA, 14 nt, Mycobacterium avium subsp. paratuberculosis
gccagccagccgcc

SEQ ID NO: 3032876 - RNA, 15 nt, Mycobacterium avium subsp. paratuberculosis
gccagccagccgccc

SEQ ID NO: 3032877 - RNA, 16 nt, Mycobacterium avium subsp. paratuberculosis
gccagccagccgccca

SEQ ID NO: 3032878 - RNA, 20 nt, Mycobacterium avium subsp. paratuberculosis
gccagccagccgcccagcau

SEQ ID NO: 3032879 - RNA, 13 nt, Mycobacterium avium subsp. paratuberculosis
gccagccagccgg

SEQ ID NO: 3032880 - RNA, 16 nt, Mycobacterium avium subsp. paratuberculosis
gccagccagccggugc

SEQ ID NO: 3032881 - RNA, 19 nt, Mycobacterium avium subsp. paratuberculosis
gccagccaggccgucggcg

SEQ ID NO: 3032882 - RNA, 18 nt, Mycobacterium avium subsp. paratuberculosis
gccagccaguugggggcc

SEQ ID NO: 3032883 - RNA, 21 nt, Mycobacterium avium subsp. paratuberculosis
gccagccaguugggggccagc

SEQ ID NO: 3032884 - RNA, 13 nt, Mycobacterium avium subsp. paratuberculosis
gccagcccagccg

SEQ ID NO: 3032885 - RNA, 14 nt, Mycobacterium avium subsp. paratuberculosis
gccagcccagccgc

SEQ ID NO: 3032886 - RNA, 16 nt, Mycobacterium avium subsp. paratuberculosis
gccagcccagccgcca

SEQ ID NO: 3032887 - RNA, 20 nt, Mycobacterium avium subsp. paratuberculosis
gccagcccaucccgauccgc

SEQ ID NO: 3032888 - RNA, 13 nt, Mycobacterium avium subsp. paratuberculosis
gccagccccacca

SEQ ID NO: 3032889 - RNA, 16 nt, Mycobacterium avium subsp. paratuberculosis
gccagccccaccaccg

SEQ ID NO: 3032890 - RNA, 18 nt, Mycobacterium avium subsp. paratuberculosis
gccagccccaccaccgcc

SEQ ID NO: 3032891 - RNA, 20 nt, Mycobacterium avium subsp. paratuberculosis
gccagccccaccaccgccac

SEQ ID NO: 3032892 - RNA, 18 nt, Mycobacterium avium subsp. paratuberculosis
gccagccccaccggccac

SEQ ID NO: 3032893 - RNA, 21 nt, Mycobacterium avium subsp. paratuberculosis
gccagccccgggaaccagccc

SEQ ID NO: 3032894 - RNA, 12 nt, Mycobacterium avium subsp. paratuberculosis
gccagcccgccc

SEQ ID NO: 3032895 - RNA, 18 nt, Mycobacterium avium subsp. paratuberculosis
gccagcccgcccagcgcc

SEQ ID NO: 3032896 - RNA, 13 nt, Mycobacterium avium subsp. paratuberculosis
gccagcccgccga

SEQ ID NO: 3032897 - RNA, 12 nt, Mycobacterium avium subsp. paratuberculosis
gccagcccgcgg

SEQ ID NO: 3032898 - RNA, 15 nt, Mycobacterium avium subsp. paratuberculosis
gccagcccgcggcag

SEQ ID NO: 3032899 - RNA, 15 nt, Mycobacterium avium subsp. paratuberculosis
gccagcccgcgucgu

SEQ ID NO: 3032900 - RNA, 22 nt, Mycobacterium avium subsp. paratuberculosis
gccagcccgcgucguguccggg

SEQ ID NO: 3032901 - RNA, 12 nt, Mycobacterium avium subsp. paratuberculosis
gccagcccggcg

SEQ ID NO: 3032902 - RNA, 14 nt, Mycobacterium avium subsp. paratuberculosis
gccagcccggcgug

SEQ ID NO: 3032903 - RNA, 15 nt, Mycobacterium avium subsp. paratuberculosis
gccagcccggcgugc

SEQ ID NO: 3032904 - RNA, 21 nt, Mycobacterium avium subsp. paratuberculosis
gccagcccggugaucgccgcc

SEQ ID NO: 3032905 - RNA, 22 nt, Mycobacterium avium subsp. paratuberculosis
gccagcccggugaucgccgccc

SEQ ID NO: 3032906 - RNA, 23 nt, Mycobacterium avium subsp. paratuberculosis
gccagcccggugaucgccgccca

SEQ ID NO: 3032907 - RNA, 13 nt, Mycobacterium avium subsp. paratuberculosis
gccagcccgucgg

SEQ ID NO: 3032908 - RNA, 15 nt, Mycobacterium avium subsp. paratuberculosis
gccagcccgucgggu

SEQ ID NO: 3032909 - RNA, 13 nt, Mycobacterium avium subsp. paratuberculosis
gccagcccguggc

SEQ ID NO: 3032910 - RNA, 17 nt, Mycobacterium avium subsp. paratuberculosis
gccagcccguggccagc

SEQ ID NO: 3032911 - RNA, 21 nt, Mycobacterium avium subsp. paratuberculosis
gccagcccguggccagcgcca

SEQ ID NO: 3032912 - RNA, 20 nt, Mycobacterium avium subsp. paratuberculosis
gccagcccguuguggcggcc

SEQ ID NO: 3032913 - RNA, 12 nt, Mycobacterium avium subsp. paratuberculosis
gccagccgaagu

SEQ ID NO: 3032914 - RNA, 21 nt, Mycobacterium avium subsp. paratuberculosis
gccagccgaaguauccgguca

SEQ ID NO: 3032915 - RNA, 23 nt, Mycobacterium avium subsp. paratuberculosis
gccagccgaugcgcccgcgccac

SEQ ID NO: 3032916 - RNA, 14 nt, Mycobacterium avium subsp. paratuberculosis
gccagccgcagcag

SEQ ID NO: 3032917 - RNA, 16 nt, Mycobacterium avium subsp. paratuberculosis
gccagccgcagcaggc

SEQ ID NO: 3032918 - RNA, 15 nt, Mycobacterium avium subsp. paratuberculosis
gccagccgcccagca

SEQ ID NO: 3032919 - RNA, 21 nt, Mycobacterium avium subsp. paratuberculosis
gccagccgcccagcaucgccg

SEQ ID NO: 3032920 - RNA, 13 nt, Mycobacterium avium subsp. paratuberculosis
gccagccgccgcc

SEQ ID NO: 3032921 - RNA, 14 nt, Mycobacterium avium subsp. paratuberculosis
gccagccgccgccg

SEQ ID NO: 3032922 - RNA, 18 nt, Mycobacterium avium subsp. paratuberculosis
gccagccgccggcucagc

SEQ ID NO: 3032923 - RNA, 20 nt, Mycobacterium avium subsp. paratuberculosis
gccagccgccggcucagcgg

SEQ ID NO: 3032924 - RNA, 13 nt, Mycobacterium avium subsp. paratuberculosis
gccagccgcgccg

SEQ ID NO: 3032925 - RNA, 15 nt, Mycobacterium avium subsp. paratuberculosis
gccagccgcgccgcg

SEQ ID NO: 3032926 - RNA, 18 nt, Mycobacterium avium subsp. paratuberculosis
gccagccgcgccgcgccg

SEQ ID NO: 3032927 - RNA, 14 nt, Mycobacterium avium subsp. paratuberculosis
gccagccgcgcggc

SEQ ID NO: 3032928 - RNA, 15 nt, Mycobacterium avium subsp. paratuberculosis
gccagccgcgcggcg

SEQ ID NO: 3032929 - RNA, 13 nt, Mycobacterium avium subsp. paratuberculosis
gccagccggccgc

SEQ ID NO: 3032930 - RNA, 14 nt, Mycobacterium avium subsp. paratuberculosis
gccagccggccgcu

SEQ ID NO: 3032931 - RNA, 15 nt, Mycobacterium avium subsp. paratuberculosis
gccagccggccgcug

SEQ ID NO: 3032932 - RNA, 16 nt, Mycobacterium avium subsp. paratuberculosis
gccagccggccgcuga

SEQ ID NO: 3032933 - RNA, 23 nt, Mycobacterium avium subsp. paratuberculosis
gccagccggcucuuggcgaccuc

SEQ ID NO: 3032934 - RNA, 16 nt, Mycobacterium avium subsp. paratuberculosis
gccagccgggccgagc

SEQ ID NO: 3032935 - RNA, 17 nt, Mycobacterium avium subsp. paratuberculosis
gccagccgggccgagcg

SEQ ID NO: 3032936 - RNA, 20 nt, Mycobacterium avium subsp. paratuberculosis
gccagccgggccgagcgcgc

SEQ ID NO: 3032937 - RNA, 21 nt, Mycobacterium avium subsp. paratuberculosis
gccagccgggccgagcgcgcc

SEQ ID NO: 3032938 - RNA, 23 nt, Mycobacterium avium subsp. paratuberculosis
gccagccgggccgagcgcgccgc

SEQ ID NO: 3032939 - RNA, 15 nt, Mycobacterium avium subsp. paratuberculosis
gccagccgggcggcc

SEQ ID NO: 3032940 - RNA, 16 nt, Mycobacterium avium subsp. paratuberculosis
gccagccgggcggcca

SEQ ID NO: 3032941 - RNA, 17 nt, Mycobacterium avium subsp. paratuberculosis
gccagccgggguagggc

SEQ ID NO: 3032942 - RNA, 21 nt, Mycobacterium avium subsp. paratuberculosis
gccagccgggguagggcggcg

SEQ ID NO: 3032943 - RNA, 16 nt, Mycobacterium avium subsp. paratuberculosis
gccagccggguggccc

SEQ ID NO: 3032944 - RNA, 20 nt, Mycobacterium avium subsp. paratuberculosis
gccagccggguggcccgcgc

SEQ ID NO: 3032945 - RNA, 21 nt, Mycobacterium avium subsp. paratuberculosis
gccagccgguacggaucgccg

SEQ ID NO: 3032946 - RNA, 18 nt, Mycobacterium avium subsp. paratuberculosis
gccagccggucaucgcgu

SEQ ID NO: 3032947 - RNA, 20 nt, Mycobacterium avium subsp. paratuberculosis
gccagccggucaucgcguag

SEQ ID NO: 3032948 - RNA, 16 nt, Mycobacterium avium subsp. paratuberculosis
gccagccggucgucgg

SEQ ID NO: 3032949 - RNA, 19 nt, Mycobacterium avium subsp. paratuberculosis
gccagccggucgucggggc

SEQ ID NO: 3032950 - RNA, 21 nt, Mycobacterium avium subsp. paratuberculosis
gccagccggucgucggggcau

SEQ ID NO: 3032951 - RNA, 22 nt, Mycobacterium avium subsp. paratuberculosis
gccagccggugcggucggcguc

SEQ ID NO: 3032952 - RNA, 23 nt, Mycobacterium avium subsp. paratuberculosis
gccagccggugcggucggcgucg

SEQ ID NO: 3032953 - RNA, 20 nt, Mycobacterium avium subsp. paratuberculosis
gccagccggugcugacccgg

SEQ ID NO: 3032954 - RNA, 18 nt, Mycobacterium avium subsp. paratuberculosis
gccagccgguggcggcca

SEQ ID NO: 3032955 - RNA, 21 nt, Mycobacterium avium subsp. paratuberculosis
gccagccgguugcgguggccg

SEQ ID NO: 3032956 - RNA, 17 nt, Mycobacterium avium subsp. paratuberculosis
gccagccgucgccgcgc

SEQ ID NO: 3032957 - RNA, 19 nt, Mycobacterium avium subsp. paratuberculosis
gccagccgucgccgcgccc

SEQ ID NO: 3032958 - RNA, 20 nt, Mycobacterium avium subsp. paratuberculosis
gccagccgucgccgcgcccg

SEQ ID NO: 3032959 - RNA, 15 nt, Mycobacterium avium subsp. paratuberculosis
gccagccgugcggcg

SEQ ID NO: 3032960 - RNA, 22 nt, Mycobacterium avium subsp. paratuberculosis
gccagccguucccggcagaacg

SEQ ID NO: 3032961 - RNA, 16 nt, Mycobacterium avium subsp. paratuberculosis
gccagccucuugaacg

SEQ ID NO: 3032962 - RNA, 15 nt, Mycobacterium avium subsp. paratuberculosis
gccagcgaccgcagg

SEQ ID NO: 3032963 - RNA, 13 nt, Mycobacterium avium subsp. paratuberculosis
gccagcgacggcc

SEQ ID NO: 3032964 - RNA, 14 nt, Mycobacterium avium subsp. paratuberculosis
gccagcgacggccg

SEQ ID NO: 3032965 - RNA, 15 nt, Mycobacterium avium subsp. paratuberculosis
gccagcgacggccgg

SEQ ID NO: 3032966 - RNA, 17 nt, Mycobacterium avium subsp. paratuberculosis
gccagcgacggccgggu

SEQ ID NO: 3032967 - RNA, 18 nt, Mycobacterium avium subsp. paratuberculosis
gccagcgaguccagccag

SEQ ID NO: 3032968 - RNA, 22 nt, Mycobacterium avium subsp. paratuberculosis
gccagcgaguccagccagccgc

SEQ ID NO: 3032969 - RNA, 16 nt, Mycobacterium avium subsp. paratuberculosis
gccagcgagucgauga

SEQ ID NO: 3032970 - RNA, 17 nt, Mycobacterium avium subsp. paratuberculosis
gccagcgagugggugaa

SEQ ID NO: 3032971 - RNA, 21 nt, Mycobacterium avium subsp. paratuberculosis
gccagcgauacccguugcgcc

SEQ ID NO: 3032972 - RNA, 12 nt, Mycobacterium avium subsp. paratuberculosis
gccagcgcaccg

SEQ ID NO: 3032973 - RNA, 15 nt, Mycobacterium avium subsp. paratuberculosis
gccagcgcaccgggc

SEQ ID NO: 3032974 - RNA, 22 nt, Mycobacterium avium subsp. paratuberculosis
gccagcgcaccgggcccgcccg

SEQ ID NO: 3032975 - RNA, 23 nt, Mycobacterium avium subsp. paratuberculosis
gccagcgcaccgggcccgcccgc

SEQ ID NO: 3032976 - RNA, 13 nt, Mycobacterium avium subsp. paratuberculosis
gccagcgcagcac

SEQ ID NO: 3032977 - RNA, 16 nt, Mycobacterium avium subsp. paratuberculosis
gccagcgcagcacuga

SEQ ID NO: 3032978 - RNA, 18 nt, Mycobacterium avium subsp. paratuberculosis
gccagcgcaguucaccga

SEQ ID NO: 3032979 - RNA, 17 nt, Mycobacterium avium subsp. paratuberculosis
gccagcgcaucggucac

SEQ ID NO: 3032980 - RNA, 14 nt, Mycobacterium avium subsp. paratuberculosis
gccagcgccacccc

SEQ ID NO: 3032981 - RNA, 15 nt, Mycobacterium avium subsp. paratuberculosis
gccagcgccaccccc

SEQ ID NO: 3032982 - RNA, 12 nt, Mycobacterium avium subsp. paratuberculosis
gccagcgccacg

SEQ ID NO: 3032983 - RNA, 20 nt, Mycobacterium avium subsp. paratuberculosis
gccagcgccacgcucaugcc

SEQ ID NO: 3032984 - RNA, 14 nt, Mycobacterium avium subsp. paratuberculosis
gccagcgccagcgc

SEQ ID NO: 3032985 - RNA, 20 nt, Mycobacterium avium subsp. paratuberculosis
gccagcgccagcgccagcgu

SEQ ID NO: 3032986 - RNA, 16 nt, Mycobacterium avium subsp. paratuberculosis
gccagcgccaugccgc

SEQ ID NO: 3032987 - RNA, 19 nt, Mycobacterium avium subsp. paratuberculosis
gccagcgccaugccgccga

SEQ ID NO: 3032988 - RNA, 23 nt, Mycobacterium avium subsp. paratuberculosis
gccagcgccaugccgccgaccgc

SEQ ID NO: 3032989 - RNA, 17 nt, Mycobacterium avium subsp. paratuberculosis
gccagcgcccccagcgg

SEQ ID NO: 3032990 - RNA, 15 nt, Mycobacterium avium subsp. paratuberculosis
gccagcgccccgccg

SEQ ID NO: 3032991 - RNA, 16 nt, Mycobacterium avium subsp. paratuberculosis
gccagcgccccgccgg

SEQ ID NO: 3032992 - RNA, 21 nt, Mycobacterium avium subsp. paratuberculosis
gccagcgcccgauucgcggcc

SEQ ID NO: 3032993 - RNA, 12 nt, Mycobacterium avium subsp. paratuberculosis
gccagcgcccgc

SEQ ID NO: 3032994 - RNA, 14 nt, Mycobacterium avium subsp. paratuberculosis
gccagcgcccgcgc

SEQ ID NO: 3032995 - RNA, 15 nt, Mycobacterium avium subsp. paratuberculosis
gccagcgcccgcgcg

SEQ ID NO: 3032996 - RNA, 16 nt, Mycobacterium avium subsp. paratuberculosis
gccagcgcccgcgcgu

SEQ ID NO: 3032997 - RNA, 14 nt, Mycobacterium avium subsp. paratuberculosis
ggcgaccggcccca

SEQ ID NO: 3032998 - RNA, 15 nt, Mycobacterium avium subsp. paratuberculosis
ggcgaccggccccaa

SEQ ID NO: 3032999 - RNA, 16 nt, Mycobacterium avium subsp. paratuberculosis
ggcgaccggggcggug

SEQ ID NO: 3033000 - RNA, 17 nt, Mycobacterium avium subsp. paratuberculosis
ggcgaccggggcgguga

SEQ ID NO: 3033001 - RNA, 18 nt, Mycobacterium avium subsp. paratuberculosis
ggcgaccggggcggugac

SEQ ID NO: 3033002 - RNA, 16 nt, Mycobacterium avium subsp. paratuberculosis
ggcgaccgguccgcgg

SEQ ID NO: 3033003 - RNA, 18 nt, Mycobacterium avium subsp. paratuberculosis
ggcgaccgugcccaccag

SEQ ID NO: 3033004 - RNA, 23 nt, Mycobacterium avium subsp. paratuberculosis
ggcgaccuccugcaaggcccccg

SEQ ID NO: 3033005 - RNA, 16 nt, Mycobacterium avium subsp. paratuberculosis
ggcgaccucggggaug

SEQ ID NO: 3033006 - RNA, 14 nt, Mycobacterium avium subsp. paratuberculosis
ggcgaccugcggcu

SEQ ID NO: 3033007 - RNA, 22 nt, Mycobacterium avium subsp. paratuberculosis
ggcgaccugcgggcccaccgcg

SEQ ID NO: 3033008 - RNA, 17 nt, Mycobacterium avium subsp. paratuberculosis
ggcgaccuggacgccgc

SEQ ID NO: 3033009 - RNA, 19 nt, Mycobacterium avium subsp. paratuberculosis
uggcggcgaugucgucgac

SEQ ID NO: 3033010 - RNA, 20 nt, Mycobacterium avium subsp. paratuberculosis
uggcggcgccggaugccagc

SEQ ID NO: 3033011 - RNA, 21 nt, Mycobacterium avium subsp. paratuberculosis
uggcggcgccggaugccagca

SEQ ID NO: 3033012 - RNA, 12 nt, Mycobacterium avium subsp. paratuberculosis
uggcggcgcgcu

SEQ ID NO: 3033013 - RNA, 13 nt, Mycobacterium avium subsp. paratuberculosis
uggcggcgcgcuc

SEQ ID NO: 3033014 - RNA, 21 nt, Mycobacterium avium subsp. paratuberculosis
uggcggcgcgcucgucgucgg

SEQ ID NO: 3033015 - RNA, 15 nt, Mycobacterium avium subsp. paratuberculosis
uggcggcggccaggg

SEQ ID NO: 3033016 - RNA, 14 nt, Mycobacterium avium subsp. paratuberculosis
uggcggcggcccgc

SEQ ID NO: 3033017 - RNA, 19 nt, Mycobacterium avium subsp. paratuberculosis
uggcggcgggccagcucgu

SEQ ID NO: 3033018 - RNA, 17 nt, Mycobacterium avium subsp. paratuberculosis
uggcggcggugaucgcc

SEQ ID NO: 3033019 - RNA, 14 nt, Mycobacterium avium subsp. paratuberculosis
uggcggcgugcagu

SEQ ID NO: 3033020 - RNA, 22 nt, Mycobacterium avium subsp. paratuberculosis
uggcggcgugcagucccagauc

SEQ ID NO: 3033021 - RNA, 22 nt, Mycobacterium avium subsp. paratuberculosis
uggcggcgugcuuaacacaugc

SEQ ID NO: 3033022 - RNA, 20 nt, Mycobacterium avium subsp. paratuberculosis
uggcggcgugggguucccgg

SEQ ID NO: 3033023 - RNA, 23 nt, Mycobacterium avium subsp. paratuberculosis
uggcggcgugggguucccggccg

SEQ ID NO: 3033024 - RNA, 14 nt, Mycobacterium avium subsp. paratuberculosis
uggcgggcccgggc

SEQ ID NO: 3033025 - RNA, 15 nt, Mycobacterium avium subsp. paratuberculosis
uggcgggcgaucgcc

SEQ ID NO: 3033026 - RNA, 12 nt, Mycobacterium avium subsp. paratuberculosis
uggcgggcgcgc

SEQ ID NO: 3033027 - RNA, 15 nt, Mycobacterium avium subsp. paratuberculosis
uggcgggcggcccgc

SEQ ID NO: 3033028 - RNA, 16 nt, Mycobacterium avium subsp. paratuberculosis
uggcgggcggcccgca

SEQ ID NO: 3033029 - RNA, 22 nt, Mycobacterium avium subsp. paratuberculosis
uggcggggcgugcccggcgccg

SEQ ID NO: 3033030 - RNA, 12 nt, Mycobacterium avium subsp. paratuberculosis
uggcggguacag

SEQ ID NO: 3033031 - RNA, 15 nt, Mycobacterium avium subsp. paratuberculosis
uggcgguccaccacc

SEQ ID NO: 3033032 - RNA, 18 nt, Mycobacterium avium subsp. paratuberculosis
uggcggucccgcaugucc

SEQ ID NO: 3033033 - RNA, 18 nt, Mycobacterium avium subsp. paratuberculosis
uggcggucugcgcccgau

SEQ ID NO: 3033034 - RNA, 19 nt, Mycobacterium avium subsp. paratuberculosis
uggcggucugcgcccgauc

SEQ ID NO: 3033035 - RNA, 12 nt, Mycobacterium avium subsp. paratuberculosis
uggcgguggccc

SEQ ID NO: 3033036 - RNA, 13 nt, Mycobacterium avium subsp. paratuberculosis
uggcgguggcggc

SEQ ID NO: 3033037 - RNA, 13 nt, Mycobacterium avium subsp. paratuberculosis
uggcgguggggcc

SEQ ID NO: 3033038 - RNA, 21 nt, Mycobacterium avium subsp. paratuberculosis
uggcgguguucgagggcgcgg

SEQ ID NO: 3033039 - RNA, 17 nt, Mycobacterium avium subsp. paratuberculosis
uggcgguuggacaggcc

SEQ ID NO: 3033040 - RNA, 17 nt, Mycobacterium avium subsp. paratuberculosis
uggcguaaccggugaca

SEQ ID NO: 3033041 - RNA, 17 nt, Mycobacterium avium subsp. paratuberculosis
uggcguaggacagcagc

SEQ ID NO: 3033042 - RNA, 21 nt, Mycobacterium avium subsp. paratuberculosis
uggcguaggacagcagccgcu

SEQ ID NO: 3033043 - RNA, 17 nt, Mycobacterium avium subsp. paratuberculosis
uggcguagucgacuucc

SEQ ID NO: 3033044 - RNA, 15 nt, Mycobacterium avium subsp. paratuberculosis
uggcguagucgucga

SEQ ID NO: 3033045 - RNA, 18 nt, Mycobacterium avium subsp. paratuberculosis
uggcguaguggugcaggu

SEQ ID NO: 3033046 - RNA, 19 nt, Mycobacterium avium subsp. paratuberculosis
uggcguauaacacgaugcg

SEQ ID NO: 3033047 - RNA, 20 nt, Mycobacterium avium subsp. paratuberculosis
uggcguaugccuccucggug

SEQ ID NO: 3033048 - RNA, 17 nt, Mycobacterium avium subsp. paratuberculosis
uggcguauucggcgcgc

SEQ ID NO: 3033049 - RNA, 18 nt, Mycobacterium avium subsp. paratuberculosis
uggcguauucggcgcgca

SEQ ID NO: 3033050 - RNA, 17 nt, Mycobacterium avium subsp. paratuberculosis
uggcgucacgcugcgcg

SEQ ID NO: 3033051 - RNA, 17 nt, Mycobacterium avium subsp. paratuberculosis
uggcguccaaugcgccg

SEQ ID NO: 3033052 - RNA, 22 nt, Mycobacterium avium subsp. paratuberculosis
uggcguccagcggguugccgcu

SEQ ID NO: 3033053 - RNA, 15 nt, Mycobacterium avium subsp. paratuberculosis
uggcguccucgacgg

SEQ ID NO: 3033054 - RNA, 20 nt, Mycobacterium avium subsp. paratuberculosis
uggcguccuugccgaucagc

SEQ ID NO: 3033055 - RNA, 13 nt, Mycobacterium avium subsp. paratuberculosis
uggcgucgaucag

SEQ ID NO: 3033056 - RNA, 21 nt, Mycobacterium avium subsp. paratuberculosis
uggcgucgaucagcgcgccgc

SEQ ID NO: 3033057 - RNA, 15 nt, Mycobacterium avium subsp. paratuberculosis
uggcgucgccgccgg

SEQ ID NO: 3033058 - RNA, 20 nt, Mycobacterium avium subsp. paratuberculosis
uggcgucgccgccggugccg

SEQ ID NO: 3033059 - RNA, 14 nt, Mycobacterium avium subsp. paratuberculosis
uggcgucggccagc

SEQ ID NO: 3033060 - RNA, 15 nt, Mycobacterium avium subsp. paratuberculosis
uggcgucggccagcg

SEQ ID NO: 3033061 - RNA, 18 nt, Mycobacterium avium subsp. paratuberculosis
uggcgucggccgggggcg

SEQ ID NO: 3033062 - RNA, 21 nt, Mycobacterium avium subsp. paratuberculosis
uggcgucggccgggggcgcgg

SEQ ID NO: 3033063 - RNA, 12 nt, Mycobacterium avium subsp. paratuberculosis
uggcgucguuga

SEQ ID NO: 3033064 - RNA, 17 nt, Mycobacterium avium subsp. paratuberculosis
uggcgucguugaacgcg

SEQ ID NO: 3033065 - RNA, 21 nt, Mycobacterium avium subsp. paratuberculosis
uggcgucguuggcgccguccg

SEQ ID NO: 3033066 - RNA, 20 nt, Mycobacterium avium subsp. paratuberculosis
uggcgugaaucuuggccagc

SEQ ID NO: 3033067 - RNA, 21 nt, Mycobacterium avium subsp. paratuberculosis
uggcgugaaucuuggccagca

SEQ ID NO: 3033068 - RNA, 22 nt, Mycobacterium avium subsp. paratuberculosis
uggcgugacacucggucaccgg

SEQ ID NO: 3033069 - RNA, 14 nt, Mycobacterium avium subsp. paratuberculosis
uggcgugacgcucg

SEQ ID NO: 3033070 - RNA, 18 nt, Mycobacterium avium subsp. paratuberculosis
uggcgugacgcucggccg

SEQ ID NO: 3033071 - RNA, 18 nt, Mycobacterium avium subsp. paratuberculosis
uggcgugacgcucggcgc

SEQ ID NO: 3033072 - RNA, 20 nt, Mycobacterium avium subsp. paratuberculosis
uggcgugacgcucggcgcgu

SEQ ID NO: 3033073 - RNA, 19 nt, Mycobacterium avium subsp. paratuberculosis
uggcgugacgcucggcggc

SEQ ID NO: 3033074 - RNA, 15 nt, Mycobacterium avium subsp. paratuberculosis
uggcgugcagcgcgg

SEQ ID NO: 3033075 - RNA, 15 nt, Mycobacterium avium subsp. paratuberculosis
uggcgugccacagca

SEQ ID NO: 3033076 - RNA, 17 nt, Mycobacterium avium subsp. paratuberculosis
uggcguggauggccggc

SEQ ID NO: 3033077 - RNA, 18 nt, Mycobacterium avium subsp. paratuberculosis
uggcguggcacccgggcg

SEQ ID NO: 3033078 - RNA, 22 nt, Mycobacterium avium subsp. paratuberculosis
uggcgugucggugauggccggc

SEQ ID NO: 3033079 - RNA, 22 nt, Mycobacterium avium subsp. paratuberculosis
uggcgugugggcucgcccgggc

SEQ ID NO: 3033080 - RNA, 14 nt, Mycobacterium avium subsp. paratuberculosis
uggcguuacacccg

SEQ ID NO: 3033081 - RNA, 16 nt, Mycobacterium avium subsp. paratuberculosis
uggcguucaucgucca

SEQ ID NO: 3033082 - RNA, 14 nt, Mycobacterium avium subsp. paratuberculosis
uggcguucgccgag

SEQ ID NO: 3033083 - RNA, 15 nt, Mycobacterium avium subsp. paratuberculosis
uggcguugagcacgc

SEQ ID NO: 3033084 - RNA, 17 nt, Mycobacterium avium subsp. paratuberculosis
uggcguugaugcgggcg

SEQ ID NO: 3033085 - RNA, 21 nt, Mycobacterium avium subsp. paratuberculosis
uggcguugcagaacgcgcgga

SEQ ID NO: 3033086 - RNA, 14 nt, Mycobacterium avium subsp. paratuberculosis
uggcuagcgggcgc

SEQ ID NO: 3033087 - RNA, 13 nt, Mycobacterium avium subsp. paratuberculosis
uggcucagcgcac

SEQ ID NO: 3033088 - RNA, 21 nt, Mycobacterium avium subsp. paratuberculosis
uggcucagcggcaggugcgcc

SEQ ID NO: 3033089 - RNA, 14 nt, Mycobacterium avium subsp. paratuberculosis
uggcucgcgggggc

SEQ ID NO: 3033090 - RNA, 23 nt, Mycobacterium avium subsp. paratuberculosis
uggcucggcaccagagcgccgga

SEQ ID NO: 3033091 - RNA, 21 nt, Mycobacterium avium subsp. paratuberculosis
uggcucggcccgccgggcgcc

SEQ ID NO: 3033092 - RNA, 15 nt, Mycobacterium avium subsp. paratuberculosis
uggcucggccgauga

SEQ ID NO: 3033093 - RNA, 13 nt, Mycobacterium avium subsp. paratuberculosis
uggcucucguccu

SEQ ID NO: 3033094 - RNA, 18 nt, Mycobacterium avium subsp. paratuberculosis
uggcugaacagcgcgccg

SEQ ID NO: 3033095 - RNA, 16 nt, Mycobacterium avium subsp. paratuberculosis
uggcugacggcgucgu

SEQ ID NO: 3033096 - RNA, 14 nt, Mycobacterium avium subsp. paratuberculosis
uggcugagcaccgg

SEQ ID NO: 3033097 - RNA, 13 nt, Mycobacterium avium subsp. paratuberculosis
uggcugagcagca

SEQ ID NO: 3033098 - RNA, 14 nt, Mycobacterium avium subsp. paratuberculosis
uggcugagcagcac

SEQ ID NO: 3033099 - RNA, 21 nt, Mycobacterium avium subsp. paratuberculosis
uggcugaggccgccccggccg

SEQ ID NO: 3033100 - RNA, 13 nt, Mycobacterium avium subsp. paratuberculosis
uggcugcccggca

SEQ ID NO: 3033101 - RNA, 23 nt, Mycobacterium avium subsp. paratuberculosis
uggcuggucucgggcaccacgcc

SEQ ID NO: 3033102 - RNA, 22 nt, Mycobacterium avium subsp. paratuberculosis
uggcugucggggaccguccccg

SEQ ID NO: 3033103 - RNA, 14 nt, Mycobacterium avium subsp. paratuberculosis
ugggaagcaucaau

SEQ ID NO: 3033104 - RNA, 17 nt, Mycobacterium avium subsp. paratuberculosis
ugggacagccggucgac

SEQ ID NO: 3033105 - RNA, 18 nt, Mycobacterium avium subsp. paratuberculosis
ugggacggaaaucgccug

SEQ ID NO: 3033106 - RNA, 13 nt, Mycobacterium avium subsp. paratuberculosis
ugggacggcgggu

SEQ ID NO: 3033107 - RNA, 15 nt, Mycobacterium avium subsp. paratuberculosis
ugggacggcgggugg

SEQ ID NO: 3033108 - RNA, 18 nt, Mycobacterium avium subsp. paratuberculosis
ugggacggcggguggggg

SEQ ID NO: 3033109 - RNA, 18 nt, Mycobacterium avium subsp. paratuberculosis
ugggacgggucggcggcg

SEQ ID NO: 3033110 - RNA, 17 nt, Mycobacterium avium subsp. paratuberculosis
ugggagcacgugaugag

SEQ ID NO: 3033111 - RNA, 21 nt, Mycobacterium avium subsp. paratuberculosis
ugggaggcgcacaacgaggcc

SEQ ID NO: 3033112 - RNA, 18 nt, Mycobacterium avium subsp. paratuberculosis
ugggaucagcagcaccgg

SEQ ID NO: 3033113 - RNA, 21 nt, Mycobacterium avium subsp. paratuberculosis
ugggauugccgggcaccagcg

SEQ ID NO: 3033114 - RNA, 13 nt, Mycobacterium avium subsp. paratuberculosis
ugggcaacgcggc

SEQ ID NO: 3033115 - RNA, 18 nt, Mycobacterium avium subsp. paratuberculosis
ugggcaauaccggcagca

SEQ ID NO: 3033116 - RNA, 18 nt, Mycobacterium avium subsp. paratuberculosis
ugggcaccagcagcgcga

SEQ ID NO: 3033117 - RNA, 22 nt, Mycobacterium avium subsp. paratuberculosis
ugggcaccagcagcgcgacgcc

SEQ ID NO: 3033118 - RNA, 16 nt, Mycobacterium avium subsp. paratuberculosis
ugggcaccccgaucag

SEQ ID NO: 3033119 - RNA, 13 nt, Mycobacterium avium subsp. paratuberculosis
ugggcaccggcac

SEQ ID NO: 3033120 - RNA, 16 nt, Mycobacterium avium subsp. paratuberculosis
ugggcaccggcaccgc

SEQ ID NO: 3033121 - RNA, 18 nt, Mycobacterium avium subsp. paratuberculosis
ugggcaccggcaccgccc

SEQ ID NO: 3033122 - RNA, 20 nt, Mycobacterium avium subsp. paratuberculosis
ugggcaccuggccgucggug

SEQ ID NO: 3033123 - RNA, 18 nt, Mycobacterium avium subsp. paratuberculosis
ugggcagccccagcgagc

SEQ ID NO: 3033124 - RNA, 19 nt, Mycobacterium avium subsp. paratuberculosis
ugggcagccccagcgagca

SEQ ID NO: 3033125 - RNA, 15 nt, Mycobacterium avium subsp. paratuberculosis
ugggcagccgcgcgu

SEQ ID NO: 3033126 - RNA, 17 nt, Mycobacterium avium subsp. paratuberculosis
ugggcagccgcgcgugc

SEQ ID NO: 3033127 - RNA, 12 nt, Mycobacterium avium subsp. paratuberculosis
ugggcagcucgu

SEQ ID NO: 3033128 - RNA, 21 nt, Mycobacterium avium subsp. paratuberculosis
ugggcagcucgucggcgcgcc

SEQ ID NO: 3033129 - RNA, 15 nt, Mycobacterium avium subsp. paratuberculosis
ugggcaucaucggca

SEQ ID NO: 3033130 - RNA, 18 nt, Mycobacterium avium subsp. paratuberculosis
ugggcaucaucggcacgc

SEQ ID NO: 3033131 - RNA, 19 nt, Mycobacterium avium subsp. paratuberculosis
ugggcauccgcucgccgcg

SEQ ID NO: 3033132 - RNA, 17 nt, Mycobacterium avium subsp. paratuberculosis
ugggcaucgucucggac

SEQ ID NO: 3033133 - RNA, 14 nt, Mycobacterium avium subsp. paratuberculosis
ugggcauggugaag

SEQ ID NO: 3033134 - RNA, 16 nt, Mycobacterium avium subsp. paratuberculosis
ugggcauggugaagcc

SEQ ID NO: 3033135 - RNA, 21 nt, Mycobacterium avium subsp. paratuberculosis
ugggcauggugaagcccagcg

SEQ ID NO: 3033136 - RNA, 20 nt, Mycobacterium avium subsp. paratuberculosis
ugggcaugucgccgaacgcc

SEQ ID NO: 3033137 - RNA, 22 nt, Mycobacterium avium subsp. paratuberculosis
ugggccaccacguacuccugcg

SEQ ID NO: 3033138 - RNA, 21 nt, Mycobacterium avium subsp. paratuberculosis
ugggccacgauccgcgcggcc

SEQ ID NO: 3033139 - RNA, 14 nt, Mycobacterium avium subsp. paratuberculosis
ugggccagcagcgu

SEQ ID NO: 3033140 - RNA, 23 nt, Mycobacterium avium subsp. paratuberculosis
ugggccagcggcgccgggucacc

SEQ ID NO: 3033141 - RNA, 21 nt, Mycobacterium avium subsp. paratuberculosis
ugggccaggaucucgucggga

SEQ ID NO: 3033142 - RNA, 23 nt, Mycobacterium avium subsp. paratuberculosis
ugggccaggccucccacagcgga

SEQ ID NO: 3033143 - RNA, 17 nt, Mycobacterium avium subsp. paratuberculosis
ugggccaucccggggac

SEQ ID NO: 3033144 - RNA, 18 nt, Mycobacterium avium subsp. paratuberculosis
ugggccaucggcagaccc

SEQ ID NO: 3033145 - RNA, 21 nt, Mycobacterium avium subsp. paratuberculosis
ugggccaucggcagacccagc

SEQ ID NO: 3033146 - RNA, 16 nt, Mycobacterium avium subsp. paratuberculosis
ugggcccgccgucgac

SEQ ID NO: 3033147 - RNA, 20 nt, Mycobacterium avium subsp. paratuberculosis
ugggcccgccgucgaccacg

SEQ ID NO: 3033148 - RNA, 16 nt, Mycobacterium avium subsp. paratuberculosis
ugggccgcaccuggca

SEQ ID NO: 3033149 - RNA, 15 nt, Mycobacterium avium subsp. paratuberculosis
ugggccgcagcagcg

SEQ ID NO: 3033150 - RNA, 16 nt, Mycobacterium avium subsp. paratuberculosis
ugggccgcagcgcggc

SEQ ID NO: 3033151 - RNA, 17 nt, Mycobacterium avium subsp. paratuberculosis
ugggccgcagcgcggcg

SEQ ID NO: 3033152 - RNA, 20 nt, Mycobacterium avium subsp. paratuberculosis
ugggccgcagcgcggcgaca

SEQ ID NO: 3033153 - RNA, 19 nt, Mycobacterium avium subsp. paratuberculosis
ugggccgccgcggcggcaa

SEQ ID NO: 3033154 - RNA, 14 nt, Mycobacterium avium subsp. paratuberculosis
ugggccgccggccg

SEQ ID NO: 3033155 - RNA, 15 nt, Mycobacterium avium subsp. paratuberculosis
ugggccgccggccgc

SEQ ID NO: 3033156 - RNA, 12 nt, Mycobacterium avium subsp. paratuberculosis
ugggccgccguc

SEQ ID NO: 3033157 - RNA, 19 nt, Mycobacterium avium subsp. paratuberculosis
ugggccgccgucgccacca

SEQ ID NO: 3033158 - RNA, 22 nt, Mycobacterium avium subsp. paratuberculosis
ugggccgccgucgccaccaccg

SEQ ID NO: 3033159 - RNA, 22 nt, Mycobacterium avium subsp. paratuberculosis
ugggccggcgcccgucacgcug

SEQ ID NO: 3033160 - RNA, 22 nt, Mycobacterium avium subsp. paratuberculosis
ugggccggucggucggccgcac

SEQ ID NO: 3033161 - RNA, 14 nt, Mycobacterium avium subsp. paratuberculosis
ugggccggugcagc

SEQ ID NO: 3033162 - RNA, 23 nt, Mycobacterium avium subsp. paratuberculosis
ugggccgucaggagugcucggcg

SEQ ID NO: 3033163 - RNA, 14 nt, Mycobacterium avium subsp. paratuberculosis
ugggccgucgcccg

SEQ ID NO: 3033164 - RNA, 14 nt, Mycobacterium avium subsp. paratuberculosis
ugggccucguccag

SEQ ID NO: 3033165 - RNA, 22 nt, Mycobacterium avium subsp. paratuberculosis
ugggcgaacagcagcacccggg

SEQ ID NO: 3033166 - RNA, 23 nt, Mycobacterium avium subsp. paratuberculosis
ugggcgaacagcagcacccgggu

SEQ ID NO: 3033167 - RNA, 16 nt, Mycobacterium avium subsp. paratuberculosis
ugggcgaacgaggccg

SEQ ID NO: 3033168 - RNA, 19 nt, Mycobacterium avium subsp. paratuberculosis
ugggcgaaucugucgaugg

SEQ ID NO: 3033169 - RNA, 22 nt, Mycobacterium avium subsp. paratuberculosis
ugggcgaccacguccagcuggg

SEQ ID NO: 3033170 - RNA, 21 nt, Mycobacterium avium subsp. paratuberculosis
ugggcgaccagauaggccagc

SEQ ID NO: 3033171 - RNA, 12 nt, Mycobacterium avium subsp. paratuberculosis
ugggcgacgucg

SEQ ID NO: 3033172 - RNA, 23 nt, Mycobacterium avium subsp. paratuberculosis
ugggcgacgucgucgcccacccg

SEQ ID NO: 3033173 - RNA, 24 nt, Mycobacterium avium subsp. paratuberculosis
ugggcgauccgcaggccgucgccg

SEQ ID NO: 3033174 - RNA, 14 nt, Mycobacterium avium subsp. paratuberculosis
ugggcgcagggccg

SEQ ID NO: 3033175 - RNA, 15 nt, Mycobacterium avium subsp. paratuberculosis
ugggcgcagggccgc

SEQ ID NO: 3033176 - RNA, 14 nt, Mycobacterium avium subsp. paratuberculosis
ugggcgccccuggc

SEQ ID NO: 3033177 - RNA, 15 nt, Mycobacterium avium subsp. paratuberculosis
ugggcgcccgcggcg

SEQ ID NO: 3033178 - RNA, 16 nt, Mycobacterium avium subsp. paratuberculosis
uggcgcaccgcggccu

SEQ ID NO: 3033179 - RNA, 17 nt, Mycobacterium avium subsp. paratuberculosis
uggcgcaccgcggccuc

SEQ ID NO: 3033180 - RNA, 13 nt, Mycobacterium avium subsp. paratuberculosis
uggcgcaccggga

SEQ ID NO: 3033181 - RNA, 15 nt, Mycobacterium avium subsp. paratuberculosis
uggcgcaccgggacg

SEQ ID NO: 3033182 - RNA, 22 nt, Mycobacterium avium subsp. paratuberculosis
uggcgcagaacaccacggugua

SEQ ID NO: 3033183 - RNA, 18 nt, Mycobacterium avium subsp. paratuberculosis
uggcgcagcaccgacucc

SEQ ID NO: 3033184 - RNA, 15 nt, Mycobacterium avium subsp. paratuberculosis
uggcgcagccgguca

SEQ ID NO: 3033185 - RNA, 19 nt, Mycobacterium avium subsp. paratuberculosis
uggcgcaguuaccggcgua

SEQ ID NO: 3033186 - RNA, 23 nt, Mycobacterium avium subsp. paratuberculosis
uggcgccacagccggggaucgcg

SEQ ID NO: 3033187 - RNA, 13 nt, Mycobacterium avium subsp. paratuberculosis
uggcgccaccucc

SEQ ID NO: 3033188 - RNA, 16 nt, Mycobacterium avium subsp. paratuberculosis
uggcgccacugccgcc

SEQ ID NO: 3033189 - RNA, 22 nt, Mycobacterium avium subsp. paratuberculosis
uggcgccacugccgccgcccag

SEQ ID NO: 3033190 - RNA, 14 nt, Mycobacterium avium subsp. paratuberculosis
uggcgcccagcgag

SEQ ID NO: 3033191 - RNA, 19 nt, Mycobacterium avium subsp. paratuberculosis
uggcgcccagcgagcugcc

SEQ ID NO: 3033192 - RNA, 21 nt, Mycobacterium avium subsp. paratuberculosis
uggcgcccagcgucucggcgg

SEQ ID NO: 3033193 - RNA, 12 nt, Mycobacterium avium subsp. paratuberculosis
uggcgcccggca

SEQ ID NO: 3033194 - RNA, 14 nt, Mycobacterium avium subsp. paratuberculosis
uggcgcccggcagc

SEQ ID NO: 3033195 - RNA, 18 nt, Mycobacterium avium subsp. paratuberculosis
uggcgcccggcagccgcu

SEQ ID NO: 3033196 - RNA, 21 nt, Mycobacterium avium subsp. paratuberculosis
uggcgcccuugccgaugccgg

SEQ ID NO: 3033197 - RNA, 15 nt, Mycobacterium avium subsp. paratuberculosis
uggcgcccuuggccu

SEQ ID NO: 3033198 - RNA, 17 nt, Mycobacterium avium subsp. paratuberculosis
uggcgcccuuggccucc

SEQ ID NO: 3033199 - RNA, 15 nt, Mycobacterium avium subsp. paratuberculosis
uggcgccgaacagau

SEQ ID NO: 3033200 - RNA, 14 nt, Mycobacterium avium subsp. paratuberculosis
uggcgccgaaugcc

SEQ ID NO: 3033201 - RNA, 17 nt, Mycobacterium avium subsp. paratuberculosis
uggcgccgacgucaggg

SEQ ID NO: 3033202 - RNA, 12 nt, Mycobacterium avium subsp. paratuberculosis
uggcgccgaucg

SEQ ID NO: 3033203 - RNA, 13 nt, Mycobacterium avium subsp. paratuberculosis
uggcgccgcgguc

SEQ ID NO: 3033204 - RNA, 20 nt, Mycobacterium avium subsp. paratuberculosis
uggcgccggcaucgaccgcc

SEQ ID NO: 3033205 - RNA, 13 nt, Mycobacterium avium subsp. paratuberculosis
uggcgccggccag

SEQ ID NO: 3033206 - RNA, 15 nt, Mycobacterium avium subsp. paratuberculosis
uggcgccggccagca

SEQ ID NO: 3033207 - RNA, 22 nt, Mycobacterium avium subsp. paratuberculosis
uggcgccggcgcgcgagcguca

SEQ ID NO: 3033208 - RNA, 16 nt, Mycobacterium avium subsp. paratuberculosis
uggcgccggggcgggc

SEQ ID NO: 3033209 - RNA, 20 nt, Mycobacterium avium subsp. paratuberculosis
uggcgccggucgacgcgggg

SEQ ID NO: 3033210 - RNA, 21 nt, Mycobacterium avium subsp. paratuberculosis
uggcgccggucgacgcggggc

SEQ ID NO: 3033211 - RNA, 17 nt, Mycobacterium avium subsp. paratuberculosis
uggcgccggucggugcg

SEQ ID NO: 3033212 - RNA, 14 nt, Mycobacterium avium subsp. paratuberculosis
uggcgccggugaag

SEQ ID NO: 3033213 - RNA, 22 nt, Mycobacterium avium subsp. paratuberculosis
uggcgccgguuucgucggucug

SEQ ID NO: 3033214 - RNA, 15 nt, Mycobacterium avium subsp. paratuberculosis
uggcgccguccgcgg

SEQ ID NO: 3033215 - RNA, 14 nt, Mycobacterium avium subsp. paratuberculosis
uggcgccgucgagg

SEQ ID NO: 3033216 - RNA, 17 nt, Mycobacterium avium subsp. paratuberculosis
uggcgccuccgcccggg

SEQ ID NO: 3033217 - RNA, 17 nt, Mycobacterium avium subsp. paratuberculosis
uggcgcgaaucccggcc

SEQ ID NO: 3033218 - RNA, 18 nt, Mycobacterium avium subsp. paratuberculosis
uggcgcgaaucccggccu

SEQ ID NO: 3033219 - RNA, 21 nt, Mycobacterium avium subsp. paratuberculosis
uggcgcgauagccggugaucg

SEQ ID NO: 3033220 - RNA, 19 nt, Mycobacterium avium subsp. paratuberculosis
uggcgcgcaccagcucggc

SEQ ID NO: 3033221 - RNA, 16 nt, Mycobacterium avium subsp. paratuberculosis
uggcgcgcagucgcag

SEQ ID NO: 3033222 - RNA, 14 nt, Mycobacterium avium subsp. paratuberculosis
uggcgcgccccggc

SEQ ID NO: 3033223 - RNA, 17 nt, Mycobacterium avium subsp. paratuberculosis
uggcgcgccccggcccg

SEQ ID NO: 3033224 - RNA, 12 nt, Mycobacterium avium subsp. paratuberculosis
uggcgcgccgca

SEQ ID NO: 3033225 - RNA, 15 nt, Mycobacterium avium subsp. paratuberculosis
uggcgcgccguaccg

SEQ ID NO: 3033226 - RNA, 13 nt, Mycobacterium avium subsp. paratuberculosis
uggcgcggccggc

SEQ ID NO: 3033227 - RNA, 19 nt, Mycobacterium avium subsp. paratuberculosis
uggcgcggcggccggccag

SEQ ID NO: 3033228 - RNA, 14 nt, Mycobacterium avium subsp. paratuberculosis
uggcgcugccgagc

SEQ ID NO: 3033229 - RNA, 16 nt, Mycobacterium avium subsp. paratuberculosis
uggcgcugccgagcac

SEQ ID NO: 3033230 - RNA, 20 nt, Mycobacterium avium subsp. paratuberculosis
uggcgcugccgagcaccucg

SEQ ID NO: 3033231 - RNA, 22 nt, Mycobacterium avium subsp. paratuberculosis
uggcgcugccgagcaccucguc

SEQ ID NO: 3033232 - RNA, 15 nt, Mycobacterium avium subsp. paratuberculosis
uggcgcugcgcgaca

SEQ ID NO: 3033233 - RNA, 23 nt, Mycobacterium avium subsp. paratuberculosis
uggcgcugcgcgacaccugcuca

SEQ ID NO: 3033234 - RNA, 12 nt, Mycobacterium avium subsp. paratuberculosis
uggcgcuggauc

SEQ ID NO: 3033235 - RNA, 15 nt, Mycobacterium avium subsp. paratuberculosis
uggcgcuggugcagc

SEQ ID NO: 3033236 - RNA, 14 nt, Mycobacterium avium subsp. paratuberculosis
uggcggauggcgcc

SEQ ID NO: 3033237 - RNA, 15 nt, Mycobacterium avium subsp. paratuberculosis
uggcggauggcgccc

SEQ ID NO: 3033238 - RNA, 13 nt, Mycobacterium avium subsp. paratuberculosis
uggcggcaagccc

SEQ ID NO: 3033239 - RNA, 23 nt, Mycobacterium avium subsp. paratuberculosis
uggcggcauccccagcugggccg

SEQ ID NO: 3033240 - RNA, 16 nt, Mycobacterium avium subsp. paratuberculosis
uggcggccaacgccuc

SEQ ID NO: 3033241 - RNA, 14 nt, Mycobacterium avium subsp. paratuberculosis
uggcggccaccauc

SEQ ID NO: 3033242 - RNA, 17 nt, Mycobacterium avium subsp. paratuberculosis
uggcggccaccaugccg

SEQ ID NO: 3033243 - RNA, 19 nt, Mycobacterium avium subsp. paratuberculosis
uggcggccaccaugccggc

SEQ ID NO: 3033244 - RNA, 20 nt, Mycobacterium avium subsp. paratuberculosis
uggcggccaccaugccggcg

SEQ ID NO: 3033245 - RNA, 22 nt, Mycobacterium avium subsp. paratuberculosis
uggcggccacgacggcgcuggc

SEQ ID NO: 3033246 - RNA, 20 nt, Mycobacterium avium subsp. paratuberculosis
uggcggccacgaucgcgauc

SEQ ID NO: 3033247 - RNA, 23 nt, Mycobacterium avium subsp. paratuberculosis
uggcggccacgaucgcgaucgcc

SEQ ID NO: 3033248 - RNA, 15 nt, Mycobacterium avium subsp. paratuberculosis
uggcggccagcgccu

SEQ ID NO: 3033249 - RNA, 18 nt, Mycobacterium avium subsp. paratuberculosis
uggcggccagcgcgccgc

SEQ ID NO: 3033250 - RNA, 16 nt, Mycobacterium avium subsp. paratuberculosis
uggcggccaggccggc

SEQ ID NO: 3033251 - RNA, 20 nt, Mycobacterium avium subsp. paratuberculosis
uggcggccaggccggcgacg

SEQ ID NO: 3033252 - RNA, 22 nt, Mycobacterium avium subsp. paratuberculosis
uggcggccaggccggcgacgau

SEQ ID NO: 3033253 - RNA, 17 nt, Mycobacterium avium subsp. paratuberculosis
uggcggcccagaucgcg

SEQ ID NO: 3033254 - RNA, 20 nt, Mycobacterium avium subsp. paratuberculosis
uggcggcccagaucgcgguc

SEQ ID NO: 3033255 - RNA, 14 nt, Mycobacterium avium subsp. paratuberculosis
uggcggcccgacca

SEQ ID NO: 3033256 - RNA, 16 nt, Mycobacterium avium subsp. paratuberculosis
uggcggcccgcgccgg

SEQ ID NO: 3033257 - RNA, 14 nt, Mycobacterium avium subsp. paratuberculosis
uggcggccgggucg

SEQ ID NO: 3033258 - RNA, 17 nt, Mycobacterium avium subsp. paratuberculosis
uggcggccgggucgagc

SEQ ID NO: 3033259 - RNA, 20 nt, Mycobacterium avium subsp. paratuberculosis
uggcggcgaacgcgcggucg

SEQ ID NO: 3033260 - RNA, 15 nt, Mycobacterium avium subsp. paratuberculosis
uggcggcgacaucga

SEQ ID NO: 3033261 - RNA, 14 nt, Mycobacterium avium subsp. paratuberculosis
uggcggcgacccgg

SEQ ID NO: 3033262 - RNA, 17 nt, Mycobacterium avium subsp. paratuberculosis
uggcggcgaucaccgcc

SEQ ID NO: 3033263 - RNA, 22 nt, Mycobacterium avium subsp. paratuberculosis
uggccucccgguagaucgccgg

SEQ ID NO: 3033264 - RNA, 20 nt, Mycobacterium avium subsp. paratuberculosis
uggccuccgacccguccagc

SEQ ID NO: 3033265 - RNA, 17 nt, Mycobacterium avium subsp. paratuberculosis
uggccuccucggugacc

SEQ ID NO: 3033266 - RNA, 19 nt, Mycobacterium avium subsp. paratuberculosis
uggccucgagugccugcgc

SEQ ID NO: 3033267 - RNA, 21 nt, Mycobacterium avium subsp. paratuberculosis
uggccucgagugccugcgccc

SEQ ID NO: 3033268 - RNA, 18 nt, Mycobacterium avium subsp. paratuberculosis
uggccucgcgcaaugccg

SEQ ID NO: 3033269 - RNA, 22 nt, Mycobacterium avium subsp. paratuberculosis
uggccucgcgcaaugccgccgc

SEQ ID NO: 3033270 - RNA, 17 nt, Mycobacterium avium subsp. paratuberculosis
uggccucggcgcgggcg

SEQ ID NO: 3033271 - RNA, 17 nt, Mycobacterium avium subsp. paratuberculosis
uggccucgggcgacgac

SEQ ID NO: 3033272 - RNA, 14 nt, Mycobacterium avium subsp. paratuberculosis
uggccucgucgcgg

SEQ ID NO: 3033273 - RNA, 15 nt, Mycobacterium avium subsp. paratuberculosis
uggccucgucggcgc

SEQ ID NO: 3033274 - RNA, 21 nt, Mycobacterium avium subsp. paratuberculosis
uggccucgucggcgccgucgc

SEQ ID NO: 3033275 - RNA, 14 nt, Mycobacterium avium subsp. paratuberculosis
uggccugaaccagc

SEQ ID NO: 3033276 - RNA, 18 nt, Mycobacterium avium subsp. paratuberculosis
uggccugaaccagcucgu

SEQ ID NO: 3033277 - RNA, 21 nt, Mycobacterium avium subsp. paratuberculosis
uggccugaaccagcucgugca

SEQ ID NO: 3033278 - RNA, 13 nt, Mycobacterium avium subsp. paratuberculosis
uggccugcacggu

SEQ ID NO: 3033279 - RNA, 20 nt, Mycobacterium avium subsp. paratuberculosis
uggccugcacggugcgccgg

SEQ ID NO: 3033280 - RNA, 20 nt, Mycobacterium avium subsp. paratuberculosis
uggccugcccggcggugccg

SEQ ID NO: 3033281 - RNA, 20 nt, Mycobacterium avium subsp. paratuberculosis
uggccugcuguuccucgaac

SEQ ID NO: 3033282 - RNA, 15 nt, Mycobacterium avium subsp. paratuberculosis
uggccugcuugggca

SEQ ID NO: 3033283 - RNA, 16 nt, Mycobacterium avium subsp. paratuberculosis
uggccugggccucguc

SEQ ID NO: 3033284 - RNA, 18 nt, Mycobacterium avium subsp. paratuberculosis
uggccugggccucgucca

SEQ ID NO: 3033285 - RNA, 17 nt, Mycobacterium avium subsp. paratuberculosis
uggccuggucgaacagc

SEQ ID NO: 3033286 - RNA, 15 nt, Mycobacterium avium subsp. paratuberculosis
uggccuggucggcga

SEQ ID NO: 3033287 - RNA, 16 nt, Mycobacterium avium subsp. paratuberculosis
uggccuggucggcgac

SEQ ID NO: 3033288 - RNA, 14 nt, Mycobacterium avium subsp. paratuberculosis
uggccugguggccc

SEQ ID NO: 3033289 - RNA, 17 nt, Mycobacterium avium subsp. paratuberculosis
uggccugguggcccagg

SEQ ID NO: 3033290 - RNA, 18 nt, Mycobacterium avium subsp. paratuberculosis
uggccugguggcccaggc

SEQ ID NO: 3033291 - RNA, 13 nt, Mycobacterium avium subsp. paratuberculosis
uggccuucaucac

SEQ ID NO: 3033292 - RNA, 17 nt, Mycobacterium avium subsp. paratuberculosis
uggccuugcugaucccc

SEQ ID NO: 3033293 - RNA, 23 nt, Mycobacterium avium subsp. paratuberculosis
uggccuugcugauccccagcggc

SEQ ID NO: 3033294 - RNA, 14 nt, Mycobacterium avium subsp. paratuberculosis
uggccuuggccacc

SEQ ID NO: 3033295 - RNA, 15 nt, Mycobacterium avium subsp. paratuberculosis
uggccuuggccacca

SEQ ID NO: 3033296 - RNA, 20 nt, Mycobacterium avium subsp. paratuberculosis
uggcgaacacgucggccagc

SEQ ID NO: 3033297 - RNA, 15 nt, Mycobacterium avium subsp. paratuberculosis
uggcgaacagcgggu

SEQ ID NO: 3033298 - RNA, 18 nt, Mycobacterium avium subsp. paratuberculosis
uggcgaaccgcggcggca

SEQ ID NO: 3033299 - RNA, 20 nt, Mycobacterium avium subsp. paratuberculosis
uggcgaaccgcggcggcagc

SEQ ID NO: 3033300 - RNA, 15 nt, Mycobacterium avium subsp. paratuberculosis
uggcgaacgcgaccu

SEQ ID NO: 3033301 - RNA, 18 nt, Mycobacterium avium subsp. paratuberculosis
uggcgaacgcgaccugca

SEQ ID NO: 3033302 - RNA, 21 nt, Mycobacterium avium subsp. paratuberculosis
uggcgaacucgacggagugcg

SEQ ID NO: 3033303 - RNA, 17 nt, Mycobacterium avium subsp. paratuberculosis
uggcgaagcccaugccg

SEQ ID NO: 3033304 - RNA, 19 nt, Mycobacterium avium subsp. paratuberculosis
uggcgaauuccccguaguc

SEQ ID NO: 3033305 - RNA, 20 nt, Mycobacterium avium subsp. paratuberculosis
uggcgacaggaaccuggucg

SEQ ID NO: 3033306 - RNA, 18 nt, Mycobacterium avium subsp. paratuberculosis
uggcgacaucgccgcggc

SEQ ID NO: 3033307 - RNA, 20 nt, Mycobacterium avium subsp. paratuberculosis
uggcgacaucgccgcggccg

SEQ ID NO: 3033308 - RNA, 12 nt, Mycobacterium avium subsp. paratuberculosis
uggcgaccaccg

SEQ ID NO: 3033309 - RNA, 17 nt, Mycobacterium avium subsp. paratuberculosis
uggcgaccaccgacccc

SEQ ID NO: 3033310 - RNA, 18 nt, Mycobacterium avium subsp. paratuberculosis
uggcgaccaucagccugc

SEQ ID NO: 3033311 - RNA, 16 nt, Mycobacterium avium subsp. paratuberculosis
uggcgaccgcgacggu

SEQ ID NO: 3033312 - RNA, 23 nt, Mycobacterium avium subsp. paratuberculosis
uggcgaccgcgacgguggacccg

SEQ ID NO: 3033313 - RNA, 14 nt, Mycobacterium avium subsp. paratuberculosis
uggcgaccgcgcag

SEQ ID NO: 3033314 - RNA, 18 nt, Mycobacterium avium subsp. paratuberculosis
uggcgaccgcgcaggcgg

SEQ ID NO: 3033315 - RNA, 23 nt, Mycobacterium avium subsp. paratuberculosis
uggcgaccgcgcaggcggcgacg

SEQ ID NO: 3033316 - RNA, 22 nt, Mycobacterium avium subsp. paratuberculosis
uggcgaccgcggccgcgacggu

SEQ ID NO: 3033317 - RNA, 17 nt, Mycobacterium avium subsp. paratuberculosis
uggcgaccgguccgcgg

SEQ ID NO: 3033318 - RNA, 16 nt, Mycobacterium avium subsp. paratuberculosis
uggcgacgaagucgac

SEQ ID NO: 3033319 - RNA, 15 nt, Mycobacterium avium subsp. paratuberculosis
uggcgacgacgccga

SEQ ID NO: 3033320 - RNA, 16 nt, Mycobacterium avium subsp. paratuberculosis
uggcgacggcgacgac

SEQ ID NO: 3033321 - RNA, 18 nt, Mycobacterium avium subsp. paratuberculosis
uggcgacggcgacgaccg

SEQ ID NO: 3033322 - RNA, 20 nt, Mycobacterium avium subsp. paratuberculosis
uggcgacggcgacgaccguc

SEQ ID NO: 3033323 - RNA, 22 nt, Mycobacterium avium subsp. paratuberculosis
uggcgacggugcaugcgcuggc

SEQ ID NO: 3033324 - RNA, 22 nt, Mycobacterium avium subsp. paratuberculosis
uggcgagcugaccggccaccuc

SEQ ID NO: 3033325 - RNA, 19 nt, Mycobacterium avium subsp. paratuberculosis
uggcgaggaaguccggcgc

SEQ ID NO: 3033326 - RNA, 19 nt, Mycobacterium avium subsp. paratuberculosis
uggcgaucaccccggcgac

SEQ ID NO: 3033327 - RNA, 20 nt, Mycobacterium avium subsp. paratuberculosis
uggcgaucaccccggcgacg

SEQ ID NO: 3033328 - RNA, 22 nt, Mycobacterium avium subsp. paratuberculosis
uggcgaucaccccggcgacggc

SEQ ID NO: 3033329 - RNA, 13 nt, Mycobacterium avium subsp. paratuberculosis
uggcgaucaccuu

SEQ ID NO: 3033330 - RNA, 16 nt, Mycobacterium avium subsp. paratuberculosis
uggcgaucagggcggc

SEQ ID NO: 3033331 - RNA, 17 nt, Mycobacterium avium subsp. paratuberculosis
uggcgaucagggcggcg

SEQ ID NO: 3033332 - RNA, 19 nt, Mycobacterium avium subsp. paratuberculosis
uggcgaucagggcggcgcc

SEQ ID NO: 3033333 - RNA, 12 nt, Mycobacterium avium subsp. paratuberculosis
uggcgaucauca

SEQ ID NO: 3033334 - RNA, 16 nt, Mycobacterium avium subsp. paratuberculosis
uggcgaucaucgucgu

SEQ ID NO: 3033335 - RNA, 18 nt, Mycobacterium avium subsp. paratuberculosis
uggcgaucgaugcccagc

SEQ ID NO: 3033336 - RNA, 12 nt, Mycobacterium avium subsp. paratuberculosis
uggcgaucucga

SEQ ID NO: 3033337 - RNA, 22 nt, Mycobacterium avium subsp. paratuberculosis
uggcgaucucgauggccucguc

SEQ ID NO: 3033338 - RNA, 22 nt, Mycobacterium avium subsp. paratuberculosis
uggcgaugacgucgucgcggcg

SEQ ID NO: 3033339 - RNA, 15 nt, Mycobacterium avium subsp. paratuberculosis
uggcgaugaucaaca

SEQ ID NO: 3033340 - RNA, 23 nt, Mycobacterium avium subsp. paratuberculosis
uggcgaugaucaccucggugaug

SEQ ID NO: 3033341 - RNA, 16 nt, Mycobacterium avium subsp. paratuberculosis
uggcgauggccugcuc

SEQ ID NO: 3033342 - RNA, 20 nt, Mycobacterium avium subsp. paratuberculosis
uggcgauggccugcucgcga

SEQ ID NO: 3033343 - RNA, 22 nt, Mycobacterium avium subsp. paratuberculosis
uggcgaugggcaauaccggcag

SEQ ID NO: 3033344 - RNA, 15 nt, Mycobacterium avium subsp. paratuberculosis
uggcgauggugccga

SEQ ID NO: 3033345 - RNA, 14 nt, Mycobacterium avium subsp. paratuberculosis
uggcgcacaacccg

SEQ ID NO: 3033346 - RNA, 14 nt, Mycobacterium avium subsp. paratuberculosis
uggcgcaccgcggc

SEQ ID NO: 3033347 - RNA, 22 nt, Mycobacterium avium subsp. paratuberculosis
uggccgccagcaccucgcggca

SEQ ID NO: 3033348 - RNA, 23 nt, Mycobacterium avium subsp. paratuberculosis
uggccgccagcaccucgcggcag

SEQ ID NO: 3033349 - RNA, 22 nt, Mycobacterium avium subsp. paratuberculosis
uggccgccaggaucugcucggc

SEQ ID NO: 3033350 - RNA, 14 nt, Mycobacterium avium subsp. paratuberculosis
uggccgcccaccac

SEQ ID NO: 3033351 - RNA, 21 nt, Mycobacterium avium subsp. paratuberculosis
uggccgcccgcagguucaugu

SEQ ID NO: 3033352 - RNA, 16 nt, Mycobacterium avium subsp. paratuberculosis
uggccgcccucgcugc

SEQ ID NO: 3033353 - RNA, 17 nt, Mycobacterium avium subsp. paratuberculosis
uggccgcccucgcugcc

SEQ ID NO: 3033354 - RNA, 18 nt, Mycobacterium avium subsp. paratuberculosis
uggccgcccucgcugccg

SEQ ID NO: 3033355 - RNA, 21 nt, Mycobacterium avium subsp. paratuberculosis
uggccgcccucgcugccgccc

SEQ ID NO: 3033356 - RNA, 12 nt, Mycobacterium avium subsp. paratuberculosis
uggccgccgccu

SEQ ID NO: 3033357 - RNA, 20 nt, Mycobacterium avium subsp. paratuberculosis
uggccgccgcuagucgccca

SEQ ID NO: 3033358 - RNA, 14 nt, Mycobacterium avium subsp. paratuberculosis
uggccgccggccgc

SEQ ID NO: 3033359 - RNA, 18 nt, Mycobacterium avium subsp. paratuberculosis
uggccgcgaacggcccgc

SEQ ID NO: 3033360 - RNA, 13 nt, Mycobacterium avium subsp. paratuberculosis
uggccgcgacgcc

SEQ ID NO: 3033361 - RNA, 16 nt, Mycobacterium avium subsp. paratuberculosis
uggccgcgacucugca

SEQ ID NO: 3033362 - RNA, 12 nt, Mycobacterium avium subsp. paratuberculosis
uggccgcgcagc

SEQ ID NO: 3033363 - RNA, 16 nt, Mycobacterium avium subsp. paratuberculosis
uggccgcgcagcgugu

SEQ ID NO: 3033364 - RNA, 21 nt, Mycobacterium avium subsp. paratuberculosis
uggccgcgcagcgugucgggg

SEQ ID NO: 3033365 - RNA, 13 nt, Mycobacterium avium subsp. paratuberculosis
uggccgcgcagcu

SEQ ID NO: 3033366 - RNA, 18 nt, Mycobacterium avium subsp. paratuberculosis
uggccgcgcagcucgggg

SEQ ID NO: 3033367 - RNA, 18 nt, Mycobacterium avium subsp. paratuberculosis
uggccgcgcccuucuucg

SEQ ID NO: 3033368 - RNA, 14 nt, Mycobacterium avium subsp. paratuberculosis
uggccgcgccgccg

SEQ ID NO: 3033369 - RNA, 17 nt, Mycobacterium avium subsp. paratuberculosis
uggccgcgccgccgccc

SEQ ID NO: 3033370 - RNA, 21 nt, Mycobacterium avium subsp. paratuberculosis
uggccgcgccgccgcccuggc

SEQ ID NO: 3033371 - RNA, 23 nt, Mycobacterium avium subsp. paratuberculosis
uggccgcgccgccgcccuggccc

SEQ ID NO: 3033372 - RNA, 17 nt, Mycobacterium avium subsp. paratuberculosis
uggccgcgccguagcgg

SEQ ID NO: 3033373 - RNA, 23 nt, Mycobacterium avium subsp. paratuberculosis
uggccgcggaguaggcgccgccg

SEQ ID NO: 3033374 - RNA, 14 nt, Mycobacterium avium subsp. paratuberculosis
uggccgcggccagc

SEQ ID NO: 3033375 - RNA, 18 nt, Mycobacterium avium subsp. paratuberculosis
uggccgcggccagcugcc

SEQ ID NO: 3033376 - RNA, 12 nt, Mycobacterium avium subsp. paratuberculosis
uggccgcggccg

SEQ ID NO: 3033377 - RNA, 17 nt, Mycobacterium avium subsp. paratuberculosis
uggccgcggccgccucc

SEQ ID NO: 3033378 - RNA, 12 nt, Mycobacterium avium subsp. paratuberculosis
uggccgcggccu

SEQ ID NO: 3033379 - RNA, 13 nt, Mycobacterium avium subsp. paratuberculosis
uggccgcggccuu

SEQ ID NO: 3033380 - RNA, 15 nt, Mycobacterium avium subsp. paratuberculosis
uggccgcgucgacca

SEQ ID NO: 3033381 - RNA, 17 nt, Mycobacterium avium subsp. paratuberculosis
uggccgcgucgaccagc

SEQ ID NO: 3033382 - RNA, 18 nt, Mycobacterium avium subsp. paratuberculosis
uggccgcgucgaccagcc

SEQ ID NO: 3033383 - RNA, 14 nt, Mycobacterium avium subsp. paratuberculosis
uggccgcgugcaac

SEQ ID NO: 3033384 - RNA, 18 nt, Mycobacterium avium subsp. paratuberculosis
uggccgcuuuccaccccg

SEQ ID NO: 3033385 - RNA, 14 nt, Mycobacterium avium subsp. paratuberculosis
uggccggaaaggcg

SEQ ID NO: 3033386 - RNA, 14 nt, Mycobacterium avium subsp. paratuberculosis
uggccggacggguc

SEQ ID NO: 3033387 - RNA, 17 nt, Mycobacterium avium subsp. paratuberculosis
uggccggacgggucgac

SEQ ID NO: 3033388 - RNA, 21 nt, Mycobacterium avium subsp. paratuberculosis
uggccggacgggucgaccgcc

SEQ ID NO: 3033389 - RNA, 14 nt, Mycobacterium avium subsp. paratuberculosis
uggccggccaccag

SEQ ID NO: 3033390 - RNA, 12 nt, Mycobacterium avium subsp. paratuberculosis
uggccggccagc

SEQ ID NO: 3033391 - RNA, 17 nt, Mycobacterium avium subsp. paratuberculosis
uggccggccaucuucag

SEQ ID NO: 3033392 - RNA, 12 nt, Mycobacterium avium subsp. paratuberculosis
uggccggcccgc

SEQ ID NO: 3033393 - RNA, 17 nt, Mycobacterium avium subsp. paratuberculosis
uggccggcccgcccgua

SEQ ID NO: 3033394 - RNA, 12 nt, Mycobacterium avium subsp. paratuberculosis
uggccggccggg

SEQ ID NO: 3033395 - RNA, 11 nt, Mycobacterium avium subsp. paratuberculosis
uggccggcgaa

SEQ ID NO: 3033396 - RNA, 18 nt, Mycobacterium avium subsp. paratuberculosis
uggccggcgaaccgccgc

SEQ ID NO: 3033397 - RNA, 18 nt, Mycobacterium avium subsp. paratuberculosis
uggccggcgauggcgcgg

SEQ ID NO: 3033398 - RNA, 20 nt, Mycobacterium avium subsp. paratuberculosis
uggccgggaaguuggccucc

SEQ ID NO: 3033399 - RNA, 21 nt, Mycobacterium avium subsp. paratuberculosis
uggccgggaaguuggccuccc

SEQ ID NO: 3033400 - RNA, 18 nt, Mycobacterium avium subsp. paratuberculosis
uggccgggaugccagucc

SEQ ID NO: 3033401 - RNA, 21 nt, Mycobacterium avium subsp. paratuberculosis
uggccgggcucgagggcggcg

SEQ ID NO: 3033402 - RNA, 15 nt, Mycobacterium avium subsp. paratuberculosis
uggccgggucgccgu

SEQ ID NO: 3033403 - RNA, 16 nt, Mycobacterium avium subsp. paratuberculosis
uggccgggucgccguc

SEQ ID NO: 3033404 - RNA, 17 nt, Mycobacterium avium subsp. paratuberculosis
uggccgggucgccgucg

SEQ ID NO: 3033405 - RNA, 15 nt, Mycobacterium avium subsp. paratuberculosis
uggccggguuccggu

SEQ ID NO: 3033406 - RNA, 17 nt, Mycobacterium avium subsp. paratuberculosis
uggccggguuggcaucc

SEQ ID NO: 3033407 - RNA, 18 nt, Mycobacterium avium subsp. paratuberculosis
uggccgguauuggccacg

SEQ ID NO: 3033408 - RNA, 19 nt, Mycobacterium avium subsp. paratuberculosis
uggccgguauuggccacgc

SEQ ID NO: 3033409 - RNA, 12 nt, Mycobacterium avium subsp. paratuberculosis
uggccggugcgc

SEQ ID NO: 3033410 - RNA, 18 nt, Mycobacterium avium subsp. paratuberculosis
uggccggugggcggcgcc

SEQ ID NO: 3033411 - RNA, 22 nt, Mycobacterium avium subsp. paratuberculosis
uggccggugggcggcgcccgac

SEQ ID NO: 3033412 - RNA, 19 nt, Mycobacterium avium subsp. paratuberculosis
uggccguccgaaucguuga

SEQ ID NO: 3033413 - RNA, 23 nt, Mycobacterium avium subsp. paratuberculosis
uggccguccggauagccgucggc

SEQ ID NO: 3033414 - RNA, 18 nt, Mycobacterium avium subsp. paratuberculosis
uggccgucgaacugcagc

SEQ ID NO: 3033415 - RNA, 13 nt, Mycobacterium avium subsp. paratuberculosis
uggccgucgccga

SEQ ID NO: 3033416 - RNA, 20 nt, Mycobacterium avium subsp. paratuberculosis
uggccgucgcguucgaccca

SEQ ID NO: 3033417 - RNA, 12 nt, Mycobacterium avium subsp. paratuberculosis
uggccgucgggu

SEQ ID NO: 3033418 - RNA, 23 nt, Mycobacterium avium subsp. paratuberculosis
uggccgucgggucggcgagcagc

SEQ ID NO: 3033419 - RNA, 18 nt, Mycobacterium avium subsp. paratuberculosis
uggccgucucgucggccg

SEQ ID NO: 3033420 - RNA, 16 nt, Mycobacterium avium subsp. paratuberculosis
uggccgugcaccgucg

SEQ ID NO: 3033421 - RNA, 19 nt, Mycobacterium avium subsp. paratuberculosis
uggccgugcaccgucgccg

SEQ ID NO: 3033422 - RNA, 16 nt, Mycobacterium avium subsp. paratuberculosis
uggccgugcagggggc

SEQ ID NO: 3033423 - RNA, 14 nt, Mycobacterium avium subsp. paratuberculosis
uggccguggucggc

SEQ ID NO: 3033424 - RNA, 21 nt, Mycobacterium avium subsp. paratuberculosis
uggccgugugcgcaucggcga

SEQ ID NO: 3033425 - RNA, 22 nt, Mycobacterium avium subsp. paratuberculosis
uggccgugugcgcaucggcgac

SEQ ID NO: 3033426 - RNA, 22 nt, Mycobacterium avium subsp. paratuberculosis
uggccguucaggucgaucagcg

SEQ ID NO: 3033427 - RNA, 22 nt, Mycobacterium avium subsp. paratuberculosis
uggccucauuggccuuuugcac

SEQ ID NO: 3033428 - RNA, 15 nt, Mycobacterium avium subsp. paratuberculosis
uggccuccaccggca

SEQ ID NO: 3033429 - RNA, 19 nt, Mycobacterium avium subsp. paratuberculosis
uggccuccagguucgccgc

SEQ ID NO: 3033430 - RNA, 16 nt, Mycobacterium avium subsp. paratuberculosis
uggccuccccauccgc

SEQ ID NO: 3033431 - RNA, 19 nt, Mycobacterium avium subsp. paratuberculosis
uggccuccccauccgcggc

SEQ ID NO: 3033432 - RNA, 17 nt, Mycobacterium avium subsp. paratuberculosis
ugcaggguccgccgucg

SEQ ID NO: 3033433 - RNA, 18 nt, Mycobacterium avium subsp. paratuberculosis
ugcaggguccgccgucga

SEQ ID NO: 3033434 - RNA, 23 nt, Mycobacterium avium subsp. paratuberculosis
ugcaggucguaguaggcgccgaa

SEQ ID NO: 3033435 - RNA, 16 nt, Mycobacterium avium subsp. paratuberculosis
ugcaggugcgcgguca

SEQ ID NO: 3033436 - RNA, 16 nt, Mycobacterium avium subsp. paratuberculosis
ugcagguuccggauca

SEQ ID NO: 3033437 - RNA, 18 nt, Mycobacterium avium subsp. paratuberculosis
ugcagguugauccggauc

SEQ ID NO: 3033438 - RNA, 21 nt, Mycobacterium avium subsp. paratuberculosis
ugcaguacgcaucggcgccgg

SEQ ID NO: 3033439 - RNA, 22 nt, Mycobacterium avium subsp. paratuberculosis
ugcaguacgcaucggcgccgga

SEQ ID NO: 3033440 - RNA, 20 nt, Mycobacterium avium subsp. paratuberculosis
ugcaguagacguugccgauc

SEQ ID NO: 3033441 - RNA, 13 nt, Mycobacterium avium subsp. paratuberculosis
ugcauacagcagg

SEQ ID NO: 3033442 - RNA, 15 nt, Mycobacterium avium subsp. paratuberculosis
ugcauagcuggcgcc

SEQ ID NO: 3033443 - RNA, 16 nt, Mycobacterium avium subsp. paratuberculosis
ugcauagucggcccga

SEQ ID NO: 3033444 - RNA, 15 nt, Mycobacterium avium subsp. paratuberculosis
ugcaucauguccagg

SEQ ID NO: 3033445 - RNA, 15 nt, Mycobacterium avium subsp. paratuberculosis
ugcaucgccaccguc

SEQ ID NO: 3033446 - RNA, 18 nt, Mycobacterium avium subsp. paratuberculosis
ugcaucgcgaucgacagc

SEQ ID NO: 3033447 - RNA, 19 nt, Mycobacterium avium subsp. paratuberculosis
ugcaucgcgaucgacagcu

SEQ ID NO: 3033448 - RNA, 20 nt, Mycobacterium avium subsp. paratuberculosis
ugcaucggcaguccgcgccg

SEQ ID NO: 3033449 - RNA, 22 nt, Mycobacterium avium subsp. paratuberculosis
ugcaucggcaguccgcgccggu

SEQ ID NO: 3033450 - RNA, 15 nt, Mycobacterium avium subsp. paratuberculosis
ugcaucucgacccgg

SEQ ID NO: 3033451 - RNA, 16 nt, Mycobacterium avium subsp. paratuberculosis
ugcaucucgaccuggg

SEQ ID NO: 3033452 - RNA, 13 nt, Mycobacterium avium subsp. paratuberculosis
ugcaugccgggca

SEQ ID NO: 3033453 - RNA, 13 nt, Mycobacterium avium subsp. paratuberculosis
ugcaugcgcugcu

SEQ ID NO: 3033454 - RNA, 22 nt, Mycobacterium avium subsp. paratuberculosis
ugcaugcgcugcuuagccccuc

SEQ ID NO: 3033455 - RNA, 16 nt, Mycobacterium avium subsp. paratuberculosis
ugcauguagcggucgu

SEQ ID NO: 3033456 - RNA, 15 nt, Mycobacterium avium subsp. paratuberculosis
ugcauguagguggcg

SEQ ID NO: 3033457 - RNA, 19 nt, Mycobacterium avium subsp. paratuberculosis
ugcauguagguggcgacca

SEQ ID NO: 3033458 - RNA, 15 nt, Mycobacterium avium subsp. paratuberculosis
ugcaugugcucggcg

SEQ ID NO: 3033459 - RNA, 16 nt, Mycobacterium avium subsp. paratuberculosis
ugcauguucaaucccg

SEQ ID NO: 3033460 - RNA, 18 nt, Mycobacterium avium subsp. paratuberculosis
ugcauuucggacggcgac

SEQ ID NO: 3033461 - RNA, 21 nt, Mycobacterium avium subsp. paratuberculosis
ugccaacacggcggcgcgcac

SEQ ID NO: 3033462 - RNA, 22 nt, Mycobacterium avium subsp. paratuberculosis
ugccaagccauuucagcagcgc

SEQ ID NO: 3033463 - RNA, 21 nt, Mycobacterium avium subsp. paratuberculosis
ugccaagcguauccggccagc

SEQ ID NO: 3033464 - RNA, 12 nt, Mycobacterium avium subsp. paratuberculosis
ugccaaggucgc

SEQ ID NO: 3033465 - RNA, 13 nt, Mycobacterium avium subsp. paratuberculosis
ugccaaggucgcc

SEQ ID NO: 3033466 - RNA, 15 nt, Mycobacterium avium subsp. paratuberculosis
ugccaaggucgccgg

SEQ ID NO: 3033467 - RNA, 22 nt, Mycobacterium avium subsp. paratuberculosis
ugccacaggccgaacagcagcg

SEQ ID NO: 3033468 - RNA, 22 nt, Mycobacterium avium subsp. paratuberculosis
ugccaccaccacggccaggaag

SEQ ID NO: 3033469 - RNA, 19 nt, Mycobacterium avium subsp. paratuberculosis
ugccaccgccgauggcgac

SEQ ID NO: 3033470 - RNA, 12 nt, Mycobacterium avium subsp. paratuberculosis
ugccaccgcugg

SEQ ID NO: 3033471 - RNA, 15 nt, Mycobacterium avium subsp. paratuberculosis
ugccaccgcugggcg

SEQ ID NO: 3033472 - RNA, 21 nt, Mycobacterium avium subsp. paratuberculosis
ugccaccgcugggcggcgcgg

SEQ ID NO: 3033473 - RNA, 13 nt, Mycobacterium avium subsp. paratuberculosis
ugccacgcccacc

SEQ ID NO: 3033474 - RNA, 17 nt, Mycobacterium avium subsp. paratuberculosis
ugccacggccgcggccc

SEQ ID NO: 3033475 - RNA, 21 nt, Mycobacterium avium subsp. paratuberculosis
ugccacggcggaucaguaccg

SEQ ID NO: 3033476 - RNA, 16 nt, Mycobacterium avium subsp. paratuberculosis
ugccacguacaccggg

SEQ ID NO: 3033477 - RNA, 14 nt, Mycobacterium avium subsp. paratuberculosis
ugccacugagcgca

SEQ ID NO: 3033478 - RNA, 19 nt, Mycobacterium avium subsp. paratuberculosis
ugccacugagcgcaggccg

SEQ ID NO: 3033479 - RNA, 15 nt, Mycobacterium avium subsp. paratuberculosis
ugccagaacggcggc

SEQ ID NO: 3033480 - RNA, 20 nt, Mycobacterium avium subsp. paratuberculosis
ugccagaagaucugccggug

SEQ ID NO: 3033481 - RNA, 22 nt, Mycobacterium avium subsp. paratuberculosis
ugccagaccacaagggccaccg

SEQ ID NO: 3033482 - RNA, 23 nt, Mycobacterium avium subsp. paratuberculosis
ugccagaccacaagggccaccgg

SEQ ID NO: 3033483 - RNA, 19 nt, Mycobacterium avium subsp. paratuberculosis
ugccagacgaacgcggccg

SEQ ID NO: 3033484 - RNA, 20 nt, Mycobacterium avium subsp. paratuberculosis
ugccagacgaacgcggccgc

SEQ ID NO: 3033485 - RNA, 22 nt, Mycobacterium avium subsp. paratuberculosis
ugccagacgaacgcggccgcca

SEQ ID NO: 3033486 - RNA, 11 nt, Mycobacterium avium subsp. paratuberculosis
ugccagcagcu

SEQ ID NO: 3033487 - RNA, 14 nt, Mycobacterium avium subsp. paratuberculosis
ugccagcagguccg

SEQ ID NO: 3033488 - RNA, 21 nt, Mycobacterium avium subsp. paratuberculosis
ugccagcccguuguggcggcc

SEQ ID NO: 3033489 - RNA, 20 nt, Mycobacterium avium subsp. paratuberculosis
ugccagccggccgcugagga

SEQ ID NO: 3033490 - RNA, 14 nt, Mycobacterium avium subsp. paratuberculosis
ugccagccgggccg

SEQ ID NO: 3033491 - RNA, 15 nt, Mycobacterium avium subsp. paratuberculosis
ugccagccgggccga

SEQ ID NO: 3033492 - RNA, 19 nt, Mycobacterium avium subsp. paratuberculosis
ugccagccgggccgagcgc

SEQ ID NO: 3033493 - RNA, 16 nt, Mycobacterium avium subsp. paratuberculosis
ugccagccggugcuga

SEQ ID NO: 3033494 - RNA, 19 nt, Mycobacterium avium subsp. paratuberculosis
ugccagccggugcugaccc

SEQ ID NO: 3033495 - RNA, 15 nt, Mycobacterium avium subsp. paratuberculosis
ugccagccgugcggc

SEQ ID NO: 3033496 - RNA, 16 nt, Mycobacterium avium subsp. paratuberculosis
ugccagccgugcggcg

SEQ ID NO: 3033497 - RNA, 18 nt, Mycobacterium avium subsp. paratuberculosis
ugccagccgugcggcggc

SEQ ID NO: 3033498 - RNA, 13 nt, Mycobacterium avium subsp. paratuberculosis
ugccagcgcaccg

SEQ ID NO: 3033499 - RNA, 18 nt, Mycobacterium avium subsp. paratuberculosis
ugccagcgcaccgggccc

SEQ ID NO: 3033500 - RNA, 16 nt, Mycobacterium avium subsp. paratuberculosis
ugccagcgcccgcugc

SEQ ID NO: 3033501 - RNA, 11 nt, Mycobacterium avium subsp. paratuberculosis
ugccagcggcg

SEQ ID NO: 3033502 - RNA, 13 nt, Mycobacterium avium subsp. paratuberculosis
ugccagcggcgca

SEQ ID NO: 3033503 - RNA, 20 nt, Mycobacterium avium subsp. paratuberculosis
ugccagcuucgggcgcgcgc

SEQ ID NO: 3033504 - RNA, 17 nt, Mycobacterium avium subsp. paratuberculosis
ugccaggcgguggccga

SEQ ID NO: 3033505 - RNA, 16 nt, Mycobacterium avium subsp. paratuberculosis
ugccagggcagcgcga

SEQ ID NO: 3033506 - RNA, 23 nt, Mycobacterium avium subsp. paratuberculosis
ugccagggggaguagucggcgau

SEQ ID NO: 3033507 - RNA, 18 nt, Mycobacterium avium subsp. paratuberculosis
ugccaguaccagcggccg

SEQ ID NO: 3033508 - RNA, 20 nt, Mycobacterium avium subsp. paratuberculosis
ugccaguaccagcggccguc

SEQ ID NO: 3033509 - RNA, 15 nt, Mycobacterium avium subsp. paratuberculosis
ugccaguccugggcc

SEQ ID NO: 3033510 - RNA, 16 nt, Mycobacterium avium subsp. paratuberculosis
ugccaguccugggccg

SEQ ID NO: 3033511 - RNA, 15 nt, Mycobacterium avium subsp. paratuberculosis
ugccauagauguugg

SEQ ID NO: 3033512 - RNA, 16 nt, Mycobacterium avium subsp. paratuberculosis
ugccaucgugggcgcc

SEQ ID NO: 3033513 - RNA, 21 nt, Mycobacterium avium subsp. paratuberculosis
ugccaucgugggcgccgucgc

SEQ ID NO: 3033514 - RNA, 23 nt, Mycobacterium avium subsp. paratuberculosis
ugccauggaaaccggcgggaacu

SEQ ID NO: 3033515 - RNA, 19 nt, Mycobacterium avium subsp. paratuberculosis
ugcccaaugaucugggccg

SEQ ID NO: 3033516 - RNA, 23 nt, Mycobacterium avium subsp. paratuberculosis
ugcccaccaccaggggcagcuga

SEQ ID NO: 3033517 - RNA, 18 nt, Mycobacterium avium subsp. paratuberculosis
ugggcgcccgcggcgcgc

SEQ ID NO: 3033518 - RNA, 20 nt, Mycobacterium avium subsp. paratuberculosis
ugggcgccgaguccgggccg

SEQ ID NO: 3033519 - RNA, 17 nt, Mycobacterium avium subsp. paratuberculosis
ugggcgccgccggcguc

SEQ ID NO: 3033520 - RNA, 14 nt, Mycobacterium avium subsp. paratuberculosis
ugggcgccugcggu

SEQ ID NO: 3033521 - RNA, 17 nt, Mycobacterium avium subsp. paratuberculosis
ugggcgcgaucaggcug

SEQ ID NO: 3033522 - RNA, 19 nt, Mycobacterium avium subsp. paratuberculosis
ugggcgcgaucggcagguc

SEQ ID NO: 3033523 - RNA, 14 nt, Mycobacterium avium subsp. paratuberculosis
ugggcgcgggccgc

SEQ ID NO: 3033524 - RNA, 17 nt, Mycobacterium avium subsp. paratuberculosis
ugggcgcgggccgcguc

SEQ ID NO: 3033525 - RNA, 14 nt, Mycobacterium avium subsp. paratuberculosis
ugggcgcugguccu

SEQ ID NO: 3033526 - RNA, 23 nt, Mycobacterium avium subsp. paratuberculosis
ugggcggauuggugccgaucacc

SEQ ID NO: 3033527 - RNA, 14 nt, Mycobacterium avium subsp. paratuberculosis
ugggcggcacaccg

SEQ ID NO: 3033528 - RNA, 14 nt, Mycobacterium avium subsp. paratuberculosis
ugggcggcaccacc

SEQ ID NO: 3033529 - RNA, 19 nt, Mycobacterium avium subsp. paratuberculosis
ugggcggcaccacccgguc

SEQ ID NO: 3033530 - RNA, 22 nt, Mycobacterium avium subsp. paratuberculosis
ugggcggccaccgcgccccggc

SEQ ID NO: 3033531 - RNA, 16 nt, Mycobacterium avium subsp. paratuberculosis
ugggcggccugcaccc

SEQ ID NO: 3033532 - RNA, 16 nt, Mycobacterium avium subsp. paratuberculosis
ugggcggcgcccgaca

SEQ ID NO: 3033533 - RNA, 15 nt, Mycobacterium avium subsp. paratuberculosis
ugggcggcgcgcugc

SEQ ID NO: 3033534 - RNA, 18 nt, Mycobacterium avium subsp. paratuberculosis
ugggcgggcacccgggcg

SEQ ID NO: 3033535 - RNA, 19 nt, Mycobacterium avium subsp. paratuberculosis
ugggcgguccgcuccacca

SEQ ID NO: 3033536 - RNA, 14 nt, Mycobacterium avium subsp. paratuberculosis
ugggcguacgggcg

SEQ ID NO: 3033537 - RNA, 19 nt, Mycobacterium avium subsp. paratuberculosis
ugggcguacugcucggcgc

SEQ ID NO: 3033538 - RNA, 15 nt, Mycobacterium avium subsp. paratuberculosis
ugggcgucgagugug

SEQ ID NO: 3033539 - RNA, 16 nt, Mycobacterium avium subsp. paratuberculosis
ugggcgugcaggccgc

SEQ ID NO: 3033540 - RNA, 23 nt, Mycobacterium avium subsp. paratuberculosis
ugggcgugcaggccgcggguggc

SEQ ID NO: 3033541 - RNA, 20 nt, Mycobacterium avium subsp. paratuberculosis
ugggcgugccggaugcgguc

SEQ ID NO: 3033542 - RNA, 16 nt, Mycobacterium avium subsp. paratuberculosis
ugggcgugccggcccg

SEQ ID NO: 3033543 - RNA, 18 nt, Mycobacterium avium subsp. paratuberculosis
ugggcgugccggcccggc

SEQ ID NO: 3033544 - RNA, 14 nt, Mycobacterium avium subsp. paratuberculosis
ugggcuaccagccc

SEQ ID NO: 3033545 - RNA, 13 nt, Mycobacterium avium subsp. paratuberculosis
ugggcuccgaccg

SEQ ID NO: 3033546 - RNA, 13 nt, Mycobacterium avium subsp. paratuberculosis
ugggcuccucgac

SEQ ID NO: 3033547 - RNA, 16 nt, Mycobacterium avium subsp. paratuberculosis
ugggcuccucgaccac

SEQ ID NO: 3033548 - RNA, 23 nt, Mycobacterium avium subsp. paratuberculosis
ugggcucgagcaacaccaccuug

SEQ ID NO: 3033549 - RNA, 19 nt, Mycobacterium avium subsp. paratuberculosis
ugggcucgagugccggcag

SEQ ID NO: 3033550 - RNA, 20 nt, Mycobacterium avium subsp. paratuberculosis
ugggcucgagugccggcagc

SEQ ID NO: 3033551 - RNA, 14 nt, Mycobacterium avium subsp. paratuberculosis
ugggcucgcccggg

SEQ ID NO: 3033552 - RNA, 16 nt, Mycobacterium avium subsp. paratuberculosis
ugggcucggcgcggga

SEQ ID NO: 3033553 - RNA, 21 nt, Mycobacterium avium subsp. paratuberculosis
ugggcugcaacaacuucgggg

SEQ ID NO: 3033554 - RNA, 23 nt, Mycobacterium avium subsp. paratuberculosis
ugggcugcaacaacuucggggug

SEQ ID NO: 3033555 - RNA, 22 nt, Mycobacterium avium subsp. paratuberculosis
ugggcugcaucuccagccgcgg

SEQ ID NO: 3033556 - RNA, 20 nt, Mycobacterium avium subsp. paratuberculosis
ugggcugcgcgucgagcagc

SEQ ID NO: 3033557 - RNA, 17 nt, Mycobacterium avium subsp. paratuberculosis
ugggcugggucaccacg

SEQ ID NO: 3033558 - RNA, 13 nt, Mycobacterium avium subsp. paratuberculosis
uggggacgacgcc

SEQ ID NO: 3033559 - RNA, 15 nt, Mycobacterium avium subsp. paratuberculosis
uggggacgacgccga

SEQ ID NO: 3033560 - RNA, 18 nt, Mycobacterium avium subsp. paratuberculosis
uggggacgacgccgaacu

SEQ ID NO: 3033561 - RNA, 15 nt, Mycobacterium avium subsp. paratuberculosis
uggggacgucgacgu

SEQ ID NO: 3033562 - RNA, 17 nt, Mycobacterium avium subsp. paratuberculosis
uggggcaccagaacacg

SEQ ID NO: 3033563 - RNA, 19 nt, Mycobacterium avium subsp. paratuberculosis
uggggcagaucgucggcac

SEQ ID NO: 3033564 - RNA, 22 nt, Mycobacterium avium subsp. paratuberculosis
uggggcaggaacgccuuggugc

SEQ ID NO: 3033565 - RNA, 11 nt, Mycobacterium avium subsp. paratuberculosis
uggggcccagc

SEQ ID NO: 3033566 - RNA, 20 nt, Mycobacterium avium subsp. paratuberculosis
uggggccgaagccgacaccg

SEQ ID NO: 3033567 - RNA, 20 nt, Mycobacterium avium subsp. paratuberculosis
uggggccgauguucaccccg

SEQ ID NO: 3033568 - RNA, 13 nt, Mycobacterium avium subsp. paratuberculosis
uggggccggcgaa

SEQ ID NO: 3033569 - RNA, 19 nt, Mycobacterium avium subsp. paratuberculosis
uggggcgcaccgccugugc

SEQ ID NO: 3033570 - RNA, 22 nt, Mycobacterium avium subsp. paratuberculosis
uggggcucagccgaagccggcg

SEQ ID NO: 3033571 - RNA, 24 nt, Mycobacterium avium subsp. paratuberculosis
uggggcuggccgcacggugcagca

SEQ ID NO: 3033572 - RNA, 23 nt, Mycobacterium avium subsp. paratuberculosis
ugggggccaggcgggugaucccg

SEQ ID NO: 3033573 - RNA, 15 nt, Mycobacterium avium subsp. paratuberculosis
ugggggcgccgcggc

SEQ ID NO: 3033574 - RNA, 21 nt, Mycobacterium avium subsp. paratuberculosis
ugggggcgccgcggcgccgcc

SEQ ID NO: 3033575 - RNA, 19 nt, Mycobacterium avium subsp. paratuberculosis
ugggggucggugaccagcc

SEQ ID NO: 3033576 - RNA, 20 nt, Mycobacterium avium subsp. paratuberculosis
ugggguccucgauggcggcg

SEQ ID NO: 3033577 - RNA, 16 nt, Mycobacterium avium subsp. paratuberculosis
uggggucgcgggcgcc

SEQ ID NO: 3033578 - RNA, 15 nt, Mycobacterium avium subsp. paratuberculosis
uggggucggccagcg

SEQ ID NO: 3033579 - RNA, 23 nt, Mycobacterium avium subsp. paratuberculosis
uggggugaggcacccgcugcacc

SEQ ID NO: 3033580 - RNA, 14 nt, Mycobacterium avium subsp. paratuberculosis
uggggugguggaau

SEQ ID NO: 3033581 - RNA, 17 nt, Mycobacterium avium subsp. paratuberculosis
uggggugucagcgcgac

SEQ ID NO: 3033582 - RNA, 21 nt, Mycobacterium avium subsp. paratuberculosis
ugggucaaaacaacgcgcagc

SEQ ID NO: 3033583 - RNA, 13 nt, Mycobacterium avium subsp. paratuberculosis
ugggucaccacgg

SEQ ID NO: 3033584 - RNA, 12 nt, Mycobacterium avium subsp. paratuberculosis
ugggucagcucc

SEQ ID NO: 3033585 - RNA, 23 nt, Mycobacterium avium subsp. paratuberculosis
ugggucaucaccuugucgcugac

SEQ ID NO: 3033586 - RNA, 21 nt, Mycobacterium avium subsp. paratuberculosis
ugggucaucgacucgaagaac

SEQ ID NO: 3033587 - RNA, 17 nt, Mycobacterium avium subsp. paratuberculosis
ugggucccaucgcugcc

SEQ ID NO: 3033588 - RNA, 19 nt, Mycobacterium avium subsp. paratuberculosis
uggguccgauugcccgacu

SEQ ID NO: 3033589 - RNA, 19 nt, Mycobacterium avium subsp. paratuberculosis
uggguccgauuucccgacu

SEQ ID NO: 3033590 - RNA, 21 nt, Mycobacterium avium subsp. paratuberculosis
uggguccgauuucccgacucc

SEQ ID NO: 3033591 - RNA, 22 nt, Mycobacterium avium subsp. paratuberculosis
ugggucgccgggucuuccacgc

SEQ ID NO: 3033592 - RNA, 17 nt, Mycobacterium avium subsp. paratuberculosis
ugggugagcggcgcguc

SEQ ID NO: 3033593 - RNA, 23 nt, Mycobacterium avium subsp. paratuberculosis
ugggugagcggcgcguccauggu

SEQ ID NO: 3033594 - RNA, 19 nt, Mycobacterium avium subsp. paratuberculosis
ugggugagcuaucagcucg

SEQ ID NO: 3033595 - RNA, 24 nt, Mycobacterium avium subsp. paratuberculosis
ugggugccccgccguuucagcagc

SEQ ID NO: 3033596 - RNA, 21 nt, Mycobacterium avium subsp. paratuberculosis
ugggugccgacgagcucgccg

SEQ ID NO: 3033597 - RNA, 13 nt, Mycobacterium avium subsp. paratuberculosis
ugggugcgcgggc

SEQ ID NO: 3033598 - RNA, 16 nt, Mycobacterium avium subsp. paratuberculosis
ugggugcgcgggcgcc

SEQ ID NO: 3033599 - RNA, 22 nt, Mycobacterium avium subsp. paratuberculosis
ugggugcucaccccggccaggg

SEQ ID NO: 3033600 - RNA, 21 nt, Mycobacterium avium subsp. paratuberculosis
uggguggccccucauugggac

SEQ ID NO: 3033601 - RNA, 20 nt, Mycobacterium avium subsp. paratuberculosis
uggguggucaccagcgcggu

SEQ ID NO: 3033602 - RNA, 23 nt, Mycobacterium avium subsp. paratuberculosis
uggguggucaccguguuggugac

SEQ ID NO: 3033603 - RNA, 17 nt, Mycobacterium avium subsp. paratuberculosis
uggguggucagcgcggu

SEQ ID NO: 3033604 - RNA, 14 nt, Mycobacterium avium subsp. paratuberculosis
ugggugguccaggc

SEQ ID NO: 3033605 - RNA, 18 nt, Mycobacterium avium subsp. paratuberculosis
uggguggucugcugggcg

SEQ ID NO: 3033606 - RNA, 18 nt, Mycobacterium avium subsp. paratuberculosis
uggguguccuugcgcacc

SEQ ID NO: 3033607 - RNA, 23 nt, Mycobacterium avium subsp. paratuberculosis
uggguguccuugcgcaccacguc

SEQ ID NO: 3033608 - RNA, 15 nt, Mycobacterium avium subsp. paratuberculosis
uggguucgaauccca

SEQ ID NO: 3033609 - RNA, 23 nt, Mycobacterium avium subsp. paratuberculosis
uggguucggcggcgcggcccagg

SEQ ID NO: 3033610 - RNA, 14 nt, Mycobacterium avium subsp. paratuberculosis
ugguaccggcgcca

SEQ ID NO: 3033611 - RNA, 15 nt, Mycobacterium avium subsp. paratuberculosis
ugguacgcgccgucg

SEQ ID NO: 3033612 - RNA, 17 nt, Mycobacterium avium subsp. paratuberculosis
ugguacgcgccgucguc

SEQ ID NO: 3033613 - RNA, 12 nt, Mycobacterium avium subsp. paratuberculosis
ugguagaacucg

SEQ ID NO: 3033614 - RNA, 21 nt, Mycobacterium avium subsp. paratuberculosis
ugguagacccggggguccagg

SEQ ID NO: 3033615 - RNA, 12 nt, Mycobacterium avium subsp. paratuberculosis
ugguagcugcug

SEQ ID NO: 3033616 - RNA, 13 nt, Mycobacterium avium subsp. paratuberculosis
ugguaggccugga

SEQ ID NO: 3033617 - RNA, 14 nt, Mycobacterium avium subsp. paratuberculosis
ugguaggcggcgca

SEQ ID NO: 3033618 - RNA, 16 nt, Mycobacterium avium subsp. paratuberculosis
ugguaggcggcgcagc

SEQ ID NO: 3033619 - RNA, 15 nt, Mycobacterium avium subsp. paratuberculosis
ugguagucgucgugg

SEQ ID NO: 3033620 - RNA, 17 nt, Mycobacterium avium subsp. paratuberculosis
ugguauccgaucgcggc

SEQ ID NO: 3033621 - RNA, 18 nt, Mycobacterium avium subsp. paratuberculosis
ugguaugccuuggcccgc

SEQ ID NO: 3033622 - RNA, 13 nt, Mycobacterium avium subsp. paratuberculosis
uggucaaggugcu

SEQ ID NO: 3033623 - RNA, 14 nt, Mycobacterium avium subsp. paratuberculosis
uggucaauccgggc

SEQ ID NO: 3033624 - RNA, 23 nt, Mycobacterium avium subsp. paratuberculosis
uggucaaugcccucguagcggcc

SEQ ID NO: 3033625 - RNA, 23 nt, Mycobacterium avium subsp. paratuberculosis
uggucacacccuugucggugacc

SEQ ID NO: 3033626 - RNA, 16 nt, Mycobacterium avium subsp. paratuberculosis
uggucacaccgcugag

SEQ ID NO: 3033627 - RNA, 14 nt, Mycobacterium avium subsp. paratuberculosis
uggucaccaccaac

SEQ ID NO: 3033628 - RNA, 14 nt, Mycobacterium avium subsp. paratuberculosis
uggucaccaccacc

SEQ ID NO: 3033629 - RNA, 18 nt, Mycobacterium avium subsp. paratuberculosis
uggucaccaggucgcggu

SEQ ID NO: 3033630 - RNA, 20 nt, Mycobacterium avium subsp. paratuberculosis
uggucaccaggucgcgguag

SEQ ID NO: 3033631 - RNA, 23 nt, Mycobacterium avium subsp. paratuberculosis
uggucacccgcagcccgaccuuc

SEQ ID NO: 3033632 - RNA, 14 nt, Mycobacterium avium subsp. paratuberculosis
uggucaccggcaag

SEQ ID NO: 3033633 - RNA, 18 nt, Mycobacterium avium subsp. paratuberculosis
uggucagcaccggcgugg

SEQ ID NO: 3033634 - RNA, 16 nt, Mycobacterium avium subsp. paratuberculosis
uggucagcagcagcgc

SEQ ID NO: 3033635 - RNA, 18 nt, Mycobacterium avium subsp. paratuberculosis
uggucagcagcagcgccu

SEQ ID NO: 3033636 - RNA, 19 nt, Mycobacterium avium subsp. paratuberculosis
uggucagccgcaccagguu

SEQ ID NO: 3033637 - RNA, 23 nt, Mycobacterium avium subsp. paratuberculosis
uggucagccgcggcggcagcacc

SEQ ID NO: 3033638 - RNA, 12 nt, Mycobacterium avium subsp. paratuberculosis
uggucagcgcgg

SEQ ID NO: 3033639 - RNA, 21 nt, Mycobacterium avium subsp. paratuberculosis
uggucagcgcggcccgcggcg

SEQ ID NO: 3033640 - RNA, 16 nt, Mycobacterium avium subsp. paratuberculosis
uggucagcgcggucag

SEQ ID NO: 3033641 - RNA, 23 nt, Mycobacterium avium subsp. paratuberculosis
uggucagcggcaggucccaggcc

SEQ ID NO: 3033642 - RNA, 20 nt, Mycobacterium avium subsp. paratuberculosis
uggucagcggcgccaccggg

SEQ ID NO: 3033643 - RNA, 21 nt, Mycobacterium avium subsp. paratuberculosis
uggucagcggcgccaccggga

SEQ ID NO: 3033644 - RNA, 20 nt, Mycobacterium avium subsp. paratuberculosis
uggucagcgucucgccgggg

SEQ ID NO: 3033645 - RNA, 17 nt, Mycobacterium avium subsp. paratuberculosis
uggucagcucccggcag

SEQ ID NO: 3033646 - RNA, 21 nt, Mycobacterium avium subsp. paratuberculosis
uggucagguaggcgucgaacg

SEQ ID NO: 3033647 - RNA, 23 nt, Mycobacterium avium subsp. paratuberculosis
uggucaguacagcuaggccagca

SEQ ID NO: 3033648 - RNA, 17 nt, Mycobacterium avium subsp. paratuberculosis
uggucaugaacgccggg

SEQ ID NO: 3033649 - RNA, 21 nt, Mycobacterium avium subsp. paratuberculosis
uggucaugaaggcgacgucgg

SEQ ID NO: 3033650 - RNA, 16 nt, Mycobacterium avium subsp. paratuberculosis
uggucaugccgucgac

SEQ ID NO: 3033651 - RNA, 19 nt, Mycobacterium avium subsp. paratuberculosis
ugguccacacguccuggac

SEQ ID NO: 3033652 - RNA, 14 nt, Mycobacterium avium subsp. paratuberculosis
ugguccaccgccgc

SEQ ID NO: 3033653 - RNA, 17 nt, Mycobacterium avium subsp. paratuberculosis
ugguccaccgccgcgcc

SEQ ID NO: 3033654 - RNA, 20 nt, Mycobacterium avium subsp. paratuberculosis
ugguccaccgcggcggccag

SEQ ID NO: 3033655 - RNA, 15 nt, Mycobacterium avium subsp. paratuberculosis
ugguccaccgggcag

SEQ ID NO: 3033656 - RNA, 16 nt, Mycobacterium avium subsp. paratuberculosis
ugguccagcaccggcg

SEQ ID NO: 3033657 - RNA, 15 nt, Mycobacterium avium subsp. paratuberculosis
ugguccagccggucg

SEQ ID NO: 3033658 - RNA, 22 nt, Mycobacterium avium subsp. paratuberculosis
ugguccagcgugcgcggcuggc

SEQ ID NO: 3033659 - RNA, 12 nt, Mycobacterium avium subsp. paratuberculosis
ugguccaggcgc

SEQ ID NO: 3033660 - RNA, 18 nt, Mycobacterium avium subsp. paratuberculosis
uggucccacagcgggguc

SEQ ID NO: 3033661 - RNA, 13 nt, Mycobacterium avium subsp. paratuberculosis
uggucccgaucac

SEQ ID NO: 3033662 - RNA, 14 nt, Mycobacterium avium subsp. paratuberculosis
uggucccgaucacc

SEQ ID NO: 3033663 - RNA, 19 nt, Mycobacterium avium subsp. paratuberculosis
uggucccgaucaccuugcc

SEQ ID NO: 3033664 - RNA, 21 nt, Mycobacterium avium subsp. paratuberculosis
uggucccgaucaccuugccca

SEQ ID NO: 3033665 - RNA, 15 nt, Mycobacterium avium subsp. paratuberculosis
ugguccgcaugucga

SEQ ID NO: 3033666 - RNA, 23 nt, Mycobacterium avium subsp. paratuberculosis
ugguccuccaacggcaccaccac

SEQ ID NO: 3033667 - RNA, 19 nt, Mycobacterium avium subsp. paratuberculosis
uggucgaacagcacgccgg

SEQ ID NO: 3033668 - RNA, 15 nt, Mycobacterium avium subsp. paratuberculosis
uggucgaacagcgcg

SEQ ID NO: 3033669 - RNA, 21 nt, Mycobacterium avium subsp. paratuberculosis
uggucgaacagcgcgcccgac

SEQ ID NO: 3033670 - RNA, 22 nt, Mycobacterium avium subsp. paratuberculosis
uggucgaaccgcgagcgcgcgg

SEQ ID NO: 3033671 - RNA, 24 nt, Mycobacterium avium subsp. paratuberculosis
uggucgaaccgcgagcgcgcggug

SEQ ID NO: 3033672 - RNA, 15 nt, Mycobacterium avium subsp. paratuberculosis
uggucgacgcgccgc

SEQ ID NO: 3033673 - RNA, 16 nt, Mycobacterium avium subsp. paratuberculosis
uggucgagccgcaguc

SEQ ID NO: 3033674 - RNA, 23 nt, Mycobacterium avium subsp. paratuberculosis
uggucgaggcccucgacaccggu

SEQ ID NO: 3033675 - RNA, 21 nt, Mycobacterium avium subsp. paratuberculosis
uggucgagggcguucgcggug

SEQ ID NO: 3033676 - RNA, 17 nt, Mycobacterium avium subsp. paratuberculosis
uggucgaucccgccggc

SEQ ID NO: 3033677 - RNA, 15 nt, Mycobacterium avium subsp. paratuberculosis
uggucgaugcccgcg

SEQ ID NO: 3033678 - RNA, 18 nt, Mycobacterium avium subsp. paratuberculosis
uggucgaugcccgcgccg

SEQ ID NO: 3033679 - RNA, 17 nt, Mycobacterium avium subsp. paratuberculosis
uggucgaugucggugcg

SEQ ID NO: 3033680 - RNA, 16 nt, Mycobacterium avium subsp. paratuberculosis
uggucgccagcaccac

SEQ ID NO: 3033681 - RNA, 20 nt, Mycobacterium avium subsp. paratuberculosis
uggucgcccaccacgacgac

SEQ ID NO: 3033682 - RNA, 22 nt, Mycobacterium avium subsp. paratuberculosis
uggucgccgaacgugcgcggcg

SEQ ID NO: 3033683 - RNA, 15 nt, Mycobacterium avium subsp. paratuberculosis
uggucgccgacggug

SEQ ID NO: 3033684 - RNA, 23 nt, Mycobacterium avium subsp. paratuberculosis
uggucgcgaagcguaugccggug

SEQ ID NO: 3033685 - RNA, 13 nt, Mycobacterium avium subsp. paratuberculosis
uggucgcgccgcg

SEQ ID NO: 3033686 - RNA, 13 nt, Mycobacterium avium subsp. paratuberculosis
uggucgcggccuu

SEQ ID NO: 3033687 - RNA, 22 nt, Mycobacterium avium subsp. paratuberculosis
uggucgcugcucaugagcccuc

SEQ ID NO: 3033688 - RNA, 18 nt, Mycobacterium avium subsp. paratuberculosis
uggucgcuuucggugacc

SEQ ID NO: 3033689 - RNA, 15 nt, Mycobacterium avium subsp. paratuberculosis
uggucggagccgucg

SEQ ID NO: 3033690 - RNA, 20 nt, Mycobacterium avium subsp. paratuberculosis
uggucggagccgucgguguc

SEQ ID NO: 3033691 - RNA, 21 nt, Mycobacterium avium subsp. paratuberculosis
uggucggcaccuccugcaccc

SEQ ID NO: 3033692 - RNA, 14 nt, Mycobacterium avium subsp. paratuberculosis
uggucggcagcacc

SEQ ID NO: 3033693 - RNA, 16 nt, Mycobacterium avium subsp. paratuberculosis
uggucggccagcgcgc

SEQ ID NO: 3033694 - RNA, 14 nt, Mycobacterium avium subsp. paratuberculosis
uggucggccagggc

SEQ ID NO: 3033695 - RNA, 16 nt, Mycobacterium avium subsp. paratuberculosis
uggucggccagggcgu

SEQ ID NO: 3033696 - RNA, 16 nt, Mycobacterium avium subsp. paratuberculosis
uggucggccggcaggc

SEQ ID NO: 3033697 - RNA, 15 nt, Mycobacterium avium subsp. paratuberculosis
uggucggcgacgccg

SEQ ID NO: 3033698 - RNA, 18 nt, Mycobacterium avium subsp. paratuberculosis
uggucgggcaugccggcc

SEQ ID NO: 3033699 - RNA, 21 nt, Mycobacterium avium subsp. paratuberculosis
uggucgggcaugccggccggc

SEQ ID NO: 3033700 - RNA, 12 nt, Mycobacterium avium subsp. paratuberculosis
uggucgggcgca

SEQ ID NO: 3033701 - RNA, 16 nt, Mycobacterium avium subsp. paratuberculosis
uggucggggucgaaca

SEQ ID NO: 3033702 - RNA, 23 nt, Mycobacterium avium subsp. paratuberculosis
uggucggggucgaacaucacccg

SEQ ID NO: 3033703 - RNA, 19 nt, Mycobacterium avium subsp. paratuberculosis
uggucgguagggucgggug

SEQ ID NO: 3033704 - RNA, 22 nt, Mycobacterium avium subsp. paratuberculosis
uggucggugcccugugaggcgu

SEQ ID NO: 3033705 - RNA, 20 nt, Mycobacterium avium subsp. paratuberculosis
uggucgguuugcgggccagu

SEQ ID NO: 3033706 - RNA, 12 nt, Mycobacterium avium subsp. paratuberculosis
uggucgucgacg

SEQ ID NO: 3033707 - RNA, 18 nt, Mycobacterium avium subsp. paratuberculosis
uggucgucguggugacgg

SEQ ID NO: 3033708 - RNA, 19 nt, Mycobacterium avium subsp. paratuberculosis
uggucgugcagcaccgcca

SEQ ID NO: 3033709 - RNA, 22 nt, Mycobacterium avium subsp. paratuberculosis
uggucguugcacacccggugcg

SEQ ID NO: 3033710 - RNA, 11 nt, Mycobacterium avium subsp. paratuberculosis
uggucucccag

SEQ ID NO: 3033711 - RNA, 18 nt, Mycobacterium avium subsp. paratuberculosis
uggucucccgggcggucg

SEQ ID NO: 3033712 - RNA, 12 nt, Mycobacterium avium subsp. paratuberculosis
uggucuccggcc

SEQ ID NO: 3033713 - RNA, 19 nt, Mycobacterium avium subsp. paratuberculosis
uggucuccuggccgccgug

SEQ ID NO: 3033714 - RNA, 18 nt, Mycobacterium avium subsp. paratuberculosis
uggucucgcaccugccgu

SEQ ID NO: 3033715 - RNA, 14 nt, Mycobacterium avium subsp. paratuberculosis
uggucucgccgauc

SEQ ID NO: 3033716 - RNA, 20 nt, Mycobacterium avium subsp. paratuberculosis
uggucucguagaagcucagc

SEQ ID NO: 3033717 - RNA, 13 nt, Mycobacterium avium subsp. paratuberculosis
uggucugccagaa

SEQ ID NO: 3033718 - RNA, 14 nt, Mycobacterium avium subsp. paratuberculosis
uggucugcgccggc

SEQ ID NO: 3033719 - RNA, 17 nt, Mycobacterium avium subsp. paratuberculosis
uggucugcgccggcggu

SEQ ID NO: 3033720 - RNA, 17 nt, Mycobacterium avium subsp. paratuberculosis
uggucugcgcgagcaga

SEQ ID NO: 3033721 - RNA, 22 nt, Mycobacterium avium subsp. paratuberculosis
uggucugcgcgagcagaucgcg

SEQ ID NO: 3033722 - RNA, 15 nt, Mycobacterium avium subsp. paratuberculosis
uggucuucggugucg

SEQ ID NO: 3033723 - RNA, 17 nt, Mycobacterium avium subsp. paratuberculosis
uggucuugccgugcagc

SEQ ID NO: 3033724 - RNA, 20 nt, Mycobacterium avium subsp. paratuberculosis
uggugaacagguaggcggcg

SEQ ID NO: 3033725 - RNA, 16 nt, Mycobacterium avium subsp. paratuberculosis
uggugaagccgugcac

SEQ ID NO: 3033726 - RNA, 20 nt, Mycobacterium avium subsp. paratuberculosis
uggugaagccgugcacgccg

SEQ ID NO: 3033727 - RNA, 21 nt, Mycobacterium avium subsp. paratuberculosis
uggugaaggcgaacaccagcc

SEQ ID NO: 3033728 - RNA, 21 nt, Mycobacterium avium subsp. paratuberculosis
uggugaaguugccggucaggc

SEQ ID NO: 3033729 - RNA, 23 nt, Mycobacterium avium subsp. paratuberculosis
uggugaccugcggaucgcgggcg

SEQ ID NO: 3033730 - RNA, 23 nt, Mycobacterium avium subsp. paratuberculosis
uggugacgaacgggccaagcacc

SEQ ID NO: 3033731 - RNA, 14 nt, Mycobacterium avium subsp. paratuberculosis
uggugacgccgacg

SEQ ID NO: 3033732 - RNA, 21 nt, Mycobacterium avium subsp. paratuberculosis
uggugacgcucacccggccca

SEQ ID NO: 3033733 - RNA, 12 nt, Mycobacterium avium subsp. paratuberculosis
uggugacgggcg

SEQ ID NO: 3033734 - RNA, 18 nt, Mycobacterium avium subsp. paratuberculosis
uggugacgggcgucggcg

SEQ ID NO: 3033735 - RNA, 16 nt, Mycobacterium avium subsp. paratuberculosis
uggugaggucgcgcag

SEQ ID NO: 3033736 - RNA, 18 nt, Mycobacterium avium subsp. paratuberculosis
uggugauagaucaucccg

SEQ ID NO: 3033737 - RNA, 19 nt, Mycobacterium avium subsp. paratuberculosis
uggugauagaucaucccgg

SEQ ID NO: 3033738 - RNA, 22 nt, Mycobacterium avium subsp. paratuberculosis
uggugauagaucaucccggcca

SEQ ID NO: 3033739 - RNA, 23 nt, Mycobacterium avium subsp. paratuberculosis
uggugauagaucaucccggccac

SEQ ID NO: 3033740 - RNA, 23 nt, Mycobacterium avium subsp. paratuberculosis
uggugaucagcauccgcaacgug

SEQ ID NO: 3033741 - RNA, 16 nt, Mycobacterium avium subsp. paratuberculosis
uggugaucagccccgc

SEQ ID NO: 3033742 - RNA, 12 nt, Mycobacterium avium subsp. paratuberculosis
uggugauccggg

SEQ ID NO: 3033743 - RNA, 14 nt, Mycobacterium avium subsp. paratuberculosis
uggugaucgccgcg

SEQ ID NO: 3033744 - RNA, 14 nt, Mycobacterium avium subsp. paratuberculosis
uggugaucggccag

SEQ ID NO: 3033745 - RNA, 18 nt, Mycobacterium avium subsp. paratuberculosis
uggugaugaaucgucccg

SEQ ID NO: 3033746 - RNA, 15 nt, Mycobacterium avium subsp. paratuberculosis
uggugaugaucccgg

SEQ ID NO: 3033747 - RNA, 22 nt, Mycobacterium avium subsp. paratuberculosis
uggugaugcgcugcaaccgguc

SEQ ID NO: 3033748 - RNA, 19 nt, Mycobacterium avium subsp. paratuberculosis
uggugaugcggaugcccgc

SEQ ID NO: 3033749 - RNA, 15 nt, Mycobacterium avium subsp. paratuberculosis
uggugaugcggucgg

SEQ ID NO: 3033750 - RNA, 17 nt, Mycobacterium avium subsp. paratuberculosis
uggugaugcggucggcg

SEQ ID NO: 3033751 - RNA, 17 nt, Mycobacterium avium subsp. paratuberculosis
uggugaugugcggcgcg

SEQ ID NO: 3033752 - RNA, 21 nt, Mycobacterium avium subsp. paratuberculosis
uggugauuguaggugugcagc

SEQ ID NO: 3033753 - RNA, 14 nt, Mycobacterium avium subsp. paratuberculosis
uggugcaacaccga

SEQ ID NO: 3033754 - RNA, 16 nt, Mycobacterium avium subsp. paratuberculosis
uggugcaccagguaga

SEQ ID NO: 3033755 - RNA, 12 nt, Mycobacterium avium subsp. paratuberculosis
uggugcaccgcc

SEQ ID NO: 3033756 - RNA, 21 nt, Mycobacterium avium subsp. paratuberculosis
uggugcaccgccagcgcggcg

SEQ ID NO: 3033757 - RNA, 23 nt, Mycobacterium avium subsp. paratuberculosis
uggugcaccgccagcgcggcggc

SEQ ID NO: 3033758 - RNA, 13 nt, Mycobacterium avium subsp. paratuberculosis
uggugcagcagcu

SEQ ID NO: 3033759 - RNA, 17 nt, Mycobacterium avium subsp. paratuberculosis
uggugcaggugcccguc

SEQ ID NO: 3033760 - RNA, 18 nt, Mycobacterium avium subsp. paratuberculosis
uggugcccaccgggcagc

SEQ ID NO: 3033761 - RNA, 18 nt, Mycobacterium avium subsp. paratuberculosis
uggugcccaucgacccgu

SEQ ID NO: 3033762 - RNA, 21 nt, Mycobacterium avium subsp. paratuberculosis
uggugcccccgcccggccggu

SEQ ID NO: 3033763 - RNA, 19 nt, Mycobacterium avium subsp. paratuberculosis
uggugccgaucaccucgcc

SEQ ID NO: 3033764 - RNA, 12 nt, Mycobacterium avium subsp. paratuberculosis
uggugccgccgg

SEQ ID NO: 3033765 - RNA, 14 nt, Mycobacterium avium subsp. paratuberculosis
uggugccgccggcg

SEQ ID NO: 3033766 - RNA, 12 nt, Mycobacterium avium subsp. paratuberculosis
uggugccgccgu

SEQ ID NO: 3033767 - RNA, 15 nt, Mycobacterium avium subsp. paratuberculosis
uggugccgccguugc

SEQ ID NO: 3033768 - RNA, 15 nt, Mycobacterium avium subsp. paratuberculosis
uggugccgcugacgg

SEQ ID NO: 3033769 - RNA, 23 nt, Mycobacterium avium subsp. paratuberculosis
uggugccggaaguucucgccgug

SEQ ID NO: 3033770 - RNA, 15 nt, Mycobacterium avium subsp. paratuberculosis
uggugcgcagcccgc

SEQ ID NO: 3033771 - RNA, 18 nt, Mycobacterium avium subsp. paratuberculosis
uggugcgcagcccgccgg

SEQ ID NO: 3033772 - RNA, 18 nt, Mycobacterium avium subsp. paratuberculosis
uggugcgcccgucggugg

SEQ ID NO: 3033773 - RNA, 12 nt, Mycobacterium avium subsp. paratuberculosis
uggugcgccggg

SEQ ID NO: 3033774 - RNA, 20 nt, Mycobacterium avium subsp. paratuberculosis
uggugcgccgggucgcggug

SEQ ID NO: 3033775 - RNA, 23 nt, Mycobacterium avium subsp. paratuberculosis
uggugcgcgccggcgucgguguc

SEQ ID NO: 3033776 - RNA, 20 nt, Mycobacterium avium subsp. paratuberculosis
uggugcggacggucgccgac

SEQ ID NO: 3033777 - RNA, 14 nt, Mycobacterium avium subsp. paratuberculosis
uggugcgggccagc

SEQ ID NO: 3033778 - RNA, 16 nt, Mycobacterium avium subsp. paratuberculosis
uggugcggucgaugac

SEQ ID NO: 3033779 - RNA, 21 nt, Mycobacterium avium subsp. paratuberculosis
uggugcggucgaugacgccgc

SEQ ID NO: 3033780 - RNA, 20 nt, Mycobacterium avium subsp. paratuberculosis
uggugcggugcaccgcggcg

SEQ ID NO: 3033781 - RNA, 20 nt, Mycobacterium avium subsp. paratuberculosis
uggugcucgccccgcccgau

SEQ ID NO: 3033782 - RNA, 14 nt, Mycobacterium avium subsp. paratuberculosis
uggugcugcccggc

SEQ ID NO: 3033783 - RNA, 16 nt, Mycobacterium avium subsp. paratuberculosis
uggugcugcccggcgc

SEQ ID NO: 3033784 - RNA, 20 nt, Mycobacterium avium subsp. paratuberculosis
uggugcugcugccccucgac

SEQ ID NO: 3033785 - RNA, 21 nt, Mycobacterium avium subsp. paratuberculosis
ugguggacaacuccuggaucc

SEQ ID NO: 3033786 - RNA, 16 nt, Mycobacterium avium subsp. paratuberculosis
ugguggacggucagcg

SEQ ID NO: 3033787 - RNA, 17 nt, Mycobacterium avium subsp. paratuberculosis
ugguggacggucagcgc

SEQ ID NO: 3033788 - RNA, 19 nt, Mycobacterium avium subsp. paratuberculosis
ugguggacggucagcgcgc

SEQ ID NO: 3033789 - RNA, 18 nt, Mycobacterium avium subsp. paratuberculosis
ugguggacgucaggccgu

SEQ ID NO: 3033790 - RNA, 15 nt, Mycobacterium avium subsp. paratuberculosis
ugguggcagcggacc

SEQ ID NO: 3033791 - RNA, 16 nt, Mycobacterium avium subsp. paratuberculosis
ugguggcagcggaccc

SEQ ID NO: 3033792 - RNA, 12 nt, Mycobacterium avium subsp. paratuberculosis
ugguggccgcgg

SEQ ID NO: 3033793 - RNA, 14 nt, Mycobacterium avium subsp. paratuberculosis
ugguggcgcugccg

SEQ ID NO: 3033794 - RNA, 22 nt, Mycobacterium avium subsp. paratuberculosis
ugguggcgcugccgagcaccuc

SEQ ID NO: 3033795 - RNA, 14 nt, Mycobacterium avium subsp. paratuberculosis
ugguggcggcgccg

SEQ ID NO: 3033796 - RNA, 15 nt, Mycobacterium avium subsp. paratuberculosis
uggugggcagaugcc

SEQ ID NO: 3033797 - RNA, 20 nt, Mycobacterium avium subsp. paratuberculosis
uggugggcagccggcaacuc

SEQ ID NO: 3033798 - RNA, 21 nt, Mycobacterium avium subsp. paratuberculosis
uggugggccaucgccaggaac

SEQ ID NO: 3033799 - RNA, 23 nt, Mycobacterium avium subsp. paratuberculosis
uggugggccaucgccaggaacca

SEQ ID NO: 3033800 - RNA, 19 nt, Mycobacterium avium subsp. paratuberculosis
uggugggcgaacagcagca

SEQ ID NO: 3033801 - RNA, 22 nt, Mycobacterium avium subsp. paratuberculosis
uggugggcgaacagcagcaccc

SEQ ID NO: 3033802 - RNA, 13 nt, Mycobacterium avium subsp. paratuberculosis
uggugggcgugcc

SEQ ID NO: 3033803 - RNA, 22 nt, Mycobacterium avium subsp. paratuberculosis
ugguggucgaacuggcgcaccg

SEQ ID NO: 3033804 - RNA, 18 nt, Mycobacterium avium subsp. paratuberculosis
ugguggucgacgcgccgc

SEQ ID NO: 3033805 - RNA, 17 nt, Mycobacterium avium subsp. paratuberculosis
ugguggucgucgacgag

SEQ ID NO: 3033806 - RNA, 22 nt, Mycobacterium avium subsp. paratuberculosis
ugguggucgucgacgagcccgc

SEQ ID NO: 3033807 - RNA, 18 nt, Mycobacterium avium subsp. paratuberculosis
ugguguagcucagccacg

SEQ ID NO: 3033808 - RNA, 22 nt, Mycobacterium avium subsp. paratuberculosis
ugguguaguccugcuucagcuc

SEQ ID NO: 3033809 - RNA, 13 nt, Mycobacterium avium subsp. paratuberculosis
uggugucaggauc

SEQ ID NO: 3033810 - RNA, 18 nt, Mycobacterium avium subsp. paratuberculosis
uggugucaggaucgccgg

SEQ ID NO: 3033811 - RNA, 15 nt, Mycobacterium avium subsp. paratuberculosis
uggugucggcgagcu

SEQ ID NO: 3033812 - RNA, 21 nt, Mycobacterium avium subsp. paratuberculosis
uggugucuuucucgaugaccc

SEQ ID NO: 3033813 - RNA, 15 nt, Mycobacterium avium subsp. paratuberculosis
uggugugcaaggcga

SEQ ID NO: 3033814 - RNA, 18 nt, Mycobacterium avium subsp. paratuberculosis
uggugugcaaggcgaugc

SEQ ID NO: 3033815 - RNA, 15 nt, Mycobacterium avium subsp. paratuberculosis
uggugugcaccagcg

SEQ ID NO: 3033816 - RNA, 16 nt, Mycobacterium avium subsp. paratuberculosis
ugguguggaucuccag

SEQ ID NO: 3033817 - RNA, 19 nt, Mycobacterium avium subsp. paratuberculosis
ugguguggcgucggccggg

SEQ ID NO: 3033818 - RNA, 18 nt, Mycobacterium avium subsp. paratuberculosis
uggugugguagggccgcu

SEQ ID NO: 3033819 - RNA, 13 nt, Mycobacterium avium subsp. paratuberculosis
ugguguucugcuc

SEQ ID NO: 3033820 - RNA, 19 nt, Mycobacterium avium subsp. paratuberculosis
ugguucaccgccaccagca

SEQ ID NO: 3033821 - RNA, 21 nt, Mycobacterium avium subsp. paratuberculosis
ugguucgacgugaucuggucg

SEQ ID NO: 3033822 - RNA, 16 nt, Mycobacterium avium subsp. paratuberculosis
ugguucguccgguagg

SEQ ID NO: 3033823 - RNA, 15 nt, Mycobacterium avium subsp. paratuberculosis
ugguugagcaccgcg

SEQ ID NO: 3033824 - RNA, 17 nt, Mycobacterium avium subsp. paratuberculosis
ugguugcggcgggccgc

SEQ ID NO: 3033825 - RNA, 22 nt, Mycobacterium avium subsp. paratuberculosis
ugguugcgguacaucccgccgg

SEQ ID NO: 3033826 - RNA, 17 nt, Mycobacterium avium subsp. paratuberculosis
ugguugcguucgccggc

SEQ ID NO: 3033827 - RNA, 13 nt, Mycobacterium avium subsp. paratuberculosis
ugguuggcccgca

SEQ ID NO: 3033828 - RNA, 15 nt, Mycobacterium avium subsp. paratuberculosis
uguaaccguggcagg

SEQ ID NO: 3033829 - RNA, 16 nt, Mycobacterium avium subsp. paratuberculosis
uguacacagggcggcg

SEQ ID NO: 3033830 - RNA, 21 nt, Mycobacterium avium subsp. paratuberculosis
uguacagcgacagcagcgugg

SEQ ID NO: 3033831 - RNA, 16 nt, Mycobacterium avium subsp. paratuberculosis
uguaccgcgagaucag

SEQ ID NO: 3033832 - RNA, 20 nt, Mycobacterium avium subsp. paratuberculosis
uguagacguagugcagccgc

SEQ ID NO: 3033833 - RNA, 14 nt, Mycobacterium avium subsp. paratuberculosis
uguagcagcgcggc

SEQ ID NO: 3033834 - RNA, 21 nt, Mycobacterium avium subsp. paratuberculosis
uguagcaggcggugguggggu

SEQ ID NO: 3033835 - RNA, 14 nt, Mycobacterium avium subsp. paratuberculosis
uguagccgccggug

SEQ ID NO: 3033836 - RNA, 18 nt, Mycobacterium avium subsp. paratuberculosis
uguagcgcugguaguaca

SEQ ID NO: 3033837 - RNA, 19 nt, Mycobacterium avium subsp. paratuberculosis
uguagcggacgggccgcau

SEQ ID NO: 3033838 - RNA, 16 nt, Mycobacterium avium subsp. paratuberculosis
uguagcggauggcgac

SEQ ID NO: 3033839 - RNA, 13 nt, Mycobacterium avium subsp. paratuberculosis
uguagcggcggcu

SEQ ID NO: 3033840 - RNA, 15 nt, Mycobacterium avium subsp. paratuberculosis
uguagcggucgugcg

SEQ ID NO: 3033841 - RNA, 13 nt, Mycobacterium avium subsp. paratuberculosis
uguaggacgccgc

SEQ ID NO: 3033842 - RNA, 17 nt, Mycobacterium avium subsp. paratuberculosis
uguaggccagcccggcg

SEQ ID NO: 3033843 - RNA, 23 nt, Mycobacterium avium subsp. paratuberculosis
uguaggcggccacacuggccaug

SEQ ID NO: 3033844 - RNA, 18 nt, Mycobacterium avium subsp. paratuberculosis
uguaggcggcgugccagg

SEQ ID NO: 3033845 - RNA, 11 nt, Mycobacterium avium subsp. paratuberculosis
uguaggugauc

SEQ ID NO: 3033846 - RNA, 19 nt, Mycobacterium avium subsp. paratuberculosis
uguaggugcgcgagauggc

SEQ ID NO: 3033847 - RNA, 15 nt, Mycobacterium avium subsp. paratuberculosis
uguaguccugcuuca

SEQ ID NO: 3033848 - RNA, 18 nt, Mycobacterium avium subsp. paratuberculosis
uguagucgaccacccgca

SEQ ID NO: 3033849 - RNA, 14 nt, Mycobacterium avium subsp. paratuberculosis
uguaguugcaaccc

SEQ ID NO: 3033850 - RNA, 20 nt, Mycobacterium avium subsp. paratuberculosis
ugucacccucgaggccgacg

SEQ ID NO: 3033851 - RNA, 16 nt, Mycobacterium avium subsp. paratuberculosis
ugucaccgacgccagc

SEQ ID NO: 3033852 - RNA, 13 nt, Mycobacterium avium subsp. paratuberculosis
ugucaccgcccac

SEQ ID NO: 3033853 - RNA, 18 nt, Mycobacterium avium subsp. paratuberculosis
ugucacguccacgccgcg

SEQ ID NO: 3033854 - RNA, 22 nt, Mycobacterium avium subsp. paratuberculosis
ugucacguugaugaucgccgau

SEQ ID NO: 3033855 - RNA, 16 nt, Mycobacterium avium subsp. paratuberculosis
ugucagcgcgaccucg

SEQ ID NO: 3033856 - RNA, 18 nt, Mycobacterium avium subsp. paratuberculosis
ugucagggcagcgguguc

SEQ ID NO: 3033857 - RNA, 15 nt, Mycobacterium avium subsp. paratuberculosis
ugucaggucggcgau

SEQ ID NO: 3033858 - RNA, 16 nt, Mycobacterium avium subsp. paratuberculosis
ugucauccgucgcccg

SEQ ID NO: 3033859 - RNA, 17 nt, Mycobacterium avium subsp. paratuberculosis
uguccacccccgcggug

SEQ ID NO: 3033860 - RNA, 16 nt, Mycobacterium avium subsp. paratuberculosis
uguccaccugcaccug

SEQ ID NO: 3033861 - RNA, 19 nt, Mycobacterium avium subsp. paratuberculosis
uguccagcagcgccggcag

SEQ ID NO: 3033862 - RNA, 20 nt, Mycobacterium avium subsp. paratuberculosis
uguccagcagcgccggcagc

SEQ ID NO: 3033863 - RNA, 15 nt, Mycobacterium avium subsp. paratuberculosis
uguccagccggugca

SEQ ID NO: 3033864 - RNA, 20 nt, Mycobacterium avium subsp. paratuberculosis
uguccagcgucucgaugacc

SEQ ID NO: 3033865 - RNA, 17 nt, Mycobacterium avium subsp. paratuberculosis
uguccaggauccccguc

SEQ ID NO: 3033866 - RNA, 19 nt, Mycobacterium avium subsp. paratuberculosis
ugucccagcgccacuggcu

SEQ ID NO: 3033867 - RNA, 14 nt, Mycobacterium avium subsp. paratuberculosis
uguccccgccggug

SEQ ID NO: 3033868 - RNA, 19 nt, Mycobacterium avium subsp. paratuberculosis
ugucccgcgcccgcgaaca

SEQ ID NO: 3033869 - RNA, 14 nt, Mycobacterium avium subsp. paratuberculosis
ugucccggccgcga

SEQ ID NO: 3033870 - RNA, 15 nt, Mycobacterium avium subsp. paratuberculosis
ugucccuugggcgga

SEQ ID NO: 3033871 - RNA, 16 nt, Mycobacterium avium subsp. paratuberculosis
uguccgaccaggaaca

SEQ ID NO: 3033872 - RNA, 14 nt, Mycobacterium avium subsp. paratuberculosis
uguccgacgccguc

SEQ ID NO: 3033873 - RNA, 15 nt, Mycobacterium avium subsp. paratuberculosis
uguccgacgccgucg

SEQ ID NO: 3033874 - RNA, 14 nt, Mycobacterium avium subsp. paratuberculosis
uguccgagccgccc

SEQ ID NO: 3033875 - RNA, 11 nt, Mycobacterium avium subsp. paratuberculosis
uguccgagcgg

SEQ ID NO: 3033876 - RNA, 15 nt, Mycobacterium avium subsp. paratuberculosis
uguccgagcgggccg

SEQ ID NO: 3033877 - RNA, 18 nt, Mycobacterium avium subsp. paratuberculosis
uguccgaugacgagcagc

SEQ ID NO: 3033878 - RNA, 19 nt, Mycobacterium avium subsp. paratuberculosis
uguccgaugacgagcagcg

SEQ ID NO: 3033879 - RNA, 17 nt, Mycobacterium avium subsp. paratuberculosis
uguccggcaggcucagc

SEQ ID NO: 3033880 - RNA, 17 nt, Mycobacterium avium subsp. paratuberculosis
uguccggcucugccugc

SEQ ID NO: 3033881 - RNA, 16 nt, Mycobacterium avium subsp. paratuberculosis
uguccgggauggacga

SEQ ID NO: 3033882 - RNA, 16 nt, Mycobacterium avium subsp. paratuberculosis
uguccggggugagcag

SEQ ID NO: 3033883 - RNA, 23 nt, Mycobacterium avium subsp. paratuberculosis
uguccgguaggccggccgcagcu

SEQ ID NO: 3033884 - RNA, 19 nt, Mycobacterium avium subsp. paratuberculosis
uguccggucuucucggcca

SEQ ID NO: 3033885 - RNA, 15 nt, Mycobacterium avium subsp. paratuberculosis
uguccgucgccggag

SEQ ID NO: 3033886 - RNA, 15 nt, Mycobacterium avium subsp. paratuberculosis
uguccuacggcgggu

SEQ ID NO: 3033887 - RNA, 17 nt, Mycobacterium avium subsp. paratuberculosis
uguccuacggcgggugc

SEQ ID NO: 3033888 - RNA, 16 nt, Mycobacterium avium subsp. paratuberculosis
uguccuccugcgccgg

SEQ ID NO: 3033889 - RNA, 22 nt, Mycobacterium avium subsp. paratuberculosis
uguccuccugcgccggcaacug

SEQ ID NO: 3033890 - RNA, 20 nt, Mycobacterium avium subsp. paratuberculosis
uguccucgagcugcacgggc

SEQ ID NO: 3033891 - RNA, 14 nt, Mycobacterium avium subsp. paratuberculosis
uguccucgggaacc

SEQ ID NO: 3033892 - RNA, 21 nt, Mycobacterium avium subsp. paratuberculosis
uguccucgucggggaacuccu

SEQ ID NO: 3033893 - RNA, 19 nt, Mycobacterium avium subsp. paratuberculosis
uguccugcaccgacugcgg

SEQ ID NO: 3033894 - RNA, 20 nt, Mycobacterium avium subsp. paratuberculosis
uguccugcaccgacugcggc

SEQ ID NO: 3033895 - RNA, 16 nt, Mycobacterium avium subsp. paratuberculosis
uguccugcucggcgac

SEQ ID NO: 3033896 - RNA, 17 nt, Mycobacterium avium subsp. paratuberculosis
ugucgaacaccgugccg

SEQ ID NO: 3033897 - RNA, 20 nt, Mycobacterium avium subsp. paratuberculosis
ugucgaacagcaggcccagg

SEQ ID NO: 3033898 - RNA, 17 nt, Mycobacterium avium subsp. paratuberculosis
ugucgaagacggcgagg

SEQ ID NO: 3033899 - RNA, 13 nt, Mycobacterium avium subsp. paratuberculosis
ugucgaagcugcg

SEQ ID NO: 3033900 - RNA, 17 nt, Mycobacterium avium subsp. paratuberculosis
ugucgaagcugcgcagc

SEQ ID NO: 3033901 - RNA, 21 nt, Mycobacterium avium subsp. paratuberculosis
ugucgaagcugcgcagccgug

SEQ ID NO: 3033902 - RNA, 14 nt, Mycobacterium avium subsp. paratuberculosis
ugucgacaggaucg

SEQ ID NO: 3033903 - RNA, 13 nt, Mycobacterium avium subsp. paratuberculosis
ugucgaccaccag

SEQ ID NO: 3033904 - RNA, 21 nt, Mycobacterium avium subsp. paratuberculosis
ugucgaccaccggguagcccg

SEQ ID NO: 3033905 - RNA, 15 nt, Mycobacterium avium subsp. paratuberculosis
ugucgaccucggcca

SEQ ID NO: 3033906 - RNA, 18 nt, Mycobacterium avium subsp. paratuberculosis
ugucgaccucggccacca

SEQ ID NO: 3033907 - RNA, 23 nt, Mycobacterium avium subsp. paratuberculosis
ugucgacgacguugcgggccagg

SEQ ID NO: 3033908 - RNA, 19 nt, Mycobacterium avium subsp. paratuberculosis
ugucgacgccgugcugccg

SEQ ID NO: 3033909 - RNA, 21 nt, Mycobacterium avium subsp. paratuberculosis
ugucgacgccgugcugccgga

SEQ ID NO: 3033910 - RNA, 14 nt, Mycobacterium avium subsp. paratuberculosis
ugucgacgucggug

SEQ ID NO: 3033911 - RNA, 15 nt, Mycobacterium avium subsp. paratuberculosis
ugucgacgucggugg

SEQ ID NO: 3033912 - RNA, 13 nt, Mycobacterium avium subsp. paratuberculosis
ugucgagcaccgc

SEQ ID NO: 3033913 - RNA, 14 nt, Mycobacterium avium subsp. paratuberculosis
ugucgagcacgucg

SEQ ID NO: 3033914 - RNA, 23 nt, Mycobacterium avium subsp. paratuberculosis
ugucgagccaccacugcgccguc

SEQ ID NO: 3033915 - RNA, 13 nt, Mycobacterium avium subsp. paratuberculosis
ugucgagccggug

SEQ ID NO: 3033916 - RNA, 22 nt, Mycobacterium avium subsp. paratuberculosis
ugucgagccggugccgaggcag

SEQ ID NO: 3033917 - RNA, 21 nt, Mycobacterium avium subsp. paratuberculosis
ugucgagcgagccgagacuga

SEQ ID NO: 3033918 - RNA, 16 nt, Mycobacterium avium subsp. paratuberculosis
ugucgaggucggugag

SEQ ID NO: 3033919 - RNA, 14 nt, Mycobacterium avium subsp. paratuberculosis
ugucgaugacggcg

SEQ ID NO: 3033920 - RNA, 19 nt, Mycobacterium avium subsp. paratuberculosis
ugucgaugacggcggcgcc

SEQ ID NO: 3033921 - RNA, 13 nt, Mycobacterium avium subsp. paratuberculosis
ugucgcaaagaca

SEQ ID NO: 3033922 - RNA, 21 nt, Mycobacterium avium subsp. paratuberculosis
ugucgcccagcugggccagcg

SEQ ID NO: 3033923 - RNA, 12 nt, Mycobacterium avium subsp. paratuberculosis
ugucgcccggcg

SEQ ID NO: 3033924 - RNA, 18 nt, Mycobacterium avium subsp. paratuberculosis
ugucgcccggcgcggcau

SEQ ID NO: 3033925 - RNA, 20 nt, Mycobacterium avium subsp. paratuberculosis
ugucgcccucgaucgcgacc

SEQ ID NO: 3033926 - RNA, 21 nt, Mycobacterium avium subsp. paratuberculosis
ugucgcccucgaucgcgacca

SEQ ID NO: 3033927 - RNA, 16 nt, Mycobacterium avium subsp. paratuberculosis
ugucgcccucgcgcag

SEQ ID NO: 3033928 - RNA, 20 nt, Mycobacterium avium subsp. paratuberculosis
ugucgccgaacgccaccacc

SEQ ID NO: 3033929 - RNA, 23 nt, Mycobacterium avium subsp. paratuberculosis
ugucgccgaacgccaccaccucc

SEQ ID NO: 3033930 - RNA, 18 nt, Mycobacterium avium subsp. paratuberculosis
ugucgccgagguccucga

SEQ ID NO: 3033931 - RNA, 17 nt, Mycobacterium avium subsp. paratuberculosis
ugucgccggcgaccgcc

SEQ ID NO: 3033932 - RNA, 21 nt, Mycobacterium avium subsp. paratuberculosis
ugucgccggcgaccgccuugu

SEQ ID NO: 3033933 - RNA, 13 nt, Mycobacterium avium subsp. paratuberculosis
ugucgccggugcu

SEQ ID NO: 3033934 - RNA, 23 nt, Mycobacterium avium subsp. paratuberculosis
ugucgccggugcuggucaugccg

SEQ ID NO: 3033935 - RNA, 19 nt, Mycobacterium avium subsp. paratuberculosis
ugucgcgcacccgcacgug

SEQ ID NO: 3033936 - RNA, 14 nt, Mycobacterium avium subsp. paratuberculosis
ugucgcgcaccgcg

SEQ ID NO: 3033937 - RNA, 16 nt, Mycobacterium avium subsp. paratuberculosis
ugucgcgcaccgcggc

SEQ ID NO: 3033938 - RNA, 19 nt, Mycobacterium avium subsp. paratuberculosis
ugucgcgcagcauccgcac

SEQ ID NO: 3033939 - RNA, 24 nt, Mycobacterium avium subsp. paratuberculosis
ugucgcgcgaacagccgaccgauc

SEQ ID NO: 3033940 - RNA, 13 nt, Mycobacterium avium subsp. paratuberculosis
ugucgcgcggcug

SEQ ID NO: 3033941 - RNA, 15 nt, Mycobacterium avium subsp. paratuberculosis
ugucgcggcccagca

SEQ ID NO: 3033942 - RNA, 20 nt, Mycobacterium avium subsp. paratuberculosis
ugucgcggcccagcaccacc

SEQ ID NO: 3033943 - RNA, 21 nt, Mycobacterium avium subsp. paratuberculosis
ugucgcggugcagacgugacg

SEQ ID NO: 3033944 - RNA, 17 nt, Mycobacterium avium subsp. paratuberculosis
ugucgcguucccgggcc

SEQ ID NO: 3033945 - RNA, 18 nt, Mycobacterium avium subsp. paratuberculosis
ugucgcguucccgggccc

SEQ ID NO: 3033946 - RNA, 21 nt, Mycobacterium avium subsp. paratuberculosis
ugucgcguucccgggcccgcu

SEQ ID NO: 3033947 - RNA, 18 nt, Mycobacterium avium subsp. paratuberculosis
ugucgcugaacgccccgu

SEQ ID NO: 3033948 - RNA, 16 nt, Mycobacterium avium subsp. paratuberculosis
ugucgcugaccaccga

SEQ ID NO: 3033949 - RNA, 14 nt, Mycobacterium avium subsp. paratuberculosis
ugucgcugccgccg

SEQ ID NO: 3033950 - RNA, 17 nt, Mycobacterium avium subsp. paratuberculosis
ugucgcugccgccgccg

SEQ ID NO: 3033951 - RNA, 20 nt, Mycobacterium avium subsp. paratuberculosis
ugucgcuggcguacgccaug

SEQ ID NO: 3033952 - RNA, 18 nt, Mycobacterium avium subsp. paratuberculosis
ugucgcuguaggccagcc

SEQ ID NO: 3033953 - RNA, 15 nt, Mycobacterium avium subsp. paratuberculosis
ugucgcuguuagccu

SEQ ID NO: 3033954 - RNA, 20 nt, Mycobacterium avium subsp. paratuberculosis
ugucgcuguuagccucgcca

SEQ ID NO: 3033955 - RNA, 20 nt, Mycobacterium avium subsp. paratuberculosis
ugucggaggccuccaggcug

SEQ ID NO: 3033956 - RNA, 18 nt, Mycobacterium avium subsp. paratuberculosis
ugucggaucgcuugacca

SEQ ID NO: 3033957 - RNA, 17 nt, Mycobacterium avium subsp. paratuberculosis
ugucggccagcgcggcg

SEQ ID NO: 3033958 - RNA, 17 nt, Mycobacterium avium subsp. paratuberculosis
ugucggccgcccguccg

SEQ ID NO: 3033959 - RNA, 13 nt, Mycobacterium avium subsp. paratuberculosis
ugucggccggcag

SEQ ID NO: 3033960 - RNA, 14 nt, Mycobacterium avium subsp. paratuberculosis
ugucggccgguccg

SEQ ID NO: 3033961 - RNA, 16 nt, Mycobacterium avium subsp. paratuberculosis
ugucggcgacccgcac

SEQ ID NO: 3033962 - RNA, 12 nt, Mycobacterium avium subsp. paratuberculosis
ugucggcgagcu

SEQ ID NO: 3033963 - RNA, 17 nt, Mycobacterium avium subsp. paratuberculosis
ugucggcgagcuugccu

SEQ ID NO: 3033964 - RNA, 16 nt, Mycobacterium avium subsp. paratuberculosis
ugucggcgauccacgc

SEQ ID NO: 3033965 - RNA, 19 nt, Mycobacterium avium subsp. paratuberculosis
ugucggcgauccacgccuc

SEQ ID NO: 3033966 - RNA, 11 nt, Mycobacterium avium subsp. paratuberculosis
ugucggcgggg

SEQ ID NO: 3033967 - RNA, 17 nt, Mycobacterium avium subsp. paratuberculosis
ugucggcggggccggug

SEQ ID NO: 3033968 - RNA, 18 nt, Mycobacterium avium subsp. paratuberculosis
ugucggcguggccguccg

SEQ ID NO: 3033969 - RNA, 15 nt, Mycobacterium avium subsp. paratuberculosis
ugucggcucgccgau

SEQ ID NO: 3033970 - RNA, 17 nt, Mycobacterium avium subsp. paratuberculosis
ugucgggcaggccggug

SEQ ID NO: 3033971 - RNA, 14 nt, Mycobacterium avium subsp. paratuberculosis
ugucgggccgcggg

SEQ ID NO: 3033972 - RNA, 15 nt, Mycobacterium avium subsp. paratuberculosis
ugucggggucgucga

SEQ ID NO: 3033973 - RNA, 22 nt, Mycobacterium avium subsp. paratuberculosis
ugucgggugcuuucgcgucugc

SEQ ID NO: 3033974 - RNA, 19 nt, Mycobacterium avium subsp. paratuberculosis
ugucggucguacgucuugc

SEQ ID NO: 3033975 - RNA, 18 nt, Mycobacterium avium subsp. paratuberculosis
ugucggugaaugucguga

SEQ ID NO: 3033976 - RNA, 17 nt, Mycobacterium avium subsp. paratuberculosis
ugucggugccgagcacg

SEQ ID NO: 3033977 - RNA, 18 nt, Mycobacterium avium subsp. paratuberculosis
ugucggugccgagcacgc

SEQ ID NO: 3033978 - RNA, 17 nt, Mycobacterium avium subsp. paratuberculosis
ugucgguggcgcgcagu

SEQ ID NO: 3033979 - RNA, 19 nt, Mycobacterium avium subsp. paratuberculosis
ugucggugguggggccggc

SEQ ID NO: 3033980 - RNA, 13 nt, Mycobacterium avium subsp. paratuberculosis
ugucgguggugug

SEQ ID NO: 3033981 - RNA, 22 nt, Mycobacterium avium subsp. paratuberculosis
ugucguagacgacgucgaccgc

SEQ ID NO: 3033982 - RNA, 15 nt, Mycobacterium avium subsp. paratuberculosis
ugucguagcggcgcc

SEQ ID NO: 3033983 - RNA, 14 nt, Mycobacterium avium subsp. paratuberculosis
ugucguagcggcug

SEQ ID NO: 3033984 - RNA, 21 nt, Mycobacterium avium subsp. paratuberculosis
ugucguaguugcgcgccgaug

SEQ ID NO: 3033985 - RNA, 22 nt, Mycobacterium avium subsp. paratuberculosis
ugucguccagugacgccugcgg

SEQ ID NO: 3033986 - RNA, 14 nt, Mycobacterium avium subsp. paratuberculosis
ugucgucgaccucg

SEQ ID NO: 3033987 - RNA, 13 nt, Mycobacterium avium subsp. paratuberculosis
ugucgucgacgcu

SEQ ID NO: 3033988 - RNA, 14 nt, Mycobacterium avium subsp. paratuberculosis
ugucgucgccggug

SEQ ID NO: 3033989 - RNA, 19 nt, Mycobacterium avium subsp. paratuberculosis
ugucgucgccgguggccgc

SEQ ID NO: 3033990 - RNA, 22 nt, Mycobacterium avium subsp. paratuberculosis
ugucgucgcugacgccgagcag

SEQ ID NO: 3033991 - RNA, 20 nt, Mycobacterium avium subsp. paratuberculosis
ugucgucggcggacuggcug

SEQ ID NO: 3033992 - RNA, 20 nt, Mycobacterium avium subsp. paratuberculosis
ugucgucgucgccgccggug

SEQ ID NO: 3033993 - RNA, 23 nt, Mycobacterium avium subsp. paratuberculosis
ugucgucgucgccgccggugaag

SEQ ID NO: 3033994 - RNA, 21 nt, Mycobacterium avium subsp. paratuberculosis
ugucgucguugugggccagcg

SEQ ID NO: 3033995 - RNA, 16 nt, Mycobacterium avium subsp. paratuberculosis
ugucgugggcgugccg

SEQ ID NO: 3033996 - RNA, 18 nt, Mycobacterium avium subsp. paratuberculosis
ugucguugacgcugggcg

SEQ ID NO: 3033997 - RNA, 14 nt, Mycobacterium avium subsp. paratuberculosis
ugucguugaugccg

SEQ ID NO: 3033998 - RNA, 18 nt, Mycobacterium avium subsp. paratuberculosis
ugugaacccugggcggcg

SEQ ID NO: 3033999 - RNA, 22 nt, Mycobacterium avium subsp. paratuberculosis
ugugacacagccaaagccuacg

SEQ ID NO: 3034000 - RNA, 12 nt, Mycobacterium avium subsp. paratuberculosis
ugugaccacggu

SEQ ID NO: 3034001 - RNA, 16 nt, Mycobacterium avium subsp. paratuberculosis
ugugacgcucgcgguu

SEQ ID NO: 3034002 - RNA, 18 nt, Mycobacterium avium subsp. paratuberculosis
ugugaucgagcaccagcg

SEQ ID NO: 3034003 - RNA, 14 nt, Mycobacterium avium subsp. paratuberculosis
ugugaucggcggcc

SEQ ID NO: 3034004 - RNA, 12 nt, Mycobacterium avium subsp. paratuberculosis
ugugcaaggcga

SEQ ID NO: 3034005 - RNA, 18 nt, Mycobacterium avium subsp. paratuberculosis
ugugcaccugagucuggg

SEQ ID NO: 3034006 - RNA, 17 nt, Mycobacterium avium subsp. paratuberculosis
ugugcacgauggacagg

SEQ ID NO: 3034007 - RNA, 13 nt, Mycobacterium avium subsp. paratuberculosis
ugugccacaggua

SEQ ID NO: 3034008 - RNA, 16 nt, Mycobacterium avium subsp. paratuberculosis
ugugccaccgccgaug

SEQ ID NO: 3034009 - RNA, 16 nt, Mycobacterium avium subsp. paratuberculosis
ugugcccagcacgacg

SEQ ID NO: 3034010 - RNA, 14 nt, Mycobacterium avium subsp. paratuberculosis
ugugcccgacggcg

SEQ ID NO: 3034011 - RNA, 12 nt, Mycobacterium avium subsp. paratuberculosis
ugugcccgcccu

SEQ ID NO: 3034012 - RNA, 22 nt, Mycobacterium avium subsp. paratuberculosis
ugugccgaagggcaaccgcagc

SEQ ID NO: 3034013 - RNA, 20 nt, Mycobacterium avium subsp. paratuberculosis
ugugccgcaaggcauuccag

SEQ ID NO: 3034014 - RNA, 18 nt, Mycobacterium avium subsp. paratuberculosis
ugugccgcugcauccgca

SEQ ID NO: 3034015 - RNA, 20 nt, Mycobacterium avium subsp. paratuberculosis
ugugccgcugguaggcggcg

SEQ ID NO: 3034016 - RNA, 12 nt, Mycobacterium avium subsp. paratuberculosis
ugugccggcggg

SEQ ID NO: 3034017 - RNA, 12 nt, Mycobacterium avium subsp. paratuberculosis
ugugccugcggg

SEQ ID NO: 3034018 - RNA, 12 nt, Mycobacterium avium subsp. paratuberculosis
ugugccuggccc

SEQ ID NO: 3034019 - RNA, 17 nt, Mycobacterium avium subsp. paratuberculosis
ugugccuggcccagaca

SEQ ID NO: 3034020 - RNA, 18 nt, Mycobacterium avium subsp. paratuberculosis
ugugccuggcuccccggc

SEQ ID NO: 3034021 - RNA, 17 nt, Mycobacterium avium subsp. paratuberculosis
ugugcgcaucggcgacg

SEQ ID NO: 3034022 - RNA, 21 nt, Mycobacterium avium subsp. paratuberculosis
ugugcgcaucggcgacgccgc

SEQ ID NO: 3034023 - RNA, 14 nt, Mycobacterium avium subsp. paratuberculosis
ugugcgccaugucc

SEQ ID NO: 3034024 - RNA, 20 nt, Mycobacterium avium subsp. paratuberculosis
ugugcgcuugggucgccggg

SEQ ID NO: 3034025 - RNA, 17 nt, Mycobacterium avium subsp. paratuberculosis
ugugcggcagcucggcg

SEQ ID NO: 3034026 - RNA, 13 nt, Mycobacterium avium subsp. paratuberculosis
ugugcggcgcggc

SEQ ID NO: 3034027 - RNA, 17 nt, Mycobacterium avium subsp. paratuberculosis
ugugcggcgcggcggug

SEQ ID NO: 3034028 - RNA, 12 nt, Mycobacterium avium subsp. paratuberculosis
ugugcggcggcu

SEQ ID NO: 3034029 - RNA, 23 nt, Mycobacterium avium subsp. paratuberculosis
ugugcgugguggggccgaugacc

SEQ ID NO: 3034030 - RNA, 13 nt, Mycobacterium avium subsp. paratuberculosis
ugugcuagcgagc

SEQ ID NO: 3034031 - RNA, 18 nt, Mycobacterium avium subsp. paratuberculosis
ugugcucggcgagguaga

SEQ ID NO: 3034032 - RNA, 14 nt, Mycobacterium avium subsp. paratuberculosis
ugugcucggcggcg

SEQ ID NO: 3034033 - RNA, 12 nt, Mycobacterium avium subsp. paratuberculosis
ugugcuggccag

SEQ ID NO: 3034034 - RNA, 19 nt, Mycobacterium avium subsp. paratuberculosis
ugugcuggccagcaccagc

SEQ ID NO: 3034035 - RNA, 15 nt, Mycobacterium avium subsp. paratuberculosis
ugugcuugaucagcg

SEQ ID NO: 3034036 - RNA, 22 nt, Mycobacterium avium subsp. paratuberculosis
uguggaacaucuccagcgcggu

SEQ ID NO: 3034037 - RNA, 19 nt, Mycobacterium avium subsp. paratuberculosis
uguggaagggccccggcau

SEQ ID NO: 3034038 - RNA, 14 nt, Mycobacterium avium subsp. paratuberculosis
uguggaccgcgcag

SEQ ID NO: 3034039 - RNA, 16 nt, Mycobacterium avium subsp. paratuberculosis
uguggagaccaggucc

SEQ ID NO: 3034040 - RNA, 15 nt, Mycobacterium avium subsp. paratuberculosis
uguggaucuccagca

SEQ ID NO: 3034041 - RNA, 22 nt, Mycobacterium avium subsp. paratuberculosis
uguggaucuccagcagcuucau

SEQ ID NO: 3034042 - RNA, 18 nt, Mycobacterium avium subsp. paratuberculosis
uguggaugacgcagccga

SEQ ID NO: 3034043 - RNA, 15 nt, Mycobacterium avium subsp. paratuberculosis
uguggcaucaccgcc

SEQ ID NO: 3034044 - RNA, 16 nt, Mycobacterium avium subsp. paratuberculosis
uguggcccaggccggc

SEQ ID NO: 3034045 - RNA, 17 nt, Mycobacterium avium subsp. paratuberculosis
uguggcccaggccggcg

SEQ ID NO: 3034046 - RNA, 20 nt, Mycobacterium avium subsp. paratuberculosis
uguggccgcggcggcccggc

SEQ ID NO: 3034047 - RNA, 17 nt, Mycobacterium avium subsp. paratuberculosis
uguggcgugugggcucg

SEQ ID NO: 3034048 - RNA, 18 nt, Mycobacterium avium subsp. paratuberculosis
uguggcgugugggcucgc

SEQ ID NO: 3034049 - RNA, 12 nt, Mycobacterium avium subsp. paratuberculosis
ugugggccagca

SEQ ID NO: 3034050 - RNA, 14 nt, Mycobacterium avium subsp. paratuberculosis
ugugggccagcagc

SEQ ID NO: 3034051 - RNA, 16 nt, Mycobacterium avium subsp. paratuberculosis
ugugggccagcgcggu

SEQ ID NO: 3034052 - RNA, 17 nt, Mycobacterium avium subsp. paratuberculosis
ugugggcgauggcggcg

SEQ ID NO: 3034053 - RNA, 20 nt, Mycobacterium avium subsp. paratuberculosis
ugugggcgauggcggcgucg

SEQ ID NO: 3034054 - RNA, 23 nt, Mycobacterium avium subsp. paratuberculosis
ugugggcgcccgcggcgcgcagg

SEQ ID NO: 3034055 - RNA, 12 nt, Mycobacterium avium subsp. paratuberculosis
ugugggcgccgu

SEQ ID NO: 3034056 - RNA, 17 nt, Mycobacterium avium subsp. paratuberculosis
ugugggcucgcccgggc

SEQ ID NO: 3034057 - RNA, 13 nt, Mycobacterium avium subsp. paratuberculosis
ugugggucgacag

SEQ ID NO: 3034058 - RNA, 15 nt, Mycobacterium avium subsp. paratuberculosis
uguggguggucagcg

SEQ ID NO: 3034059 - RNA, 15 nt, Mycobacterium avium subsp. paratuberculosis
ugugguacagcgcca

SEQ ID NO: 3034060 - RNA, 19 nt, Mycobacterium avium subsp. paratuberculosis
ugugguacagcgccagcgg

SEQ ID NO: 3034061 - RNA, 15 nt, Mycobacterium avium subsp. paratuberculosis
uguggucgaucccgc

SEQ ID NO: 3034062 - RNA, 19 nt, Mycobacterium avium subsp. paratuberculosis
uguuaagacuucggcgaac

SEQ ID NO: 3034063 - RNA, 22 nt, Mycobacterium avium subsp. paratuberculosis
uguucaccccguugagcagcgg

SEQ ID NO: 3034064 - RNA, 16 nt, Mycobacterium avium subsp. paratuberculosis
uguuccuugcggccgc

SEQ ID NO: 3034065 - RNA, 18 nt, Mycobacterium avium subsp. paratuberculosis
uguucgacugcaggaaca

SEQ ID NO: 3034066 - RNA, 17 nt, Mycobacterium avium subsp. paratuberculosis
uguucgagaguuugccc

SEQ ID NO: 3034067 - RNA, 14 nt, Mycobacterium avium subsp. paratuberculosis
uguucgaugcgguc

SEQ ID NO: 3034068 - RNA, 19 nt, Mycobacterium avium subsp. paratuberculosis
uguucgaugcggucccgcg

SEQ ID NO: 3034069 - RNA, 22 nt, Mycobacterium avium subsp. paratuberculosis
uguucgccgaggaaccggcagc

SEQ ID NO: 3034070 - RNA, 16 nt, Mycobacterium avium subsp. paratuberculosis
uguucgccgucgcggg

SEQ ID NO: 3034071 - RNA, 18 nt, Mycobacterium avium subsp. paratuberculosis
uguucgccgucgcgggug

SEQ ID NO: 3034072 - RNA, 11 nt, Mycobacterium avium subsp. paratuberculosis
uguucgcggcu

SEQ ID NO: 3034073 - RNA, 15 nt, Mycobacterium avium subsp. paratuberculosis
uguucggcgccagcc

SEQ ID NO: 3034074 - RNA, 19 nt, Mycobacterium avium subsp. paratuberculosis
uguucggcgccagccgcac

SEQ ID NO: 3034075 - RNA, 16 nt, Mycobacterium avium subsp. paratuberculosis
uguucggguagacgau

SEQ ID NO: 3034076 - RNA, 15 nt, Mycobacterium avium subsp. paratuberculosis
uguucucgagcccga

SEQ ID NO: 3034077 - RNA, 19 nt, Mycobacterium avium subsp. paratuberculosis
uguugaacgccgcguccuc

SEQ ID NO: 3034078 - RNA, 17 nt, Mycobacterium avium subsp. paratuberculosis
uguugaccacccgcagc

SEQ ID NO: 3034079 - RNA, 16 nt, Mycobacterium avium subsp. paratuberculosis
uguugaccuucucgac

SEQ ID NO: 3034080 - RNA, 20 nt, Mycobacterium avium subsp. paratuberculosis
uguugacgggccgcggccag

SEQ ID NO: 3034081 - RNA, 16 nt, Mycobacterium avium subsp. paratuberculosis
uguugagcucgcggcg

SEQ ID NO: 3034082 - RNA, 19 nt, Mycobacterium avium subsp. paratuberculosis
uguugaggaugucgacgau

SEQ ID NO: 3034083 - RNA, 20 nt, Mycobacterium avium subsp. paratuberculosis
uguugaucagguucaccagc

SEQ ID NO: 3034084 - RNA, 17 nt, Mycobacterium avium subsp. paratuberculosis
uguugaugucgcgcggc

SEQ ID NO: 3034085 - RNA, 18 nt, Mycobacterium avium subsp. paratuberculosis
uguugccccgcgagagaa

SEQ ID NO: 3034086 - RNA, 16 nt, Mycobacterium avium subsp. paratuberculosis
uguugcgcacccgcgg

SEQ ID NO: 3034087 - RNA, 19 nt, Mycobacterium avium subsp. paratuberculosis
uguugcgcagcgaacguca

SEQ ID NO: 3034088 - RNA, 15 nt, Mycobacterium avium subsp. paratuberculosis
uguugcgcagcgucu

SEQ ID NO: 3034089 - RNA, 18 nt, Mycobacterium avium subsp. paratuberculosis
uguugcggccggccauga

SEQ ID NO: 3034090 - RNA, 16 nt, Mycobacterium avium subsp. paratuberculosis
uguugcggcggccggc

SEQ ID NO: 3034091 - RNA, 14 nt, Mycobacterium avium subsp. paratuberculosis
uguugcgguccagg

SEQ ID NO: 3034092 - RNA, 21 nt, Mycobacterium avium subsp. paratuberculosis
uguugcucggggcucgcggug

SEQ ID NO: 3034093 - RNA, 15 nt, Mycobacterium avium subsp. paratuberculosis
uguuggaaccggcca

SEQ ID NO: 3034094 - RNA, 11 nt, Mycobacterium avium subsp. paratuberculosis
uguuggccaga

SEQ ID NO: 3034095 - RNA, 16 nt, Mycobacterium avium subsp. paratuberculosis
uguuggccgcgacgcc

SEQ ID NO: 3034096 - RNA, 14 nt, Mycobacterium avium subsp. paratuberculosis
uguuggcgacggug

SEQ ID NO: 3034097 - RNA, 14 nt, Mycobacterium avium subsp. paratuberculosis
uguuggcggcggug

SEQ ID NO: 3034098 - RNA, 16 nt, Mycobacterium avium subsp. paratuberculosis
uguugguaagcgacga

SEQ ID NO: 3034099 - RNA, 18 nt, Mycobacterium avium subsp. paratuberculosis
uguuguccaacaugccuu

SEQ ID NO: 3034100 - RNA, 16 nt, Mycobacterium avium subsp. paratuberculosis
uguuguccgaccagga

SEQ ID NO: 3034101 - RNA, 18 nt, Mycobacterium avium subsp. paratuberculosis
uguuguggucugaccccc

SEQ ID NO: 3034102 - RNA, 22 nt, Mycobacterium avium subsp. paratuberculosis
uguuugaucaccaccugguccu

SEQ ID NO: 3034103 - RNA, 11 nt, Mycobacterium avium subsp. paratuberculosis
uguuugcugca

SEQ ID NO: 3034104 - RNA, 13 nt, Mycobacterium avium subsp. paratuberculosis
uguuuggccgcgc

SEQ ID NO: 3034105 - RNA, 20 nt, Mycobacterium avium subsp. paratuberculosis
uuaaucgcccaacaacucga

SEQ ID NO: 3034106 - RNA, 11 nt, Mycobacterium avium subsp. paratuberculosis
uuacgcccgau

SEQ ID NO: 3034107 - RNA, 19 nt, Mycobacterium avium subsp. paratuberculosis
uuacgcccgaucccgggcc

SEQ ID NO: 3034108 - RNA, 19 nt, Mycobacterium avium subsp. paratuberculosis
uuacggcgugaccggcugc

SEQ ID NO: 3034109 - RNA, 20 nt, Mycobacterium avium subsp. paratuberculosis
uuacguggacgcgcgcggcg

SEQ ID NO: 3034110 - RNA, 15 nt, Mycobacterium avium subsp. paratuberculosis
uuacucgccggcggc

SEQ ID NO: 3034111 - RNA, 15 nt, Mycobacterium avium subsp. paratuberculosis
uuagccccucccacc

SEQ ID NO: 3034112 - RNA, 13 nt, Mycobacterium avium subsp. paratuberculosis
uuagcccggccgc

SEQ ID NO: 3034113 - RNA, 23 nt, Mycobacterium avium subsp. paratuberculosis
uuauucggcuucguaacacccuc

SEQ ID NO: 3034114 - RNA, 17 nt, Mycobacterium avium subsp. paratuberculosis
uucaaccccgcgcgcgg

SEQ ID NO: 3034115 - RNA, 15 nt, Mycobacterium avium subsp. paratuberculosis
uucaccagcacgguc

SEQ ID NO: 3034116 - RNA, 19 nt, Mycobacterium avium subsp. paratuberculosis
uucaccagggugccccgcg

SEQ ID NO: 3034117 - RNA, 13 nt, Mycobacterium avium subsp. paratuberculosis
uucaccccggcgc

SEQ ID NO: 3034118 - RNA, 15 nt, Mycobacterium avium subsp. paratuberculosis
uucaccccggcgcgg

SEQ ID NO: 3034119 - RNA, 19 nt, Mycobacterium avium subsp. paratuberculosis
uucaccccguugagcagcg

SEQ ID NO: 3034120 - RNA, 17 nt, Mycobacterium avium subsp. paratuberculosis
uucaccgccaccagcag

SEQ ID NO: 3034121 - RNA, 13 nt, Mycobacterium avium subsp. paratuberculosis
uucaccgcgccgg

SEQ ID NO: 3034122 - RNA, 22 nt, Mycobacterium avium subsp. paratuberculosis
uucaccgcgccgggcaccacca

SEQ ID NO: 3034123 - RNA, 15 nt, Mycobacterium avium subsp. paratuberculosis
uucaccgcgccgguc

SEQ ID NO: 3034124 - RNA, 15 nt, Mycobacterium avium subsp. paratuberculosis
uucaccgugcgcgcg

SEQ ID NO: 3034125 - RNA, 11 nt, Mycobacterium avium subsp. paratuberculosis
uucaccucuuc

SEQ ID NO: 3034126 - RNA, 15 nt, Mycobacterium avium subsp. paratuberculosis
uucacgaagaacacu

SEQ ID NO: 3034127 - RNA, 15 nt, Mycobacterium avium subsp. paratuberculosis
uucacgaccggcagc

SEQ ID NO: 3034128 - RNA, 13 nt, Mycobacterium avium subsp. paratuberculosis
uucacgaggccgg

SEQ ID NO: 3034129 - RNA, 16 nt, Mycobacterium avium subsp. paratuberculosis
uucacgcucgcgugcg

SEQ ID NO: 3034130 - RNA, 13 nt, Mycobacterium avium subsp. paratuberculosis
uucacgcucggcg

SEQ ID NO: 3034131 - RNA, 14 nt, Mycobacterium avium subsp. paratuberculosis
uucacgcucggcgg

SEQ ID NO: 3034132 - RNA, 22 nt, Mycobacterium avium subsp. paratuberculosis
uucacgucgaucacgccgccgg

SEQ ID NO: 3034133 - RNA, 16 nt, Mycobacterium avium subsp. paratuberculosis
uucagaagucgcccgc

SEQ ID NO: 3034134 - RNA, 21 nt, Mycobacterium avium subsp. paratuberculosis
uucagcaacccgaaagccccc

SEQ ID NO: 3034135 - RNA, 15 nt, Mycobacterium avium subsp. paratuberculosis
uucagcagccggcag

SEQ ID NO: 3034136 - RNA, 15 nt, Mycobacterium avium subsp. paratuberculosis
uucagccccucgggg

SEQ ID NO: 3034137 - RNA, 15 nt, Mycobacterium avium subsp. paratuberculosis
uucagcccucgagcc

SEQ ID NO: 3034138 - RNA, 15 nt, Mycobacterium avium subsp. paratuberculosis
uucagccggagccgg

SEQ ID NO: 3034139 - RNA, 12 nt, Mycobacterium avium subsp. paratuberculosis
uucagccggcgg

SEQ ID NO: 3034140 - RNA, 15 nt, Mycobacterium avium subsp. paratuberculosis
uucagccggcgguuc

SEQ ID NO: 3034141 - RNA, 19 nt, Mycobacterium avium subsp. paratuberculosis
uucagcgacuugccgccgg

SEQ ID NO: 3034142 - RNA, 16 nt, Mycobacterium avium subsp. paratuberculosis
uucagcgggcgguugc

SEQ ID NO: 3034143 - RNA, 19 nt, Mycobacterium avium subsp. paratuberculosis
uucagcugcagccggccgg

SEQ ID NO: 3034144 - RNA, 19 nt, Mycobacterium avium subsp. paratuberculosis
uucaggcccgcgccgacgg

SEQ ID NO: 3034145 - RNA, 13 nt, Mycobacterium avium subsp. paratuberculosis
uucagggcggugc

SEQ ID NO: 3034146 - RNA, 21 nt, Mycobacterium avium subsp. paratuberculosis
uucaggucuccguugucgagg

SEQ ID NO: 3034147 - RNA, 24 nt, Mycobacterium avium subsp. paratuberculosis
uucaggucuccguugucgaggucg

SEQ ID NO: 3034148 - RNA, 15 nt, Mycobacterium avium subsp. paratuberculosis
uucaucgccgucgcc

SEQ ID NO: 3034149 - RNA, 20 nt, Mycobacterium avium subsp. paratuberculosis
uucaugaucucguugcggcg

SEQ ID NO: 3034150 - RNA, 18 nt, Mycobacterium avium subsp. paratuberculosis
uucauguggaagccgcga

SEQ ID NO: 3034151 - RNA, 14 nt, Mycobacterium avium subsp. paratuberculosis
uuccaaccaccgug

SEQ ID NO: 3034152 - RNA, 19 nt, Mycobacterium avium subsp. paratuberculosis
uuccaaccaggcgcucguc

SEQ ID NO: 3034153 - RNA, 20 nt, Mycobacterium avium subsp. paratuberculosis
uuccaagccgggcggcagca

SEQ ID NO: 3034154 - RNA, 21 nt, Mycobacterium avium subsp. paratuberculosis
uuccaagccgggcggcagcag

SEQ ID NO: 3034155 - RNA, 20 nt, Mycobacterium avium subsp. paratuberculosis
uuccacagcccguugcugcg

SEQ ID NO: 3034156 - RNA, 22 nt, Mycobacterium avium subsp. paratuberculosis
uuccacagcccguugcugcguu

SEQ ID NO: 3034157 - RNA, 16 nt, Mycobacterium avium subsp. paratuberculosis
uuccacaucagguuga

SEQ ID NO: 3034158 - RNA, 14 nt, Mycobacterium avium subsp. paratuberculosis
uuccaccaccgcgg

SEQ ID NO: 3034159 - RNA, 15 nt, Mycobacterium avium subsp. paratuberculosis
uuccaccagcggccg

SEQ ID NO: 3034160 - RNA, 23 nt, Mycobacterium avium subsp. paratuberculosis
uuccaccucgggccgggcgggca

SEQ ID NO: 3034161 - RNA, 16 nt, Mycobacterium avium subsp. paratuberculosis
uuccacgaccuggcgg

SEQ ID NO: 3034162 - RNA, 11 nt, Mycobacterium avium subsp. paratuberculosis
uuccacgccgg

SEQ ID NO: 3034163 - RNA, 12 nt, Mycobacterium avium subsp. paratuberculosis
uuccacugccaa

SEQ ID NO: 3034164 - RNA, 14 nt, Mycobacterium avium subsp. paratuberculosis
uuccagaccggcgg

SEQ ID NO: 3034165 - RNA, 14 nt, Mycobacterium avium subsp. paratuberculosis
uuccagaucugucu

SEQ ID NO: 3034166 - RNA, 14 nt, Mycobacterium avium subsp. paratuberculosis
uuccagcaccaccc

SEQ ID NO: 3034167 - RNA, 14 nt, Mycobacterium avium subsp. paratuberculosis
uuccagcacccggc

SEQ ID NO: 3034168 - RNA, 21 nt, Mycobacterium avium subsp. paratuberculosis
uuccagcacccggcccacgcc

SEQ ID NO: 3034169 - RNA, 22 nt, Mycobacterium avium subsp. paratuberculosis
uuccagcacccggcccacgccg

SEQ ID NO: 3034170 - RNA, 23 nt, Mycobacterium avium subsp. paratuberculosis
uuccagcacccggcccacgccgu

SEQ ID NO: 3034171 - RNA, 14 nt, Mycobacterium avium subsp. paratuberculosis
uuccagcacgccca

SEQ ID NO: 3034172 - RNA, 17 nt, Mycobacterium avium subsp. paratuberculosis
uuccagccauucgucgg

SEQ ID NO: 3034173 - RNA, 19 nt, Mycobacterium avium subsp. paratuberculosis
uuccagccgaucgcggugc

SEQ ID NO: 3034174 - RNA, 11 nt, Mycobacterium avium subsp. paratuberculosis
uuccagcgcca

SEQ ID NO: 3034175 - RNA, 11 nt, Mycobacterium avium subsp. paratuberculosis
uuccagcgccg

SEQ ID NO: 3034176 - RNA, 22 nt, Mycobacterium avium subsp. paratuberculosis
uuccagcgccggcaccagcagc

SEQ ID NO: 3034177 - RNA, 19 nt, Mycobacterium avium subsp. paratuberculosis
uuccagcgcgaccgcccgg

SEQ ID NO: 3034178 - RNA, 17 nt, Mycobacterium avium subsp. paratuberculosis
uuccagcgcguagucgg

SEQ ID NO: 3034179 - RNA, 14 nt, Mycobacterium avium subsp. paratuberculosis
uuccaguccggcgc

SEQ ID NO: 3034180 - RNA, 16 nt, Mycobacterium avium subsp. paratuberculosis
uuccauauuggcuagc

SEQ ID NO: 3034181 - RNA, 14 nt, Mycobacterium avium subsp. paratuberculosis
uuccaucagcgccc

SEQ ID NO: 3034182 - RNA, 20 nt, Mycobacterium avium subsp. paratuberculosis
uuccaucagcgcccgcgcgg

SEQ ID NO: 3034183 - RNA, 17 nt, Mycobacterium avium subsp. paratuberculosis
uuccaucgggcccagca

SEQ ID NO: 3034184 - RNA, 19 nt, Mycobacterium avium subsp. paratuberculosis
uuccaucgggcccagcagc

SEQ ID NO: 3034185 - RNA, 20 nt, Mycobacterium avium subsp. paratuberculosis
uuccaucgggcccagcagcc

SEQ ID NO: 3034186 - RNA, 16 nt, Mycobacterium avium subsp. paratuberculosis
uuccaugucgacgacg

SEQ ID NO: 3034187 - RNA, 14 nt, Mycobacterium avium subsp. paratuberculosis
uuccaugucgucga

SEQ ID NO: 3034188 - RNA, 17 nt, Mycobacterium avium subsp. paratuberculosis
uuccaugucgucgagcu

SEQ ID NO: 3034189 - RNA, 19 nt, Mycobacterium avium subsp. paratuberculosis
uuccauucacgguccauca

SEQ ID NO: 3034190 - RNA, 17 nt, Mycobacterium avium subsp. paratuberculosis
uucccaguccggccagc

SEQ ID NO: 3034191 - RNA, 18 nt, Mycobacterium avium subsp. paratuberculosis
uuccccggcggccggccc

SEQ ID NO: 3034192 - RNA, 21 nt, Mycobacterium avium subsp. paratuberculosis
uuccccguagucacccggccc

SEQ ID NO: 3034193 - RNA, 22 nt, Mycobacterium avium subsp. paratuberculosis
uucccgaacagggcgacggcgg

SEQ ID NO: 3034194 - RNA, 10 nt, Mycobacterium avium subsp. paratuberculosis
uucccgccgc

SEQ ID NO: 3034195 - RNA, 12 nt, Mycobacterium avium subsp. paratuberculosis
uucccgccgccg

SEQ ID NO: 3034196 - RNA, 16 nt, Mycobacterium avium subsp. paratuberculosis
uucccgccgccgcggg

SEQ ID NO: 3034197 - RNA, 14 nt, Mycobacterium avium subsp. paratuberculosis
uucccgccgccguc

SEQ ID NO: 3034198 - RNA, 18 nt, Mycobacterium avium subsp. paratuberculosis
uucccgcgagcugccccu

SEQ ID NO: 3034199 - RNA, 14 nt, Mycobacterium avium subsp. paratuberculosis
uucccgcuuggcgg

SEQ ID NO: 3034200 - RNA, 21 nt, Mycobacterium avium subsp. paratuberculosis
uucccggcagaacgacgccag

SEQ ID NO: 3034201 - RNA, 21 nt, Mycobacterium avium subsp. paratuberculosis
uuccgccgcgcccgucgagcg

SEQ ID NO: 3034202 - RNA, 15 nt, Mycobacterium avium subsp. paratuberculosis
uuccgccggagacga

SEQ ID NO: 3034203 - RNA, 13 nt, Mycobacterium avium subsp. paratuberculosis
uuccgccucggcg

SEQ ID NO: 3034204 - RNA, 23 nt, Mycobacterium avium subsp. paratuberculosis
uuccgccucggcgaggucgucga

SEQ ID NO: 3034205 - RNA, 19 nt, Mycobacterium avium subsp. paratuberculosis
uuccgcgacaaggucgacc

SEQ ID NO: 3034206 - RNA, 13 nt, Mycobacterium avium subsp. paratuberculosis
uuccgcgucggcc

SEQ ID NO: 3034207 - RNA, 19 nt, Mycobacterium avium subsp. paratuberculosis
uuccgcugaugcggccgga

SEQ ID NO: 3034208 - RNA, 22 nt, Mycobacterium avium subsp. paratuberculosis
uuccggaucaaccacaccagca

SEQ ID NO: 3034209 - RNA, 20 nt, Mycobacterium avium subsp. paratuberculosis
uuccggccggccgccggcgg

SEQ ID NO: 3034210 - RNA, 19 nt, Mycobacterium avium subsp. paratuberculosis
uuccggcgcgaucggccgc

SEQ ID NO: 3034211 - RNA, 16 nt, Mycobacterium avium subsp. paratuberculosis
uuccgggaagucgucg

SEQ ID NO: 3034212 - RNA, 20 nt, Mycobacterium avium subsp. paratuberculosis
uuccgggccaccgucuucgg

SEQ ID NO: 3034213 - RNA, 16 nt, Mycobacterium avium subsp. paratuberculosis
uuccgggcgaccccgg

SEQ ID NO: 3034214 - RNA, 19 nt, Mycobacterium avium subsp. paratuberculosis
uuccggggaaccgcccuuc

SEQ ID NO: 3034215 - RNA, 22 nt, Mycobacterium avium subsp. paratuberculosis
uuccgguggacuccagcaccag

SEQ ID NO: 3034216 - RNA, 14 nt, Mycobacterium avium subsp. paratuberculosis
uuccggugucgagc

SEQ ID NO: 3034217 - RNA, 20 nt, Mycobacterium avium subsp. paratuberculosis
uuccgucgaacagcgggcag

SEQ ID NO: 3034218 - RNA, 14 nt, Mycobacterium avium subsp. paratuberculosis
uuccgucuuggcca

SEQ ID NO: 3034219 - RNA, 18 nt, Mycobacterium avium subsp. paratuberculosis
uuccguugugccaccgcc

SEQ ID NO: 3034220 - RNA, 14 nt, Mycobacterium avium subsp. paratuberculosis
uuccuccucggcgc

SEQ ID NO: 3034221 - RNA, 19 nt, Mycobacterium avium subsp. paratuberculosis
uuccucgcugaccucgaca

SEQ ID NO: 3034222 - RNA, 16 nt, Mycobacterium avium subsp. paratuberculosis
uuccucgcuguccugc

SEQ ID NO: 3034223 - RNA, 17 nt, Mycobacterium avium subsp. paratuberculosis
uuccucggcgcucgccg

SEQ ID NO: 3034224 - RNA, 20 nt, Mycobacterium avium subsp. paratuberculosis
uuccucgugcgugcgcucga

SEQ ID NO: 3034225 - RNA, 23 nt, Mycobacterium avium subsp. paratuberculosis
uuccugcgcgugcuugccgaugu

SEQ ID NO: 3034226 - RNA, 21 nt, Mycobacterium avium subsp. paratuberculosis
uuccugcgcuaccaggcgugc

SEQ ID NO: 3034227 - RNA, 21 nt, Mycobacterium avium subsp. paratuberculosis
uuccugggacagccggucgac

SEQ ID NO: 3034228 - RNA, 16 nt, Mycobacterium avium subsp. paratuberculosis
uucgaacgcccgcacc

SEQ ID NO: 3034229 - RNA, 23 nt, Mycobacterium avium subsp. paratuberculosis
uucgaagcccgugccgaugccgg

SEQ ID NO: 3034230 - RNA, 13 nt, Mycobacterium avium subsp. paratuberculosis
uucgaagcgcagc

SEQ ID NO: 3034231 - RNA, 19 nt, Mycobacterium avium subsp. paratuberculosis
uucgaaguacucaccggug

SEQ ID NO: 3034232 - RNA, 23 nt, Mycobacterium avium subsp. paratuberculosis
uucgacacggugaacgucgaucc

SEQ ID NO: 3034233 - RNA, 12 nt, Mycobacterium avium subsp. paratuberculosis
uucgacccggug

SEQ ID NO: 3034234 - RNA, 14 nt, Mycobacterium avium subsp. paratuberculosis
uucgaccuccacga

SEQ ID NO: 3034235 - RNA, 23 nt, Mycobacterium avium subsp. paratuberculosis
uucgacgauguuggcgacgacgg

SEQ ID NO: 3034236 - RNA, 15 nt, Mycobacterium avium subsp. paratuberculosis
uucgacggccggccc

SEQ ID NO: 3034237 - RNA, 20 nt, Mycobacterium avium subsp. paratuberculosis
uucgacggugaugucgccgg

SEQ ID NO: 3034238 - RNA, 23 nt, Mycobacterium avium subsp. paratuberculosis
uucgacggugaugucgccggcgg

SEQ ID NO: 3034239 - RNA, 22 nt, Mycobacterium avium subsp. paratuberculosis
uucgagacacgcgccggcgcgg

SEQ ID NO: 3034240 - RNA, 13 nt, Mycobacterium avium subsp. paratuberculosis
uucgagccgccgc

SEQ ID NO: 3034241 - RNA, 19 nt, Mycobacterium avium subsp. paratuberculosis
uucgaggaucugggcggcg

SEQ ID NO: 3034242 - RNA, 18 nt, Mycobacterium avium subsp. paratuberculosis
uucgaggugcucgcgcag

SEQ ID NO: 3034243 - RNA, 19 nt, Mycobacterium avium subsp. paratuberculosis
uucgaucaaaucccgcagc

SEQ ID NO: 3034244 - RNA, 20 nt, Mycobacterium avium subsp. paratuberculosis
uucgaucaggcgcagcccga

SEQ ID NO: 3034245 - RNA, 15 nt, Mycobacterium avium subsp. paratuberculosis
uucgaugcccuccag

SEQ ID NO: 3034246 - RNA, 16 nt, Mycobacterium avium subsp. paratuberculosis
uucgaugcgcucggcg

SEQ ID NO: 3034247 - RNA, 17 nt, Mycobacterium avium subsp. paratuberculosis
uucgaugcgcucggcga

SEQ ID NO: 3034248 - RNA, 17 nt, Mycobacterium avium subsp. paratuberculosis
uucgaugggaaccgcuc

SEQ ID NO: 3034249 - RNA, 17 nt, Mycobacterium avium subsp. paratuberculosis
uucgaugucggccagcg

SEQ ID NO: 3034250 - RNA, 18 nt, Mycobacterium avium subsp. paratuberculosis
uucgccagugccgcgcgg

SEQ ID NO: 3034251 - RNA, 13 nt, Mycobacterium avium subsp. paratuberculosis
uucgcccaccccg

SEQ ID NO: 3034252 - RNA, 19 nt, Mycobacterium avium subsp. paratuberculosis
uucgcccggcugcgccgcg

SEQ ID NO: 3034253 - RNA, 20 nt, Mycobacterium avium subsp. paratuberculosis
uucgcccuccccggccagca

SEQ ID NO: 3034254 - RNA, 15 nt, Mycobacterium avium subsp. paratuberculosis
uucgccgacagcagc

SEQ ID NO: 3034255 - RNA, 16 nt, Mycobacterium avium subsp. paratuberculosis
uucgccgaggaaccgg

SEQ ID NO: 3034256 - RNA, 19 nt, Mycobacterium avium subsp. paratuberculosis
uucgccgauguccccgcgg

SEQ ID NO: 3034257 - RNA, 16 nt, Mycobacterium avium subsp. paratuberculosis
uucgccgcgcuugcga

SEQ ID NO: 3034258 - RNA, 20 nt, Mycobacterium avium subsp. paratuberculosis
uucgccgcgcuugcgaccgc

SEQ ID NO: 3034259 - RNA, 14 nt, Mycobacterium avium subsp. paratuberculosis
uucgccggccagca

SEQ ID NO: 3034260 - RNA, 18 nt, Mycobacterium avium subsp. paratuberculosis
uucgccggccagcacgcc

SEQ ID NO: 3034261 - RNA, 20 nt, Mycobacterium avium subsp. paratuberculosis
uucgccggcgacggccagcg

SEQ ID NO: 3034262 - RNA, 17 nt, Mycobacterium avium subsp. paratuberculosis
uucgccggggccuucuu

SEQ ID NO: 3034263 - RNA, 23 nt, Mycobacterium avium subsp. paratuberculosis
uucgccuccgggaaggcggccgc

SEQ ID NO: 3034264 - RNA, 18 nt, Mycobacterium avium subsp. paratuberculosis
uucgccugcagccgccgc

SEQ ID NO: 3034265 - RNA, 19 nt, Mycobacterium avium subsp. paratuberculosis
uucgccugcagccgccgcg

SEQ ID NO: 3034266 - RNA, 20 nt, Mycobacterium avium subsp. paratuberculosis
uucgcgaacuucaggcccuc

SEQ ID NO: 3034267 - RNA, 22 nt, Mycobacterium avium subsp. paratuberculosis
uucgcgaucacguucucggcga

SEQ ID NO: 3034268 - RNA, 20 nt, Mycobacterium avium subsp. paratuberculosis
uucgcgcaccaccucggcga

SEQ ID NO: 3034269 - RNA, 22 nt, Mycobacterium avium subsp. paratuberculosis
uucgcgcacgccaucgccucgg

SEQ ID NO: 3034270 - RNA, 13 nt, Mycobacterium avium subsp. paratuberculosis
uucgcgcacgcug

SEQ ID NO: 3034271 - RNA, 22 nt, Mycobacterium avium subsp. paratuberculosis
uucgcgcacgcuggccggcagc

SEQ ID NO: 3034272 - RNA, 23 nt, Mycobacterium avium subsp. paratuberculosis
uucgcgcacggcgcgcaccgcgg

SEQ ID NO: 3034273 - RNA, 16 nt, Mycobacterium avium subsp. paratuberculosis
uucgcgcacgucgagg

SEQ ID NO: 3034274 - RNA, 13 nt, Mycobacterium avium subsp. paratuberculosis
uucgcgcgcggcg

SEQ ID NO: 3034275 - RNA, 18 nt, Mycobacterium avium subsp. paratuberculosis
uucgcggauccgggccgc

SEQ ID NO: 3034276 - RNA, 15 nt, Mycobacterium avium subsp. paratuberculosis
uucgcggcuggccgc

SEQ ID NO: 3034277 - RNA, 16 nt, Mycobacterium avium subsp. paratuberculosis
uucgcggcuggccgcg

SEQ ID NO: 3034278 - RNA, 17 nt, Mycobacterium avium subsp. paratuberculosis
uucgcggcuggccgcgg

SEQ ID NO: 3034279 - RNA, 17 nt, Mycobacterium avium subsp. paratuberculosis
uucgcgggugccuucuu

SEQ ID NO: 3034280 - RNA, 20 nt, Mycobacterium avium subsp. paratuberculosis
uucgcgggugcgcucgacgg

SEQ ID NO: 3034281 - RNA, 23 nt, Mycobacterium avium subsp. paratuberculosis
uucgcggucggcaacccgaccuc

SEQ ID NO: 3034282 - RNA, 17 nt, Mycobacterium avium subsp. paratuberculosis
uucgcguacccgcgcgg

SEQ ID NO: 3034283 - RNA, 17 nt, Mycobacterium avium subsp. paratuberculosis
uucgcgucugcucgcgg

SEQ ID NO: 3034284 - RNA, 17 nt, Mycobacterium avium subsp. paratuberculosis
uucgcgugugcccagca

SEQ ID NO: 3034285 - RNA, 17 nt, Mycobacterium avium subsp. paratuberculosis
uucgcguuccgccacgg

SEQ ID NO: 3034286 - RNA, 20 nt, Mycobacterium avium subsp. paratuberculosis
uucgcguuccgccacggcgg

SEQ ID NO: 3034287 - RNA, 17 nt, Mycobacterium avium subsp. paratuberculosis
uucgcucgucggcgcgg

SEQ ID NO: 3034288 - RNA, 15 nt, Mycobacterium avium subsp. paratuberculosis
uucgcugcccucggu

SEQ ID NO: 3034289 - RNA, 17 nt, Mycobacterium avium subsp. paratuberculosis
uucgcugcccucggucg

SEQ ID NO: 3034290 - RNA, 16 nt, Mycobacterium avium subsp. paratuberculosis
uucgcugccgccgccg

SEQ ID NO: 3034291 - RNA, 16 nt, Mycobacterium avium subsp. paratuberculosis
uucgcugcgccggcgg

SEQ ID NO: 3034292 - RNA, 17 nt, Mycobacterium avium subsp. paratuberculosis
uucgcuggcggccagcg

SEQ ID NO: 3034293 - RNA, 14 nt, Mycobacterium avium subsp. paratuberculosis
uucgcuggcggggc

SEQ ID NO: 3034294 - RNA, 16 nt, Mycobacterium avium subsp. paratuberculosis
uucgcuggcggggcgu

SEQ ID NO: 3034295 - RNA, 15 nt, Mycobacterium avium subsp. paratuberculosis
uucgcuuucgccggg

SEQ ID NO: 3034296 - RNA, 16 nt, Mycobacterium avium subsp. paratuberculosis
uucggaggucagcagg

SEQ ID NO: 3034297 - RNA, 15 nt, Mycobacterium avium subsp. paratuberculosis
uucggaguccaccgg

SEQ ID NO: 3034298 - RNA, 16 nt, Mycobacterium avium subsp. paratuberculosis
uucggaguccaccggc

SEQ ID NO: 3034299 - RNA, 19 nt, Mycobacterium avium subsp. paratuberculosis
uucggccaccgcgcggcgg

SEQ ID NO: 3034300 - RNA, 20 nt, Mycobacterium avium subsp. paratuberculosis
uucggccaccgcguccgcgg

SEQ ID NO: 3034301 - RNA, 20 nt, Mycobacterium avium subsp. paratuberculosis
uucggccagaucggccaggu

SEQ ID NO: 3034302 - RNA, 23 nt, Mycobacterium avium subsp. paratuberculosis
uucggccagcgcggugugcggcg

SEQ ID NO: 3034303 - RNA, 19 nt, Mycobacterium avium subsp. paratuberculosis
uucggccagcgcgucggcc

SEQ ID NO: 3034304 - RNA, 17 nt, Mycobacterium avium subsp. paratuberculosis
uucggcccggcucaaug

SEQ ID NO: 3034305 - RNA, 12 nt, Mycobacterium avium subsp. paratuberculosis
uucggccgcgga

SEQ ID NO: 3034306 - RNA, 15 nt, Mycobacterium avium subsp. paratuberculosis
uucggccggcagcgg

SEQ ID NO: 3034307 - RNA, 19 nt, Mycobacterium avium subsp. paratuberculosis
uucggccggccccgcccgg

SEQ ID NO: 3034308 - RNA, 22 nt, Mycobacterium avium subsp. paratuberculosis
uucggccggccccgcccggcgc

SEQ ID NO: 3034309 - RNA, 18 nt, Mycobacterium avium subsp. paratuberculosis
uucggcgauccgggcacg

SEQ ID NO: 3034310 - RNA, 16 nt, Mycobacterium avium subsp. paratuberculosis
uucggcgaucucgucg

SEQ ID NO: 3034311 - RNA, 19 nt, Mycobacterium avium subsp. paratuberculosis
uucggcgaucucgucgcgg

SEQ ID NO: 3034312 - RNA, 23 nt, Mycobacterium avium subsp. paratuberculosis
uucggcgaugcguugcgccagca

SEQ ID NO: 3034313 - RNA, 22 nt, Mycobacterium avium subsp. paratuberculosis
uucggcgccaacaacucgacgc

SEQ ID NO: 3034314 - RNA, 23 nt, Mycobacterium avium subsp. paratuberculosis
uucggcgccaacaacucgacgcu

SEQ ID NO: 3034315 - RNA, 15 nt, Mycobacterium avium subsp. paratuberculosis
uucggcgccaccccg

SEQ ID NO: 3034316 - RNA, 13 nt, Mycobacterium avium subsp. paratuberculosis
uucggcgccagcc

SEQ ID NO: 3034317 - RNA, 24 nt, Mycobacterium avium subsp. paratuberculosis
uucggcgccgcgaccccggaccgc

SEQ ID NO: 3034318 - RNA, 18 nt, Mycobacterium avium subsp. paratuberculosis
uucggcgcgcagcucgcg

SEQ ID NO: 3034319 - RNA, 12 nt, Mycobacterium avium subsp. paratuberculosis
uucggcgcggcu

SEQ ID NO: 3034320 - RNA, 17 nt, Mycobacterium avium subsp. paratuberculosis
uucggcguccucgacgc

SEQ ID NO: 3034321 - RNA, 19 nt, Mycobacterium avium subsp. paratuberculosis
uucggcguccucgacgccg

SEQ ID NO: 3034322 - RNA, 22 nt, Mycobacterium avium subsp. paratuberculosis
uucggcgucgccuuccugcgcg

SEQ ID NO: 3034323 - RNA, 15 nt, Mycobacterium avium subsp. paratuberculosis
uucggcguggcggug

SEQ ID NO: 3034324 - RNA, 13 nt, Mycobacterium avium subsp. paratuberculosis
uucggcucggcga

SEQ ID NO: 3034325 - RNA, 15 nt, Mycobacterium avium subsp. paratuberculosis
uucgggcagcgccuc

SEQ ID NO: 3034326 - RNA, 12 nt, Mycobacterium avium subsp. paratuberculosis
uucgggccagcc

SEQ ID NO: 3034327 - RNA, 15 nt, Mycobacterium avium subsp. paratuberculosis
uucgggcccggccgc

SEQ ID NO: 3034328 - RNA, 21 nt, Mycobacterium avium subsp. paratuberculosis
uucgggccugaccaaggacaa

SEQ ID NO: 3034329 - RNA, 20 nt, Mycobacterium avium subsp. paratuberculosis
uucgggcugcgcuugcggcg

SEQ ID NO: 3034330 - RNA, 23 nt, Mycobacterium avium subsp. paratuberculosis
uucggggguaaaccgccagcagc

SEQ ID NO: 3034331 - RNA, 17 nt, Mycobacterium avium subsp. paratuberculosis
uucggggguggccagcu

SEQ ID NO: 3034332 - RNA, 17 nt, Mycobacterium avium subsp. paratuberculosis
uucgggguggucaccgg

SEQ ID NO: 3034333 - RNA, 13 nt, Mycobacterium avium subsp. paratuberculosis
uucgggucgacga

SEQ ID NO: 3034334 - RNA, 21 nt, Mycobacterium avium subsp. paratuberculosis
uucggguggcgucgccgccgg

SEQ ID NO: 3034335 - RNA, 12 nt, Mycobacterium avium subsp. paratuberculosis
uucggucagcac

SEQ ID NO: 3034336 - RNA, 11 nt, Mycobacterium avium subsp. paratuberculosis
uucgguccagg

SEQ ID NO: 3034337 - RNA, 22 nt, Mycobacterium avium subsp. paratuberculosis
uucggucccggcgggggcggcg

SEQ ID NO: 3034338 - RNA, 22 nt, Mycobacterium avium subsp. paratuberculosis
uucgguggcgauggugcugccc

SEQ ID NO: 3034339 - RNA, 18 nt, Mycobacterium avium subsp. paratuberculosis
uucgguggggccgccguc

SEQ ID NO: 3034340 - RNA, 16 nt, Mycobacterium avium subsp. paratuberculosis
uucgguugucgcggug

SEQ ID NO: 3034341 - RNA, 22 nt, Mycobacterium avium subsp. paratuberculosis
uucguaccuagggcccacgcuc

SEQ ID NO: 3034342 - RNA, 15 nt, Mycobacterium avium subsp. paratuberculosis
uucguagaucacggc

SEQ ID NO: 3034343 - RNA, 19 nt, Mycobacterium avium subsp. paratuberculosis
uucguagggacugcgccgg

SEQ ID NO: 3034344 - RNA, 17 nt, Mycobacterium avium subsp. paratuberculosis
uucgucaacgccccggu

SEQ ID NO: 3034345 - RNA, 22 nt, Mycobacterium avium subsp. paratuberculosis
uucgucaaugauggucagccgc

SEQ ID NO: 3034346 - RNA, 14 nt, Mycobacterium avium subsp. paratuberculosis
uucguccagcccga

SEQ ID NO: 3034347 - RNA, 17 nt, Mycobacterium avium subsp. paratuberculosis
uucgucccaguccagcc

SEQ ID NO: 3034348 - RNA, 21 nt, Mycobacterium avium subsp. paratuberculosis
uucguccgugcugccggccgg

SEQ ID NO: 3034349 - RNA, 14 nt, Mycobacterium avium subsp. paratuberculosis
uucgucgaacagga

SEQ ID NO: 3034350 - RNA, 18 nt, Mycobacterium avium subsp. paratuberculosis
uucgucgaaguagggccg

SEQ ID NO: 3034351 - RNA, 20 nt, Mycobacterium avium subsp. paratuberculosis
uucgucgaaguagggccgca

SEQ ID NO: 3034352 - RNA, 18 nt, Mycobacterium avium subsp. paratuberculosis
uucgucgaccgucacgcu

SEQ ID NO: 3034353 - RNA, 13 nt, Mycobacterium avium subsp. paratuberculosis
uucgucgaucagc

SEQ ID NO: 3034354 - RNA, 15 nt, Mycobacterium avium subsp. paratuberculosis
uucgucgccggccgc

SEQ ID NO: 3034355 - RNA, 23 nt, Mycobacterium avium subsp. paratuberculosis
uucgucgccggccgccagcgccc

SEQ ID NO: 3034356 - RNA, 15 nt, Mycobacterium avium subsp. paratuberculosis
uucgucgccggugag

SEQ ID NO: 3034357 - RNA, 12 nt, Mycobacterium avium subsp. paratuberculosis
uucgucgcggcg

SEQ ID NO: 3034358 - RNA, 14 nt, Mycobacterium avium subsp. paratuberculosis
uucgucggcggugu

SEQ ID NO: 3034359 - RNA, 18 nt, Mycobacterium avium subsp. paratuberculosis
uucgucggugcgcgccgc

SEQ ID NO: 3034360 - RNA, 19 nt, Mycobacterium avium subsp. paratuberculosis
uucgucgucggccucggcg

SEQ ID NO: 3034361 - RNA, 20 nt, Mycobacterium avium subsp. paratuberculosis
uucgucgucggccucggcgg

SEQ ID NO: 3034362 - RNA, 22 nt, Mycobacterium avium subsp. paratuberculosis
uucgucgucguuggcccgccgc

SEQ ID NO: 3034363 - RNA, 12 nt, Mycobacterium avium subsp. paratuberculosis
uucgugcuguga

SEQ ID NO: 3034364 - RNA, 21 nt, Mycobacterium avium subsp. paratuberculosis
uucguggucucgcaccugccg

SEQ ID NO: 3034365 - RNA, 19 nt, Mycobacterium avium subsp. paratuberculosis
uucgugucaccgcccacga

SEQ ID NO: 3034366 - RNA, 19 nt, Mycobacterium avium subsp. paratuberculosis
uucuacggcgggccggcgc

SEQ ID NO: 3034367 - RNA, 21 nt, Mycobacterium avium subsp. paratuberculosis
uucucacaggugacgacgcuc

SEQ ID NO: 3034368 - RNA, 13 nt, Mycobacterium avium subsp. paratuberculosis
uucuccagcacga

SEQ ID NO: 3034369 - RNA, 23 nt, Mycobacterium avium subsp. paratuberculosis
uucuccagcacgaaggccgccgg

SEQ ID NO: 3034370 - RNA, 18 nt, Mycobacterium avium subsp. paratuberculosis
uucuccauccgggcggcc

SEQ ID NO: 3034371 - RNA, 19 nt, Mycobacterium avium subsp. paratuberculosis
uucuccccgccucgguuga

SEQ ID NO: 3034372 - RNA, 15 nt, Mycobacterium avium subsp. paratuberculosis
uucuccggcccgcuc

SEQ ID NO: 3034373 - RNA, 17 nt, Mycobacterium avium subsp. paratuberculosis
uucucgaccaggcucac

SEQ ID NO: 3034374 - RNA, 22 nt, Mycobacterium avium subsp. paratuberculosis
uucucgaugacccaccagccga

SEQ ID NO: 3034375 - RNA, 12 nt, Mycobacterium avium subsp. paratuberculosis
uucucgcacagc

SEQ ID NO: 3034376 - RNA, 14 nt, Mycobacterium avium subsp. paratuberculosis
uucucgcacagcac

SEQ ID NO: 3034377 - RNA, 18 nt, Mycobacterium avium subsp. paratuberculosis
uucucgcccggcuccacg

SEQ ID NO: 3034378 - RNA, 19 nt, Mycobacterium avium subsp. paratuberculosis
uucucgcccggcuccacga

SEQ ID NO: 3034379 - RNA, 22 nt, Mycobacterium avium subsp. paratuberculosis
uucucgccgugcagcaccucga

SEQ ID NO: 3034380 - RNA, 12 nt, Mycobacterium avium subsp. paratuberculosis
uucucgcgcagg

SEQ ID NO: 3034381 - RNA, 10 nt, Mycobacterium avium subsp. paratuberculosis
uucucgcggc

SEQ ID NO: 3034382 - RNA, 14 nt, Mycobacterium avium subsp. paratuberculosis
uucucggacgcccg

SEQ ID NO: 3034383 - RNA, 21 nt, Mycobacterium avium subsp. paratuberculosis
uucucggaguaguuccggcgg

SEQ ID NO: 3034384 - RNA, 14 nt, Mycobacterium avium subsp. paratuberculosis
uucugcaccagcuc

SEQ ID NO: 3034385 - RNA, 21 nt, Mycobacterium avium subsp. paratuberculosis
uucugcacgacgaacaccacc

SEQ ID NO: 3034386 - RNA, 16 nt, Mycobacterium avium subsp. paratuberculosis
uucugccacucgucga

SEQ ID NO: 3034387 - RNA, 11 nt, Mycobacterium avium subsp. paratuberculosis
uucugcgccgg

SEQ ID NO: 3034388 - RNA, 16 nt, Mycobacterium avium subsp. paratuberculosis
uucugcgcgccgucgg

SEQ ID NO: 3034389 - RNA, 16 nt, Mycobacterium avium subsp. paratuberculosis
uucugcgucggcuuga

SEQ ID NO: 3034390 - RNA, 16 nt, Mycobacterium avium subsp. paratuberculosis
uucugcucuucggugg

SEQ ID NO: 3034391 - RNA, 13 nt, Mycobacterium avium subsp. paratuberculosis
uucugcugcacgu

SEQ ID NO: 3034392 - RNA, 18 nt, Mycobacterium avium subsp. paratuberculosis
uucuggaugcggucgucg

SEQ ID NO: 3034393 - RNA, 19 nt, Mycobacterium avium subsp. paratuberculosis
uucuggccgaccgccgcca

SEQ ID NO: 3034394 - RNA, 16 nt, Mycobacterium avium subsp. paratuberculosis
uucuggccguggucgg

SEQ ID NO: 3034395 - RNA, 19 nt, Mycobacterium avium subsp. paratuberculosis
uucuggcgcugcucggagg

SEQ ID NO: 3034396 - RNA, 19 nt, Mycobacterium avium subsp. paratuberculosis
uucuguugucggcucgccg

SEQ ID NO: 3034397 - RNA, 17 nt, Mycobacterium avium subsp. paratuberculosis
uucuucagccgcagcug

SEQ ID NO: 3034398 - RNA, 15 nt, Mycobacterium avium subsp. paratuberculosis
uucuucagggcggug

SEQ ID NO: 3034399 - RNA, 20 nt, Mycobacterium avium subsp. paratuberculosis
uucuucgccgcagccuucuu

SEQ ID NO: 3034400 - RNA, 21 nt, Mycobacterium avium subsp. paratuberculosis
uucuucgccgcagccuucuug

SEQ ID NO: 3034401 - RNA, 20 nt, Mycobacterium avium subsp. paratuberculosis
uucuucgccggcgcuuugcc

SEQ ID NO: 3034402 - RNA, 20 nt, Mycobacterium avium subsp. paratuberculosis
uucuucgccggggccuucuu

SEQ ID NO: 3034403 - RNA, 21 nt, Mycobacterium avium subsp. paratuberculosis
uucuucgccggggccuucuug

SEQ ID NO: 3034404 - RNA, 24 nt, Mycobacterium avium subsp. paratuberculosis
uucuucgcgaagaacgacgccacc

SEQ ID NO: 3034405 - RNA, 21 nt, Mycobacterium avium subsp. paratuberculosis
uucuucgcgggugccuucuug

SEQ ID NO: 3034406 - RNA, 22 nt, Mycobacterium avium subsp. paratuberculosis
uucuugaccgcagccuucuucg

SEQ ID NO: 3034407 - RNA, 23 nt, Mycobacterium avium subsp. paratuberculosis
uucuugcccgaauugcgcugcac

SEQ ID NO: 3034408 - RNA, 23 nt, Mycobacterium avium subsp. paratuberculosis
uucuugcugcccgcggccgccgc

SEQ ID NO: 3034409 - RNA, 16 nt, Mycobacterium avium subsp. paratuberculosis
uucuugcugccgucgg

SEQ ID NO: 3034410 - RNA, 13 nt, Mycobacterium avium subsp. paratuberculosis
uucuuggccgcgc

SEQ ID NO: 3034411 - RNA, 22 nt, Mycobacterium avium subsp. paratuberculosis
uucuuggccgcgcccuucuucg

SEQ ID NO: 3034412 - RNA, 12 nt, Mycobacterium avium subsp. paratuberculosis
uucuuggccgga

SEQ ID NO: 3034413 - RNA, 21 nt, Mycobacterium avium subsp. paratuberculosis
uucuuggccggagccuugguc

SEQ ID NO: 3034414 - RNA, 16 nt, Mycobacterium avium subsp. paratuberculosis
uucuuggcgggcgacu

SEQ ID NO: 3034415 - RNA, 20 nt, Mycobacterium avium subsp. paratuberculosis
uucuuggcgggcgccuucuu

SEQ ID NO: 3034416 - RNA, 18 nt, Mycobacterium avium subsp. paratuberculosis
uugaacggcaccccgcgg

SEQ ID NO: 3034417 - RNA, 14 nt, Mycobacterium avium subsp. paratuberculosis
uugaacucggccag

SEQ ID NO: 3034418 - RNA, 12 nt, Mycobacterium avium subsp. paratuberculosis
uugaagcccucg

SEQ ID NO: 3034419 - RNA, 14 nt, Mycobacterium avium subsp. paratuberculosis
uugaagccggugag

SEQ ID NO: 3034420 - RNA, 12 nt, Mycobacterium avium subsp. paratuberculosis
uugaagcgcaga

SEQ ID NO: 3034421 - RNA, 21 nt, Mycobacterium avium subsp. paratuberculosis
uugaagcgcagaucgcgcauc

SEQ ID NO: 3034422 - RNA, 16 nt, Mycobacterium avium subsp. paratuberculosis
uugaccaccagguagg

SEQ ID NO: 3034423 - RNA, 16 nt, Mycobacterium avium subsp. paratuberculosis
uugaccaccgagccgg

SEQ ID NO: 3034424 - RNA, 14 nt, Mycobacterium avium subsp. paratuberculosis
uugaccacggcgcg

SEQ ID NO: 3034425 - RNA, 14 nt, Mycobacterium avium subsp. paratuberculosis
uugaccacggugcg

SEQ ID NO: 3034426 - RNA, 13 nt, Mycobacterium avium subsp. paratuberculosis
uugaccagcagcu

SEQ ID NO: 3034427 - RNA, 12 nt, Mycobacterium avium subsp. paratuberculosis
uugaccaggugg

SEQ ID NO: 3034428 - RNA, 21 nt, Mycobacterium avium subsp. paratuberculosis
uugacccaggcccgggaucgg

SEQ ID NO: 3034429 - RNA, 15 nt, Mycobacterium avium subsp. paratuberculosis
uugaccccgacggcg

SEQ ID NO: 3034430 - RNA, 20 nt, Mycobacterium avium subsp. paratuberculosis
uugaccccgacggcgccgcg

SEQ ID NO: 3034431 - RNA, 20 nt, Mycobacterium avium subsp. paratuberculosis
uugaccccggccccggccgg

SEQ ID NO: 3034432 - RNA, 13 nt, Mycobacterium avium subsp. paratuberculosis
uugacccggccgg

SEQ ID NO: 3034433 - RNA, 22 nt, Mycobacterium avium subsp. paratuberculosis
uugacccggccggucgccugcu

SEQ ID NO: 3034434 - RNA, 15 nt, Mycobacterium avium subsp. paratuberculosis
uugacccucagcagg

SEQ ID NO: 3034435 - RNA, 15 nt, Mycobacterium avium subsp. paratuberculosis
uugaccgccuuggcc

SEQ ID NO: 3034436 - RNA, 18 nt, Mycobacterium avium subsp. paratuberculosis
uugaccgccuuggccacg

SEQ ID NO: 3034437 - RNA, 17 nt, Mycobacterium avium subsp. paratuberculosis
uugaccgugacggugcg

SEQ ID NO: 3034438 - RNA, 13 nt, Mycobacterium avium subsp. paratuberculosis
uugacgccgacag

SEQ ID NO: 3034439 - RNA, 13 nt, Mycobacterium avium subsp. paratuberculosis
uugacgccgccga

SEQ ID NO: 3034440 - RNA, 16 nt, Mycobacterium avium subsp. paratuberculosis
uugacggccgcggcgg

SEQ ID NO: 3034441 - RNA, 15 nt, Mycobacterium avium subsp. paratuberculosis
uugacggccugggcg

SEQ ID NO: 3034442 - RNA, 14 nt, Mycobacterium avium subsp. paratuberculosis
uugacgggccgcgg

SEQ ID NO: 3034443 - RNA, 21 nt, Mycobacterium avium subsp. paratuberculosis
uugacggucugggaggcggcg

SEQ ID NO: 3034444 - RNA, 17 nt, Mycobacterium avium subsp. paratuberculosis
uugacggugaccggcgc

SEQ ID NO: 3034445 - RNA, 15 nt, Mycobacterium avium subsp. paratuberculosis
uugacguaacacccu

SEQ ID NO: 3034446 - RNA, 12 nt, Mycobacterium avium subsp. paratuberculosis
uugagcacgccc

SEQ ID NO: 3034447 - RNA, 19 nt, Mycobacterium avium subsp. paratuberculosis
uugagcacggugaucagca

SEQ ID NO: 3034448 - RNA, 22 nt, Mycobacterium avium subsp. paratuberculosis
uugagcacggugaucagcagca

SEQ ID NO: 3034449 - RNA, 19 nt, Mycobacterium avium subsp. paratuberculosis
uugagcagcagaccgccgg

SEQ ID NO: 3034450 - RNA, 13 nt, Mycobacterium avium subsp. paratuberculosis
uugagcaggcugg

SEQ ID NO: 3034451 - RNA, 21 nt, Mycobacterium avium subsp. paratuberculosis
uugagcauguugaacgccgcg

SEQ ID NO: 3034452 - RNA, 22 nt, Mycobacterium avium subsp. paratuberculosis
uugagccacaacaugucccggg

SEQ ID NO: 3034453 - RNA, 15 nt, Mycobacterium avium subsp. paratuberculosis
uugagccccgccggg

SEQ ID NO: 3034454 - RNA, 16 nt, Mycobacterium avium subsp. paratuberculosis
uugagccgcucgccgg

SEQ ID NO: 3034455 - RNA, 17 nt, Mycobacterium avium subsp. paratuberculosis
uugagccgcucgccggg

SEQ ID NO: 3034456 - RNA, 23 nt, Mycobacterium avium subsp. paratuberculosis
uugagccggucgugcgacuccug

SEQ ID NO: 3034457 - RNA, 14 nt, Mycobacterium avium subsp. paratuberculosis
uugagcgccagcgc

SEQ ID NO: 3034458 - RNA, 22 nt, Mycobacterium avium subsp. paratuberculosis
uugagcuccggugauucgugca

SEQ ID NO: 3034459 - RNA, 16 nt, Mycobacterium avium subsp. paratuberculosis
uugagcuucccggcgg

SEQ ID NO: 3034460 - RNA, 22 nt, Mycobacterium avium subsp. paratuberculosis
uugagcuucccggcggucgccg

SEQ ID NO: 3034461 - RNA, 14 nt, Mycobacterium avium subsp. paratuberculosis
uugaggcggcggcg

SEQ ID NO: 3034462 - RNA, 16 nt, Mycobacterium avium subsp. paratuberculosis
uugagucccucggcga

SEQ ID NO: 3034463 - RNA, 19 nt, Mycobacterium avium subsp. paratuberculosis
uugagucccucggcgagcg

SEQ ID NO: 3034464 - RNA, 20 nt, Mycobacterium avium subsp. paratuberculosis
uugagugcgccgugcagcac

SEQ ID NO: 3034465 - RNA, 15 nt, Mycobacterium avium subsp. paratuberculosis
uugauaggucacgcc

SEQ ID NO: 3034466 - RNA, 22 nt, Mycobacterium avium subsp. paratuberculosis
uugaucacaccgucggcgaucg

SEQ ID NO: 3034467 - RNA, 17 nt, Mycobacterium avium subsp. paratuberculosis
uugaucacccgggucga

SEQ ID NO: 3034468 - RNA, 15 nt, Mycobacterium avium subsp. paratuberculosis
uugaucaguuccuug

SEQ ID NO: 3034469 - RNA, 17 nt, Mycobacterium avium subsp. paratuberculosis
uugauccggaucgggcg

SEQ ID NO: 3034470 - RNA, 15 nt, Mycobacterium avium subsp. paratuberculosis
uugauccggccgcgg

SEQ ID NO: 3034471 - RNA, 21 nt, Mycobacterium avium subsp. paratuberculosis
uugaucgagcaccgggcgucg

SEQ ID NO: 3034472 - RNA, 13 nt, Mycobacterium avium subsp. paratuberculosis
uugaucucggcgg

SEQ ID NO: 3034473 - RNA, 16 nt, Mycobacterium avium subsp. paratuberculosis
uugaucucggcggcga

SEQ ID NO: 3034474 - RNA, 15 nt, Mycobacterium avium subsp. paratuberculosis
uugaucucgucgcgg

SEQ ID NO: 3034475 - RNA, 19 nt, Mycobacterium avium subsp. paratuberculosis
uugaugaacacggucgccg

SEQ ID NO: 3034476 - RNA, 20 nt, Mycobacterium avium subsp. paratuberculosis
uugaugaacacggucgccgg

SEQ ID NO: 3034477 - RNA, 15 nt, Mycobacterium avium subsp. paratuberculosis
uugaugaugcugucg

SEQ ID NO: 3034478 - RNA, 14 nt, Mycobacterium avium subsp. paratuberculosis
uugaugccguccgg

SEQ ID NO: 3034479 - RNA, 20 nt, Mycobacterium avium subsp. paratuberculosis
uugaugccgucgguggucca

SEQ ID NO: 3034480 - RNA, 14 nt, Mycobacterium avium subsp. paratuberculosis
uugaugucggccag

SEQ ID NO: 3034481 - RNA, 22 nt, Mycobacterium avium subsp. paratuberculosis
uugauugcgcuugucagcggcc

SEQ ID NO: 3034482 - RNA, 21 nt, Mycobacterium avium subsp. paratuberculosis
uugcaccaccgucuugccguu

SEQ ID NO: 3034483 - RNA, 13 nt, Mycobacterium avium subsp. paratuberculosis
uugcacggcggcg

SEQ ID NO: 3034484 - RNA, 21 nt, Mycobacterium avium subsp. paratuberculosis
uugcagcgccgcggcgcccuc

SEQ ID NO: 3034485 - RNA, 17 nt, Mycobacterium avium subsp. paratuberculosis
uugcagcuuggcggugg

SEQ ID NO: 3034486 - RNA, 15 nt, Mycobacterium avium subsp. paratuberculosis
uugcaggccacgccc

SEQ ID NO: 3034487 - RNA, 14 nt, Mycobacterium avium subsp. paratuberculosis
uugccaacugcagc

SEQ ID NO: 3034488 - RNA, 16 nt, Mycobacterium avium subsp. paratuberculosis
uugccaacugcagcaa

SEQ ID NO: 3034489 - RNA, 17 nt, Mycobacterium avium subsp. paratuberculosis
uugccacugagcgcagg

SEQ ID NO: 3034490 - RNA, 15 nt, Mycobacterium avium subsp. paratuberculosis
uugcccgacuccuca

SEQ ID NO: 3034491 - RNA, 13 nt, Mycobacterium avium subsp. paratuberculosis
uugcccgccagca

SEQ ID NO: 3034492 - RNA, 19 nt, Mycobacterium avium subsp. paratuberculosis
uugcccggcgagcgacgcc

SEQ ID NO: 3034493 - RNA, 23 nt, Mycobacterium avium subsp. paratuberculosis
uugcccggcgagcgacgccacgg

SEQ ID NO: 3034494 - RNA, 17 nt, Mycobacterium avium subsp. paratuberculosis
uugcccugaacgucuug

SEQ ID NO: 3034495 - RNA, 16 nt, Mycobacterium avium subsp. paratuberculosis
uugcccugcgugcaga

SEQ ID NO: 3034496 - RNA, 12 nt, Mycobacterium avium subsp. paratuberculosis
uugccgacgacg

SEQ ID NO: 3034497 - RNA, 18 nt, Mycobacterium avium subsp. paratuberculosis
uugccgaucccggccagc

SEQ ID NO: 3034498 - RNA, 14 nt, Mycobacterium avium subsp. paratuberculosis
uugccgccgccggg

SEQ ID NO: 3034499 - RNA, 13 nt, Mycobacterium avium subsp. paratuberculosis
uugccgccggcgc

SEQ ID NO: 3034500 - RNA, 13 nt, Mycobacterium avium subsp. paratuberculosis
uugccgcgccggg

SEQ ID NO: 3034501 - RNA, 17 nt, Mycobacterium avium subsp. paratuberculosis
uugccgcgcgcccgcgg

SEQ ID NO: 3034502 - RNA, 19 nt, Mycobacterium avium subsp. paratuberculosis
uugccgcgcgcccgcggcc

SEQ ID NO: 3034503 - RNA, 18 nt, Mycobacterium avium subsp. paratuberculosis
uugccggccaucugcugg

SEQ ID NO: 3034504 - RNA, 16 nt, Mycobacterium avium subsp. paratuberculosis
uugccggcggccagca

SEQ ID NO: 3034505 - RNA, 12 nt, Mycobacterium avium subsp. paratuberculosis
uugccggcggcg

SEQ ID NO: 3034506 - RNA, 22 nt, Mycobacterium avium subsp. paratuberculosis
uugccggcggcgaagccggccc

SEQ ID NO: 3034507 - RNA, 15 nt, Mycobacterium avium subsp. paratuberculosis
uugccggcggcgggc

SEQ ID NO: 3034508 - RNA, 18 nt, Mycobacterium avium subsp. paratuberculosis
uugccggcuuccucgcgg

SEQ ID NO: 3034509 - RNA, 15 nt, Mycobacterium avium subsp. paratuberculosis
uugccgggcaccagc

SEQ ID NO: 3034510 - RNA, 13 nt, Mycobacterium avium subsp. paratuberculosis
uugccgggccaga

SEQ ID NO: 3034511 - RNA, 18 nt, Mycobacterium avium subsp. paratuberculosis
uugccggugccgacgauc

SEQ ID NO: 3034512 - RNA, 19 nt, Mycobacterium avium subsp. paratuberculosis
uugccgguguaucccauca

SEQ ID NO: 3034513 - RNA, 14 nt, Mycobacterium avium subsp. paratuberculosis
uugccgucggccgc

SEQ ID NO: 3034514 - RNA, 17 nt, Mycobacterium avium subsp. paratuberculosis
uugccgucgggacgcgg

SEQ ID NO: 3034515 - RNA, 15 nt, Mycobacterium avium subsp. paratuberculosis
uugccgugcucggcg

SEQ ID NO: 3034516 - RNA, 16 nt, Mycobacterium avium subsp. paratuberculosis
uugccuuuccgcgcgg

SEQ ID NO: 3034517 - RNA, 23 nt, Mycobacterium avium subsp. paratuberculosis
uugcgaaagcccaggcccggcac

SEQ ID NO: 3034518 - RNA, 19 nt, Mycobacterium avium subsp. paratuberculosis
uugcgagccggucugggcg

SEQ ID NO: 3034519 - RNA, 19 nt, Mycobacterium avium subsp. paratuberculosis
uugcgcaacagcgugcaca

SEQ ID NO: 3034520 - RNA, 22 nt, Mycobacterium avium subsp. paratuberculosis
uugcgcacccgcgggucgucgg

SEQ ID NO: 3034521 - RNA, 13 nt, Mycobacterium avium subsp. paratuberculosis
uugcgcagcagca

SEQ ID NO: 3034522 - RNA, 16 nt, Mycobacterium avium subsp. paratuberculosis
uugcgcaucagcgcca

SEQ ID NO: 3034523 - RNA, 12 nt, Mycobacterium avium subsp. paratuberculosis
uugcgccagcgg

SEQ ID NO: 3034524 - RNA, 14 nt, Mycobacterium avium subsp. paratuberculosis
uugcgccccggcgg

SEQ ID NO: 3034525 - RNA, 16 nt, Mycobacterium avium subsp. paratuberculosis
uugcgccccggcgggc

SEQ ID NO: 3034526 - RNA, 21 nt, Mycobacterium avium subsp. paratuberculosis
uugcgccccggcgggcggccg

SEQ ID NO: 3034527 - RNA, 16 nt, Mycobacterium avium subsp. paratuberculosis
uugcgccgcgagcgca

SEQ ID NO: 3034528 - RNA, 17 nt, Mycobacterium avium subsp. paratuberculosis
uugcgccgcgagcgcag

SEQ ID NO: 3034529 - RNA, 16 nt, Mycobacterium avium subsp. paratuberculosis
uugcgccggguggccg

SEQ ID NO: 3034530 - RNA, 21 nt, Mycobacterium avium subsp. paratuberculosis
uugcgccggguggccggggcc

SEQ ID NO: 3034531 - RNA, 21 nt, Mycobacterium avium subsp. paratuberculosis
uugcgcgaaucgcaagcagag

SEQ ID NO: 3034532 - RNA, 14 nt, Mycobacterium avium subsp. paratuberculosis
uugcgcgacgccgu

SEQ ID NO: 3034533 - RNA, 17 nt, Mycobacterium avium subsp. paratuberculosis
uugcgcggaaugcucga

SEQ ID NO: 3034534 - RNA, 13 nt, Mycobacterium avium subsp. paratuberculosis
uugcgcggcggcc

SEQ ID NO: 3034535 - RNA, 13 nt, Mycobacterium avium subsp. paratuberculosis
uugcgcggcgggc

SEQ ID NO: 3034536 - RNA, 18 nt, Mycobacterium avium subsp. paratuberculosis
uugcgcucggucgcggcg

SEQ ID NO: 3034537 - RNA, 22 nt, Mycobacterium avium subsp. paratuberculosis
uugcgcuggaugaaggucgcgg

SEQ ID NO: 3034538 - RNA, 19 nt, Mycobacterium avium subsp. paratuberculosis
uugcggcaccagucgcgca

SEQ ID NO: 3034539 - RNA, 21 nt, Mycobacterium avium subsp. paratuberculosis
uugcggcacgccgaccacccc

SEQ ID NO: 3034540 - RNA, 23 nt, Mycobacterium avium subsp. paratuberculosis
uugcggcagcacaccuuccacca

SEQ ID NO: 3034541 - RNA, 17 nt, Mycobacterium avium subsp. paratuberculosis
uugcggccaaacgugga

SEQ ID NO: 3034542 - RNA, 21 nt, Mycobacterium avium subsp. paratuberculosis
uugcggcccugcaggucgcgg

SEQ ID NO: 3034543 - RNA, 13 nt, Mycobacterium avium subsp. paratuberculosis
uugcggccgccgg

SEQ ID NO: 3034544 - RNA, 12 nt, Mycobacterium avium subsp. paratuberculosis
uugcggccggcc

SEQ ID NO: 3034545 - RNA, 13 nt, Mycobacterium avium subsp. paratuberculosis
uugcggccggcgg

SEQ ID NO: 3034546 - RNA, 15 nt, Mycobacterium avium subsp. paratuberculosis
uugcggcgcaaccuc

SEQ ID NO: 3034547 - RNA, 20 nt, Mycobacterium avium subsp. paratuberculosis
uugcggcgcagccagcucgg

SEQ ID NO: 3034548 - RNA, 22 nt, Mycobacterium avium subsp. paratuberculosis
uugcggcggccggccagcagcc

SEQ ID NO: 3034549 - RNA, 15 nt, Mycobacterium avium subsp. paratuberculosis
uugcgggacugggcg

SEQ ID NO: 3034550 - RNA, 13 nt, Mycobacterium avium subsp. paratuberculosis
uugcgggccaggu

SEQ ID NO: 3034551 - RNA, 17 nt, Mycobacterium avium subsp. paratuberculosis
uugcgggucugcucacg

SEQ ID NO: 3034552 - RNA, 16 nt, Mycobacterium avium subsp. paratuberculosis
uugcgggugucgccgg

SEQ ID NO: 3034553 - RNA, 18 nt, Mycobacterium avium subsp. paratuberculosis
uugcgggugucgccggug

SEQ ID NO: 3034554 - RNA, 21 nt, Mycobacterium avium subsp. paratuberculosis
uugcgguccccggagagccgg

SEQ ID NO: 3034555 - RNA, 16 nt, Mycobacterium avium subsp. paratuberculosis
uugcguugcgcggcgg

SEQ ID NO: 3034556 - RNA, 18 nt, Mycobacterium avium subsp. paratuberculosis
uugcuccacacuggcucu

SEQ ID NO: 3034557 - RNA, 13 nt, Mycobacterium avium subsp. paratuberculosis
uugcucgccgcgu

SEQ ID NO: 3034558 - RNA, 13 nt, Mycobacterium avium subsp. paratuberculosis
uugcucggcggcc

SEQ ID NO: 3034559 - RNA, 12 nt, Mycobacterium avium subsp. paratuberculosis
uugcugaacacc

SEQ ID NO: 3034560 - RNA, 22 nt, Mycobacterium avium subsp. paratuberculosis
uugcugagccggcccugcggcc

SEQ ID NO: 3034561 - RNA, 14 nt, Mycobacterium avium subsp. paratuberculosis
uugcugcccagggc

SEQ ID NO: 3034562 - RNA, 13 nt, Mycobacterium avium subsp. paratuberculosis
uugcuggcggccu

SEQ ID NO: 3034563 - RNA, 18 nt, Mycobacterium avium subsp. paratuberculosis
uugcuggcggccuucuug

SEQ ID NO: 3034564 - RNA, 22 nt, Mycobacterium avium subsp. paratuberculosis
uugcuggcggccuucuuggccg

SEQ ID NO: 3034565 - RNA, 15 nt, Mycobacterium avium subsp. paratuberculosis
uuggacaggccggcg

SEQ ID NO: 3034566 - RNA, 18 nt, Mycobacterium avium subsp. paratuberculosis
uuggacgaaacccggcgg

SEQ ID NO: 3034567 - RNA, 13 nt, Mycobacterium avium subsp. paratuberculosis
uuggacgacacca

SEQ ID NO: 3034568 - RNA, 15 nt, Mycobacterium avium subsp. paratuberculosis
uuggagaucucggcg

SEQ ID NO: 3034569 - RNA, 17 nt, Mycobacterium avium subsp. paratuberculosis
uuggagccgagcaccgg

SEQ ID NO: 3034570 - RNA, 18 nt, Mycobacterium avium subsp. paratuberculosis
uuggauuuaucucggcga

SEQ ID NO: 3034571 - RNA, 23 nt, Mycobacterium avium subsp. paratuberculosis
uuggcaaggagguggucgagcuc

SEQ ID NO: 3034572 - RNA, 17 nt, Mycobacterium avium subsp. paratuberculosis
uuggccacgucgaagcc

SEQ ID NO: 3034573 - RNA, 19 nt, Mycobacterium avium subsp. paratuberculosis
uuggccacgucgaagcccg

SEQ ID NO: 3034574 - RNA, 14 nt, Mycobacterium avium subsp. paratuberculosis
uuggccagcaccgc

SEQ ID NO: 3034575 - RNA, 15 nt, Mycobacterium avium subsp. paratuberculosis
uuggccagcaccgcg

SEQ ID NO: 3034576 - RNA, 16 nt, Mycobacterium avium subsp. paratuberculosis
uuggccagcaccgcgg

SEQ ID NO: 3034577 - RNA, 16 nt, Mycobacterium avium subsp. paratuberculosis
uuggccagcucggcgg

SEQ ID NO: 3034578 - RNA, 11 nt, Mycobacterium avium subsp. paratuberculosis
uuggccaggcg

SEQ ID NO: 3034579 - RNA, 13 nt, Mycobacterium avium subsp. paratuberculosis
uuggccaggcggg

SEQ ID NO: 3034580 - RNA, 14 nt, Mycobacterium avium subsp. paratuberculosis
uuggcccgccgccg

SEQ ID NO: 3034581 - RNA, 22 nt, Mycobacterium avium subsp. paratuberculosis
uuggcccgcgcccgcucgaggg

SEQ ID NO: 3034582 - RNA, 13 nt, Mycobacterium avium subsp. paratuberculosis
uuggcccgcgcgg

SEQ ID NO: 3034583 - RNA, 17 nt, Mycobacterium avium subsp. paratuberculosis
uuggcccgcggcgcccg

SEQ ID NO: 3034584 - RNA, 23 nt, Mycobacterium avium subsp. paratuberculosis
uuggcccugcucuucgcgcgcgg

SEQ ID NO: 3034585 - RNA, 23 nt, Mycobacterium avium subsp. paratuberculosis
uuggccgagccgggcggccagcg

SEQ ID NO: 3034586 - RNA, 17 nt, Mycobacterium avium subsp. paratuberculosis
uuggccgccagcaccuc

SEQ ID NO: 3034587 - RNA, 18 nt, Mycobacterium avium subsp. paratuberculosis
uuggccgcgacgccgccg

SEQ ID NO: 3034588 - RNA, 23 nt, Mycobacterium avium subsp. paratuberculosis
uuggccgcgggcgggccgaaccg

SEQ ID NO: 3034589 - RNA, 18 nt, Mycobacterium avium subsp. paratuberculosis
uuggccggaaucgcggga

SEQ ID NO: 3034590 - RNA, 16 nt, Mycobacterium avium subsp. paratuberculosis
uuggccggagccuucu

SEQ ID NO: 3034591 - RNA, 17 nt, Mycobacterium avium subsp. paratuberculosis
uuggccggagccuucuu

SEQ ID NO: 3034592 - RNA, 21 nt, Mycobacterium avium subsp. paratuberculosis
uuggccggagccuuggucgcg

SEQ ID NO: 3034593 - RNA, 14 nt, Mycobacterium avium subsp. paratuberculosis
uuggccggcacucg

SEQ ID NO: 3034594 - RNA, 23 nt, Mycobacterium avium subsp. paratuberculosis
uuggccggcacucgccucggagg

SEQ ID NO: 3034595 - RNA, 11 nt, Mycobacterium avium subsp. paratuberculosis
uuggccggccc

SEQ ID NO: 3034596 - RNA, 13 nt, Mycobacterium avium subsp. paratuberculosis
uuggccggcgggu

SEQ ID NO: 3034597 - RNA, 23 nt, Mycobacterium avium subsp. paratuberculosis
uuggccgggcggaagucggugcc

SEQ ID NO: 3034598 - RNA, 20 nt, Mycobacterium avium subsp. paratuberculosis
uuggccggugcgccgaccgc

SEQ ID NO: 3034599 - RNA, 23 nt, Mycobacterium avium subsp. paratuberculosis
uuggccguaggucgggucgagac

SEQ ID NO: 3034600 - RNA, 22 nt, Mycobacterium avium subsp. paratuberculosis
uuggccgugcagggggcgcagc

SEQ ID NO: 3034601 - RNA, 16 nt, Mycobacterium avium subsp. paratuberculosis
uuggccucauuggccu

SEQ ID NO: 3034602 - RNA, 15 nt, Mycobacterium avium subsp. paratuberculosis
uuggccucggcgcgg

SEQ ID NO: 3034603 - RNA, 13 nt, Mycobacterium avium subsp. paratuberculosis
uuggccucgggcg

SEQ ID NO: 3034604 - RNA, 22 nt, Mycobacterium avium subsp. paratuberculosis
uuggccucgggcgacgacgcgg

SEQ ID NO: 3034605 - RNA, 19 nt, Mycobacterium avium subsp. paratuberculosis
uuggccugcuugggcagca

SEQ ID NO: 3034606 - RNA, 21 nt, Mycobacterium avium subsp. paratuberculosis
uuggcgaagcguuucagcaac

SEQ ID NO: 3034607 - RNA, 21 nt, Mycobacterium avium subsp. paratuberculosis
uuggcgacgaagucgacggcg

SEQ ID NO: 3034608 - RNA, 15 nt, Mycobacterium avium subsp. paratuberculosis
uuggcgacgacggcg

SEQ ID NO: 3034609 - RNA, 21 nt, Mycobacterium avium subsp. paratuberculosis
uuggcgacgcugaacagcagc

SEQ ID NO: 3034610 - RNA, 22 nt, Mycobacterium avium subsp. paratuberculosis
uuggcgacgcugaacagcagca

SEQ ID NO: 3034611 - RNA, 23 nt, Mycobacterium avium subsp. paratuberculosis
uuggcgacgcugaacagcagcag

SEQ ID NO: 3034612 - RNA, 13 nt, Mycobacterium avium subsp. paratuberculosis
uuggcgaucucga

SEQ ID NO: 3034613 - RNA, 21 nt, Mycobacterium avium subsp. paratuberculosis
uuggcgaucucgauggccucg

SEQ ID NO: 3034614 - RNA, 13 nt, Mycobacterium avium subsp. paratuberculosis
uuggcgcgcucgg

SEQ ID NO: 3034615 - RNA, 16 nt, Mycobacterium avium subsp. paratuberculosis
uuggcgcgcucggugg

SEQ ID NO: 3034616 - RNA, 22 nt, Mycobacterium avium subsp. paratuberculosis
uuggcggccaccaucuccgcgg

SEQ ID NO: 3034617 - RNA, 13 nt, Mycobacterium avium subsp. paratuberculosis
uuggcggccagcg

SEQ ID NO: 3034618 - RNA, 19 nt, Mycobacterium avium subsp. paratuberculosis
uuggcggccgggucgagcg

SEQ ID NO: 3034619 - RNA, 13 nt, Mycobacterium avium subsp. paratuberculosis
uuggcggccugcg

SEQ ID NO: 3034620 - RNA, 20 nt, Mycobacterium avium subsp. paratuberculosis
uuggcggcggugaucgccgg

SEQ ID NO: 3034621 - RNA, 13 nt, Mycobacterium avium subsp. paratuberculosis
uuggcggcggugg

SEQ ID NO: 3034622 - RNA, 20 nt, Mycobacterium avium subsp. paratuberculosis
uuggcggcgucgucgccgug

SEQ ID NO: 3034623 - RNA, 17 nt, Mycobacterium avium subsp. paratuberculosis
uuggcgggcgacuucuu

SEQ ID NO: 3034624 - RNA, 17 nt, Mycobacterium avium subsp. paratuberculosis
uuggcggucugcgcccg

SEQ ID NO: 3034625 - RNA, 20 nt, Mycobacterium avium subsp. paratuberculosis
uuggcggucugcgcccgauc

SEQ ID NO: 3034626 - RNA, 14 nt, Mycobacterium avium subsp. paratuberculosis
uuggcgucgggcac

SEQ ID NO: 3034627 - RNA, 15 nt, Mycobacterium avium subsp. paratuberculosis
uuggcgucgggcacc

SEQ ID NO: 3034628 - RNA, 12 nt, Mycobacterium avium subsp. paratuberculosis
uuggcugucgcg

SEQ ID NO: 3034629 - RNA, 23 nt, Mycobacterium avium subsp. paratuberculosis
uuggcuugaaaguccgccgacag

SEQ ID NO: 3034630 - RNA, 22 nt, Mycobacterium avium subsp. paratuberculosis
uugggcacgguguagcugcggg

SEQ ID NO: 3034631 - RNA, 13 nt, Mycobacterium avium subsp. paratuberculosis
uugggcagcagcu

SEQ ID NO: 3034632 - RNA, 15 nt, Mycobacterium avium subsp. paratuberculosis
uugggcagcucggcg

SEQ ID NO: 3034633 - RNA, 17 nt, Mycobacterium avium subsp. paratuberculosis
uugggccagcggcgccg

SEQ ID NO: 3034634 - RNA, 22 nt, Mycobacterium avium subsp. paratuberculosis
uugggccggcgcccgucacgcu

SEQ ID NO: 3034635 - RNA, 23 nt, Mycobacterium avium subsp. paratuberculosis
uugggccggucggucggccgcac

SEQ ID NO: 3034636 - RNA, 17 nt, Mycobacterium avium subsp. paratuberculosis
uugggcgccagcagcac

SEQ ID NO: 3034637 - RNA, 16 nt, Mycobacterium avium subsp. paratuberculosis
uugggcgccucgccga

SEQ ID NO: 3034638 - RNA, 22 nt, Mycobacterium avium subsp. paratuberculosis
uugggcgggaucgcggcgguca

SEQ ID NO: 3034639 - RNA, 16 nt, Mycobacterium avium subsp. paratuberculosis
uugggcgucucgauga

SEQ ID NO: 3034640 - RNA, 14 nt, Mycobacterium avium subsp. paratuberculosis
uuggggccggccgc

SEQ ID NO: 3034641 - RNA, 21 nt, Mycobacterium avium subsp. paratuberculosis
uuggggcugaccucgccgccc

SEQ ID NO: 3034642 - RNA, 15 nt, Mycobacterium avium subsp. paratuberculosis
uugggggcgccgcgg

SEQ ID NO: 3034643 - RNA, 20 nt, Mycobacterium avium subsp. paratuberculosis
uugggucaucgacucgaaga

SEQ ID NO: 3034644 - RNA, 22 nt, Mycobacterium avium subsp. paratuberculosis
uugggucucaucccgccgaccc

SEQ ID NO: 3034645 - RNA, 17 nt, Mycobacterium avium subsp. paratuberculosis
uuggucacaaagcccgg

SEQ ID NO: 3034646 - RNA, 19 nt, Mycobacterium avium subsp. paratuberculosis
uuggucaccaucagcggcu

SEQ ID NO: 3034647 - RNA, 18 nt, Mycobacterium avium subsp. paratuberculosis
uuggucagcggcaggucc

SEQ ID NO: 3034648 - RNA, 16 nt, Mycobacterium avium subsp. paratuberculosis
uugguccaggcguucg

SEQ ID NO: 3034649 - RNA, 17 nt, Mycobacterium avium subsp. paratuberculosis
uuggucccgaucaccuu

SEQ ID NO: 3034650 - RNA, 17 nt, Mycobacterium avium subsp. paratuberculosis
uuggucgcggccuucuu

SEQ ID NO: 3034651 - RNA, 15 nt, Mycobacterium avium subsp. paratuberculosis
uuggucggcgcggcg

SEQ ID NO: 3034652 - RNA, 13 nt, Mycobacterium avium subsp. paratuberculosis
uuggucgggcaca

SEQ ID NO: 3034653 - RNA, 21 nt, Mycobacterium avium subsp. paratuberculosis
uuggucucgauggucgccuug

SEQ ID NO: 3034654 - RNA, 22 nt, Mycobacterium avium subsp. paratuberculosis
uuggugaaaccguuggccugcg

SEQ ID NO: 3034655 - RNA, 17 nt, Mycobacterium avium subsp. paratuberculosis
uuggugccgaucaccuc

SEQ ID NO: 3034656 - RNA, 17 nt, Mycobacterium avium subsp. paratuberculosis
uuggugcgccgucacgu

SEQ ID NO: 3034657 - RNA, 15 nt, Mycobacterium avium subsp. paratuberculosis
uuggugguggcgugg

SEQ ID NO: 3034658 - RNA, 14 nt, Mycobacterium avium subsp. paratuberculosis
uuggugguggucgu

SEQ ID NO: 3034659 - RNA, 23 nt, Mycobacterium avium subsp. paratuberculosis
uugguguaggcgaucgggaacag

SEQ ID NO: 3034660 - RNA, 16 nt, Mycobacterium avium subsp. paratuberculosis
uuguagcaggcggugg

SEQ ID NO: 3034661 - RNA, 13 nt, Mycobacterium avium subsp. paratuberculosis
uuguagcgcagca

SEQ ID NO: 3034662 - RNA, 20 nt, Mycobacterium avium subsp. paratuberculosis
uuguagucgucgaccgccac

SEQ ID NO: 3034663 - RNA, 15 nt, Mycobacterium avium subsp. paratuberculosis
uugucaccgaaccgc

SEQ ID NO: 3034664 - RNA, 21 nt, Mycobacterium avium subsp. paratuberculosis
uuguccaccauggcuuccgcc

SEQ ID NO: 3034665 - RNA, 16 nt, Mycobacterium avium subsp. paratuberculosis
uuguccacccccgcgg

SEQ ID NO: 3034666 - RNA, 18 nt, Mycobacterium avium subsp. paratuberculosis
uuguccaggauccccguc

SEQ ID NO: 3034667 - RNA, 15 nt, Mycobacterium avium subsp. paratuberculosis
uuguccggccagguc

SEQ ID NO: 3034668 - RNA, 18 nt, Mycobacterium avium subsp. paratuberculosis
uuguccucgaagaucucc

SEQ ID NO: 3034669 - RNA, 22 nt, Mycobacterium avium subsp. paratuberculosis
uuguccugcaccgacugcggcg

SEQ ID NO: 3034670 - RNA, 20 nt, Mycobacterium avium subsp. paratuberculosis
uugucgaaggugaucuuguu

SEQ ID NO: 3034671 - RNA, 18 nt, Mycobacterium avium subsp. paratuberculosis
uugucgaaguaguagcug

SEQ ID NO: 3034672 - RNA, 23 nt, Mycobacterium avium subsp. paratuberculosis
uugucgaguucgcucuucucguu

SEQ ID NO: 3034673 - RNA, 18 nt, Mycobacterium avium subsp. paratuberculosis
uugucgcgcaccgcggcg

SEQ ID NO: 3034674 - RNA, 19 nt, Mycobacterium avium subsp. paratuberculosis
uugucgcucaaaggcgggc

SEQ ID NO: 3034675 - RNA, 19 nt, Mycobacterium avium subsp. paratuberculosis
uugucgcucagaggcgggc

SEQ ID NO: 3034676 - RNA, 22 nt, Mycobacterium avium subsp. paratuberculosis
uugucgcuguuagccucgccag

SEQ ID NO: 3034677 - RNA, 11 nt, Mycobacterium avium subsp. paratuberculosis
uugucggccaa

SEQ ID NO: 3034678 - RNA, 16 nt, Mycobacterium avium subsp. paratuberculosis
uugucggcgacggcgg

SEQ ID NO: 3034679 - RNA, 14 nt, Mycobacterium avium subsp. paratuberculosis
uugucggcggucug

SEQ ID NO: 3034680 - RNA, 12 nt, Mycobacterium avium subsp. paratuberculosis
uugucggcgugg

SEQ ID NO: 3034681 - RNA, 19 nt, Mycobacterium avium subsp. paratuberculosis
uugucgucgucggcgacga

SEQ ID NO: 3034682 - RNA, 18 nt, Mycobacterium avium subsp. paratuberculosis
uugugacccgcucgggcg

SEQ ID NO: 3034683 - RNA, 18 nt, Mycobacterium avium subsp. paratuberculosis
uugugcaccaacacgucg

SEQ ID NO: 3034684 - RNA, 14 nt, Mycobacterium avium subsp. paratuberculosis
uugugccaccgccg

SEQ ID NO: 3034685 - RNA, 19 nt, Mycobacterium avium subsp. paratuberculosis
uugugcuucuggcucaaca

SEQ ID NO: 3034686 - RNA, 24 nt, Mycobacterium avium subsp. paratuberculosis
uuguggcggcccaauucguaggcg

SEQ ID NO: 3034687 - RNA, 13 nt, Mycobacterium avium subsp. paratuberculosis
uuguugcucggcg

SEQ ID NO: 3034688 - RNA, 19 nt, Mycobacterium avium subsp. paratuberculosis
uuucaaguccucccaaccc

SEQ ID NO: 3034689 - RNA, 16 nt, Mycobacterium avium subsp. paratuberculosis
uuucacagcucaccug

SEQ ID NO: 3034690 - RNA, 17 nt, Mycobacterium avium subsp. paratuberculosis
uuucacgucggcgaugg

SEQ ID NO: 3034691 - RNA, 20 nt, Mycobacterium avium subsp. paratuberculosis
uuuccaguccggcgcccggc

SEQ ID NO: 3034692 - RNA, 12 nt, Mycobacterium avium subsp. paratuberculosis
uuuccaucuggg

SEQ ID NO: 3034693 - RNA, 14 nt, Mycobacterium avium subsp. paratuberculosis
uuuccccaccaggc

SEQ ID NO: 3034694 - RNA, 16 nt, Mycobacterium avium subsp. paratuberculosis
uuucccgaguggcgcc

SEQ ID NO: 3034695 - RNA, 17 nt, Mycobacterium avium subsp. paratuberculosis
uuucccgcgagcugccc

SEQ ID NO: 3034696 - RNA, 18 nt, Mycobacterium avium subsp. paratuberculosis
uuucccgucgucgaugcg

SEQ ID NO: 3034697 - RNA, 23 nt, Mycobacterium avium subsp. paratuberculosis
uuucccgucgucgaugcgcagca

SEQ ID NO: 3034698 - RNA, 12 nt, Mycobacterium avium subsp. paratuberculosis
uuucgcgcggca

SEQ ID NO: 3034699 - RNA, 20 nt, Mycobacterium avium subsp. paratuberculosis
uuucgcgcuaggacgcgggc

SEQ ID NO: 3034700 - RNA, 14 nt, Mycobacterium avium subsp. paratuberculosis
uuucgcucagccgu

SEQ ID NO: 3034701 - RNA, 19 nt, Mycobacterium avium subsp. paratuberculosis
uuucgggucgagagccgca

SEQ ID NO: 3034702 - RNA, 14 nt, Mycobacterium avium subsp. paratuberculosis
uuucgucggcggug

SEQ ID NO: 3034703 - RNA, 18 nt, Mycobacterium avium subsp. paratuberculosis
uuucgucggugcgcgccg

SEQ ID NO: 3034704 - RNA, 13 nt, Mycobacterium avium subsp. paratuberculosis
uuucguggucucg

SEQ ID NO: 3034705 - RNA, 13 nt, Mycobacterium avium subsp. paratuberculosis
uuucucagcggcg

SEQ ID NO: 3034706 - RNA, 16 nt, Mycobacterium avium subsp. paratuberculosis
uuugagcauguugaac

SEQ ID NO: 3034707 - RNA, 13 nt, Mycobacterium avium subsp. paratuberculosis
uuugaggcgagca

SEQ ID NO: 3034708 - RNA, 15 nt, Mycobacterium avium subsp. paratuberculosis
uuugaugccgccggg

SEQ ID NO: 3034709 - RNA, 22 nt, Mycobacterium avium subsp. paratuberculosis
uuugauugcgcggcgccggaug

SEQ ID NO: 3034710 - RNA, 21 nt, Mycobacterium avium subsp. paratuberculosis
uuugcacccgccauggcggca

SEQ ID NO: 3034711 - RNA, 14 nt, Mycobacterium avium subsp. paratuberculosis
uuugcauacagcag

SEQ ID NO: 3034712 - RNA, 12 nt, Mycobacterium avium subsp. paratuberculosis
uuugccacugag

SEQ ID NO: 3034713 - RNA, 17 nt, Mycobacterium avium subsp. paratuberculosis
uuugccacugagcgcag

SEQ ID NO: 3034714 - RNA, 19 nt, Mycobacterium avium subsp. paratuberculosis
uuugcccuccuucccggug

SEQ ID NO: 3034715 - RNA, 16 nt, Mycobacterium avium subsp. paratuberculosis
uuugcgggucugcuca

SEQ ID NO: 3034716 - RNA, 16 nt, Mycobacterium avium subsp. paratuberculosis
uuuggaccagggcggu

SEQ ID NO: 3034717 - RNA, 19 nt, Mycobacterium avium subsp. paratuberculosis
uuuggccauaccuagcacu

SEQ ID NO: 3034718 - RNA, 15 nt, Mycobacterium avium subsp. paratuberculosis
uuuggcuggucucgg

SEQ ID NO: 3034719 - RNA, 23 nt, Mycobacterium avium subsp. paratuberculosis
uuuguacaagugaugaccuggau

SEQ ID NO: 3034720 - RNA, 16 nt, Mycobacterium avium subsp. paratuberculosis
uuuucccggccgccgg

SEQ ID NO: 3034721 - RNA, 22 nt, Mycobacterium avium subsp. paratuberculosis
uuuucgaaaccggucaacggcu

SEQ ID NO: 3034722 - RNA, 18 nt, Mycobacterium avium subsp. paratuberculosis
uuuucgccgucacugcac

SEQ ID NO: 3034723 - RNA, 22 nt, Mycobacterium avium subsp. paratuberculosis
uuuugaaauagccgcgccgcgg

SEQ ID NO: 3034724 - RNA, 11 nt, Mycobacterium avium subsp. paratuberculosis
uuuuguugacc

SEQ ID NO: 3034725 - RNA, 19 nt, Mycobacterium avium subsp. paratuberculosis
uuuuugugggugguccagg

SEQ ID NO: 3034726 - RNA, 16 nt, Mycobacterium avium subsp. paratuberculosis
uggccagcuucaccgg

SEQ ID NO: 3034727 - RNA, 19 nt, Mycobacterium avium subsp. paratuberculosis
uggccaggcccagcccggc

SEQ ID NO: 3034728 - RNA, 16 nt, Mycobacterium avium subsp. paratuberculosis
uggccaggcuggcguc

SEQ ID NO: 3034729 - RNA, 23 nt, Mycobacterium avium subsp. paratuberculosis
uggccaggcuggcgucgaacgug

SEQ ID NO: 3034730 - RNA, 15 nt, Mycobacterium avium subsp. paratuberculosis
uggccagguugcgcc

SEQ ID NO: 3034731 - RNA, 17 nt, Mycobacterium avium subsp. paratuberculosis
uggccagguugcgccgu

SEQ ID NO: 3034732 - RNA, 21 nt, Mycobacterium avium subsp. paratuberculosis
uggccaucuggccgcgggugc

SEQ ID NO: 3034733 - RNA, 12 nt, Mycobacterium avium subsp. paratuberculosis
uggcccaccgaa

SEQ ID NO: 3034734 - RNA, 17 nt, Mycobacterium avium subsp. paratuberculosis
uggcccaccgaaucacc

SEQ ID NO: 3034735 - RNA, 19 nt, Mycobacterium avium subsp. paratuberculosis
uggcccaccgaaucaccca

SEQ ID NO: 3034736 - RNA, 12 nt, Mycobacterium avium subsp. paratuberculosis
uggcccacgacg

SEQ ID NO: 3034737 - RNA, 18 nt, Mycobacterium avium subsp. paratuberculosis
uggcccacgacgucuggg

SEQ ID NO: 3034738 - RNA, 21 nt, Mycobacterium avium subsp. paratuberculosis
uggcccacgacgucugggccg

SEQ ID NO: 3034739 - RNA, 15 nt, Mycobacterium avium subsp. paratuberculosis
uggcccacgcagccg

SEQ ID NO: 3034740 - RNA, 18 nt, Mycobacterium avium subsp. paratuberculosis
uggcccacgcagccgucg

SEQ ID NO: 3034741 - RNA, 17 nt, Mycobacterium avium subsp. paratuberculosis
uggcccagccggccgac

SEQ ID NO: 3034742 - RNA, 19 nt, Mycobacterium avium subsp. paratuberculosis
uggcccagccggccgacgc

SEQ ID NO: 3034743 - RNA, 16 nt, Mycobacterium avium subsp. paratuberculosis
uggcccagccggugcg

SEQ ID NO: 3034744 - RNA, 12 nt, Mycobacterium avium subsp. paratuberculosis
uggcccaggcag

SEQ ID NO: 3034745 - RNA, 14 nt, Mycobacterium avium subsp. paratuberculosis
uggcccaggccggc

SEQ ID NO: 3034746 - RNA, 16 nt, Mycobacterium avium subsp. paratuberculosis
uggcccauguggccug

SEQ ID NO: 3034747 - RNA, 16 nt, Mycobacterium avium subsp. paratuberculosis
uggccccacgggccau

SEQ ID NO: 3034748 - RNA, 23 nt, Mycobacterium avium subsp. paratuberculosis
uggccccagaaccgcucggcggc

SEQ ID NO: 3034749 - RNA, 16 nt, Mycobacterium avium subsp. paratuberculosis
uggccccagccaccgu

SEQ ID NO: 3034750 - RNA, 14 nt, Mycobacterium avium subsp. paratuberculosis
uggcccccaccacg

SEQ ID NO: 3034751 - RNA, 13 nt, Mycobacterium avium subsp. paratuberculosis
uggccccgaucau

SEQ ID NO: 3034752 - RNA, 13 nt, Mycobacterium avium subsp. paratuberculosis
uggccccggcgag

SEQ ID NO: 3034753 - RNA, 21 nt, Mycobacterium avium subsp. paratuberculosis
uggccccgggccgcagggugg

SEQ ID NO: 3034754 - RNA, 18 nt, Mycobacterium avium subsp. paratuberculosis
uggcccgacccguucuug

SEQ ID NO: 3034755 - RNA, 19 nt, Mycobacterium avium subsp. paratuberculosis
uggcccgacccguucuugu

SEQ ID NO: 3034756 - RNA, 19 nt, Mycobacterium avium subsp. paratuberculosis
uggcccgcaccacccagcc

SEQ ID NO: 3034757 - RNA, 19 nt, Mycobacterium avium subsp. paratuberculosis
uggcccgcacccgccgccc

SEQ ID NO: 3034758 - RNA, 16 nt, Mycobacterium avium subsp. paratuberculosis
uggcccgccacgugcg

SEQ ID NO: 3034759 - RNA, 19 nt, Mycobacterium avium subsp. paratuberculosis
uggcccgccaucgcccggu

SEQ ID NO: 3034760 - RNA, 13 nt, Mycobacterium avium subsp. paratuberculosis
uggcccgcccggg

SEQ ID NO: 3034761 - RNA, 22 nt, Mycobacterium avium subsp. paratuberculosis
uggcccgccgcggcuccagcag

SEQ ID NO: 3034762 - RNA, 15 nt, Mycobacterium avium subsp. paratuberculosis
uggcccgcgcccgcu

SEQ ID NO: 3034763 - RNA, 14 nt, Mycobacterium avium subsp. paratuberculosis
uggcccgcgcgcug

SEQ ID NO: 3034764 - RNA, 15 nt, Mycobacterium avium subsp. paratuberculosis
uggcccgcgcgcuga

SEQ ID NO: 3034765 - RNA, 16 nt, Mycobacterium avium subsp. paratuberculosis
uggcccgcgcggccgc

SEQ ID NO: 3034766 - RNA, 14 nt, Mycobacterium avium subsp. paratuberculosis
uggcccgcggcgcc

SEQ ID NO: 3034767 - RNA, 18 nt, Mycobacterium avium subsp. paratuberculosis
uggcccgcggcgcccgga

SEQ ID NO: 3034768 - RNA, 15 nt, Mycobacterium avium subsp. paratuberculosis
uggcccggaccgccg

SEQ ID NO: 3034769 - RNA, 18 nt, Mycobacterium avium subsp. paratuberculosis
uggcccggaccgccgcgg

SEQ ID NO: 3034770 - RNA, 20 nt, Mycobacterium avium subsp. paratuberculosis
uggcccggauggccgggcag

SEQ ID NO: 3034771 - RNA, 15 nt, Mycobacterium avium subsp. paratuberculosis
uggcccgggccacac

SEQ ID NO: 3034772 - RNA, 21 nt, Mycobacterium avium subsp. paratuberculosis
uggcccgggccacacccgucg

SEQ ID NO: 3034773 - RNA, 16 nt, Mycobacterium avium subsp. paratuberculosis
uggcccggugcgacgc

SEQ ID NO: 3034774 - RNA, 17 nt, Mycobacterium avium subsp. paratuberculosis
uggcccggugcgacgcc

SEQ ID NO: 3034775 - RNA, 23 nt, Mycobacterium avium subsp. paratuberculosis
uggcccuccacggugcgcaccga

SEQ ID NO: 3034776 - RNA, 12 nt, Mycobacterium avium subsp. paratuberculosis
uggcccucggag

SEQ ID NO: 3034777 - RNA, 17 nt, Mycobacterium avium subsp. paratuberculosis
uggcccugcucgucguu

SEQ ID NO: 3034778 - RNA, 20 nt, Mycobacterium avium subsp. paratuberculosis
uggcccugcucuucgcgcgc

SEQ ID NO: 3034779 - RNA, 15 nt, Mycobacterium avium subsp. paratuberculosis
uggcccuucgaccuc

SEQ ID NO: 3034780 - RNA, 17 nt, Mycobacterium avium subsp. paratuberculosis
uggccgaaccgcucguc

SEQ ID NO: 3034781 - RNA, 20 nt, Mycobacterium avium subsp. paratuberculosis
uggccgaacggcaugucggu

SEQ ID NO: 3034782 - RNA, 14 nt, Mycobacterium avium subsp. paratuberculosis
uggccgaacggguc

SEQ ID NO: 3034783 - RNA, 16 nt, Mycobacterium avium subsp. paratuberculosis
uggccgaacugcauca

SEQ ID NO: 3034784 - RNA, 12 nt, Mycobacterium avium subsp. paratuberculosis
uggccgaccccg

SEQ ID NO: 3034785 - RNA, 18 nt, Mycobacterium avium subsp. paratuberculosis
uggccgaccgccgccauc

SEQ ID NO: 3034786 - RNA, 17 nt, Mycobacterium avium subsp. paratuberculosis
uggccgacgugccggug

SEQ ID NO: 3034787 - RNA, 15 nt, Mycobacterium avium subsp. paratuberculosis
uggccgagagccggu

SEQ ID NO: 3034788 - RNA, 20 nt, Mycobacterium avium subsp. paratuberculosis
uggccgagccgggcggccag

SEQ ID NO: 3034789 - RNA, 16 nt, Mycobacterium avium subsp. paratuberculosis
uggccgagcggcugcu

SEQ ID NO: 3034790 - RNA, 18 nt, Mycobacterium avium subsp. paratuberculosis
uggccgaggauggggucg

SEQ ID NO: 3034791 - RNA, 19 nt, Mycobacterium avium subsp. paratuberculosis
uggccgagggguccggggc

SEQ ID NO: 3034792 - RNA, 22 nt, Mycobacterium avium subsp. paratuberculosis
uggccgagggguccggggcacg

SEQ ID NO: 3034793 - RNA, 19 nt, Mycobacterium avium subsp. paratuberculosis
uggccgaucagcggcgggc

SEQ ID NO: 3034794 - RNA, 14 nt, Mycobacterium avium subsp. paratuberculosis
uggccgaucagcug

SEQ ID NO: 3034795 - RNA, 22 nt, Mycobacterium avium subsp. paratuberculosis
uggccgaucagcugcucggcca

SEQ ID NO: 3034796 - RNA, 19 nt, Mycobacterium avium subsp. paratuberculosis
uggccgaucccggccacgu

SEQ ID NO: 3034797 - RNA, 22 nt, Mycobacterium avium subsp. paratuberculosis
uggccgaucccggccacgucga

SEQ ID NO: 3034798 - RNA, 16 nt, Mycobacterium avium subsp. paratuberculosis
uggccgauggucagcu

SEQ ID NO: 3034799 - RNA, 17 nt, Mycobacterium avium subsp. paratuberculosis
uggccgauggucagcug

SEQ ID NO: 3034800 - RNA, 22 nt, Mycobacterium avium subsp. paratuberculosis
uggccgauggucagcugccgca

SEQ ID NO: 3034801 - RNA, 20 nt, Mycobacterium avium subsp. paratuberculosis
uggccgcacaccugcaucac

SEQ ID NO: 3034802 - RNA, 18 nt, Mycobacterium avium subsp. paratuberculosis
uggccgcacggugcagca

SEQ ID NO: 3034803 - RNA, 14 nt, Mycobacterium avium subsp. paratuberculosis
uggccgcaggcggc

SEQ ID NO: 3034804 - RNA, 18 nt, Mycobacterium avium subsp. paratuberculosis
uggccgcaggcggccagc

SEQ ID NO: 3034805 - RNA, 19 nt, Mycobacterium avium subsp. paratuberculosis
uggccgcaggcggccagca

SEQ ID NO: 3034806 - RNA, 14 nt, Mycobacterium avium subsp. paratuberculosis
uggccgccaccaac

SEQ ID NO: 3034807 - RNA, 16 nt, Mycobacterium avium subsp. paratuberculosis
uggccgccaccaacau

SEQ ID NO: 3034808 - RNA, 22 nt, Mycobacterium avium subsp. paratuberculosis
uggccgccaccaacaucgacgu

SEQ ID NO: 3034809 - RNA, 13 nt, Mycobacterium avium subsp. paratuberculosis
uggccgccacgau

SEQ ID NO: 3034810 - RNA, 15 nt, Mycobacterium avium subsp. paratuberculosis
uggccgccagcaccu

SEQ ID NO: 3034811 - RNA, 13 nt, Mycobacterium avium subsp. paratuberculosis
ucggugcgcggcg

SEQ ID NO: 3034812 - RNA, 16 nt, Mycobacterium avium subsp. paratuberculosis
ucggugcggaugcuga

SEQ ID NO: 3034813 - RNA, 22 nt, Mycobacterium avium subsp. paratuberculosis
ucggugcgguaggugccggccg

SEQ ID NO: 3034814 - RNA, 17 nt, Mycobacterium avium subsp. paratuberculosis
ucggugcucaucagcga

SEQ ID NO: 3034815 - RNA, 15 nt, Mycobacterium avium subsp. paratuberculosis
ucgguggacagcgcg

SEQ ID NO: 3034816 - RNA, 17 nt, Mycobacterium avium subsp. paratuberculosis
ucgguggacagcgcgac

SEQ ID NO: 3034817 - RNA, 14 nt, Mycobacterium avium subsp. paratuberculosis
ucgguggacgcggu

SEQ ID NO: 3034818 - RNA, 15 nt, Mycobacterium avium subsp. paratuberculosis
ucgguggacgcgguc

SEQ ID NO: 3034819 - RNA, 17 nt, Mycobacterium avium subsp. paratuberculosis
ucgguggauccggugac

SEQ ID NO: 3034820 - RNA, 22 nt, Mycobacterium avium subsp. paratuberculosis
ucgguggauccggugaccgcga

SEQ ID NO: 3034821 - RNA, 23 nt, Mycobacterium avium subsp. paratuberculosis
ucgguggauccggugaccgcgac

SEQ ID NO: 3034822 - RNA, 19 nt, Mycobacterium avium subsp. paratuberculosis
ucgguggcaccccgcgccg

SEQ ID NO: 3034823 - RNA, 20 nt, Mycobacterium avium subsp. paratuberculosis
ucgguggcaccccgcgccgg

SEQ ID NO: 3034824 - RNA, 18 nt, Mycobacterium avium subsp. paratuberculosis
ucgguggccaccaccgag

SEQ ID NO: 3034825 - RNA, 13 nt, Mycobacterium avium subsp. paratuberculosis
ucgguggccaccg

SEQ ID NO: 3034826 - RNA, 17 nt, Mycobacterium avium subsp. paratuberculosis
ucgguggccaccgcgac

SEQ ID NO: 3034827 - RNA, 22 nt, Mycobacterium avium subsp. paratuberculosis
ucgguggccaccgcgacgccca

SEQ ID NO: 3034828 - RNA, 23 nt, Mycobacterium avium subsp. paratuberculosis
ucgguggccaccgcgacgcccag

SEQ ID NO: 3034829 - RNA, 11 nt, Mycobacterium avium subsp. paratuberculosis
ucgguggccca

SEQ ID NO: 3034830 - RNA, 14 nt, Mycobacterium avium subsp. paratuberculosis
ucgguggcccagcc

SEQ ID NO: 3034831 - RNA, 17 nt, Mycobacterium avium subsp. paratuberculosis
ucgguggcccagccggc

SEQ ID NO: 3034832 - RNA, 19 nt, Mycobacterium avium subsp. paratuberculosis
ucgguggcccagccggccg

SEQ ID NO: 3034833 - RNA, 12 nt, Mycobacterium avium subsp. paratuberculosis
ucgguggccucg

SEQ ID NO: 3034834 - RNA, 12 nt, Mycobacterium avium subsp. paratuberculosis
ucgguggcggcg

SEQ ID NO: 3034835 - RNA, 13 nt, Mycobacterium avium subsp. paratuberculosis
ucgguggcggugc

SEQ ID NO: 3034836 - RNA, 15 nt, Mycobacterium avium subsp. paratuberculosis
ucgguggcggugccg

SEQ ID NO: 3034837 - RNA, 20 nt, Mycobacterium avium subsp. paratuberculosis
ucgguggcgucggcggccug

SEQ ID NO: 3034838 - RNA, 16 nt, Mycobacterium avium subsp. paratuberculosis
ucggugggcagcucgu

SEQ ID NO: 3034839 - RNA, 16 nt, Mycobacterium avium subsp. paratuberculosis
ucggugggccgcaccu

SEQ ID NO: 3034840 - RNA, 19 nt, Mycobacterium avium subsp. paratuberculosis
ucggugggccgcaccuggc

SEQ ID NO: 3034841 - RNA, 15 nt, Mycobacterium avium subsp. paratuberculosis
ucggugggccgccgc

SEQ ID NO: 3034842 - RNA, 22 nt, Mycobacterium avium subsp. paratuberculosis
ucgguggggacgugcacgcguu

SEQ ID NO: 3034843 - RNA, 13 nt, Mycobacterium avium subsp. paratuberculosis
ucgguggucgacg

SEQ ID NO: 3034844 - RNA, 20 nt, Mycobacterium avium subsp. paratuberculosis
ucgguggucgacgagcccgc

SEQ ID NO: 3034845 - RNA, 13 nt, Mycobacterium avium subsp. paratuberculosis
ucgguggucucgu

SEQ ID NO: 3034846 - RNA, 18 nt, Mycobacterium avium subsp. paratuberculosis
ucggugguggggccggcg

SEQ ID NO: 3034847 - RNA, 20 nt, Mycobacterium avium subsp. paratuberculosis
ucgguggugucaaccagguc

SEQ ID NO: 3034848 - RNA, 17 nt, Mycobacterium avium subsp. paratuberculosis
ucgguguagagcaccuc

SEQ ID NO: 3034849 - RNA, 20 nt, Mycobacterium avium subsp. paratuberculosis
ucgguguagcgagugccggc

SEQ ID NO: 3034850 - RNA, 20 nt, Mycobacterium avium subsp. paratuberculosis
ucgguguagucggcgaucgg

SEQ ID NO: 3034851 - RNA, 21 nt, Mycobacterium avium subsp. paratuberculosis
ucggugucgaaguacgccguc

SEQ ID NO: 3034852 - RNA, 16 nt, Mycobacterium avium subsp. paratuberculosis
ucggugucgagggcca

SEQ ID NO: 3034853 - RNA, 16 nt, Mycobacterium avium subsp. paratuberculosis
ucggugucgcucaucc

SEQ ID NO: 3034854 - RNA, 20 nt, Mycobacterium avium subsp. paratuberculosis
ucggugugcagcagcucggc

SEQ ID NO: 3034855 - RNA, 21 nt, Mycobacterium avium subsp. paratuberculosis
ucggugugcagcagcucggcg

SEQ ID NO: 3034856 - RNA, 23 nt, Mycobacterium avium subsp. paratuberculosis
ucggugugcagcagcucggcgau

SEQ ID NO: 3034857 - RNA, 14 nt, Mycobacterium avium subsp. paratuberculosis
ucggugugccgcug

SEQ ID NO: 3034858 - RNA, 21 nt, Mycobacterium avium subsp. paratuberculosis
ucggugugcgguucacgcggc

SEQ ID NO: 3034859 - RNA, 17 nt, Mycobacterium avium subsp. paratuberculosis
ucgguugcuccggcguc

SEQ ID NO: 3034860 - RNA, 14 nt, Mycobacterium avium subsp. paratuberculosis
ucgguuggcucgca

SEQ ID NO: 3034861 - RNA, 19 nt, Mycobacterium avium subsp. paratuberculosis
ucguaacgccacggcggcc

SEQ ID NO: 3034862 - RNA, 12 nt, Mycobacterium avium subsp. paratuberculosis
ucguacagcagc

SEQ ID NO: 3034863 - RNA, 13 nt, Mycobacterium avium subsp. paratuberculosis
ucguacagcagcc

SEQ ID NO: 3034864 - RNA, 22 nt, Mycobacterium avium subsp. paratuberculosis
ucguacagcagccccugcacca

SEQ ID NO: 3034865 - RNA, 18 nt, Mycobacterium avium subsp. paratuberculosis
ucguaccaccaccagucg

SEQ ID NO: 3034866 - RNA, 22 nt, Mycobacterium avium subsp. paratuberculosis
ucguaccugccccacacgcucg

SEQ ID NO: 3034867 - RNA, 23 nt, Mycobacterium avium subsp. paratuberculosis
ucguacgacacgaugggucaggu

SEQ ID NO: 3034868 - RNA, 17 nt, Mycobacterium avium subsp. paratuberculosis
ucguacggcccgggaag

SEQ ID NO: 3034869 - RNA, 17 nt, Mycobacterium avium subsp. paratuberculosis
ucguacgucuugcgcac

SEQ ID NO: 3034870 - RNA, 19 nt, Mycobacterium avium subsp. paratuberculosis
ucguacucccaggccgcgg

SEQ ID NO: 3034871 - RNA, 22 nt, Mycobacterium avium subsp. paratuberculosis
ucguacucccaggccgcggcca

SEQ ID NO: 3034872 - RNA, 18 nt, Mycobacterium avium subsp. paratuberculosis
ucguagaccgcuugcgac

SEQ ID NO: 3034873 - RNA, 15 nt, Mycobacterium avium subsp. paratuberculosis
ucguagacgacgucg

SEQ ID NO: 3034874 - RNA, 13 nt, Mycobacterium avium subsp. paratuberculosis
ucguagagcgcga

SEQ ID NO: 3034875 - RNA, 19 nt, Mycobacterium avium subsp. paratuberculosis
ucguagagcgcgaagcccu

SEQ ID NO: 3034876 - RNA, 14 nt, Mycobacterium avium subsp. paratuberculosis
ucguagagcugacg

SEQ ID NO: 3034877 - RNA, 23 nt, Mycobacterium avium subsp. paratuberculosis
ucguagagcugacgggaccgcac

SEQ ID NO: 3034878 - RNA, 16 nt, Mycobacterium avium subsp. paratuberculosis
ucguagaucacggcgu

SEQ ID NO: 3034879 - RNA, 12 nt, Mycobacterium avium subsp. paratuberculosis
ucguagccggca

SEQ ID NO: 3034880 - RNA, 19 nt, Mycobacterium avium subsp. paratuberculosis
ucguagccgugcaucgggc

SEQ ID NO: 3034881 - RNA, 19 nt, Mycobacterium avium subsp. paratuberculosis
ucguagcggcgccaccggc

SEQ ID NO: 3034882 - RNA, 13 nt, Mycobacterium avium subsp. paratuberculosis
ucguaggacacca

SEQ ID NO: 3034883 - RNA, 18 nt, Mycobacterium avium subsp. paratuberculosis
ucguagggcucggcgucg

SEQ ID NO: 3034884 - RNA, 16 nt, Mycobacterium avium subsp. paratuberculosis
ucguagguggccagca

SEQ ID NO: 3034885 - RNA, 21 nt, Mycobacterium avium subsp. paratuberculosis
ucguagguggccagcacgauc

SEQ ID NO: 3034886 - RNA, 19 nt, Mycobacterium avium subsp. paratuberculosis
ucguagucgcucggcggcg

SEQ ID NO: 3034887 - RNA, 14 nt, Mycobacterium avium subsp. paratuberculosis
ucguagucggcccg

SEQ ID NO: 3034888 - RNA, 14 nt, Mycobacterium avium subsp. paratuberculosis
ucguaguugcggcc

SEQ ID NO: 3034889 - RNA, 17 nt, Mycobacterium avium subsp. paratuberculosis
ucguaguugcggccggc

SEQ ID NO: 3034890 - RNA, 22 nt, Mycobacterium avium subsp. paratuberculosis
ucgucaaaccguuuucggcgcg

SEQ ID NO: 3034891 - RNA, 23 nt, Mycobacterium avium subsp. paratuberculosis
ucgucaaaccguuuucggcgcgc

SEQ ID NO: 3034892 - RNA, 17 nt, Mycobacterium avium subsp. paratuberculosis
ucgucaaugauggucag

SEQ ID NO: 3034893 - RNA, 23 nt, Mycobacterium avium subsp. paratuberculosis
ucgucaaugauggucagccgcac

SEQ ID NO: 3034894 - RNA, 19 nt, Mycobacterium avium subsp. paratuberculosis
ucgucaccgaccccucggc

SEQ ID NO: 3034895 - RNA, 22 nt, Mycobacterium avium subsp. paratuberculosis
ucgucaccgaccccucggcggc

SEQ ID NO: 3034896 - RNA, 13 nt, Mycobacterium avium subsp. paratuberculosis
ucggucagcgagc

SEQ ID NO: 3034897 - RNA, 13 nt, Mycobacterium avium subsp. paratuberculosis
ucggucagcgcgu

SEQ ID NO: 3034898 - RNA, 15 nt, Mycobacterium avium subsp. paratuberculosis
ucggucagcggcguc

SEQ ID NO: 3034899 - RNA, 15 nt, Mycobacterium avium subsp. paratuberculosis
ucggucagcgucgcc

SEQ ID NO: 3034900 - RNA, 13 nt, Mycobacterium avium subsp. paratuberculosis
ucggucagcucga

SEQ ID NO: 3034901 - RNA, 15 nt, Mycobacterium avium subsp. paratuberculosis
ucggucagcucgggg

SEQ ID NO: 3034902 - RNA, 18 nt, Mycobacterium avium subsp. paratuberculosis
ucggucaggaacgcggac

SEQ ID NO: 3034903 - RNA, 13 nt, Mycobacterium avium subsp. paratuberculosis
ucggucaggcacu

SEQ ID NO: 3034904 - RNA, 17 nt, Mycobacterium avium subsp. paratuberculosis
ucggucaggccggcgcc

SEQ ID NO: 3034905 - RNA, 18 nt, Mycobacterium avium subsp. paratuberculosis
ucggucagucgcgccgcc

SEQ ID NO: 3034906 - RNA, 21 nt, Mycobacterium avium subsp. paratuberculosis
ucgguccaaaacaucccggac

SEQ ID NO: 3034907 - RNA, 18 nt, Mycobacterium avium subsp. paratuberculosis
ucgguccagguggccaug

SEQ ID NO: 3034908 - RNA, 16 nt, Mycobacterium avium subsp. paratuberculosis
ucgguccagguggggu

SEQ ID NO: 3034909 - RNA, 12 nt, Mycobacterium avium subsp. paratuberculosis
ucggucccaguc

SEQ ID NO: 3034910 - RNA, 17 nt, Mycobacterium avium subsp. paratuberculosis
ucggucccgacagggag

SEQ ID NO: 3034911 - RNA, 17 nt, Mycobacterium avium subsp. paratuberculosis
ucggucccgacgcggcg

SEQ ID NO: 3034912 - RNA, 20 nt, Mycobacterium avium subsp. paratuberculosis
ucggucccgacgcggcgcga

SEQ ID NO: 3034913 - RNA, 14 nt, Mycobacterium avium subsp. paratuberculosis
ucggucccggcggg

SEQ ID NO: 3034914 - RNA, 23 nt, Mycobacterium avium subsp. paratuberculosis
ucgguccggcgaauccgaccggc

SEQ ID NO: 3034915 - RNA, 21 nt, Mycobacterium avium subsp. paratuberculosis
ucggucgccagcaccgugcug

SEQ ID NO: 3034916 - RNA, 19 nt, Mycobacterium avium subsp. paratuberculosis
ucggucgccgaauccggcg

SEQ ID NO: 3034917 - RNA, 21 nt, Mycobacterium avium subsp. paratuberculosis
ucggucgccgaauccggcggg

SEQ ID NO: 3034918 - RNA, 13 nt, Mycobacterium avium subsp. paratuberculosis
ucggucgcgaccc

SEQ ID NO: 3034919 - RNA, 17 nt, Mycobacterium avium subsp. paratuberculosis
ucggucgcgacccgguc

SEQ ID NO: 3034920 - RNA, 20 nt, Mycobacterium avium subsp. paratuberculosis
ucggucgcgccgaccugguc

SEQ ID NO: 3034921 - RNA, 15 nt, Mycobacterium avium subsp. paratuberculosis
ucggucgcggcaucc

SEQ ID NO: 3034922 - RNA, 20 nt, Mycobacterium avium subsp. paratuberculosis
ucggucgcggcgaucggguc

SEQ ID NO: 3034923 - RNA, 15 nt, Mycobacterium avium subsp. paratuberculosis
ucggucgcggcgucg

SEQ ID NO: 3034924 - RNA, 16 nt, Mycobacterium avium subsp. paratuberculosis
ucggucgcggcgucgc

SEQ ID NO: 3034925 - RNA, 12 nt, Mycobacterium avium subsp. paratuberculosis
ucggucgcgguc

SEQ ID NO: 3034926 - RNA, 16 nt, Mycobacterium avium subsp. paratuberculosis
ucggucgcggucggcg

SEQ ID NO: 3034927 - RNA, 17 nt, Mycobacterium avium subsp. paratuberculosis
ucggucgcggucggcgc

SEQ ID NO: 3034928 - RNA, 20 nt, Mycobacterium avium subsp. paratuberculosis
ucggucgcggucggcgcccg

SEQ ID NO: 3034929 - RNA, 18 nt, Mycobacterium avium subsp. paratuberculosis
ucggucgcgugaccggcg

SEQ ID NO: 3034930 - RNA, 16 nt, Mycobacterium avium subsp. paratuberculosis
ucggucucgccccggc

SEQ ID NO: 3034931 - RNA, 15 nt, Mycobacterium avium subsp. paratuberculosis
ucggucucggcggcg

SEQ ID NO: 3034932 - RNA, 17 nt, Mycobacterium avium subsp. paratuberculosis
ucggucucggcggcgcc

SEQ ID NO: 3034933 - RNA, 19 nt, Mycobacterium avium subsp. paratuberculosis
ucggucucggcggcgccca

SEQ ID NO: 3034934 - RNA, 13 nt, Mycobacterium avium subsp. paratuberculosis
ucggucucgucca

SEQ ID NO: 3034935 - RNA, 22 nt, Mycobacterium avium subsp. paratuberculosis
ucggucugccuggcgaacucgc

SEQ ID NO: 3034936 - RNA, 18 nt, Mycobacterium avium subsp. paratuberculosis
ucggugaacccgccggcg

SEQ ID NO: 3034937 - RNA, 18 nt, Mycobacterium avium subsp. paratuberculosis
ucggugaacgccggugag

SEQ ID NO: 3034938 - RNA, 16 nt, Mycobacterium avium subsp. paratuberculosis
ucggugaacugcagcc

SEQ ID NO: 3034939 - RNA, 15 nt, Mycobacterium avium subsp. paratuberculosis
ucggugaagccgacg

SEQ ID NO: 3034940 - RNA, 16 nt, Mycobacterium avium subsp. paratuberculosis
ucggugaagcggcgcg

SEQ ID NO: 3034941 - RNA, 17 nt, Mycobacterium avium subsp. paratuberculosis
ucggugaagugccggcu

SEQ ID NO: 3034942 - RNA, 18 nt, Mycobacterium avium subsp. paratuberculosis
ucggugaaugucgugacc

SEQ ID NO: 3034943 - RNA, 15 nt, Mycobacterium avium subsp. paratuberculosis
ucggugaccacgguc

SEQ ID NO: 3034944 - RNA, 16 nt, Mycobacterium avium subsp. paratuberculosis
ucggugaccucgaaga

SEQ ID NO: 3034945 - RNA, 17 nt, Mycobacterium avium subsp. paratuberculosis
ucggugacgaacggcga

SEQ ID NO: 3034946 - RNA, 22 nt, Mycobacterium avium subsp. paratuberculosis
ucggugacgcccuuguccucga

SEQ ID NO: 3034947 - RNA, 15 nt, Mycobacterium avium subsp. paratuberculosis
ucggugacggcgucg

SEQ ID NO: 3034948 - RNA, 13 nt, Mycobacterium avium subsp. paratuberculosis
ucggugagacgac

SEQ ID NO: 3034949 - RNA, 23 nt, Mycobacterium avium subsp. paratuberculosis
ucggugagcaccguugugacccg

SEQ ID NO: 3034950 - RNA, 21 nt, Mycobacterium avium subsp. paratuberculosis
ucggugagccaguucgccagc

SEQ ID NO: 3034951 - RNA, 14 nt, Mycobacterium avium subsp. paratuberculosis
ucggugagcguggu

SEQ ID NO: 3034952 - RNA, 20 nt, Mycobacterium avium subsp. paratuberculosis
ucggugagcuggccgcgcag

SEQ ID NO: 3034953 - RNA, 23 nt, Mycobacterium avium subsp. paratuberculosis
ucggugaucaccaugaucagcgc

SEQ ID NO: 3034954 - RNA, 18 nt, Mycobacterium avium subsp. paratuberculosis
ucggugauccacgcggug

SEQ ID NO: 3034955 - RNA, 18 nt, Mycobacterium avium subsp. paratuberculosis
ucggugaucucaccggcg

SEQ ID NO: 3034956 - RNA, 20 nt, Mycobacterium avium subsp. paratuberculosis
ucggugaucucaccggcggc

SEQ ID NO: 3034957 - RNA, 15 nt, Mycobacterium avium subsp. paratuberculosis
ucggugaucugcacc

SEQ ID NO: 3034958 - RNA, 16 nt, Mycobacterium avium subsp. paratuberculosis
ucggugaucugcacca

SEQ ID NO: 3034959 - RNA, 19 nt, Mycobacterium avium subsp. paratuberculosis
ucggugaucugcaccagcg

SEQ ID NO: 3034960 - RNA, 16 nt, Mycobacterium avium subsp. paratuberculosis
ucggugaugccgagcg

SEQ ID NO: 3034961 - RNA, 13 nt, Mycobacterium avium subsp. paratuberculosis
ucggugaugccgg

SEQ ID NO: 3034962 - RNA, 14 nt, Mycobacterium avium subsp. paratuberculosis
ucggugaugccgga

SEQ ID NO: 3034963 - RNA, 12 nt, Mycobacterium avium subsp. paratuberculosis
ucggugaugguc

SEQ ID NO: 3034964 - RNA, 17 nt, Mycobacterium avium subsp. paratuberculosis
ucggugaugucgacguc

SEQ ID NO: 3034965 - RNA, 17 nt, Mycobacterium avium subsp. paratuberculosis
ucggugcagaccccggc

SEQ ID NO: 3034966 - RNA, 20 nt, Mycobacterium avium subsp. paratuberculosis
ucggugcagaccccggcguc

SEQ ID NO: 3034967 - RNA, 17 nt, Mycobacterium avium subsp. paratuberculosis
ucggugcaggccgcgac

SEQ ID NO: 3034968 - RNA, 19 nt, Mycobacterium avium subsp. paratuberculosis
ucggugccaucgugggcgc

SEQ ID NO: 3034969 - RNA, 13 nt, Mycobacterium avium subsp. paratuberculosis
ucggugcccagca

SEQ ID NO: 3034970 - RNA, 21 nt, Mycobacterium avium subsp. paratuberculosis
ucggugcccagcaccgccggc

SEQ ID NO: 3034971 - RNA, 23 nt, Mycobacterium avium subsp. paratuberculosis
ucggugcccgcggguagcccguc

SEQ ID NO: 3034972 - RNA, 17 nt, Mycobacterium avium subsp. paratuberculosis
ucggugcccugugaggc

SEQ ID NO: 3034973 - RNA, 18 nt, Mycobacterium avium subsp. paratuberculosis
ucggugcccugugaggcg

SEQ ID NO: 3034974 - RNA, 16 nt, Mycobacterium avium subsp. paratuberculosis
ucggugccgacggugc

SEQ ID NO: 3034975 - RNA, 13 nt, Mycobacterium avium subsp. paratuberculosis
ucggugccggccc

SEQ ID NO: 3034976 - RNA, 17 nt, Mycobacterium avium subsp. paratuberculosis
ucggugccggugaugaa

SEQ ID NO: 3034977 - RNA, 20 nt, Mycobacterium avium subsp. paratuberculosis
ucggugcgaaaauggcugcc

SEQ ID NO: 3034978 - RNA, 14 nt, Mycobacterium avium subsp. paratuberculosis
ucggugcgacccgg

SEQ ID NO: 3034979 - RNA, 13 nt, Mycobacterium avium subsp. paratuberculosis
ucggugcgcaccc

SEQ ID NO: 3034980 - RNA, 18 nt, Mycobacterium avium subsp. paratuberculosis
ucggugcgccagaucagc

SEQ ID NO: 3034981 - RNA, 11 nt, Mycobacterium avium subsp. paratuberculosis
ugcgccaggca

SEQ ID NO: 3034982 - RNA, 15 nt, Mycobacterium avium subsp. paratuberculosis
ugcgccaguggggga

SEQ ID NO: 3034983 - RNA, 22 nt, Mycobacterium avium subsp. paratuberculosis
ugcgccagugggggaauggcgg

SEQ ID NO: 3034984 - RNA, 18 nt, Mycobacterium avium subsp. paratuberculosis
ugcgccaguugcucgggu

SEQ ID NO: 3034985 - RNA, 17 nt, Mycobacterium avium subsp. paratuberculosis
ugcgccaguuugccguc

SEQ ID NO: 3034986 - RNA, 20 nt, Mycobacterium avium subsp. paratuberculosis
ugcgccaguuugccgucggg

SEQ ID NO: 3034987 - RNA, 21 nt, Mycobacterium avium subsp. paratuberculosis
ugcgccaguuugccgucggga

SEQ ID NO: 3034988 - RNA, 22 nt, Mycobacterium avium subsp. paratuberculosis
ugcgccaguuugccgucgggac

SEQ ID NO: 3034989 - RNA, 22 nt, Mycobacterium avium subsp. paratuberculosis
ugcgccauguccggcaggcuca

SEQ ID NO: 3034990 - RNA, 16 nt, Mycobacterium avium subsp. paratuberculosis
ugcgcccagaugccgg

SEQ ID NO: 3034991 - RNA, 11 nt, Mycobacterium avium subsp. paratuberculosis
ugcgcccagcg

SEQ ID NO: 3034992 - RNA, 23 nt, Mycobacterium avium subsp. paratuberculosis
ugcgcccagcgcgcgaucgccgg

SEQ ID NO: 3034993 - RNA, 16 nt, Mycobacterium avium subsp. paratuberculosis
ugcgccccgcccugcu

SEQ ID NO: 3034994 - RNA, 16 nt, Mycobacterium avium subsp. paratuberculosis
ugcgccccggcgggcg

SEQ ID NO: 3034995 - RNA, 20 nt, Mycobacterium avium subsp. paratuberculosis
ugcgccccggcgucgaugac

SEQ ID NO: 3034996 - RNA, 13 nt, Mycobacterium avium subsp. paratuberculosis
ugcgcccgacgcc

SEQ ID NO: 3034997 - RNA, 14 nt, Mycobacterium avium subsp. paratuberculosis
ugcgcccgacgccg

SEQ ID NO: 3034998 - RNA, 15 nt, Mycobacterium avium subsp. paratuberculosis
ugcgcccgacgccgg

SEQ ID NO: 3034999 - RNA, 16 nt, Mycobacterium avium subsp. paratuberculosis
ugcgcccgacgccgga

SEQ ID NO: 3035000 - RNA, 22 nt, Mycobacterium avium subsp. paratuberculosis
ugcgcccgacgccggaccccac

SEQ ID NO: 3035001 - RNA, 17 nt, Mycobacterium avium subsp. paratuberculosis
ugcgcccgaucggcgug

SEQ ID NO: 3035002 - RNA, 14 nt, Mycobacterium avium subsp. paratuberculosis
ugcgcccgccgcca

SEQ ID NO: 3035003 - RNA, 14 nt, Mycobacterium avium subsp. paratuberculosis
ugcgcccgcgauca

SEQ ID NO: 3035004 - RNA, 20 nt, Mycobacterium avium subsp. paratuberculosis
ugcgcccgcgaucaacaccg

SEQ ID NO: 3035005 - RNA, 16 nt, Mycobacterium avium subsp. paratuberculosis
ugcgcccgcugcggcg

SEQ ID NO: 3035006 - RNA, 19 nt, Mycobacterium avium subsp. paratuberculosis
ugcgcccggccagccggua

SEQ ID NO: 3035007 - RNA, 23 nt, Mycobacterium avium subsp. paratuberculosis
ugcgcccgggaaguucacguccu

SEQ ID NO: 3035008 - RNA, 16 nt, Mycobacterium avium subsp. paratuberculosis
ugcgcccggucacccg

SEQ ID NO: 3035009 - RNA, 15 nt, Mycobacterium avium subsp. paratuberculosis
ugcgcccgucggugg

SEQ ID NO: 3035010 - RNA, 18 nt, Mycobacterium avium subsp. paratuberculosis
ugcgcccgucgucgccga

SEQ ID NO: 3035011 - RNA, 22 nt, Mycobacterium avium subsp. paratuberculosis
ugcgcccugguugauccagcgg

SEQ ID NO: 3035012 - RNA, 16 nt, Mycobacterium avium subsp. paratuberculosis
ugcgccgaacgugcac

SEQ ID NO: 3035013 - RNA, 21 nt, Mycobacterium avium subsp. paratuberculosis
ugcgccgacagcugagcagcc

SEQ ID NO: 3035014 - RNA, 23 nt, Mycobacterium avium subsp. paratuberculosis
ugcgccgacagcugagcagcccg

SEQ ID NO: 3035015 - RNA, 13 nt, Mycobacterium avium subsp. paratuberculosis
ugcgccgaccgcg

SEQ ID NO: 3035016 - RNA, 19 nt, Mycobacterium avium subsp. paratuberculosis
ugcgccgacuugaucgcgg

SEQ ID NO: 3035017 - RNA, 15 nt, Mycobacterium avium subsp. paratuberculosis
ugcgccgauggugcc

SEQ ID NO: 3035018 - RNA, 14 nt, Mycobacterium avium subsp. paratuberculosis
ugcgccgcagcggu

SEQ ID NO: 3035019 - RNA, 23 nt, Mycobacterium avium subsp. paratuberculosis
ugcgccgcauuggugccggccuc

SEQ ID NO: 3035020 - RNA, 20 nt, Mycobacterium avium subsp. paratuberculosis
ugcgccgccagggcgcggcg

SEQ ID NO: 3035021 - RNA, 23 nt, Mycobacterium avium subsp. paratuberculosis
ugcgccgcccacaccgacaccgg

SEQ ID NO: 3035022 - RNA, 14 nt, Mycobacterium avium subsp. paratuberculosis
ugcgccgccgcguc

SEQ ID NO: 3035023 - RNA, 20 nt, Mycobacterium avium subsp. paratuberculosis
ugcgccgccgcgucgccgcc

SEQ ID NO: 3035024 - RNA, 22 nt, Mycobacterium avium subsp. paratuberculosis
ugcgccgccgcgucgccgccgg

SEQ ID NO: 3035025 - RNA, 13 nt, Mycobacterium avium subsp. paratuberculosis
ugcgccgccuccg

SEQ ID NO: 3035026 - RNA, 17 nt, Mycobacterium avium subsp. paratuberculosis
ugcgccgcggaugugga

SEQ ID NO: 3035027 - RNA, 12 nt, Mycobacterium avium subsp. paratuberculosis
ugcgccgcggcg

SEQ ID NO: 3035028 - RNA, 15 nt, Mycobacterium avium subsp. paratuberculosis
ugcgccgcucgucgg

SEQ ID NO: 3035029 - RNA, 19 nt, Mycobacterium avium subsp. paratuberculosis
ugcgccggcaacuggccgc

SEQ ID NO: 3035030 - RNA, 21 nt, Mycobacterium avium subsp. paratuberculosis
ugcgccggcaacuggccgccc

SEQ ID NO: 3035031 - RNA, 16 nt, Mycobacterium avium subsp. paratuberculosis
ugcgccggcgcggcca

SEQ ID NO: 3035032 - RNA, 19 nt, Mycobacterium avium subsp. paratuberculosis
ugcgccggcgcggccagcu

SEQ ID NO: 3035033 - RNA, 14 nt, Mycobacterium avium subsp. paratuberculosis
ugcgccggcggccg

SEQ ID NO: 3035034 - RNA, 22 nt, Mycobacterium avium subsp. paratuberculosis
ugcgccggcgguaugcccgggc

SEQ ID NO: 3035035 - RNA, 16 nt, Mycobacterium avium subsp. paratuberculosis
ugcgccggcggugucg

SEQ ID NO: 3035036 - RNA, 20 nt, Mycobacterium avium subsp. paratuberculosis
ugcgccggcggugucgagau

SEQ ID NO: 3035037 - RNA, 16 nt, Mycobacterium avium subsp. paratuberculosis
ugcgccggggccgcgg

SEQ ID NO: 3035038 - RNA, 22 nt, Mycobacterium avium subsp. paratuberculosis
ugcgccggggccgcggcucgcg

SEQ ID NO: 3035039 - RNA, 20 nt, Mycobacterium avium subsp. paratuberculosis
ugcgccggguccagccgcgg

SEQ ID NO: 3035040 - RNA, 19 nt, Mycobacterium avium subsp. paratuberculosis
ugcgccggguggccggggc

SEQ ID NO: 3035041 - RNA, 16 nt, Mycobacterium avium subsp. paratuberculosis
ugcgccgguagcgaca

SEQ ID NO: 3035042 - RNA, 13 nt, Mycobacterium avium subsp. paratuberculosis
ugcgccgguucgc

SEQ ID NO: 3035043 - RNA, 19 nt, Mycobacterium avium subsp. paratuberculosis
ugcgccgguucgcuggcgg

SEQ ID NO: 3035044 - RNA, 16 nt, Mycobacterium avium subsp. paratuberculosis
ugcgccgucaccggcu

SEQ ID NO: 3035045 - RNA, 18 nt, Mycobacterium avium subsp. paratuberculosis
ugcgccgucaucgacacc

SEQ ID NO: 3035046 - RNA, 15 nt, Mycobacterium avium subsp. paratuberculosis
ugcgccgucccggac

SEQ ID NO: 3035047 - RNA, 17 nt, Mycobacterium avium subsp. paratuberculosis
ugcgccgucccggacgc

SEQ ID NO: 3035048 - RNA, 22 nt, Mycobacterium avium subsp. paratuberculosis
ugcgccgucccggacgcugcgg

SEQ ID NO: 3035049 - RNA, 24 nt, Mycobacterium avium subsp. paratuberculosis
ugcgccgucccggacgcugcggua

SEQ ID NO: 3035050 - RNA, 22 nt, Mycobacterium avium subsp. paratuberculosis
ugcgccguccggccacgaccuc

SEQ ID NO: 3035051 - RNA, 16 nt, Mycobacterium avium subsp. paratuberculosis
ugcgccgugcagcacg

SEQ ID NO: 3035052 - RNA, 22 nt, Mycobacterium avium subsp. paratuberculosis
ugcgccgugcagcacgccgcgg

SEQ ID NO: 3035053 - RNA, 23 nt, Mycobacterium avium subsp. paratuberculosis
ugcgccguugauugcgcccgccg

SEQ ID NO: 3035054 - RNA, 13 nt, Mycobacterium avium subsp. paratuberculosis
ugcgccucgauca

SEQ ID NO: 3035055 - RNA, 21 nt, Mycobacterium avium subsp. paratuberculosis
ugcgccucgaucaacgccggg

SEQ ID NO: 3035056 - RNA, 20 nt, Mycobacterium avium subsp. paratuberculosis
ugcgccuugucgauggucgc

SEQ ID NO: 3035057 - RNA, 21 nt, Mycobacterium avium subsp. paratuberculosis
ugcgcgaccaaacgcagcguc

SEQ ID NO: 3035058 - RNA, 21 nt, Mycobacterium avium subsp. paratuberculosis
ugcgcgaccucuucgcuggac

SEQ ID NO: 3035059 - RNA, 13 nt, Mycobacterium avium subsp. paratuberculosis
ugcgcgacgccgu

SEQ ID NO: 3035060 - RNA, 14 nt, Mycobacterium avium subsp. paratuberculosis
ugcgcgacgccguc

SEQ ID NO: 3035061 - RNA, 21 nt, Mycobacterium avium subsp. paratuberculosis
ugcgcgacgcugauggcgagg

SEQ ID NO: 3035062 - RNA, 13 nt, Mycobacterium avium subsp. paratuberculosis
ugcgcgacggccu

SEQ ID NO: 3035063 - RNA, 18 nt, Mycobacterium avium subsp. paratuberculosis
ugcgcgacggcgcuguac

SEQ ID NO: 3035064 - RNA, 18 nt, Mycobacterium avium subsp. paratuberculosis
ugcgcgagauggcgauca

SEQ ID NO: 3035065 - RNA, 21 nt, Mycobacterium avium subsp. paratuberculosis
ugcgcgagcagaucgcggauc

SEQ ID NO: 3035066 - RNA, 23 nt, Mycobacterium avium subsp. paratuberculosis
ugcgcgaggagauuuuguuugga

SEQ ID NO: 3035067 - RNA, 14 nt, Mycobacterium avium subsp. paratuberculosis
ugcgcgaucgccgg

SEQ ID NO: 3035068 - RNA, 15 nt, Mycobacterium avium subsp. paratuberculosis
ugcgcgaucgccgga

SEQ ID NO: 3035069 - RNA, 22 nt, Mycobacterium avium subsp. paratuberculosis
ugcgcgauggcgugccggcgcu

SEQ ID NO: 3035070 - RNA, 17 nt, Mycobacterium avium subsp. paratuberculosis
ugcgcgaugucgacggu

SEQ ID NO: 3035071 - RNA, 14 nt, Mycobacterium avium subsp. paratuberculosis
ugcgcgcaccaggc

SEQ ID NO: 3035072 - RNA, 23 nt, Mycobacterium avium subsp. paratuberculosis
ugcgcgcaccaggccgacgcugg

SEQ ID NO: 3035073 - RNA, 13 nt, Mycobacterium avium subsp. paratuberculosis
ugcgcgccaccag

SEQ ID NO: 3035074 - RNA, 14 nt, Mycobacterium avium subsp. paratuberculosis
ugcgcgccaccagg

SEQ ID NO: 3035075 - RNA, 15 nt, Mycobacterium avium subsp. paratuberculosis
ugcgcgccagcagcg

SEQ ID NO: 3035076 - RNA, 17 nt, Mycobacterium avium subsp. paratuberculosis
ugcgcgccagcagcgcg

SEQ ID NO: 3035077 - RNA, 20 nt, Mycobacterium avium subsp. paratuberculosis
ugcgcgccagcagcgcgccg

SEQ ID NO: 3035078 - RNA, 15 nt, Mycobacterium avium subsp. paratuberculosis
ugcgcgcccugcugg

SEQ ID NO: 3035079 - RNA, 19 nt, Mycobacterium avium subsp. paratuberculosis
ugcgcgccgaccgcgagca

SEQ ID NO: 3035080 - RNA, 15 nt, Mycobacterium avium subsp. paratuberculosis
ugcgcgccgacgacc

SEQ ID NO: 3035081 - RNA, 18 nt, Mycobacterium avium subsp. paratuberculosis
ugcgcgccgacgaccagu

SEQ ID NO: 3035082 - RNA, 12 nt, Mycobacterium avium subsp. paratuberculosis
ugcgcgccgaug

SEQ ID NO: 3035083 - RNA, 18 nt, Mycobacterium avium subsp. paratuberculosis
ugcgcgccgcgacgucgg

SEQ ID NO: 3035084 - RNA, 21 nt, Mycobacterium avium subsp. paratuberculosis
ugcgcgccgucggcguucagc

SEQ ID NO: 3035085 - RNA, 17 nt, Mycobacterium avium subsp. paratuberculosis
ugcgcgccgugacgccg

SEQ ID NO: 3035086 - RNA, 13 nt, Mycobacterium avium subsp. paratuberculosis
ugcgcgccguugg

SEQ ID NO: 3035087 - RNA, 14 nt, Mycobacterium avium subsp. paratuberculosis
ugcgcgcgcaccug

SEQ ID NO: 3035088 - RNA, 19 nt, Mycobacterium avium subsp. paratuberculosis
ugcgcgcgcgaucgguguc

SEQ ID NO: 3035089 - RNA, 18 nt, Mycobacterium avium subsp. paratuberculosis
ugcgcgcgcgcucggcgu

SEQ ID NO: 3035090 - RNA, 18 nt, Mycobacterium avium subsp. paratuberculosis
ugcgcgcggugcacgguc

SEQ ID NO: 3035091 - RNA, 22 nt, Mycobacterium avium subsp. paratuberculosis
ugcgcgcguuguccagcagcgc

SEQ ID NO: 3035092 - RNA, 15 nt, Mycobacterium avium subsp. paratuberculosis
ugcgcgcuggccgcg

SEQ ID NO: 3035093 - RNA, 18 nt, Mycobacterium avium subsp. paratuberculosis
ugcgcggaaacuccuggc

SEQ ID NO: 3035094 - RNA, 15 nt, Mycobacterium avium subsp. paratuberculosis
ugcgcggaccggcga

SEQ ID NO: 3035095 - RNA, 22 nt, Mycobacterium avium subsp. paratuberculosis
ugcgcggcccguugagcaccgc

SEQ ID NO: 3035096 - RNA, 23 nt, Mycobacterium avium subsp. paratuberculosis
ugcgcggcccguugagcaccgcg

SEQ ID NO: 3035097 - RNA, 13 nt, Mycobacterium avium subsp. paratuberculosis
ugcgcggccgcgu

SEQ ID NO: 3035098 - RNA, 15 nt, Mycobacterium avium subsp. paratuberculosis
ugcgcggccgcgucg

SEQ ID NO: 3035099 - RNA, 21 nt, Mycobacterium avium subsp. paratuberculosis
ugcgcggccgcgucggcggcg

SEQ ID NO: 3035100 - RNA, 15 nt, Mycobacterium avium subsp. paratuberculosis
ugcgcggccggcgug

SEQ ID NO: 3035101 - RNA, 16 nt, Mycobacterium avium subsp. paratuberculosis
ugcgcggccugcagca

SEQ ID NO: 3035102 - RNA, 21 nt, Mycobacterium avium subsp. paratuberculosis
ugcgcggccugcagcaccgaa

SEQ ID NO: 3035103 - RNA, 17 nt, Mycobacterium avium subsp. paratuberculosis
ugcgcggcgaccaccuc

SEQ ID NO: 3035104 - RNA, 23 nt, Mycobacterium avium subsp. paratuberculosis
ugcgcggcgaccaccucggcgac

SEQ ID NO: 3035105 - RNA, 11 nt, Mycobacterium avium subsp. paratuberculosis
ugcgcggcgcc

SEQ ID NO: 3035106 - RNA, 13 nt, Mycobacterium avium subsp. paratuberculosis
ugcgcggcgccgg

SEQ ID NO: 3035107 - RNA, 22 nt, Mycobacterium avium subsp. paratuberculosis
ugcgcggcgccguuucggacga

SEQ ID NO: 3035108 - RNA, 22 nt, Mycobacterium avium subsp. paratuberculosis
ugcgcggcggcguccgcggccg

SEQ ID NO: 3035109 - RNA, 22 nt, Mycobacterium avium subsp. paratuberculosis
ugcgcggcguccaccagcacgc

SEQ ID NO: 3035110 - RNA, 20 nt, Mycobacterium avium subsp. paratuberculosis
ugcgcgggaacgaucggcuc

SEQ ID NO: 3035111 - RNA, 15 nt, Mycobacterium avium subsp. paratuberculosis
ugcgcgggcgcccgu

SEQ ID NO: 3035112 - RNA, 15 nt, Mycobacterium avium subsp. paratuberculosis
ugcgcgggcgcggac

SEQ ID NO: 3035113 - RNA, 22 nt, Mycobacterium avium subsp. paratuberculosis
ugcgcgggcgcggccagcgcga

SEQ ID NO: 3035114 - RNA, 16 nt, Mycobacterium avium subsp. paratuberculosis
ugcgcgggguggcgcc

SEQ ID NO: 3035115 - RNA, 18 nt, Mycobacterium avium subsp. paratuberculosis
ugcgcgggguggcgccgg

SEQ ID NO: 3035116 - RNA, 19 nt, Mycobacterium avium subsp. paratuberculosis
ugcgcgggguggcgccggc

SEQ ID NO: 3035117 - RNA, 16 nt, Mycobacterium avium subsp. paratuberculosis
ugcgcgggucgccggg

SEQ ID NO: 3035118 - RNA, 23 nt, Mycobacterium avium subsp. paratuberculosis
ugcgcgggucgccgggcaggugg

SEQ ID NO: 3035119 - RNA, 18 nt, Mycobacterium avium subsp. paratuberculosis
ugcgcgguaacagagcgg

SEQ ID NO: 3035120 - RNA, 19 nt, Mycobacterium avium subsp. paratuberculosis
ugcgcggucagcgcgucca

SEQ ID NO: 3035121 - RNA, 23 nt, Mycobacterium avium subsp. paratuberculosis
ugcgcgucagccgucgucguccg

SEQ ID NO: 3035122 - RNA, 17 nt, Mycobacterium avium subsp. paratuberculosis
ugcgcgucauggccguc

SEQ ID NO: 3035123 - RNA, 15 nt, Mycobacterium avium subsp. paratuberculosis
ugcgcgucgagcagc

SEQ ID NO: 3035124 - RNA, 21 nt, Mycobacterium avium subsp. paratuberculosis
ugcgcgucgagcagcaccacc

SEQ ID NO: 3035125 - RNA, 14 nt, Mycobacterium avium subsp. paratuberculosis
ugcgcgucgcggcg

SEQ ID NO: 3035126 - RNA, 17 nt, Mycobacterium avium subsp. paratuberculosis
ugcgcgucgcggcgcgg

SEQ ID NO: 3035127 - RNA, 18 nt, Mycobacterium avium subsp. paratuberculosis
ugcgcgucgcggcgcgga

SEQ ID NO: 3035128 - RNA, 21 nt, Mycobacterium avium subsp. paratuberculosis
ugcgcgucgcggcgcggaccc

SEQ ID NO: 3035129 - RNA, 21 nt, Mycobacterium avium subsp. paratuberculosis
ugcgcgucgcgguggagcaca

SEQ ID NO: 3035130 - RNA, 20 nt, Mycobacterium avium subsp. paratuberculosis
ugcgcgucggagaucaccgg

SEQ ID NO: 3035131 - RNA, 22 nt, Mycobacterium avium subsp. paratuberculosis
ugcgcgucggagaucaccggca

SEQ ID NO: 3035132 - RNA, 13 nt, Mycobacterium avium subsp. paratuberculosis
ugcgcgucgucgc

SEQ ID NO: 3035133 - RNA, 17 nt, Mycobacterium avium subsp. paratuberculosis
ugcgcguggggcgucgc

SEQ ID NO: 3035134 - RNA, 18 nt, Mycobacterium avium subsp. paratuberculosis
ugcgcguugcgcggaccg

SEQ ID NO: 3035135 - RNA, 22 nt, Mycobacterium avium subsp. paratuberculosis
ugcgcguuuugaaauccgggcg

SEQ ID NO: 3035136 - RNA, 13 nt, Mycobacterium avium subsp. paratuberculosis
ugcgcuaccaggc

SEQ ID NO: 3035137 - RNA, 22 nt, Mycobacterium avium subsp. paratuberculosis
ugcgcucacccaaaaaggcgcg

SEQ ID NO: 3035138 - RNA, 13 nt, Mycobacterium avium subsp. paratuberculosis
ugcgcucgacggc

SEQ ID NO: 3035139 - RNA, 14 nt, Mycobacterium avium subsp. paratuberculosis
ugcgcucgccgauc

SEQ ID NO: 3035140 - RNA, 13 nt, Mycobacterium avium subsp. paratuberculosis
ugcgcucggcgac

SEQ ID NO: 3035141 - RNA, 14 nt, Mycobacterium avium subsp. paratuberculosis
ugcgcugcaaccgg

SEQ ID NO: 3035142 - RNA, 14 nt, Mycobacterium avium subsp. paratuberculosis
ugcgcugcaccgca

SEQ ID NO: 3035143 - RNA, 16 nt, Mycobacterium avium subsp. paratuberculosis
ugcgcugcagcgagac

SEQ ID NO: 3035144 - RNA, 20 nt, Mycobacterium avium subsp. paratuberculosis
ugcgcugcagcgagaccucc

SEQ ID NO: 3035145 - RNA, 17 nt, Mycobacterium avium subsp. paratuberculosis
ugcgcugcccgauggug

SEQ ID NO: 3035146 - RNA, 18 nt, Mycobacterium avium subsp. paratuberculosis
ugcgcugcuuagccccuc

SEQ ID NO: 3035147 - RNA, 14 nt, Mycobacterium avium subsp. paratuberculosis
ugcgcuggcgaaca

SEQ ID NO: 3035148 - RNA, 13 nt, Mycobacterium avium subsp. paratuberculosis
ugcgcugugcggg

SEQ ID NO: 3035149 - RNA, 13 nt, Mycobacterium avium subsp. paratuberculosis
ugcgcuugcggcg

SEQ ID NO: 3035150 - RNA, 17 nt, Mycobacterium avium subsp. paratuberculosis
ugcgcuugcggcgcagc

SEQ ID NO: 3035151 - RNA, 17 nt, Mycobacterium avium subsp. paratuberculosis
ugcgcuugucagcggcc

SEQ ID NO: 3035152 - RNA, 20 nt, Mycobacterium avium subsp. paratuberculosis
ugcgcuugucggcguggccg

SEQ ID NO: 3035153 - RNA, 20 nt, Mycobacterium avium subsp. paratuberculosis
ugcggaacccacgugcggcg

SEQ ID NO: 3035154 - RNA, 21 nt, Mycobacterium avium subsp. paratuberculosis
ugcggaaucacuuccgcggca

SEQ ID NO: 3035155 - RNA, 22 nt, Mycobacterium avium subsp. paratuberculosis
ugcggacaccagucgcacaacc

SEQ ID NO: 3035156 - RNA, 23 nt, Mycobacterium avium subsp. paratuberculosis
ugcggacaccagucgcacaaccg

SEQ ID NO: 3035157 - RNA, 22 nt, Mycobacterium avium subsp. paratuberculosis
ugcggacgcguugaaaguccuu

SEQ ID NO: 3035158 - RNA, 17 nt, Mycobacterium avium subsp. paratuberculosis
ugcggacggucgccgac

SEQ ID NO: 3035159 - RNA, 14 nt, Mycobacterium avium subsp. paratuberculosis
ugcggaucgaacgg

SEQ ID NO: 3035160 - RNA, 21 nt, Mycobacterium avium subsp. paratuberculosis
ugcggaucgggcguggcgucg

SEQ ID NO: 3035161 - RNA, 17 nt, Mycobacterium avium subsp. paratuberculosis
ugcggaucucgaccucg

SEQ ID NO: 3035162 - RNA, 20 nt, Mycobacterium avium subsp. paratuberculosis
ugcggaucucggugccggug

SEQ ID NO: 3035163 - RNA, 19 nt, Mycobacterium avium subsp. paratuberculosis
ugcggaugaugguggccag

SEQ ID NO: 3035164 - RNA, 15 nt, Mycobacterium avium subsp. paratuberculosis
ugcggaugcugacca

SEQ ID NO: 3035165 - RNA, 15 nt, Mycobacterium avium subsp. paratuberculosis
ugcggcaacagcacc

SEQ ID NO: 3035166 - RNA, 16 nt, Mycobacterium avium subsp. paratuberculosis
ugcggcaacagcacca

SEQ ID NO: 3035167 - RNA, 19 nt, Mycobacterium avium subsp. paratuberculosis
ugcggcaacagcaccagca

SEQ ID NO: 3035168 - RNA, 12 nt, Mycobacterium avium subsp. paratuberculosis
ugcggcaacccg

SEQ ID NO: 3035169 - RNA, 15 nt, Mycobacterium avium subsp. paratuberculosis
ugcggcacaccagcg

SEQ ID NO: 3035170 - RNA, 22 nt, Mycobacterium avium subsp. paratuberculosis
ugcggcaccacgcugugcucga

SEQ ID NO: 3035171 - RNA, 15 nt, Mycobacterium avium subsp. paratuberculosis
ugcggcaccagcccg

SEQ ID NO: 3035172 - RNA, 20 nt, Mycobacterium avium subsp. paratuberculosis
ugcggcaccagucgcgcagc

SEQ ID NO: 3035173 - RNA, 15 nt, Mycobacterium avium subsp. paratuberculosis
ugcggcaccggcgaa

SEQ ID NO: 3035174 - RNA, 14 nt, Mycobacterium avium subsp. paratuberculosis
ugcggcaccuccag

SEQ ID NO: 3035175 - RNA, 20 nt, Mycobacterium avium subsp. paratuberculosis
ugcggcaccuccagcccggc

SEQ ID NO: 3035176 - RNA, 22 nt, Mycobacterium avium subsp. paratuberculosis
ugcggcaccucggccuugacca

SEQ ID NO: 3035177 - RNA, 14 nt, Mycobacterium avium subsp. paratuberculosis
ugcggcacgccgac

SEQ ID NO: 3035178 - RNA, 16 nt, Mycobacterium avium subsp. paratuberculosis
ugcggcacgccgacca

SEQ ID NO: 3035179 - RNA, 23 nt, Mycobacterium avium subsp. paratuberculosis
ugcggcacgccgaccacccccag

SEQ ID NO: 3035180 - RNA, 20 nt, Mycobacterium avium subsp. paratuberculosis
ugcggcacggcgaggucggg

SEQ ID NO: 3035181 - RNA, 14 nt, Mycobacterium avium subsp. paratuberculosis
ugcggcacggugcg

SEQ ID NO: 3035182 - RNA, 19 nt, Mycobacterium avium subsp. paratuberculosis
ugcggcagaccgguggcga

SEQ ID NO: 3035183 - RNA, 14 nt, Mycobacterium avium subsp. paratuberculosis
ugcggcagcacacc

SEQ ID NO: 3035184 - RNA, 14 nt, Mycobacterium avium subsp. paratuberculosis
ugcggcagggccac

SEQ ID NO: 3035185 - RNA, 18 nt, Mycobacterium avium subsp. paratuberculosis
ugcggcaggucggccagc

SEQ ID NO: 3035186 - RNA, 19 nt, Mycobacterium avium subsp. paratuberculosis
ugcggcaggucggccagcg

SEQ ID NO: 3035187 - RNA, 22 nt, Mycobacterium avium subsp. paratuberculosis
ugcggcaggucggccagcgccg

SEQ ID NO: 3035188 - RNA, 23 nt, Mycobacterium avium subsp. paratuberculosis
ugcggcaggucggccagcgccgc

SEQ ID NO: 3035189 - RNA, 19 nt, Mycobacterium avium subsp. paratuberculosis
ugcggccagugccgggcca

SEQ ID NO: 3035190 - RNA, 16 nt, Mycobacterium avium subsp. paratuberculosis
ugcggccauguccccg

SEQ ID NO: 3035191 - RNA, 21 nt, Mycobacterium avium subsp. paratuberculosis
ugcggccauguccccgccggu

SEQ ID NO: 3035192 - RNA, 24 nt, Mycobacterium avium subsp. paratuberculosis
ugcggcccaaccggaucggcuagc

SEQ ID NO: 3035193 - RNA, 14 nt, Mycobacterium avium subsp. paratuberculosis
ugcggcccagcccg

SEQ ID NO: 3035194 - RNA, 19 nt, Mycobacterium avium subsp. paratuberculosis
ugcggcccagcccggccag

SEQ ID NO: 3035195 - RNA, 20 nt, Mycobacterium avium subsp. paratuberculosis
ugcggcccagcccggccagc

SEQ ID NO: 3035196 - RNA, 14 nt, Mycobacterium avium subsp. paratuberculosis
ugcggccccgccag

SEQ ID NO: 3035197 - RNA, 12 nt, Mycobacterium avium subsp. paratuberculosis
ugcggcccgacc

SEQ ID NO: 3035198 - RNA, 17 nt, Mycobacterium avium subsp. paratuberculosis
ugcggcccgacccgguc

SEQ ID NO: 3035199 - RNA, 14 nt, Mycobacterium avium subsp. paratuberculosis
ugcggcccgccggg

SEQ ID NO: 3035200 - RNA, 16 nt, Mycobacterium avium subsp. paratuberculosis
ugcggcccgccgggcg

SEQ ID NO: 3035201 - RNA, 15 nt, Mycobacterium avium subsp. paratuberculosis
ugcggcccgcggcau

SEQ ID NO: 3035202 - RNA, 18 nt, Mycobacterium avium subsp. paratuberculosis
ugcggcccgcggcaucgu

SEQ ID NO: 3035203 - RNA, 12 nt, Mycobacterium avium subsp. paratuberculosis
ugcggcccggcu

SEQ ID NO: 3035204 - RNA, 17 nt, Mycobacterium avium subsp. paratuberculosis
ugcggcccuggcgggcg

SEQ ID NO: 3035205 - RNA, 16 nt, Mycobacterium avium subsp. paratuberculosis
ugcggcccuugcggcc

SEQ ID NO: 3035206 - RNA, 17 nt, Mycobacterium avium subsp. paratuberculosis
ugcggcccuugcggccg

SEQ ID NO: 3035207 - RNA, 18 nt, Mycobacterium avium subsp. paratuberculosis
ugcggcccuugcggccga

SEQ ID NO: 3035208 - RNA, 20 nt, Mycobacterium avium subsp. paratuberculosis
ugcggcccuugcggccgauc

SEQ ID NO: 3035209 - RNA, 23 nt, Mycobacterium avium subsp. paratuberculosis
ugcggcccuugcggccgaucacc

SEQ ID NO: 3035210 - RNA, 18 nt, Mycobacterium avium subsp. paratuberculosis
ugcggccgcagcgcccgg

SEQ ID NO: 3035211 - RNA, 17 nt, Mycobacterium avium subsp. paratuberculosis
ugcggccgccggccagc

SEQ ID NO: 3035212 - RNA, 18 nt, Mycobacterium avium subsp. paratuberculosis
ugcggccgcgacgcgcgg

SEQ ID NO: 3035213 - RNA, 23 nt, Mycobacterium avium subsp. paratuberculosis
ugcggccgcgacugcacccgaac

SEQ ID NO: 3035214 - RNA, 13 nt, Mycobacterium avium subsp. paratuberculosis
ugcggccgcgauc

SEQ ID NO: 3035215 - RNA, 22 nt, Mycobacterium avium subsp. paratuberculosis
ugcggccgcgcagcucgacgac

SEQ ID NO: 3035216 - RNA, 19 nt, Mycobacterium avium subsp. paratuberculosis
ugcggccgcuucccacccg

SEQ ID NO: 3035217 - RNA, 16 nt, Mycobacterium avium subsp. paratuberculosis
ugcggccggaaucucg

SEQ ID NO: 3035218 - RNA, 15 nt, Mycobacterium avium subsp. paratuberculosis
ugcggccggaccacc

SEQ ID NO: 3035219 - RNA, 15 nt, Mycobacterium avium subsp. paratuberculosis
ugcggccggccauga

SEQ ID NO: 3035220 - RNA, 16 nt, Mycobacterium avium subsp. paratuberculosis
ugcggccggcgccggc

SEQ ID NO: 3035221 - RNA, 13 nt, Mycobacterium avium subsp. paratuberculosis
ugcggccggcggc

SEQ ID NO: 3035222 - RNA, 18 nt, Mycobacterium avium subsp. paratuberculosis
ugcggccggcgggcagca

SEQ ID NO: 3035223 - RNA, 17 nt, Mycobacterium avium subsp. paratuberculosis
ugcggccggcggugucg

SEQ ID NO: 3035224 - RNA, 19 nt, Mycobacterium avium subsp. paratuberculosis
ugcggccggcggugucgua

SEQ ID NO: 3035225 - RNA, 14 nt, Mycobacterium avium subsp. paratuberculosis
ugcggccgucggga

SEQ ID NO: 3035226 - RNA, 21 nt, Mycobacterium avium subsp. paratuberculosis
ugcggccucggcaccgugccg

SEQ ID NO: 3035227 - RNA, 17 nt, Mycobacterium avium subsp. paratuberculosis
ugcggcgaaccgggccc

SEQ ID NO: 3035228 - RNA, 17 nt, Mycobacterium avium subsp. paratuberculosis
ugcggcgaacgcguccc

SEQ ID NO: 3035229 - RNA, 15 nt, Mycobacterium avium subsp. paratuberculosis
ugcggcgacgaucgg

SEQ ID NO: 3035230 - RNA, 22 nt, Mycobacterium avium subsp. paratuberculosis
ugcggcgagucccggcgcacca

SEQ ID NO: 3035231 - RNA, 18 nt, Mycobacterium avium subsp. paratuberculosis
ugcggcgcagccagcucg

SEQ ID NO: 3035232 - RNA, 22 nt, Mycobacterium avium subsp. paratuberculosis
ugcggcgcagccagcucggcgu

SEQ ID NO: 3035233 - RNA, 22 nt, Mycobacterium avium subsp. paratuberculosis
ugcggcgcagcgucucgaucga

SEQ ID NO: 3035234 - RNA, 16 nt, Mycobacterium avium subsp. paratuberculosis
ugcggcgcccuucccg

SEQ ID NO: 3035235 - RNA, 18 nt, Mycobacterium avium subsp. paratuberculosis
ugcggcgcggccaccccg

SEQ ID NO: 3035236 - RNA, 16 nt, Mycobacterium avium subsp. paratuberculosis
ugcggcgcggcggugg

SEQ ID NO: 3035237 - RNA, 13 nt, Mycobacterium avium subsp. paratuberculosis
ugcggcgcggugc

SEQ ID NO: 3035238 - RNA, 18 nt, Mycobacterium avium subsp. paratuberculosis
ugcggcgcggugcgccga

SEQ ID NO: 3035239 - RNA, 19 nt, Mycobacterium avium subsp. paratuberculosis
ugcggcgcggugcgccgac

SEQ ID NO: 3035240 - RNA, 21 nt, Mycobacterium avium subsp. paratuberculosis
ugcggcgcggugcgccgacag

SEQ ID NO: 3035241 - RNA, 15 nt, Mycobacterium avium subsp. paratuberculosis
ugcggcgcugccggc

SEQ ID NO: 3035242 - RNA, 15 nt, Mycobacterium avium subsp. paratuberculosis
ugcggcggcagucgc

SEQ ID NO: 3035243 - RNA, 17 nt, Mycobacterium avium subsp. paratuberculosis
ugcggcggcagucgcag

SEQ ID NO: 3035244 - RNA, 23 nt, Mycobacterium avium subsp. paratuberculosis
ugcggcggcagucgcagcagcag

SEQ ID NO: 3035245 - RNA, 13 nt, Mycobacterium avium subsp. paratuberculosis
ugcggcggcggcg

SEQ ID NO: 3035246 - RNA, 14 nt, Mycobacterium avium subsp. paratuberculosis
ugcggcgggccgca

SEQ ID NO: 3035247 - RNA, 24 nt, Mycobacterium avium subsp. paratuberculosis
ugcggcgucgucuuggccugcugu

SEQ ID NO: 3035248 - RNA, 17 nt, Mycobacterium avium subsp. paratuberculosis
ugcggcucaccaggucc

SEQ ID NO: 3035249 - RNA, 18 nt, Mycobacterium avium subsp. paratuberculosis
ugcggcuccacgaaguca

SEQ ID NO: 3035250 - RNA, 13 nt, Mycobacterium avium subsp. paratuberculosis
ugcggcucccacc

SEQ ID NO: 3035251 - RNA, 16 nt, Mycobacterium avium subsp. paratuberculosis
ugcggcucgucggcga

SEQ ID NO: 3035252 - RNA, 14 nt, Mycobacterium avium subsp. paratuberculosis
ugcggcugcccagg

SEQ ID NO: 3035253 - RNA, 20 nt, Mycobacterium avium subsp. paratuberculosis
ugcggcugcgcguucggcgc

SEQ ID NO: 3035254 - RNA, 15 nt, Mycobacterium avium subsp. paratuberculosis
ugcgggaccagcgcc

SEQ ID NO: 3035255 - RNA, 15 nt, Mycobacterium avium subsp. paratuberculosis
ugcgggacugggcga

SEQ ID NO: 3035256 - RNA, 21 nt, Mycobacterium avium subsp. paratuberculosis
ugcgggagaaaugggccaggu

SEQ ID NO: 3035257 - RNA, 19 nt, Mycobacterium avium subsp. paratuberculosis
ugcgggccaccgucccggu

SEQ ID NO: 3035258 - RNA, 18 nt, Mycobacterium avium subsp. paratuberculosis
ugcgggccagcacgaccc

SEQ ID NO: 3035259 - RNA, 23 nt, Mycobacterium avium subsp. paratuberculosis
ugcgggccagcacgaccccgccc

SEQ ID NO: 3035260 - RNA, 12 nt, Mycobacterium avium subsp. paratuberculosis
ugcgggccagga

SEQ ID NO: 3035261 - RNA, 19 nt, Mycobacterium avium subsp. paratuberculosis
ugcgggccaggaugucgga

SEQ ID NO: 3035262 - RNA, 12 nt, Mycobacterium avium subsp. paratuberculosis
ugcgggccaggu

SEQ ID NO: 3035263 - RNA, 18 nt, Mycobacterium avium subsp. paratuberculosis
ugcgggccaggucgagcg

SEQ ID NO: 3035264 - RNA, 11 nt, Mycobacterium avium subsp. paratuberculosis
ugcgggcccac

SEQ ID NO: 3035265 - RNA, 17 nt, Mycobacterium avium subsp. paratuberculosis
ugcgggccggagccuuc

SEQ ID NO: 3035266 - RNA, 12 nt, Mycobacterium avium subsp. paratuberculosis
ugcgggcgaacg

SEQ ID NO: 3035267 - RNA, 12 nt, Mycobacterium avium subsp. paratuberculosis
ugcgggcgaugg

SEQ ID NO: 3035268 - RNA, 13 nt, Mycobacterium avium subsp. paratuberculosis
ugcgggcggcagc

SEQ ID NO: 3035269 - RNA, 15 nt, Mycobacterium avium subsp. paratuberculosis
ugcgggcggcagcca

SEQ ID NO: 3035270 - RNA, 16 nt, Mycobacterium avium subsp. paratuberculosis
ugcgggcggcgcggcg

SEQ ID NO: 3035271 - RNA, 19 nt, Mycobacterium avium subsp. paratuberculosis
ugcgggcgggccgccaggu

SEQ ID NO: 3035272 - RNA, 22 nt, Mycobacterium avium subsp. paratuberculosis
ugcggggaggucgucgcgucca

SEQ ID NO: 3035273 - RNA, 12 nt, Mycobacterium avium subsp. paratuberculosis
ugcggggccgcg

SEQ ID NO: 3035274 - RNA, 12 nt, Mycobacterium avium subsp. paratuberculosis
ugcggggccggc

SEQ ID NO: 3035275 - RNA, 16 nt, Mycobacterium avium subsp. paratuberculosis
ugcggggccggcggcg

SEQ ID NO: 3035276 - RNA, 19 nt, Mycobacterium avium subsp. paratuberculosis
ugcggggccucgucgccgc

SEQ ID NO: 3035277 - RNA, 22 nt, Mycobacterium avium subsp. paratuberculosis
ugcggggccucgucgccgcggu

SEQ ID NO: 3035278 - RNA, 13 nt, Mycobacterium avium subsp. paratuberculosis
ugcggggugucga

SEQ ID NO: 3035279 - RNA, 19 nt, Mycobacterium avium subsp. paratuberculosis
ugcggggugugcaggccga

SEQ ID NO: 3035280 - RNA, 15 nt, Mycobacterium avium subsp. paratuberculosis
ugcgggucacacccu

SEQ ID NO: 3035281 - RNA, 23 nt, Mycobacterium avium subsp. paratuberculosis
ugcgggucacggucaggccggga

SEQ ID NO: 3035282 - RNA, 22 nt, Mycobacterium avium subsp. paratuberculosis
ugcggguccaucgccucgacca

SEQ ID NO: 3035283 - RNA, 13 nt, Mycobacterium avium subsp. paratuberculosis
ugcgggucggcgu

SEQ ID NO: 3035284 - RNA, 15 nt, Mycobacterium avium subsp. paratuberculosis
ugcgggucggcguca

SEQ ID NO: 3035285 - RNA, 15 nt, Mycobacterium avium subsp. paratuberculosis
ugcgggucucgccca

SEQ ID NO: 3035286 - RNA, 16 nt, Mycobacterium avium subsp. paratuberculosis
ugcgggugaggccagg

SEQ ID NO: 3035287 - RNA, 17 nt, Mycobacterium avium subsp. paratuberculosis
ugcgggugaggccaggc

SEQ ID NO: 3035288 - RNA, 18 nt, Mycobacterium avium subsp. paratuberculosis
ugcgggugauccagcccu

SEQ ID NO: 3035289 - RNA, 13 nt, Mycobacterium avium subsp. paratuberculosis
ugcgggugcggcc

SEQ ID NO: 3035290 - RNA, 17 nt, Mycobacterium avium subsp. paratuberculosis
ugcggguggccgggucg

SEQ ID NO: 3035291 - RNA, 18 nt, Mycobacterium avium subsp. paratuberculosis
ugcgggugguccacccag

SEQ ID NO: 3035292 - RNA, 13 nt, Mycobacterium avium subsp. paratuberculosis
ugcggguguccga

SEQ ID NO: 3035293 - RNA, 16 nt, Mycobacterium avium subsp. paratuberculosis
ugcgggugucgccggu

SEQ ID NO: 3035294 - RNA, 17 nt, Mycobacterium avium subsp. paratuberculosis
ugcgggugucgccggug

SEQ ID NO: 3035295 - RNA, 20 nt, Mycobacterium avium subsp. paratuberculosis
ugcggguguugcgcagcguc

SEQ ID NO: 3035296 - RNA, 17 nt, Mycobacterium avium subsp. paratuberculosis
ugcggguuggcgccggu

SEQ ID NO: 3035297 - RNA, 20 nt, Mycobacterium avium subsp. paratuberculosis
ugcgguacacguggccgauc

SEQ ID NO: 3035298 - RNA, 22 nt, Mycobacterium avium subsp. paratuberculosis
ugcgguacacguggccgaucag

SEQ ID NO: 3035299 - RNA, 16 nt, Mycobacterium avium subsp. paratuberculosis
ugcgguaugccaagcc

SEQ ID NO: 3035300 - RNA, 14 nt, Mycobacterium avium subsp. paratuberculosis
ugcgguccccggag

SEQ ID NO: 3035301 - RNA, 21 nt, Mycobacterium avium subsp. paratuberculosis
ugcgguccucgagcuggccgu

SEQ ID NO: 3035302 - RNA, 23 nt, Mycobacterium avium subsp. paratuberculosis
ugcggucgaugacgccgcgccgc

SEQ ID NO: 3035303 - RNA, 15 nt, Mycobacterium avium subsp. paratuberculosis
ugcggucgcgcagcc

SEQ ID NO: 3035304 - RNA, 19 nt, Mycobacterium avium subsp. paratuberculosis
ugcggucgcgcagccgggc

SEQ ID NO: 3035305 - RNA, 16 nt, Mycobacterium avium subsp. paratuberculosis
ugcggucgucgcccac

SEQ ID NO: 3035306 - RNA, 14 nt, Mycobacterium avium subsp. paratuberculosis
ugcggugaaaucuc

SEQ ID NO: 3035307 - RNA, 15 nt, Mycobacterium avium subsp. paratuberculosis
ugcggugaucccagg

SEQ ID NO: 3035308 - RNA, 15 nt, Mycobacterium avium subsp. paratuberculosis
ugcggugaugcgcgg

SEQ ID NO: 3035309 - RNA, 17 nt, Mycobacterium avium subsp. paratuberculosis
ugcggugcaccgcggcg

SEQ ID NO: 3035310 - RNA, 21 nt, Mycobacterium avium subsp. paratuberculosis
ugcggugcaccgcggcgcgca

SEQ ID NO: 3035311 - RNA, 13 nt, Mycobacterium avium subsp. paratuberculosis
ugcggugccgggc

SEQ ID NO: 3035312 - RNA, 15 nt, Mycobacterium avium subsp. paratuberculosis
ugcggugccgggcca

SEQ ID NO: 3035313 - RNA, 19 nt, Mycobacterium avium subsp. paratuberculosis
ugcggugccgggugcugaa

SEQ ID NO: 3035314 - RNA, 13 nt, Mycobacterium avium subsp. paratuberculosis
ugcggugcgccgc

SEQ ID NO: 3035315 - RNA, 14 nt, Mycobacterium avium subsp. paratuberculosis
ugcggugcgccgca

SEQ ID NO: 3035316 - RNA, 12 nt, Mycobacterium avium subsp. paratuberculosis
ugcggugcggcc

SEQ ID NO: 3035317 - RNA, 12 nt, Mycobacterium avium subsp. paratuberculosis
ugcggugcucgu

SEQ ID NO: 3035318 - RNA, 16 nt, Mycobacterium avium subsp. paratuberculosis
ugcggugcucgucgag

SEQ ID NO: 3035319 - RNA, 18 nt, Mycobacterium avium subsp. paratuberculosis
ugcggugcugccgugccg

SEQ ID NO: 3035320 - RNA, 13 nt, Mycobacterium avium subsp. paratuberculosis
ugcgguggucgaa

SEQ ID NO: 3035321 - RNA, 13 nt, Mycobacterium avium subsp. paratuberculosis
ugcgguggucggc

SEQ ID NO: 3035322 - RNA, 21 nt, Mycobacterium avium subsp. paratuberculosis
ugcgguguaaccguggcaggc

SEQ ID NO: 3035323 - RNA, 19 nt, Mycobacterium avium subsp. paratuberculosis
ugcgguugagcaccagccc

SEQ ID NO: 3035324 - RNA, 24 nt, Mycobacterium avium subsp. paratuberculosis
ugcgguuggcccgcggcgcccgga

SEQ ID NO: 3035325 - RNA, 13 nt, Mycobacterium avium subsp. paratuberculosis
ugcgguuggccgg

SEQ ID NO: 3035326 - RNA, 17 nt, Mycobacterium avium subsp. paratuberculosis
ugcgguuggccggaauc

SEQ ID NO: 3035327 - RNA, 14 nt, Mycobacterium avium subsp. paratuberculosis
ugcgguuggccggc

SEQ ID NO: 3035328 - RNA, 16 nt, Mycobacterium avium subsp. paratuberculosis
ugcgguuggccggccg

SEQ ID NO: 3035329 - RNA, 18 nt, Mycobacterium avium subsp. paratuberculosis
ugcgucacgcuggugacg

SEQ ID NO: 3035330 - RNA, 22 nt, Mycobacterium avium subsp. paratuberculosis
ugcgucagaaccggggccagca

SEQ ID NO: 3035331 - RNA, 17 nt, Mycobacterium avium subsp. paratuberculosis
ugcguccagaccggccg

SEQ ID NO: 3035332 - RNA, 14 nt, Mycobacterium avium subsp. paratuberculosis
ugcgucccgcgccg

SEQ ID NO: 3035333 - RNA, 15 nt, Mycobacterium avium subsp. paratuberculosis
ugcgucccgcgccgg

SEQ ID NO: 3035334 - RNA, 16 nt, Mycobacterium avium subsp. paratuberculosis
ugcgucccgcgccgga

SEQ ID NO: 3035335 - RNA, 20 nt, Mycobacterium avium subsp. paratuberculosis
ugcgucccguuggcgccggu

SEQ ID NO: 3035336 - RNA, 15 nt, Mycobacterium avium subsp. paratuberculosis
ugcguccgccggcgg

SEQ ID NO: 3035337 - RNA, 11 nt, Mycobacterium avium subsp. paratuberculosis
ugcgucgcggc

SEQ ID NO: 3035338 - RNA, 18 nt, Mycobacterium avium subsp. paratuberculosis
ugcgucggcaaugaccgg

SEQ ID NO: 3035339 - RNA, 17 nt, Mycobacterium avium subsp. paratuberculosis
ugcgucggcaccagcgg

SEQ ID NO: 3035340 - RNA, 19 nt, Mycobacterium avium subsp. paratuberculosis
ugcgucggcaccagcggca

SEQ ID NO: 3035341 - RNA, 13 nt, Mycobacterium avium subsp. paratuberculosis
ugcgucgggcgcc

SEQ ID NO: 3035342 - RNA, 23 nt, Mycobacterium avium subsp. paratuberculosis
ugcgucugcuugugaaugggcug

SEQ ID NO: 3035343 - RNA, 15 nt, Mycobacterium avium subsp. paratuberculosis
ugcgucuuuucccac

SEQ ID NO: 3035344 - RNA, 22 nt, Mycobacterium avium subsp. paratuberculosis
ugcgucuuuucccacacgcucg

SEQ ID NO: 3035345 - RNA, 13 nt, Mycobacterium avium subsp. paratuberculosis
ugcgugaccugcu

SEQ ID NO: 3035346 - RNA, 21 nt, Mycobacterium avium subsp. paratuberculosis
ugcgugcagacaaccggugug

SEQ ID NO: 3035347 - RNA, 14 nt, Mycobacterium avium subsp. paratuberculosis
ugcgugcagccgca

SEQ ID NO: 3035348 - RNA, 15 nt, Mycobacterium avium subsp. paratuberculosis
ugcgugcccggccag

SEQ ID NO: 3035349 - RNA, 18 nt, Mycobacterium avium subsp. paratuberculosis
ugcgugccuugcacccag

SEQ ID NO: 3035350 - RNA, 16 nt, Mycobacterium avium subsp. paratuberculosis
ugcgugcgcucgaccu

SEQ ID NO: 3035351 - RNA, 21 nt, Mycobacterium avium subsp. paratuberculosis
ugcgugcgcucgaccucggcg

SEQ ID NO: 3035352 - RNA, 21 nt, Mycobacterium avium subsp. paratuberculosis
ugcgugcgggucgcgcggcua

SEQ ID NO: 3035353 - RNA, 21 nt, Mycobacterium avium subsp. paratuberculosis
ugcguggucuaccugcugcuc

SEQ ID NO: 3035354 - RNA, 14 nt, Mycobacterium avium subsp. paratuberculosis
ugcgugguggggcc

SEQ ID NO: 3035355 - RNA, 12 nt, Mycobacterium avium subsp. paratuberculosis
ugcguguggcgc

SEQ ID NO: 3035356 - RNA, 18 nt, Mycobacterium avium subsp. paratuberculosis
ugcguguggcgcacgccc

SEQ ID NO: 3035357 - RNA, 20 nt, Mycobacterium avium subsp. paratuberculosis
ugcguucccagcccggccag

SEQ ID NO: 3035358 - RNA, 21 nt, Mycobacterium avium subsp. paratuberculosis
ugcguucccagcccggccagu

SEQ ID NO: 3035359 - RNA, 15 nt, Mycobacterium avium subsp. paratuberculosis
ugcguuccucgacgg

SEQ ID NO: 3035360 - RNA, 14 nt, Mycobacterium avium subsp. paratuberculosis
ugcguucggccgca

SEQ ID NO: 3035361 - RNA, 18 nt, Mycobacterium avium subsp. paratuberculosis
ugcguucggccgcagcgg

SEQ ID NO: 3035362 - RNA, 17 nt, Mycobacterium avium subsp. paratuberculosis
ugcguugcgccagcacc

SEQ ID NO: 3035363 - RNA, 21 nt, Mycobacterium avium subsp. paratuberculosis
ugcguugcgccagcaccgaca

SEQ ID NO: 3035364 - RNA, 16 nt, Mycobacterium avium subsp. paratuberculosis
ugcguuugccgucgag

SEQ ID NO: 3035365 - RNA, 22 nt, Mycobacterium avium subsp. paratuberculosis
ugcucaccgagcugggccggcg

SEQ ID NO: 3035366 - RNA, 22 nt, Mycobacterium avium subsp. paratuberculosis
ugcucagcggccaucgccgcca

SEQ ID NO: 3035367 - RNA, 18 nt, Mycobacterium avium subsp. paratuberculosis
ugcucagcgggaagccga

SEQ ID NO: 3035368 - RNA, 15 nt, Mycobacterium avium subsp. paratuberculosis
ugcucagcucccgag

SEQ ID NO: 3035369 - RNA, 22 nt, Mycobacterium avium subsp. paratuberculosis
ugcucaggaugauuucggcgug

SEQ ID NO: 3035370 - RNA, 18 nt, Mycobacterium avium subsp. paratuberculosis
ugcucagguugcgcagca

SEQ ID NO: 3035371 - RNA, 21 nt, Mycobacterium avium subsp. paratuberculosis
ugcucagguugcgcagcagcc

SEQ ID NO: 3035372 - RNA, 16 nt, Mycobacterium avium subsp. paratuberculosis
ugcuccagcaggcgcg

SEQ ID NO: 3035373 - RNA, 19 nt, Mycobacterium avium subsp. paratuberculosis
ugcucccaggcgucgucgu

SEQ ID NO: 3035374 - RNA, 21 nt, Mycobacterium avium subsp. paratuberculosis
ugcuccucgaaccucgcggcg

SEQ ID NO: 3035375 - RNA, 19 nt, Mycobacterium avium subsp. paratuberculosis
ugcuccucggucagcggcg

SEQ ID NO: 3035376 - RNA, 21 nt, Mycobacterium avium subsp. paratuberculosis
ugcucgaaccgcgagacccgg

SEQ ID NO: 3035377 - RNA, 23 nt, Mycobacterium avium subsp. paratuberculosis
ugcucgaaccgcgagacccgguc

SEQ ID NO: 3035378 - RNA, 15 nt, Mycobacterium avium subsp. paratuberculosis
ugcucgaacgcgccg

SEQ ID NO: 3035379 - RNA, 20 nt, Mycobacterium avium subsp. paratuberculosis
ugcucgaagcuuucggugcg

SEQ ID NO: 3035380 - RNA, 13 nt, Mycobacterium avium subsp. paratuberculosis
ugcucgaccagau

SEQ ID NO: 3035381 - RNA, 17 nt, Mycobacterium avium subsp. paratuberculosis
ugcucgaccagcgccga

SEQ ID NO: 3035382 - RNA, 18 nt, Mycobacterium avium subsp. paratuberculosis
ugcucgaccagcgccgag

SEQ ID NO: 3035383 - RNA, 21 nt, Mycobacterium avium subsp. paratuberculosis
ugcucgagcaucuccagccgg

SEQ ID NO: 3035384 - RNA, 18 nt, Mycobacterium avium subsp. paratuberculosis
ugcucgaucggcgcgccg

SEQ ID NO: 3035385 - RNA, 21 nt, Mycobacterium avium subsp. paratuberculosis
ugcucgaucucggccaccguc

SEQ ID NO: 3035386 - RNA, 17 nt, Mycobacterium avium subsp. paratuberculosis
ugcucgaugcgcaccug

SEQ ID NO: 3035387 - RNA, 17 nt, Mycobacterium avium subsp. paratuberculosis
ugcucgaugcggcccug

SEQ ID NO: 3035388 - RNA, 15 nt, Mycobacterium avium subsp. paratuberculosis
ugcucgauggccagc

SEQ ID NO: 3035389 - RNA, 22 nt, Mycobacterium avium subsp. paratuberculosis
ugcucgccgcguacgccgccuu

SEQ ID NO: 3035390 - RNA, 16 nt, Mycobacterium avium subsp. paratuberculosis
ugcucgccggcgcgga

SEQ ID NO: 3035391 - RNA, 23 nt, Mycobacterium avium subsp. paratuberculosis
ugcucgccguagaauccgccguu

SEQ ID NO: 3035392 - RNA, 17 nt, Mycobacterium avium subsp. paratuberculosis
ugcucgcgcagcagcug

SEQ ID NO: 3035393 - RNA, 15 nt, Mycobacterium avium subsp. paratuberculosis
ugcucgcgcugccgc

SEQ ID NO: 3035394 - RNA, 21 nt, Mycobacterium avium subsp. paratuberculosis
ugcucgcgcugccgcgcgccg

SEQ ID NO: 3035395 - RNA, 19 nt, Mycobacterium avium subsp. paratuberculosis
ugcucgcgggccaccgcgg

SEQ ID NO: 3035396 - RNA, 20 nt, Mycobacterium avium subsp. paratuberculosis
ugcucgcgggccaccgcggc

SEQ ID NO: 3035397 - RNA, 16 nt, Mycobacterium avium subsp. paratuberculosis
ugcucgcuugccagcc

SEQ ID NO: 3035398 - RNA, 18 nt, Mycobacterium avium subsp. paratuberculosis
ugcucgcuugccagccgg

SEQ ID NO: 3035399 - RNA, 20 nt, Mycobacterium avium subsp. paratuberculosis
ugcucggccaccgcgcggug

SEQ ID NO: 3035400 - RNA, 14 nt, Mycobacterium avium subsp. paratuberculosis
ugcucggccacgac

SEQ ID NO: 3035401 - RNA, 16 nt, Mycobacterium avium subsp. paratuberculosis
ugcucggcgagcaccg

SEQ ID NO: 3035402 - RNA, 19 nt, Mycobacterium avium subsp. paratuberculosis
ugcucggcgcgcggggccg

SEQ ID NO: 3035403 - RNA, 15 nt, Mycobacterium avium subsp. paratuberculosis
ugcucggcggcccgc

SEQ ID NO: 3035404 - RNA, 13 nt, Mycobacterium avium subsp. paratuberculosis
ugcucggcggccg

SEQ ID NO: 3035405 - RNA, 16 nt, Mycobacterium avium subsp. paratuberculosis
ugcucggcggcgcagg

SEQ ID NO: 3035406 - RNA, 17 nt, Mycobacterium avium subsp. paratuberculosis
ugcucggcggcgcaggc

SEQ ID NO: 3035407 - RNA, 22 nt, Mycobacterium avium subsp. paratuberculosis
ugcucggcgggucacucgaccu

SEQ ID NO: 3035408 - RNA, 13 nt, Mycobacterium avium subsp. paratuberculosis
ugcucgggugacg

SEQ ID NO: 3035409 - RNA, 17 nt, Mycobacterium avium subsp. paratuberculosis
ugcucggucaacccgau

SEQ ID NO: 3035410 - RNA, 21 nt, Mycobacterium avium subsp. paratuberculosis
ugcucggugauccacgcggug

SEQ ID NO: 3035411 - RNA, 15 nt, Mycobacterium avium subsp. paratuberculosis
ugcucggugaugccg

SEQ ID NO: 3035412 - RNA, 16 nt, Mycobacterium avium subsp. paratuberculosis
ugcucggugaugccga

SEQ ID NO: 3035413 - RNA, 14 nt, Mycobacterium avium subsp. paratuberculosis
ugcucggugucgau

SEQ ID NO: 3035414 - RNA, 21 nt, Mycobacterium avium subsp. paratuberculosis
ugcucguccuggcgcuggugc

SEQ ID NO: 3035415 - RNA, 18 nt, Mycobacterium avium subsp. paratuberculosis
ugcucgucgagcauccgg

SEQ ID NO: 3035416 - RNA, 22 nt, Mycobacterium avium subsp. paratuberculosis
ugcucgucggacucuucuuccu

SEQ ID NO: 3035417 - RNA, 13 nt, Mycobacterium avium subsp. paratuberculosis
ugcucgucggccg

SEQ ID NO: 3035418 - RNA, 15 nt, Mycobacterium avium subsp. paratuberculosis
ugcucgucggugacg

SEQ ID NO: 3035419 - RNA, 20 nt, Mycobacterium avium subsp. paratuberculosis
ugcucgugcaaaccggaccg

SEQ ID NO: 3035420 - RNA, 23 nt, Mycobacterium avium subsp. paratuberculosis
ugcucgugcaaaccggaccgccg

SEQ ID NO: 3035421 - RNA, 22 nt, Mycobacterium avium subsp. paratuberculosis
ugcucguugugcauguggccgu

SEQ ID NO: 3035422 - RNA, 14 nt, Mycobacterium avium subsp. paratuberculosis
ugcucucggccucc

SEQ ID NO: 3035423 - RNA, 13 nt, Mycobacterium avium subsp. paratuberculosis
ugcucugccuacu

SEQ ID NO: 3035424 - RNA, 15 nt, Mycobacterium avium subsp. paratuberculosis
ugcucuugacggccg

SEQ ID NO: 3035425 - RNA, 18 nt, Mycobacterium avium subsp. paratuberculosis
ugcucuugacggccgcgg

SEQ ID NO: 3035426 - RNA, 19 nt, Mycobacterium avium subsp. paratuberculosis
ugcucuugacggccgcggc

SEQ ID NO: 3035427 - RNA, 18 nt, Mycobacterium avium subsp. paratuberculosis
ugcugaaugaacgaccug

SEQ ID NO: 3035428 - RNA, 15 nt, Mycobacterium avium subsp. paratuberculosis
ugcugacaccucgga

SEQ ID NO: 3035429 - RNA, 14 nt, Mycobacterium avium subsp. paratuberculosis
ugcugaccaaggcc

SEQ ID NO: 3035430 - RNA, 15 nt, Mycobacterium avium subsp. paratuberculosis
ugcugaccaaggccg

SEQ ID NO: 3035431 - RNA, 20 nt, Mycobacterium avium subsp. paratuberculosis
ugcugacccggucgcggccg

SEQ ID NO: 3035432 - RNA, 14 nt, Mycobacterium avium subsp. paratuberculosis
ugcugagccgccga

SEQ ID NO: 3035433 - RNA, 12 nt, Mycobacterium avium subsp. paratuberculosis
ugcugagcugcg

SEQ ID NO: 3035434 - RNA, 18 nt, Mycobacterium avium subsp. paratuberculosis
ugcugauccacgcccgga

SEQ ID NO: 3035435 - RNA, 16 nt, Mycobacterium avium subsp. paratuberculosis
ugcugcaacggcuggc

SEQ ID NO: 3035436 - RNA, 23 nt, Mycobacterium avium subsp. paratuberculosis
ugcugcaacggcuggcgcaggug

SEQ ID NO: 3035437 - RNA, 17 nt, Mycobacterium avium subsp. paratuberculosis
ugcugcacccaccggcg

SEQ ID NO: 3035438 - RNA, 20 nt, Mycobacterium avium subsp. paratuberculosis
ugcugcacgucgccggcgac

SEQ ID NO: 3035439 - RNA, 21 nt, Mycobacterium avium subsp. paratuberculosis
ugcugcagauccgcucgccgu

SEQ ID NO: 3035440 - RNA, 16 nt, Mycobacterium avium subsp. paratuberculosis
ugcugcagcgcccggg

SEQ ID NO: 3035441 - RNA, 17 nt, Mycobacterium avium subsp. paratuberculosis
ugcugcagcgcccgggc

SEQ ID NO: 3035442 - RNA, 19 nt, Mycobacterium avium subsp. paratuberculosis
ugcugcagcgcccgggcca

SEQ ID NO: 3035443 - RNA, 22 nt, Mycobacterium avium subsp. paratuberculosis
ugcugcagcgcccgggccagga

SEQ ID NO: 3035444 - RNA, 19 nt, Mycobacterium avium subsp. paratuberculosis
ugcugcagcgcgaggcgca

SEQ ID NO: 3035445 - RNA, 20 nt, Mycobacterium avium subsp. paratuberculosis
ugcugcccauccaggccagc

SEQ ID NO: 3035446 - RNA, 12 nt, Mycobacterium avium subsp. paratuberculosis
ugcugcccgcgg

SEQ ID NO: 3035447 - RNA, 15 nt, Mycobacterium avium subsp. paratuberculosis
ugcugcccgcggccg

SEQ ID NO: 3035448 - RNA, 12 nt, Mycobacterium avium subsp. paratuberculosis
ugcugcccggcg

SEQ ID NO: 3035449 - RNA, 16 nt, Mycobacterium avium subsp. paratuberculosis
ugcugcccggcgcgga

SEQ ID NO: 3035450 - RNA, 13 nt, Mycobacterium avium subsp. paratuberculosis
ugcugcccuugug

SEQ ID NO: 3035451 - RNA, 13 nt, Mycobacterium avium subsp. paratuberculosis
ugcugccgccggc

SEQ ID NO: 3035452 - RNA, 13 nt, Mycobacterium avium subsp. paratuberculosis
ugcugccggacac

SEQ ID NO: 3035453 - RNA, 13 nt, Mycobacterium avium subsp. paratuberculosis
ugcugccgugccg

SEQ ID NO: 3035454 - RNA, 15 nt, Mycobacterium avium subsp. paratuberculosis
ugcugccguugggca

SEQ ID NO: 3035455 - RNA, 19 nt, Mycobacterium avium subsp. paratuberculosis
ugcugccugccguugggga

SEQ ID NO: 3035456 - RNA, 21 nt, Mycobacterium avium subsp. paratuberculosis
ugcugcgcaacaccucggcga

SEQ ID NO: 3035457 - RNA, 14 nt, Mycobacterium avium subsp. paratuberculosis
ugcugcgcagcagc

SEQ ID NO: 3035458 - RNA, 15 nt, Mycobacterium avium subsp. paratuberculosis
ugcugcgcggcacgg

SEQ ID NO: 3035459 - RNA, 13 nt, Mycobacterium avium subsp. paratuberculosis
ugcugcggccgga

SEQ ID NO: 3035460 - RNA, 16 nt, Mycobacterium avium subsp. paratuberculosis
ugcugcggcuccacga

SEQ ID NO: 3035461 - RNA, 17 nt, Mycobacterium avium subsp. paratuberculosis
ugcugcgggucagcagc

SEQ ID NO: 3035462 - RNA, 16 nt, Mycobacterium avium subsp. paratuberculosis
ugcugcguucggcgau

SEQ ID NO: 3035463 - RNA, 13 nt, Mycobacterium avium subsp. paratuberculosis
ugcugcucggccg

SEQ ID NO: 3035464 - RNA, 14 nt, Mycobacterium avium subsp. paratuberculosis
ugcugcucggccgc

SEQ ID NO: 3035465 - RNA, 17 nt, Mycobacterium avium subsp. paratuberculosis
ugcuggaaucgcggauc

SEQ ID NO: 3035466 - RNA, 15 nt, Mycobacterium avium subsp. paratuberculosis
ugcuggacggcccga

SEQ ID NO: 3035467 - RNA, 12 nt, Mycobacterium avium subsp. paratuberculosis
ugcuggccacca

SEQ ID NO: 3035468 - RNA, 18 nt, Mycobacterium avium subsp. paratuberculosis
ugcuggccagcaccagcg

SEQ ID NO: 3035469 - RNA, 15 nt, Mycobacterium avium subsp. paratuberculosis
ugcuggccaucgcgg

SEQ ID NO: 3035470 - RNA, 23 nt, Mycobacterium avium subsp. paratuberculosis
ugcuggcggccuucuuggccgga

SEQ ID NO: 3035471 - RNA, 18 nt, Mycobacterium avium subsp. paratuberculosis
ugcuggcguucgccgagg

SEQ ID NO: 3035472 - RNA, 22 nt, Mycobacterium avium subsp. paratuberculosis
ugcugggacgggucggcggcga

SEQ ID NO: 3035473 - RNA, 23 nt, Mycobacterium avium subsp. paratuberculosis
ugcugggccacgauccgcgcggc

SEQ ID NO: 3035474 - RNA, 14 nt, Mycobacterium avium subsp. paratuberculosis
ugcugggcgggcag

SEQ ID NO: 3035475 - RNA, 21 nt, Mycobacterium avium subsp. paratuberculosis
ugcuggggguggcgucgacgg

SEQ ID NO: 3035476 - RNA, 17 nt, Mycobacterium avium subsp. paratuberculosis
ugcuggucaugccgucg

SEQ ID NO: 3035477 - RNA, 22 nt, Mycobacterium avium subsp. paratuberculosis
ugcuggucuugccgugcagcag

SEQ ID NO: 3035478 - RNA, 13 nt, Mycobacterium avium subsp. paratuberculosis
ugcuggugaaguu

SEQ ID NO: 3035479 - RNA, 17 nt, Mycobacterium avium subsp. paratuberculosis
ugcuggugccgccgaug

SEQ ID NO: 3035480 - RNA, 14 nt, Mycobacterium avium subsp. paratuberculosis
ugcuguacgacaac

SEQ ID NO: 3035481 - RNA, 23 nt, Mycobacterium avium subsp. paratuberculosis
ugcuguacgacaacagugccuac

SEQ ID NO: 3035482 - RNA, 12 nt, Mycobacterium avium subsp. paratuberculosis
ugcugucgucgc

SEQ ID NO: 3035483 - RNA, 19 nt, Mycobacterium avium subsp. paratuberculosis
ugcuuagccccucccacca

SEQ ID NO: 3035484 - RNA, 15 nt, Mycobacterium avium subsp. paratuberculosis
ugcuucagcucgcug

SEQ ID NO: 3035485 - RNA, 20 nt, Mycobacterium avium subsp. paratuberculosis
ugcuuccgaucaacggcagc

SEQ ID NO: 3035486 - RNA, 22 nt, Mycobacterium avium subsp. paratuberculosis
ugcuuccgaucaacggcagcga

SEQ ID NO: 3035487 - RNA, 14 nt, Mycobacterium avium subsp. paratuberculosis
ugcuucgucgccgg

SEQ ID NO: 3035488 - RNA, 14 nt, Mycobacterium avium subsp. paratuberculosis
ugcuucuggcucaa

SEQ ID NO: 3035489 - RNA, 22 nt, Mycobacterium avium subsp. paratuberculosis
ugcuucuggguguaggucaaga

SEQ ID NO: 3035490 - RNA, 17 nt, Mycobacterium avium subsp. paratuberculosis
ugcuugaacgccgcccc

SEQ ID NO: 3035491 - RNA, 19 nt, Mycobacterium avium subsp. paratuberculosis
ugcuugccgaugucggcgu

SEQ ID NO: 3035492 - RNA, 16 nt, Mycobacterium avium subsp. paratuberculosis
ugcuugccgccgggcc

SEQ ID NO: 3035493 - RNA, 14 nt, Mycobacterium avium subsp. paratuberculosis
ugcuuggcggccug

SEQ ID NO: 3035494 - RNA, 16 nt, Mycobacterium avium subsp. paratuberculosis
ugcuugggcagcagcu

SEQ ID NO: 3035495 - RNA, 16 nt, Mycobacterium avium subsp. paratuberculosis
ugcuuggucagcgcgg

SEQ ID NO: 3035496 - RNA, 23 nt, Mycobacterium avium subsp. paratuberculosis
uggaacaucccggagccgucggc

SEQ ID NO: 3035497 - RNA, 14 nt, Mycobacterium avium subsp. paratuberculosis
uggaacaucuccag

SEQ ID NO: 3035498 - RNA, 15 nt, Mycobacterium avium subsp. paratuberculosis
uggaaccggccacca

SEQ ID NO: 3035499 - RNA, 14 nt, Mycobacterium avium subsp. paratuberculosis
uggaacgccgagga

SEQ ID NO: 3035500 - RNA, 17 nt, Mycobacterium avium subsp. paratuberculosis
uggaacgcgucgcgcca

SEQ ID NO: 3035501 - RNA, 19 nt, Mycobacterium avium subsp. paratuberculosis
uggaacgcgucgcgccagc

SEQ ID NO: 3035502 - RNA, 21 nt, Mycobacterium avium subsp. paratuberculosis
uggaacgcgucgcgccagcgg

SEQ ID NO: 3035503 - RNA, 14 nt, Mycobacterium avium subsp. paratuberculosis
uggaagauguccuc

SEQ ID NO: 3035504 - RNA, 17 nt, Mycobacterium avium subsp. paratuberculosis
uggaagcgcaucgccgg

SEQ ID NO: 3035505 - RNA, 18 nt, Mycobacterium avium subsp. paratuberculosis
uggaagcgcaucgccggc

SEQ ID NO: 3035506 - RNA, 23 nt, Mycobacterium avium subsp. paratuberculosis
uggaaugugccugcgggcccagc

SEQ ID NO: 3035507 - RNA, 17 nt, Mycobacterium avium subsp. paratuberculosis
uggaauucuggccgacc

SEQ ID NO: 3035508 - RNA, 12 nt, Mycobacterium avium subsp. paratuberculosis
uggacaccgcac

SEQ ID NO: 3035509 - RNA, 17 nt, Mycobacterium avium subsp. paratuberculosis
uggacaccuuggcggcc

SEQ ID NO: 3035510 - RNA, 15 nt, Mycobacterium avium subsp. paratuberculosis
uggacagaugccaga

SEQ ID NO: 3035511 - RNA, 17 nt, Mycobacterium avium subsp. paratuberculosis
uggacagaugccagacg

SEQ ID NO: 3035512 - RNA, 15 nt, Mycobacterium avium subsp. paratuberculosis
uggacagcagcagcu

SEQ ID NO: 3035513 - RNA, 20 nt, Mycobacterium avium subsp. paratuberculosis
uggacagcgauugcacaccg

SEQ ID NO: 3035514 - RNA, 14 nt, Mycobacterium avium subsp. paratuberculosis
uggacagcgcgacg

SEQ ID NO: 3035515 - RNA, 22 nt, Mycobacterium avium subsp. paratuberculosis
uggacagcucgacgaacuccgc

SEQ ID NO: 3035516 - RNA, 18 nt, Mycobacterium avium subsp. paratuberculosis
uggacaggcacucgccca

SEQ ID NO: 3035517 - RNA, 15 nt, Mycobacterium avium subsp. paratuberculosis
uggacaggcccagcg

SEQ ID NO: 3035518 - RNA, 17 nt, Mycobacterium avium subsp. paratuberculosis
uggacaggccggcgacg

SEQ ID NO: 3035519 - RNA, 18 nt, Mycobacterium avium subsp. paratuberculosis
uggacaggucgaugaugu

SEQ ID NO: 3035520 - RNA, 17 nt, Mycobacterium avium subsp. paratuberculosis
uggacaggugcauccag

SEQ ID NO: 3035521 - RNA, 21 nt, Mycobacterium avium subsp. paratuberculosis
uggacaguucgguggggccgc

SEQ ID NO: 3035522 - RNA, 18 nt, Mycobacterium avium subsp. paratuberculosis
uggaccagggcgguggcg

SEQ ID NO: 3035523 - RNA, 18 nt, Mycobacterium avium subsp. paratuberculosis
uggacccgaagucgacgc

SEQ ID NO: 3035524 - RNA, 22 nt, Mycobacterium avium subsp. paratuberculosis
uggacccgaccuuuugcccggc

SEQ ID NO: 3035525 - RNA, 22 nt, Mycobacterium avium subsp. paratuberculosis
uggacccgccccgacagcaacg

SEQ ID NO: 3035526 - RNA, 19 nt, Mycobacterium avium subsp. paratuberculosis
uggaccggguggugggcga

SEQ ID NO: 3035527 - RNA, 20 nt, Mycobacterium avium subsp. paratuberculosis
uggacgaaagccuccaaccc

SEQ ID NO: 3035528 - RNA, 14 nt, Mycobacterium avium subsp. paratuberculosis
uggacgaacgcggc

SEQ ID NO: 3035529 - RNA, 16 nt, Mycobacterium avium subsp. paratuberculosis
uggacgacgugcccuu

SEQ ID NO: 3035530 - RNA, 16 nt, Mycobacterium avium subsp. paratuberculosis
uggacgagcagccgca

SEQ ID NO: 3035531 - RNA, 19 nt, Mycobacterium avium subsp. paratuberculosis
uggacgaggugaacgccgc

SEQ ID NO: 3035532 - RNA, 15 nt, Mycobacterium avium subsp. paratuberculosis
uggacgaugcggggc

SEQ ID NO: 3035533 - RNA, 17 nt, Mycobacterium avium subsp. paratuberculosis
uggacgaugcggggccg

SEQ ID NO: 3035534 - RNA, 21 nt, Mycobacterium avium subsp. paratuberculosis
uggacgaugcggggccggcgg

SEQ ID NO: 3035535 - RNA, 22 nt, Mycobacterium avium subsp. paratuberculosis
uggacgaugcggggccggcggc

SEQ ID NO: 3035536 - RNA, 16 nt, Mycobacterium avium subsp. paratuberculosis
uggacgccagcaugau

SEQ ID NO: 3035537 - RNA, 21 nt, Mycobacterium avium subsp. paratuberculosis
uggacgcccagaacugggccg

SEQ ID NO: 3035538 - RNA, 18 nt, Mycobacterium avium subsp. paratuberculosis
uggacgcgauggcgcugg

SEQ ID NO: 3035539 - RNA, 19 nt, Mycobacterium avium subsp. paratuberculosis
uggacgcgauggcgcuggc

SEQ ID NO: 3035540 - RNA, 15 nt, Mycobacterium avium subsp. paratuberculosis
uggacgcgcgcggcg

SEQ ID NO: 3035541 - RNA, 20 nt, Mycobacterium avium subsp. paratuberculosis
uggacgcggccucaccgcgg

SEQ ID NO: 3035542 - RNA, 11 nt, Mycobacterium avium subsp. paratuberculosis
uggacgcgguc

SEQ ID NO: 3035543 - RNA, 17 nt, Mycobacterium avium subsp. paratuberculosis
uggacgcggucgccgcc

SEQ ID NO: 3035544 - RNA, 16 nt, Mycobacterium avium subsp. paratuberculosis
uggacggaucggugua

SEQ ID NO: 3035545 - RNA, 16 nt, Mycobacterium avium subsp. paratuberculosis
uggacggcccgacgac

SEQ ID NO: 3035546 - RNA, 21 nt, Mycobacterium avium subsp. paratuberculosis
uggacggcccgacgacgccgu

SEQ ID NO: 3035547 - RNA, 23 nt, Mycobacterium avium subsp. paratuberculosis
uggacggcccgacgacgccguca

SEQ ID NO: 3035548 - RNA, 16 nt, Mycobacterium avium subsp. paratuberculosis
uggacguccagcggcc

SEQ ID NO: 3035549 - RNA, 23 nt, Mycobacterium avium subsp. paratuberculosis
uggacgucgucgcuguccucgag

SEQ ID NO: 3035550 - RNA, 15 nt, Mycobacterium avium subsp. paratuberculosis
uggacuccaccgcca

SEQ ID NO: 3035551 - RNA, 16 nt, Mycobacterium avium subsp. paratuberculosis
uggacuccaccgccac

SEQ ID NO: 3035552 - RNA, 15 nt, Mycobacterium avium subsp. paratuberculosis
uggacuccagcacca

SEQ ID NO: 3035553 - RNA, 18 nt, Mycobacterium avium subsp. paratuberculosis
uggacuccagcaccagca

SEQ ID NO: 3035554 - RNA, 13 nt, Mycobacterium avium subsp. paratuberculosis
uggagaaguccuu

SEQ ID NO: 3035555 - RNA, 21 nt, Mycobacterium avium subsp. paratuberculosis
uggagaccucuucgacccgca

SEQ ID NO: 3035556 - RNA, 21 nt, Mycobacterium avium subsp. paratuberculosis
uggagaucaccgcguagcgcc

SEQ ID NO: 3035557 - RNA, 14 nt, Mycobacterium avium subsp. paratuberculosis
uggagauggccagc

SEQ ID NO: 3035558 - RNA, 18 nt, Mycobacterium avium subsp. paratuberculosis
uggagauggccagcacca

SEQ ID NO: 3035559 - RNA, 17 nt, Mycobacterium avium subsp. paratuberculosis
uggagcacagcacggca

SEQ ID NO: 3035560 - RNA, 11 nt, Mycobacterium avium subsp. paratuberculosis
uggagccgacc

SEQ ID NO: 3035561 - RNA, 13 nt, Mycobacterium avium subsp. paratuberculosis
uggagccgaccag

SEQ ID NO: 3035562 - RNA, 14 nt, Mycobacterium avium subsp. paratuberculosis
uggagccgaccagc

SEQ ID NO: 3035563 - RNA, 15 nt, Mycobacterium avium subsp. paratuberculosis
uggagccgaccagcg

SEQ ID NO: 3035564 - RNA, 18 nt, Mycobacterium avium subsp. paratuberculosis
uggagccgaccagcgcga

SEQ ID NO: 3035565 - RNA, 23 nt, Mycobacterium avium subsp. paratuberculosis
uggagccgaccagcgcgaucucc

SEQ ID NO: 3035566 - RNA, 12 nt, Mycobacterium avium subsp. paratuberculosis
uggagccgagca

SEQ ID NO: 3035567 - RNA, 21 nt, Mycobacterium avium subsp. paratuberculosis
uggagccgagcaccgggcugu

SEQ ID NO: 3035568 - RNA, 15 nt, Mycobacterium avium subsp. paratuberculosis
uggagcggaucccgg

SEQ ID NO: 3035569 - RNA, 15 nt, Mycobacterium avium subsp. paratuberculosis
uggagcggcccagcu

SEQ ID NO: 3035570 - RNA, 21 nt, Mycobacterium avium subsp. paratuberculosis
uggagcggcccagcucgguga

SEQ ID NO: 3035571 - RNA, 20 nt, Mycobacterium avium subsp. paratuberculosis
uggagcugaaguucaccacc

SEQ ID NO: 3035572 - RNA, 22 nt, Mycobacterium avium subsp. paratuberculosis
uggagcugaaguucaccaccgc

SEQ ID NO: 3035573 - RNA, 21 nt, Mycobacterium avium subsp. paratuberculosis
uggaggcguagugcgcccaga

SEQ ID NO: 3035574 - RNA, 16 nt, Mycobacterium avium subsp. paratuberculosis
uggaggugaucgccag

SEQ ID NO: 3035575 - RNA, 17 nt, Mycobacterium avium subsp. paratuberculosis
uggaggugccgcgcagc

SEQ ID NO: 3035576 - RNA, 15 nt, Mycobacterium avium subsp. paratuberculosis
uggaguagcuggauu

SEQ ID NO: 3035577 - RNA, 19 nt, Mycobacterium avium subsp. paratuberculosis
uggaguggucaggcccagg

SEQ ID NO: 3035578 - RNA, 17 nt, Mycobacterium avium subsp. paratuberculosis
uggaguugucggugaag

SEQ ID NO: 3035579 - RNA, 16 nt, Mycobacterium avium subsp. paratuberculosis
uggauauuucgcggcc

SEQ ID NO: 3035580 - RNA, 14 nt, Mycobacterium avium subsp. paratuberculosis
uggaucaccaucac

SEQ ID NO: 3035581 - RNA, 12 nt, Mycobacterium avium subsp. paratuberculosis
uggaucaucccg

SEQ ID NO: 3035582 - RNA, 18 nt, Mycobacterium avium subsp. paratuberculosis
uggaucccgaacugccgc

SEQ ID NO: 3035583 - RNA, 15 nt, Mycobacterium avium subsp. paratuberculosis
uggauccgaucagca

SEQ ID NO: 3035584 - RNA, 20 nt, Mycobacterium avium subsp. paratuberculosis
uggauccgaucagcagcacc

SEQ ID NO: 3035585 - RNA, 22 nt, Mycobacterium avium subsp. paratuberculosis
uggaucgcuucggccagcgcgu

SEQ ID NO: 3035586 - RNA, 15 nt, Mycobacterium avium subsp. paratuberculosis
uggaucggcccgacg

SEQ ID NO: 3035587 - RNA, 17 nt, Mycobacterium avium subsp. paratuberculosis
uggaucuugacggcgac

SEQ ID NO: 3035588 - RNA, 12 nt, Mycobacterium avium subsp. paratuberculosis
uggaugaacagc

SEQ ID NO: 3035589 - RNA, 13 nt, Mycobacterium avium subsp. paratuberculosis
uggaugcccaggg

SEQ ID NO: 3035590 - RNA, 18 nt, Mycobacterium avium subsp. paratuberculosis
uggaugucacgguccagg

SEQ ID NO: 3035591 - RNA, 23 nt, Mycobacterium avium subsp. paratuberculosis
uggauuccaccguggucggcagc

SEQ ID NO: 3035592 - RNA, 13 nt, Mycobacterium avium subsp. paratuberculosis
uggcaacgccggu

SEQ ID NO: 3035593 - RNA, 12 nt, Mycobacterium avium subsp. paratuberculosis
uggcaaggccag

SEQ ID NO: 3035594 - RNA, 13 nt, Mycobacterium avium subsp. paratuberculosis
uggcaaggccagc

SEQ ID NO: 3035595 - RNA, 18 nt, Mycobacterium avium subsp. paratuberculosis
uggcaauucgaccgucuc

SEQ ID NO: 3035596 - RNA, 20 nt, Mycobacterium avium subsp. paratuberculosis
uggcaccccgcgccgggcgu

SEQ ID NO: 3035597 - RNA, 16 nt, Mycobacterium avium subsp. paratuberculosis
uggcacccucggugcu

SEQ ID NO: 3035598 - RNA, 19 nt, Mycobacterium avium subsp. paratuberculosis
uggcaccgggugggccgac

SEQ ID NO: 3035599 - RNA, 22 nt, Mycobacterium avium subsp. paratuberculosis
uggcaccgggugggccgaccug

SEQ ID NO: 3035600 - RNA, 18 nt, Mycobacterium avium subsp. paratuberculosis
uggcacgccacucgucga

SEQ ID NO: 3035601 - RNA, 17 nt, Mycobacterium avium subsp. paratuberculosis
uggcagcauccgccgac

SEQ ID NO: 3035602 - RNA, 13 nt, Mycobacterium avium subsp. paratuberculosis
uggcagccggccg

SEQ ID NO: 3035603 - RNA, 12 nt, Mycobacterium avium subsp. paratuberculosis
uggcagcgcucc

SEQ ID NO: 3035604 - RNA, 17 nt, Mycobacterium avium subsp. paratuberculosis
uggcagcgcuccugcag

SEQ ID NO: 3035605 - RNA, 22 nt, Mycobacterium avium subsp. paratuberculosis
uggcagcgcuccugcagcgcgg

SEQ ID NO: 3035606 - RNA, 20 nt, Mycobacterium avium subsp. paratuberculosis
uggcagcggucggcggcuga

SEQ ID NO: 3035607 - RNA, 17 nt, Mycobacterium avium subsp. paratuberculosis
uggcagcucgggcagcc

SEQ ID NO: 3035608 - RNA, 20 nt, Mycobacterium avium subsp. paratuberculosis
uggcagcucgggcagcccgc

SEQ ID NO: 3035609 - RNA, 21 nt, Mycobacterium avium subsp. paratuberculosis
uggcaggcgauggugccggcc

SEQ ID NO: 3035610 - RNA, 13 nt, Mycobacterium avium subsp. paratuberculosis
uggcaggcgaugu

SEQ ID NO: 3035611 - RNA, 13 nt, Mycobacterium avium subsp. paratuberculosis
uggcagggccagc

SEQ ID NO: 3035612 - RNA, 14 nt, Mycobacterium avium subsp. paratuberculosis
uggcagggccagca

SEQ ID NO: 3035613 - RNA, 14 nt, Mycobacterium avium subsp. paratuberculosis
uggcaggucgcgcc

SEQ ID NO: 3035614 - RNA, 14 nt, Mycobacterium avium subsp. paratuberculosis
uggccaacgcguuc

SEQ ID NO: 3035615 - RNA, 15 nt, Mycobacterium avium subsp. paratuberculosis
uggccaacucgaccu

SEQ ID NO: 3035616 - RNA, 23 nt, Mycobacterium avium subsp. paratuberculosis
uggccaaguagacucagcgucga

SEQ ID NO: 3035617 - RNA, 15 nt, Mycobacterium avium subsp. paratuberculosis
uggccaccacauugg

SEQ ID NO: 3035618 - RNA, 20 nt, Mycobacterium avium subsp. paratuberculosis
uggccaccacauuggcgacc

SEQ ID NO: 3035619 - RNA, 11 nt, Mycobacterium avium subsp. paratuberculosis
uggccaccacc

SEQ ID NO: 3035620 - RNA, 14 nt, Mycobacterium avium subsp. paratuberculosis
uggccaccaccacg

SEQ ID NO: 3035621 - RNA, 23 nt, Mycobacterium avium subsp. paratuberculosis
uggccaccaccacggagcgcccg

SEQ ID NO: 3035622 - RNA, 13 nt, Mycobacterium avium subsp. paratuberculosis
uggccaccacggg

SEQ ID NO: 3035623 - RNA, 15 nt, Mycobacterium avium subsp. paratuberculosis
uggccaccacggguc

SEQ ID NO: 3035624 - RNA, 18 nt, Mycobacterium avium subsp. paratuberculosis
uggccaccacgggucggu

SEQ ID NO: 3035625 - RNA, 15 nt, Mycobacterium avium subsp. paratuberculosis
uggccaccagcagca

SEQ ID NO: 3035626 - RNA, 17 nt, Mycobacterium avium subsp. paratuberculosis
uggccaccagcagcagg

SEQ ID NO: 3035627 - RNA, 18 nt, Mycobacterium avium subsp. paratuberculosis
uggccaccagcagcaggu

SEQ ID NO: 3035628 - RNA, 17 nt, Mycobacterium avium subsp. paratuberculosis
uggccacccucgccgcc

SEQ ID NO: 3035629 - RNA, 20 nt, Mycobacterium avium subsp. paratuberculosis
uggccaccgaagccgacguc

SEQ ID NO: 3035630 - RNA, 22 nt, Mycobacterium avium subsp. paratuberculosis
uggccaccgaagccgacgucga

SEQ ID NO: 3035631 - RNA, 23 nt, Mycobacterium avium subsp. paratuberculosis
uggccaccgaugcccgacaccgc

SEQ ID NO: 3035632 - RNA, 21 nt, Mycobacterium avium subsp. paratuberculosis
uggccaccgcaucgccgaggg

SEQ ID NO: 3035633 - RNA, 24 nt, Mycobacterium avium subsp. paratuberculosis
uggccaccgccugcgcgaucgccg

SEQ ID NO: 3035634 - RNA, 13 nt, Mycobacterium avium subsp. paratuberculosis
uggccaccggggu

SEQ ID NO: 3035635 - RNA, 13 nt, Mycobacterium avium subsp. paratuberculosis
uggccaccucgac

SEQ ID NO: 3035636 - RNA, 14 nt, Mycobacterium avium subsp. paratuberculosis
uggccacgauccgg

SEQ ID NO: 3035637 - RNA, 17 nt, Mycobacterium avium subsp. paratuberculosis
uggccacgauccggggc

SEQ ID NO: 3035638 - RNA, 21 nt, Mycobacterium avium subsp. paratuberculosis
uggccacggcguugaccaacg

SEQ ID NO: 3035639 - RNA, 20 nt, Mycobacterium avium subsp. paratuberculosis
uggccagaugcccgccccgc

SEQ ID NO: 3035640 - RNA, 12 nt, Mycobacterium avium subsp. paratuberculosis
uggccagcacca

SEQ ID NO: 3035641 - RNA, 16 nt, Mycobacterium avium subsp. paratuberculosis
uggccagcaccaccgc

SEQ ID NO: 3035642 - RNA, 18 nt, Mycobacterium avium subsp. paratuberculosis
uggccagcaccagcgcgc

SEQ ID NO: 3035643 - RNA, 16 nt, Mycobacterium avium subsp. paratuberculosis
uggccagcaccgcggc

SEQ ID NO: 3035644 - RNA, 18 nt, Mycobacterium avium subsp. paratuberculosis
uggccagcaccgcggccg

SEQ ID NO: 3035645 - RNA, 19 nt, Mycobacterium avium subsp. paratuberculosis
uggccagcaccgcggccgu

SEQ ID NO: 3035646 - RNA, 20 nt, Mycobacterium avium subsp. paratuberculosis
uggccagcaccgcggccguc

SEQ ID NO: 3035647 - RNA, 19 nt, Mycobacterium avium subsp. paratuberculosis
uggccagcaccgcgucgau

SEQ ID NO: 3035648 - RNA, 17 nt, Mycobacterium avium subsp. paratuberculosis
uggccagcaccgucagc

SEQ ID NO: 3035649 - RNA, 15 nt, Mycobacterium avium subsp. paratuberculosis
uggccagcacgcugc

SEQ ID NO: 3035650 - RNA, 15 nt, Mycobacterium avium subsp. paratuberculosis
uggccagcagcgugg

SEQ ID NO: 3035651 - RNA, 15 nt, Mycobacterium avium subsp. paratuberculosis
uggccagcagguaga

SEQ ID NO: 3035652 - RNA, 19 nt, Mycobacterium avium subsp. paratuberculosis
uggccagcagugccaccac

SEQ ID NO: 3035653 - RNA, 18 nt, Mycobacterium avium subsp. paratuberculosis
uggccagccgggcgaccg

SEQ ID NO: 3035654 - RNA, 18 nt, Mycobacterium avium subsp. paratuberculosis
uggccagcgccagcgcca

SEQ ID NO: 3035655 - RNA, 15 nt, Mycobacterium avium subsp. paratuberculosis
uggccagcgccucca

SEQ ID NO: 3035656 - RNA, 12 nt, Mycobacterium avium subsp. paratuberculosis
uggccagcgcgg

SEQ ID NO: 3035657 - RNA, 21 nt, Mycobacterium avium subsp. paratuberculosis
uggccagcucggucagccggg

SEQ ID NO: 3035658 - RNA, 17 nt, Mycobacterium avium subsp. paratuberculosis
uggccagcucgucgcgg

SEQ ID NO: 3035659 - RNA, 21 nt, Mycobacterium bovis subsp bovis AF2122/97
aaaaacccggugaccagcaac

SEQ ID NO: 3035660 - RNA, 18 nt, Mycobacterium bovis subsp bovis AF2122/97
aaaaacgaacccaggcac

SEQ ID NO: 3035661 - RNA, 21 nt, Mycobacterium bovis subsp bovis AF2122/97
aaaaaguuaccgguauagcca

SEQ ID NO: 3035662 - RNA, 15 nt, Mycobacterium bovis subsp bovis AF2122/97
aaaacauaucggugc

SEQ ID NO: 3035663 - RNA, 14 nt, Mycobacterium bovis subsp bovis AF2122/97
aaaaccacccccac

SEQ ID NO: 3035664 - RNA, 15 nt, Mycobacterium bovis subsp bovis AF2122/97
aaaaccacccccacc

SEQ ID NO: 3035665 - RNA, 14 nt, Mycobacterium bovis subsp bovis AF2122/97
aaaacccaacaccc

SEQ ID NO: 3035666 - RNA, 21 nt, Mycobacterium bovis subsp bovis AF2122/97
aaaacccggugaccagcaacc

SEQ ID NO: 3035667 - RNA, 12 nt, Mycobacterium bovis subsp bovis AF2122/97
aaaaccgcaccg

SEQ ID NO: 3035668 - RNA, 22 nt, Mycobacterium bovis subsp bovis AF2122/97
aaaaccucgacgcccgcccugg

SEQ ID NO: 3035669 - RNA, 16 nt, Mycobacterium bovis subsp bovis AF2122/97
aaaacgaacccaggca

SEQ ID NO: 3035670 - RNA, 13 nt, Mycobacterium bovis subsp bovis AF2122/97
aaaacgagcuucc

SEQ ID NO: 3035671 - RNA, 21 nt, Mycobacterium bovis subsp bovis AF2122/97
aaaacgccaugccgggaacca

SEQ ID NO: 3035672 - RNA, 21 nt, Mycobacterium bovis subsp bovis AF2122/97
aaaacgggguggcacgcauga

SEQ ID NO: 3035673 - RNA, 23 nt, Mycobacterium bovis subsp bovis AF2122/97
aaaagaucuucgccgagaacgau

SEQ ID NO: 3035674 - RNA, 12 nt, Mycobacterium bovis subsp bovis AF2122/97
aaaagccagggc

SEQ ID NO: 3035675 - RNA, 22 nt, Mycobacterium bovis subsp bovis AF2122/97
aaaagcccccauuucggcacga

SEQ ID NO: 3035676 - RNA, 22 nt, Mycobacterium bovis subsp bovis AF2122/97
aaaagcccccauuucgggcucu

SEQ ID NO: 3035677 - RNA, 23 nt, Mycobacterium bovis subsp bovis AF2122/97
aaaagcccccgcacgcucggcgu

SEQ ID NO: 3035678 - RNA, 17 nt, Mycobacterium bovis subsp bovis AF2122/97
aaaagcccgacacgaaa

SEQ ID NO: 3035679 - RNA, 14 nt, Mycobacterium bovis subsp bovis AF2122/97
aaaagcucggcccu

SEQ ID NO: 3035680 - RNA, 14 nt, Mycobacterium bovis subsp bovis AF2122/97
aaaaggaagaccuc

SEQ ID NO: 3035681 - RNA, 23 nt, Mycobacterium bovis subsp bovis AF2122/97
aaaaggaucccgccgcugccgcc

SEQ ID NO: 3035682 - RNA, 18 nt, Mycobacterium bovis subsp bovis AF2122/97
aaaagggcggcagcgagg

SEQ ID NO: 3035683 - RNA, 16 nt, Mycobacterium bovis subsp bovis AF2122/97
aaaagguaccgcgugc

SEQ ID NO: 3035684 - RNA, 19 nt, Mycobacterium bovis subsp bovis AF2122/97
aaaaucaucugcacauuca

SEQ ID NO: 3035685 - RNA, 15 nt, Mycobacterium bovis subsp bovis AF2122/97
aaaaucgcccaauuc

SEQ ID NO: 3035686 - RNA, 20 nt, Mycobacterium bovis subsp bovis AF2122/97
aaaaugacccacacaccgag

SEQ ID NO: 3035687 - RNA, 20 nt, Mycobacterium bovis subsp bovis AF2122/97
aaaaugccgcucucggcgau

SEQ ID NO: 3035688 - RNA, 22 nt, Mycobacterium bovis subsp bovis AF2122/97
aaacaaacccaacaccagcagc

SEQ ID NO: 3035689 - RNA, 22 nt, Mycobacterium bovis subsp bovis AF2122/97
aaacagcauggcgaagaacaac

SEQ ID NO: 3035690 - RNA, 14 nt, Mycobacterium bovis subsp bovis AF2122/97
aaacagcgcgccgg

SEQ ID NO: 3035691 - RNA, 17 nt, Mycobacterium bovis subsp bovis AF2122/97
aaacagcuugcugcgca

SEQ ID NO: 3035692 - RNA, 13 nt, Mycobacterium bovis subsp bovis AF2122/97
aaacagguaagca

SEQ ID NO: 3035693 - RNA, 12 nt, Mycobacterium bovis subsp bovis AF2122/97
aaacaugugggu

SEQ ID NO: 3035694 - RNA, 20 nt, Mycobacterium bovis subsp bovis AF2122/97
aaacaugugggugaacaccg

SEQ ID NO: 3035695 - RNA, 14 nt, Mycobacterium bovis subsp bovis AF2122/97
aaaccacuggaugg

SEQ ID NO: 3035696 - RNA, 21 nt, Mycobacterium bovis subsp bovis AF2122/97
aaaccagauugccgagcccag

SEQ ID NO: 3035697 - RNA, 13 nt, Mycobacterium bovis subsp bovis AF2122/97
aaaccagccacca

SEQ ID NO: 3035698 - RNA, 13 nt, Mycobacterium bovis subsp bovis AF2122/97
aaaccagcgucca

SEQ ID NO: 3035699 - RNA, 17 nt, Mycobacterium bovis subsp bovis AF2122/97
aaaccagguggccaggc

SEQ ID NO: 3035700 - RNA, 14 nt, Mycobacterium bovis subsp bovis AF2122/97
aaacccaacaccag

SEQ ID NO: 3035701 - RNA, 23 nt, Mycobacterium bovis subsp bovis AF2122/97
aaacccggcccagguugccaacc

SEQ ID NO: 3035702 - RNA, 22 nt, Mycobacterium bovis subsp bovis AF2122/97
aaacccggugaccagcaaccac

SEQ ID NO: 3035703 - RNA, 15 nt, Mycobacterium bovis subsp bovis AF2122/97
aaacccugcacccga

SEQ ID NO: 3035704 - RNA, 13 nt, Mycobacterium bovis subsp bovis AF2122/97
aaacccugcugcg

SEQ ID NO: 3035705 - RNA, 16 nt, Mycobacterium bovis subsp bovis AF2122/97
aaaccgaggauguggu

SEQ ID NO: 3035706 - RNA, 13 nt, Mycobacterium bovis subsp bovis AF2122/97
aacaacgcgcaac

SEQ ID NO: 3035707 - RNA, 20 nt, Mycobacterium bovis subsp bovis AF2122/97
aacaacgcuaacugcuuuuc

SEQ ID NO: 3035708 - RNA, 19 nt, Mycobacterium bovis subsp bovis AF2122/97
aacaacguucggcacaacc

SEQ ID NO: 3035709 - RNA, 13 nt, Mycobacterium bovis subsp bovis AF2122/97
aacaacuccagca

SEQ ID NO: 3035710 - RNA, 14 nt, Mycobacterium bovis subsp bovis AF2122/97
aacaacuccagcag

SEQ ID NO: 3035711 - RNA, 15 nt, Mycobacterium bovis subsp bovis AF2122/97
aacaacuccagcagg

SEQ ID NO: 3035712 - RNA, 20 nt, Mycobacterium bovis subsp bovis AF2122/97
aacaacuuggccaucccggc

SEQ ID NO: 3035713 - RNA, 22 nt, Mycobacterium bovis subsp bovis AF2122/97
aacaacuuggccaucccggccu

SEQ ID NO: 3035714 - RNA, 20 nt, Mycobacterium bovis subsp bovis AF2122/97
aacaagaucagacccagcgc

SEQ ID NO: 3035715 - RNA, 16 nt, Mycobacterium bovis subsp bovis AF2122/97
aacacagccgucgcac

SEQ ID NO: 3035716 - RNA, 21 nt, Mycobacterium bovis subsp bovis AF2122/97
aacacauccaguaaccguccg

SEQ ID NO: 3035717 - RNA, 20 nt, Mycobacterium bovis subsp bovis AF2122/97
aacacaugcaagucgaacgg

SEQ ID NO: 3035718 - RNA, 20 nt, Mycobacterium bovis subsp bovis AF2122/97
aacacauugccggccaccag

SEQ ID NO: 3035719 - RNA, 11 nt, Mycobacterium bovis subsp bovis AF2122/97
aacaccaacca

SEQ ID NO: 3035720 - RNA, 18 nt, Mycobacterium bovis subsp bovis AF2122/97
aacaccaacgacagcgac

SEQ ID NO: 3035721 - RNA, 22 nt, Mycobacterium bovis subsp bovis AF2122/97
aacaccacaccgagcaccugac

SEQ ID NO: 3035722 - RNA, 19 nt, Mycobacterium bovis subsp bovis AF2122/97
aacaccagauggcucucgg

SEQ ID NO: 3035723 - RNA, 17 nt, Mycobacterium bovis subsp bovis AF2122/97
aacaccccgggcgccga

SEQ ID NO: 3035724 - RNA, 18 nt, Mycobacterium bovis subsp bovis AF2122/97
aacacccgaagccggcgc

SEQ ID NO: 3035725 - RNA, 13 nt, Mycobacterium bovis subsp bovis AF2122/97
aacacccgcccgg

SEQ ID NO: 3035726 - RNA, 13 nt, Mycobacterium bovis subsp bovis AF2122/97
aacaccgacgaca

SEQ ID NO: 3035727 - RNA, 13 nt, Mycobacterium bovis subsp bovis AF2122/97
aacaccgacgacg

SEQ ID NO: 3035728 - RNA, 11 nt, Mycobacterium bovis subsp bovis AF2122/97
aacaccgccag

SEQ ID NO: 3035729 - RNA, 13 nt, Mycobacterium bovis subsp bovis AF2122/97
aacaccgccagca

SEQ ID NO: 3035730 - RNA, 22 nt, Mycobacterium bovis subsp bovis AF2122/97
aacaccgcccggcccggcucgg

SEQ ID NO: 3035731 - RNA, 13 nt, Mycobacterium bovis subsp bovis AF2122/97
aacaccgcggcgc

SEQ ID NO: 3035732 - RNA, 12 nt, Mycobacterium bovis subsp bovis AF2122/97
aacaccgcggug

SEQ ID NO: 3035733 - RNA, 22 nt, Mycobacterium bovis subsp bovis AF2122/97
aacaccggcuccagcaugggcg

SEQ ID NO: 3035734 - RNA, 11 nt, Mycobacterium bovis subsp bovis AF2122/97
aacaccggcug

SEQ ID NO: 3035735 - RNA, 16 nt, Mycobacterium bovis subsp bovis AF2122/97
aacaccggugucggcc

SEQ ID NO: 3035736 - RNA, 14 nt, Mycobacterium bovis subsp bovis AF2122/97
aacaccgucagcgu

SEQ ID NO: 3035737 - RNA, 16 nt, Mycobacterium bovis subsp bovis AF2122/97
aacaccguccaauugg

SEQ ID NO: 3035738 - RNA, 18 nt, Mycobacterium bovis subsp bovis AF2122/97
aacaccgucggcagcagc

SEQ ID NO: 3035739 - RNA, 19 nt, Mycobacterium bovis subsp bovis AF2122/97
aacaccgucggcagcagcg

SEQ ID NO: 3035740 - RNA, 19 nt, Mycobacterium bovis subsp bovis AF2122/97
aacaccuaugggaccggca

SEQ ID NO: 3035741 - RNA, 20 nt, Mycobacterium bovis subsp bovis AF2122/97
aacaccucaccgcggaucga

SEQ ID NO: 3035742 - RNA, 14 nt, Mycobacterium bovis subsp bovis AF2122/97
aacacgacagccag

SEQ ID NO: 3035743 - RNA, 15 nt, Mycobacterium bovis subsp bovis AF2122/97
aacacgaugcgcggu

SEQ ID NO: 3035744 - RNA, 12 nt, Mycobacterium bovis subsp bovis AF2122/97
aacacgccggcc

SEQ ID NO: 3035745 - RNA, 17 nt, Mycobacterium bovis subsp bovis AF2122/97
aacacgccgucgaccgg

SEQ ID NO: 3035746 - RNA, 21 nt, Mycobacterium bovis subsp bovis AF2122/97
aacacgccgucgaccggcggg

SEQ ID NO: 3035747 - RNA, 12 nt, Mycobacterium bovis subsp bovis AF2122/97
aacacgggcagc

SEQ ID NO: 3035748 - RNA, 14 nt, Mycobacterium bovis subsp bovis AF2122/97
aacacgucggccag

SEQ ID NO: 3035749 - RNA, 23 nt, Mycobacterium bovis subsp bovis AF2122/97
aacacguggauguguaggugggg

SEQ ID NO: 3035750 - RNA, 23 nt, Mycobacterium bovis subsp bovis AF2122/97
aacacuuugcgcacuaccgccuu

SEQ ID NO: 3035751 - RNA, 14 nt, Mycobacterium bovis subsp bovis AF2122/97
aacagacggggucg

SEQ ID NO: 3035752 - RNA, 21 nt, Mycobacterium bovis subsp bovis AF2122/97
aacagauucggugccagcagg

SEQ ID NO: 3035753 - RNA, 21 nt, Mycobacterium bovis subsp bovis AF2122/97
aacagcaauuuuccgucgaug

SEQ ID NO: 3035754 - RNA, 20 nt, Mycobacterium bovis subsp bovis AF2122/97
aacagcaccaguguggcgau

SEQ ID NO: 3035755 - RNA, 14 nt, Mycobacterium bovis subsp bovis AF2122/97
aacagcaccgccgg

SEQ ID NO: 3035756 - RNA, 18 nt, Mycobacterium bovis subsp bovis AF2122/97
aacagccgagccagcagc

SEQ ID NO: 3035757 - RNA, 12 nt, Mycobacterium bovis subsp bovis AF2122/97
aacagccgcagc

SEQ ID NO: 3035758 - RNA, 15 nt, Mycobacterium bovis subsp bovis AF2122/97
aacagcgaaccgccg

SEQ ID NO: 3035759 - RNA, 20 nt, Mycobacterium bovis subsp bovis AF2122/97
aacagcgaaccggcugggcg

SEQ ID NO: 3035760 - RNA, 18 nt, Mycobacterium bovis subsp bovis AF2122/97
aacagcgacgccaugguc

SEQ ID NO: 3035761 - RNA, 13 nt, Mycobacterium bovis subsp bovis AF2122/97
aacagcgauccga

SEQ ID NO: 3035762 - RNA, 22 nt, Mycobacterium bovis subsp bovis AF2122/97
aacagcgccaagacgucggcgu

SEQ ID NO: 3035763 - RNA, 13 nt, Mycobacterium bovis subsp bovis AF2122/97
aacagcgcgccgg

SEQ ID NO: 3035764 - RNA, 16 nt, Mycobacterium bovis subsp bovis AF2122/97
aacagcgcgccggcgu

SEQ ID NO: 3035765 - RNA, 13 nt, Mycobacterium bovis subsp bovis AF2122/97
aacagcgcgucgg

SEQ ID NO: 3035766 - RNA, 21 nt, Mycobacterium bovis subsp bovis AF2122/97
aacagcgggggcagcgcgaac

SEQ ID NO: 3035767 - RNA, 18 nt, Mycobacterium bovis subsp bovis AF2122/97
aacagcggguccuucugc

SEQ ID NO: 3035768 - RNA, 23 nt, Mycobacterium bovis subsp bovis AF2122/97
aacagcgguggguaggcucccac

SEQ ID NO: 3035769 - RNA, 18 nt, Mycobacterium bovis subsp bovis AF2122/97
aacagcgucaaccggucc

SEQ ID NO: 3035770 - RNA, 14 nt, Mycobacterium bovis subsp bovis AF2122/97
aacagcucggccag

SEQ ID NO: 3035771 - RNA, 16 nt, Mycobacterium bovis subsp bovis AF2122/97
aacagcugcccgccag

SEQ ID NO: 3035772 - RNA, 14 nt, Mycobacterium bovis subsp bovis AF2122/97
aacaggaucagcga

SEQ ID NO: 3035773 - RNA, 11 nt, Mycobacterium bovis subsp bovis AF2122/97
aacaggauggu

SEQ ID NO: 3035774 - RNA, 15 nt, Mycobacterium bovis subsp bovis AF2122/97
aacaggauggugcgg

SEQ ID NO: 3035775 - RNA, 19 nt, Mycobacterium bovis subsp bovis AF2122/97
aacaggccgccaccgucac

SEQ ID NO: 3035776 - RNA, 14 nt, Mycobacterium bovis subsp bovis AF2122/97
aacaggccggccgc

SEQ ID NO: 3035777 - RNA, 16 nt, Mycobacterium bovis subsp bovis AF2122/97
aacaggccguggcgga

SEQ ID NO: 3035778 - RNA, 18 nt, Mycobacterium bovis subsp bovis AF2122/97
aacagguaagcagccagc

SEQ ID NO: 3035779 - RNA, 18 nt, Mycobacterium bovis subsp bovis AF2122/97
aacagguccaccggccag

SEQ ID NO: 3035780 - RNA, 22 nt, Mycobacterium bovis subsp bovis AF2122/97
aacaggucuacccggucgccgg

SEQ ID NO: 3035781 - RNA, 20 nt, Mycobacterium bovis subsp bovis AF2122/97
aacagucgcagccaggcacg

SEQ ID NO: 3035782 - RNA, 20 nt, Mycobacterium bovis subsp bovis AF2122/97
aacagugguuagucggccug

SEQ ID NO: 3035783 - RNA, 19 nt, Mycobacterium bovis subsp bovis AF2122/97
aacaguucacgaccccgga

SEQ ID NO: 3035784 - RNA, 17 nt, Mycobacterium bovis subsp bovis AF2122/97
aacaucaccucgaugcc

SEQ ID NO: 3035785 - RNA, 15 nt, Mycobacterium bovis subsp bovis AF2122/97
aacaucacugccuug

SEQ ID NO: 3035786 - RNA, 19 nt, Mycobacterium bovis subsp bovis AF2122/97
aacauccccgagcugucgg

SEQ ID NO: 3035787 - RNA, 16 nt, Mycobacterium bovis subsp bovis AF2122/97
aacauccugggcaagu

SEQ ID NO: 3035788 - RNA, 19 nt, Mycobacterium bovis subsp bovis AF2122/97
aacaucggacagggugcgc

SEQ ID NO: 3035789 - RNA, 20 nt, Mycobacterium bovis subsp bovis AF2122/97
aacaucggacagggugcgcu

SEQ ID NO: 3035790 - RNA, 18 nt, Mycobacterium bovis subsp bovis AF2122/97
aacaucgguggcgccgaa

SEQ ID NO: 3035791 - RNA, 14 nt, Mycobacterium bovis subsp bovis AF2122/97
aacaucuccgcguc

SEQ ID NO: 3035792 - RNA, 19 nt, Mycobacterium bovis subsp bovis AF2122/97
aacaucucggcgcagccgg

SEQ ID NO: 3035793 - RNA, 12 nt, Mycobacterium bovis subsp bovis AF2122/97
aacccugcaccc

SEQ ID NO: 3035794 - RNA, 16 nt, Mycobacterium bovis subsp bovis AF2122/97
aaccgaacccacccau

SEQ ID NO: 3035795 - RNA, 23 nt, Mycobacterium bovis subsp bovis AF2122/97
aaccgaagccucggcaugcagcc

SEQ ID NO: 3035796 - RNA, 18 nt, Mycobacterium bovis subsp bovis AF2122/97
aaccgacgcguccggugc

SEQ ID NO: 3035797 - RNA, 16 nt, Mycobacterium bovis subsp bovis AF2122/97
aaccgacggccagcaa

SEQ ID NO: 3035798 - RNA, 21 nt, Mycobacterium bovis subsp bovis AF2122/97
aaccgagaugcggaccacacc

SEQ ID NO: 3035799 - RNA, 18 nt, Mycobacterium bovis subsp bovis AF2122/97
aaccgaggaugugguugg

SEQ ID NO: 3035800 - RNA, 16 nt, Mycobacterium bovis subsp bovis AF2122/97
aaccgauugagcccca

SEQ ID NO: 3035801 - RNA, 18 nt, Mycobacterium bovis subsp bovis AF2122/97
aaccgcacccugacagcg

SEQ ID NO: 3035802 - RNA, 17 nt, Mycobacterium bovis subsp bovis AF2122/97
aaccgcaccgucccagu

SEQ ID NO: 3035803 - RNA, 12 nt, Mycobacterium bovis subsp bovis AF2122/97
aaccgcagucgc

SEQ ID NO: 3035804 - RNA, 14 nt, Mycobacterium bovis subsp bovis AF2122/97
aaccgcagucgcgg

SEQ ID NO: 3035805 - RNA, 16 nt, Mycobacterium bovis subsp bovis AF2122/97
aaccgcagucgcggca

SEQ ID NO: 3035806 - RNA, 18 nt, Mycobacterium bovis subsp bovis AF2122/97
aaccgcagucgcggcaga

SEQ ID NO: 3035807 - RNA, 15 nt, Mycobacterium bovis subsp bovis AF2122/97
aaccgcaguucuuga

SEQ ID NO: 3035808 - RNA, 23 nt, Mycobacterium bovis subsp bovis AF2122/97
aaccgccaucgucgaagaccuca

SEQ ID NO: 3035809 - RNA, 19 nt, Mycobacterium bovis subsp bovis AF2122/97
aaccgccccgugggccucg

SEQ ID NO: 3035810 - RNA, 17 nt, Mycobacterium bovis subsp bovis AF2122/97
aaccgccgccgccgcgu

SEQ ID NO: 3035811 - RNA, 21 nt, Mycobacterium bovis subsp bovis AF2122/97
aaccgccgcugccgcgcggcg

SEQ ID NO: 3035812 - RNA, 22 nt, Mycobacterium bovis subsp bovis AF2122/97
aaccgccgcugccgcgcggcga

SEQ ID NO: 3035813 - RNA, 15 nt, Mycobacterium bovis subsp bovis AF2122/97
aaccgcgaacccgau

SEQ ID NO: 3035814 - RNA, 12 nt, Mycobacterium bovis subsp bovis AF2122/97
aaccgcgcggcg

SEQ ID NO: 3035815 - RNA, 20 nt, Mycobacterium bovis subsp bovis AF2122/97
aaccgcggaucgaccgccag

SEQ ID NO: 3035816 - RNA, 23 nt, Mycobacterium bovis subsp bovis AF2122/97
aaccgcggaucgaccgccagcgc

SEQ ID NO: 3035817 - RNA, 13 nt, Mycobacterium bovis subsp bovis AF2122/97
aaccgcggccccg

SEQ ID NO: 3035818 - RNA, 22 nt, Mycobacterium bovis subsp bovis AF2122/97
aaccgcggccccgacugccgcg

SEQ ID NO: 3035819 - RNA, 21 nt, Mycobacterium bovis subsp bovis AF2122/97
aaccgcucggcgaugauguug

SEQ ID NO: 3035820 - RNA, 18 nt, Mycobacterium bovis subsp bovis AF2122/97
aaccgcugauagcggucg

SEQ ID NO: 3035821 - RNA, 22 nt, Mycobacterium bovis subsp bovis AF2122/97
aaccgcugcgcgaaucgcgucg

SEQ ID NO: 3035822 - RNA, 23 nt, Mycobacterium bovis subsp bovis AF2122/97
aaccgcugcgcgaaucgcgucga

SEQ ID NO: 3035823 - RNA, 19 nt, Mycobacterium bovis subsp bovis AF2122/97
aaccgcugcuccucgcggu

SEQ ID NO: 3035824 - RNA, 18 nt, Mycobacterium bovis subsp bovis AF2122/97
aaccgcugggggcggucg

SEQ ID NO: 3035825 - RNA, 19 nt, Mycobacterium bovis subsp bovis AF2122/97
aaccggaccuggguggcgu

SEQ ID NO: 3035826 - RNA, 12 nt, Mycobacterium bovis subsp bovis AF2122/97
aaccggacgccc

SEQ ID NO: 3035827 - RNA, 16 nt, Mycobacterium bovis subsp bovis AF2122/97
aaccggacgcccucac

SEQ ID NO: 3035828 - RNA, 13 nt, Mycobacterium bovis subsp bovis AF2122/97
aaccggaugcggu

SEQ ID NO: 3035829 - RNA, 17 nt, Mycobacterium bovis subsp bovis AF2122/97
aaccggccagccgacgc

SEQ ID NO: 3035830 - RNA, 22 nt, Mycobacterium bovis subsp bovis AF2122/97
aaccggccagccgacgcggcgg

SEQ ID NO: 3035831 - RNA, 20 nt, Mycobacterium bovis subsp bovis AF2122/97
aaccggccaucgaccguccg

SEQ ID NO: 3035832 - RNA, 18 nt, Mycobacterium bovis subsp bovis AF2122/97
aaccggccgcgacgacac

SEQ ID NO: 3035833 - RNA, 21 nt, Mycobacterium bovis subsp bovis AF2122/97
aaccggcgcaguagccgacca

SEQ ID NO: 3035834 - RNA, 15 nt, Mycobacterium bovis subsp bovis AF2122/97
aaccggcgcgccccg

SEQ ID NO: 3035835 - RNA, 14 nt, Mycobacterium bovis subsp bovis AF2122/97
aaccggcggcgacg

SEQ ID NO: 3035836 - RNA, 21 nt, Mycobacterium bovis subsp bovis AF2122/97
aaccggcggcgacggcggcac

SEQ ID NO: 3035837 - RNA, 20 nt, Mycobacterium bovis subsp bovis AF2122/97
aaccgggacaaucucggccg

SEQ ID NO: 3035838 - RNA, 15 nt, Mycobacterium bovis subsp bovis AF2122/97
aaccgggcaaaucaa

SEQ ID NO: 3035839 - RNA, 18 nt, Mycobacterium bovis subsp bovis AF2122/97
aaccgggcaaaucaagca

SEQ ID NO: 3035840 - RNA, 21 nt, Mycobacterium bovis subsp bovis AF2122/97
aaccggguguggucgguggcg

SEQ ID NO: 3035841 - RNA, 23 nt, Mycobacterium bovis subsp bovis AF2122/97
aaccggguguggucgguggcggg

SEQ ID NO: 3035842 - RNA, 22 nt, Mycobacterium bovis subsp bovis AF2122/97
aaccggucaaacgcgcgcgcca

SEQ ID NO: 3035843 - RNA, 21 nt, Mycobacterium bovis subsp bovis AF2122/97
aaccgguccugggauccggcg

SEQ ID NO: 3035844 - RNA, 22 nt, Mycobacterium bovis subsp bovis AF2122/97
aaccggucgauccccacaauca

SEQ ID NO: 3035845 - RNA, 15 nt, Mycobacterium bovis subsp bovis AF2122/97
aaccggucgcagugc

SEQ ID NO: 3035846 - RNA, 23 nt, Mycobacterium bovis subsp bovis AF2122/97
aaccggugcgguuucaccgacga

SEQ ID NO: 3035847 - RNA, 21 nt, Mycobacterium bovis subsp bovis AF2122/97
aaccgguguagcagcgccagc

SEQ ID NO: 3035848 - RNA, 16 nt, Mycobacterium bovis subsp bovis AF2122/97
aaccguagcccugcuc

SEQ ID NO: 3035849 - RNA, 12 nt, Mycobacterium bovis subsp bovis AF2122/97
aaccguagcgcc

SEQ ID NO: 3035850 - RNA, 17 nt, Mycobacterium bovis subsp bovis AF2122/97
aaccgucagcgcgccgu

SEQ ID NO: 3035851 - RNA, 17 nt, Mycobacterium bovis subsp bovis AF2122/97
aaccgucccaaugcaac

SEQ ID NO: 3035852 - RNA, 13 nt, Mycobacterium bovis subsp bovis AF2122/97
aaccguccgcgga

SEQ ID NO: 3035853 - RNA, 20 nt, Mycobacterium bovis subsp bovis AF2122/97
aaccguccggggccgcggcc

SEQ ID NO: 3035854 - RNA, 15 nt, Mycobacterium bovis subsp bovis AF2122/97
aaccgugagcaccag

SEQ ID NO: 3035855 - RNA, 19 nt, Mycobacterium bovis subsp bovis AF2122/97
aaccgugagcaccagcagc

SEQ ID NO: 3035856 - RNA, 21 nt, Mycobacterium bovis subsp bovis AF2122/97
aaccgugagcaccagcagcac

SEQ ID NO: 3035857 - RNA, 15 nt, Mycobacterium bovis subsp bovis AF2122/97
aaccgugcugggcau

SEQ ID NO: 3035858 - RNA, 23 nt, Mycobacterium bovis subsp bovis AF2122/97
aaccguggccgcgaucccggccg

SEQ ID NO: 3035859 - RNA, 19 nt, Mycobacterium bovis subsp bovis AF2122/97
aaccguugcgcaagcuggu

SEQ ID NO: 3035860 - RNA, 24 nt, Mycobacterium bovis subsp bovis AF2122/97
aaccguuucgggaagucgggccgg

SEQ ID NO: 3035861 - RNA, 22 nt, Mycobacterium bovis subsp bovis AF2122/97
aaccucaccugacacgcccgcg

SEQ ID NO: 3035862 - RNA, 14 nt, Mycobacterium bovis subsp bovis AF2122/97
aaccucagcgcggu

SEQ ID NO: 3035863 - RNA, 20 nt, Mycobacterium bovis subsp bovis AF2122/97
aaccucaucgcggucgccac

SEQ ID NO: 3035864 - RNA, 16 nt, Mycobacterium bovis subsp bovis AF2122/97
aaccucgacgcccgcc

SEQ ID NO: 3035865 - RNA, 14 nt, Mycobacterium bovis subsp bovis AF2122/97
aaccucggacugca

SEQ ID NO: 3035866 - RNA, 19 nt, Mycobacterium bovis subsp bovis AF2122/97
aaccucggaucgccaggcc

SEQ ID NO: 3035867 - RNA, 22 nt, Mycobacterium bovis subsp bovis AF2122/97
aaccucgguugguccucggcgg

SEQ ID NO: 3035868 - RNA, 14 nt, Mycobacterium bovis subsp bovis AF2122/97
aaccucuggcggcg

SEQ ID NO: 3035869 - RNA, 17 nt, Mycobacterium bovis subsp bovis AF2122/97
aaccugaaccggccgcg

SEQ ID NO: 3035870 - RNA, 20 nt, Mycobacterium bovis subsp bovis AF2122/97
aaccugccgggccacggcug

SEQ ID NO: 3035871 - RNA, 16 nt, Mycobacterium bovis subsp bovis AF2122/97
aaccugcgaccaggcg

SEQ ID NO: 3035872 - RNA, 13 nt, Mycobacterium bovis subsp bovis AF2122/97
aaccugcgcggcg

SEQ ID NO: 3035873 - RNA, 14 nt, Mycobacterium bovis subsp bovis AF2122/97
aaccugcgcggcga

SEQ ID NO: 3035874 - RNA, 15 nt, Mycobacterium bovis subsp bovis AF2122/97
aaccugcucggccgu

SEQ ID NO: 3035875 - RNA, 19 nt, Mycobacterium bovis subsp bovis AF2122/97
aaccugcucggcgcgccgg

SEQ ID NO: 3035876 - RNA, 23 nt, Mycobacterium bovis subsp bovis AF2122/97
aaccugcucggcgcgccggucgc

SEQ ID NO: 3035877 - RNA, 22 nt, Mycobacterium bovis subsp bovis AF2122/97
aaccugcugcagaaaggccaac

SEQ ID NO: 3035878 - RNA, 12 nt, Mycobacterium bovis subsp bovis AF2122/97
aaccuucgaccu

SEQ ID NO: 3035879 - RNA, 14 nt, Mycobacterium bovis subsp bovis AF2122/97
aacgcggccaccac

SEQ ID NO: 3035880 - RNA, 22 nt, Mycobacterium bovis subsp bovis AF2122/97
aacgcggccuugcgcacaggcg

SEQ ID NO: 3035881 - RNA, 13 nt, Mycobacterium bovis subsp bovis AF2122/97
aacgcggcgucga

SEQ ID NO: 3035882 - RNA, 22 nt, Mycobacterium bovis subsp bovis AF2122/97
aacgcggugggcacagccagua

SEQ ID NO: 3035883 - RNA, 20 nt, Mycobacterium bovis subsp bovis AF2122/97
aacgcguauucggcaucgcc

SEQ ID NO: 3035884 - RNA, 17 nt, Mycobacterium bovis subsp bovis AF2122/97
aacgcgucccgccgcac

SEQ ID NO: 3035885 - RNA, 16 nt, Mycobacterium bovis subsp bovis AF2122/97
aacgcgucgucgguca

SEQ ID NO: 3035886 - RNA, 18 nt, Mycobacterium bovis subsp bovis AF2122/97
aacgcgugaccagggccu

SEQ ID NO: 3035887 - RNA, 20 nt, Mycobacterium bovis subsp bovis AF2122/97
aacgcguugaccaucacgcc

SEQ ID NO: 3035888 - RNA, 14 nt, Mycobacterium bovis subsp bovis AF2122/97
aacgcucgucgaca

SEQ ID NO: 3035889 - RNA, 21 nt, Mycobacterium bovis subsp bovis AF2122/97
aacgcugaggaagcggcggca

SEQ ID NO: 3035890 - RNA, 20 nt, Mycobacterium bovis subsp bovis AF2122/97
aacgcuguaagcaugccguu

SEQ ID NO: 3035891 - RNA, 15 nt, Mycobacterium bovis subsp bovis AF2122/97
aacgcuucugccugc

SEQ ID NO: 3035892 - RNA, 14 nt, Mycobacterium bovis subsp bovis AF2122/97
aacggaagaccgcg

SEQ ID NO: 3035893 - RNA, 15 nt, Mycobacterium bovis subsp bovis AF2122/97
aacggacgaagcacc

SEQ ID NO: 3035894 - RNA, 17 nt, Mycobacterium bovis subsp bovis AF2122/97
aacggauucccgcccag

SEQ ID NO: 3035895 - RNA, 21 nt, Mycobacterium bovis subsp bovis AF2122/97
aacggauucccgcccagcagc

SEQ ID NO: 3035896 - RNA, 23 nt, Mycobacterium bovis subsp bovis AF2122/97
aacggauuggugggccagcagca

SEQ ID NO: 3035897 - RNA, 17 nt, Mycobacterium bovis subsp bovis AF2122/97
aacggcaaggucgcggc

SEQ ID NO: 3035898 - RNA, 19 nt, Mycobacterium bovis subsp bovis AF2122/97
aacggcaccagcgggucgg

SEQ ID NO: 3035899 - RNA, 17 nt, Mycobacterium bovis subsp bovis AF2122/97
aacggcacccugcggca

SEQ ID NO: 3035900 - RNA, 20 nt, Mycobacterium bovis subsp bovis AF2122/97
aacggcacccugcggcaccu

SEQ ID NO: 3035901 - RNA, 17 nt, Mycobacterium bovis subsp bovis AF2122/97
aacggcaccgcgcccac

SEQ ID NO: 3035902 - RNA, 19 nt, Mycobacterium bovis subsp bovis AF2122/97
aacggcagccgaagcgccc

SEQ ID NO: 3035903 - RNA, 23 nt, Mycobacterium bovis subsp bovis AF2122/97
aacggccacaugccacagcggcg

SEQ ID NO: 3035904 - RNA, 18 nt, Mycobacterium bovis subsp bovis AF2122/97
aacggcgaaacucgucga

SEQ ID NO: 3035905 - RNA, 22 nt, Mycobacterium bovis subsp bovis AF2122/97
aacggcgaccgccaucacgacc

SEQ ID NO: 3035906 - RNA, 23 nt, Mycobacterium bovis subsp bovis AF2122/97
aacggcggaucggcggccggcac

SEQ ID NO: 3035907 - RNA, 20 nt, Mycobacterium bovis subsp bovis AF2122/97
aacggcggcaucggcggcaa

SEQ ID NO: 3035908 - RNA, 21 nt, Mycobacterium bovis subsp bovis AF2122/97
aacggcggcaucggcggcaac

SEQ ID NO: 3035909 - RNA, 17 nt, Mycobacterium bovis subsp bovis AF2122/97
aacggcggccauggcgg

SEQ ID NO: 3035910 - RNA, 22 nt, Mycobacterium bovis subsp bovis AF2122/97
aacggcggccauggcgggucgg

SEQ ID NO: 3035911 - RNA, 13 nt, Mycobacterium bovis subsp bovis AF2122/97
aacggcggcgacg

SEQ ID NO: 3035912 - RNA, 12 nt, Mycobacterium bovis subsp bovis AF2122/97
aacggcgguggg

SEQ ID NO: 3035913 - RNA, 14 nt, Mycobacterium bovis subsp bovis AF2122/97
aacggcgucguggu

SEQ ID NO: 3035914 - RNA, 21 nt, Mycobacterium bovis subsp bovis AF2122/97
aacggcucgggaacuucgccg

SEQ ID NO: 3035915 - RNA, 22 nt, Mycobacterium bovis subsp bovis AF2122/97
aacggcuuggcugccuccauca

SEQ ID NO: 3035916 - RNA, 14 nt, Mycobacterium bovis subsp bovis AF2122/97
aacgggauccgcgc

SEQ ID NO: 3035917 - RNA, 13 nt, Mycobacterium bovis subsp bovis AF2122/97
aacgggaugccgg

SEQ ID NO: 3035918 - RNA, 16 nt, Mycobacterium bovis subsp bovis AF2122/97
aacgggaugcggucga

SEQ ID NO: 3035919 - RNA, 15 nt, Mycobacterium bovis subsp bovis AF2122/97
aacgggccuucgcca

SEQ ID NO: 3035920 - RNA, 23 nt, Mycobacterium bovis subsp bovis AF2122/97
aacgggcuuccgacaugaaccgg

SEQ ID NO: 3035921 - RNA, 20 nt, Mycobacterium bovis subsp bovis AF2122/97
aacggggcgacguccgcgac

SEQ ID NO: 3035922 - RNA, 13 nt, Mycobacterium bovis subsp bovis AF2122/97
aacgggguggcac

SEQ ID NO: 3035923 - RNA, 19 nt, Mycobacterium bovis subsp bovis AF2122/97
aacgggguggcacgcauga

SEQ ID NO: 3035924 - RNA, 15 nt, Mycobacterium bovis subsp bovis AF2122/97
aacggguccgacggu

SEQ ID NO: 3035925 - RNA, 18 nt, Mycobacterium bovis subsp bovis AF2122/97
aacgggucggcgaccacc

SEQ ID NO: 3035926 - RNA, 18 nt, Mycobacterium bovis subsp bovis AF2122/97
aacggguggauugacgcg

SEQ ID NO: 3035927 - RNA, 19 nt, Mycobacterium bovis subsp bovis AF2122/97
aacgguacgccgccgcgac

SEQ ID NO: 3035928 - RNA, 10 nt, Mycobacterium bovis subsp bovis AF2122/97
aacggugccu

SEQ ID NO: 3035929 - RNA, 14 nt, Mycobacterium bovis subsp bovis AF2122/97
aacgguggcgcggu

SEQ ID NO: 3035930 - RNA, 13 nt, Mycobacterium bovis subsp bovis AF2122/97
aacgguucggccg

SEQ ID NO: 3035931 - RNA, 14 nt, Mycobacterium bovis subsp bovis AF2122/97
aacgguugcucguc

SEQ ID NO: 3035932 - RNA, 20 nt, Mycobacterium bovis subsp bovis AF2122/97
aacgguuucuuucggcagcg

SEQ ID NO: 3035933 - RNA, 13 nt, Mycobacterium bovis subsp bovis AF2122/97
aacguagccagca

SEQ ID NO: 3035934 - RNA, 14 nt, Mycobacterium bovis subsp bovis AF2122/97
aacguaggguggcc

SEQ ID NO: 3035935 - RNA, 16 nt, Mycobacterium bovis subsp bovis AF2122/97
aacguaggguggccgg

SEQ ID NO: 3035936 - RNA, 13 nt, Mycobacterium bovis subsp bovis AF2122/97
aacgucaaccggg

SEQ ID NO: 3035937 - RNA, 16 nt, Mycobacterium bovis subsp bovis AF2122/97
aacgucaaccgggcgg

SEQ ID NO: 3035938 - RNA, 19 nt, Mycobacterium bovis subsp bovis AF2122/97
aacgucagugccccgcagc

SEQ ID NO: 3035939 - RNA, 20 nt, Mycobacterium bovis subsp bovis AF2122/97
aacguccagccguggcggcg

SEQ ID NO: 3035940 - RNA, 18 nt, Mycobacterium bovis subsp bovis AF2122/97
aacgucgagauccucguc

SEQ ID NO: 3035941 - RNA, 23 nt, Mycobacterium bovis subsp bovis AF2122/97
aacgucgagauccucgucgaggu

SEQ ID NO: 3035942 - RNA, 22 nt, Mycobacterium bovis subsp bovis AF2122/97
aacgucgauguccccggcggca

SEQ ID NO: 3035943 - RNA, 15 nt, Mycobacterium bovis subsp bovis AF2122/97
aacgucgccgcggcg

SEQ ID NO: 3035944 - RNA, 13 nt, Mycobacterium bovis subsp bovis AF2122/97
aacgucgucgcgu

SEQ ID NO: 3035945 - RNA, 20 nt, Mycobacterium bovis subsp bovis AF2122/97
aacgucgucgcgucgccagg

SEQ ID NO: 3035946 - RNA, 22 nt, Mycobacterium bovis subsp bovis AF2122/97
aacgucgucgcgucgccaggcc

SEQ ID NO: 3035947 - RNA, 14 nt, Mycobacterium bovis subsp bovis AF2122/97
aacgucgugauguc

SEQ ID NO: 3035948 - RNA, 16 nt, Mycobacterium bovis subsp bovis AF2122/97
aacgugaugcggucgc

SEQ ID NO: 3035949 - RNA, 20 nt, Mycobacterium bovis subsp bovis AF2122/97
aacgugcaaccacggcggca

SEQ ID NO: 3035950 - RNA, 14 nt, Mycobacterium bovis subsp bovis AF2122/97
aacgugcugguggg

SEQ ID NO: 3035951 - RNA, 14 nt, Mycobacterium bovis subsp bovis AF2122/97
aacguguugaccag

SEQ ID NO: 3035952 - RNA, 19 nt, Mycobacterium bovis subsp bovis AF2122/97
aacguguugaccgggucgu

SEQ ID NO: 3035953 - RNA, 17 nt, Mycobacterium bovis subsp bovis AF2122/97
aacguucggcacaacca

SEQ ID NO: 3035954 - RNA, 18 nt, Mycobacterium bovis subsp bovis AF2122/97
aacguuuugggcgccgga

SEQ ID NO: 3035955 - RNA, 18 nt, Mycobacterium bovis subsp bovis AF2122/97
aacuacggcguccccgac

SEQ ID NO: 3035956 - RNA, 14 nt, Mycobacterium bovis subsp bovis AF2122/97
aacuacggugcccu

SEQ ID NO: 3035957 - RNA, 21 nt, Mycobacterium bovis subsp bovis AF2122/97
aacuacucccccgcgaaguug

SEQ ID NO: 3035958 - RNA, 15 nt, Mycobacterium bovis subsp bovis AF2122/97
aacucacccgagcca

SEQ ID NO: 3035959 - RNA, 22 nt, Mycobacterium bovis subsp bovis AF2122/97
aacucaugcccgacgagucgcc

SEQ ID NO: 3035960 - RNA, 18 nt, Mycobacterium bovis subsp bovis AF2122/97
aacucaugggccaacuca

SEQ ID NO: 3035961 - RNA, 16 nt, Mycobacterium bovis subsp bovis AF2122/97
aacuccagcagcccgg

SEQ ID NO: 3035962 - RNA, 23 nt, Mycobacterium bovis subsp bovis AF2122/97
aacuccgccaccaucgccucggc

SEQ ID NO: 3035963 - RNA, 11 nt, Mycobacterium bovis subsp bovis AF2122/97
aacuccgcgau

SEQ ID NO: 3035964 - RNA, 14 nt, Mycobacterium bovis subsp bovis AF2122/97
aacuccgcggcgcg

SEQ ID NO: 3035965 - RNA, 21 nt, Mycobacterium bovis subsp bovis AF2122/97
aagauagacguuguugaaggc

SEQ ID NO: 3035966 - RNA, 22 nt, Mycobacterium bovis subsp bovis AF2122/97
aagaucaccucccgcggcaccu

SEQ ID NO: 3035967 - RNA, 15 nt, Mycobacterium bovis subsp bovis AF2122/97
aagaucacgcgucgu

SEQ ID NO: 3035968 - RNA, 13 nt, Mycobacterium bovis subsp bovis AF2122/97
aagauccagcgca

SEQ ID NO: 3035969 - RNA, 14 nt, Mycobacterium bovis subsp bovis AF2122/97
aagaucgagccgac

SEQ ID NO: 3035970 - RNA, 19 nt, Mycobacterium bovis subsp bovis AF2122/97
aagaucgcgugccacagca

SEQ ID NO: 3035971 - RNA, 22 nt, Mycobacterium bovis subsp bovis AF2122/97
aagaucgcugcgaagccgagca

SEQ ID NO: 3035972 - RNA, 15 nt, Mycobacterium bovis subsp bovis AF2122/97
aagaucggugccagc

SEQ ID NO: 3035973 - RNA, 18 nt, Mycobacterium bovis subsp bovis AF2122/97
aagaucucggccaggaug

SEQ ID NO: 3035974 - RNA, 16 nt, Mycobacterium bovis subsp bovis AF2122/97
aagaugaccucggcga

SEQ ID NO: 3035975 - RNA, 19 nt, Mycobacterium bovis subsp bovis AF2122/97
aagaugaccucggcgacga

SEQ ID NO: 3035976 - RNA, 15 nt, Mycobacterium bovis subsp bovis AF2122/97
aagaugccugcuagc

SEQ ID NO: 3035977 - RNA, 20 nt, Mycobacterium bovis subsp bovis AF2122/97
aagaugccugcuagcagcag

SEQ ID NO: 3035978 - RNA, 20 nt, Mycobacterium bovis subsp bovis AF2122/97
aagauggcgcgcugggcugc

SEQ ID NO: 3035979 - RNA, 14 nt, Mycobacterium bovis subsp bovis AF2122/97
aagauguccggucc

SEQ ID NO: 3035980 - RNA, 23 nt, Mycobacterium bovis subsp bovis AF2122/97
aagauuauggcgagcgcgccaau

SEQ ID NO: 3035981 - RNA, 14 nt, Mycobacterium bovis subsp bovis AF2122/97
aagcaacggaaucg

SEQ ID NO: 3035982 - RNA, 17 nt, Mycobacterium bovis subsp bovis AF2122/97
aagcaagcguguuguuu

SEQ ID NO: 3035983 - RNA, 21 nt, Mycobacterium bovis subsp bovis AF2122/97
aagcaauuccaccgccgagau

SEQ ID NO: 3035984 - RNA, 14 nt, Mycobacterium bovis subsp bovis AF2122/97
aagcacaccgccag

SEQ ID NO: 3035985 - RNA, 19 nt, Mycobacterium bovis subsp bovis AF2122/97
aagcacaccgccagcggca

SEQ ID NO: 3035986 - RNA, 20 nt, Mycobacterium bovis subsp bovis AF2122/97
aagcacaccgccagcggcaa

SEQ ID NO: 3035987 - RNA, 13 nt, Mycobacterium bovis subsp bovis AF2122/97
aagcacagcccgg

SEQ ID NO: 3035988 - RNA, 21 nt, Mycobacterium bovis subsp bovis AF2122/97
aagcacagcccggcgacgacc

SEQ ID NO: 3035989 - RNA, 17 nt, Mycobacterium bovis subsp bovis AF2122/97
aagcacagcgaacagac

SEQ ID NO: 3035990 - RNA, 10 nt, Mycobacterium bovis subsp bovis AF2122/97
aagcaccagc

SEQ ID NO: 3035991 - RNA, 14 nt, Mycobacterium bovis subsp bovis AF2122/97
aagcaccagccagc

SEQ ID NO: 3035992 - RNA, 19 nt, Mycobacterium bovis subsp bovis AF2122/97
aagcacgguggccgagccg

SEQ ID NO: 3035993 - RNA, 19 nt, Mycobacterium bovis subsp bovis AF2122/97
aagcagaaguccucggcgg

SEQ ID NO: 3035994 - RNA, 12 nt, Mycobacterium bovis subsp bovis AF2122/97
aagcagccagca

SEQ ID NO: 3035995 - RNA, 13 nt, Mycobacterium bovis subsp bovis AF2122/97
aagcagccagcaa

SEQ ID NO: 3035996 - RNA, 21 nt, Mycobacterium bovis subsp bovis AF2122/97
aagcagccagcaacaccagau

SEQ ID NO: 3035997 - RNA, 15 nt, Mycobacterium bovis subsp bovis AF2122/97
aagcagcugggcauc

SEQ ID NO: 3035998 - RNA, 16 nt, Mycobacterium bovis subsp bovis AF2122/97
aagccaccagaauccu

SEQ ID NO: 3035999 - RNA, 15 nt, Mycobacterium bovis subsp bovis AF2122/97
aagccacgcagaaca

SEQ ID NO: 3036000 - RNA, 16 nt, Mycobacterium bovis subsp bovis AF2122/97
aagccacgccggucgc

SEQ ID NO: 3036001 - RNA, 21 nt, Mycobacterium bovis subsp bovis AF2122/97
aagccacgccggucgcgguca

SEQ ID NO: 3036002 - RNA, 20 nt, Mycobacterium bovis subsp bovis AF2122/97
aagccagcgcagccaggcug

SEQ ID NO: 3036003 - RNA, 12 nt, Mycobacterium bovis subsp bovis AF2122/97
aagcccaacagc

SEQ ID NO: 3036004 - RNA, 22 nt, Mycobacterium bovis subsp bovis AF2122/97
aagcccaccgucugcuggccgg

SEQ ID NO: 3036005 - RNA, 20 nt, Mycobacterium bovis subsp bovis AF2122/97
aagcccacguuuagggugcc

SEQ ID NO: 3036006 - RNA, 16 nt, Mycobacterium bovis subsp bovis AF2122/97
aagccccccgagcugu

SEQ ID NO: 3036007 - RNA, 17 nt, Mycobacterium bovis subsp bovis AF2122/97
aagcccgaagacggggu

SEQ ID NO: 3036008 - RNA, 16 nt, Mycobacterium bovis subsp bovis AF2122/97
aagcccgagacggugu

SEQ ID NO: 3036009 - RNA, 21 nt, Mycobacterium bovis subsp bovis AF2122/97
aagcccgaguugaaggugccg

SEQ ID NO: 3036010 - RNA, 22 nt, Mycobacterium bovis subsp bovis AF2122/97
aagcccgaguuguucgugccgg

SEQ ID NO: 3036011 - RNA, 15 nt, Mycobacterium bovis subsp bovis AF2122/97
aagcccgaucggcgg

SEQ ID NO: 3036012 - RNA, 13 nt, Mycobacterium bovis subsp bovis AF2122/97
aagcccggcggca

SEQ ID NO: 3036013 - RNA, 14 nt, Mycobacterium bovis subsp bovis AF2122/97
aagcccuccucgau

SEQ ID NO: 3036014 - RNA, 20 nt, Mycobacterium bovis subsp bovis AF2122/97
aagcccucgacacgccgugc

SEQ ID NO: 3036015 - RNA, 17 nt, Mycobacterium bovis subsp bovis AF2122/97
aagcccuuguagcacac

SEQ ID NO: 3036016 - RNA, 20 nt, Mycobacterium bovis subsp bovis AF2122/97
aagccgaacaccgucagcgu

SEQ ID NO: 3036017 - RNA, 18 nt, Mycobacterium bovis subsp bovis AF2122/97
aagccgacaucggcggcc

SEQ ID NO: 3036018 - RNA, 19 nt, Mycobacterium bovis subsp bovis AF2122/97
aagccgaccaccgccgggc

SEQ ID NO: 3036019 - RNA, 20 nt, Mycobacterium bovis subsp bovis AF2122/97
aagccgaccguaccgaucca

SEQ ID NO: 3036020 - RNA, 16 nt, Mycobacterium bovis subsp bovis AF2122/97
aagccgacgaccagca

SEQ ID NO: 3036021 - RNA, 19 nt, Mycobacterium bovis subsp bovis AF2122/97
aagccgacgaccagcagau

SEQ ID NO: 3036022 - RNA, 22 nt, Mycobacterium bovis subsp bovis AF2122/97
aagccgacgauccacggcgaug

SEQ ID NO: 3036023 - RNA, 21 nt, Mycobacterium bovis subsp bovis AF2122/97
aagccgauguccgacgccacc

SEQ ID NO: 3036024 - RNA, 15 nt, Mycobacterium bovis subsp bovis AF2122/97
aagccgcaccgcugu

SEQ ID NO: 3036025 - RNA, 17 nt, Mycobacterium bovis subsp bovis AF2122/97
aagccgccggaguuggu

SEQ ID NO: 3036026 - RNA, 12 nt, Mycobacterium bovis subsp bovis AF2122/97
aagccgccgggc

SEQ ID NO: 3036027 - RNA, 12 nt, Mycobacterium bovis subsp bovis AF2122/97
aagccgccgggu

SEQ ID NO: 3036028 - RNA, 20 nt, Mycobacterium bovis subsp bovis AF2122/97
aagccgcggcuaggccagca

SEQ ID NO: 3036029 - RNA, 23 nt, Mycobacterium bovis subsp bovis AF2122/97
aagccgcggcuaggccagcacgg

SEQ ID NO: 3036030 - RNA, 12 nt, Mycobacterium bovis subsp bovis AF2122/97
aagccgcugaac

SEQ ID NO: 3036031 - RNA, 14 nt, Mycobacterium bovis subsp bovis AF2122/97
aagccgcugaugua

SEQ ID NO: 3036032 - RNA, 15 nt, Mycobacterium bovis subsp bovis AF2122/97
aagccggagcccggc

SEQ ID NO: 3036033 - RNA, 14 nt, Mycobacterium bovis subsp bovis AF2122/97
aagccggccacgca

SEQ ID NO: 3036034 - RNA, 13 nt, Mycobacterium bovis subsp bovis AF2122/97
aagccggccacua

SEQ ID NO: 3036035 - RNA, 16 nt, Mycobacterium bovis subsp bovis AF2122/97
aagccggcugcauccu

SEQ ID NO: 3036036 - RNA, 19 nt, Mycobacterium bovis subsp bovis AF2122/97
aagccgggucucggugcgg

SEQ ID NO: 3036037 - RNA, 19 nt, Mycobacterium bovis subsp bovis AF2122/97
aagccgggugggagcagcc

SEQ ID NO: 3036038 - RNA, 17 nt, Mycobacterium bovis subsp bovis AF2122/97
aagccguagaccaggcc

SEQ ID NO: 3036039 - RNA, 23 nt, Mycobacterium bovis subsp bovis AF2122/97
aagccguagaccaggcccagguc

SEQ ID NO: 3036040 - RNA, 21 nt, Mycobacterium bovis subsp bovis AF2122/97
aagccguaguaguggccgcca

SEQ ID NO: 3036041 - RNA, 14 nt, Mycobacterium bovis subsp bovis AF2122/97
aagccgucagcuca

SEQ ID NO: 3036042 - RNA, 16 nt, Mycobacterium bovis subsp bovis AF2122/97
aagccgucgacgcggu

SEQ ID NO: 3036043 - RNA, 18 nt, Mycobacterium bovis subsp bovis AF2122/97
aagccguguucgaccgca

SEQ ID NO: 3036044 - RNA, 18 nt, Mycobacterium bovis subsp bovis AF2122/97
aagccucggcaugcagcc

SEQ ID NO: 3036045 - RNA, 18 nt, Mycobacterium bovis subsp bovis AF2122/97
aagccucguggugagauc

SEQ ID NO: 3036046 - RNA, 22 nt, Mycobacterium bovis subsp bovis AF2122/97
aagccuggaaaacccaggucuu

SEQ ID NO: 3036047 - RNA, 19 nt, Mycobacterium bovis subsp bovis AF2122/97
aagccuuaccccgcagcuc

SEQ ID NO: 3036048 - RNA, 21 nt, Mycobacterium bovis subsp bovis AF2122/97
aagccuucggugucgccgaac

SEQ ID NO: 3036049 - RNA, 15 nt, Mycobacterium bovis subsp bovis AF2122/97
aagccuugccgucga

SEQ ID NO: 3036050 - RNA, 21 nt, Mycobacterium bovis subsp bovis AF2122/97
aagcgaaaucaguucccgaac

SEQ ID NO: 3036051 - RNA, 13 nt, Mycobacterium bovis subsp bovis AF2122/97
aagcgaagccaga

SEQ ID NO: 3036052 - RNA, 17 nt, Mycobacterium bovis subsp bovis AF2122/97
aaggugaucagcaggau

SEQ ID NO: 3036053 - RNA, 17 nt, Mycobacterium bovis subsp bovis AF2122/97
aaggugaugaacaccgg

SEQ ID NO: 3036054 - RNA, 23 nt, Mycobacterium bovis subsp bovis AF2122/97
aaggugcaccauuguuccguccc

SEQ ID NO: 3036055 - RNA, 17 nt, Mycobacterium bovis subsp bovis AF2122/97
aaggugcgcugggugau

SEQ ID NO: 3036056 - RNA, 19 nt, Mycobacterium bovis subsp bovis AF2122/97
aaggugcgcugggugauga

SEQ ID NO: 3036057 - RNA, 11 nt, Mycobacterium bovis subsp bovis AF2122/97
aaggugcugcg

SEQ ID NO: 3036058 - RNA, 22 nt, Mycobacterium bovis subsp bovis AF2122/97
aagguggccaccaaacgcugcu

SEQ ID NO: 3036059 - RNA, 21 nt, Mycobacterium bovis subsp bovis AF2122/97
aaggugucgacggugucuugg

SEQ ID NO: 3036060 - RNA, 22 nt, Mycobacterium bovis subsp bovis AF2122/97
aagguugaacgccgccagcaga

SEQ ID NO: 3036061 - RNA, 13 nt, Mycobacterium bovis subsp bovis AF2122/97
aagguugccgauc

SEQ ID NO: 3036062 - RNA, 23 nt, Mycobacterium bovis subsp bovis AF2122/97
aaguaauagcuguuggccagccg

SEQ ID NO: 3036063 - RNA, 15 nt, Mycobacterium bovis subsp bovis AF2122/97
aaguacacggcggcc

SEQ ID NO: 3036064 - RNA, 22 nt, Mycobacterium bovis subsp bovis AF2122/97
aaguacuggcguugccaccgga

SEQ ID NO: 3036065 - RNA, 22 nt, Mycobacterium bovis subsp bovis AF2122/97
aaguagccgaccggcagcgaug

SEQ ID NO: 3036066 - RNA, 17 nt, Mycobacterium bovis subsp bovis AF2122/97
aaguagguuuucggcgg

SEQ ID NO: 3036067 - RNA, 22 nt, Mycobacterium bovis subsp bovis AF2122/97
aaguagguuuucggcggcucua

SEQ ID NO: 3036068 - RNA, 17 nt, Mycobacterium bovis subsp bovis AF2122/97
aaguagucgaaggucag

SEQ ID NO: 3036069 - RNA, 13 nt, Mycobacterium bovis subsp bovis AF2122/97
aaguaucgcagca

SEQ ID NO: 3036070 - RNA, 23 nt, Mycobacterium bovis subsp bovis AF2122/97
aagucaaacgccgucacggcagu

SEQ ID NO: 3036071 - RNA, 17 nt, Mycobacterium bovis subsp bovis AF2122/97
aagucaacaccgcggcc

SEQ ID NO: 3036072 - RNA, 13 nt, Mycobacterium bovis subsp bovis AF2122/97
aagucacgcaccc

SEQ ID NO: 3036073 - RNA, 14 nt, Mycobacterium bovis subsp bovis AF2122/97
aagucacggcggcu

SEQ ID NO: 3036074 - RNA, 24 nt, Mycobacterium bovis subsp bovis AF2122/97
aagucauucguagcuucccuccag

SEQ ID NO: 3036075 - RNA, 14 nt, Mycobacterium bovis subsp bovis AF2122/97
aaguccagcagcga

SEQ ID NO: 3036076 - RNA, 17 nt, Mycobacterium bovis subsp bovis AF2122/97
aagucccgaguggccgg

SEQ ID NO: 3036077 - RNA, 15 nt, Mycobacterium bovis subsp bovis AF2122/97
aagucccgggcaccg

SEQ ID NO: 3036078 - RNA, 18 nt, Mycobacterium bovis subsp bovis AF2122/97
aaguccgccgccugcgca

SEQ ID NO: 3036079 - RNA, 17 nt, Mycobacterium bovis subsp bovis AF2122/97
aaguccuccacggcggg

SEQ ID NO: 3036080 - RNA, 15 nt, Mycobacterium bovis subsp bovis AF2122/97
aaguccuccgggcug

SEQ ID NO: 3036081 - RNA, 21 nt, Mycobacterium bovis subsp bovis AF2122/97
aaguccucggcggacccggug

SEQ ID NO: 3036082 - RNA, 18 nt, Mycobacterium bovis subsp bovis AF2122/97
aaguccuucacugcgacc

SEQ ID NO: 3036083 - RNA, 19 nt, Mycobacterium bovis subsp bovis AF2122/97
aagucgaacggcuuggcgu

SEQ ID NO: 3036084 - RNA, 14 nt, Mycobacterium bovis subsp bovis AF2122/97
aagucgacgccgca

SEQ ID NO: 3036085 - RNA, 15 nt, Mycobacterium bovis subsp bovis AF2122/97
aagucgacgguggcg

SEQ ID NO: 3036086 - RNA, 21 nt, Mycobacterium bovis subsp bovis AF2122/97
aagucgagcagauacagcgga

SEQ ID NO: 3036087 - RNA, 15 nt, Mycobacterium bovis subsp bovis AF2122/97
aagucgcauggcggc

SEQ ID NO: 3036088 - RNA, 23 nt, Mycobacterium bovis subsp bovis AF2122/97
aagucgcccagucccaggugcug

SEQ ID NO: 3036089 - RNA, 13 nt, Mycobacterium bovis subsp bovis AF2122/97
aagucgucgaggu

SEQ ID NO: 3036090 - RNA, 15 nt, Mycobacterium bovis subsp bovis AF2122/97
aagucguugcgcggu

SEQ ID NO: 3036091 - RNA, 18 nt, Mycobacterium bovis subsp bovis AF2122/97
aagucuugaccgcaccgg

SEQ ID NO: 3036092 - RNA, 20 nt, Mycobacterium bovis subsp bovis AF2122/97
aagugaauaccccagaccgc

SEQ ID NO: 3036093 - RNA, 11 nt, Mycobacterium bovis subsp bovis AF2122/97
aagugcagggc

SEQ ID NO: 3036094 - RNA, 13 nt, Mycobacterium bovis subsp bovis AF2122/97
aagugcagggcug

SEQ ID NO: 3036095 - RNA, 17 nt, Mycobacterium bovis subsp bovis AF2122/97
aagugccuuccucggca

SEQ ID NO: 3036096 - RNA, 23 nt, Mycobacterium bovis subsp bovis AF2122/97
aagugggcgguaccucgucgagc

SEQ ID NO: 3036097 - RNA, 16 nt, Mycobacterium bovis subsp bovis AF2122/97
aagugggugccggcac

SEQ ID NO: 3036098 - RNA, 20 nt, Mycobacterium bovis subsp bovis AF2122/97
aaguuccagccgacggcagu

SEQ ID NO: 3036099 - RNA, 16 nt, Mycobacterium bovis subsp bovis AF2122/97
aaguucucggugcgca

SEQ ID NO: 3036100 - RNA, 11 nt, Mycobacterium bovis subsp bovis AF2122/97
aaguugaagaa

SEQ ID NO: 3036101 - RNA, 12 nt, Mycobacterium bovis subsp bovis AF2122/97
aaguugaagaag

SEQ ID NO: 3036102 - RNA, 14 nt, Mycobacterium bovis subsp bovis AF2122/97
aaguugcccaggug

SEQ ID NO: 3036103 - RNA, 12 nt, Mycobacterium bovis subsp bovis AF2122/97
aaguuggccgcc

SEQ ID NO: 3036104 - RNA, 16 nt, Mycobacterium bovis subsp bovis AF2122/97
aaguuggcugagcagc

SEQ ID NO: 3036105 - RNA, 16 nt, Mycobacterium bovis subsp bovis AF2122/97
aauacaccuccugccu

SEQ ID NO: 3036106 - RNA, 23 nt, Mycobacterium bovis subsp bovis AF2122/97
aauacaccuuguggacccgccag

SEQ ID NO: 3036107 - RNA, 19 nt, Mycobacterium bovis subsp bovis AF2122/97
aauacccagcgcagcagcg

SEQ ID NO: 3036108 - RNA, 18 nt, Mycobacterium bovis subsp bovis AF2122/97
aauacgaggacgacgauc

SEQ ID NO: 3036109 - RNA, 19 nt, Mycobacterium bovis subsp bovis AF2122/97
aauacgcggggccggccgg

SEQ ID NO: 3036110 - RNA, 20 nt, Mycobacterium bovis subsp bovis AF2122/97
aauacgcugcuggucuugcc

SEQ ID NO: 3036111 - RNA, 12 nt, Mycobacterium bovis subsp bovis AF2122/97
aauacggcggcg

SEQ ID NO: 3036112 - RNA, 21 nt, Mycobacterium bovis subsp bovis AF2122/97
aauacugccguucggggcgcg

SEQ ID NO: 3036113 - RNA, 21 nt, Mycobacterium bovis subsp bovis AF2122/97
aauacuuggaaaagcuguuga

SEQ ID NO: 3036114 - RNA, 16 nt, Mycobacterium bovis subsp bovis AF2122/97
aauagcgacagcagcg

SEQ ID NO: 3036115 - RNA, 14 nt, Mycobacterium bovis subsp bovis AF2122/97
aauagcucgccggc

SEQ ID NO: 3036116 - RNA, 18 nt, Mycobacterium bovis subsp bovis AF2122/97
aauagcucgccggcgaac

SEQ ID NO: 3036117 - RNA, 21 nt, Mycobacterium bovis subsp bovis AF2122/97
aauagcugcgcgaagccacca

SEQ ID NO: 3036118 - RNA, 22 nt, Mycobacterium bovis subsp bovis AF2122/97
aauaggcuccagcgcgcgccgc

SEQ ID NO: 3036119 - RNA, 22 nt, Mycobacterium bovis subsp bovis AF2122/97
aauaggucugagucuuucccgc

SEQ ID NO: 3036120 - RNA, 20 nt, Mycobacterium bovis subsp bovis AF2122/97
aauaguuguugcaggagccg

SEQ ID NO: 3036121 - RNA, 17 nt, Mycobacterium bovis subsp bovis AF2122/97
aauaugccacagaccga

SEQ ID NO: 3036122 - RNA, 12 nt, Mycobacterium bovis subsp bovis AF2122/97
aaucaagcacag

SEQ ID NO: 3036123 - RNA, 14 nt, Mycobacterium bovis subsp bovis AF2122/97
aaucaagcacagcc

SEQ ID NO: 3036124 - RNA, 12 nt, Mycobacterium bovis subsp bovis AF2122/97
aaucaagcagcg

SEQ ID NO: 3036125 - RNA, 16 nt, Mycobacterium bovis subsp bovis AF2122/97
aaucacaauuccacaa

SEQ ID NO: 3036126 - RNA, 23 nt, Mycobacterium bovis subsp bovis AF2122/97
aaucacccgcgagaucgggccgg

SEQ ID NO: 3036127 - RNA, 22 nt, Mycobacterium bovis subsp bovis AF2122/97
aaucaccgaauaccgccgcgca

SEQ ID NO: 3036128 - RNA, 21 nt, Mycobacterium bovis subsp bovis AF2122/97
aaucaccgccgcgaccgccuc

SEQ ID NO: 3036129 - RNA, 14 nt, Mycobacterium bovis subsp bovis AF2122/97
aaucaccgccggcg

SEQ ID NO: 3036130 - RNA, 16 nt, Mycobacterium bovis subsp bovis AF2122/97
aaucaccggagcgccg

SEQ ID NO: 3036131 - RNA, 13 nt, Mycobacterium bovis subsp bovis AF2122/97
aaucagcacccca

SEQ ID NO: 3036132 - RNA, 15 nt, Mycobacterium bovis subsp bovis AF2122/97
aaucagcccgccgga

SEQ ID NO: 3036133 - RNA, 19 nt, Mycobacterium bovis subsp bovis AF2122/97
aaucagggucugcgccgcc

SEQ ID NO: 3036134 - RNA, 18 nt, Mycobacterium bovis subsp bovis AF2122/97
aauccaaggcucagcagc

SEQ ID NO: 3036135 - RNA, 20 nt, Mycobacterium bovis subsp bovis AF2122/97
aauccaaggcucagcagcgc

SEQ ID NO: 3036136 - RNA, 15 nt, Mycobacterium bovis subsp bovis AF2122/97
aauccacgucgcggc

SEQ ID NO: 3036137 - RNA, 19 nt, Mycobacterium bovis subsp bovis AF2122/97
aauccagccgcgcgccggc

SEQ ID NO: 3036138 - RNA, 18 nt, Mycobacterium bovis subsp bovis AF2122/97
aauggauugcggcacgga

SEQ ID NO: 3036139 - RNA, 18 nt, Mycobacterium bovis subsp bovis AF2122/97
aauggcaacacaccgaac

SEQ ID NO: 3036140 - RNA, 12 nt, Mycobacterium bovis subsp bovis AF2122/97
aauggcaccgag

SEQ ID NO: 3036141 - RNA, 19 nt, Mycobacterium bovis subsp bovis AF2122/97
aauggcagcacgaccuggu

SEQ ID NO: 3036142 - RNA, 13 nt, Mycobacterium bovis subsp bovis AF2122/97
aauggccaccggc

SEQ ID NO: 3036143 - RNA, 13 nt, Mycobacterium bovis subsp bovis AF2122/97
aauggccagcacc

SEQ ID NO: 3036144 - RNA, 16 nt, Mycobacterium bovis subsp bovis AF2122/97
aauggccagcaccacg

SEQ ID NO: 3036145 - RNA, 17 nt, Mycobacterium bovis subsp bovis AF2122/97
aauggccagcaccacgg

SEQ ID NO: 3036146 - RNA, 21 nt, Mycobacterium bovis subsp bovis AF2122/97
aauggccgccgcagcuccccg

SEQ ID NO: 3036147 - RNA, 18 nt, Mycobacterium bovis subsp bovis AF2122/97
aauggcgccggccggcag

SEQ ID NO: 3036148 - RNA, 21 nt, Mycobacterium bovis subsp bovis AF2122/97
aauggcgccggccggcgcggu

SEQ ID NO: 3036149 - RNA, 17 nt, Mycobacterium bovis subsp bovis AF2122/97
aauggcggacagggcgg

SEQ ID NO: 3036150 - RNA, 20 nt, Mycobacterium bovis subsp bovis AF2122/97
aauggcggacagggcggcaa

SEQ ID NO: 3036151 - RNA, 19 nt, Mycobacterium bovis subsp bovis AF2122/97
aauggcggccuugcucagc

SEQ ID NO: 3036152 - RNA, 16 nt, Mycobacterium bovis subsp bovis AF2122/97
aauggcgucgccggca

SEQ ID NO: 3036153 - RNA, 17 nt, Mycobacterium bovis subsp bovis AF2122/97
aauggcgucgccggcac

SEQ ID NO: 3036154 - RNA, 21 nt, Mycobacterium bovis subsp bovis AF2122/97
aauggcgucgccggcaccggc

SEQ ID NO: 3036155 - RNA, 20 nt, Mycobacterium bovis subsp bovis AF2122/97
aauggcucugaggucaccgg

SEQ ID NO: 3036156 - RNA, 21 nt, Mycobacterium bovis subsp bovis AF2122/97
aauggcugagcccgccgcgac

SEQ ID NO: 3036157 - RNA, 22 nt, Mycobacterium bovis subsp bovis AF2122/97
aaugggaccgggcguuucccug

SEQ ID NO: 3036158 - RNA, 13 nt, Mycobacterium bovis subsp bovis AF2122/97
aaugggggcuggu

SEQ ID NO: 3036159 - RNA, 20 nt, Mycobacterium bovis subsp bovis AF2122/97
aaugggguguuugucgcggu

SEQ ID NO: 3036160 - RNA, 23 nt, Mycobacterium bovis subsp bovis AF2122/97
aaugguggcguccagggcgccga

SEQ ID NO: 3036161 - RNA, 13 nt, Mycobacterium bovis subsp bovis AF2122/97
aauguaguccagc

SEQ ID NO: 3036162 - RNA, 16 nt, Mycobacterium bovis subsp bovis AF2122/97
aaugucaccccgccca

SEQ ID NO: 3036163 - RNA, 16 nt, Mycobacterium bovis subsp bovis AF2122/97
aauguccaggcgcgca

SEQ ID NO: 3036164 - RNA, 16 nt, Mycobacterium bovis subsp bovis AF2122/97
aauguccgcagacgac

SEQ ID NO: 3036165 - RNA, 18 nt, Mycobacterium bovis subsp bovis AF2122/97
aaugucgauuucgaugac

SEQ ID NO: 3036166 - RNA, 19 nt, Mycobacterium bovis subsp bovis AF2122/97
aaugucggcagggccccca

SEQ ID NO: 3036167 - RNA, 23 nt, Mycobacterium bovis subsp bovis AF2122/97
aaugucggcgaugcguccgccca

SEQ ID NO: 3036168 - RNA, 20 nt, Mycobacterium bovis subsp bovis AF2122/97
aaugucuuuggucgccggac

SEQ ID NO: 3036169 - RNA, 19 nt, Mycobacterium bovis subsp bovis AF2122/97
aauguugcgaucugcggcg

SEQ ID NO: 3036170 - RNA, 15 nt, Mycobacterium bovis subsp bovis AF2122/97
aauucaacagcaccg

SEQ ID NO: 3036171 - RNA, 15 nt, Mycobacterium bovis subsp bovis AF2122/97
aauucacgcaccaca

SEQ ID NO: 3036172 - RNA, 15 nt, Mycobacterium bovis subsp bovis AF2122/97
aauuccacugcgcca

SEQ ID NO: 3036173 - RNA, 13 nt, Mycobacterium bovis subsp bovis AF2122/97
aauuccagccagc

SEQ ID NO: 3036174 - RNA, 19 nt, Mycobacterium bovis subsp bovis AF2122/97
aauuccagccagccgcccu

SEQ ID NO: 3036175 - RNA, 13 nt, Mycobacterium bovis subsp bovis AF2122/97
aauuccagccccc

SEQ ID NO: 3036176 - RNA, 18 nt, Mycobacterium bovis subsp bovis AF2122/97
aauuccgcagagaccaag

SEQ ID NO: 3036177 - RNA, 14 nt, Mycobacterium bovis subsp bovis AF2122/97
aauuccggcucacc

SEQ ID NO: 3036178 - RNA, 18 nt, Mycobacterium bovis subsp bovis AF2122/97
aauuccggcucaccgauc

SEQ ID NO: 3036179 - RNA, 17 nt, Mycobacterium bovis subsp bovis AF2122/97
aauuccggugaucgcgg

SEQ ID NO: 3036180 - RNA, 21 nt, Mycobacterium bovis subsp bovis AF2122/97
aauuccggugaucgcgguggc

SEQ ID NO: 3036181 - RNA, 16 nt, Mycobacterium bovis subsp bovis AF2122/97
aauuccguuaggcucc

SEQ ID NO: 3036182 - RNA, 15 nt, Mycobacterium bovis subsp bovis AF2122/97
aauucgacugcaacu

SEQ ID NO: 3036183 - RNA, 15 nt, Mycobacterium bovis subsp bovis AF2122/97
aauucggcgucgugg

SEQ ID NO: 3036184 - RNA, 21 nt, Mycobacterium bovis subsp bovis AF2122/97
aauucgggcauggucgccgga

SEQ ID NO: 3036185 - RNA, 21 nt, Mycobacterium bovis subsp bovis AF2122/97
aauucguacagugucugccau

SEQ ID NO: 3036186 - RNA, 15 nt, Mycobacterium bovis subsp bovis AF2122/97
aauucguagggaugc

SEQ ID NO: 3036187 - RNA, 19 nt, Mycobacterium bovis subsp bovis AF2122/97
aauucguucagcgccagcg

SEQ ID NO: 3036188 - RNA, 17 nt, Mycobacterium bovis subsp bovis AF2122/97
aauucucgcccugacgu

SEQ ID NO: 3036189 - RNA, 18 nt, Mycobacterium bovis subsp bovis AF2122/97
aauucuggugucaucaau

SEQ ID NO: 3036190 - RNA, 20 nt, Mycobacterium bovis subsp bovis AF2122/97
aauucuggugucaucaaucu

SEQ ID NO: 3036191 - RNA, 14 nt, Mycobacterium bovis subsp bovis AF2122/97
aauugcccggcacg

SEQ ID NO: 3036192 - RNA, 17 nt, Mycobacterium bovis subsp bovis AF2122/97
aauugcccuagcagcaa

SEQ ID NO: 3036193 - RNA, 13 nt, Mycobacterium bovis subsp bovis AF2122/97
aauugcccugacg

SEQ ID NO: 3036194 - RNA, 16 nt, Mycobacterium bovis subsp bovis AF2122/97
aauugcccugacgauc

SEQ ID NO: 3036195 - RNA, 17 nt, Mycobacterium bovis subsp bovis AF2122/97
aauuggccguuggcggc

SEQ ID NO: 3036196 - RNA, 21 nt, Mycobacterium bovis subsp bovis AF2122/97
aauugggcgauuuugcgucug

SEQ ID NO: 3036197 - RNA, 19 nt, Mycobacterium bovis subsp bovis AF2122/97
aauuggucgaacagcgaac

SEQ ID NO: 3036198 - RNA, 17 nt, Mycobacterium bovis subsp bovis AF2122/97
aauuucacugcgagcgc

SEQ ID NO: 3036199 - RNA, 23 nt, Mycobacterium bovis subsp bovis AF2122/97
aauuucgacacgaaggucgcggu

SEQ ID NO: 3036200 - RNA, 17 nt, Mycobacterium bovis subsp bovis AF2122/97
aauuucgauuucccaug

SEQ ID NO: 3036201 - RNA, 11 nt, Mycobacterium bovis subsp bovis AF2122/97
aauuugacgac

SEQ ID NO: 3036202 - RNA, 14 nt, Mycobacterium bovis subsp bovis AF2122/97
aauuuggugaagug

SEQ ID NO: 3036203 - RNA, 12 nt, Mycobacterium bovis subsp bovis AF2122/97
acaaaagccagg

SEQ ID NO: 3036204 - RNA, 12 nt, Mycobacterium bovis subsp bovis AF2122/97
acaaaaggccau

SEQ ID NO: 3036205 - RNA, 12 nt, Mycobacterium bovis subsp bovis AF2122/97
acaaaaucagca

SEQ ID NO: 3036206 - RNA, 14 nt, Mycobacterium bovis subsp bovis AF2122/97
acaaaaucagcagc

SEQ ID NO: 3036207 - RNA, 17 nt, Mycobacterium bovis subsp bovis AF2122/97
acaaaaucagcagcccc

SEQ ID NO: 3036208 - RNA, 13 nt, Mycobacterium bovis subsp bovis AF2122/97
acaaacagcgcca

SEQ ID NO: 3036209 - RNA, 20 nt, Mycobacterium bovis subsp bovis AF2122/97
acaaacaucgcacccaccac

SEQ ID NO: 3036210 - RNA, 23 nt, Mycobacterium bovis subsp bovis AF2122/97
acaaacaucgcacccaccacacc

SEQ ID NO: 3036211 - RNA, 21 nt, Mycobacterium bovis subsp bovis AF2122/97
acaaaccgucggggaugccga

SEQ ID NO: 3036212 - RNA, 17 nt, Mycobacterium bovis subsp bovis AF2122/97
acaaaccugcaugccca

SEQ ID NO: 3036213 - RNA, 21 nt, Mycobacterium bovis subsp bovis AF2122/97
acaaacggcuuggcugccucc

SEQ ID NO: 3036214 - RNA, 12 nt, Mycobacterium bovis subsp bovis AF2122/97
acaaagaagugg

SEQ ID NO: 3036215 - RNA, 18 nt, Mycobacterium bovis subsp bovis AF2122/97
acaaagccacgcagaaca

SEQ ID NO: 3036216 - RNA, 19 nt, Mycobacterium bovis subsp bovis AF2122/97
acaaaucggcgguggcggu

SEQ ID NO: 3036217 - RNA, 12 nt, Mycobacterium bovis subsp bovis AF2122/97
acaacaacacgg

SEQ ID NO: 3036218 - RNA, 23 nt, Mycobacterium bovis subsp bovis AF2122/97
acaacacagaacucaccgacgga

SEQ ID NO: 3036219 - RNA, 17 nt, Mycobacterium bovis subsp bovis AF2122/97
acaacaccaccagcacg

SEQ ID NO: 3036220 - RNA, 15 nt, Mycobacterium bovis subsp bovis AF2122/97
acaacacgccgucga

SEQ ID NO: 3036221 - RNA, 12 nt, Mycobacterium bovis subsp bovis AF2122/97
acaacacgggca

SEQ ID NO: 3036222 - RNA, 14 nt, Mycobacterium bovis subsp bovis AF2122/97
acaacagccgcagc

SEQ ID NO: 3036223 - RNA, 14 nt, Mycobacterium bovis subsp bovis AF2122/97
acaacagcgcucca

SEQ ID NO: 3036224 - RNA, 20 nt, Mycobacterium bovis subsp bovis AF2122/97
acaacagcgucuggccgucg

SEQ ID NO: 3036225 - RNA, 17 nt, Mycobacterium bovis subsp bovis AF2122/97
acaccagcaggcggcuc

SEQ ID NO: 3036226 - RNA, 12 nt, Mycobacterium bovis subsp bovis AF2122/97
acaccagccaga

SEQ ID NO: 3036227 - RNA, 13 nt, Mycobacterium bovis subsp bovis AF2122/97
acaccagcccggc

SEQ ID NO: 3036228 - RNA, 16 nt, Mycobacterium bovis subsp bovis AF2122/97
acaccagcccggcggc

SEQ ID NO: 3036229 - RNA, 12 nt, Mycobacterium bovis subsp bovis AF2122/97
acaccagcgcag

SEQ ID NO: 3036230 - RNA, 13 nt, Mycobacterium bovis subsp bovis AF2122/97
acaccagcgcagc

SEQ ID NO: 3036231 - RNA, 14 nt, Mycobacterium bovis subsp bovis AF2122/97
acaccagcggucgg

SEQ ID NO: 3036232 - RNA, 16 nt, Mycobacterium bovis subsp bovis AF2122/97
acaccagcggucggcg

SEQ ID NO: 3036233 - RNA, 21 nt, Mycobacterium bovis subsp bovis AF2122/97
acaccagcuuguagcgcucgu

SEQ ID NO: 3036234 - RNA, 22 nt, Mycobacterium bovis subsp bovis AF2122/97
acaccaggccgagccgcccgcc

SEQ ID NO: 3036235 - RNA, 23 nt, Mycobacterium bovis subsp bovis AF2122/97
acaccaggucauugccggcgacg

SEQ ID NO: 3036236 - RNA, 17 nt, Mycobacterium bovis subsp bovis AF2122/97
acaccaguaaugcccau

SEQ ID NO: 3036237 - RNA, 16 nt, Mycobacterium bovis subsp bovis AF2122/97
acaccaguagcaccag

SEQ ID NO: 3036238 - RNA, 22 nt, Mycobacterium bovis subsp bovis AF2122/97
acaccauaggccgacggguugg

SEQ ID NO: 3036239 - RNA, 18 nt, Mycobacterium bovis subsp bovis AF2122/97
acaccaucuccgccgucg

SEQ ID NO: 3036240 - RNA, 22 nt, Mycobacterium bovis subsp bovis AF2122/97
acaccaucuccgccgucgccac

SEQ ID NO: 3036241 - RNA, 23 nt, Mycobacterium bovis subsp bovis AF2122/97
acacccaaaccggcccgcagcag

SEQ ID NO: 3036242 - RNA, 14 nt, Mycobacterium bovis subsp bovis AF2122/97
acacccaccucgcc

SEQ ID NO: 3036243 - RNA, 15 nt, Mycobacterium bovis subsp bovis AF2122/97
acacccagcgugccc

SEQ ID NO: 3036244 - RNA, 15 nt, Mycobacterium bovis subsp bovis AF2122/97
acacccaucaccgcc

SEQ ID NO: 3036245 - RNA, 18 nt, Mycobacterium bovis subsp bovis AF2122/97
acacccaucaccgccagc

SEQ ID NO: 3036246 - RNA, 21 nt, Mycobacterium bovis subsp bovis AF2122/97
acacccauuacugagcuucca

SEQ ID NO: 3036247 - RNA, 21 nt, Mycobacterium bovis subsp bovis AF2122/97
acacccccccccccacccacc

SEQ ID NO: 3036248 - RNA, 21 nt, Mycobacterium bovis subsp bovis AF2122/97
acaccccggccuugccaccgg

SEQ ID NO: 3036249 - RNA, 20 nt, Mycobacterium bovis subsp bovis AF2122/97
acacccgacacggcucgccg

SEQ ID NO: 3036250 - RNA, 12 nt, Mycobacterium bovis subsp bovis AF2122/97
acacccgagcaa

SEQ ID NO: 3036251 - RNA, 18 nt, Mycobacterium bovis subsp bovis AF2122/97
acacccgagcaacggcgg

SEQ ID NO: 3036252 - RNA, 14 nt, Mycobacterium bovis subsp bovis AF2122/97
acacccgcaccgga

SEQ ID NO: 3036253 - RNA, 13 nt, Mycobacterium bovis subsp bovis AF2122/97
acacccgccaggc

SEQ ID NO: 3036254 - RNA, 13 nt, Mycobacterium bovis subsp bovis AF2122/97
acacccgcccggg

SEQ ID NO: 3036255 - RNA, 23 nt, Mycobacterium bovis subsp bovis AF2122/97
acacccgcgaacgcgacagccac

SEQ ID NO: 3036256 - RNA, 13 nt, Mycobacterium bovis subsp bovis AF2122/97
acacccgcucgcc

SEQ ID NO: 3036257 - RNA, 13 nt, Mycobacterium bovis subsp bovis AF2122/97
acacccggcacac

SEQ ID NO: 3036258 - RNA, 17 nt, Mycobacterium bovis subsp bovis AF2122/97
acacccggccgaccucg

SEQ ID NO: 3036259 - RNA, 19 nt, Mycobacterium bovis subsp bovis AF2122/97
acacccggccgaccucggc

SEQ ID NO: 3036260 - RNA, 16 nt, Mycobacterium bovis subsp bovis AF2122/97
acacccgggccaucgc

SEQ ID NO: 3036261 - RNA, 21 nt, Mycobacterium bovis subsp bovis AF2122/97
acacccucgggcaacucggug

SEQ ID NO: 3036262 - RNA, 20 nt, Mycobacterium bovis subsp bovis AF2122/97
acacccugggugccggcagc

SEQ ID NO: 3036263 - RNA, 23 nt, Mycobacterium bovis subsp bovis AF2122/97
acacccugggugccggcagcggc

SEQ ID NO: 3036264 - RNA, 17 nt, Mycobacterium bovis subsp bovis AF2122/97
acacccuugcccacggc

SEQ ID NO: 3036265 - RNA, 18 nt, Mycobacterium bovis subsp bovis AF2122/97
acacccuugcccacggcg

SEQ ID NO: 3036266 - RNA, 15 nt, Mycobacterium bovis subsp bovis AF2122/97
acaccgaaagccucu

SEQ ID NO: 3036267 - RNA, 13 nt, Mycobacterium bovis subsp bovis AF2122/97
acaccgacacgcc

SEQ ID NO: 3036268 - RNA, 14 nt, Mycobacterium bovis subsp bovis AF2122/97
acaccgacacgccg

SEQ ID NO: 3036269 - RNA, 16 nt, Mycobacterium bovis subsp bovis AF2122/97
acaccgacgcggucgg

SEQ ID NO: 3036270 - RNA, 21 nt, Mycobacterium bovis subsp bovis AF2122/97
acaccgacgcggucggcggcc

SEQ ID NO: 3036271 - RNA, 23 nt, Mycobacterium bovis subsp bovis AF2122/97
acaccgacgcggucggcggccgc

SEQ ID NO: 3036272 - RNA, 19 nt, Mycobacterium bovis subsp bovis AF2122/97
acaccgagaagcugugccu

SEQ ID NO: 3036273 - RNA, 13 nt, Mycobacterium bovis subsp bovis AF2122/97
acaccgagcaccu

SEQ ID NO: 3036274 - RNA, 20 nt, Mycobacterium bovis subsp bovis AF2122/97
acaccgaggcgaccggaccg

SEQ ID NO: 3036275 - RNA, 18 nt, Mycobacterium bovis subsp bovis AF2122/97
acaccgaucggacgucgu

SEQ ID NO: 3036276 - RNA, 16 nt, Mycobacterium bovis subsp bovis AF2122/97
acaccgcaacgcgugc

SEQ ID NO: 3036277 - RNA, 20 nt, Mycobacterium bovis subsp bovis AF2122/97
acaccgcaccugggcggcgc

SEQ ID NO: 3036278 - RNA, 21 nt, Mycobacterium bovis subsp bovis AF2122/97
acaccgccaccacgccgucga

SEQ ID NO: 3036279 - RNA, 13 nt, Mycobacterium bovis subsp bovis AF2122/97
acaccgccagcau

SEQ ID NO: 3036280 - RNA, 15 nt, Mycobacterium bovis subsp bovis AF2122/97
acaccgccagcauga

SEQ ID NO: 3036281 - RNA, 13 nt, Mycobacterium bovis subsp bovis AF2122/97
acaccgcccggcc

SEQ ID NO: 3036282 - RNA, 15 nt, Mycobacterium bovis subsp bovis AF2122/97
acaccgcccggcccg

SEQ ID NO: 3036283 - RNA, 14 nt, Mycobacterium bovis subsp bovis AF2122/97
acaccgcgaucacc

SEQ ID NO: 3036284 - RNA, 24 nt, Mycobacterium bovis subsp bovis AF2122/97
acaccgcgaucaccaccggaucgc

SEQ ID NO: 3036285 - RNA, 14 nt, Mycobacterium bovis subsp bovis AF2122/97
acaccgcgcccgcc

SEQ ID NO: 3036286 - RNA, 17 nt, Mycobacterium bovis subsp bovis AF2122/97
acaccgcgcccgccgau

SEQ ID NO: 3036287 - RNA, 19 nt, Mycobacterium bovis subsp bovis AF2122/97
acaccgcgcccgccgaucc

SEQ ID NO: 3036288 - RNA, 21 nt, Mycobacterium bovis subsp bovis AF2122/97
acaccgcgccgacgaaaucgu

SEQ ID NO: 3036289 - RNA, 16 nt, Mycobacterium bovis subsp bovis AF2122/97
acaccgcggcgaucug

SEQ ID NO: 3036290 - RNA, 12 nt, Mycobacterium bovis subsp bovis AF2122/97
acaccgcggcgc

SEQ ID NO: 3036291 - RNA, 17 nt, Mycobacterium bovis subsp bovis AF2122/97
acaccgcggcggcgcgu

SEQ ID NO: 3036292 - RNA, 21 nt, Mycobacterium bovis subsp bovis AF2122/97
acaccggcacugcccagcaga

SEQ ID NO: 3036293 - RNA, 13 nt, Mycobacterium bovis subsp bovis AF2122/97
acaccggccaaca

SEQ ID NO: 3036294 - RNA, 20 nt, Mycobacterium bovis subsp bovis AF2122/97
acaccggccaccagcccgau

SEQ ID NO: 3036295 - RNA, 16 nt, Mycobacterium bovis subsp bovis AF2122/97
acaccggccagcggcc

SEQ ID NO: 3036296 - RNA, 17 nt, Mycobacterium bovis subsp bovis AF2122/97
acaccggccagcggccc

SEQ ID NO: 3036297 - RNA, 21 nt, Mycobacterium bovis subsp bovis AF2122/97
acaccggccaggccggcggcg

SEQ ID NO: 3036298 - RNA, 13 nt, Mycobacterium bovis subsp bovis AF2122/97
acaccggccgcga

SEQ ID NO: 3036299 - RNA, 21 nt, Mycobacterium bovis subsp bovis AF2122/97
acaccggccugcgcgaccgac

SEQ ID NO: 3036300 - RNA, 24 nt, Mycobacterium bovis subsp bovis AF2122/97
acaccggccugcgcgaccgaccag

SEQ ID NO: 3036301 - RNA, 21 nt, Mycobacterium bovis subsp bovis AF2122/97
acaccggcgcucaaugcgguc

SEQ ID NO: 3036302 - RNA, 16 nt, Mycobacterium bovis subsp bovis AF2122/97
acaccggcuggaaucu

SEQ ID NO: 3036303 - RNA, 17 nt, Mycobacterium bovis subsp bovis AF2122/97
acaccggggacgucgac

SEQ ID NO: 3036304 - RNA, 17 nt, Mycobacterium bovis subsp bovis AF2122/97
acaccgguaacgccaac

SEQ ID NO: 3036305 - RNA, 22 nt, Mycobacterium bovis subsp bovis AF2122/97
acaccgguaacgccaacaccgg

SEQ ID NO: 3036306 - RNA, 15 nt, Mycobacterium bovis subsp bovis AF2122/97
acaccggucggcagc

SEQ ID NO: 3036307 - RNA, 16 nt, Mycobacterium bovis subsp bovis AF2122/97
acaccggugucggcca

SEQ ID NO: 3036308 - RNA, 17 nt, Mycobacterium bovis subsp bovis AF2122/97
acaccggugucggccag

SEQ ID NO: 3036309 - RNA, 18 nt, Mycobacterium bovis subsp bovis AF2122/97
acaccgguugacagcucc

SEQ ID NO: 3036310 - RNA, 23 nt, Mycobacterium bovis subsp bovis AF2122/97
acaccgucaccgagcccgaucgc

SEQ ID NO: 3036311 - RNA, 17 nt, Mycobacterium bovis subsp bovis AF2122/97
acaccgucacgccaccg

SEQ ID NO: 3036312 - RNA, 15 nt, Mycobacterium bovis subsp bovis AF2122/97
acagaaucgaccgcc

SEQ ID NO: 3036313 - RNA, 19 nt, Mycobacterium bovis subsp bovis AF2122/97
acagaccgaacagcaccga

SEQ ID NO: 3036314 - RNA, 18 nt, Mycobacterium bovis subsp bovis AF2122/97
acagaccgggcaccagaa

SEQ ID NO: 3036315 - RNA, 16 nt, Mycobacterium bovis subsp bovis AF2122/97
acagacgcaauagcca

SEQ ID NO: 3036316 - RNA, 17 nt, Mycobacterium bovis subsp bovis AF2122/97
acagacggggucgcccg

SEQ ID NO: 3036317 - RNA, 18 nt, Mycobacterium bovis subsp bovis AF2122/97
acagaucuugugccaggc

SEQ ID NO: 3036318 - RNA, 14 nt, Mycobacterium bovis subsp bovis AF2122/97
acagaugcauccag

SEQ ID NO: 3036319 - RNA, 19 nt, Mycobacterium bovis subsp bovis AF2122/97
acagaugcauccagcugcu

SEQ ID NO: 3036320 - RNA, 14 nt, Mycobacterium bovis subsp bovis AF2122/97
acagaugccaccca

SEQ ID NO: 3036321 - RNA, 13 nt, Mycobacterium bovis subsp bovis AF2122/97
acagcaacccgcc

SEQ ID NO: 3036322 - RNA, 23 nt, Mycobacterium bovis subsp bovis AF2122/97
acagcaagauuauggcgagcgcg

SEQ ID NO: 3036323 - RNA, 14 nt, Mycobacterium bovis subsp bovis AF2122/97
acagcaauccgcaa

SEQ ID NO: 3036324 - RNA, 13 nt, Mycobacterium bovis subsp bovis AF2122/97
acagcacauccag

SEQ ID NO: 3036325 - RNA, 15 nt, Mycobacterium bovis subsp bovis AF2122/97
acagcacccacgccg

SEQ ID NO: 3036326 - RNA, 17 nt, Mycobacterium bovis subsp bovis AF2122/97
acagcaccccgccgggg

SEQ ID NO: 3036327 - RNA, 20 nt, Mycobacterium bovis subsp bovis AF2122/97
acagcaccccgccgggggca

SEQ ID NO: 3036328 - RNA, 21 nt, Mycobacterium bovis subsp bovis AF2122/97
acagcacccgggccacgucga

SEQ ID NO: 3036329 - RNA, 16 nt, Mycobacterium bovis subsp bovis AF2122/97
acagcaccgaacccgc

SEQ ID NO: 3036330 - RNA, 21 nt, Mycobacterium bovis subsp bovis AF2122/97
acagcaccgaacccgccaccg

SEQ ID NO: 3036331 - RNA, 18 nt, Mycobacterium bovis subsp bovis AF2122/97
acagcaccgccggugcgg

SEQ ID NO: 3036332 - RNA, 12 nt, Mycobacterium bovis subsp bovis AF2122/97
acagcaccgcga

SEQ ID NO: 3036333 - RNA, 15 nt, Mycobacterium bovis subsp bovis AF2122/97
acagcaccguccucg

SEQ ID NO: 3036334 - RNA, 17 nt, Mycobacterium bovis subsp bovis AF2122/97
acagcaccguccucggu

SEQ ID NO: 3036335 - RNA, 20 nt, Mycobacterium bovis subsp bovis AF2122/97
acagcaccguccucggucac

SEQ ID NO: 3036336 - RNA, 12 nt, Mycobacterium bovis subsp bovis AF2122/97
acagcagcaccg

SEQ ID NO: 3036337 - RNA, 15 nt, Mycobacterium bovis subsp bovis AF2122/97
acagcagcaccgcga

SEQ ID NO: 3036338 - RNA, 18 nt, Mycobacterium bovis subsp bovis AF2122/97
acagcagccgccggccgg

SEQ ID NO: 3036339 - RNA, 20 nt, Mycobacterium bovis subsp bovis AF2122/97
acagcagccgccggccggca

SEQ ID NO: 3036340 - RNA, 13 nt, Mycobacterium bovis subsp bovis AF2122/97
acagcagccggug

SEQ ID NO: 3036341 - RNA, 21 nt, Mycobacterium bovis subsp bovis AF2122/97
acagcaggcauucccgcggca

SEQ ID NO: 3036342 - RNA, 21 nt, Mycobacterium bovis subsp bovis AF2122/97
acagcaggccgcgcucgucga

SEQ ID NO: 3036343 - RNA, 22 nt, Mycobacterium bovis subsp bovis AF2122/97
acagcaggcucgaaccgacgcg

SEQ ID NO: 3036344 - RNA, 18 nt, Mycobacterium bovis subsp bovis AF2122/97
acagcaugguuagcggug

SEQ ID NO: 3036345 - RNA, 22 nt, Mycobacterium bovis subsp bovis AF2122/97
acagcaugucgcggacccgcgc

SEQ ID NO: 3036346 - RNA, 23 nt, Mycobacterium bovis subsp bovis AF2122/97
acagcaugucucgggcgcgggug

SEQ ID NO: 3036347 - RNA, 13 nt, Mycobacterium bovis subsp bovis AF2122/97
acagccaccagcc

SEQ ID NO: 3036348 - RNA, 17 nt, Mycobacterium bovis subsp bovis AF2122/97
acagccaccagccgggc

SEQ ID NO: 3036349 - RNA, 17 nt, Mycobacterium bovis subsp bovis AF2122/97
acagccacgcacaauac

SEQ ID NO: 3036350 - RNA, 18 nt, Mycobacterium bovis subsp bovis AF2122/97
acagcccacaggcggcgc

SEQ ID NO: 3036351 - RNA, 12 nt, Mycobacterium bovis subsp bovis AF2122/97
acagcccaccgg

SEQ ID NO: 3036352 - RNA, 18 nt, Mycobacterium bovis subsp bovis AF2122/97
acagccccaucaccaccg

SEQ ID NO: 3036353 - RNA, 19 nt, Mycobacterium bovis subsp bovis AF2122/97
acagccccaucaccaccgg

SEQ ID NO: 3036354 - RNA, 15 nt, Mycobacterium bovis subsp bovis AF2122/97
acagccccgcggcca

SEQ ID NO: 3036355 - RNA, 18 nt, Mycobacterium bovis subsp bovis AF2122/97
acagccccgcggccagca

SEQ ID NO: 3036356 - RNA, 13 nt, Mycobacterium bovis subsp bovis AF2122/97
acagcccgccggc

SEQ ID NO: 3036357 - RNA, 21 nt, Mycobacterium bovis subsp bovis AF2122/97
acagcccggccuugccgccgg

SEQ ID NO: 3036358 - RNA, 21 nt, Mycobacterium bovis subsp bovis AF2122/97
acagcccggcgacgacccggg

SEQ ID NO: 3036359 - RNA, 14 nt, Mycobacterium bovis subsp bovis AF2122/97
acagcccggcggcg

SEQ ID NO: 3036360 - RNA, 11 nt, Mycobacterium bovis subsp bovis AF2122/97
acagccgccga

SEQ ID NO: 3036361 - RNA, 15 nt, Mycobacterium bovis subsp bovis AF2122/97
acagccgccgccggc

SEQ ID NO: 3036362 - RNA, 11 nt, Mycobacterium bovis subsp bovis AF2122/97
acagccggcca

SEQ ID NO: 3036363 - RNA, 23 nt, Mycobacterium bovis subsp bovis AF2122/97
acagccggccaauggccugcagc

SEQ ID NO: 3036364 - RNA, 14 nt, Mycobacterium bovis subsp bovis AF2122/97
acagccgucgcacc

SEQ ID NO: 3036365 - RNA, 12 nt, Mycobacterium bovis subsp bovis AF2122/97
acagcgaacaga

SEQ ID NO: 3036366 - RNA, 17 nt, Mycobacterium bovis subsp bovis AF2122/97
acagcgaacagacaugc

SEQ ID NO: 3036367 - RNA, 23 nt, Mycobacterium bovis subsp bovis AF2122/97
acagcgaacagacaugcgcacca

SEQ ID NO: 3036368 - RNA, 14 nt, Mycobacterium bovis subsp bovis AF2122/97
acagcgaaccgccg

SEQ ID NO: 3036369 - RNA, 13 nt, Mycobacterium bovis subsp bovis AF2122/97
acagcgacagcgu

SEQ ID NO: 3036370 - RNA, 15 nt, Mycobacterium bovis subsp bovis AF2122/97
acagcgacgccaugg

SEQ ID NO: 3036371 - RNA, 13 nt, Mycobacterium bovis subsp bovis AF2122/97
acagcgagcacac

SEQ ID NO: 3036372 - RNA, 22 nt, Mycobacterium bovis subsp bovis AF2122/97
acagcgaguucuggaauccggc

SEQ ID NO: 3036373 - RNA, 17 nt, Mycobacterium bovis subsp bovis AF2122/97
acagcgcaaaaucaccg

SEQ ID NO: 3036374 - RNA, 22 nt, Mycobacterium bovis subsp bovis AF2122/97
acagcgccaucgaugcggugaa

SEQ ID NO: 3036375 - RNA, 15 nt, Mycobacterium bovis subsp bovis AF2122/97
acagcgccaugcccu

SEQ ID NO: 3036376 - RNA, 22 nt, Mycobacterium bovis subsp bovis AF2122/97
acagcgccaugcccucggcgcc

SEQ ID NO: 3036377 - RNA, 23 nt, Mycobacterium bovis subsp bovis AF2122/97
acagcgccuggccggaauacccg

SEQ ID NO: 3036378 - RNA, 17 nt, Mycobacterium bovis subsp bovis AF2122/97
acagcgccuuguuggcg

SEQ ID NO: 3036379 - RNA, 23 nt, Mycobacterium bovis subsp bovis AF2122/97
acagcgcgagaucagccggcagc

SEQ ID NO: 3036380 - RNA, 12 nt, Mycobacterium bovis subsp bovis AF2122/97
acagcgcggcgg

SEQ ID NO: 3036381 - RNA, 22 nt, Mycobacterium bovis subsp bovis AF2122/97
acagcgcgggacacgucgcgcc

SEQ ID NO: 3036382 - RNA, 16 nt, Mycobacterium bovis subsp bovis AF2122/97
acagcgcuacaaacga

SEQ ID NO: 3036383 - RNA, 15 nt, Mycobacterium bovis subsp bovis AF2122/97
acagcggaccccacg

SEQ ID NO: 3036384 - RNA, 15 nt, Mycobacterium bovis subsp bovis AF2122/97
acagcggaucccgcc

SEQ ID NO: 3036385 - RNA, 20 nt, Mycobacterium bovis subsp bovis AF2122/97
acagcggcgauuggcuguga

SEQ ID NO: 3036386 - RNA, 18 nt, Mycobacterium bovis subsp bovis AF2122/97
acagcgggauauggauga

SEQ ID NO: 3036387 - RNA, 14 nt, Mycobacterium bovis subsp bovis AF2122/97
acagcgggaucccg

SEQ ID NO: 3036388 - RNA, 22 nt, Mycobacterium bovis subsp bovis AF2122/97
acagcgggcgcuguagucgcgc

SEQ ID NO: 3036389 - RNA, 17 nt, Mycobacterium bovis subsp bovis AF2122/97
acagcgggggcagcgcg

SEQ ID NO: 3036390 - RNA, 20 nt, Mycobacterium bovis subsp bovis AF2122/97
acagcggguucaacgcgcgc

SEQ ID NO: 3036391 - RNA, 20 nt, Mycobacterium bovis subsp bovis AF2122/97
acagcguccgucgucggcgu

SEQ ID NO: 3036392 - RNA, 18 nt, Mycobacterium bovis subsp bovis AF2122/97
acagcguugccaggugcu

SEQ ID NO: 3036393 - RNA, 21 nt, Mycobacterium bovis subsp bovis AF2122/97
acagcuaucccaggggcaccg

SEQ ID NO: 3036394 - RNA, 22 nt, Mycobacterium bovis subsp bovis AF2122/97
acagcucggccaggcuggccaa

SEQ ID NO: 3036395 - RNA, 15 nt, Mycobacterium bovis subsp bovis AF2122/97
acagcugacgagccg

SEQ ID NO: 3036396 - RNA, 18 nt, Mycobacterium bovis subsp bovis AF2122/97
acagcugacgagccggug

SEQ ID NO: 3036397 - RNA, 20 nt, Mycobacterium bovis subsp bovis AF2122/97
acagcugaucccagaucggc

SEQ ID NO: 3036398 - RNA, 15 nt, Mycobacterium bovis subsp bovis AF2122/97
acagcugcgcacguc

SEQ ID NO: 3036399 - RNA, 16 nt, Mycobacterium bovis subsp bovis AF2122/97
acaucgaggccacgcc

SEQ ID NO: 3036400 - RNA, 19 nt, Mycobacterium bovis subsp bovis AF2122/97
acaucgaggccacgccagc

SEQ ID NO: 3036401 - RNA, 23 nt, Mycobacterium bovis subsp bovis AF2122/97
acaucgaugucagugaucaccaa

SEQ ID NO: 3036402 - RNA, 19 nt, Mycobacterium bovis subsp bovis AF2122/97
acaucgcaggcaccccgau

SEQ ID NO: 3036403 - RNA, 17 nt, Mycobacterium bovis subsp bovis AF2122/97
acaucgccauaccggcc

SEQ ID NO: 3036404 - RNA, 21 nt, Mycobacterium bovis subsp bovis AF2122/97
acaucgccauaccggccgcca

SEQ ID NO: 3036405 - RNA, 19 nt, Mycobacterium bovis subsp bovis AF2122/97
acaucgcccggaaccggcg

SEQ ID NO: 3036406 - RNA, 21 nt, Mycobacterium bovis subsp bovis AF2122/97
acaucgcgaaaccggaccuga

SEQ ID NO: 3036407 - RNA, 15 nt, Mycobacterium bovis subsp bovis AF2122/97
acaucgcgggcgugc

SEQ ID NO: 3036408 - RNA, 19 nt, Mycobacterium bovis subsp bovis AF2122/97
acaucgcgggcgugccgac

SEQ ID NO: 3036409 - RNA, 15 nt, Mycobacterium bovis subsp bovis AF2122/97
acaucggaacgugac

SEQ ID NO: 3036410 - RNA, 19 nt, Mycobacterium bovis subsp bovis AF2122/97
acaucggcccgcugaccau

SEQ ID NO: 3036411 - RNA, 11 nt, Mycobacterium bovis subsp bovis AF2122/97
acaucggccgg

SEQ ID NO: 3036412 - RNA, 14 nt, Mycobacterium bovis subsp bovis AF2122/97
acaucggcggcguc

SEQ ID NO: 3036413 - RNA, 20 nt, Mycobacterium bovis subsp bovis AF2122/97
acaucggcggcgucgacguc

SEQ ID NO: 3036414 - RNA, 18 nt, Mycobacterium bovis subsp bovis AF2122/97
acaucgggaucugggcuc

SEQ ID NO: 3036415 - RNA, 16 nt, Mycobacterium bovis subsp bovis AF2122/97
acaucgggccgccgag

SEQ ID NO: 3036416 - RNA, 23 nt, Mycobacterium bovis subsp bovis AF2122/97
acaucggugccacguucgcgggc

SEQ ID NO: 3036417 - RNA, 18 nt, Mycobacterium bovis subsp bovis AF2122/97
acaucgguggcccggugc

SEQ ID NO: 3036418 - RNA, 15 nt, Mycobacterium bovis subsp bovis AF2122/97
acaucgucacugcca

SEQ ID NO: 3036419 - RNA, 18 nt, Mycobacterium bovis subsp bovis AF2122/97
acaucgucacugccaccu

SEQ ID NO: 3036420 - RNA, 15 nt, Mycobacterium bovis subsp bovis AF2122/97
acaucgucgagcgcg

SEQ ID NO: 3036421 - RNA, 18 nt, Mycobacterium bovis subsp bovis AF2122/97
acaucgucgccagggccg

SEQ ID NO: 3036422 - RNA, 21 nt, Mycobacterium bovis subsp bovis AF2122/97
acaucgucggcgggcggcagc

SEQ ID NO: 3036423 - RNA, 16 nt, Mycobacterium bovis subsp bovis AF2122/97
acaucgugauccccgc

SEQ ID NO: 3036424 - RNA, 23 nt, Mycobacterium bovis subsp bovis AF2122/97
acaucuccgcgucggucagcugu

SEQ ID NO: 3036425 - RNA, 22 nt, Mycobacterium bovis subsp bovis AF2122/97
acaucuugucgaucugcccccg

SEQ ID NO: 3036426 - RNA, 20 nt, Mycobacterium bovis subsp bovis AF2122/97
acaugaauuuccccgguagc

SEQ ID NO: 3036427 - RNA, 19 nt, Mycobacterium bovis subsp bovis AF2122/97
acaugacagccccgccgcc

SEQ ID NO: 3036428 - RNA, 22 nt, Mycobacterium bovis subsp bovis AF2122/97
acaugaccugauccggccgguu

SEQ ID NO: 3036429 - RNA, 14 nt, Mycobacterium bovis subsp bovis AF2122/97
acaugauccgccgg

SEQ ID NO: 3036430 - RNA, 17 nt, Mycobacterium bovis subsp bovis AF2122/97
acaugcaagucgaacgg

SEQ ID NO: 3036431 - RNA, 17 nt, Mycobacterium bovis subsp bovis AF2122/97
acaugccacagcggcga

SEQ ID NO: 3036432 - RNA, 15 nt, Mycobacterium bovis subsp bovis AF2122/97
acaugcccugcgcuc

SEQ ID NO: 3036433 - RNA, 12 nt, Mycobacterium bovis subsp bovis AF2122/97
acaugccggcga

SEQ ID NO: 3036434 - RNA, 16 nt, Mycobacterium bovis subsp bovis AF2122/97
acaugcgcaccauggg

SEQ ID NO: 3036435 - RNA, 20 nt, Mycobacterium bovis subsp bovis AF2122/97
acaugcgccgagauccacgc

SEQ ID NO: 3036436 - RNA, 14 nt, Mycobacterium bovis subsp bovis AF2122/97
acaugcgcucgcgg

SEQ ID NO: 3036437 - RNA, 18 nt, Mycobacterium bovis subsp bovis AF2122/97
acaugcugccgcugcgaa

SEQ ID NO: 3036438 - RNA, 16 nt, Mycobacterium bovis subsp bovis AF2122/97
acaugcuggagaaacc

SEQ ID NO: 3036439 - RNA, 21 nt, Mycobacterium bovis subsp bovis AF2122/97
acauggcggugcgcagcuugg

SEQ ID NO: 3036440 - RNA, 15 nt, Mycobacterium bovis subsp bovis AF2122/97
acaugggugaugcaa

SEQ ID NO: 3036441 - RNA, 21 nt, Mycobacterium bovis subsp bovis AF2122/97
acaugguccgaccagcggccg

SEQ ID NO: 3036442 - RNA, 15 nt, Mycobacterium bovis subsp bovis AF2122/97
acaugguccggccgc

SEQ ID NO: 3036443 - RNA, 18 nt, Mycobacterium bovis subsp bovis AF2122/97
acauggugaccauggccg

SEQ ID NO: 3036444 - RNA, 15 nt, Mycobacterium bovis subsp bovis AF2122/97
acaugucacacccac

SEQ ID NO: 3036445 - RNA, 15 nt, Mycobacterium bovis subsp bovis AF2122/97
acaugugaccggcga

SEQ ID NO: 3036446 - RNA, 18 nt, Mycobacterium bovis subsp bovis AF2122/97
acauguuuucgagcccaa

SEQ ID NO: 3036447 - RNA, 21 nt, Mycobacterium bovis subsp bovis AF2122/97
acauucauccaccccugagcu

SEQ ID NO: 3036448 - RNA, 20 nt, Mycobacterium bovis subsp bovis AF2122/97
acauucugcagcgucuccuu

SEQ ID NO: 3036449 - RNA, 12 nt, Mycobacterium bovis subsp bovis AF2122/97
acauugccaccg

SEQ ID NO: 3036450 - RNA, 19 nt, Mycobacterium bovis subsp bovis AF2122/97
acauugccggccaccagcc

SEQ ID NO: 3036451 - RNA, 19 nt, Mycobacterium bovis subsp bovis AF2122/97
acauugcgcccagcgaccc

SEQ ID NO: 3036452 - RNA, 19 nt, Mycobacterium bovis subsp bovis AF2122/97
acauuggccaggucggcca

SEQ ID NO: 3036453 - RNA, 14 nt, Mycobacterium bovis subsp bovis AF2122/97
acauuggccgucau

SEQ ID NO: 3036454 - RNA, 21 nt, Mycobacterium bovis subsp bovis AF2122/97
acauuggccgucaucgccggg

SEQ ID NO: 3036455 - RNA, 21 nt, Mycobacterium bovis subsp bovis AF2122/97
acauuggugcugacauuucca

SEQ ID NO: 3036456 - RNA, 23 nt, Mycobacterium bovis subsp bovis AF2122/97
acauugguguccaccaccggcac

SEQ ID NO: 3036457 - RNA, 22 nt, Mycobacterium bovis subsp bovis AF2122/97
acauugguguggaauacgcugc

SEQ ID NO: 3036458 - RNA, 21 nt, Mycobacterium bovis subsp bovis AF2122/97
accaaaaggaucaacgugcgc

SEQ ID NO: 3036459 - RNA, 20 nt, Mycobacterium bovis subsp bovis AF2122/97
accaaaauccuucgcgcuca

SEQ ID NO: 3036460 - RNA, 22 nt, Mycobacterium bovis subsp bovis AF2122/97
accaaacccgaugguacucagg

SEQ ID NO: 3036461 - RNA, 20 nt, Mycobacterium bovis subsp bovis AF2122/97
accaaagcgacgagcagcaa

SEQ ID NO: 3036462 - RNA, 20 nt, Mycobacterium bovis subsp bovis AF2122/97
accaacacccccccccccac

SEQ ID NO: 3036463 - RNA, 21 nt, Mycobacterium bovis subsp bovis AF2122/97
accaacacccccccccccacc

SEQ ID NO: 3036464 - RNA, 14 nt, Mycobacterium bovis subsp bovis AF2122/97
accaacaccgcccg

SEQ ID NO: 3036465 - RNA, 16 nt, Mycobacterium bovis subsp bovis AF2122/97
accaacaccgguggcu

SEQ ID NO: 3036466 - RNA, 13 nt, Mycobacterium bovis subsp bovis AF2122/97
accaacacgucga

SEQ ID NO: 3036467 - RNA, 14 nt, Mycobacterium bovis subsp bovis AF2122/97
accaacacgucgag

SEQ ID NO: 3036468 - RNA, 20 nt, Mycobacterium bovis subsp bovis AF2122/97
accaacauguugucgucgcc

SEQ ID NO: 3036469 - RNA, 21 nt, Mycobacterium bovis subsp bovis AF2122/97
accaacauguugucgucgccg

SEQ ID NO: 3036470 - RNA, 22 nt, Mycobacterium bovis subsp bovis AF2122/97
accaacauguugucgucgccgc

SEQ ID NO: 3036471 - RNA, 16 nt, Mycobacterium bovis subsp bovis AF2122/97
accaacccacccccca

SEQ ID NO: 3036472 - RNA, 13 nt, Mycobacterium bovis subsp bovis AF2122/97
accaacccggcuc

SEQ ID NO: 3036473 - RNA, 14 nt, Mycobacterium bovis subsp bovis AF2122/97
accaaccgcgcgag

SEQ ID NO: 3036474 - RNA, 19 nt, Mycobacterium bovis subsp bovis AF2122/97
accaaccgggacaaccccu

SEQ ID NO: 3036475 - RNA, 22 nt, Mycobacterium bovis subsp bovis AF2122/97
accaacgcaacacgggcgccgg

SEQ ID NO: 3036476 - RNA, 21 nt, Mycobacterium bovis subsp bovis AF2122/97
accaacgccaacgccacggca

SEQ ID NO: 3036477 - RNA, 14 nt, Mycobacterium bovis subsp bovis AF2122/97
accaacgccaccgu

SEQ ID NO: 3036478 - RNA, 20 nt, Mycobacterium bovis subsp bovis AF2122/97
accaacgcuucugccugcgc

SEQ ID NO: 3036479 - RNA, 18 nt, Mycobacterium bovis subsp bovis AF2122/97
accaacgucgacuucagc

SEQ ID NO: 3036480 - RNA, 20 nt, Mycobacterium bovis subsp bovis AF2122/97
accaacguuuugggcgccgg

SEQ ID NO: 3036481 - RNA, 15 nt, Mycobacterium bovis subsp bovis AF2122/97
accaacucggcgacc

SEQ ID NO: 3036482 - RNA, 17 nt, Mycobacterium bovis subsp bovis AF2122/97
accaacucggcgaccug

SEQ ID NO: 3036483 - RNA, 19 nt, Mycobacterium bovis subsp bovis AF2122/97
accaagcccgucgucgugc

SEQ ID NO: 3036484 - RNA, 21 nt, Mycobacterium bovis subsp bovis AF2122/97
accaagcgcgguggucgcgac

SEQ ID NO: 3036485 - RNA, 17 nt, Mycobacterium bovis subsp bovis AF2122/97
accaccgcggcggcggc

SEQ ID NO: 3036486 - RNA, 14 nt, Mycobacterium bovis subsp bovis AF2122/97
accaccgcggcugc

SEQ ID NO: 3036487 - RNA, 15 nt, Mycobacterium bovis subsp bovis AF2122/97
accaccgcggcugcu

SEQ ID NO: 3036488 - RNA, 16 nt, Mycobacterium bovis subsp bovis AF2122/97
accaccgcggugugcg

SEQ ID NO: 3036489 - RNA, 13 nt, Mycobacterium bovis subsp bovis AF2122/97
accaccgcucgcc

SEQ ID NO: 3036490 - RNA, 19 nt, Mycobacterium bovis subsp bovis AF2122/97
accaccgcucgucguccgg

SEQ ID NO: 3036491 - RNA, 19 nt, Mycobacterium bovis subsp bovis AF2122/97
accaccgcugccggcgccg

SEQ ID NO: 3036492 - RNA, 15 nt, Mycobacterium bovis subsp bovis AF2122/97
accaccggaacgccg

SEQ ID NO: 3036493 - RNA, 23 nt, Mycobacterium bovis subsp bovis AF2122/97
accaccggaauacgcgccgccgg

SEQ ID NO: 3036494 - RNA, 22 nt, Mycobacterium bovis subsp bovis AF2122/97
accaccggaucgccgucggcgg

SEQ ID NO: 3036495 - RNA, 20 nt, Mycobacterium bovis subsp bovis AF2122/97
accaccggcaacaucagcag

SEQ ID NO: 3036496 - RNA, 13 nt, Mycobacterium bovis subsp bovis AF2122/97
accaccggcaccc

SEQ ID NO: 3036497 - RNA, 14 nt, Mycobacterium bovis subsp bovis AF2122/97
accaccggcacccg

SEQ ID NO: 3036498 - RNA, 14 nt, Mycobacterium bovis subsp bovis AF2122/97
accaccggcaccgc

SEQ ID NO: 3036499 - RNA, 15 nt, Mycobacterium bovis subsp bovis AF2122/97
accaccggcaccgcu

SEQ ID NO: 3036500 - RNA, 14 nt, Mycobacterium bovis subsp bovis AF2122/97
accaccggcacggu

SEQ ID NO: 3036501 - RNA, 12 nt, Mycobacterium bovis subsp bovis AF2122/97
accaccggcccc

SEQ ID NO: 3036502 - RNA, 13 nt, Mycobacterium bovis subsp bovis AF2122/97
accaccggccgcg

SEQ ID NO: 3036503 - RNA, 15 nt, Mycobacterium bovis subsp bovis AF2122/97
accaccggccgcgca

SEQ ID NO: 3036504 - RNA, 15 nt, Mycobacterium bovis subsp bovis AF2122/97
accaccggccguccc

SEQ ID NO: 3036505 - RNA, 16 nt, Mycobacterium bovis subsp bovis AF2122/97
accaccggccgucccg

SEQ ID NO: 3036506 - RNA, 21 nt, Mycobacterium bovis subsp bovis AF2122/97
accaccggccgucccgcgagc

SEQ ID NO: 3036507 - RNA, 24 nt, Mycobacterium bovis subsp bovis AF2122/97
accaccggccgucccgcgagcagc

SEQ ID NO: 3036508 - RNA, 13 nt, Mycobacterium bovis subsp bovis AF2122/97
accaccggcgccg

SEQ ID NO: 3036509 - RNA, 14 nt, Mycobacterium bovis subsp bovis AF2122/97
accaccggcgccgc

SEQ ID NO: 3036510 - RNA, 16 nt, Mycobacterium bovis subsp bovis AF2122/97
accaccggcgccgccg

SEQ ID NO: 3036511 - RNA, 18 nt, Mycobacterium bovis subsp bovis AF2122/97
accaccggcgccgccggc

SEQ ID NO: 3036512 - RNA, 16 nt, Mycobacterium bovis subsp bovis AF2122/97
accaccgggcgcugcu

SEQ ID NO: 3036513 - RNA, 19 nt, Mycobacterium bovis subsp bovis AF2122/97
accaccgguccagcgccgg

SEQ ID NO: 3036514 - RNA, 15 nt, Mycobacterium bovis subsp bovis AF2122/97
accaccgucaccgcc

SEQ ID NO: 3036515 - RNA, 16 nt, Mycobacterium bovis subsp bovis AF2122/97
accaccgucaccgccg

SEQ ID NO: 3036516 - RNA, 18 nt, Mycobacterium bovis subsp bovis AF2122/97
accaccgucaccgccggc

SEQ ID NO: 3036517 - RNA, 19 nt, Mycobacterium bovis subsp bovis AF2122/97
accaccgucaccgccggca

SEQ ID NO: 3036518 - RNA, 14 nt, Mycobacterium bovis subsp bovis AF2122/97
accaccgucgagcc

SEQ ID NO: 3036519 - RNA, 14 nt, Mycobacterium bovis subsp bovis AF2122/97
accaccgucuccgg

SEQ ID NO: 3036520 - RNA, 14 nt, Mycobacterium bovis subsp bovis AF2122/97
accaccgugaccga

SEQ ID NO: 3036521 - RNA, 18 nt, Mycobacterium bovis subsp bovis AF2122/97
accaccguuaccggggug

SEQ ID NO: 3036522 - RNA, 18 nt, Mycobacterium bovis subsp bovis AF2122/97
accaccguuugagcggcc

SEQ ID NO: 3036523 - RNA, 14 nt, Mycobacterium bovis subsp bovis AF2122/97
accaccucagcugc

SEQ ID NO: 3036524 - RNA, 19 nt, Mycobacterium bovis subsp bovis AF2122/97
accaccucggugaccaggc

SEQ ID NO: 3036525 - RNA, 20 nt, Mycobacterium bovis subsp bovis AF2122/97
accaccucggugaccaggcc

SEQ ID NO: 3036526 - RNA, 22 nt, Mycobacterium bovis subsp bovis AF2122/97
accaccucggugaccaggccgg

SEQ ID NO: 3036527 - RNA, 17 nt, Mycobacterium bovis subsp bovis AF2122/97
accaccucgugggccac

SEQ ID NO: 3036528 - RNA, 15 nt, Mycobacterium bovis subsp bovis AF2122/97
accaccuggccggcc

SEQ ID NO: 3036529 - RNA, 18 nt, Mycobacterium bovis subsp bovis AF2122/97
accaccuggugcaaccgu

SEQ ID NO: 3036530 - RNA, 21 nt, Mycobacterium bovis subsp bovis AF2122/97
accaccuggugcaaccgugcc

SEQ ID NO: 3036531 - RNA, 21 nt, Mycobacterium bovis subsp bovis AF2122/97
accaccuuggaugcccugccc

SEQ ID NO: 3036532 - RNA, 16 nt, Mycobacterium bovis subsp bovis AF2122/97
accacgaccgacaccc

SEQ ID NO: 3036533 - RNA, 14 nt, Mycobacterium bovis subsp bovis AF2122/97
accacgacgacgac

SEQ ID NO: 3036534 - RNA, 14 nt, Mycobacterium bovis subsp bovis AF2122/97
accacgacguucga

SEQ ID NO: 3036535 - RNA, 18 nt, Mycobacterium bovis subsp bovis AF2122/97
accacgacguucgacgac

SEQ ID NO: 3036536 - RNA, 13 nt, Mycobacterium bovis subsp bovis AF2122/97
accacgagcagcc

SEQ ID NO: 3036537 - RNA, 18 nt, Mycobacterium bovis subsp bovis AF2122/97
accacgaucgcagugggc

SEQ ID NO: 3036538 - RNA, 21 nt, Mycobacterium bovis subsp bovis AF2122/97
accacgaugaccggggacagc

SEQ ID NO: 3036539 - RNA, 13 nt, Mycobacterium bovis subsp bovis AF2122/97
accacgaugauca

SEQ ID NO: 3036540 - RNA, 14 nt, Mycobacterium bovis subsp bovis AF2122/97
accacgauggcggc

SEQ ID NO: 3036541 - RNA, 20 nt, Mycobacterium bovis subsp bovis AF2122/97
accacgauggcggccaccgu

SEQ ID NO: 3036542 - RNA, 14 nt, Mycobacterium bovis subsp bovis AF2122/97
accacgcaccgccc

SEQ ID NO: 3036543 - RNA, 18 nt, Mycobacterium bovis subsp bovis AF2122/97
accacgcaccgccccgcc

SEQ ID NO: 3036544 - RNA, 17 nt, Mycobacterium bovis subsp bovis AF2122/97
accacgcccgacgagga

SEQ ID NO: 3036545 - RNA, 20 nt, Mycobacterium bovis subsp bovis AF2122/97
accacgcccgacgaggaugu

SEQ ID NO: 3036546 - RNA, 12 nt, Mycobacterium bovis subsp bovis AF2122/97
accacgccgacg

SEQ ID NO: 3036547 - RNA, 16 nt, Mycobacterium bovis subsp bovis AF2122/97
accacgccgccggcgc

SEQ ID NO: 3036548 - RNA, 15 nt, Mycobacterium bovis subsp bovis AF2122/97
accacgccggugacg

SEQ ID NO: 3036549 - RNA, 14 nt, Mycobacterium bovis subsp bovis AF2122/97
accacgccguggcc

SEQ ID NO: 3036550 - RNA, 22 nt, Mycobacterium bovis subsp bovis AF2122/97
accacgccguggcccgcucccu

SEQ ID NO: 3036551 - RNA, 13 nt, Mycobacterium bovis subsp bovis AF2122/97
accacgcgacgcg

SEQ ID NO: 3036552 - RNA, 15 nt, Mycobacterium bovis subsp bovis AF2122/97
accacgcgcccgcac

SEQ ID NO: 3036553 - RNA, 13 nt, Mycobacterium bovis subsp bovis AF2122/97
accacgcggcggu

SEQ ID NO: 3036554 - RNA, 17 nt, Mycobacterium bovis subsp bovis AF2122/97
accacgcuggccucguc

SEQ ID NO: 3036555 - RNA, 13 nt, Mycobacterium bovis subsp bovis AF2122/97
accacgcugugcu

SEQ ID NO: 3036556 - RNA, 23 nt, Mycobacterium bovis subsp bovis AF2122/97
accacgcuuaacagcggguccuu

SEQ ID NO: 3036557 - RNA, 14 nt, Mycobacterium bovis subsp bovis AF2122/97
accacggaccagcg

SEQ ID NO: 3036558 - RNA, 14 nt, Mycobacterium bovis subsp bovis AF2122/97
accacggcaccgau

SEQ ID NO: 3036559 - RNA, 20 nt, Mycobacterium bovis subsp bovis AF2122/97
accacggcaggcagggcagc

SEQ ID NO: 3036560 - RNA, 12 nt, Mycobacterium bovis subsp bovis AF2122/97
accacggccaga

SEQ ID NO: 3036561 - RNA, 20 nt, Mycobacterium bovis subsp bovis AF2122/97
accacggccagaaacccggc

SEQ ID NO: 3036562 - RNA, 14 nt, Mycobacterium bovis subsp bovis AF2122/97
accacggccagcgg

SEQ ID NO: 3036563 - RNA, 14 nt, Mycobacterium bovis subsp bovis AF2122/97
accacggccgccgc

SEQ ID NO: 3036564 - RNA, 14 nt, Mycobacterium bovis subsp bovis AF2122/97
accacggcgauccg

SEQ ID NO: 3036565 - RNA, 19 nt, Mycobacterium bovis subsp bovis AF2122/97
accacggcgauccggucgg

SEQ ID NO: 3036566 - RNA, 22 nt, Mycobacterium bovis subsp bovis AF2122/97
accacggcgauccggucggcca

SEQ ID NO: 3036567 - RNA, 23 nt, Mycobacterium bovis subsp bovis AF2122/97
accacggcgauccggucggccag

SEQ ID NO: 3036568 - RNA, 18 nt, Mycobacterium bovis subsp bovis AF2122/97
accacggcggccaccugc

SEQ ID NO: 3036569 - RNA, 20 nt, Mycobacterium bovis subsp bovis AF2122/97
accacggcguugccgccggc

SEQ ID NO: 3036570 - RNA, 20 nt, Mycobacterium bovis subsp bovis AF2122/97
accacgguagacaagucggc

SEQ ID NO: 3036571 - RNA, 23 nt, Mycobacterium bovis subsp bovis AF2122/97
accacgguagacaagucggcgcu

SEQ ID NO: 3036572 - RNA, 15 nt, Mycobacterium bovis subsp bovis AF2122/97
accagccgugguggu

SEQ ID NO: 3036573 - RNA, 23 nt, Mycobacterium bovis subsp bovis AF2122/97
accagccguggugguugaucagc

SEQ ID NO: 3036574 - RNA, 20 nt, Mycobacterium bovis subsp bovis AF2122/97
accagccuuaugcagugaca

SEQ ID NO: 3036575 - RNA, 18 nt, Mycobacterium bovis subsp bovis AF2122/97
accagccuuuccggccgc

SEQ ID NO: 3036576 - RNA, 21 nt, Mycobacterium bovis subsp bovis AF2122/97
accagccuuuccggccgccug

SEQ ID NO: 3036577 - RNA, 23 nt, Mycobacterium bovis subsp bovis AF2122/97
accagccuuuccggccgccugcc

SEQ ID NO: 3036578 - RNA, 23 nt, Mycobacterium bovis subsp bovis AF2122/97
accagcgaauccagccgcgcgcc

SEQ ID NO: 3036579 - RNA, 15 nt, Mycobacterium bovis subsp bovis AF2122/97
accagcgaccagguc

SEQ ID NO: 3036580 - RNA, 18 nt, Mycobacterium bovis subsp bovis AF2122/97
accagcgaccaggucgcc

SEQ ID NO: 3036581 - RNA, 21 nt, Mycobacterium bovis subsp bovis AF2122/97
accagcgaccaggucgccagc

SEQ ID NO: 3036582 - RNA, 18 nt, Mycobacterium bovis subsp bovis AF2122/97
accagcgacgaccacacc

SEQ ID NO: 3036583 - RNA, 13 nt, Mycobacterium bovis subsp bovis AF2122/97
accagcgacgcca

SEQ ID NO: 3036584 - RNA, 13 nt, Mycobacterium bovis subsp bovis AF2122/97
accagcgaggcca

SEQ ID NO: 3036585 - RNA, 16 nt, Mycobacterium bovis subsp bovis AF2122/97
accagcgaguugagca

SEQ ID NO: 3036586 - RNA, 17 nt, Mycobacterium bovis subsp bovis AF2122/97
accagcgaguugagcau

SEQ ID NO: 3036587 - RNA, 16 nt, Mycobacterium bovis subsp bovis AF2122/97
accagcgcacgcucgg

SEQ ID NO: 3036588 - RNA, 14 nt, Mycobacterium bovis subsp bovis AF2122/97
accagcgcagccga

SEQ ID NO: 3036589 - RNA, 20 nt, Mycobacterium bovis subsp bovis AF2122/97
accagcgcagccgaucgucu

SEQ ID NO: 3036590 - RNA, 14 nt, Mycobacterium bovis subsp bovis AF2122/97
accagcgcaucggc

SEQ ID NO: 3036591 - RNA, 20 nt, Mycobacterium bovis subsp bovis AF2122/97
accagcgcaucggccagcag

SEQ ID NO: 3036592 - RNA, 16 nt, Mycobacterium bovis subsp bovis AF2122/97
accagcgccccggcgc

SEQ ID NO: 3036593 - RNA, 21 nt, Mycobacterium bovis subsp bovis AF2122/97
accagcgccgauaccagccaa

SEQ ID NO: 3036594 - RNA, 19 nt, Mycobacterium bovis subsp bovis AF2122/97
accagcgccgcacccgcuc

SEQ ID NO: 3036595 - RNA, 21 nt, Mycobacterium bovis subsp bovis AF2122/97
accagcgccuugaccagcagc

SEQ ID NO: 3036596 - RNA, 14 nt, Mycobacterium bovis subsp bovis AF2122/97
accagcgcgagccc

SEQ ID NO: 3036597 - RNA, 13 nt, Mycobacterium bovis subsp bovis AF2122/97
accagcgcgccgu

SEQ ID NO: 3036598 - RNA, 21 nt, Mycobacterium bovis subsp bovis AF2122/97
accagcgcgccguagaccagc

SEQ ID NO: 3036599 - RNA, 22 nt, Mycobacterium bovis subsp bovis AF2122/97
accagcgcgccguagaccagca

SEQ ID NO: 3036600 - RNA, 15 nt, Mycobacterium bovis subsp bovis AF2122/97
accagcgcgcgccga

SEQ ID NO: 3036601 - RNA, 17 nt, Mycobacterium bovis subsp bovis AF2122/97
accagcgcuccagcacc

SEQ ID NO: 3036602 - RNA, 21 nt, Mycobacterium bovis subsp bovis AF2122/97
accagcgcuccagcacccgcg

SEQ ID NO: 3036603 - RNA, 22 nt, Mycobacterium bovis subsp bovis AF2122/97
accagcgcuccagcacccgcgc

SEQ ID NO: 3036604 - RNA, 17 nt, Mycobacterium bovis subsp bovis AF2122/97
accagcggcaccgcgcc

SEQ ID NO: 3036605 - RNA, 18 nt, Mycobacterium bovis subsp bovis AF2122/97
accagcggcaccgcggcc

SEQ ID NO: 3036606 - RNA, 18 nt, Mycobacterium bovis subsp bovis AF2122/97
accagcggccgaccgcga

SEQ ID NO: 3036607 - RNA, 13 nt, Mycobacterium bovis subsp bovis AF2122/97
accagcggcggca

SEQ ID NO: 3036608 - RNA, 13 nt, Mycobacterium bovis subsp bovis AF2122/97
accagcggcggcg

SEQ ID NO: 3036609 - RNA, 21 nt, Mycobacterium bovis subsp bovis AF2122/97
accagcgggucggcggugccg

SEQ ID NO: 3036610 - RNA, 13 nt, Mycobacterium bovis subsp bovis AF2122/97
accagcggucagc

SEQ ID NO: 3036611 - RNA, 15 nt, Mycobacterium bovis subsp bovis AF2122/97
accagcggucagccg

SEQ ID NO: 3036612 - RNA, 16 nt, Mycobacterium bovis subsp bovis AF2122/97
accagcggucagccgg

SEQ ID NO: 3036613 - RNA, 21 nt, Mycobacterium bovis subsp bovis AF2122/97
accagcggucggcgaccacca

SEQ ID NO: 3036614 - RNA, 16 nt, Mycobacterium bovis subsp bovis AF2122/97
accagcguccagccgc

SEQ ID NO: 3036615 - RNA, 15 nt, Mycobacterium bovis subsp bovis AF2122/97
accagcgucgcggcc

SEQ ID NO: 3036616 - RNA, 17 nt, Mycobacterium bovis subsp bovis AF2122/97
accagcgucgcggccac

SEQ ID NO: 3036617 - RNA, 23 nt, Mycobacterium bovis subsp bovis AF2122/97
accagcguggggccgccaccagc

SEQ ID NO: 3036618 - RNA, 22 nt, Mycobacterium bovis subsp bovis AF2122/97
accagcguguggagcucgcggc

SEQ ID NO: 3036619 - RNA, 14 nt, Mycobacterium bovis subsp bovis AF2122/97
accagcucagcugc

SEQ ID NO: 3036620 - RNA, 15 nt, Mycobacterium bovis subsp bovis AF2122/97
accagcucagcugcg

SEQ ID NO: 3036621 - RNA, 17 nt, Mycobacterium bovis subsp bovis AF2122/97
accagcucagcugcgga

SEQ ID NO: 3036622 - RNA, 18 nt, Mycobacterium bovis subsp bovis AF2122/97
accagcucggugaucacc

SEQ ID NO: 3036623 - RNA, 16 nt, Mycobacterium bovis subsp bovis AF2122/97
accagcugagccgucg

SEQ ID NO: 3036624 - RNA, 20 nt, Mycobacterium bovis subsp bovis AF2122/97
accagcugagccgucggcgc

SEQ ID NO: 3036625 - RNA, 13 nt, Mycobacterium bovis subsp bovis AF2122/97
accagcugccggc

SEQ ID NO: 3036626 - RNA, 15 nt, Mycobacterium bovis subsp bovis AF2122/97
accagcugucgggca

SEQ ID NO: 3036627 - RNA, 16 nt, Mycobacterium bovis subsp bovis AF2122/97
accagcuugaccgacc

SEQ ID NO: 3036628 - RNA, 16 nt, Mycobacterium bovis subsp bovis AF2122/97
accaggaccaccgcau

SEQ ID NO: 3036629 - RNA, 18 nt, Mycobacterium bovis subsp bovis AF2122/97
accaggacccaucgccag

SEQ ID NO: 3036630 - RNA, 19 nt, Mycobacterium bovis subsp bovis AF2122/97
accaggacccaucgccagc

SEQ ID NO: 3036631 - RNA, 21 nt, Mycobacterium bovis subsp bovis AF2122/97
accaggaccggcugcaggugc

SEQ ID NO: 3036632 - RNA, 18 nt, Mycobacterium bovis subsp bovis AF2122/97
accaggagccuccagcgc

SEQ ID NO: 3036633 - RNA, 13 nt, Mycobacterium bovis subsp bovis AF2122/97
accaggcccgguu

SEQ ID NO: 3036634 - RNA, 16 nt, Mycobacterium bovis subsp bovis AF2122/97
accaggccgaaaucca

SEQ ID NO: 3036635 - RNA, 15 nt, Mycobacterium bovis subsp bovis AF2122/97
accaggccgagccgc

SEQ ID NO: 3036636 - RNA, 20 nt, Mycobacterium bovis subsp bovis AF2122/97
accaggccgagccgcccgcc

SEQ ID NO: 3036637 - RNA, 15 nt, Mycobacterium bovis subsp bovis AF2122/97
accaggccgcgcgca

SEQ ID NO: 3036638 - RNA, 20 nt, Mycobacterium bovis subsp bovis AF2122/97
accaggccgcgcgcaccggu

SEQ ID NO: 3036639 - RNA, 13 nt, Mycobacterium bovis subsp bovis AF2122/97
accaggccggccc

SEQ ID NO: 3036640 - RNA, 17 nt, Mycobacterium bovis subsp bovis AF2122/97
accaggccggcccgcaa

SEQ ID NO: 3036641 - RNA, 20 nt, Mycobacterium bovis subsp bovis AF2122/97
accaggccguccucggucag

SEQ ID NO: 3036642 - RNA, 12 nt, Mycobacterium bovis subsp bovis AF2122/97
accaggcgagcc

SEQ ID NO: 3036643 - RNA, 16 nt, Mycobacterium bovis subsp bovis AF2122/97
accaggcgagccgcca

SEQ ID NO: 3036644 - RNA, 17 nt, Mycobacterium bovis subsp bovis AF2122/97
accaggcgagccgccac

SEQ ID NO: 3036645 - RNA, 15 nt, Mycobacterium bovis subsp bovis AF2122/97
accaggcgagccggc

SEQ ID NO: 3036646 - RNA, 16 nt, Mycobacterium bovis subsp bovis AF2122/97
accaggcggccguaac

SEQ ID NO: 3036647 - RNA, 16 nt, Mycobacterium bovis subsp bovis AF2122/97
accaggcggcgcgggu

SEQ ID NO: 3036648 - RNA, 14 nt, Mycobacterium bovis subsp bovis AF2122/97
accaggcuccggcc

SEQ ID NO: 3036649 - RNA, 16 nt, Mycobacterium bovis subsp bovis AF2122/97
accaggcuccggccgg

SEQ ID NO: 3036650 - RNA, 18 nt, Mycobacterium bovis subsp bovis AF2122/97
accagggacgaugcccuc

SEQ ID NO: 3036651 - RNA, 16 nt, Mycobacterium bovis subsp bovis AF2122/97
accagggcagccgggu

SEQ ID NO: 3036652 - RNA, 16 nt, Mycobacterium bovis subsp bovis AF2122/97
accagggcagcggcca

SEQ ID NO: 3036653 - RNA, 15 nt, Mycobacterium bovis subsp bovis AF2122/97
accagggccaccgcg

SEQ ID NO: 3036654 - RNA, 23 nt, Mycobacterium bovis subsp bovis AF2122/97
accagggccgccgcugccgccug

SEQ ID NO: 3036655 - RNA, 21 nt, Mycobacterium bovis subsp bovis AF2122/97
accagggccuccacccgccac

SEQ ID NO: 3036656 - RNA, 18 nt, Mycobacterium bovis subsp bovis AF2122/97
accagggcgcggaucugc

SEQ ID NO: 3036657 - RNA, 17 nt, Mycobacterium bovis subsp bovis AF2122/97
accaggggaccgcggcg

SEQ ID NO: 3036658 - RNA, 19 nt, Mycobacterium bovis subsp bovis AF2122/97
accaggggaccgcggcgcg

SEQ ID NO: 3036659 - RNA, 15 nt, Mycobacterium bovis subsp bovis AF2122/97
acccaaccgcgccac

SEQ ID NO: 3036660 - RNA, 15 nt, Mycobacterium bovis subsp bovis AF2122/97
acccaacgaccacca

SEQ ID NO: 3036661 - RNA, 16 nt, Mycobacterium bovis subsp bovis AF2122/97
acccaacgaccaccac

SEQ ID NO: 3036662 - RNA, 22 nt, Mycobacterium bovis subsp bovis AF2122/97
acccaacgcggugggcacagcc

SEQ ID NO: 3036663 - RNA, 22 nt, Mycobacterium bovis subsp bovis AF2122/97
acccaacucaugggccaacuca

SEQ ID NO: 3036664 - RNA, 19 nt, Mycobacterium bovis subsp bovis AF2122/97
acccaagaauucaccacuc

SEQ ID NO: 3036665 - RNA, 15 nt, Mycobacterium bovis subsp bovis AF2122/97
acccaagucgccgag

SEQ ID NO: 3036666 - RNA, 22 nt, Mycobacterium bovis subsp bovis AF2122/97
acccaaugccaccgcggccgcg

SEQ ID NO: 3036667 - RNA, 14 nt, Mycobacterium bovis subsp bovis AF2122/97
acccaauggagccg

SEQ ID NO: 3036668 - RNA, 22 nt, Mycobacterium bovis subsp bovis AF2122/97
acccaauucacgacgccgagca

SEQ ID NO: 3036669 - RNA, 22 nt, Mycobacterium bovis subsp bovis AF2122/97
acccacacccagcgugcccgcc

SEQ ID NO: 3036670 - RNA, 23 nt, Mycobacterium bovis subsp bovis AF2122/97
acccacacccagcgugcccgcca

SEQ ID NO: 3036671 - RNA, 22 nt, Mycobacterium bovis subsp bovis AF2122/97
acccacacgcccucgacgccgc

SEQ ID NO: 3036672 - RNA, 14 nt, Mycobacterium bovis subsp bovis AF2122/97
acccacagucgccg

SEQ ID NO: 3036673 - RNA, 18 nt, Mycobacterium bovis subsp bovis AF2122/97
acccacagucgccggccg

SEQ ID NO: 3036674 - RNA, 20 nt, Mycobacterium bovis subsp bovis AF2122/97
acccacaucagccgcaccag

SEQ ID NO: 3036675 - RNA, 21 nt, Mycobacterium bovis subsp bovis AF2122/97
acccacaugacgaucgcggcg

SEQ ID NO: 3036676 - RNA, 15 nt, Mycobacterium bovis subsp bovis AF2122/97
acccaccaauccaca

SEQ ID NO: 3036677 - RNA, 15 nt, Mycobacterium bovis subsp bovis AF2122/97
acccaccaccgcaac

SEQ ID NO: 3036678 - RNA, 21 nt, Mycobacterium bovis subsp bovis AF2122/97
acccaccccccagcgccgccg

SEQ ID NO: 3036679 - RNA, 22 nt, Mycobacterium bovis subsp bovis AF2122/97
acccaccccccagcgccgccgc

SEQ ID NO: 3036680 - RNA, 13 nt, Mycobacterium bovis subsp bovis AF2122/97
acccacccgcacc

SEQ ID NO: 3036681 - RNA, 17 nt, Mycobacterium bovis subsp bovis AF2122/97
acccacccgcaccaccg

SEQ ID NO: 3036682 - RNA, 15 nt, Mycobacterium bovis subsp bovis AF2122/97
acccacccgcaccgc

SEQ ID NO: 3036683 - RNA, 16 nt, Mycobacterium bovis subsp bovis AF2122/97
acccacccgcaccgcc

SEQ ID NO: 3036684 - RNA, 18 nt, Mycobacterium bovis subsp bovis AF2122/97
acccacccgcaccgccgg

SEQ ID NO: 3036685 - RNA, 19 nt, Mycobacterium bovis subsp bovis AF2122/97
acccacccgcaccgccggc

SEQ ID NO: 3036686 - RNA, 19 nt, Mycobacterium bovis subsp bovis AF2122/97
acccaccgccccggcggcg

SEQ ID NO: 3036687 - RNA, 13 nt, Mycobacterium bovis subsp bovis AF2122/97
acccaccggccac

SEQ ID NO: 3036688 - RNA, 14 nt, Mycobacterium bovis subsp bovis AF2122/97
acccaccggccacc

SEQ ID NO: 3036689 - RNA, 20 nt, Mycobacterium bovis subsp bovis AF2122/97
acccaccggccaccagggcc

SEQ ID NO: 3036690 - RNA, 20 nt, Mycobacterium bovis subsp bovis AF2122/97
acccaccguuugggcgccgg

SEQ ID NO: 3036691 - RNA, 16 nt, Mycobacterium bovis subsp bovis AF2122/97
acccaccucccgcagc

SEQ ID NO: 3036692 - RNA, 21 nt, Mycobacterium bovis subsp bovis AF2122/97
acccaccucccgcagccgggc

SEQ ID NO: 3036693 - RNA, 22 nt, Mycobacterium bovis subsp bovis AF2122/97
acccaccucccgcagccgggca

SEQ ID NO: 3036694 - RNA, 16 nt, Mycobacterium bovis subsp bovis AF2122/97
acccacgagagcgcug

SEQ ID NO: 3036695 - RNA, 19 nt, Mycobacterium bovis subsp bovis AF2122/97
acccacgaucagcagcguc

SEQ ID NO: 3036696 - RNA, 12 nt, Mycobacterium bovis subsp bovis AF2122/97
acccacgccgac

SEQ ID NO: 3036697 - RNA, 13 nt, Mycobacterium bovis subsp bovis AF2122/97
acccacuccgccg

SEQ ID NO: 3036698 - RNA, 15 nt, Mycobacterium bovis subsp bovis AF2122/97
acccacuccgccgau

SEQ ID NO: 3036699 - RNA, 16 nt, Mycobacterium bovis subsp bovis AF2122/97
acccacugcacggagc

SEQ ID NO: 3036700 - RNA, 18 nt, Mycobacterium bovis subsp bovis AF2122/97
acccacugcacggagccg

SEQ ID NO: 3036701 - RNA, 23 nt, Mycobacterium bovis subsp bovis AF2122/97
acccacugcacggagccgccggc

SEQ ID NO: 3036702 - RNA, 17 nt, Mycobacterium bovis subsp bovis AF2122/97
acccacugcccgccgac

SEQ ID NO: 3036703 - RNA, 20 nt, Mycobacterium bovis subsp bovis AF2122/97
acccacuuucgacccgcggc

SEQ ID NO: 3036704 - RNA, 21 nt, Mycobacterium bovis subsp bovis AF2122/97
acccacuuucgacccgcggcg

SEQ ID NO: 3036705 - RNA, 22 nt, Mycobacterium bovis subsp bovis AF2122/97
acccacuuucgacccgcggcgg

SEQ ID NO: 3036706 - RNA, 18 nt, Mycobacterium bovis subsp bovis AF2122/97
acccacuuuucgguggcg

SEQ ID NO: 3036707 - RNA, 23 nt, Mycobacterium bovis subsp bovis AF2122/97
acccacuuuucgguggcggcagc

SEQ ID NO: 3036708 - RNA, 15 nt, Mycobacterium bovis subsp bovis AF2122/97
acccagaaugacauc

SEQ ID NO: 3036709 - RNA, 20 nt, Mycobacterium bovis subsp bovis AF2122/97
acccagaaugacaucgucgc

SEQ ID NO: 3036710 - RNA, 15 nt, Mycobacterium bovis subsp bovis AF2122/97
acccagaauuccggc

SEQ ID NO: 3036711 - RNA, 18 nt, Mycobacterium bovis subsp bovis AF2122/97
acccagaauuccggcgga

SEQ ID NO: 3036712 - RNA, 19 nt, Mycobacterium bovis subsp bovis AF2122/97
acccagaauuccggcggag

SEQ ID NO: 3036713 - RNA, 17 nt, Mycobacterium bovis subsp bovis AF2122/97
acccagacaccggcuau

SEQ ID NO: 3036714 - RNA, 15 nt, Mycobacterium bovis subsp bovis AF2122/97
acccagaccgccgaa

SEQ ID NO: 3036715 - RNA, 16 nt, Mycobacterium bovis subsp bovis AF2122/97
acccagaucggcgacg

SEQ ID NO: 3036716 - RNA, 21 nt, Mycobacterium bovis subsp bovis AF2122/97
acccagaucggcgacgccguc

SEQ ID NO: 3036717 - RNA, 15 nt, Mycobacterium bovis subsp bovis AF2122/97
acccagaugcaggcu

SEQ ID NO: 3036718 - RNA, 17 nt, Mycobacterium bovis subsp bovis AF2122/97
acccagcaccagggcgc

SEQ ID NO: 3036719 - RNA, 14 nt, Mycobacterium bovis subsp bovis AF2122/97
acccagcacgcgcg

SEQ ID NO: 3036720 - RNA, 15 nt, Mycobacterium bovis subsp bovis AF2122/97
acccagcacgcgcgc

SEQ ID NO: 3036721 - RNA, 16 nt, Mycobacterium bovis subsp bovis AF2122/97
acccagcacgcgcgcg

SEQ ID NO: 3036722 - RNA, 15 nt, Mycobacterium bovis subsp bovis AF2122/97
acccagccagccgcg

SEQ ID NO: 3036723 - RNA, 14 nt, Mycobacterium bovis subsp bovis AF2122/97
acccagcccagccg

SEQ ID NO: 3036724 - RNA, 17 nt, Mycobacterium bovis subsp bovis AF2122/97
acccagcccagccguuc

SEQ ID NO: 3036725 - RNA, 14 nt, Mycobacterium bovis subsp bovis AF2122/97
acccagccgcagcc

SEQ ID NO: 3036726 - RNA, 13 nt, Mycobacterium bovis subsp bovis AF2122/97
acccagccggccu

SEQ ID NO: 3036727 - RNA, 12 nt, Mycobacterium bovis subsp bovis AF2122/97
acccagcgcagc

SEQ ID NO: 3036728 - RNA, 18 nt, Mycobacterium bovis subsp bovis AF2122/97
acccagcgcagcagcggc

SEQ ID NO: 3036729 - RNA, 12 nt, Mycobacterium bovis subsp bovis AF2122/97
acccagcgcccg

SEQ ID NO: 3036730 - RNA, 15 nt, Mycobacterium bovis subsp bovis AF2122/97
acccagcgcccggcc

SEQ ID NO: 3036731 - RNA, 17 nt, Mycobacterium bovis subsp bovis AF2122/97
acccagcgcccggccac

SEQ ID NO: 3036732 - RNA, 16 nt, Mycobacterium bovis subsp bovis AF2122/97
acccagcggcgccacg

SEQ ID NO: 3036733 - RNA, 17 nt, Mycobacterium bovis subsp bovis AF2122/97
acccagcggcgccacgu

SEQ ID NO: 3036734 - RNA, 14 nt, Mycobacterium bovis subsp bovis AF2122/97
acccagcgggucgc

SEQ ID NO: 3036735 - RNA, 19 nt, Mycobacterium bovis subsp bovis AF2122/97
acccagcgguaucccccag

SEQ ID NO: 3036736 - RNA, 14 nt, Mycobacterium bovis subsp bovis AF2122/97
acccagcgugcccg

SEQ ID NO: 3036737 - RNA, 16 nt, Mycobacterium bovis subsp bovis AF2122/97
acccagcgugcccgcc

SEQ ID NO: 3036738 - RNA, 17 nt, Mycobacterium bovis subsp bovis AF2122/97
acccagcgugcccgcca

SEQ ID NO: 3036739 - RNA, 18 nt, Mycobacterium bovis subsp bovis AF2122/97
acccagcgugcccgccac

SEQ ID NO: 3036740 - RNA, 21 nt, Mycobacterium bovis subsp bovis AF2122/97
acccagcgugcccgccaccgg

SEQ ID NO: 3036741 - RNA, 22 nt, Mycobacterium bovis subsp bovis AF2122/97
acccagcgugcccgccaccggc

SEQ ID NO: 3036742 - RNA, 17 nt, Mycobacterium bovis subsp bovis AF2122/97
acccagcucgcgcaccc

SEQ ID NO: 3036743 - RNA, 18 nt, Mycobacterium bovis subsp bovis AF2122/97
acccagcucgucgacguc

SEQ ID NO: 3036744 - RNA, 17 nt, Mycobacterium bovis subsp bovis AF2122/97
acccagcugggucccgc

SEQ ID NO: 3036745 - RNA, 18 nt, Mycobacterium bovis subsp bovis AF2122/97
acccagcugggucccgcu

SEQ ID NO: 3036746 - RNA, 16 nt, Mycobacterium bovis subsp bovis AF2122/97
accccgaucacccgca

SEQ ID NO: 3036747 - RNA, 23 nt, Mycobacterium bovis subsp bovis AF2122/97
accccgauucgugucggugcgcg

SEQ ID NO: 3036748 - RNA, 14 nt, Mycobacterium bovis subsp bovis AF2122/97
accccgcagcucac

SEQ ID NO: 3036749 - RNA, 17 nt, Mycobacterium bovis subsp bovis AF2122/97
accccgcagcucaccuc

SEQ ID NO: 3036750 - RNA, 12 nt, Mycobacterium bovis subsp bovis AF2122/97
accccgccagcc

SEQ ID NO: 3036751 - RNA, 17 nt, Mycobacterium bovis subsp bovis AF2122/97
accccgccaugcggcgc

SEQ ID NO: 3036752 - RNA, 22 nt, Mycobacterium bovis subsp bovis AF2122/97
accccgccaugcggcgcgucgc

SEQ ID NO: 3036753 - RNA, 12 nt, Mycobacterium bovis subsp bovis AF2122/97
accccgccgagc

SEQ ID NO: 3036754 - RNA, 16 nt, Mycobacterium bovis subsp bovis AF2122/97
accccgccgagcgguu

SEQ ID NO: 3036755 - RNA, 15 nt, Mycobacterium bovis subsp bovis AF2122/97
accccgccgaucacc

SEQ ID NO: 3036756 - RNA, 12 nt, Mycobacterium bovis subsp bovis AF2122/97
accccgccgcca

SEQ ID NO: 3036757 - RNA, 18 nt, Mycobacterium bovis subsp bovis AF2122/97
accccgccgggggcaccg

SEQ ID NO: 3036758 - RNA, 15 nt, Mycobacterium bovis subsp bovis AF2122/97
accccgcgcgccagc

SEQ ID NO: 3036759 - RNA, 17 nt, Mycobacterium bovis subsp bovis AF2122/97
accccgcgcgccagcuc

SEQ ID NO: 3036760 - RNA, 19 nt, Mycobacterium bovis subsp bovis AF2122/97
accccgcgcgccagcucgg

SEQ ID NO: 3036761 - RNA, 16 nt, Mycobacterium bovis subsp bovis AF2122/97
accccgcgcggugccc

SEQ ID NO: 3036762 - RNA, 21 nt, Mycobacterium bovis subsp bovis AF2122/97
accccgcgcggugcccugccg

SEQ ID NO: 3036763 - RNA, 15 nt, Mycobacterium bovis subsp bovis AF2122/97
accccgcgguagccg

SEQ ID NO: 3036764 - RNA, 19 nt, Mycobacterium bovis subsp bovis AF2122/97
accccgcguaugccaggac

SEQ ID NO: 3036765 - RNA, 22 nt, Mycobacterium bovis subsp bovis AF2122/97
accccgcuuuuucccggcggcg

SEQ ID NO: 3036766 - RNA, 15 nt, Mycobacterium bovis subsp bovis AF2122/97
accccggaaucccca

SEQ ID NO: 3036767 - RNA, 18 nt, Mycobacterium bovis subsp bovis AF2122/97
accccggaauccccaagc

SEQ ID NO: 3036768 - RNA, 22 nt, Mycobacterium bovis subsp bovis AF2122/97
accccggaauccccaagcccga

SEQ ID NO: 3036769 - RNA, 19 nt, Mycobacterium bovis subsp bovis AF2122/97
accccggcauacaacuggu

SEQ ID NO: 3036770 - RNA, 20 nt, Mycobacterium bovis subsp bovis AF2122/97
accccggcauacaacuggug

SEQ ID NO: 3036771 - RNA, 13 nt, Mycobacterium bovis subsp bovis AF2122/97
accccggccacca

SEQ ID NO: 3036772 - RNA, 14 nt, Mycobacterium bovis subsp bovis AF2122/97
accccggccaccag

SEQ ID NO: 3036773 - RNA, 18 nt, Mycobacterium bovis subsp bovis AF2122/97
accccggccaccagcaug

SEQ ID NO: 3036774 - RNA, 14 nt, Mycobacterium bovis subsp bovis AF2122/97
accccggccacuug

SEQ ID NO: 3036775 - RNA, 21 nt, Mycobacterium bovis subsp bovis AF2122/97
accccggccccgacggucaac

SEQ ID NO: 3036776 - RNA, 11 nt, Mycobacterium bovis subsp bovis AF2122/97
accccggcccg

SEQ ID NO: 3036777 - RNA, 12 nt, Mycobacterium bovis subsp bovis AF2122/97
accccggccggc

SEQ ID NO: 3036778 - RNA, 13 nt, Mycobacterium bovis subsp bovis AF2122/97
accccggccggcu

SEQ ID NO: 3036779 - RNA, 18 nt, Mycobacterium bovis subsp bovis AF2122/97
accccggccuugccaccg

SEQ ID NO: 3036780 - RNA, 15 nt, Mycobacterium bovis subsp bovis AF2122/97
accccggcgguaccg

SEQ ID NO: 3036781 - RNA, 15 nt, Mycobacterium bovis subsp bovis AF2122/97
accccggcggucagg

SEQ ID NO: 3036782 - RNA, 16 nt, Mycobacterium bovis subsp bovis AF2122/97
accccggcguugccgc

SEQ ID NO: 3036783 - RNA, 12 nt, Mycobacterium bovis subsp bovis AF2122/97
accccggcucga

SEQ ID NO: 3036784 - RNA, 16 nt, Mycobacterium bovis subsp bovis AF2122/97
accccggcucggccac

SEQ ID NO: 3036785 - RNA, 18 nt, Mycobacterium bovis subsp bovis AF2122/97
accccggguacgccgggc

SEQ ID NO: 3036786 - RNA, 13 nt, Mycobacterium bovis subsp bovis AF2122/97
accccggucccgc

SEQ ID NO: 3036787 - RNA, 16 nt, Mycobacterium bovis subsp bovis AF2122/97
accccggucccgccga

SEQ ID NO: 3036788 - RNA, 21 nt, Mycobacterium bovis subsp bovis AF2122/97
accccggucggagcggugccg

SEQ ID NO: 3036789 - RNA, 14 nt, Mycobacterium bovis subsp bovis AF2122/97
accccggucggccc

SEQ ID NO: 3036790 - RNA, 15 nt, Mycobacterium bovis subsp bovis AF2122/97
accccggugcccgcg

SEQ ID NO: 3036791 - RNA, 16 nt, Mycobacterium bovis subsp bovis AF2122/97
accccggugcccgcgg

SEQ ID NO: 3036792 - RNA, 19 nt, Mycobacterium bovis subsp bovis AF2122/97
accccguaggcgccgaacc

SEQ ID NO: 3036793 - RNA, 23 nt, Mycobacterium bovis subsp bovis AF2122/97
accccguaggcgccgaaccagcg

SEQ ID NO: 3036794 - RNA, 15 nt, Mycobacterium bovis subsp bovis AF2122/97
accccguaggugcac

SEQ ID NO: 3036795 - RNA, 18 nt, Mycobacterium bovis subsp bovis AF2122/97
accccgucagcgggcagc

SEQ ID NO: 3036796 - RNA, 17 nt, Mycobacterium bovis subsp bovis AF2122/97
accccguccucgaucgc

SEQ ID NO: 3036797 - RNA, 18 nt, Mycobacterium bovis subsp bovis AF2122/97
accccguccucgaucgcg

SEQ ID NO: 3036798 - RNA, 22 nt, Mycobacterium bovis subsp bovis AF2122/97
accccguuccacgaucacccgg

SEQ ID NO: 3036799 - RNA, 13 nt, Mycobacterium bovis subsp bovis AF2122/97
accccucacccag

SEQ ID NO: 3036800 - RNA, 22 nt, Mycobacterium bovis subsp bovis AF2122/97
accccucacccagcuggguccc

SEQ ID NO: 3036801 - RNA, 16 nt, Mycobacterium bovis subsp bovis AF2122/97
accccuggccgccggc

SEQ ID NO: 3036802 - RNA, 17 nt, Mycobacterium bovis subsp bovis AF2122/97
accccuggccgccggcg

SEQ ID NO: 3036803 - RNA, 18 nt, Mycobacterium bovis subsp bovis AF2122/97
accccuggccgccggcgc

SEQ ID NO: 3036804 - RNA, 20 nt, Mycobacterium bovis subsp bovis AF2122/97
accccuggccgccggcgccg

SEQ ID NO: 3036805 - RNA, 21 nt, Mycobacterium bovis subsp bovis AF2122/97
accccuggguugaggaucccg

SEQ ID NO: 3036806 - RNA, 17 nt, Mycobacterium bovis subsp bovis AF2122/97
accccugguagcaccca

SEQ ID NO: 3036807 - RNA, 19 nt, Mycobacterium bovis subsp bovis AF2122/97
accccugguagcacccacg

SEQ ID NO: 3036808 - RNA, 21 nt, Mycobacterium bovis subsp bovis AF2122/97
accccugguagcacccacggc

SEQ ID NO: 3036809 - RNA, 20 nt, Mycobacterium bovis subsp bovis AF2122/97
accccugucgggucgagucc

SEQ ID NO: 3036810 - RNA, 21 nt, Mycobacterium bovis subsp bovis AF2122/97
accccuucgccagcgccacug

SEQ ID NO: 3036811 - RNA, 23 nt, Mycobacterium bovis subsp bovis AF2122/97
accccuugccuuccgacccaacg

SEQ ID NO: 3036812 - RNA, 14 nt, Mycobacterium bovis subsp bovis AF2122/97
acccgaaacaccgu

SEQ ID NO: 3036813 - RNA, 19 nt, Mycobacterium bovis subsp bovis AF2122/97
acccgaaacaccgucuggc

SEQ ID NO: 3036814 - RNA, 19 nt, Mycobacterium bovis subsp bovis AF2122/97
acccgaacugggcgaucga

SEQ ID NO: 3036815 - RNA, 23 nt, Mycobacterium bovis subsp bovis AF2122/97
acccgaagauuuugggcgccgac

SEQ ID NO: 3036816 - RNA, 14 nt, Mycobacterium bovis subsp bovis AF2122/97
acccgaagccggcg

SEQ ID NO: 3036817 - RNA, 15 nt, Mycobacterium bovis subsp bovis AF2122/97
acccgaagccggcgc

SEQ ID NO: 3036818 - RNA, 23 nt, Mycobacterium bovis subsp bovis AF2122/97
acccgaauacugaucuuggcccg

SEQ ID NO: 3036819 - RNA, 15 nt, Mycobacterium bovis subsp bovis AF2122/97
acccgaauccaccag

SEQ ID NO: 3036820 - RNA, 18 nt, Mycobacterium bovis subsp bovis AF2122/97
acccgacaacgcugggcg

SEQ ID NO: 3036821 - RNA, 19 nt, Mycobacterium bovis subsp bovis AF2122/97
acccgacaacgcugggcgg

SEQ ID NO: 3036822 - RNA, 17 nt, Mycobacterium bovis subsp bovis AF2122/97
acccgacaugcgccgag

SEQ ID NO: 3036823 - RNA, 19 nt, Mycobacterium bovis subsp bovis AF2122/97
acccgacaugguccgacca

SEQ ID NO: 3036824 - RNA, 13 nt, Mycobacterium bovis subsp bovis AF2122/97
acccgaccagcac

SEQ ID NO: 3036825 - RNA, 13 nt, Mycobacterium bovis subsp bovis AF2122/97
acccgaccgccau

SEQ ID NO: 3036826 - RNA, 18 nt, Mycobacterium bovis subsp bovis AF2122/97
acccgaccgucgucgugc

SEQ ID NO: 3036827 - RNA, 14 nt, Mycobacterium bovis subsp bovis AF2122/97
acccgacgaugccg

SEQ ID NO: 3036828 - RNA, 15 nt, Mycobacterium bovis subsp bovis AF2122/97
acccgagaucaccgg

SEQ ID NO: 3036829 - RNA, 16 nt, Mycobacterium bovis subsp bovis AF2122/97
acccgagaucaccggu

SEQ ID NO: 3036830 - RNA, 18 nt, Mycobacterium bovis subsp bovis AF2122/97
acccgagcaacggcggca

SEQ ID NO: 3036831 - RNA, 12 nt, Mycobacterium bovis subsp bovis AF2122/97
acccgagccgcc

SEQ ID NO: 3036832 - RNA, 14 nt, Mycobacterium bovis subsp bovis AF2122/97
acccgagccgccgu

SEQ ID NO: 3036833 - RNA, 22 nt, Mycobacterium bovis subsp bovis AF2122/97
acccgccuaaagcgugucgccc

SEQ ID NO: 3036834 - RNA, 23 nt, Mycobacterium bovis subsp bovis AF2122/97
acccgccuaaagcgugucgcccu

SEQ ID NO: 3036835 - RNA, 19 nt, Mycobacterium bovis subsp bovis AF2122/97
acccgccucgggccggcgu

SEQ ID NO: 3036836 - RNA, 19 nt, Mycobacterium bovis subsp bovis AF2122/97
acccgccuguaccggcguu

SEQ ID NO: 3036837 - RNA, 20 nt, Mycobacterium bovis subsp bovis AF2122/97
acccgcgaacgcgacagcca

SEQ ID NO: 3036838 - RNA, 20 nt, Mycobacterium bovis subsp bovis AF2122/97
acccgcgagaucgggccggc

SEQ ID NO: 3036839 - RNA, 23 nt, Mycobacterium bovis subsp bovis AF2122/97
acccgcgagaucgggccggccgc

SEQ ID NO: 3036840 - RNA, 18 nt, Mycobacterium bovis subsp bovis AF2122/97
acccgcgagcaucgacga

SEQ ID NO: 3036841 - RNA, 20 nt, Mycobacterium bovis subsp bovis AF2122/97
acccgcgagcaucgacgaac

SEQ ID NO: 3036842 - RNA, 21 nt, Mycobacterium bovis subsp bovis AF2122/97
acccgcgagguugaccaccag

SEQ ID NO: 3036843 - RNA, 14 nt, Mycobacterium bovis subsp bovis AF2122/97
acccgcgccgcgca

SEQ ID NO: 3036844 - RNA, 16 nt, Mycobacterium bovis subsp bovis AF2122/97
acccgcgccgcgcauc

SEQ ID NO: 3036845 - RNA, 21 nt, Mycobacterium bovis subsp bovis AF2122/97
acccgcgccgcgcaucgcggc

SEQ ID NO: 3036846 - RNA, 15 nt, Mycobacterium bovis subsp bovis AF2122/97
acccgcgccggccgc

SEQ ID NO: 3036847 - RNA, 15 nt, Mycobacterium bovis subsp bovis AF2122/97
acccgcgcgcaccag

SEQ ID NO: 3036848 - RNA, 12 nt, Mycobacterium bovis subsp bovis AF2122/97
acccgcgcgccg

SEQ ID NO: 3036849 - RNA, 13 nt, Mycobacterium bovis subsp bovis AF2122/97
acccgcgcgccgg

SEQ ID NO: 3036850 - RNA, 15 nt, Mycobacterium bovis subsp bovis AF2122/97
acccgcgcgccggcg

SEQ ID NO: 3036851 - RNA, 16 nt, Mycobacterium bovis subsp bovis AF2122/97
acccgcgcgccggcga

SEQ ID NO: 3036852 - RNA, 15 nt, Mycobacterium bovis subsp bovis AF2122/97
acccgcgcgucgccc

SEQ ID NO: 3036853 - RNA, 12 nt, Mycobacterium bovis subsp bovis AF2122/97
acccgcggcagc

SEQ ID NO: 3036854 - RNA, 13 nt, Mycobacterium bovis subsp bovis AF2122/97
acccgcggcgccg

SEQ ID NO: 3036855 - RNA, 15 nt, Mycobacterium bovis subsp bovis AF2122/97
acccgcggcgccguu

SEQ ID NO: 3036856 - RNA, 12 nt, Mycobacterium bovis subsp bovis AF2122/97
acccgcggcgcg

SEQ ID NO: 3036857 - RNA, 20 nt, Mycobacterium bovis subsp bovis AF2122/97
acccgcggggaaucacccac

SEQ ID NO: 3036858 - RNA, 17 nt, Mycobacterium bovis subsp bovis AF2122/97
acccgcgggucguccgg

SEQ ID NO: 3036859 - RNA, 19 nt, Mycobacterium bovis subsp bovis AF2122/97
acccgcgggucguccggcg

SEQ ID NO: 3036860 - RNA, 21 nt, Mycobacterium bovis subsp bovis AF2122/97
acccgcgggucguccggcggc

SEQ ID NO: 3036861 - RNA, 22 nt, Mycobacterium bovis subsp bovis AF2122/97
acccgcgggucguccggcggca

SEQ ID NO: 3036862 - RNA, 23 nt, Mycobacterium bovis subsp bovis AF2122/97
acccgcgggugauguucguaaag

SEQ ID NO: 3036863 - RNA, 21 nt, Mycobacterium bovis subsp bovis AF2122/97
acccgcggugacgccagccug

SEQ ID NO: 3036864 - RNA, 19 nt, Mycobacterium bovis subsp bovis AF2122/97
acccgcggugccugcagcu

SEQ ID NO: 3036865 - RNA, 15 nt, Mycobacterium bovis subsp bovis AF2122/97
acccgcguaccacgg

SEQ ID NO: 3036866 - RNA, 20 nt, Mycobacterium bovis subsp bovis AF2122/97
acccgcgucgagugccgcca

SEQ ID NO: 3036867 - RNA, 23 nt, Mycobacterium bovis subsp bovis AF2122/97
acccgcgucgagugccgccaccg

SEQ ID NO: 3036868 - RNA, 20 nt, Mycobacterium bovis subsp bovis AF2122/97
acccgcguugaaggcgccgg

SEQ ID NO: 3036869 - RNA, 15 nt, Mycobacterium bovis subsp bovis AF2122/97
acccgcuacgacggu

SEQ ID NO: 3036870 - RNA, 18 nt, Mycobacterium bovis subsp bovis AF2122/97
acccgcuacgacgguccg

SEQ ID NO: 3036871 - RNA, 23 nt, Mycobacterium bovis subsp bovis AF2122/97
acccgcucacgcucacccggcgu

SEQ ID NO: 3036872 - RNA, 13 nt, Mycobacterium bovis subsp bovis AF2122/97
acccgcuccaccc

SEQ ID NO: 3036873 - RNA, 15 nt, Mycobacterium bovis subsp bovis AF2122/97
acccgcuccaccccu

SEQ ID NO: 3036874 - RNA, 18 nt, Mycobacterium bovis subsp bovis AF2122/97
acccgcucccgugcuggc

SEQ ID NO: 3036875 - RNA, 13 nt, Mycobacterium bovis subsp bovis AF2122/97
acccgcucgcccg

SEQ ID NO: 3036876 - RNA, 14 nt, Mycobacterium bovis subsp bovis AF2122/97
acccgcucggccgc

SEQ ID NO: 3036877 - RNA, 19 nt, Mycobacterium bovis subsp bovis AF2122/97
acccgcucggccgccgggu

SEQ ID NO: 3036878 - RNA, 15 nt, Mycobacterium bovis subsp bovis AF2122/97
acccgcucggcgcgc

SEQ ID NO: 3036879 - RNA, 19 nt, Mycobacterium bovis subsp bovis AF2122/97
acccgcucggcggucggga

SEQ ID NO: 3036880 - RNA, 16 nt, Mycobacterium bovis subsp bovis AF2122/97
acccgcugcacgccgu

SEQ ID NO: 3036881 - RNA, 18 nt, Mycobacterium bovis subsp bovis AF2122/97
acccgcuggcccgccaga

SEQ ID NO: 3036882 - RNA, 20 nt, Mycobacterium bovis subsp bovis AF2122/97
acccgcuggcucaucgaagc

SEQ ID NO: 3036883 - RNA, 23 nt, Mycobacterium bovis subsp bovis AF2122/97
acccgcuuucggaaaaccgcacc

SEQ ID NO: 3036884 - RNA, 16 nt, Mycobacterium bovis subsp bovis AF2122/97
acccggaaccagccgc

SEQ ID NO: 3036885 - RNA, 19 nt, Mycobacterium bovis subsp bovis AF2122/97
acccggaaccagccgcgga

SEQ ID NO: 3036886 - RNA, 15 nt, Mycobacterium bovis subsp bovis AF2122/97
acccggaagaacucg

SEQ ID NO: 3036887 - RNA, 15 nt, Mycobacterium bovis subsp bovis AF2122/97
acccggaaucgucgc

SEQ ID NO: 3036888 - RNA, 20 nt, Mycobacterium bovis subsp bovis AF2122/97
acccggacauagccgcgcuc

SEQ ID NO: 3036889 - RNA, 16 nt, Mycobacterium bovis subsp bovis AF2122/97
acccggacgaacgccg

SEQ ID NO: 3036890 - RNA, 17 nt, Mycobacterium bovis subsp bovis AF2122/97
acccggagaaucggucc

SEQ ID NO: 3036891 - RNA, 14 nt, Mycobacterium bovis subsp bovis AF2122/97
acccggagccgcca

SEQ ID NO: 3036892 - RNA, 15 nt, Mycobacterium bovis subsp bovis AF2122/97
acccggaugucgugc

SEQ ID NO: 3036893 - RNA, 14 nt, Mycobacterium bovis subsp bovis AF2122/97
acccggcagcccgg

SEQ ID NO: 3036894 - RNA, 15 nt, Mycobacterium bovis subsp bovis AF2122/97
acccggccagcggca

SEQ ID NO: 3036895 - RNA, 17 nt, Mycobacterium bovis subsp bovis AF2122/97
acccggccagcggcagg

SEQ ID NO: 3036896 - RNA, 22 nt, Mycobacterium bovis subsp bovis AF2122/97
acccggccaggaguuugaccac

SEQ ID NO: 3036897 - RNA, 22 nt, Mycobacterium bovis subsp bovis AF2122/97
acccggccagguauguccgcca

SEQ ID NO: 3036898 - RNA, 21 nt, Mycobacterium bovis subsp bovis AF2122/97
acccggcccauugucgaucac

SEQ ID NO: 3036899 - RNA, 21 nt, Mycobacterium bovis subsp bovis AF2122/97
acccggccgaccucggcaacg

SEQ ID NO: 3036900 - RNA, 12 nt, Mycobacterium bovis subsp bovis AF2122/97
acccggccgccg

SEQ ID NO: 3036901 - RNA, 13 nt, Mycobacterium bovis subsp bovis AF2122/97
acccggccgccga

SEQ ID NO: 3036902 - RNA, 22 nt, Mycobacterium bovis subsp bovis AF2122/97
acccggccgccgaaacucacca

SEQ ID NO: 3036903 - RNA, 13 nt, Mycobacterium bovis subsp bovis AF2122/97
acccggccgcgca

SEQ ID NO: 3036904 - RNA, 20 nt, Mycobacterium bovis subsp bovis AF2122/97
acccggccgggccugcacca

SEQ ID NO: 3036905 - RNA, 23 nt, Mycobacterium bovis subsp bovis AF2122/97
acccggccguugggccaccggcg

SEQ ID NO: 3036906 - RNA, 14 nt, Mycobacterium bovis subsp bovis AF2122/97
acccggccucggug

SEQ ID NO: 3036907 - RNA, 14 nt, Mycobacterium bovis subsp bovis AF2122/97
acccggccuucucc

SEQ ID NO: 3036908 - RNA, 15 nt, Mycobacterium bovis subsp bovis AF2122/97
acccggcgaccacgg

SEQ ID NO: 3036909 - RNA, 21 nt, Mycobacterium bovis subsp bovis AF2122/97
acccggcgaccacggcaccga

SEQ ID NO: 3036910 - RNA, 20 nt, Mycobacterium bovis subsp bovis AF2122/97
acccggcgauuggaccgcca

SEQ ID NO: 3036911 - RNA, 20 nt, Mycobacterium bovis subsp bovis AF2122/97
acccggcgccgucgaugacc

SEQ ID NO: 3036912 - RNA, 16 nt, Mycobacterium bovis subsp bovis AF2122/97
acccggcgggcccgcc

SEQ ID NO: 3036913 - RNA, 18 nt, Mycobacterium bovis subsp bovis AF2122/97
acccggcgggcccgccgg

SEQ ID NO: 3036914 - RNA, 20 nt, Mycobacterium bovis subsp bovis AF2122/97
acccggcgggcccgccggcc

SEQ ID NO: 3036915 - RNA, 21 nt, Mycobacterium bovis subsp bovis AF2122/97
acccggcgggcggugggcagc

SEQ ID NO: 3036916 - RNA, 13 nt, Mycobacterium bovis subsp bovis AF2122/97
acccggcggugcc

SEQ ID NO: 3036917 - RNA, 22 nt, Mycobacterium bovis subsp bovis AF2122/97
acccggcggugccgucagcggc

SEQ ID NO: 3036918 - RNA, 24 nt, Mycobacterium bovis subsp bovis AF2122/97
acccggcggugccgucagcggcgg

SEQ ID NO: 3036919 - RNA, 23 nt, Mycobacterium bovis subsp bovis AF2122/97
acccgugccuuacuuccauccac

SEQ ID NO: 3036920 - RNA, 14 nt, Mycobacterium bovis subsp bovis AF2122/97
acccguguacgcgc

SEQ ID NO: 3036921 - RNA, 19 nt, Mycobacterium bovis subsp bovis AF2122/97
acccguguugagggugccc

SEQ ID NO: 3036922 - RNA, 23 nt, Mycobacterium bovis subsp bovis AF2122/97
acccguucagcgacggccgccag

SEQ ID NO: 3036923 - RNA, 15 nt, Mycobacterium bovis subsp bovis AF2122/97
acccguuccacgccg

SEQ ID NO: 3036924 - RNA, 18 nt, Mycobacterium bovis subsp bovis AF2122/97
acccguuccacgccggca

SEQ ID NO: 3036925 - RNA, 20 nt, Mycobacterium bovis subsp bovis AF2122/97
acccguucgaacuggcuggu

SEQ ID NO: 3036926 - RNA, 19 nt, Mycobacterium bovis subsp bovis AF2122/97
acccguucgugagcggcca

SEQ ID NO: 3036927 - RNA, 20 nt, Mycobacterium bovis subsp bovis AF2122/97
acccguucgugagcggccag

SEQ ID NO: 3036928 - RNA, 22 nt, Mycobacterium bovis subsp bovis AF2122/97
acccguucuucgcgauguccuc

SEQ ID NO: 3036929 - RNA, 21 nt, Mycobacterium bovis subsp bovis AF2122/97
acccguugaagacggccaccg

SEQ ID NO: 3036930 - RNA, 14 nt, Mycobacterium bovis subsp bovis AF2122/97
acccguugaucgcg

SEQ ID NO: 3036931 - RNA, 21 nt, Mycobacterium bovis subsp bovis AF2122/97
acccguugcucccacggcacc

SEQ ID NO: 3036932 - RNA, 21 nt, Mycobacterium bovis subsp bovis AF2122/97
acccguuggauguuuuccggu

SEQ ID NO: 3036933 - RNA, 22 nt, Mycobacterium bovis subsp bovis AF2122/97
acccguuuugggugaucgcaca

SEQ ID NO: 3036934 - RNA, 22 nt, Mycobacterium bovis subsp bovis AF2122/97
acccuaaaccagccaccaccag

SEQ ID NO: 3036935 - RNA, 20 nt, Mycobacterium bovis subsp bovis AF2122/97
acccuagauaugcacccgca

SEQ ID NO: 3036936 - RNA, 13 nt, Mycobacterium bovis subsp bovis AF2122/97
acccuccacagcg

SEQ ID NO: 3036937 - RNA, 14 nt, Mycobacterium bovis subsp bovis AF2122/97
acccuccccaacgu

SEQ ID NO: 3036938 - RNA, 13 nt, Mycobacterium bovis subsp bovis AF2122/97
acccuccgcagcu

SEQ ID NO: 3036939 - RNA, 13 nt, Mycobacterium bovis subsp bovis AF2122/97
acccuccgccggu

SEQ ID NO: 3036940 - RNA, 21 nt, Mycobacterium bovis subsp bovis AF2122/97
acccuccggacccacccgcac

SEQ ID NO: 3036941 - RNA, 19 nt, Mycobacterium bovis subsp bovis AF2122/97
acccucgggcgucacggug

SEQ ID NO: 3036942 - RNA, 19 nt, Mycobacterium bovis subsp bovis AF2122/97
acccugaugaucguccagc

SEQ ID NO: 3036943 - RNA, 14 nt, Mycobacterium bovis subsp bovis AF2122/97
acccugauggggcc

SEQ ID NO: 3036944 - RNA, 23 nt, Mycobacterium bovis subsp bovis AF2122/97
acccugcacccgacccgaugcgu

SEQ ID NO: 3036945 - RNA, 18 nt, Mycobacterium bovis subsp bovis AF2122/97
acccugcccuagcccgau

SEQ ID NO: 3036946 - RNA, 22 nt, Mycobacterium bovis subsp bovis AF2122/97
acccugcccuagcccgauucug

SEQ ID NO: 3036947 - RNA, 20 nt, Mycobacterium bovis subsp bovis AF2122/97
acccugccgcgaugagcggc

SEQ ID NO: 3036948 - RNA, 19 nt, Mycobacterium bovis subsp bovis AF2122/97
acccugcgccgccacagca

SEQ ID NO: 3036949 - RNA, 15 nt, Mycobacterium bovis subsp bovis AF2122/97
acccugcgugcggcg

SEQ ID NO: 3036950 - RNA, 11 nt, Mycobacterium bovis subsp bovis AF2122/97
acccugcugcg

SEQ ID NO: 3036951 - RNA, 15 nt, Mycobacterium bovis subsp bovis AF2122/97
acccuggccggugcg

SEQ ID NO: 3036952 - RNA, 19 nt, Mycobacterium bovis subsp bovis AF2122/97
acccuggccuuugagcgcg

SEQ ID NO: 3036953 - RNA, 22 nt, Mycobacterium bovis subsp bovis AF2122/97
acccugggcuggcugaccgaau

SEQ ID NO: 3036954 - RNA, 20 nt, Mycobacterium bovis subsp bovis AF2122/97
acccuggguauccaccgcga

SEQ ID NO: 3036955 - RNA, 16 nt, Mycobacterium bovis subsp bovis AF2122/97
acccuggucgaaacgg

SEQ ID NO: 3036956 - RNA, 13 nt, Mycobacterium bovis subsp bovis AF2122/97
acccugguggugc

SEQ ID NO: 3036957 - RNA, 13 nt, Mycobacterium bovis subsp bovis AF2122/97
acccugucgcgca

SEQ ID NO: 3036958 - RNA, 15 nt, Mycobacterium bovis subsp bovis AF2122/97
acccugucgcgcacc

SEQ ID NO: 3036959 - RNA, 23 nt, Mycobacterium bovis subsp bovis AF2122/97
acccuguuugcccaacagacauu

SEQ ID NO: 3036960 - RNA, 22 nt, Mycobacterium bovis subsp bovis AF2122/97
acccuucgcggugugcggcagc

SEQ ID NO: 3036961 - RNA, 15 nt, Mycobacterium bovis subsp bovis AF2122/97
accgaaaaacaccag

SEQ ID NO: 3036962 - RNA, 18 nt, Mycobacterium bovis subsp bovis AF2122/97
accgaaaaacaccagcga

SEQ ID NO: 3036963 - RNA, 23 nt, Mycobacterium bovis subsp bovis AF2122/97
accgaaaagccguucgcgucgcc

SEQ ID NO: 3036964 - RNA, 16 nt, Mycobacterium bovis subsp bovis AF2122/97
accgaaaaguccgccg

SEQ ID NO: 3036965 - RNA, 17 nt, Mycobacterium bovis subsp bovis AF2122/97
accgaaaaguccgccgc

SEQ ID NO: 3036966 - RNA, 16 nt, Mycobacterium bovis subsp bovis AF2122/97
accgaaaccggucagc

SEQ ID NO: 3036967 - RNA, 21 nt, Mycobacterium bovis subsp bovis AF2122/97
accgaaacgaugcggccugca

SEQ ID NO: 3036968 - RNA, 14 nt, Mycobacterium bovis subsp bovis AF2122/97
accgaaacgccgac

SEQ ID NO: 3036969 - RNA, 22 nt, Mycobacterium bovis subsp bovis AF2122/97
accgaaacggggcgacguccgc

SEQ ID NO: 3036970 - RNA, 17 nt, Mycobacterium bovis subsp bovis AF2122/97
accgaaagccgcaccag

SEQ ID NO: 3036971 - RNA, 18 nt, Mycobacterium bovis subsp bovis AF2122/97
accgaaagccgcaccaga

SEQ ID NO: 3036972 - RNA, 21 nt, Mycobacterium bovis subsp bovis AF2122/97
accgaaauacccagcgcagca

SEQ ID NO: 3036973 - RNA, 21 nt, Mycobacterium bovis subsp bovis AF2122/97
accgaaauggucguucccgcc

SEQ ID NO: 3036974 - RNA, 23 nt, Mycobacterium bovis subsp bovis AF2122/97
accgaaauggucguucccgccgg

SEQ ID NO: 3036975 - RNA, 19 nt, Mycobacterium bovis subsp bovis AF2122/97
accgaacagcaccuccgua

SEQ ID NO: 3036976 - RNA, 20 nt, Mycobacterium bovis subsp bovis AF2122/97
accgaacaguaggccuccgc

SEQ ID NO: 3036977 - RNA, 13 nt, Mycobacterium bovis subsp bovis AF2122/97
accgaacagucgc

SEQ ID NO: 3036978 - RNA, 20 nt, Mycobacterium bovis subsp bovis AF2122/97
accgaacagucgcagccagg

SEQ ID NO: 3036979 - RNA, 13 nt, Mycobacterium bovis subsp bovis AF2122/97
accgaacccgacg

SEQ ID NO: 3036980 - RNA, 15 nt, Mycobacterium bovis subsp bovis AF2122/97
accgaacccgccacc

SEQ ID NO: 3036981 - RNA, 17 nt, Mycobacterium bovis subsp bovis AF2122/97
accgaacccgccaccgc

SEQ ID NO: 3036982 - RNA, 19 nt, Mycobacterium bovis subsp bovis AF2122/97
accgaacccgccaccgcga

SEQ ID NO: 3036983 - RNA, 23 nt, Mycobacterium bovis subsp bovis AF2122/97
accgaacccgccaccgcgacacc

SEQ ID NO: 3036984 - RNA, 14 nt, Mycobacterium bovis subsp bovis AF2122/97
accgaacgacucga

SEQ ID NO: 3036985 - RNA, 14 nt, Mycobacterium bovis subsp bovis AF2122/97
accgaacgcaccga

SEQ ID NO: 3036986 - RNA, 16 nt, Mycobacterium bovis subsp bovis AF2122/97
accgaacgcggccacc

SEQ ID NO: 3036987 - RNA, 18 nt, Mycobacterium bovis subsp bovis AF2122/97
accgaacgcggccaccga

SEQ ID NO: 3036988 - RNA, 17 nt, Mycobacterium bovis subsp bovis AF2122/97
accgaacuugcggaccu

SEQ ID NO: 3036989 - RNA, 16 nt, Mycobacterium bovis subsp bovis AF2122/97
accgaagaacaguugc

SEQ ID NO: 3036990 - RNA, 18 nt, Mycobacterium bovis subsp bovis AF2122/97
accgaagagcgcgcgcaa

SEQ ID NO: 3036991 - RNA, 19 nt, Mycobacterium bovis subsp bovis AF2122/97
accgaagagcgcgcgcaac

SEQ ID NO: 3036992 - RNA, 14 nt, Mycobacterium bovis subsp bovis AF2122/97
accgaagccgccgg

SEQ ID NO: 3036993 - RNA, 15 nt, Mycobacterium bovis subsp bovis AF2122/97
accgaagcgaacggc

SEQ ID NO: 3036994 - RNA, 14 nt, Mycobacterium bovis subsp bovis AF2122/97
accgaagucugcag

SEQ ID NO: 3036995 - RNA, 20 nt, Mycobacterium bovis subsp bovis AF2122/97
accgaaucgggucggccgcu

SEQ ID NO: 3036996 - RNA, 16 nt, Mycobacterium bovis subsp bovis AF2122/97
accgaauggccgccgc

SEQ ID NO: 3036997 - RNA, 18 nt, Mycobacterium bovis subsp bovis AF2122/97
accgaauggccgccgcag

SEQ ID NO: 3036998 - RNA, 21 nt, Mycobacterium bovis subsp bovis AF2122/97
accgaaugugaaaugcgcgau

SEQ ID NO: 3036999 - RNA, 20 nt, Mycobacterium bovis subsp bovis AF2122/97
accgacaauucaacacacgg

SEQ ID NO: 3037000 - RNA, 22 nt, Mycobacterium bovis subsp bovis AF2122/97
accgacaccccgaugccgugcc

SEQ ID NO: 3037001 - RNA, 15 nt, Mycobacterium bovis subsp bovis AF2122/97
accgacaccggccgc

SEQ ID NO: 3037002 - RNA, 18 nt, Mycobacterium bovis subsp bovis AF2122/97
accgacaccggccgcgac

SEQ ID NO: 3037003 - RNA, 16 nt, Mycobacterium bovis subsp bovis AF2122/97
accgacaccgugccgc

SEQ ID NO: 3037004 - RNA, 13 nt, Mycobacterium bovis subsp bovis AF2122/97
accgacaccgugu

SEQ ID NO: 3037005 - RNA, 16 nt, Mycobacterium bovis subsp bovis AF2122/97
accgaugccuugaccg

SEQ ID NO: 3037006 - RNA, 18 nt, Mycobacterium bovis subsp bovis AF2122/97
accgaugccuugaccgcg

SEQ ID NO: 3037007 - RNA, 13 nt, Mycobacterium bovis subsp bovis AF2122/97
accgaugcgccgg

SEQ ID NO: 3037008 - RNA, 14 nt, Mycobacterium bovis subsp bovis AF2122/97
accgaugcugacga

SEQ ID NO: 3037009 - RNA, 18 nt, Mycobacterium bovis subsp bovis AF2122/97
accgauggcgcaccggcg

SEQ ID NO: 3037010 - RNA, 19 nt, Mycobacterium bovis subsp bovis AF2122/97
accgauggcgcaccggcgu

SEQ ID NO: 3037011 - RNA, 21 nt, Mycobacterium bovis subsp bovis AF2122/97
accgauggcgcaccggcgucg

SEQ ID NO: 3037012 - RNA, 20 nt, Mycobacterium bovis subsp bovis AF2122/97
accgauggcgcgcucaacgg

SEQ ID NO: 3037013 - RNA, 23 nt, Mycobacterium bovis subsp bovis AF2122/97
accgaugguggugccaaccuggg

SEQ ID NO: 3037014 - RNA, 22 nt, Mycobacterium bovis subsp bovis AF2122/97
accgaugugggcgccgucgccg

SEQ ID NO: 3037015 - RNA, 14 nt, Mycobacterium bovis subsp bovis AF2122/97
accgauuccagcgg

SEQ ID NO: 3037016 - RNA, 17 nt, Mycobacterium bovis subsp bovis AF2122/97
accgauucggccagcgc

SEQ ID NO: 3037017 - RNA, 19 nt, Mycobacterium bovis subsp bovis AF2122/97
accgauucggccagcgccc

SEQ ID NO: 3037018 - RNA, 20 nt, Mycobacterium bovis subsp bovis AF2122/97
accgauucggccagcgcccg

SEQ ID NO: 3037019 - RNA, 15 nt, Mycobacterium bovis subsp bovis AF2122/97
accgauucggcgacg

SEQ ID NO: 3037020 - RNA, 15 nt, Mycobacterium bovis subsp bovis AF2122/97
accgauugucggcaa

SEQ ID NO: 3037021 - RNA, 16 nt, Mycobacterium bovis subsp bovis AF2122/97
accgauugucggcaac

SEQ ID NO: 3037022 - RNA, 20 nt, Mycobacterium bovis subsp bovis AF2122/97
accgauuucuuuaccagcac

SEQ ID NO: 3037023 - RNA, 16 nt, Mycobacterium bovis subsp bovis AF2122/97
accgcaaacccgccga

SEQ ID NO: 3037024 - RNA, 17 nt, Mycobacterium bovis subsp bovis AF2122/97
accgcaaacccgccgac

SEQ ID NO: 3037025 - RNA, 18 nt, Mycobacterium bovis subsp bovis AF2122/97
accgcaaacccgccgaca

SEQ ID NO: 3037026 - RNA, 15 nt, Mycobacterium bovis subsp bovis AF2122/97
accgcaaaggagaag

SEQ ID NO: 3037027 - RNA, 16 nt, Mycobacterium bovis subsp bovis AF2122/97
accgcaacgacggccg

SEQ ID NO: 3037028 - RNA, 16 nt, Mycobacterium bovis subsp bovis AF2122/97
accgcaacucgccgaa

SEQ ID NO: 3037029 - RNA, 14 nt, Mycobacterium bovis subsp bovis AF2122/97
accgcaagaaucag

SEQ ID NO: 3037030 - RNA, 15 nt, Mycobacterium bovis subsp bovis AF2122/97
accgcaaggcccaca

SEQ ID NO: 3037031 - RNA, 22 nt, Mycobacterium bovis subsp bovis AF2122/97
accgcaaucauccgaucgccgc

SEQ ID NO: 3037032 - RNA, 16 nt, Mycobacterium bovis subsp bovis AF2122/97
accgcaaucggauacc

SEQ ID NO: 3037033 - RNA, 18 nt, Mycobacterium bovis subsp bovis AF2122/97
accgcaaucggauaccca

SEQ ID NO: 3037034 - RNA, 22 nt, Mycobacterium bovis subsp bovis AF2122/97
accgcaaucggauacccagccg

SEQ ID NO: 3037035 - RNA, 16 nt, Mycobacterium bovis subsp bovis AF2122/97
accgcaauggcggccu

SEQ ID NO: 3037036 - RNA, 18 nt, Mycobacterium bovis subsp bovis AF2122/97
accgcaauuggcguagca

SEQ ID NO: 3037037 - RNA, 18 nt, Mycobacterium bovis subsp bovis AF2122/97
accgcaccaaagcgaaau

SEQ ID NO: 3037038 - RNA, 18 nt, Mycobacterium bovis subsp bovis AF2122/97
accgcacccugacagcga

SEQ ID NO: 3037039 - RNA, 23 nt, Mycobacterium bovis subsp bovis AF2122/97
accgcacccuggguauccaccgc

SEQ ID NO: 3037040 - RNA, 17 nt, Mycobacterium bovis subsp bovis AF2122/97
accgcaccgaccugagu

SEQ ID NO: 3037041 - RNA, 12 nt, Mycobacterium bovis subsp bovis AF2122/97
accgcaccggca

SEQ ID NO: 3037042 - RNA, 13 nt, Mycobacterium bovis subsp bovis AF2122/97
accgcaccggccg

SEQ ID NO: 3037043 - RNA, 15 nt, Mycobacterium bovis subsp bovis AF2122/97
accgcaccggccgcu

SEQ ID NO: 3037044 - RNA, 18 nt, Mycobacterium bovis subsp bovis AF2122/97
accgcacgcuggcgggca

SEQ ID NO: 3037045 - RNA, 19 nt, Mycobacterium bovis subsp bovis AF2122/97
accgcacggugaccacgcc

SEQ ID NO: 3037046 - RNA, 21 nt, Mycobacterium bovis subsp bovis AF2122/97
accgcagacgugguagccggc

SEQ ID NO: 3037047 - RNA, 22 nt, Mycobacterium bovis subsp bovis AF2122/97
accgcagacgugguagccggcg

SEQ ID NO: 3037048 - RNA, 19 nt, Mycobacterium bovis subsp bovis AF2122/97
accgcagauccccgccacc

SEQ ID NO: 3037049 - RNA, 21 nt, Mycobacterium bovis subsp bovis AF2122/97
accgcagauccccgccaccga

SEQ ID NO: 3037050 - RNA, 18 nt, Mycobacterium bovis subsp bovis AF2122/97
accgcagccaacgucacc

SEQ ID NO: 3037051 - RNA, 19 nt, Mycobacterium bovis subsp bovis AF2122/97
accgcagccaacgucacca

SEQ ID NO: 3037052 - RNA, 18 nt, Mycobacterium bovis subsp bovis AF2122/97
accgcagcggaacugggc

SEQ ID NO: 3037053 - RNA, 19 nt, Mycobacterium bovis subsp bovis AF2122/97
accgcagcggaacugggcc

SEQ ID NO: 3037054 - RNA, 13 nt, Mycobacterium bovis subsp bovis AF2122/97
accgcagcgggcg

SEQ ID NO: 3037055 - RNA, 22 nt, Mycobacterium bovis subsp bovis AF2122/97
accgcagcgugaucuggccacg

SEQ ID NO: 3037056 - RNA, 23 nt, Mycobacterium bovis subsp bovis AF2122/97
accgcaggugccguggcuaccgc

SEQ ID NO: 3037057 - RNA, 15 nt, Mycobacterium bovis subsp bovis AF2122/97
accgcagucccagca

SEQ ID NO: 3037058 - RNA, 16 nt, Mycobacterium bovis subsp bovis AF2122/97
accgcagucccagcac

SEQ ID NO: 3037059 - RNA, 17 nt, Mycobacterium bovis subsp bovis AF2122/97
accgcagucccagcaca

SEQ ID NO: 3037060 - RNA, 13 nt, Mycobacterium bovis subsp bovis AF2122/97
accgcagucgcgg

SEQ ID NO: 3037061 - RNA, 14 nt, Mycobacterium bovis subsp bovis AF2122/97
accgcagucgcugg

SEQ ID NO: 3037062 - RNA, 16 nt, Mycobacterium bovis subsp bovis AF2122/97
accgcauaacgcgaac

SEQ ID NO: 3037063 - RNA, 15 nt, Mycobacterium bovis subsp bovis AF2122/97
accgcaucggugcca

SEQ ID NO: 3037064 - RNA, 21 nt, Mycobacterium bovis subsp bovis AF2122/97
accgcaucgguggggcgccgg

SEQ ID NO: 3037065 - RNA, 23 nt, Mycobacterium bovis subsp bovis AF2122/97
accgcaucgguggggcgccgggg

SEQ ID NO: 3037066 - RNA, 15 nt, Mycobacterium bovis subsp bovis AF2122/97
accgcaucgucgagc

SEQ ID NO: 3037067 - RNA, 16 nt, Mycobacterium bovis subsp bovis AF2122/97
accgcaucgucgagcc

SEQ ID NO: 3037068 - RNA, 16 nt, Mycobacterium bovis subsp bovis AF2122/97
accgcaugaucgcacc

SEQ ID NO: 3037069 - RNA, 15 nt, Mycobacterium bovis subsp bovis AF2122/97
accgcaugguggugg

SEQ ID NO: 3037070 - RNA, 20 nt, Mycobacterium bovis subsp bovis AF2122/97
accgcaugguggugggugau

SEQ ID NO: 3037071 - RNA, 13 nt, Mycobacterium bovis subsp bovis AF2122/97
accgcauguggga

SEQ ID NO: 3037072 - RNA, 16 nt, Mycobacterium bovis subsp bovis AF2122/97
accgcauucggacgcc

SEQ ID NO: 3037073 - RNA, 17 nt, Mycobacterium bovis subsp bovis AF2122/97
accgcauucggacgcca

SEQ ID NO: 3037074 - RNA, 22 nt, Mycobacterium bovis subsp bovis AF2122/97
accgcauucguggagccggccg

SEQ ID NO: 3037075 - RNA, 21 nt, Mycobacterium bovis subsp bovis AF2122/97
accgccaaacgcugcgcccgg

SEQ ID NO: 3037076 - RNA, 18 nt, Mycobacterium bovis subsp bovis AF2122/97
accgccaacauuggugag

SEQ ID NO: 3037077 - RNA, 16 nt, Mycobacterium bovis subsp bovis AF2122/97
accgccaaccuacccu

SEQ ID NO: 3037078 - RNA, 19 nt, Mycobacterium bovis subsp bovis AF2122/97
accgccacacggggccgcc

SEQ ID NO: 3037079 - RNA, 17 nt, Mycobacterium bovis subsp bovis AF2122/97
accgccaccacccaggc

SEQ ID NO: 3037080 - RNA, 17 nt, Mycobacterium bovis subsp bovis AF2122/97
accgccaccccggucgg

SEQ ID NO: 3037081 - RNA, 15 nt, Mycobacterium bovis subsp bovis AF2122/97
accgccaccgccagc

SEQ ID NO: 3037082 - RNA, 16 nt, Mycobacterium bovis subsp bovis AF2122/97
accgccaccgccagcg

SEQ ID NO: 3037083 - RNA, 15 nt, Mycobacterium bovis subsp bovis AF2122/97
accgccaccgcggcc

SEQ ID NO: 3037084 - RNA, 16 nt, Mycobacterium bovis subsp bovis AF2122/97
accgccaccgcggccu

SEQ ID NO: 3037085 - RNA, 13 nt, Mycobacterium bovis subsp bovis AF2122/97
accgccaccuugg

SEQ ID NO: 3037086 - RNA, 18 nt, Mycobacterium bovis subsp bovis AF2122/97
accgccagcagcaggcca

SEQ ID NO: 3037087 - RNA, 14 nt, Mycobacterium bovis subsp bovis AF2122/97
accgccagccccgc

SEQ ID NO: 3037088 - RNA, 13 nt, Mycobacterium bovis subsp bovis AF2122/97
accgccagcccgg

SEQ ID NO: 3037089 - RNA, 18 nt, Mycobacterium bovis subsp bovis AF2122/97
accgccagccgcgagccg

SEQ ID NO: 3037090 - RNA, 14 nt, Mycobacterium bovis subsp bovis AF2122/97
accgccagcgccac

SEQ ID NO: 3037091 - RNA, 15 nt, Mycobacterium bovis subsp bovis AF2122/97
accgccagcgccacc

SEQ ID NO: 3037092 - RNA, 14 nt, Mycobacterium bovis subsp bovis AF2122/97
accgccggcggcgg

SEQ ID NO: 3037093 - RNA, 21 nt, Mycobacterium bovis subsp bovis AF2122/97
accgccggcggcggccgcagc

SEQ ID NO: 3037094 - RNA, 22 nt, Mycobacterium bovis subsp bovis AF2122/97
accgccggcuccgccguugccg

SEQ ID NO: 3037095 - RNA, 20 nt, Mycobacterium bovis subsp bovis AF2122/97
accgccgggcccucgccaug

SEQ ID NO: 3037096 - RNA, 22 nt, Mycobacterium bovis subsp bovis AF2122/97
accgccgggcccucgccauggc

SEQ ID NO: 3037097 - RNA, 17 nt, Mycobacterium bovis subsp bovis AF2122/97
accgccggugccgauga

SEQ ID NO: 3037098 - RNA, 22 nt, Mycobacterium bovis subsp bovis AF2122/97
accgccggugccgaugaccgaa

SEQ ID NO: 3037099 - RNA, 14 nt, Mycobacterium bovis subsp bovis AF2122/97
accgccggugccgc

SEQ ID NO: 3037100 - RNA, 18 nt, Mycobacterium bovis subsp bovis AF2122/97
accgccggugccgccauc

SEQ ID NO: 3037101 - RNA, 12 nt, Mycobacterium bovis subsp bovis AF2122/97
accgccggugcg

SEQ ID NO: 3037102 - RNA, 15 nt, Mycobacterium bovis subsp bovis AF2122/97
accgccggugcugac

SEQ ID NO: 3037103 - RNA, 13 nt, Mycobacterium bovis subsp bovis AF2122/97
accgccgucccgg

SEQ ID NO: 3037104 - RNA, 16 nt, Mycobacterium bovis subsp bovis AF2122/97
accgccgucccggcuc

SEQ ID NO: 3037105 - RNA, 22 nt, Mycobacterium bovis subsp bovis AF2122/97
accgccgucccggcucgagcuc

SEQ ID NO: 3037106 - RNA, 13 nt, Mycobacterium bovis subsp bovis AF2122/97
accgccgucgcca

SEQ ID NO: 3037107 - RNA, 21 nt, Mycobacterium bovis subsp bovis AF2122/97
accgccgucggguugcgacga

SEQ ID NO: 3037108 - RNA, 22 nt, Mycobacterium bovis subsp bovis AF2122/97
accgccgucggguugcgacgaa

SEQ ID NO: 3037109 - RNA, 17 nt, Mycobacterium bovis subsp bovis AF2122/97
accgccguggcccgcuc

SEQ ID NO: 3037110 - RNA, 15 nt, Mycobacterium bovis subsp bovis AF2122/97
accgccgugugccac

SEQ ID NO: 3037111 - RNA, 18 nt, Mycobacterium bovis subsp bovis AF2122/97
accgccgugugccacggg

SEQ ID NO: 3037112 - RNA, 20 nt, Mycobacterium bovis subsp bovis AF2122/97
accgccguuaccgacgccgg

SEQ ID NO: 3037113 - RNA, 21 nt, Mycobacterium bovis subsp bovis AF2122/97
accgccguuaccgacgccggu

SEQ ID NO: 3037114 - RNA, 18 nt, Mycobacterium bovis subsp bovis AF2122/97
accgccguuaccgccguu

SEQ ID NO: 3037115 - RNA, 20 nt, Mycobacterium bovis subsp bovis AF2122/97
accgccguugccaagcagcu

SEQ ID NO: 3037116 - RNA, 13 nt, Mycobacterium bovis subsp bovis AF2122/97
accgccguugccg

SEQ ID NO: 3037117 - RNA, 19 nt, Mycobacterium bovis subsp bovis AF2122/97
accgccguugccgaucagc

SEQ ID NO: 3037118 - RNA, 14 nt, Mycobacterium bovis subsp bovis AF2122/97
accgccguugccgc

SEQ ID NO: 3037119 - RNA, 15 nt, Mycobacterium bovis subsp bovis AF2122/97
accgccguugccgcc

SEQ ID NO: 3037120 - RNA, 16 nt, Mycobacterium bovis subsp bovis AF2122/97
accgccguugccgccg

SEQ ID NO: 3037121 - RNA, 17 nt, Mycobacterium bovis subsp bovis AF2122/97
accgccguugccgccgg

SEQ ID NO: 3037122 - RNA, 18 nt, Mycobacterium bovis subsp bovis AF2122/97
accgccguugccgccggc

SEQ ID NO: 3037123 - RNA, 19 nt, Mycobacterium bovis subsp bovis AF2122/97
accgccguugccgccggcg

SEQ ID NO: 3037124 - RNA, 17 nt, Mycobacterium bovis subsp bovis AF2122/97
accgccguugucgaccu

SEQ ID NO: 3037125 - RNA, 16 nt, Mycobacterium bovis subsp bovis AF2122/97
accgccguuugcgccg

SEQ ID NO: 3037126 - RNA, 21 nt, Mycobacterium bovis subsp bovis AF2122/97
accgccguuugcgccguugcc

SEQ ID NO: 3037127 - RNA, 14 nt, Mycobacterium bovis subsp bovis AF2122/97
accgccuccaccgc

SEQ ID NO: 3037128 - RNA, 21 nt, Mycobacterium bovis subsp bovis AF2122/97
accgccuccaccgccgcgcgg

SEQ ID NO: 3037129 - RNA, 17 nt, Mycobacterium bovis subsp bovis AF2122/97
accgccucgucgaugcc

SEQ ID NO: 3037130 - RNA, 13 nt, Mycobacterium bovis subsp bovis AF2122/97
accgccugcgccg

SEQ ID NO: 3037131 - RNA, 18 nt, Mycobacterium bovis subsp bovis AF2122/97
accgccugcgccgcccgc

SEQ ID NO: 3037132 - RNA, 13 nt, Mycobacterium bovis subsp bovis AF2122/97
accgccugcgccu

SEQ ID NO: 3037133 - RNA, 18 nt, Mycobacterium bovis subsp bovis AF2122/97
accgccugcgcggcugcc

SEQ ID NO: 3037134 - RNA, 15 nt, Mycobacterium bovis subsp bovis AF2122/97
accgccugcucggcg

SEQ ID NO: 3037135 - RNA, 18 nt, Mycobacterium bovis subsp bovis AF2122/97
accgccugcucggcgacc

SEQ ID NO: 3037136 - RNA, 16 nt, Mycobacterium bovis subsp bovis AF2122/97
accgccugggcggcca

SEQ ID NO: 3037137 - RNA, 18 nt, Mycobacterium bovis subsp bovis AF2122/97
accgccugggcggccagc

SEQ ID NO: 3037138 - RNA, 20 nt, Mycobacterium bovis subsp bovis AF2122/97
accgccugggcggccagcac

SEQ ID NO: 3037139 - RNA, 15 nt, Mycobacterium bovis subsp bovis AF2122/97
accgccugugccgcc

SEQ ID NO: 3037140 - RNA, 20 nt, Mycobacterium bovis subsp bovis AF2122/97
accgccugugccgccggcgc

SEQ ID NO: 3037141 - RNA, 22 nt, Mycobacterium bovis subsp bovis AF2122/97
accgccugugccgccggcgcca

SEQ ID NO: 3037142 - RNA, 15 nt, Mycobacterium bovis subsp bovis AF2122/97
accgccuugucggcg

SEQ ID NO: 3037143 - RNA, 17 nt, Mycobacterium bovis subsp bovis AF2122/97
accgccuugucggcgau

SEQ ID NO: 3037144 - RNA, 17 nt, Mycobacterium bovis subsp bovis AF2122/97
accgccuuugccgccgg

SEQ ID NO: 3037145 - RNA, 18 nt, Mycobacterium bovis subsp bovis AF2122/97
accgccuuugccgccggc

SEQ ID NO: 3037146 - RNA, 20 nt, Mycobacterium bovis subsp bovis AF2122/97
accgccuuugccgccggcac

SEQ ID NO: 3037147 - RNA, 23 nt, Mycobacterium bovis subsp bovis AF2122/97
accgccuuugccgccggcaccgc

SEQ ID NO: 3037148 - RNA, 22 nt, Mycobacterium bovis subsp bovis AF2122/97
accgcgaaaaccuccgggucca

SEQ ID NO: 3037149 - RNA, 16 nt, Mycobacterium bovis subsp bovis AF2122/97
accgcgaaagcaccga

SEQ ID NO: 3037150 - RNA, 21 nt, Mycobacterium bovis subsp bovis AF2122/97
accgcgaaagcaccgagcauc

SEQ ID NO: 3037151 - RNA, 16 nt, Mycobacterium bovis subsp bovis AF2122/97
accgcgaagccgaccg

SEQ ID NO: 3037152 - RNA, 18 nt, Mycobacterium bovis subsp bovis AF2122/97
accgcgaaugugaucacc

SEQ ID NO: 3037153 - RNA, 21 nt, Mycobacterium bovis subsp bovis AF2122/97
accgcgaaugugaucacccgc

SEQ ID NO: 3037154 - RNA, 15 nt, Mycobacterium bovis subsp bovis AF2122/97
accgcgacaccccgg

SEQ ID NO: 3037155 - RNA, 21 nt, Mycobacterium bovis subsp bovis AF2122/97
accgcgaccagccagcgagga

SEQ ID NO: 3037156 - RNA, 16 nt, Mycobacterium bovis subsp bovis AF2122/97
accgcgaccagcuggc

SEQ ID NO: 3037157 - RNA, 24 nt, Mycobacterium bovis subsp bovis AF2122/97
accgcgaccaucgcgacggcaagc

SEQ ID NO: 3037158 - RNA, 14 nt, Mycobacterium bovis subsp bovis AF2122/97
accgcgacccggcc

SEQ ID NO: 3037159 - RNA, 13 nt, Mycobacterium bovis subsp bovis AF2122/97
accgcgacgacga

SEQ ID NO: 3037160 - RNA, 14 nt, Mycobacterium bovis subsp bovis AF2122/97
accgcgacgagcgg

SEQ ID NO: 3037161 - RNA, 14 nt, Mycobacterium bovis subsp bovis AF2122/97
accgcgacggcagg

SEQ ID NO: 3037162 - RNA, 14 nt, Mycobacterium bovis subsp bovis AF2122/97
accgcgacggcgcc

SEQ ID NO: 3037163 - RNA, 15 nt, Mycobacterium bovis subsp bovis AF2122/97
accgcgacggcgccg

SEQ ID NO: 3037164 - RNA, 14 nt, Mycobacterium bovis subsp bovis AF2122/97
accgcgagcagcac

SEQ ID NO: 3037165 - RNA, 14 nt, Mycobacterium bovis subsp bovis AF2122/97
accgcgagcaugau

SEQ ID NO: 3037166 - RNA, 21 nt, Mycobacterium bovis subsp bovis AF2122/97
accgcgagggggguguugagg

SEQ ID NO: 3037167 - RNA, 17 nt, Mycobacterium bovis subsp bovis AF2122/97
accgcgaucaccaccgg

SEQ ID NO: 3037168 - RNA, 19 nt, Mycobacterium bovis subsp bovis AF2122/97
accgcgaucacccacaugg

SEQ ID NO: 3037169 - RNA, 13 nt, Mycobacterium bovis subsp bovis AF2122/97
accgcgaucgccg

SEQ ID NO: 3037170 - RNA, 15 nt, Mycobacterium bovis subsp bovis AF2122/97
accgcgaucgccgac

SEQ ID NO: 3037171 - RNA, 12 nt, Mycobacterium bovis subsp bovis AF2122/97
accgcgaucgcg

SEQ ID NO: 3037172 - RNA, 16 nt, Mycobacterium bovis subsp bovis AF2122/97
accgcgaugucacgga

SEQ ID NO: 3037173 - RNA, 20 nt, Mycobacterium bovis subsp bovis AF2122/97
accgcgaugucacggaugug

SEQ ID NO: 3037174 - RNA, 17 nt, Mycobacterium bovis subsp bovis AF2122/97
accgcgcagaacgaucg

SEQ ID NO: 3037175 - RNA, 18 nt, Mycobacterium bovis subsp bovis AF2122/97
accgcgcagaacgaucgc

SEQ ID NO: 3037176 - RNA, 15 nt, Mycobacterium bovis subsp bovis AF2122/97
accgcgcaucaucgc

SEQ ID NO: 3037177 - RNA, 21 nt, Mycobacterium bovis subsp bovis AF2122/97
accgcgcaucaucgcccaccg

SEQ ID NO: 3037178 - RNA, 11 nt, Mycobacterium bovis subsp bovis AF2122/97
accgcgccacc

SEQ ID NO: 3037179 - RNA, 21 nt, Mycobacterium bovis subsp bovis AF2122/97
accgcuaacagauuguccggc

SEQ ID NO: 3037180 - RNA, 23 nt, Mycobacterium bovis subsp bovis AF2122/97
accgcuaacagauuguccggccg

SEQ ID NO: 3037181 - RNA, 15 nt, Mycobacterium bovis subsp bovis AF2122/97
accgcuaccagcugg

SEQ ID NO: 3037182 - RNA, 17 nt, Mycobacterium bovis subsp bovis AF2122/97
accgcuaugaugccgcc

SEQ ID NO: 3037183 - RNA, 19 nt, Mycobacterium bovis subsp bovis AF2122/97
accgcuaugaugccgccgg

SEQ ID NO: 3037184 - RNA, 18 nt, Mycobacterium bovis subsp bovis AF2122/97
accgcucagggugcgccg

SEQ ID NO: 3037185 - RNA, 19 nt, Mycobacterium bovis subsp bovis AF2122/97
accgcucagggugcgccgc

SEQ ID NO: 3037186 - RNA, 22 nt, Mycobacterium bovis subsp bovis AF2122/97
accgcucgaugucccgagcccg

SEQ ID NO: 3037187 - RNA, 20 nt, Mycobacterium bovis subsp bovis AF2122/97
accgcucggaguugagcugu

SEQ ID NO: 3037188 - RNA, 14 nt, Mycobacterium bovis subsp bovis AF2122/97
accgcucggcggca

SEQ ID NO: 3037189 - RNA, 14 nt, Mycobacterium bovis subsp bovis AF2122/97
accgcucgggcgcg

SEQ ID NO: 3037190 - RNA, 15 nt, Mycobacterium bovis subsp bovis AF2122/97
accgcucgucgccgg

SEQ ID NO: 3037191 - RNA, 16 nt, Mycobacterium bovis subsp bovis AF2122/97
accgcucgucgccggu

SEQ ID NO: 3037192 - RNA, 14 nt, Mycobacterium bovis subsp bovis AF2122/97
accgcucgucgucc

SEQ ID NO: 3037193 - RNA, 16 nt, Mycobacterium bovis subsp bovis AF2122/97
accgcucgucguccgg

SEQ ID NO: 3037194 - RNA, 18 nt, Mycobacterium bovis subsp bovis AF2122/97
accgcucgucguccggcc

SEQ ID NO: 3037195 - RNA, 24 nt, Mycobacterium bovis subsp bovis AF2122/97
accgcucgucguccggccacgguc

SEQ ID NO: 3037196 - RNA, 17 nt, Mycobacterium bovis subsp bovis AF2122/97
accgcucgugcaaucgc

SEQ ID NO: 3037197 - RNA, 17 nt, Mycobacterium bovis subsp bovis AF2122/97
accgcucugcggccacg

SEQ ID NO: 3037198 - RNA, 18 nt, Mycobacterium bovis subsp bovis AF2122/97
accgcugaccccggcagc

SEQ ID NO: 3037199 - RNA, 13 nt, Mycobacterium bovis subsp bovis AF2122/97
accgcugaccgca

SEQ ID NO: 3037200 - RNA, 18 nt, Mycobacterium bovis subsp bovis AF2122/97
accgcugaccgcaacgcg

SEQ ID NO: 3037201 - RNA, 22 nt, Mycobacterium bovis subsp bovis AF2122/97
accgcugaggaacccuccggac

SEQ ID NO: 3037202 - RNA, 15 nt, Mycobacterium bovis subsp bovis AF2122/97
accgcugauagcggu

SEQ ID NO: 3037203 - RNA, 16 nt, Mycobacterium bovis subsp bovis AF2122/97
accgcugauagcgguc

SEQ ID NO: 3037204 - RNA, 17 nt, Mycobacterium bovis subsp bovis AF2122/97
accgcugauagcggucg

SEQ ID NO: 3037205 - RNA, 20 nt, Mycobacterium bovis subsp bovis AF2122/97
accgcugauagcggucgguc

SEQ ID NO: 3037206 - RNA, 14 nt, Mycobacterium bovis subsp bovis AF2122/97
accgcugccgcauc

SEQ ID NO: 3037207 - RNA, 13 nt, Mycobacterium bovis subsp bovis AF2122/97
accgcugccggca

SEQ ID NO: 3037208 - RNA, 14 nt, Mycobacterium bovis subsp bovis AF2122/97
accgcugccggcac

SEQ ID NO: 3037209 - RNA, 22 nt, Mycobacterium bovis subsp bovis AF2122/97
accgcugccggcacgcaugccg

SEQ ID NO: 3037210 - RNA, 16 nt, Mycobacterium bovis subsp bovis AF2122/97
accgcugccggcagcg

SEQ ID NO: 3037211 - RNA, 14 nt, Mycobacterium bovis subsp bovis AF2122/97
accgcugccggcgc

SEQ ID NO: 3037212 - RNA, 16 nt, Mycobacterium bovis subsp bovis AF2122/97
accgcugccggcgccg

SEQ ID NO: 3037213 - RNA, 18 nt, Mycobacterium bovis subsp bovis AF2122/97
accgcugccggugugcgg

SEQ ID NO: 3037214 - RNA, 14 nt, Mycobacterium bovis subsp bovis AF2122/97
accgcugccugccg

SEQ ID NO: 3037215 - RNA, 14 nt, Mycobacterium bovis subsp bovis AF2122/97
accgcugcggcacc

SEQ ID NO: 3037216 - RNA, 20 nt, Mycobacterium bovis subsp bovis AF2122/97
accgcugcggcaccacccgg

SEQ ID NO: 3037217 - RNA, 22 nt, Mycobacterium bovis subsp bovis AF2122/97
accgcugcggcaccacccggcg

SEQ ID NO: 3037218 - RNA, 20 nt, Mycobacterium bovis subsp bovis AF2122/97
accgcugcuagugcgggccg

SEQ ID NO: 3037219 - RNA, 18 nt, Mycobacterium bovis subsp bovis AF2122/97
accgcugcuccucgcggu

SEQ ID NO: 3037220 - RNA, 16 nt, Mycobacterium bovis subsp bovis AF2122/97
accgcugcugcugccc

SEQ ID NO: 3037221 - RNA, 17 nt, Mycobacterium bovis subsp bovis AF2122/97
accgcugcugcugcccc

SEQ ID NO: 3037222 - RNA, 19 nt, Mycobacterium bovis subsp bovis AF2122/97
accgcugcuugucgaggcg

SEQ ID NO: 3037223 - RNA, 20 nt, Mycobacterium bovis subsp bovis AF2122/97
accgcugcuugucgaggcgc

SEQ ID NO: 3037224 - RNA, 13 nt, Mycobacterium bovis subsp bovis AF2122/97
accgcuggaucgc

SEQ ID NO: 3037225 - RNA, 15 nt, Mycobacterium bovis subsp bovis AF2122/97
accgcuggaucgcgu

SEQ ID NO: 3037226 - RNA, 22 nt, Mycobacterium bovis subsp bovis AF2122/97
accgcuggcccggcgcuccaac

SEQ ID NO: 3037227 - RNA, 16 nt, Mycobacterium bovis subsp bovis AF2122/97
accgcugggacaacgu

SEQ ID NO: 3037228 - RNA, 19 nt, Mycobacterium bovis subsp bovis AF2122/97
accgcugggacaacgugcc

SEQ ID NO: 3037229 - RNA, 19 nt, Mycobacterium bovis subsp bovis AF2122/97
accgcugggggcggucgcc

SEQ ID NO: 3037230 - RNA, 15 nt, Mycobacterium bovis subsp bovis AF2122/97
accgcugggucgccg

SEQ ID NO: 3037231 - RNA, 16 nt, Mycobacterium bovis subsp bovis AF2122/97
accgcugggucgccgu

SEQ ID NO: 3037232 - RNA, 18 nt, Mycobacterium bovis subsp bovis AF2122/97
accgcuggugugucccgg

SEQ ID NO: 3037233 - RNA, 16 nt, Mycobacterium bovis subsp bovis AF2122/97
accgcuguugcaucgc

SEQ ID NO: 3037234 - RNA, 21 nt, Mycobacterium bovis subsp bovis AF2122/97
accgcuucaggcgccacugcu

SEQ ID NO: 3037235 - RNA, 21 nt, Mycobacterium bovis subsp bovis AF2122/97
accgcuuccagguugaagaau

SEQ ID NO: 3037236 - RNA, 13 nt, Mycobacterium bovis subsp bovis AF2122/97
accgcuucccccg

SEQ ID NO: 3037237 - RNA, 14 nt, Mycobacterium bovis subsp bovis AF2122/97
accgcuucccccgg

SEQ ID NO: 3037238 - RNA, 16 nt, Mycobacterium bovis subsp bovis AF2122/97
accgcuucccccgguc

SEQ ID NO: 3037239 - RNA, 21 nt, Mycobacterium bovis subsp bovis AF2122/97
accgcuugaccccuggccgcc

SEQ ID NO: 3037240 - RNA, 23 nt, Mycobacterium bovis subsp bovis AF2122/97
accgcuugaccccuggccgccgg

SEQ ID NO: 3037241 - RNA, 16 nt, Mycobacterium bovis subsp bovis AF2122/97
accgcuugcccgcgca

SEQ ID NO: 3037242 - RNA, 19 nt, Mycobacterium bovis subsp bovis AF2122/97
accgcuuugaauugcgcgc

SEQ ID NO: 3037243 - RNA, 19 nt, Mycobacterium bovis subsp bovis AF2122/97
accggaaaccacagcgcca

SEQ ID NO: 3037244 - RNA, 16 nt, Mycobacterium bovis subsp bovis AF2122/97
accggaaaugucuccu

SEQ ID NO: 3037245 - RNA, 22 nt, Mycobacterium bovis subsp bovis AF2122/97
accggaaccaccaguaccaccg

SEQ ID NO: 3037246 - RNA, 23 nt, Mycobacterium bovis subsp bovis AF2122/97
accggaaccagcguaucggccgg

SEQ ID NO: 3037247 - RNA, 13 nt, Mycobacterium bovis subsp bovis AF2122/97
accggaacgccgu

SEQ ID NO: 3037248 - RNA, 20 nt, Mycobacterium bovis subsp bovis AF2122/97
accggaauacgcgccgccgg

SEQ ID NO: 3037249 - RNA, 23 nt, Mycobacterium bovis subsp bovis AF2122/97
accggaauccccccugucgccga

SEQ ID NO: 3037250 - RNA, 17 nt, Mycobacterium bovis subsp bovis AF2122/97
accggacaaacaucgca

SEQ ID NO: 3037251 - RNA, 23 nt, Mycobacterium bovis subsp bovis AF2122/97
accggaccgaagaccuccucggu

SEQ ID NO: 3037252 - RNA, 13 nt, Mycobacterium bovis subsp bovis AF2122/97
accggaccugacc

SEQ ID NO: 3037253 - RNA, 19 nt, Mycobacterium bovis subsp bovis AF2122/97
accggacgaaacgaucgcg

SEQ ID NO: 3037254 - RNA, 22 nt, Mycobacterium bovis subsp bovis AF2122/97
accggacgaaacgaucgcgcca

SEQ ID NO: 3037255 - RNA, 13 nt, Mycobacterium bovis subsp bovis AF2122/97
accggacgaucag

SEQ ID NO: 3037256 - RNA, 17 nt, Mycobacterium bovis subsp bovis AF2122/97
accggacgaucagggug

SEQ ID NO: 3037257 - RNA, 15 nt, Mycobacterium bovis subsp bovis AF2122/97
accggacugcgccgg

SEQ ID NO: 3037258 - RNA, 14 nt, Mycobacterium bovis subsp bovis AF2122/97
accggagagccggu

SEQ ID NO: 3037259 - RNA, 13 nt, Mycobacterium bovis subsp bovis AF2122/97
accggagaucccg

SEQ ID NO: 3037260 - RNA, 18 nt, Mycobacterium bovis subsp bovis AF2122/97
accggagcgccgagcucg

SEQ ID NO: 3037261 - RNA, 19 nt, Mycobacterium bovis subsp bovis AF2122/97
accggagucgcccgguccg

SEQ ID NO: 3037262 - RNA, 12 nt, Mycobacterium bovis subsp bovis AF2122/97
accggaguucag

SEQ ID NO: 3037263 - RNA, 19 nt, Mycobacterium bovis subsp bovis AF2122/97
accggaguucucgcugauc

SEQ ID NO: 3037264 - RNA, 13 nt, Mycobacterium bovis subsp bovis AF2122/97
accggaucaccgc

SEQ ID NO: 3037265 - RNA, 13 nt, Mycobacterium bovis subsp bovis AF2122/97
accggcgaucggg

SEQ ID NO: 3037266 - RNA, 13 nt, Mycobacterium bovis subsp bovis AF2122/97
accggcgcaccgu

SEQ ID NO: 3037267 - RNA, 19 nt, Mycobacterium bovis subsp bovis AF2122/97
accggcgcaguagccgacc

SEQ ID NO: 3037268 - RNA, 20 nt, Mycobacterium bovis subsp bovis AF2122/97
accggcgcaguagccgacca

SEQ ID NO: 3037269 - RNA, 20 nt, Mycobacterium bovis subsp bovis AF2122/97
accggcgccaccggcgccgc

SEQ ID NO: 3037270 - RNA, 15 nt, Mycobacterium bovis subsp bovis AF2122/97
accggcgccaccgug

SEQ ID NO: 3037271 - RNA, 17 nt, Mycobacterium bovis subsp bovis AF2122/97
accggcgcccagcgccu

SEQ ID NO: 3037272 - RNA, 18 nt, Mycobacterium bovis subsp bovis AF2122/97
accggcgcccagcgccuc

SEQ ID NO: 3037273 - RNA, 22 nt, Mycobacterium bovis subsp bovis AF2122/97
accggcgcccagcgccucgaug

SEQ ID NO: 3037274 - RNA, 13 nt, Mycobacterium bovis subsp bovis AF2122/97
accggcgccgccc

SEQ ID NO: 3037275 - RNA, 14 nt, Mycobacterium bovis subsp bovis AF2122/97
accggcgccgcccg

SEQ ID NO: 3037276 - RNA, 17 nt, Mycobacterium bovis subsp bovis AF2122/97
accggcgccgccggcac

SEQ ID NO: 3037277 - RNA, 14 nt, Mycobacterium bovis subsp bovis AF2122/97
accggcgccgccgu

SEQ ID NO: 3037278 - RNA, 16 nt, Mycobacterium bovis subsp bovis AF2122/97
accggcgccgccgucg

SEQ ID NO: 3037279 - RNA, 19 nt, Mycobacterium bovis subsp bovis AF2122/97
accggcgccgccgucgccg

SEQ ID NO: 3037280 - RNA, 21 nt, Mycobacterium bovis subsp bovis AF2122/97
accggcgccgccgucgccgcc

SEQ ID NO: 3037281 - RNA, 15 nt, Mycobacterium bovis subsp bovis AF2122/97
accggcgccgccguu

SEQ ID NO: 3037282 - RNA, 21 nt, Mycobacterium bovis subsp bovis AF2122/97
accggcgccggaguugaagaa

SEQ ID NO: 3037283 - RNA, 19 nt, Mycobacterium bovis subsp bovis AF2122/97
accggcgccguagccgauc

SEQ ID NO: 3037284 - RNA, 13 nt, Mycobacterium bovis subsp bovis AF2122/97
accggcgccuccg

SEQ ID NO: 3037285 - RNA, 17 nt, Mycobacterium bovis subsp bovis AF2122/97
accggcgccuccggcac

SEQ ID NO: 3037286 - RNA, 19 nt, Mycobacterium bovis subsp bovis AF2122/97
accggcgcgaccgcggcga

SEQ ID NO: 3037287 - RNA, 12 nt, Mycobacterium bovis subsp bovis AF2122/97
accggcgcgccc

SEQ ID NO: 3037288 - RNA, 16 nt, Mycobacterium bovis subsp bovis AF2122/97
accggcgcgccccgcc

SEQ ID NO: 3037289 - RNA, 21 nt, Mycobacterium bovis subsp bovis AF2122/97
accggcgcgccccgccgcacg

SEQ ID NO: 3037290 - RNA, 15 nt, Mycobacterium bovis subsp bovis AF2122/97
accggcggcgacggc

SEQ ID NO: 3037291 - RNA, 18 nt, Mycobacterium bovis subsp bovis AF2122/97
accggcggcgacggugcc

SEQ ID NO: 3037292 - RNA, 23 nt, Mycobacterium bovis subsp bovis AF2122/97
accggcggcgacggugccaccgc

SEQ ID NO: 3037293 - RNA, 15 nt, Mycobacterium bovis subsp bovis AF2122/97
accggcggcgagcgg

SEQ ID NO: 3037294 - RNA, 14 nt, Mycobacterium bovis subsp bovis AF2122/97
accggcggcgccgg

SEQ ID NO: 3037295 - RNA, 21 nt, Mycobacterium bovis subsp bovis AF2122/97
accggcggcgccggaggcggc

SEQ ID NO: 3037296 - RNA, 17 nt, Mycobacterium bovis subsp bovis AF2122/97
accggcggcgccggccu

SEQ ID NO: 3037297 - RNA, 19 nt, Mycobacterium bovis subsp bovis AF2122/97
accggcgggaugcgcgccc

SEQ ID NO: 3037298 - RNA, 20 nt, Mycobacterium bovis subsp bovis AF2122/97
accggcgggaugcgcgcccg

SEQ ID NO: 3037299 - RNA, 16 nt, Mycobacterium bovis subsp bovis AF2122/97
accggcgggcgaacgc

SEQ ID NO: 3037300 - RNA, 20 nt, Mycobacterium bovis subsp bovis AF2122/97
accggcgggcgaacgcuuca

SEQ ID NO: 3037301 - RNA, 19 nt, Mycobacterium bovis subsp bovis AF2122/97
accggcggucugcagugca

SEQ ID NO: 3037302 - RNA, 12 nt, Mycobacterium bovis subsp bovis AF2122/97
accggcggugcc

SEQ ID NO: 3037303 - RNA, 13 nt, Mycobacterium bovis subsp bovis AF2122/97
accggcggugccg

SEQ ID NO: 3037304 - RNA, 21 nt, Mycobacterium bovis subsp bovis AF2122/97
accggcggugccgguggugac

SEQ ID NO: 3037305 - RNA, 16 nt, Mycobacterium bovis subsp bovis AF2122/97
accggcguaaccggca

SEQ ID NO: 3037306 - RNA, 18 nt, Mycobacterium bovis subsp bovis AF2122/97
accggcguaaccggcagc

SEQ ID NO: 3037307 - RNA, 23 nt, Mycobacterium bovis subsp bovis AF2122/97
accggcgucgaaggugaccaggc

SEQ ID NO: 3037308 - RNA, 14 nt, Mycobacterium bovis subsp bovis AF2122/97
accggcgucggcgc

SEQ ID NO: 3037309 - RNA, 17 nt, Mycobacterium bovis subsp bovis AF2122/97
accggcgucggcgcggc

SEQ ID NO: 3037310 - RNA, 17 nt, Mycobacterium bovis subsp bovis AF2122/97
accggcgucguugacca

SEQ ID NO: 3037311 - RNA, 17 nt, Mycobacterium bovis subsp bovis AF2122/97
accggcgucugcccgcc

SEQ ID NO: 3037312 - RNA, 20 nt, Mycobacterium bovis subsp bovis AF2122/97
accggcgucugcccgcccag

SEQ ID NO: 3037313 - RNA, 22 nt, Mycobacterium bovis subsp bovis AF2122/97
accggcgucugcccgcccagcc

SEQ ID NO: 3037314 - RNA, 15 nt, Mycobacterium bovis subsp bovis AF2122/97
accggcgugcugugc

SEQ ID NO: 3037315 - RNA, 16 nt, Mycobacterium bovis subsp bovis AF2122/97
accggcgugcugugcu

SEQ ID NO: 3037316 - RNA, 18 nt, Mycobacterium bovis subsp bovis AF2122/97
accggcgugucacgucgc

SEQ ID NO: 3037317 - RNA, 21 nt, Mycobacterium bovis subsp bovis AF2122/97
accggcgugucacgucgcagu

SEQ ID NO: 3037318 - RNA, 19 nt, Mycobacterium bovis subsp bovis AF2122/97
accggcguugcguagacga

SEQ ID NO: 3037319 - RNA, 20 nt, Mycobacterium bovis subsp bovis AF2122/97
accggcuacggcgacacgcc

SEQ ID NO: 3037320 - RNA, 15 nt, Mycobacterium bovis subsp bovis AF2122/97
accggcuaugcuggc

SEQ ID NO: 3037321 - RNA, 22 nt, Mycobacterium bovis subsp bovis AF2122/97
accggcucaaggacgcaccgcc

SEQ ID NO: 3037322 - RNA, 21 nt, Mycobacterium bovis subsp bovis AF2122/97
accggcucaccacgccggucg

SEQ ID NO: 3037323 - RNA, 20 nt, Mycobacterium bovis subsp bovis AF2122/97
accggcucacguaaccagug

SEQ ID NO: 3037324 - RNA, 15 nt, Mycobacterium bovis subsp bovis AF2122/97
accggcucggcggug

SEQ ID NO: 3037325 - RNA, 17 nt, Mycobacterium bovis subsp bovis AF2122/97
accggcugaccggggcg

SEQ ID NO: 3037326 - RNA, 20 nt, Mycobacterium bovis subsp bovis AF2122/97
accggcugaccggggcgccc

SEQ ID NO: 3037327 - RNA, 21 nt, Mycobacterium bovis subsp bovis AF2122/97
accggcugaccggggcgcccg

SEQ ID NO: 3037328 - RNA, 18 nt, Mycobacterium bovis subsp bovis AF2122/97
accggcugauucgagcca

SEQ ID NO: 3037329 - RNA, 22 nt, Mycobacterium bovis subsp bovis AF2122/97
accggcugauucgagccacaug

SEQ ID NO: 3037330 - RNA, 18 nt, Mycobacterium bovis subsp bovis AF2122/97
accggcugcaaccagcgg

SEQ ID NO: 3037331 - RNA, 23 nt, Mycobacterium bovis subsp bovis AF2122/97
accggcugcaaccagcggcacau

SEQ ID NO: 3037332 - RNA, 14 nt, Mycobacterium bovis subsp bovis AF2122/97
accggcugcaggug

SEQ ID NO: 3037333 - RNA, 19 nt, Mycobacterium bovis subsp bovis AF2122/97
accggcugcaggugcuggu

SEQ ID NO: 3037334 - RNA, 12 nt, Mycobacterium bovis subsp bovis AF2122/97
accggcuggcca

SEQ ID NO: 3037335 - RNA, 19 nt, Mycobacterium bovis subsp bovis AF2122/97
accggcuggccagguggcc

SEQ ID NO: 3037336 - RNA, 17 nt, Mycobacterium bovis subsp bovis AF2122/97
accggcuggcccagcga

SEQ ID NO: 3037337 - RNA, 15 nt, Mycobacterium bovis subsp bovis AF2122/97
accggcugggcgcca

SEQ ID NO: 3037338 - RNA, 16 nt, Mycobacterium bovis subsp bovis AF2122/97
accggcuggugccaac

SEQ ID NO: 3037339 - RNA, 21 nt, Mycobacterium bovis subsp bovis AF2122/97
accggcuggugccaacugcgc

SEQ ID NO: 3037340 - RNA, 22 nt, Mycobacterium bovis subsp bovis AF2122/97
accggcuggugccaacugcgcc

SEQ ID NO: 3037341 - RNA, 20 nt, Mycobacterium bovis subsp bovis AF2122/97
accggcugguucaacaccgg

SEQ ID NO: 3037342 - RNA, 21 nt, Mycobacterium bovis subsp bovis AF2122/97
accggcugguugaccgaguug

SEQ ID NO: 3037343 - RNA, 17 nt, Mycobacterium bovis subsp bovis AF2122/97
accggcuuccccagcag

SEQ ID NO: 3037344 - RNA, 17 nt, Mycobacterium bovis subsp bovis AF2122/97
accggcuucggccagca

SEQ ID NO: 3037345 - RNA, 21 nt, Mycobacterium bovis subsp bovis AF2122/97
accggcuucgucggccagcag

SEQ ID NO: 3037346 - RNA, 20 nt, Mycobacterium bovis subsp bovis AF2122/97
accggcuugcccuccgggua

SEQ ID NO: 3037347 - RNA, 15 nt, Mycobacterium bovis subsp bovis AF2122/97
accggcuuggcggga

SEQ ID NO: 3037348 - RNA, 18 nt, Mycobacterium bovis subsp bovis AF2122/97
accggcuugggccaggcc

SEQ ID NO: 3037349 - RNA, 17 nt, Mycobacterium bovis subsp bovis AF2122/97
accgggaaccacgguca

SEQ ID NO: 3037350 - RNA, 19 nt, Mycobacterium bovis subsp bovis AF2122/97
accgggaaccacggucagc

SEQ ID NO: 3037351 - RNA, 16 nt, Mycobacterium bovis subsp bovis AF2122/97
accggugucggccagc

SEQ ID NO: 3037352 - RNA, 19 nt, Mycobacterium bovis subsp bovis AF2122/97
accgguguuccgcccagcg

SEQ ID NO: 3037353 - RNA, 20 nt, Mycobacterium bovis subsp bovis AF2122/97
accgguguuccgcccagcga

SEQ ID NO: 3037354 - RNA, 22 nt, Mycobacterium bovis subsp bovis AF2122/97
accgguguugguauguaaguug

SEQ ID NO: 3037355 - RNA, 17 nt, Mycobacterium bovis subsp bovis AF2122/97
accgguucccgggcagc

SEQ ID NO: 3037356 - RNA, 16 nt, Mycobacterium bovis subsp bovis AF2122/97
accgguugcggucauc

SEQ ID NO: 3037357 - RNA, 22 nt, Mycobacterium bovis subsp bovis AF2122/97
accgguuggguagcaccgauuu

SEQ ID NO: 3037358 - RNA, 15 nt, Mycobacterium bovis subsp bovis AF2122/97
accgguuucgucggu

SEQ ID NO: 3037359 - RNA, 19 nt, Mycobacterium bovis subsp bovis AF2122/97
accgguuucgucggucugc

SEQ ID NO: 3037360 - RNA, 16 nt, Mycobacterium bovis subsp bovis AF2122/97
accgguuucuucggcc

SEQ ID NO: 3037361 - RNA, 17 nt, Mycobacterium bovis subsp bovis AF2122/97
accgguuucuucggcca

SEQ ID NO: 3037362 - RNA, 22 nt, Mycobacterium bovis subsp bovis AF2122/97
accgguuucuucggccagcucc

SEQ ID NO: 3037363 - RNA, 17 nt, Mycobacterium bovis subsp bovis AF2122/97
accgguuuucgccggcu

SEQ ID NO: 3037364 - RNA, 19 nt, Mycobacterium bovis subsp bovis AF2122/97
accgguuuucgccggcucc

SEQ ID NO: 3037365 - RNA, 15 nt, Mycobacterium bovis subsp bovis AF2122/97
accguaauuucuuca

SEQ ID NO: 3037366 - RNA, 22 nt, Mycobacterium bovis subsp bovis AF2122/97
accguaauuucuucacggucga

SEQ ID NO: 3037367 - RNA, 14 nt, Mycobacterium bovis subsp bovis AF2122/97
accguaccgaucca

SEQ ID NO: 3037368 - RNA, 15 nt, Mycobacterium bovis subsp bovis AF2122/97
accguagcccugcuc

SEQ ID NO: 3037369 - RNA, 16 nt, Mycobacterium bovis subsp bovis AF2122/97
accguagugaacggcu

SEQ ID NO: 3037370 - RNA, 14 nt, Mycobacterium bovis subsp bovis AF2122/97
accguauugaccag

SEQ ID NO: 3037371 - RNA, 17 nt, Mycobacterium bovis subsp bovis AF2122/97
accgucaaccugcugca

SEQ ID NO: 3037372 - RNA, 20 nt, Mycobacterium bovis subsp bovis AF2122/97
accgucacaagucgacacgc

SEQ ID NO: 3037373 - RNA, 23 nt, Mycobacterium bovis subsp bovis AF2122/97
accgucacaagucgacacgccga

SEQ ID NO: 3037374 - RNA, 13 nt, Mycobacterium bovis subsp bovis AF2122/97
accgucacccccg

SEQ ID NO: 3037375 - RNA, 16 nt, Mycobacterium bovis subsp bovis AF2122/97
accgucacccccgaua

SEQ ID NO: 3037376 - RNA, 18 nt, Mycobacterium bovis subsp bovis AF2122/97
accgucaccgagcccgau

SEQ ID NO: 3037377 - RNA, 19 nt, Mycobacterium bovis subsp bovis AF2122/97
accgucaccgagcccgauc

SEQ ID NO: 3037378 - RNA, 13 nt, Mycobacterium bovis subsp bovis AF2122/97
accgucaccgccg

SEQ ID NO: 3037379 - RNA, 15 nt, Mycobacterium bovis subsp bovis AF2122/97
accgucacgccaccg

SEQ ID NO: 3037380 - RNA, 13 nt, Mycobacterium bovis subsp bovis AF2122/97
accgucacgucgu

SEQ ID NO: 3037381 - RNA, 20 nt, Mycobacterium bovis subsp bovis AF2122/97
accgucagaccauccagguu

SEQ ID NO: 3037382 - RNA, 14 nt, Mycobacterium bovis subsp bovis AF2122/97
accgucagcgccgc

SEQ ID NO: 3037383 - RNA, 18 nt, Mycobacterium bovis subsp bovis AF2122/97
accgucagcgccgcugac

SEQ ID NO: 3037384 - RNA, 24 nt, Mycobacterium bovis subsp bovis AF2122/97
accgucagcgcgaccgucaggguc

SEQ ID NO: 3037385 - RNA, 18 nt, Mycobacterium bovis subsp bovis AF2122/97
accgucagcgcgccgucg

SEQ ID NO: 3037386 - RNA, 17 nt, Mycobacterium bovis subsp bovis AF2122/97
accgucaguagccacgc

SEQ ID NO: 3037387 - RNA, 20 nt, Mycobacterium bovis subsp bovis AF2122/97
accgucaugaagccguugcc

SEQ ID NO: 3037388 - RNA, 22 nt, Mycobacterium bovis subsp bovis AF2122/97
accgucaugaagccguugccgc

SEQ ID NO: 3037389 - RNA, 16 nt, Mycobacterium bovis subsp bovis AF2122/97
accgucauggcgggug

SEQ ID NO: 3037390 - RNA, 23 nt, Mycobacterium bovis subsp bovis AF2122/97
accgucauggcgggugcggcgau

SEQ ID NO: 3037391 - RNA, 14 nt, Mycobacterium bovis subsp bovis AF2122/97
accguccaccgacg

SEQ ID NO: 3037392 - RNA, 15 nt, Mycobacterium bovis subsp bovis AF2122/97
accguccacgacagc

SEQ ID NO: 3037393 - RNA, 22 nt, Mycobacterium bovis subsp bovis AF2122/97
accguccacgacagcagagugg

SEQ ID NO: 3037394 - RNA, 13 nt, Mycobacterium bovis subsp bovis AF2122/97
accguccagcaac

SEQ ID NO: 3037395 - RNA, 14 nt, Mycobacterium bovis subsp bovis AF2122/97
accguccagcaaca

SEQ ID NO: 3037396 - RNA, 15 nt, Mycobacterium bovis subsp bovis AF2122/97
accguccagcaacag

SEQ ID NO: 3037397 - RNA, 17 nt, Mycobacterium bovis subsp bovis AF2122/97
accguccagcaacagcg

SEQ ID NO: 3037398 - RNA, 13 nt, Mycobacterium bovis subsp bovis AF2122/97
accguccagcagc

SEQ ID NO: 3037399 - RNA, 16 nt, Mycobacterium bovis subsp bovis AF2122/97
accgucccagcgccgc

SEQ ID NO: 3037400 - RNA, 14 nt, Mycobacterium bovis subsp bovis AF2122/97
accguccccggcgu

SEQ ID NO: 3037401 - RNA, 14 nt, Mycobacterium bovis subsp bovis AF2122/97
accguccgacggcg

SEQ ID NO: 3037402 - RNA, 12 nt, Mycobacterium bovis subsp bovis AF2122/97
accguccgcgga

SEQ ID NO: 3037403 - RNA, 14 nt, Mycobacterium bovis subsp bovis AF2122/97
accguccggggccg

SEQ ID NO: 3037404 - RNA, 19 nt, Mycobacterium bovis subsp bovis AF2122/97
accguccgggucaccagcg

SEQ ID NO: 3037405 - RNA, 14 nt, Mycobacterium bovis subsp bovis AF2122/97
accguccgucggcg

SEQ ID NO: 3037406 - RNA, 15 nt, Mycobacterium bovis subsp bovis AF2122/97
accguccgucggcgc

SEQ ID NO: 3037407 - RNA, 14 nt, Mycobacterium bovis subsp bovis AF2122/97
accgucgacagcgu

SEQ ID NO: 3037408 - RNA, 12 nt, Mycobacterium bovis subsp bovis AF2122/97
accgucgaggua

SEQ ID NO: 3037409 - RNA, 17 nt, Mycobacterium bovis subsp bovis AF2122/97
accgucgauuucgacga

SEQ ID NO: 3037410 - RNA, 14 nt, Mycobacterium bovis subsp bovis AF2122/97
accgucgccgccgg

SEQ ID NO: 3037411 - RNA, 16 nt, Mycobacterium bovis subsp bovis AF2122/97
accgucgccggugacg

SEQ ID NO: 3037412 - RNA, 18 nt, Mycobacterium bovis subsp bovis AF2122/97
accgucgccggugacgac

SEQ ID NO: 3037413 - RNA, 20 nt, Mycobacterium bovis subsp bovis AF2122/97
accgucgcgcugccggccgc

SEQ ID NO: 3037414 - RNA, 23 nt, Mycobacterium bovis subsp bovis AF2122/97
accgucgcgggagaaaacggcgg

SEQ ID NO: 3037415 - RNA, 14 nt, Mycobacterium bovis subsp bovis AF2122/97
accgucgcggguca

SEQ ID NO: 3037416 - RNA, 16 nt, Mycobacterium bovis subsp bovis AF2122/97
accgucgcgggucaca

SEQ ID NO: 3037417 - RNA, 18 nt, Mycobacterium bovis subsp bovis AF2122/97
accgucgcuaugcgccgc

SEQ ID NO: 3037418 - RNA, 22 nt, Mycobacterium bovis subsp bovis AF2122/97
accgucggcaccagcagccagc

SEQ ID NO: 3037419 - RNA, 16 nt, Mycobacterium bovis subsp bovis AF2122/97
accgucggcagcagcg

SEQ ID NO: 3037420 - RNA, 22 nt, Mycobacterium bovis subsp bovis AF2122/97
accgucggcagcagcggugcag

SEQ ID NO: 3037421 - RNA, 18 nt, Mycobacterium bovis subsp bovis AF2122/97
accgucgggauggacggc

SEQ ID NO: 3037422 - RNA, 17 nt, Mycobacterium bovis subsp bovis AF2122/97
accgucgggcccagccg

SEQ ID NO: 3037423 - RNA, 22 nt, Mycobacterium bovis subsp bovis AF2122/97
accgucggugaaauucgcggcg

SEQ ID NO: 3037424 - RNA, 17 nt, Mycobacterium bovis subsp bovis AF2122/97
accgucguacucggcgg

SEQ ID NO: 3037425 - RNA, 19 nt, Mycobacterium bovis subsp bovis AF2122/97
accgucguacucggcggcc

SEQ ID NO: 3037426 - RNA, 20 nt, Mycobacterium bovis subsp bovis AF2122/97
accgucguacucggcggcca

SEQ ID NO: 3037427 - RNA, 15 nt, Mycobacterium bovis subsp bovis AF2122/97
accgucgucaccgcg

SEQ ID NO: 3037428 - RNA, 18 nt, Mycobacterium bovis subsp bovis AF2122/97
accgucgucaccgcgacg

SEQ ID NO: 3037429 - RNA, 14 nt, Mycobacterium bovis subsp bovis AF2122/97
accgucguccagac

SEQ ID NO: 3037430 - RNA, 19 nt, Mycobacterium bovis subsp bovis AF2122/97
accgucguggcgguggccg

SEQ ID NO: 3037431 - RNA, 22 nt, Mycobacterium bovis subsp bovis AF2122/97
accgucuccggcgccaccgccg

SEQ ID NO: 3037432 - RNA, 23 nt, Mycobacterium bovis subsp bovis AF2122/97
accgucuccggcgccaccgccgc

SEQ ID NO: 3037433 - RNA, 15 nt, Mycobacterium bovis subsp bovis AF2122/97
accgucucgccgcgc

SEQ ID NO: 3037434 - RNA, 20 nt, Mycobacterium bovis subsp bovis AF2122/97
accgucugcaccggcaggcg

SEQ ID NO: 3037435 - RNA, 14 nt, Mycobacterium bovis subsp bovis AF2122/97
accgucugcuggcc

SEQ ID NO: 3037436 - RNA, 18 nt, Mycobacterium bovis subsp bovis AF2122/97
accgucugcuggccgggu

SEQ ID NO: 3037437 - RNA, 22 nt, Mycobacterium bovis subsp bovis AF2122/97
accgucuggaguucgucaccgu

SEQ ID NO: 3037438 - RNA, 17 nt, Mycobacterium bovis subsp bovis AF2122/97
accucaccugacacgcc

SEQ ID NO: 3037439 - RNA, 12 nt, Mycobacterium bovis subsp bovis AF2122/97
accucacgggcg

SEQ ID NO: 3037440 - RNA, 14 nt, Mycobacterium bovis subsp bovis AF2122/97
accucacugcggcg

SEQ ID NO: 3037441 - RNA, 17 nt, Mycobacterium bovis subsp bovis AF2122/97
accucagaaaguccccg

SEQ ID NO: 3037442 - RNA, 12 nt, Mycobacterium bovis subsp bovis AF2122/97
accucagcgcgg

SEQ ID NO: 3037443 - RNA, 12 nt, Mycobacterium bovis subsp bovis AF2122/97
accucagcugcg

SEQ ID NO: 3037444 - RNA, 17 nt, Mycobacterium bovis subsp bovis AF2122/97
accucaucgcagacggc

SEQ ID NO: 3037445 - RNA, 21 nt, Mycobacterium bovis subsp bovis AF2122/97
accucaucgcggucgccaccg

SEQ ID NO: 3037446 - RNA, 16 nt, Mycobacterium bovis subsp bovis AF2122/97
accucaugaucucacc

SEQ ID NO: 3037447 - RNA, 19 nt, Mycobacterium bovis subsp bovis AF2122/97
accucaugcacgccguagc

SEQ ID NO: 3037448 - RNA, 16 nt, Mycobacterium bovis subsp bovis AF2122/97
accuccaacaggccua

SEQ ID NO: 3037449 - RNA, 21 nt, Mycobacterium bovis subsp bovis AF2122/97
accuccacugggucgcugccg

SEQ ID NO: 3037450 - RNA, 16 nt, Mycobacterium bovis subsp bovis AF2122/97
accuccagcaccaccg

SEQ ID NO: 3037451 - RNA, 15 nt, Mycobacterium bovis subsp bovis AF2122/97
accuccagugcggcc

SEQ ID NO: 3037452 - RNA, 18 nt, Mycobacterium bovis subsp bovis AF2122/97
accucccacccccgguuc

SEQ ID NO: 3037453 - RNA, 16 nt, Mycobacterium bovis subsp bovis AF2122/97
accucccacgccgccg

SEQ ID NO: 3037454 - RNA, 17 nt, Mycobacterium bovis subsp bovis AF2122/97
accucccacgccgccgu

SEQ ID NO: 3037455 - RNA, 13 nt, Mycobacterium bovis subsp bovis AF2122/97
accucccgcagcc

SEQ ID NO: 3037456 - RNA, 24 nt, Mycobacterium bovis subsp bovis AF2122/97
accucccgggcgagccgugccagc

SEQ ID NO: 3037457 - RNA, 17 nt, Mycobacterium bovis subsp bovis AF2122/97
accuccgacggccgcgg

SEQ ID NO: 3037458 - RNA, 19 nt, Mycobacterium bovis subsp bovis AF2122/97
accuccgacggccgcggcg

SEQ ID NO: 3037459 - RNA, 20 nt, Mycobacterium bovis subsp bovis AF2122/97
accuccgacggccgcggcgu

SEQ ID NO: 3037460 - RNA, 14 nt, Mycobacterium bovis subsp bovis AF2122/97
accuccgaggccgc

SEQ ID NO: 3037461 - RNA, 20 nt, Mycobacterium bovis subsp bovis AF2122/97
accuccgaggccgccaucgc

SEQ ID NO: 3037462 - RNA, 14 nt, Mycobacterium bovis subsp bovis AF2122/97
accuccgccaccaa

SEQ ID NO: 3037463 - RNA, 19 nt, Mycobacterium bovis subsp bovis AF2122/97
accuccgcgacggcggcuc

SEQ ID NO: 3037464 - RNA, 15 nt, Mycobacterium bovis subsp bovis AF2122/97
accuccggguccagg

SEQ ID NO: 3037465 - RNA, 17 nt, Mycobacterium bovis subsp bovis AF2122/97
accuccggguccaggaa

SEQ ID NO: 3037466 - RNA, 21 nt, Mycobacterium bovis subsp bovis AF2122/97
accuccggguccaggaacggc

SEQ ID NO: 3037467 - RNA, 11 nt, Mycobacterium bovis subsp bovis AF2122/97
accuccucgaa

SEQ ID NO: 3037468 - RNA, 17 nt, Mycobacterium bovis subsp bovis AF2122/97
accucgaaaccguggcc

SEQ ID NO: 3037469 - RNA, 18 nt, Mycobacterium bovis subsp bovis AF2122/97
accucgaaaccguggcca

SEQ ID NO: 3037470 - RNA, 19 nt, Mycobacterium bovis subsp bovis AF2122/97
accucgaaaccguggccau

SEQ ID NO: 3037471 - RNA, 19 nt, Mycobacterium bovis subsp bovis AF2122/97
accucgaagugcaggugcg

SEQ ID NO: 3037472 - RNA, 14 nt, Mycobacterium bovis subsp bovis AF2122/97
accucgaccuggau

SEQ ID NO: 3037473 - RNA, 22 nt, Mycobacterium bovis subsp bovis AF2122/97
accucgaccuggaugggcucga

SEQ ID NO: 3037474 - RNA, 15 nt, Mycobacterium bovis subsp bovis AF2122/97
accucgacggugacg

SEQ ID NO: 3037475 - RNA, 23 nt, Mycobacterium bovis subsp bovis AF2122/97
accucgacggugacgaccacguc

SEQ ID NO: 3037476 - RNA, 22 nt, Mycobacterium bovis subsp bovis AF2122/97
accucgccaacaucccaacaca

SEQ ID NO: 3037477 - RNA, 15 nt, Mycobacterium bovis subsp bovis AF2122/97
accucgccaucgacc

SEQ ID NO: 3037478 - RNA, 21 nt, Mycobacterium bovis subsp bovis AF2122/97
accucgccaucgaccuugagc

SEQ ID NO: 3037479 - RNA, 13 nt, Mycobacterium bovis subsp bovis AF2122/97
accucgcccauga

SEQ ID NO: 3037480 - RNA, 18 nt, Mycobacterium bovis subsp bovis AF2122/97
accucgcccucccgggcc

SEQ ID NO: 3037481 - RNA, 17 nt, Mycobacterium bovis subsp bovis AF2122/97
accucgcccugcagacg

SEQ ID NO: 3037482 - RNA, 15 nt, Mycobacterium bovis subsp bovis AF2122/97
accucgccgcggcgg

SEQ ID NO: 3037483 - RNA, 11 nt, Mycobacterium bovis subsp bovis AF2122/97
accucgccggc

SEQ ID NO: 3037484 - RNA, 12 nt, Mycobacterium bovis subsp bovis AF2122/97
accucgccggcg

SEQ ID NO: 3037485 - RNA, 13 nt, Mycobacterium bovis subsp bovis AF2122/97
accucgccggcgg

SEQ ID NO: 3037486 - RNA, 15 nt, Mycobacterium bovis subsp bovis AF2122/97
accucgccggugacg

SEQ ID NO: 3037487 - RNA, 19 nt, Mycobacterium bovis subsp bovis AF2122/97
accucgcgcaccggcuggc

SEQ ID NO: 3037488 - RNA, 16 nt, Mycobacterium bovis subsp bovis AF2122/97
accucgcgggcgaucg

SEQ ID NO: 3037489 - RNA, 15 nt, Mycobacterium bovis subsp bovis AF2122/97
accucgcuggccgca

SEQ ID NO: 3037490 - RNA, 15 nt, Mycobacterium bovis subsp bovis AF2122/97
accucggacugcagc

SEQ ID NO: 3037491 - RNA, 21 nt, Mycobacterium bovis subsp bovis AF2122/97
accucggacugcagcgcggcc

SEQ ID NO: 3037492 - RNA, 21 nt, Mycobacterium bovis subsp bovis AF2122/97
accucggagaugaacucggcg

SEQ ID NO: 3037493 - RNA, 15 nt, Mycobacterium bovis subsp bovis AF2122/97
accucggaucgccag

SEQ ID NO: 3037494 - RNA, 18 nt, Mycobacterium bovis subsp bovis AF2122/97
accucggcaaccaccucg

SEQ ID NO: 3037495 - RNA, 23 nt, Mycobacterium bovis subsp bovis AF2122/97
accucggcacggaccgcgucgcg

SEQ ID NO: 3037496 - RNA, 22 nt, Mycobacterium bovis subsp bovis AF2122/97
accucggccagcuccgccugcc

SEQ ID NO: 3037497 - RNA, 14 nt, Mycobacterium bovis subsp bovis AF2122/97
accucggccgccag

SEQ ID NO: 3037498 - RNA, 15 nt, Mycobacterium bovis subsp bovis AF2122/97
accucggccgccagc

SEQ ID NO: 3037499 - RNA, 18 nt, Mycobacterium bovis subsp bovis AF2122/97
accucggccgccagcccc

SEQ ID NO: 3037500 - RNA, 19 nt, Mycobacterium bovis subsp bovis AF2122/97
accucggcgacgaugucga

SEQ ID NO: 3037501 - RNA, 17 nt, Mycobacterium bovis subsp bovis AF2122/97
accucggcgacgucggc

SEQ ID NO: 3037502 - RNA, 18 nt, Mycobacterium bovis subsp bovis AF2122/97
accucggcgaugucgcgc

SEQ ID NO: 3037503 - RNA, 19 nt, Mycobacterium bovis subsp bovis AF2122/97
accucggucccguugccgc

SEQ ID NO: 3037504 - RNA, 21 nt, Mycobacterium bovis subsp bovis AF2122/97
accucggugaccaggccggcc

SEQ ID NO: 3037505 - RNA, 14 nt, Mycobacterium bovis subsp bovis AF2122/97
accucggugccggc

SEQ ID NO: 3037506 - RNA, 17 nt, Mycobacterium bovis subsp bovis AF2122/97
accucggugccggccgc

SEQ ID NO: 3037507 - RNA, 12 nt, Mycobacterium bovis subsp bovis AF2122/97
accucggugcgg

SEQ ID NO: 3037508 - RNA, 20 nt, Mycobacterium bovis subsp bovis AF2122/97
accucgguugguccucggcg

SEQ ID NO: 3037509 - RNA, 23 nt, Mycobacterium bovis subsp bovis AF2122/97
accucguaugccguggccgccau

SEQ ID NO: 3037510 - RNA, 21 nt, Mycobacterium bovis subsp bovis AF2122/97
accucgucaaucaccaccgcc

SEQ ID NO: 3037511 - RNA, 14 nt, Mycobacterium bovis subsp bovis AF2122/97
accucgucacccgg

SEQ ID NO: 3037512 - RNA, 15 nt, Mycobacterium bovis subsp bovis AF2122/97
accucgucacccggu

SEQ ID NO: 3037513 - RNA, 14 nt, Mycobacterium bovis subsp bovis AF2122/97
accucgucaccggu

SEQ ID NO: 3037514 - RNA, 14 nt, Mycobacterium bovis subsp bovis AF2122/97
accucgucccacag

SEQ ID NO: 3037515 - RNA, 13 nt, Mycobacterium bovis subsp bovis AF2122/97
accucgucgaucg

SEQ ID NO: 3037516 - RNA, 17 nt, Mycobacterium bovis subsp bovis AF2122/97
accucgucgaucgccgc

SEQ ID NO: 3037517 - RNA, 19 nt, Mycobacterium bovis subsp bovis AF2122/97
accucgucgaucgccgcgc

SEQ ID NO: 3037518 - RNA, 14 nt, Mycobacterium bovis subsp bovis AF2122/97
accucgucggccga

SEQ ID NO: 3037519 - RNA, 22 nt, Mycobacterium bovis subsp bovis AF2122/97
accucgucggccgacaccgcca

SEQ ID NO: 3037520 - RNA, 23 nt, Mycobacterium bovis subsp bovis AF2122/97
accucgucggccgacaccgccac

SEQ ID NO: 3037521 - RNA, 18 nt, Mycobacterium bovis subsp bovis AF2122/97
accucgucgucgaaguug

SEQ ID NO: 3037522 - RNA, 17 nt, Mycobacterium bovis subsp bovis AF2122/97
accucgugguucugcag

SEQ ID NO: 3037523 - RNA, 18 nt, Mycobacterium bovis subsp bovis AF2122/97
accucguugcugccggcg

SEQ ID NO: 3037524 - RNA, 22 nt, Mycobacterium bovis subsp bovis AF2122/97
accucucgcuugccgaaauccu

SEQ ID NO: 3037525 - RNA, 19 nt, Mycobacterium bovis subsp bovis AF2122/97
accuucggccgaccgggcu

SEQ ID NO: 3037526 - RNA, 16 nt, Mycobacterium bovis subsp bovis AF2122/97
accuucgggacaaagc

SEQ ID NO: 3037527 - RNA, 15 nt, Mycobacterium bovis subsp bovis AF2122/97
accuucgucgcggcc

SEQ ID NO: 3037528 - RNA, 16 nt, Mycobacterium bovis subsp bovis AF2122/97
accuucucgaugcuga

SEQ ID NO: 3037529 - RNA, 18 nt, Mycobacterium bovis subsp bovis AF2122/97
accuucugguccagcacc

SEQ ID NO: 3037530 - RNA, 16 nt, Mycobacterium bovis subsp bovis AF2122/97
accuucuuggcgggug

SEQ ID NO: 3037531 - RNA, 17 nt, Mycobacterium bovis subsp bovis AF2122/97
accuugaccgucgcgca

SEQ ID NO: 3037532 - RNA, 14 nt, Mycobacterium bovis subsp bovis AF2122/97
accuugaucgagca

SEQ ID NO: 3037533 - RNA, 21 nt, Mycobacterium bovis subsp bovis AF2122/97
accuugcccaccaguuccggg

SEQ ID NO: 3037534 - RNA, 22 nt, Mycobacterium bovis subsp bovis AF2122/97
accuugcgguucggacacacag

SEQ ID NO: 3037535 - RNA, 14 nt, Mycobacterium bovis subsp bovis AF2122/97
accuuggccgugcc

SEQ ID NO: 3037536 - RNA, 19 nt, Mycobacterium bovis subsp bovis AF2122/97
accuuggcguugaccagca

SEQ ID NO: 3037537 - RNA, 12 nt, Mycobacterium bovis subsp bovis AF2122/97
accuuggcuggg

SEQ ID NO: 3037538 - RNA, 23 nt, Mycobacterium bovis subsp bovis AF2122/97
accuuggcugggcccgccgucac

SEQ ID NO: 3037539 - RNA, 18 nt, Mycobacterium bovis subsp bovis AF2122/97
accuuggugcccagcagg

SEQ ID NO: 3037540 - RNA, 18 nt, Mycobacterium bovis subsp bovis AF2122/97
accuugguguggggcggc

SEQ ID NO: 3037541 - RNA, 18 nt, Mycobacterium bovis subsp bovis AF2122/97
accuuguggacccgccag

SEQ ID NO: 3037542 - RNA, 12 nt, Mycobacterium bovis subsp bovis AF2122/97
acgaaaaccggu

SEQ ID NO: 3037543 - RNA, 22 nt, Mycobacterium bovis subsp bovis AF2122/97
acgaaaagccgcgucgcgaugu

SEQ ID NO: 3037544 - RNA, 13 nt, Mycobacterium bovis subsp bovis AF2122/97
acgaaaggcgcgu

SEQ ID NO: 3037545 - RNA, 15 nt, Mycobacterium bovis subsp bovis AF2122/97
acgaaaucggcggcg

SEQ ID NO: 3037546 - RNA, 15 nt, Mycobacterium bovis subsp bovis AF2122/97
acgaaaucgucgggu

SEQ ID NO: 3037547 - RNA, 16 nt, Mycobacterium bovis subsp bovis AF2122/97
acgaaaucgucgggua

SEQ ID NO: 3037548 - RNA, 22 nt, Mycobacterium bovis subsp bovis AF2122/97
acgaaauugggcgauucugcgu

SEQ ID NO: 3037549 - RNA, 19 nt, Mycobacterium bovis subsp bovis AF2122/97
acgaacaccagcgcgccgu

SEQ ID NO: 3037550 - RNA, 12 nt, Mycobacterium bovis subsp bovis AF2122/97
acgaacaccccg

SEQ ID NO: 3037551 - RNA, 18 nt, Mycobacterium bovis subsp bovis AF2122/97
acgaacaguugcggcugg

SEQ ID NO: 3037552 - RNA, 14 nt, Mycobacterium bovis subsp bovis AF2122/97
acgaacaugccaug

SEQ ID NO: 3037553 - RNA, 21 nt, Mycobacterium bovis subsp bovis AF2122/97
acgaacccacugcccgccgac

SEQ ID NO: 3037554 - RNA, 16 nt, Mycobacterium bovis subsp bovis AF2122/97
acgaaccccacgcaga

SEQ ID NO: 3037555 - RNA, 16 nt, Mycobacterium bovis subsp bovis AF2122/97
acgaaccccaucagaa

SEQ ID NO: 3037556 - RNA, 23 nt, Mycobacterium bovis subsp bovis AF2122/97
acgaacccgacaauggcgccagc

SEQ ID NO: 3037557 - RNA, 19 nt, Mycobacterium bovis subsp bovis AF2122/97
acgaacccucagccgcgcc

SEQ ID NO: 3037558 - RNA, 12 nt, Mycobacterium bovis subsp bovis AF2122/97
acgaaccgccga

SEQ ID NO: 3037559 - RNA, 20 nt, Mycobacterium bovis subsp bovis AF2122/97
acgaaccgccgacggcgccc

SEQ ID NO: 3037560 - RNA, 20 nt, Mycobacterium bovis subsp bovis AF2122/97
acgaaccgccgccgccgcgu

SEQ ID NO: 3037561 - RNA, 16 nt, Mycobacterium bovis subsp bovis AF2122/97
acgaaccggaucaucg

SEQ ID NO: 3037562 - RNA, 23 nt, Mycobacterium bovis subsp bovis AF2122/97
acgaaccggaucaucgccgcggc

SEQ ID NO: 3037563 - RNA, 20 nt, Mycobacterium bovis subsp bovis AF2122/97
acgaacgaguccaacucggc

SEQ ID NO: 3037564 - RNA, 19 nt, Mycobacterium bovis subsp bovis AF2122/97
acgaacugcagccauucuu

SEQ ID NO: 3037565 - RNA, 21 nt, Mycobacterium bovis subsp bovis AF2122/97
acgaacuggucucggcugaga

SEQ ID NO: 3037566 - RNA, 14 nt, Mycobacterium bovis subsp bovis AF2122/97
acgaacuucgaugc

SEQ ID NO: 3037567 - RNA, 23 nt, Mycobacterium bovis subsp bovis AF2122/97
acgaagaacaccuugggcagcuu

SEQ ID NO: 3037568 - RNA, 19 nt, Mycobacterium bovis subsp bovis AF2122/97
acgaagacuugcaucaaaa

SEQ ID NO: 3037569 - RNA, 21 nt, Mycobacterium bovis subsp bovis AF2122/97
acgaagaucgcgugccacagc

SEQ ID NO: 3037570 - RNA, 22 nt, Mycobacterium bovis subsp bovis AF2122/97
acgaagaucgcgugccacagca

SEQ ID NO: 3037571 - RNA, 18 nt, Mycobacterium bovis subsp bovis AF2122/97
acgaagaucgcugcgaag

SEQ ID NO: 3037572 - RNA, 18 nt, Mycobacterium bovis subsp bovis AF2122/97
acgaagaucuucaccggc

SEQ ID NO: 3037573 - RNA, 13 nt, Mycobacterium bovis subsp bovis AF2122/97
acgaagccggcgc

SEQ ID NO: 3037574 - RNA, 20 nt, Mycobacterium bovis subsp bovis AF2122/97
acgaagcguugaccgcgguc

SEQ ID NO: 3037575 - RNA, 20 nt, Mycobacterium bovis subsp bovis AF2122/97
acgaagguggcauucgucga

SEQ ID NO: 3037576 - RNA, 22 nt, Mycobacterium bovis subsp bovis AF2122/97
acgaagucgaacggcuuggcgu

SEQ ID NO: 3037577 - RNA, 20 nt, Mycobacterium bovis subsp bovis AF2122/97
acgaagucgacgaacucgcc

SEQ ID NO: 3037578 - RNA, 21 nt, Mycobacterium bovis subsp bovis AF2122/97
acgaauccacuggucaacggg

SEQ ID NO: 3037579 - RNA, 13 nt, Mycobacterium bovis subsp bovis AF2122/97
acgaauccccgac

SEQ ID NO: 3037580 - RNA, 15 nt, Mycobacterium bovis subsp bovis AF2122/97
acgaauccgaucacc

SEQ ID NO: 3037581 - RNA, 14 nt, Mycobacterium bovis subsp bovis AF2122/97
acgaauccggccac

SEQ ID NO: 3037582 - RNA, 20 nt, Mycobacterium bovis subsp bovis AF2122/97
acgaaucgcccaucgcaagc

SEQ ID NO: 3037583 - RNA, 13 nt, Mycobacterium bovis subsp bovis AF2122/97
acgaauggggcca

SEQ ID NO: 3037584 - RNA, 24 nt, Mycobacterium bovis subsp bovis AF2122/97
acgaaugggucuuugcccgccacg

SEQ ID NO: 3037585 - RNA, 14 nt, Mycobacterium bovis subsp bovis AF2122/97
acgaaugguaucga

SEQ ID NO: 3037586 - RNA, 16 nt, Mycobacterium bovis subsp bovis AF2122/97
acgaaugucaccccgc

SEQ ID NO: 3037587 - RNA, 19 nt, Mycobacterium bovis subsp bovis AF2122/97
acgaaugucaccccgccca

SEQ ID NO: 3037588 - RNA, 17 nt, Mycobacterium bovis subsp bovis AF2122/97
acgaauguccgcagacg

SEQ ID NO: 3037589 - RNA, 22 nt, Mycobacterium bovis subsp bovis AF2122/97
acgacaaaccgggcgugccauc

SEQ ID NO: 3037590 - RNA, 15 nt, Mycobacterium bovis subsp bovis AF2122/97
acgacaacacccacg

SEQ ID NO: 3037591 - RNA, 16 nt, Mycobacterium bovis subsp bovis AF2122/97
acgacaacagccagcu

SEQ ID NO: 3037592 - RNA, 19 nt, Mycobacterium bovis subsp bovis AF2122/97
acgacaacaggccgucgau

SEQ ID NO: 3037593 - RNA, 14 nt, Mycobacterium bovis subsp bovis AF2122/97
acgacaaccgagcu

SEQ ID NO: 3037594 - RNA, 20 nt, Mycobacterium bovis subsp bovis AF2122/97
acgacaagugcccggccaac

SEQ ID NO: 3037595 - RNA, 15 nt, Mycobacterium bovis subsp bovis AF2122/97
acgacaccucgaagg

SEQ ID NO: 3037596 - RNA, 13 nt, Mycobacterium bovis subsp bovis AF2122/97
acgacacguugac

SEQ ID NO: 3037597 - RNA, 16 nt, Mycobacterium bovis subsp bovis AF2122/97
acgacaggcgcccaca

SEQ ID NO: 3037598 - RNA, 15 nt, Mycobacterium bovis subsp bovis AF2122/97
acgacaggucgcccg

SEQ ID NO: 3037599 - RNA, 20 nt, Mycobacterium bovis subsp bovis AF2122/97
acgacagucgcagucgcuaa

SEQ ID NO: 3037600 - RNA, 22 nt, Mycobacterium bovis subsp bovis AF2122/97
acgacauacgagcagugaccgc

SEQ ID NO: 3037601 - RNA, 19 nt, Mycobacterium bovis subsp bovis AF2122/97
acgacaucaccaccgcacg

SEQ ID NO: 3037602 - RNA, 23 nt, Mycobacterium bovis subsp bovis AF2122/97
acgacaucgagccaacgcgcaga

SEQ ID NO: 3037603 - RNA, 20 nt, Mycobacterium bovis subsp bovis AF2122/97
acgacaucguaggccggcau

SEQ ID NO: 3037604 - RNA, 19 nt, Mycobacterium bovis subsp bovis AF2122/97
acgacaugagcgccacgcc

SEQ ID NO: 3037605 - RNA, 21 nt, Mycobacterium bovis subsp bovis AF2122/97
acgacaugguuggugucguac

SEQ ID NO: 3037606 - RNA, 13 nt, Mycobacterium bovis subsp bovis AF2122/97
acgaccaauagca

SEQ ID NO: 3037607 - RNA, 12 nt, Mycobacterium bovis subsp bovis AF2122/97
acgaccagcaga

SEQ ID NO: 3037608 - RNA, 13 nt, Mycobacterium bovis subsp bovis AF2122/97
acgaccagcagau

SEQ ID NO: 3037609 - RNA, 17 nt, Mycobacterium bovis subsp bovis AF2122/97
acgaccagcagauccag

SEQ ID NO: 3037610 - RNA, 13 nt, Mycobacterium bovis subsp bovis AF2122/97
acgaccagccccg

SEQ ID NO: 3037611 - RNA, 17 nt, Mycobacterium bovis subsp bovis AF2122/97
acgagcuuccacgccgg

SEQ ID NO: 3037612 - RNA, 19 nt, Mycobacterium bovis subsp bovis AF2122/97
acgagcuuccacgccggac

SEQ ID NO: 3037613 - RNA, 14 nt, Mycobacterium bovis subsp bovis AF2122/97
acgaggacgucacc

SEQ ID NO: 3037614 - RNA, 18 nt, Mycobacterium bovis subsp bovis AF2122/97
acgaggacgucaccguca

SEQ ID NO: 3037615 - RNA, 19 nt, Mycobacterium bovis subsp bovis AF2122/97
acgaggcacaaucaccgcc

SEQ ID NO: 3037616 - RNA, 21 nt, Mycobacterium bovis subsp bovis AF2122/97
acgaggcacaaucaccgccgc

SEQ ID NO: 3037617 - RNA, 14 nt, Mycobacterium bovis subsp bovis AF2122/97
acgaggccgacgac

SEQ ID NO: 3037618 - RNA, 23 nt, Mycobacterium bovis subsp bovis AF2122/97
acgaggccgacgacauugggcgc

SEQ ID NO: 3037619 - RNA, 17 nt, Mycobacterium bovis subsp bovis AF2122/97
acgaggcguucaccacg

SEQ ID NO: 3037620 - RNA, 22 nt, Mycobacterium bovis subsp bovis AF2122/97
acgaggcguucaccacgaucgc

SEQ ID NO: 3037621 - RNA, 23 nt, Mycobacterium bovis subsp bovis AF2122/97
acgaggcguucaccacgaucgcg

SEQ ID NO: 3037622 - RNA, 20 nt, Mycobacterium bovis subsp bovis AF2122/97
acgagggccacguagcagca

SEQ ID NO: 3037623 - RNA, 14 nt, Mycobacterium bovis subsp bovis AF2122/97
acgagguagcgcgc

SEQ ID NO: 3037624 - RNA, 20 nt, Mycobacterium bovis subsp bovis AF2122/97
acgagguagcgcgcaacgua

SEQ ID NO: 3037625 - RNA, 15 nt, Mycobacterium bovis subsp bovis AF2122/97
acgaggucugcggcc

SEQ ID NO: 3037626 - RNA, 16 nt, Mycobacterium bovis subsp bovis AF2122/97
acgaggucugcggccg

SEQ ID NO: 3037627 - RNA, 16 nt, Mycobacterium bovis subsp bovis AF2122/97
acgagguugccgcacc

SEQ ID NO: 3037628 - RNA, 24 nt, Mycobacterium bovis subsp bovis AF2122/97
acgagguugccgcaccagucgcgc

SEQ ID NO: 3037629 - RNA, 18 nt, Mycobacterium bovis subsp bovis AF2122/97
acgaguacgggcaggccg

SEQ ID NO: 3037630 - RNA, 17 nt, Mycobacterium bovis subsp bovis AF2122/97
acgaguaggcggcuccg

SEQ ID NO: 3037631 - RNA, 12 nt, Mycobacterium bovis subsp bovis AF2122/97
acgagucgccag

SEQ ID NO: 3037632 - RNA, 19 nt, Mycobacterium bovis subsp bovis AF2122/97
acgagucgccgcgggcagc

SEQ ID NO: 3037633 - RNA, 15 nt, Mycobacterium bovis subsp bovis AF2122/97
acgagucgucguccg

SEQ ID NO: 3037634 - RNA, 19 nt, Mycobacterium bovis subsp bovis AF2122/97
acgaguuaccgguggugcg

SEQ ID NO: 3037635 - RNA, 23 nt, Mycobacterium bovis subsp bovis AF2122/97
acgauaaaugcuucgaccgccgu

SEQ ID NO: 3037636 - RNA, 23 nt, Mycobacterium bovis subsp bovis AF2122/97
acgauauagggcuccucgugcac

SEQ ID NO: 3037637 - RNA, 15 nt, Mycobacterium bovis subsp bovis AF2122/97
acgaucaacccgguc

SEQ ID NO: 3037638 - RNA, 17 nt, Mycobacterium bovis subsp bovis AF2122/97
acgaucaacccggucca

SEQ ID NO: 3037639 - RNA, 14 nt, Mycobacterium bovis subsp bovis AF2122/97
acgaucaagcuggc

SEQ ID NO: 3037640 - RNA, 13 nt, Mycobacterium bovis subsp bovis AF2122/97
acgaucacaccac

SEQ ID NO: 3037641 - RNA, 16 nt, Mycobacterium bovis subsp bovis AF2122/97
acgaucagcacgucgc

SEQ ID NO: 3037642 - RNA, 13 nt, Mycobacterium bovis subsp bovis AF2122/97
acgaucagcagcg

SEQ ID NO: 3037643 - RNA, 16 nt, Mycobacterium bovis subsp bovis AF2122/97
acgaucagcagcgucg

SEQ ID NO: 3037644 - RNA, 22 nt, Mycobacterium bovis subsp bovis AF2122/97
acgaucaggccgucgccggagu

SEQ ID NO: 3037645 - RNA, 24 nt, Mycobacterium bovis subsp bovis AF2122/97
acgaucaucgggguggccaccagc

SEQ ID NO: 3037646 - RNA, 22 nt, Mycobacterium bovis subsp bovis AF2122/97
acgaucauugcacccaccccga

SEQ ID NO: 3037647 - RNA, 21 nt, Mycobacterium bovis subsp bovis AF2122/97
acgauccagcccaacucggcc

SEQ ID NO: 3037648 - RNA, 12 nt, Mycobacterium bovis subsp bovis AF2122/97
acgaucccgccg

SEQ ID NO: 3037649 - RNA, 21 nt, Mycobacterium bovis subsp bovis AF2122/97
acgaucgaugaccuuugaguc

SEQ ID NO: 3037650 - RNA, 19 nt, Mycobacterium bovis subsp bovis AF2122/97
acgaucgccaggccgagcc

SEQ ID NO: 3037651 - RNA, 15 nt, Mycobacterium bovis subsp bovis AF2122/97
acgaucgcgccgucg

SEQ ID NO: 3037652 - RNA, 19 nt, Mycobacterium bovis subsp bovis AF2122/97
acgaucgcggcgggcccga

SEQ ID NO: 3037653 - RNA, 15 nt, Mycobacterium bovis subsp bovis AF2122/97
acgaucggcggcgcg

SEQ ID NO: 3037654 - RNA, 19 nt, Mycobacterium bovis subsp bovis AF2122/97
acgaucggcucacgacugc

SEQ ID NO: 3037655 - RNA, 20 nt, Mycobacterium bovis subsp bovis AF2122/97
acgaucguagguacgcaggg

SEQ ID NO: 3037656 - RNA, 16 nt, Mycobacterium bovis subsp bovis AF2122/97
acgaucgugcgaucga

SEQ ID NO: 3037657 - RNA, 16 nt, Mycobacterium bovis subsp bovis AF2122/97
acgaucucgccgccag

SEQ ID NO: 3037658 - RNA, 16 nt, Mycobacterium bovis subsp bovis AF2122/97
acgaucucgccggcga

SEQ ID NO: 3037659 - RNA, 14 nt, Mycobacterium bovis subsp bovis AF2122/97
acgaucugcagcac

SEQ ID NO: 3037660 - RNA, 17 nt, Mycobacterium bovis subsp bovis AF2122/97
acgaugaaccgggcagc

SEQ ID NO: 3037661 - RNA, 13 nt, Mycobacterium bovis subsp bovis AF2122/97
acgaugaccgcgc

SEQ ID NO: 3037662 - RNA, 14 nt, Mycobacterium bovis subsp bovis AF2122/97
acgaugaccgcgcg

SEQ ID NO: 3037663 - RNA, 23 nt, Mycobacterium bovis subsp bovis AF2122/97
acgaugaccgcgcggcccgccga

SEQ ID NO: 3037664 - RNA, 23 nt, Mycobacterium bovis subsp bovis AF2122/97
acgaugaccggaaaugucuccuc

SEQ ID NO: 3037665 - RNA, 15 nt, Mycobacterium bovis subsp bovis AF2122/97
acgaugaucccaagc

SEQ ID NO: 3037666 - RNA, 22 nt, Mycobacterium bovis subsp bovis AF2122/97
acgaugcccuucugacuaucuc

SEQ ID NO: 3037667 - RNA, 12 nt, Mycobacterium bovis subsp bovis AF2122/97
acgaugccgccg

SEQ ID NO: 3037668 - RNA, 14 nt, Mycobacterium bovis subsp bovis AF2122/97
acgaugccgccggc

SEQ ID NO: 3037669 - RNA, 16 nt, Mycobacterium bovis subsp bovis AF2122/97
acgaugccgccggcgg

SEQ ID NO: 3037670 - RNA, 22 nt, Mycobacterium bovis subsp bovis AF2122/97
acgaugccgccugguguacaca

SEQ ID NO: 3037671 - RNA, 22 nt, Mycobacterium bovis subsp bovis AF2122/97
acgaugccggcaagccugcgcu

SEQ ID NO: 3037672 - RNA, 14 nt, Mycobacterium bovis subsp bovis AF2122/97
acgaugccggcccg

SEQ ID NO: 3037673 - RNA, 17 nt, Mycobacterium bovis subsp bovis AF2122/97
acgaugccucggcggcc

SEQ ID NO: 3037674 - RNA, 20 nt, Mycobacterium bovis subsp bovis AF2122/97
acgaugccucggcggccucg

SEQ ID NO: 3037675 - RNA, 16 nt, Mycobacterium bovis subsp bovis AF2122/97
acgaugcgcacaccga

SEQ ID NO: 3037676 - RNA, 21 nt, Mycobacterium bovis subsp bovis AF2122/97
acgaugcgggcgaucucgaug

SEQ ID NO: 3037677 - RNA, 13 nt, Mycobacterium bovis subsp bovis AF2122/97
acgaugcucagcu

SEQ ID NO: 3037678 - RNA, 16 nt, Mycobacterium bovis subsp bovis AF2122/97
acgaugcucagcuggu

SEQ ID NO: 3037679 - RNA, 18 nt, Mycobacterium bovis subsp bovis AF2122/97
acgaugcuggcggccucg

SEQ ID NO: 3037680 - RNA, 14 nt, Mycobacterium bovis subsp bovis AF2122/97
acgauggccgccgc

SEQ ID NO: 3037681 - RNA, 17 nt, Mycobacterium bovis subsp bovis AF2122/97
acgauggccgccgcgag

SEQ ID NO: 3037682 - RNA, 14 nt, Mycobacterium bovis subsp bovis AF2122/97
acgauggccggguc

SEQ ID NO: 3037683 - RNA, 15 nt, Mycobacterium bovis subsp bovis AF2122/97
acgauggcggccacc

SEQ ID NO: 3037684 - RNA, 16 nt, Mycobacterium bovis subsp bovis AF2122/97
acgauggcgucggcca

SEQ ID NO: 3037685 - RNA, 18 nt, Mycobacterium bovis subsp bovis AF2122/97
acgauggcgucggccagg

SEQ ID NO: 3037686 - RNA, 17 nt, Mycobacterium bovis subsp bovis AF2122/97
acgaugguggcgaucau

SEQ ID NO: 3037687 - RNA, 19 nt, Mycobacterium bovis subsp bovis AF2122/97
acgaugguguaacggcggc

SEQ ID NO: 3037688 - RNA, 20 nt, Mycobacterium bovis subsp bovis AF2122/97
acgaugguguacugcugcuu

SEQ ID NO: 3037689 - RNA, 12 nt, Mycobacterium bovis subsp bovis AF2122/97
acgaugucaccc

SEQ ID NO: 3037690 - RNA, 14 nt, Mycobacterium bovis subsp bovis AF2122/97
acgauguccuggaa

SEQ ID NO: 3037691 - RNA, 14 nt, Mycobacterium bovis subsp bovis AF2122/97
acgaugucggcacc

SEQ ID NO: 3037692 - RNA, 23 nt, Mycobacterium bovis subsp bovis AF2122/97
acgaugucggucggaucggcgcc

SEQ ID NO: 3037693 - RNA, 19 nt, Mycobacterium bovis subsp bovis AF2122/97
acgaugugguccaucgcgc

SEQ ID NO: 3037694 - RNA, 14 nt, Mycobacterium bovis subsp bovis AF2122/97
acgauucggcggcc

SEQ ID NO: 3037695 - RNA, 22 nt, Mycobacterium bovis subsp bovis AF2122/97
acgauucggcggccgugucggg

SEQ ID NO: 3037696 - RNA, 16 nt, Mycobacterium bovis subsp bovis AF2122/97
acgauuuuagcggcug

SEQ ID NO: 3037697 - RNA, 23 nt, Mycobacterium bovis subsp bovis AF2122/97
acgcaaaauccccucgcaaccgg

SEQ ID NO: 3037698 - RNA, 19 nt, Mycobacterium bovis subsp bovis AF2122/97
acgcaaaaucgcccaauuc

SEQ ID NO: 3037699 - RNA, 20 nt, Mycobacterium bovis subsp bovis AF2122/97
acgcaaaaucgcccaauuuc

SEQ ID NO: 3037700 - RNA, 15 nt, Mycobacterium bovis subsp bovis AF2122/97
acgcaaagacagcgc

SEQ ID NO: 3037701 - RNA, 11 nt, Mycobacterium bovis subsp bovis AF2122/97
acgcaacaucg

SEQ ID NO: 3037702 - RNA, 22 nt, Mycobacterium bovis subsp bovis AF2122/97
acgcaacggugaucagccaccg

SEQ ID NO: 3037703 - RNA, 17 nt, Mycobacterium bovis subsp bovis AF2122/97
acgcaauagccaucacg

SEQ ID NO: 3037704 - RNA, 18 nt, Mycobacterium bovis subsp bovis AF2122/97
acgcacaauacggucagc

SEQ ID NO: 3037705 - RNA, 13 nt, Mycobacterium bovis subsp bovis AF2122/97
acgcacacaccgu

SEQ ID NO: 3037706 - RNA, 14 nt, Mycobacterium bovis subsp bovis AF2122/97
acgcacagcagcac

SEQ ID NO: 3037707 - RNA, 15 nt, Mycobacterium bovis subsp bovis AF2122/97
acgcacagcccgaug

SEQ ID NO: 3037708 - RNA, 23 nt, Mycobacterium bovis subsp bovis AF2122/97
acgcaccacaaacaccccacaca

SEQ ID NO: 3037709 - RNA, 17 nt, Mycobacterium bovis subsp bovis AF2122/97
acgcaccacaauccacg

SEQ ID NO: 3037710 - RNA, 13 nt, Mycobacterium bovis subsp bovis AF2122/97
acgcacccaccga

SEQ ID NO: 3037711 - RNA, 18 nt, Mycobacterium bovis subsp bovis AF2122/97
acgcaccgaaacgccgac

SEQ ID NO: 3037712 - RNA, 18 nt, Mycobacterium bovis subsp bovis AF2122/97
acgcaccgaggccgccga

SEQ ID NO: 3037713 - RNA, 12 nt, Mycobacterium bovis subsp bovis AF2122/97
acgcaccgcccc

SEQ ID NO: 3037714 - RNA, 15 nt, Mycobacterium bovis subsp bovis AF2122/97
acgcaccgccccgcc

SEQ ID NO: 3037715 - RNA, 17 nt, Mycobacterium bovis subsp bovis AF2122/97
acgcaccgcgguggggu

SEQ ID NO: 3037716 - RNA, 12 nt, Mycobacterium bovis subsp bovis AF2122/97
acgcaccggcgc

SEQ ID NO: 3037717 - RNA, 14 nt, Mycobacterium bovis subsp bovis AF2122/97
acgcaccugcgcgc

SEQ ID NO: 3037718 - RNA, 16 nt, Mycobacterium bovis subsp bovis AF2122/97
acgcaccugcgcgcgg

SEQ ID NO: 3037719 - RNA, 22 nt, Mycobacterium bovis subsp bovis AF2122/97
acgcacgacugugcgccgcagc

SEQ ID NO: 3037720 - RNA, 20 nt, Mycobacterium bovis subsp bovis AF2122/97
acgcacgcaguucggucagc

SEQ ID NO: 3037721 - RNA, 14 nt, Mycobacterium bovis subsp bovis AF2122/97
acgcacgccgcgug

SEQ ID NO: 3037722 - RNA, 16 nt, Mycobacterium bovis subsp bovis AF2122/97
acgcacgcgguucacc

SEQ ID NO: 3037723 - RNA, 21 nt, Mycobacterium bovis subsp bovis AF2122/97
acgcacgcgguucaccacguc

SEQ ID NO: 3037724 - RNA, 13 nt, Mycobacterium bovis subsp bovis AF2122/97
acgcacggccacc

SEQ ID NO: 3037725 - RNA, 21 nt, Mycobacterium bovis subsp bovis AF2122/97
acgcagaagcccccaaaccgg

SEQ ID NO: 3037726 - RNA, 23 nt, Mycobacterium bovis subsp bovis AF2122/97
acgcagaaguugauggucaaugc

SEQ ID NO: 3037727 - RNA, 15 nt, Mycobacterium bovis subsp bovis AF2122/97
acgcagaaucgccua

SEQ ID NO: 3037728 - RNA, 16 nt, Mycobacterium bovis subsp bovis AF2122/97
acgcagaccguccagc

SEQ ID NO: 3037729 - RNA, 22 nt, Mycobacterium bovis subsp bovis AF2122/97
acgcagagccaacaaaucaggg

SEQ ID NO: 3037730 - RNA, 16 nt, Mycobacterium bovis subsp bovis AF2122/97
acgcagagucaacaga

SEQ ID NO: 3037731 - RNA, 17 nt, Mycobacterium bovis subsp bovis AF2122/97
acgcagaucaggguggc

SEQ ID NO: 3037732 - RNA, 15 nt, Mycobacterium bovis subsp bovis AF2122/97
acgcagcacggcacc

SEQ ID NO: 3037733 - RNA, 18 nt, Mycobacterium bovis subsp bovis AF2122/97
acgcagccaaugccggau

SEQ ID NO: 3037734 - RNA, 14 nt, Mycobacterium bovis subsp bovis AF2122/97
acgcagccacgucu

SEQ ID NO: 3037735 - RNA, 12 nt, Mycobacterium bovis subsp bovis AF2122/97
acgcagcccguc

SEQ ID NO: 3037736 - RNA, 17 nt, Mycobacterium bovis subsp bovis AF2122/97
acgcagcccgucggcgc

SEQ ID NO: 3037737 - RNA, 23 nt, Mycobacterium bovis subsp bovis AF2122/97
acgcagccgauacaggccacgca

SEQ ID NO: 3037738 - RNA, 19 nt, Mycobacterium bovis subsp bovis AF2122/97
acgcagccguagcugggca

SEQ ID NO: 3037739 - RNA, 23 nt, Mycobacterium bovis subsp bovis AF2122/97
acgcagccguagcugggcacccc

SEQ ID NO: 3037740 - RNA, 14 nt, Mycobacterium bovis subsp bovis AF2122/97
acgcagcgcggcug

SEQ ID NO: 3037741 - RNA, 20 nt, Mycobacterium bovis subsp bovis AF2122/97
acgcagcgcggcuggggccc

SEQ ID NO: 3037742 - RNA, 22 nt, Mycobacterium bovis subsp bovis AF2122/97
acgcagcggcaaggucaacggg

SEQ ID NO: 3037743 - RNA, 19 nt, Mycobacterium bovis subsp bovis AF2122/97
acgcagcuugcccgacggc

SEQ ID NO: 3037744 - RNA, 22 nt, Mycobacterium bovis subsp bovis AF2122/97
acgcaggaaaaccccggccacc

SEQ ID NO: 3037745 - RNA, 15 nt, Mycobacterium bovis subsp bovis AF2122/97
acgcaggaucacacu

SEQ ID NO: 3037746 - RNA, 22 nt, Mycobacterium bovis subsp bovis AF2122/97
acgcaggugaacgccggugcgc

SEQ ID NO: 3037747 - RNA, 14 nt, Mycobacterium bovis subsp bovis AF2122/97
acgcagugcccgau

SEQ ID NO: 3037748 - RNA, 16 nt, Mycobacterium bovis subsp bovis AF2122/97
acgcaguucggucagc

SEQ ID NO: 3037749 - RNA, 18 nt, Mycobacterium bovis subsp bovis AF2122/97
acgcaguucggucagcgc

SEQ ID NO: 3037750 - RNA, 20 nt, Mycobacterium bovis subsp bovis AF2122/97
acgcauaagcccccgcacgc

SEQ ID NO: 3037751 - RNA, 23 nt, Mycobacterium bovis subsp bovis AF2122/97
acgcauaagcccccgcacgcacg

SEQ ID NO: 3037752 - RNA, 20 nt, Mycobacterium bovis subsp bovis AF2122/97
acgcaucccgaauggccgau

SEQ ID NO: 3037753 - RNA, 14 nt, Mycobacterium bovis subsp bovis AF2122/97
acgcaucgaugcgu

SEQ ID NO: 3037754 - RNA, 13 nt, Mycobacterium bovis subsp bovis AF2122/97
acgcaucgucagc

SEQ ID NO: 3037755 - RNA, 20 nt, Mycobacterium bovis subsp bovis AF2122/97
acgcaugcgagaacgucgag

SEQ ID NO: 3037756 - RNA, 12 nt, Mycobacterium bovis subsp bovis AF2122/97
acgcaugcgcgc

SEQ ID NO: 3037757 - RNA, 13 nt, Mycobacterium bovis subsp bovis AF2122/97
acgcaugcgcgcg

SEQ ID NO: 3037758 - RNA, 22 nt, Mycobacterium bovis subsp bovis AF2122/97
acgcaugcgugacccgacaugg

SEQ ID NO: 3037759 - RNA, 17 nt, Mycobacterium bovis subsp bovis AF2122/97
acgcaugggccagguca

SEQ ID NO: 3037760 - RNA, 18 nt, Mycobacterium bovis subsp bovis AF2122/97
acgcaugucgggccaggc

SEQ ID NO: 3037761 - RNA, 19 nt, Mycobacterium bovis subsp bovis AF2122/97
acgcaugucgggccaggcg

SEQ ID NO: 3037762 - RNA, 23 nt, Mycobacterium bovis subsp bovis AF2122/97
acgcauuguccugaaaacaccgc

SEQ ID NO: 3037763 - RNA, 21 nt, Mycobacterium bovis subsp bovis AF2122/97
acgccaaaauggugccguccg

SEQ ID NO: 3037764 - RNA, 12 nt, Mycobacterium bovis subsp bovis AF2122/97
acgccaacaccg

SEQ ID NO: 3037765 - RNA, 13 nt, Mycobacterium bovis subsp bovis AF2122/97
acgccaacaccgg

SEQ ID NO: 3037766 - RNA, 17 nt, Mycobacterium bovis subsp bovis AF2122/97
acgccaacaccggcauc

SEQ ID NO: 3037767 - RNA, 19 nt, Mycobacterium bovis subsp bovis AF2122/97
acgccaacgugacgccggc

SEQ ID NO: 3037768 - RNA, 19 nt, Mycobacterium bovis subsp bovis AF2122/97
acgccaacguugcgccagc

SEQ ID NO: 3037769 - RNA, 17 nt, Mycobacterium bovis subsp bovis AF2122/97
acgccaagcucggccca

SEQ ID NO: 3037770 - RNA, 19 nt, Mycobacterium bovis subsp bovis AF2122/97
acgccaagcucggcccagc

SEQ ID NO: 3037771 - RNA, 20 nt, Mycobacterium bovis subsp bovis AF2122/97
acgccaagcucggcccagcg

SEQ ID NO: 3037772 - RNA, 18 nt, Mycobacterium bovis subsp bovis AF2122/97
acgccaaguacgcgaccg

SEQ ID NO: 3037773 - RNA, 18 nt, Mycobacterium bovis subsp bovis AF2122/97
acgccaaguccgcucacc

SEQ ID NO: 3037774 - RNA, 12 nt, Mycobacterium bovis subsp bovis AF2122/97
acgccaaugccg

SEQ ID NO: 3037775 - RNA, 20 nt, Mycobacterium bovis subsp bovis AF2122/97
acgccaaugccgcggaggcg

SEQ ID NO: 3037776 - RNA, 13 nt, Mycobacterium bovis subsp bovis AF2122/97
acgccaccaccuc

SEQ ID NO: 3037777 - RNA, 17 nt, Mycobacterium bovis subsp bovis AF2122/97
acgccaccaccuccgcg

SEQ ID NO: 3037778 - RNA, 13 nt, Mycobacterium bovis subsp bovis AF2122/97
acgccacccaggg

SEQ ID NO: 3037779 - RNA, 15 nt, Mycobacterium bovis subsp bovis AF2122/97
acgccacccagggcc

SEQ ID NO: 3037780 - RNA, 12 nt, Mycobacterium bovis subsp bovis AF2122/97
acgccaccgcga

SEQ ID NO: 3037781 - RNA, 16 nt, Mycobacterium bovis subsp bovis AF2122/97
acgccaccgcggucac

SEQ ID NO: 3037782 - RNA, 22 nt, Mycobacterium bovis subsp bovis AF2122/97
acgccaccgcggucaccgacgc

SEQ ID NO: 3037783 - RNA, 13 nt, Mycobacterium bovis subsp bovis AF2122/97
acgccaccgucgc

SEQ ID NO: 3037784 - RNA, 14 nt, Mycobacterium bovis subsp bovis AF2122/97
acgccgacggcacc

SEQ ID NO: 3037785 - RNA, 16 nt, Mycobacterium bovis subsp bovis AF2122/97
acgccgagaccgccgc

SEQ ID NO: 3037786 - RNA, 20 nt, Mycobacterium bovis subsp bovis AF2122/97
acgccgagaccgccgcugcc

SEQ ID NO: 3037787 - RNA, 15 nt, Mycobacterium bovis subsp bovis AF2122/97
acgccgagcacacgu

SEQ ID NO: 3037788 - RNA, 13 nt, Mycobacterium bovis subsp bovis AF2122/97
acgccgagcgcca

SEQ ID NO: 3037789 - RNA, 13 nt, Mycobacterium bovis subsp bovis AF2122/97
acgccgaggcguu

SEQ ID NO: 3037790 - RNA, 22 nt, Mycobacterium bovis subsp bovis AF2122/97
acgccgaggucuccggugcgca

SEQ ID NO: 3037791 - RNA, 15 nt, Mycobacterium bovis subsp bovis AF2122/97
acgccgaucgcggcg

SEQ ID NO: 3037792 - RNA, 17 nt, Mycobacterium bovis subsp bovis AF2122/97
acgccgaucgcggcggc

SEQ ID NO: 3037793 - RNA, 18 nt, Mycobacterium bovis subsp bovis AF2122/97
acgccgaucgcggcggcc

SEQ ID NO: 3037794 - RNA, 23 nt, Mycobacterium bovis subsp bovis AF2122/97
acgccgaucugguaagucagcuc

SEQ ID NO: 3037795 - RNA, 17 nt, Mycobacterium bovis subsp bovis AF2122/97
acgccgaugcggugcgg

SEQ ID NO: 3037796 - RNA, 18 nt, Mycobacterium bovis subsp bovis AF2122/97
acgccgcaauggaccgaa

SEQ ID NO: 3037797 - RNA, 23 nt, Mycobacterium bovis subsp bovis AF2122/97
acgccgcaucggcgggucugggu

SEQ ID NO: 3037798 - RNA, 12 nt, Mycobacterium bovis subsp bovis AF2122/97
acgccgccaccc

SEQ ID NO: 3037799 - RNA, 19 nt, Mycobacterium bovis subsp bovis AF2122/97
acgccgccacccggcgggc

SEQ ID NO: 3037800 - RNA, 20 nt, Mycobacterium bovis subsp bovis AF2122/97
acgccgccagcaccucggcc

SEQ ID NO: 3037801 - RNA, 14 nt, Mycobacterium bovis subsp bovis AF2122/97
acgccgccagcaga

SEQ ID NO: 3037802 - RNA, 20 nt, Mycobacterium bovis subsp bovis AF2122/97
acgccgccagcauugaagaa

SEQ ID NO: 3037803 - RNA, 19 nt, Mycobacterium bovis subsp bovis AF2122/97
acgccgccagguccgccgg

SEQ ID NO: 3037804 - RNA, 22 nt, Mycobacterium bovis subsp bovis AF2122/97
acgccgccccugcgcggccacc

SEQ ID NO: 3037805 - RNA, 13 nt, Mycobacterium bovis subsp bovis AF2122/97
acgccgcccgccg

SEQ ID NO: 3037806 - RNA, 13 nt, Mycobacterium bovis subsp bovis AF2122/97
acgccgcccgcug

SEQ ID NO: 3037807 - RNA, 15 nt, Mycobacterium bovis subsp bovis AF2122/97
acgccgccgcgacgc

SEQ ID NO: 3037808 - RNA, 18 nt, Mycobacterium bovis subsp bovis AF2122/97
acgccgccgcugccgccc

SEQ ID NO: 3037809 - RNA, 14 nt, Mycobacterium bovis subsp bovis AF2122/97
acgccgccggcacc

SEQ ID NO: 3037810 - RNA, 12 nt, Mycobacterium bovis subsp bovis AF2122/97
acgccgccggcc

SEQ ID NO: 3037811 - RNA, 14 nt, Mycobacterium bovis subsp bovis AF2122/97
acgccgccggcccc

SEQ ID NO: 3037812 - RNA, 17 nt, Mycobacterium bovis subsp bovis AF2122/97
acgccgccggccccgcc

SEQ ID NO: 3037813 - RNA, 22 nt, Mycobacterium bovis subsp bovis AF2122/97
acgccgccggccccgccgaugc

SEQ ID NO: 3037814 - RNA, 23 nt, Mycobacterium bovis subsp bovis AF2122/97
acgccgccggccccgccgaugcc

SEQ ID NO: 3037815 - RNA, 13 nt, Mycobacterium bovis subsp bovis AF2122/97
acgccgccggccg

SEQ ID NO: 3037816 - RNA, 16 nt, Mycobacterium bovis subsp bovis AF2122/97
acgccgccggccgcca

SEQ ID NO: 3037817 - RNA, 17 nt, Mycobacterium bovis subsp bovis AF2122/97
acgccgccggcgccacc

SEQ ID NO: 3037818 - RNA, 23 nt, Mycobacterium bovis subsp bovis AF2122/97
acgccgccggcgccaccguugcc

SEQ ID NO: 3037819 - RNA, 20 nt, Mycobacterium bovis subsp bovis AF2122/97
acgccgccggcgcugaucgc

SEQ ID NO: 3037820 - RNA, 15 nt, Mycobacterium bovis subsp bovis AF2122/97
acgccgccggugucg

SEQ ID NO: 3037821 - RNA, 14 nt, Mycobacterium bovis subsp bovis AF2122/97
acgccgcgagagcc

SEQ ID NO: 3037822 - RNA, 21 nt, Mycobacterium bovis subsp bovis AF2122/97
acgccgcgagagccggcggcg

SEQ ID NO: 3037823 - RNA, 17 nt, Mycobacterium bovis subsp bovis AF2122/97
acgccgcgcagccggcc

SEQ ID NO: 3037824 - RNA, 21 nt, Mycobacterium bovis subsp bovis AF2122/97
acgccgcgcagccggcccguc

SEQ ID NO: 3037825 - RNA, 14 nt, Mycobacterium bovis subsp bovis AF2122/97
acgccgcgccggcg

SEQ ID NO: 3037826 - RNA, 12 nt, Mycobacterium bovis subsp bovis AF2122/97
acgccgcggcgc

SEQ ID NO: 3037827 - RNA, 22 nt, Mycobacterium bovis subsp bovis AF2122/97
acgccgcggcgccggugggcgg

SEQ ID NO: 3037828 - RNA, 19 nt, Mycobacterium bovis subsp bovis AF2122/97
acgccgcgguuuucgccgg

SEQ ID NO: 3037829 - RNA, 14 nt, Mycobacterium bovis subsp bovis AF2122/97
acgccgcucccgca

SEQ ID NO: 3037830 - RNA, 18 nt, Mycobacterium bovis subsp bovis AF2122/97
acgccgcuggagaucacg

SEQ ID NO: 3037831 - RNA, 20 nt, Mycobacterium bovis subsp bovis AF2122/97
acgccgcuggagaucacgcc

SEQ ID NO: 3037832 - RNA, 21 nt, Mycobacterium bovis subsp bovis AF2122/97
acgccgcuggagaucacgccg

SEQ ID NO: 3037833 - RNA, 22 nt, Mycobacterium bovis subsp bovis AF2122/97
acgccgcuggagaucacgccga

SEQ ID NO: 3037834 - RNA, 19 nt, Mycobacterium bovis subsp bovis AF2122/97
acgccggacccggucgccg

SEQ ID NO: 3037835 - RNA, 20 nt, Mycobacterium bovis subsp bovis AF2122/97
acgccggacccggucgccgg

SEQ ID NO: 3037836 - RNA, 22 nt, Mycobacterium bovis subsp bovis AF2122/97
acgccggauuauucgcgguagc

SEQ ID NO: 3037837 - RNA, 13 nt, Mycobacterium bovis subsp bovis AF2122/97
acgccggcaucgc

SEQ ID NO: 3037838 - RNA, 14 nt, Mycobacterium bovis subsp bovis AF2122/97
acgccggcaugcca

SEQ ID NO: 3037839 - RNA, 21 nt, Mycobacterium bovis subsp bovis AF2122/97
acgccggcaugccagccacga

SEQ ID NO: 3037840 - RNA, 19 nt, Mycobacterium bovis subsp bovis AF2122/97
acgccggcccggugaugaa

SEQ ID NO: 3037841 - RNA, 15 nt, Mycobacterium bovis subsp bovis AF2122/97
acgccggccgcgcug

SEQ ID NO: 3037842 - RNA, 23 nt, Mycobacterium bovis subsp bovis AF2122/97
acgccggccucgccgaagcgggc

SEQ ID NO: 3037843 - RNA, 14 nt, Mycobacterium bovis subsp bovis AF2122/97
acgccggcgccgcc

SEQ ID NO: 3037844 - RNA, 12 nt, Mycobacterium bovis subsp bovis AF2122/97
acgccggcggcg

SEQ ID NO: 3037845 - RNA, 22 nt, Mycobacterium bovis subsp bovis AF2122/97
acgccgggcuguucggccaugg

SEQ ID NO: 3037846 - RNA, 23 nt, Mycobacterium bovis subsp bovis AF2122/97
acgccgggcuguucggccauggc

SEQ ID NO: 3037847 - RNA, 18 nt, Mycobacterium bovis subsp bovis AF2122/97
acgccggggaaccuugac

SEQ ID NO: 3037848 - RNA, 14 nt, Mycobacterium bovis subsp bovis AF2122/97
acgccgggugccgc

SEQ ID NO: 3037849 - RNA, 16 nt, Mycobacterium bovis subsp bovis AF2122/97
acgccggguucgccgg

SEQ ID NO: 3037850 - RNA, 19 nt, Mycobacterium bovis subsp bovis AF2122/97
acgccggugccggccagac

SEQ ID NO: 3037851 - RNA, 20 nt, Mycobacterium bovis subsp bovis AF2122/97
acgccgguggcagagccgcc

SEQ ID NO: 3037852 - RNA, 14 nt, Mycobacterium bovis subsp bovis AF2122/97
acgccguacccgga

SEQ ID NO: 3037853 - RNA, 17 nt, Mycobacterium bovis subsp bovis AF2122/97
acgccguagcaucgggc

SEQ ID NO: 3037854 - RNA, 16 nt, Mycobacterium bovis subsp bovis AF2122/97
acgccguagccggccg

SEQ ID NO: 3037855 - RNA, 18 nt, Mycobacterium bovis subsp bovis AF2122/97
acgccguagccggccggc

SEQ ID NO: 3037856 - RNA, 23 nt, Mycobacterium bovis subsp bovis AF2122/97
acgccguaucggggcaccacgcc

SEQ ID NO: 3037857 - RNA, 18 nt, Mycobacterium bovis subsp bovis AF2122/97
acgccgucagaacaccgg

SEQ ID NO: 3037858 - RNA, 21 nt, Mycobacterium bovis subsp bovis AF2122/97
acgccgucagaacaccggcca

SEQ ID NO: 3037859 - RNA, 14 nt, Mycobacterium bovis subsp bovis AF2122/97
acgccgucaugccc

SEQ ID NO: 3037860 - RNA, 11 nt, Mycobacterium bovis subsp bovis AF2122/97
acgccguccgg

SEQ ID NO: 3037861 - RNA, 17 nt, Mycobacterium bovis subsp bovis AF2122/97
acgccgucgaccggcgg

SEQ ID NO: 3037862 - RNA, 18 nt, Mycobacterium bovis subsp bovis AF2122/97
acgccgucgaccggcggg

SEQ ID NO: 3037863 - RNA, 13 nt, Mycobacterium bovis subsp bovis AF2122/97
acgccgucgacgc

SEQ ID NO: 3037864 - RNA, 21 nt, Mycobacterium bovis subsp bovis AF2122/97
acgccgucgagcacggugagc

SEQ ID NO: 3037865 - RNA, 14 nt, Mycobacterium bovis subsp bovis AF2122/97
acgccgucgccugc

SEQ ID NO: 3037866 - RNA, 15 nt, Mycobacterium bovis subsp bovis AF2122/97
acgccgucgccugca

SEQ ID NO: 3037867 - RNA, 19 nt, Mycobacterium bovis subsp bovis AF2122/97
acgccgucggacaccgcau

SEQ ID NO: 3037868 - RNA, 13 nt, Mycobacterium bovis subsp bovis AF2122/97
acgccgucggcgc

SEQ ID NO: 3037869 - RNA, 15 nt, Mycobacterium bovis subsp bovis AF2122/97
acgccgucggcgccg

SEQ ID NO: 3037870 - RNA, 14 nt, Mycobacterium bovis subsp bovis AF2122/97
acgccgucggcgcg

SEQ ID NO: 3037871 - RNA, 23 nt, Mycobacterium bovis subsp bovis AF2122/97
acgcgcuugaagguucgaucgcg

SEQ ID NO: 3037872 - RNA, 17 nt, Mycobacterium bovis subsp bovis AF2122/97
acgcggaaaccaucgcc

SEQ ID NO: 3037873 - RNA, 21 nt, Mycobacterium bovis subsp bovis AF2122/97
acgcggaaaccaucgccagcc

SEQ ID NO: 3037874 - RNA, 15 nt, Mycobacterium bovis subsp bovis AF2122/97
acgcggacaccgcgg

SEQ ID NO: 3037875 - RNA, 15 nt, Mycobacterium bovis subsp bovis AF2122/97
acgcggaucgggcac

SEQ ID NO: 3037876 - RNA, 16 nt, Mycobacterium bovis subsp bovis AF2122/97
acgcggaucgggcacc

SEQ ID NO: 3037877 - RNA, 21 nt, Mycobacterium bovis subsp bovis AF2122/97
acgcggaucgggcaccccgac

SEQ ID NO: 3037878 - RNA, 20 nt, Mycobacterium bovis subsp bovis AF2122/97
acgcggccaacgaacgugcc

SEQ ID NO: 3037879 - RNA, 14 nt, Mycobacterium bovis subsp bovis AF2122/97
acgcggccaccgac

SEQ ID NO: 3037880 - RNA, 17 nt, Mycobacterium bovis subsp bovis AF2122/97
acgcggccgaggucacc

SEQ ID NO: 3037881 - RNA, 20 nt, Mycobacterium bovis subsp bovis AF2122/97
acgcggccgaggucacccgg

SEQ ID NO: 3037882 - RNA, 13 nt, Mycobacterium bovis subsp bovis AF2122/97
acgcggccgggcg

SEQ ID NO: 3037883 - RNA, 20 nt, Mycobacterium bovis subsp bovis AF2122/97
acgcggccgggcguccucgu

SEQ ID NO: 3037884 - RNA, 23 nt, Mycobacterium bovis subsp bovis AF2122/97
acgcggccgggcguccucgucga

SEQ ID NO: 3037885 - RNA, 12 nt, Mycobacterium bovis subsp bovis AF2122/97
acgcggcgcgcu

SEQ ID NO: 3037886 - RNA, 23 nt, Mycobacterium bovis subsp bovis AF2122/97
acgcggcgcgcugaaaugccguc

SEQ ID NO: 3037887 - RNA, 16 nt, Mycobacterium bovis subsp bovis AF2122/97
acgcggcuuugacgcc

SEQ ID NO: 3037888 - RNA, 17 nt, Mycobacterium bovis subsp bovis AF2122/97
acgcgggaacgaugccg

SEQ ID NO: 3037889 - RNA, 20 nt, Mycobacterium bovis subsp bovis AF2122/97
acgcgggagguacccccagc

SEQ ID NO: 3037890 - RNA, 17 nt, Mycobacterium bovis subsp bovis AF2122/97
acgcgggcacugguggc

SEQ ID NO: 3037891 - RNA, 13 nt, Mycobacterium bovis subsp bovis AF2122/97
acgcgggccgacc

SEQ ID NO: 3037892 - RNA, 18 nt, Mycobacterium bovis subsp bovis AF2122/97
acgcgggcguuggccagc

SEQ ID NO: 3037893 - RNA, 16 nt, Mycobacterium bovis subsp bovis AF2122/97
acgcggucaucgagcu

SEQ ID NO: 3037894 - RNA, 14 nt, Mycobacterium bovis subsp bovis AF2122/97
acgcggucccacuc

SEQ ID NO: 3037895 - RNA, 17 nt, Mycobacterium bovis subsp bovis AF2122/97
acgcgguccucgagccg

SEQ ID NO: 3037896 - RNA, 22 nt, Mycobacterium bovis subsp bovis AF2122/97
acgcggucgacgacgcccucac

SEQ ID NO: 3037897 - RNA, 21 nt, Mycobacterium bovis subsp bovis AF2122/97
acgcggucggcagcgacgccg

SEQ ID NO: 3037898 - RNA, 13 nt, Mycobacterium bovis subsp bovis AF2122/97
acgcggucugcuc

SEQ ID NO: 3037899 - RNA, 20 nt, Mycobacterium bovis subsp bovis AF2122/97
acgcggucugcuccaggcgc

SEQ ID NO: 3037900 - RNA, 22 nt, Mycobacterium bovis subsp bovis AF2122/97
acgcggucugcuccaggcgcgc

SEQ ID NO: 3037901 - RNA, 13 nt, Mycobacterium bovis subsp bovis AF2122/97
acgcggugccggg

SEQ ID NO: 3037902 - RNA, 13 nt, Mycobacterium bovis subsp bovis AF2122/97
acgcgguucacca

SEQ ID NO: 3037903 - RNA, 17 nt, Mycobacterium bovis subsp bovis AF2122/97
acgcguagagccgauca

SEQ ID NO: 3037904 - RNA, 17 nt, Mycobacterium bovis subsp bovis AF2122/97
acgcguagcggucccgc

SEQ ID NO: 3037905 - RNA, 20 nt, Mycobacterium bovis subsp bovis AF2122/97
acgcguauucggcaucgccg

SEQ ID NO: 3037906 - RNA, 17 nt, Mycobacterium bovis subsp bovis AF2122/97
acgcgucagcggcgagc

SEQ ID NO: 3037907 - RNA, 15 nt, Mycobacterium bovis subsp bovis AF2122/97
acgcguccagcgcgg

SEQ ID NO: 3037908 - RNA, 17 nt, Mycobacterium bovis subsp bovis AF2122/97
acgcguccagcgcggcc

SEQ ID NO: 3037909 - RNA, 16 nt, Mycobacterium bovis subsp bovis AF2122/97
acgcgucccgccgcac

SEQ ID NO: 3037910 - RNA, 14 nt, Mycobacterium bovis subsp bovis AF2122/97
acgcgucgccgacg

SEQ ID NO: 3037911 - RNA, 15 nt, Mycobacterium bovis subsp bovis AF2122/97
acgcgucgccggccg

SEQ ID NO: 3037912 - RNA, 21 nt, Mycobacterium bovis subsp bovis AF2122/97
acgcgucggucgcggacaggu

SEQ ID NO: 3037913 - RNA, 17 nt, Mycobacterium bovis subsp bovis AF2122/97
acgcgucgugccacuuc

SEQ ID NO: 3037914 - RNA, 16 nt, Mycobacterium bovis subsp bovis AF2122/97
acgcgucguggucggc

SEQ ID NO: 3037915 - RNA, 18 nt, Mycobacterium bovis subsp bovis AF2122/97
acgcgucguggucggcga

SEQ ID NO: 3037916 - RNA, 18 nt, Mycobacterium bovis subsp bovis AF2122/97
acgcgucguugucgucgc

SEQ ID NO: 3037917 - RNA, 19 nt, Mycobacterium bovis subsp bovis AF2122/97
acgcgucuucggucgcggc

SEQ ID NO: 3037918 - RNA, 20 nt, Mycobacterium bovis subsp bovis AF2122/97
acgcgucuucggucgcggcc

SEQ ID NO: 3037919 - RNA, 12 nt, Mycobacterium bovis subsp bovis AF2122/97
acgcgugcugag

SEQ ID NO: 3037920 - RNA, 18 nt, Mycobacterium bovis subsp bovis AF2122/97
acgcguggcauccagcag

SEQ ID NO: 3037921 - RNA, 20 nt, Mycobacterium bovis subsp bovis AF2122/97
acgcguggcauccagcagcg

SEQ ID NO: 3037922 - RNA, 15 nt, Mycobacterium bovis subsp bovis AF2122/97
acgcguucaacaccg

SEQ ID NO: 3037923 - RNA, 21 nt, Mycobacterium bovis subsp bovis AF2122/97
acgcguucaacaccgccgacc

SEQ ID NO: 3037924 - RNA, 14 nt, Mycobacterium bovis subsp bovis AF2122/97
acgcguucaacgaa

SEQ ID NO: 3037925 - RNA, 16 nt, Mycobacterium bovis subsp bovis AF2122/97
acgcguuccauggccc

SEQ ID NO: 3037926 - RNA, 17 nt, Mycobacterium bovis subsp bovis AF2122/97
acgcguucgagugcggu

SEQ ID NO: 3037927 - RNA, 14 nt, Mycobacterium bovis subsp bovis AF2122/97
acgcguugacgauc

SEQ ID NO: 3037928 - RNA, 18 nt, Mycobacterium bovis subsp bovis AF2122/97
acgcguugcacagcagcg

SEQ ID NO: 3037929 - RNA, 21 nt, Mycobacterium bovis subsp bovis AF2122/97
acgcguugugcccgccggccc

SEQ ID NO: 3037930 - RNA, 13 nt, Mycobacterium bovis subsp bovis AF2122/97
acgcuaaacccgu

SEQ ID NO: 3037931 - RNA, 14 nt, Mycobacterium bovis subsp bovis AF2122/97
acgcuaacgucgau

SEQ ID NO: 3037932 - RNA, 13 nt, Mycobacterium bovis subsp bovis AF2122/97
acgcuagccgaca

SEQ ID NO: 3037933 - RNA, 13 nt, Mycobacterium bovis subsp bovis AF2122/97
acgcucacgggcu

SEQ ID NO: 3037934 - RNA, 22 nt, Mycobacterium bovis subsp bovis AF2122/97
acgcuccaggccuaguccggca

SEQ ID NO: 3037935 - RNA, 19 nt, Mycobacterium bovis subsp bovis AF2122/97
acgcuccaggguccggacg

SEQ ID NO: 3037936 - RNA, 16 nt, Mycobacterium bovis subsp bovis AF2122/97
acgcuccccagcgaau

SEQ ID NO: 3037937 - RNA, 21 nt, Mycobacterium bovis subsp bovis AF2122/97
acgcucccuacgagcccacgc

SEQ ID NO: 3037938 - RNA, 20 nt, Mycobacterium bovis subsp bovis AF2122/97
acgcuccgccggguuggcgc

SEQ ID NO: 3037939 - RNA, 20 nt, Mycobacterium bovis subsp bovis AF2122/97
acgcuccgggaauggcgacc

SEQ ID NO: 3037940 - RNA, 18 nt, Mycobacterium bovis subsp bovis AF2122/97
acgcucgcgaagccgguu

SEQ ID NO: 3037941 - RNA, 14 nt, Mycobacterium bovis subsp bovis AF2122/97
acgcucgcugcagc

SEQ ID NO: 3037942 - RNA, 18 nt, Mycobacterium bovis subsp bovis AF2122/97
acgcucggcggggaccgc

SEQ ID NO: 3037943 - RNA, 21 nt, Mycobacterium bovis subsp bovis AF2122/97
acgcucggcggggaccgcggu

SEQ ID NO: 3037944 - RNA, 20 nt, Mycobacterium bovis subsp bovis AF2122/97
acgcucggcguccgcccagc

SEQ ID NO: 3037945 - RNA, 23 nt, Mycobacterium bovis subsp bovis AF2122/97
acgcucggcguccgcccagcacc

SEQ ID NO: 3037946 - RNA, 23 nt, Mycobacterium bovis subsp bovis AF2122/97
acgcucggcuauggguucgcggu

SEQ ID NO: 3037947 - RNA, 20 nt, Mycobacterium bovis subsp bovis AF2122/97
acgcucggucgccaccgccg

SEQ ID NO: 3037948 - RNA, 18 nt, Mycobacterium bovis subsp bovis AF2122/97
acgcucggugcugcgccg

SEQ ID NO: 3037949 - RNA, 20 nt, Mycobacterium bovis subsp bovis AF2122/97
acgcucggugcugcgccgau

SEQ ID NO: 3037950 - RNA, 19 nt, Mycobacterium bovis subsp bovis AF2122/97
acgcucguuugcgagcagg

SEQ ID NO: 3037951 - RNA, 21 nt, Mycobacterium bovis subsp bovis AF2122/97
acgcucguuugcgagcagggg

SEQ ID NO: 3037952 - RNA, 22 nt, Mycobacterium bovis subsp bovis AF2122/97
acgcucguuugcgagcagggga

SEQ ID NO: 3037953 - RNA, 23 nt, Mycobacterium bovis subsp bovis AF2122/97
acgcugaccggaucugacggcgc

SEQ ID NO: 3037954 - RNA, 20 nt, Mycobacterium bovis subsp bovis AF2122/97
acgcugaguccccagguggg

SEQ ID NO: 3037955 - RNA, 21 nt, Mycobacterium bovis subsp bovis AF2122/97
acgcugaucuuccccucggcc

SEQ ID NO: 3037956 - RNA, 23 nt, Mycobacterium bovis subsp bovis AF2122/97
acgcugaucuuccccucggccgc

SEQ ID NO: 3037957 - RNA, 13 nt, Mycobacterium bovis subsp bovis AF2122/97
acggcaccagcgg

SEQ ID NO: 3037958 - RNA, 16 nt, Mycobacterium bovis subsp bovis AF2122/97
acggcaccagcggguc

SEQ ID NO: 3037959 - RNA, 23 nt, Mycobacterium bovis subsp bovis AF2122/97
acggcaccagcgggucggcggug

SEQ ID NO: 3037960 - RNA, 21 nt, Mycobacterium bovis subsp bovis AF2122/97
acggcaccauguacaggcugu

SEQ ID NO: 3037961 - RNA, 11 nt, Mycobacterium bovis subsp bovis AF2122/97
acggcaccccc

SEQ ID NO: 3037962 - RNA, 18 nt, Mycobacterium bovis subsp bovis AF2122/97
acggcacccccgacgaga

SEQ ID NO: 3037963 - RNA, 21 nt, Mycobacterium bovis subsp bovis AF2122/97
acggcacccugcggcaccuca

SEQ ID NO: 3037964 - RNA, 15 nt, Mycobacterium bovis subsp bovis AF2122/97
acggcaccgcgccca

SEQ ID NO: 3037965 - RNA, 13 nt, Mycobacterium bovis subsp bovis AF2122/97
acggcaccggccc

SEQ ID NO: 3037966 - RNA, 23 nt, Mycobacterium bovis subsp bovis AF2122/97
acggcacugugcguccgcaacag

SEQ ID NO: 3037967 - RNA, 15 nt, Mycobacterium bovis subsp bovis AF2122/97
acggcagaccauggu

SEQ ID NO: 3037968 - RNA, 14 nt, Mycobacterium bovis subsp bovis AF2122/97
acggcagcacgguc

SEQ ID NO: 3037969 - RNA, 15 nt, Mycobacterium bovis subsp bovis AF2122/97
acggcagccaaccgg

SEQ ID NO: 3037970 - RNA, 14 nt, Mycobacterium bovis subsp bovis AF2122/97
acggcagccaccgu

SEQ ID NO: 3037971 - RNA, 20 nt, Mycobacterium bovis subsp bovis AF2122/97
acggcagccaccgucaugcc

SEQ ID NO: 3037972 - RNA, 17 nt, Mycobacterium bovis subsp bovis AF2122/97
acggcagccgggcggca

SEQ ID NO: 3037973 - RNA, 12 nt, Mycobacterium bovis subsp bovis AF2122/97
acggcagcgccc

SEQ ID NO: 3037974 - RNA, 22 nt, Mycobacterium bovis subsp bovis AF2122/97
acggcagcgcccagaucgccga

SEQ ID NO: 3037975 - RNA, 15 nt, Mycobacterium bovis subsp bovis AF2122/97
acggcagcgccgguc

SEQ ID NO: 3037976 - RNA, 16 nt, Mycobacterium bovis subsp bovis AF2122/97
acggcagcucggggca

SEQ ID NO: 3037977 - RNA, 22 nt, Mycobacterium bovis subsp bovis AF2122/97
acggcaggcagggcagcccggc

SEQ ID NO: 3037978 - RNA, 16 nt, Mycobacterium bovis subsp bovis AF2122/97
acggcaggcggccgcc

SEQ ID NO: 3037979 - RNA, 20 nt, Mycobacterium bovis subsp bovis AF2122/97
acggcaggcggccgccggga

SEQ ID NO: 3037980 - RNA, 22 nt, Mycobacterium bovis subsp bovis AF2122/97
acggcauccgcucaacaaucgg

SEQ ID NO: 3037981 - RNA, 15 nt, Mycobacterium bovis subsp bovis AF2122/97
acggcaucggccacc

SEQ ID NO: 3037982 - RNA, 17 nt, Mycobacterium bovis subsp bovis AF2122/97
acggcaucggccaccug

SEQ ID NO: 3037983 - RNA, 22 nt, Mycobacterium bovis subsp bovis AF2122/97
acggcaucugaaaauugacccc

SEQ ID NO: 3037984 - RNA, 17 nt, Mycobacterium bovis subsp bovis AF2122/97
acggcauucgaccucaa

SEQ ID NO: 3037985 - RNA, 14 nt, Mycobacterium bovis subsp bovis AF2122/97
acggccaacauccg

SEQ ID NO: 3037986 - RNA, 14 nt, Mycobacterium bovis subsp bovis AF2122/97
acggccaagaucgg

SEQ ID NO: 3037987 - RNA, 20 nt, Mycobacterium bovis subsp bovis AF2122/97
acggccacaccgucacgcca

SEQ ID NO: 3037988 - RNA, 16 nt, Mycobacterium bovis subsp bovis AF2122/97
acggccaccgggguca

SEQ ID NO: 3037989 - RNA, 19 nt, Mycobacterium bovis subsp bovis AF2122/97
acggccacgguggagcgcg

SEQ ID NO: 3037990 - RNA, 16 nt, Mycobacterium bovis subsp bovis AF2122/97
acggccagaaacccgg

SEQ ID NO: 3037991 - RNA, 12 nt, Mycobacterium bovis subsp bovis AF2122/97
acggccagcagg

SEQ ID NO: 3037992 - RNA, 21 nt, Mycobacterium bovis subsp bovis AF2122/97
acggccagcaggaugaugacc

SEQ ID NO: 3037993 - RNA, 17 nt, Mycobacterium bovis subsp bovis AF2122/97
acggccaggacaacgca

SEQ ID NO: 3037994 - RNA, 19 nt, Mycobacterium bovis subsp bovis AF2122/97
acggccagugcgcagaaca

SEQ ID NO: 3037995 - RNA, 22 nt, Mycobacterium bovis subsp bovis AF2122/97
acggccaguugguagccgcccu

SEQ ID NO: 3037996 - RNA, 17 nt, Mycobacterium bovis subsp bovis AF2122/97
acggccauauugggagu

SEQ ID NO: 3037997 - RNA, 22 nt, Mycobacterium bovis subsp bovis AF2122/97
acggccaucgccagccugugcu

SEQ ID NO: 3037998 - RNA, 19 nt, Mycobacterium bovis subsp bovis AF2122/97
acggccaugaucacaccgc

SEQ ID NO: 3037999 - RNA, 21 nt, Mycobacterium bovis subsp bovis AF2122/97
acggccccugccacgacgaac

SEQ ID NO: 3038000 - RNA, 14 nt, Mycobacterium bovis subsp bovis AF2122/97
acggcccgaucccg

SEQ ID NO: 3038001 - RNA, 15 nt, Mycobacterium bovis subsp bovis AF2122/97
acggcccgccguccg

SEQ ID NO: 3038002 - RNA, 16 nt, Mycobacterium bovis subsp bovis AF2122/97
acggcccgccguccgg

SEQ ID NO: 3038003 - RNA, 14 nt, Mycobacterium bovis subsp bovis AF2122/97
acggcccggcaccc

SEQ ID NO: 3038004 - RNA, 16 nt, Mycobacterium bovis subsp bovis AF2122/97
acggcccuuguggagu

SEQ ID NO: 3038005 - RNA, 21 nt, Mycobacterium bovis subsp bovis AF2122/97
acggcccuuguggaguacggc

SEQ ID NO: 3038006 - RNA, 15 nt, Mycobacterium bovis subsp bovis AF2122/97
acggccgacaacccg

SEQ ID NO: 3038007 - RNA, 16 nt, Mycobacterium bovis subsp bovis AF2122/97
acggccgacaacccgg

SEQ ID NO: 3038008 - RNA, 20 nt, Mycobacterium bovis subsp bovis AF2122/97
acggccgacaacccggccgg

SEQ ID NO: 3038009 - RNA, 18 nt, Mycobacterium bovis subsp bovis AF2122/97
acggccggccgcugccac

SEQ ID NO: 3038010 - RNA, 19 nt, Mycobacterium bovis subsp bovis AF2122/97
acggccggccgcugccacu

SEQ ID NO: 3038011 - RNA, 20 nt, Mycobacterium bovis subsp bovis AF2122/97
acggccggcggucgggcccg

SEQ ID NO: 3038012 - RNA, 14 nt, Mycobacterium bovis subsp bovis AF2122/97
acggccgggacggc

SEQ ID NO: 3038013 - RNA, 16 nt, Mycobacterium bovis subsp bovis AF2122/97
acggccgggacggcga

SEQ ID NO: 3038014 - RNA, 14 nt, Mycobacterium bovis subsp bovis AF2122/97
acggccgucgacga

SEQ ID NO: 3038015 - RNA, 22 nt, Mycobacterium bovis subsp bovis AF2122/97
acggccgucgauugcaggucgg

SEQ ID NO: 3038016 - RNA, 13 nt, Mycobacterium bovis subsp bovis AF2122/97
acggccgucgccc

SEQ ID NO: 3038017 - RNA, 15 nt, Mycobacterium bovis subsp bovis AF2122/97
acggccucgucgaug

SEQ ID NO: 3038018 - RNA, 22 nt, Mycobacterium bovis subsp bovis AF2122/97
acggccucgucgauguucgccg

SEQ ID NO: 3038019 - RNA, 18 nt, Mycobacterium bovis subsp bovis AF2122/97
acggccugcgagucgcgc

SEQ ID NO: 3038020 - RNA, 14 nt, Mycobacterium bovis subsp bovis AF2122/97
acggccuggccacc

SEQ ID NO: 3038021 - RNA, 18 nt, Mycobacterium bovis subsp bovis AF2122/97
acggccuggccaccuggu

SEQ ID NO: 3038022 - RNA, 20 nt, Mycobacterium bovis subsp bovis AF2122/97
acggccuggggcagccgggc

SEQ ID NO: 3038023 - RNA, 21 nt, Mycobacterium bovis subsp bovis AF2122/97
acggccuggggcagccgggcg

SEQ ID NO: 3038024 - RNA, 20 nt, Mycobacterium bovis subsp bovis AF2122/97
acggccuuggcgacgucggc

SEQ ID NO: 3038025 - RNA, 20 nt, Mycobacterium bovis subsp bovis AF2122/97
acggcgaaaaucccgcuccc

SEQ ID NO: 3038026 - RNA, 14 nt, Mycobacterium bovis subsp bovis AF2122/97
acggcgaaacucgu

SEQ ID NO: 3038027 - RNA, 20 nt, Mycobacterium bovis subsp bovis AF2122/97
acggcgaaaucgacagcagc

SEQ ID NO: 3038028 - RNA, 17 nt, Mycobacterium bovis subsp bovis AF2122/97
acggcgaacccgccgau

SEQ ID NO: 3038029 - RNA, 21 nt, Mycobacterium bovis subsp bovis AF2122/97
acggcgaaccggcccaccgac

SEQ ID NO: 3038030 - RNA, 20 nt, Mycobacterium bovis subsp bovis AF2122/97
acggcgaagucgagugccgc

SEQ ID NO: 3038031 - RNA, 16 nt, Mycobacterium bovis subsp bovis AF2122/97
acggcgacacgccagc

SEQ ID NO: 3038032 - RNA, 18 nt, Mycobacterium bovis subsp bovis AF2122/97
acggcgacacgccagccg

SEQ ID NO: 3038033 - RNA, 22 nt, Mycobacterium bovis subsp bovis AF2122/97
acggcgacacgccagccgugcc

SEQ ID NO: 3038034 - RNA, 17 nt, Mycobacterium bovis subsp bovis AF2122/97
acggcgacauacccgau

SEQ ID NO: 3038035 - RNA, 16 nt, Mycobacterium bovis subsp bovis AF2122/97
acggcgacaucggccc

SEQ ID NO: 3038036 - RNA, 22 nt, Mycobacterium bovis subsp bovis AF2122/97
acggcgacaucggcccgaucac

SEQ ID NO: 3038037 - RNA, 16 nt, Mycobacterium bovis subsp bovis AF2122/97
acggcgaccaccgcgg

SEQ ID NO: 3038038 - RNA, 21 nt, Mycobacterium bovis subsp bovis AF2122/97
acggcgaccaccgcggcugcu

SEQ ID NO: 3038039 - RNA, 15 nt, Mycobacterium bovis subsp bovis AF2122/97
acggcgaccacgccg

SEQ ID NO: 3038040 - RNA, 16 nt, Mycobacterium bovis subsp bovis AF2122/97
acggcgaccacgccgc

SEQ ID NO: 3038041 - RNA, 20 nt, Mycobacterium bovis subsp bovis AF2122/97
acggcgaccacgccgccggc

SEQ ID NO: 3038042 - RNA, 21 nt, Mycobacterium bovis subsp bovis AF2122/97
acggcgaccacgccgccggcg

SEQ ID NO: 3038043 - RNA, 15 nt, Mycobacterium bovis subsp bovis AF2122/97
acggcgguaccgccg

SEQ ID NO: 3038044 - RNA, 20 nt, Mycobacterium bovis subsp bovis AF2122/97
acggcgguaccgccgcugcc

SEQ ID NO: 3038045 - RNA, 18 nt, Mycobacterium bovis subsp bovis AF2122/97
acggcguacgccggaccc

SEQ ID NO: 3038046 - RNA, 20 nt, Mycobacterium bovis subsp bovis AF2122/97
acggcguacgccggacccgg

SEQ ID NO: 3038047 - RNA, 21 nt, Mycobacterium bovis subsp bovis AF2122/97
acggcguacgccggacccggu

SEQ ID NO: 3038048 - RNA, 23 nt, Mycobacterium bovis subsp bovis AF2122/97
acggcguagacguccgcggucgc

SEQ ID NO: 3038049 - RNA, 15 nt, Mycobacterium bovis subsp bovis AF2122/97
acggcguccaagaac

SEQ ID NO: 3038050 - RNA, 12 nt, Mycobacterium bovis subsp bovis AF2122/97
acggcgucgagu

SEQ ID NO: 3038051 - RNA, 13 nt, Mycobacterium bovis subsp bovis AF2122/97
acggcgucggcca

SEQ ID NO: 3038052 - RNA, 15 nt, Mycobacterium bovis subsp bovis AF2122/97
acggcgucggccacc

SEQ ID NO: 3038053 - RNA, 19 nt, Mycobacterium bovis subsp bovis AF2122/97
acggcgucggccaccgccu

SEQ ID NO: 3038054 - RNA, 19 nt, Mycobacterium bovis subsp bovis AF2122/97
acggcgucggcuucucgau

SEQ ID NO: 3038055 - RNA, 15 nt, Mycobacterium bovis subsp bovis AF2122/97
acggcgucgggccgu

SEQ ID NO: 3038056 - RNA, 18 nt, Mycobacterium bovis subsp bovis AF2122/97
acggcgucuuccucggcc

SEQ ID NO: 3038057 - RNA, 20 nt, Mycobacterium bovis subsp bovis AF2122/97
acggcgucuuccucggccac

SEQ ID NO: 3038058 - RNA, 21 nt, Mycobacterium bovis subsp bovis AF2122/97
acggcgucuuccucggccacc

SEQ ID NO: 3038059 - RNA, 22 nt, Mycobacterium bovis subsp bovis AF2122/97
acggcgugaaaaacgcccgcgc

SEQ ID NO: 3038060 - RNA, 21 nt, Mycobacterium bovis subsp bovis AF2122/97
acggcgugaaguggucguaga

SEQ ID NO: 3038061 - RNA, 18 nt, Mycobacterium bovis subsp bovis AF2122/97
acggcguggaugcccggu

SEQ ID NO: 3038062 - RNA, 19 nt, Mycobacterium bovis subsp bovis AF2122/97
acggcguggucggcaaagc

SEQ ID NO: 3038063 - RNA, 18 nt, Mycobacterium bovis subsp bovis AF2122/97
acggcguuacguggugga

SEQ ID NO: 3038064 - RNA, 17 nt, Mycobacterium bovis subsp bovis AF2122/97
acggcguugagcaggug

SEQ ID NO: 3038065 - RNA, 18 nt, Mycobacterium bovis subsp bovis AF2122/97
acggcguugauccgcacc

SEQ ID NO: 3038066 - RNA, 16 nt, Mycobacterium bovis subsp bovis AF2122/97
acggcguugccgccgg

SEQ ID NO: 3038067 - RNA, 18 nt, Mycobacterium bovis subsp bovis AF2122/97
acggcguugccgccggcu

SEQ ID NO: 3038068 - RNA, 16 nt, Mycobacterium bovis subsp bovis AF2122/97
acggcguugccggaga

SEQ ID NO: 3038069 - RNA, 15 nt, Mycobacterium bovis subsp bovis AF2122/97
acggcguuggcgccg

SEQ ID NO: 3038070 - RNA, 17 nt, Mycobacterium bovis subsp bovis AF2122/97
acggcguugucgacgaa

SEQ ID NO: 3038071 - RNA, 20 nt, Mycobacterium bovis subsp bovis AF2122/97
acggcguuuucaauuucacu

SEQ ID NO: 3038072 - RNA, 13 nt, Mycobacterium bovis subsp bovis AF2122/97
acggcuaccaccg

SEQ ID NO: 3038073 - RNA, 14 nt, Mycobacterium bovis subsp bovis AF2122/97
acggcuaccaccgc

SEQ ID NO: 3038074 - RNA, 17 nt, Mycobacterium bovis subsp bovis AF2122/97
acggcuaccaccgcacc

SEQ ID NO: 3038075 - RNA, 23 nt, Mycobacterium bovis subsp bovis AF2122/97
acggcucagcgugcgcuggcuga

SEQ ID NO: 3038076 - RNA, 23 nt, Mycobacterium bovis subsp bovis AF2122/97
acggcuccgggcgcucggucucc

SEQ ID NO: 3038077 - RNA, 20 nt, Mycobacterium bovis subsp bovis AF2122/97
acggcucgggaacuucgccg

SEQ ID NO: 3038078 - RNA, 23 nt, Mycobacterium bovis subsp bovis AF2122/97
acggcucgggaacuucgccgaag

SEQ ID NO: 3038079 - RNA, 18 nt, Mycobacterium bovis subsp bovis AF2122/97
acggcucgucgaacaugg

SEQ ID NO: 3038080 - RNA, 15 nt, Mycobacterium bovis subsp bovis AF2122/97
acggcucuaccgguc

SEQ ID NO: 3038081 - RNA, 20 nt, Mycobacterium bovis subsp bovis AF2122/97
acggcucuaccgguccguca

SEQ ID NO: 3038082 - RNA, 22 nt, Mycobacterium bovis subsp bovis AF2122/97
acggcucuaccgguccgucacc

SEQ ID NO: 3038083 - RNA, 21 nt, Mycobacterium bovis subsp bovis AF2122/97
acggcugaccggggucggccu

SEQ ID NO: 3038084 - RNA, 23 nt, Mycobacterium bovis subsp bovis AF2122/97
acggcugaccggggucggccugc

SEQ ID NO: 3038085 - RNA, 23 nt, Mycobacterium bovis subsp bovis AF2122/97
acggcugaccuucucacgcacca

SEQ ID NO: 3038086 - RNA, 16 nt, Mycobacterium bovis subsp bovis AF2122/97
acggcugcagaggcgc

SEQ ID NO: 3038087 - RNA, 14 nt, Mycobacterium bovis subsp bovis AF2122/97
acggcugccgucag

SEQ ID NO: 3038088 - RNA, 18 nt, Mycobacterium bovis subsp bovis AF2122/97
acggcugccgucagccgu

SEQ ID NO: 3038089 - RNA, 20 nt, Mycobacterium bovis subsp bovis AF2122/97
acggcugccgucagccguuc

SEQ ID NO: 3038090 - RNA, 18 nt, Mycobacterium bovis subsp bovis AF2122/97
acggcugcggaacggguc

SEQ ID NO: 3038091 - RNA, 20 nt, Mycobacterium bovis subsp bovis AF2122/97
acggcuuccaacucggcggc

SEQ ID NO: 3038092 - RNA, 22 nt, Mycobacterium bovis subsp bovis AF2122/97
acggcuuccaacucggcggcca

SEQ ID NO: 3038093 - RNA, 15 nt, Mycobacterium bovis subsp bovis AF2122/97
acggcuucgccgcgg

SEQ ID NO: 3038094 - RNA, 15 nt, Mycobacterium bovis subsp bovis AF2122/97
acggcuucggcgagc

SEQ ID NO: 3038095 - RNA, 20 nt, Mycobacterium bovis subsp bovis AF2122/97
acggcuuggcgucggccggc

SEQ ID NO: 3038096 - RNA, 20 nt, Mycobacterium bovis subsp bovis AF2122/97
acggcuuggcugccuccauc

SEQ ID NO: 3038097 - RNA, 16 nt, Mycobacterium bovis subsp bovis AF2122/97
acggcuuugcggcgcg

SEQ ID NO: 3038098 - RNA, 16 nt, Mycobacterium bovis subsp bovis AF2122/97
acgggaaacuccgcgg

SEQ ID NO: 3038099 - RNA, 17 nt, Mycobacterium bovis subsp bovis AF2122/97
acgggaaacuccgcggc

SEQ ID NO: 3038100 - RNA, 18 nt, Mycobacterium bovis subsp bovis AF2122/97
acgggaaacuccgcggcg

SEQ ID NO: 3038101 - RNA, 22 nt, Mycobacterium bovis subsp bovis AF2122/97
acgggaaacuccgcggcgcgca

SEQ ID NO: 3038102 - RNA, 13 nt, Mycobacterium bovis subsp bovis AF2122/97
acgggaacaacgg

SEQ ID NO: 3038103 - RNA, 12 nt, Mycobacterium bovis subsp bovis AF2122/97
acgggaacgucc

SEQ ID NO: 3038104 - RNA, 22 nt, Mycobacterium bovis subsp bovis AF2122/97
acgggaacguccagccguggcg

SEQ ID NO: 3038105 - RNA, 13 nt, Mycobacterium bovis subsp bovis AF2122/97
acgggacgcaugc

SEQ ID NO: 3038106 - RNA, 24 nt, Mycobacterium bovis subsp bovis AF2122/97
acgggacgcaugcgugacccgaca

SEQ ID NO: 3038107 - RNA, 13 nt, Mycobacterium bovis subsp bovis AF2122/97
acgggacgucacc

SEQ ID NO: 3038108 - RNA, 14 nt, Mycobacterium bovis subsp bovis AF2122/97
acgggauagccguu

SEQ ID NO: 3038109 - RNA, 21 nt, Mycobacterium bovis subsp bovis AF2122/97
acgggauagccguucggcauc

SEQ ID NO: 3038110 - RNA, 19 nt, Mycobacterium bovis subsp bovis AF2122/97
acgggauccgcgcgcugga

SEQ ID NO: 3038111 - RNA, 14 nt, Mycobacterium bovis subsp bovis AF2122/97
acgggaucgacccg

SEQ ID NO: 3038112 - RNA, 20 nt, Mycobacterium bovis subsp bovis AF2122/97
acgggaucgcccaggcgcga

SEQ ID NO: 3038113 - RNA, 21 nt, Mycobacterium bovis subsp bovis AF2122/97
acgggaucugcggaggcgacc

SEQ ID NO: 3038114 - RNA, 13 nt, Mycobacterium bovis subsp bovis AF2122/97
acgggaugccggc

SEQ ID NO: 3038115 - RNA, 20 nt, Mycobacterium bovis subsp bovis AF2122/97
acgggcaaaccauugcgccu

SEQ ID NO: 3038116 - RNA, 19 nt, Mycobacterium bovis subsp bovis AF2122/97
acgggcacccgagccgcac

SEQ ID NO: 3038117 - RNA, 15 nt, Mycobacterium bovis subsp bovis AF2122/97
acgggcacgcggcga

SEQ ID NO: 3038118 - RNA, 12 nt, Mycobacterium bovis subsp bovis AF2122/97
acgggcaggagc

SEQ ID NO: 3038119 - RNA, 11 nt, Mycobacterium bovis subsp bovis AF2122/97
acgggcaguga

SEQ ID NO: 3038120 - RNA, 12 nt, Mycobacterium bovis subsp bovis AF2122/97
acgggcagugaa

SEQ ID NO: 3038121 - RNA, 14 nt, Mycobacterium bovis subsp bovis AF2122/97
acgggcagugaaca

SEQ ID NO: 3038122 - RNA, 13 nt, Mycobacterium bovis subsp bovis AF2122/97
acgggccaccagc

SEQ ID NO: 3038123 - RNA, 12 nt, Mycobacterium bovis subsp bovis AF2122/97
acgggccaccgu

SEQ ID NO: 3038124 - RNA, 24 nt, Mycobacterium bovis subsp bovis AF2122/97
acgggccauggguagccgcccagc

SEQ ID NO: 3038125 - RNA, 17 nt, Mycobacterium bovis subsp bovis AF2122/97
acgggccgcaucgucgc

SEQ ID NO: 3038126 - RNA, 16 nt, Mycobacterium bovis subsp bovis AF2122/97
acgggccggaccauca

SEQ ID NO: 3038127 - RNA, 21 nt, Mycobacterium bovis subsp bovis AF2122/97
acgggccggaccaucagcguc

SEQ ID NO: 3038128 - RNA, 13 nt, Mycobacterium bovis subsp bovis AF2122/97
acgggccggccga

SEQ ID NO: 3038129 - RNA, 15 nt, Mycobacterium bovis subsp bovis AF2122/97
acggugagaucgggu

SEQ ID NO: 3038130 - RNA, 19 nt, Mycobacterium bovis subsp bovis AF2122/97
acggugagggcgucgucga

SEQ ID NO: 3038131 - RNA, 21 nt, Mycobacterium bovis subsp bovis AF2122/97
acggugagggcgucgucgagu

SEQ ID NO: 3038132 - RNA, 16 nt, Mycobacterium bovis subsp bovis AF2122/97
acggugaucagcagca

SEQ ID NO: 3038133 - RNA, 18 nt, Mycobacterium bovis subsp bovis AF2122/97
acggugaucgccggcuuc

SEQ ID NO: 3038134 - RNA, 19 nt, Mycobacterium bovis subsp bovis AF2122/97
acggugaugaggaucgcgu

SEQ ID NO: 3038135 - RNA, 14 nt, Mycobacterium bovis subsp bovis AF2122/97
acggugauggggga

SEQ ID NO: 3038136 - RNA, 19 nt, Mycobacterium bovis subsp bovis AF2122/97
acggugaugggggagccgg

SEQ ID NO: 3038137 - RNA, 20 nt, Mycobacterium bovis subsp bovis AF2122/97
acggugaugggggagccggu

SEQ ID NO: 3038138 - RNA, 21 nt, Mycobacterium bovis subsp bovis AF2122/97
acggugaugggggagccggug

SEQ ID NO: 3038139 - RNA, 21 nt, Mycobacterium bovis subsp bovis AF2122/97
acggugcacagcagugaacgu

SEQ ID NO: 3038140 - RNA, 13 nt, Mycobacterium bovis subsp bovis AF2122/97
acggugcagcucc

SEQ ID NO: 3038141 - RNA, 17 nt, Mycobacterium bovis subsp bovis AF2122/97
acggugcaggaccagaa

SEQ ID NO: 3038142 - RNA, 19 nt, Mycobacterium bovis subsp bovis AF2122/97
acggugccaccgcgacggc

SEQ ID NO: 3038143 - RNA, 14 nt, Mycobacterium bovis subsp bovis AF2122/97
acggugcccagggc

SEQ ID NO: 3038144 - RNA, 16 nt, Mycobacterium bovis subsp bovis AF2122/97
acggugcccagggcga

SEQ ID NO: 3038145 - RNA, 16 nt, Mycobacterium bovis subsp bovis AF2122/97
acggugccgaccgcgu

SEQ ID NO: 3038146 - RNA, 13 nt, Mycobacterium bovis subsp bovis AF2122/97
acggugccgacga

SEQ ID NO: 3038147 - RNA, 14 nt, Mycobacterium bovis subsp bovis AF2122/97
acggugccggcacc

SEQ ID NO: 3038148 - RNA, 18 nt, Mycobacterium bovis subsp bovis AF2122/97
acggugccggcacccgag

SEQ ID NO: 3038149 - RNA, 19 nt, Mycobacterium bovis subsp bovis AF2122/97
acggugccgucggugccgc

SEQ ID NO: 3038150 - RNA, 15 nt, Mycobacterium bovis subsp bovis AF2122/97
acggugcgcagggcc

SEQ ID NO: 3038151 - RNA, 20 nt, Mycobacterium bovis subsp bovis AF2122/97
acggugcgggcuaggcggcg

SEQ ID NO: 3038152 - RNA, 19 nt, Mycobacterium bovis subsp bovis AF2122/97
acggugcucuucgaugacu

SEQ ID NO: 3038153 - RNA, 15 nt, Mycobacterium bovis subsp bovis AF2122/97
acggugcugccguug

SEQ ID NO: 3038154 - RNA, 18 nt, Mycobacterium bovis subsp bovis AF2122/97
acgguggcaacggaggug

SEQ ID NO: 3038155 - RNA, 14 nt, Mycobacterium bovis subsp bovis AF2122/97
acgguggccgcacg

SEQ ID NO: 3038156 - RNA, 15 nt, Mycobacterium bovis subsp bovis AF2122/97
acgguggccgcugcc

SEQ ID NO: 3038157 - RNA, 18 nt, Mycobacterium bovis subsp bovis AF2122/97
acgguggccgcugccagc

SEQ ID NO: 3038158 - RNA, 23 nt, Mycobacterium bovis subsp bovis AF2122/97
acgguggccgcugccagccguuc

SEQ ID NO: 3038159 - RNA, 21 nt, Mycobacterium bovis subsp bovis AF2122/97
acgguggccggcaacggcgcg

SEQ ID NO: 3038160 - RNA, 20 nt, Mycobacterium bovis subsp bovis AF2122/97
acgguggcgccgucggccga

SEQ ID NO: 3038161 - RNA, 15 nt, Mycobacterium bovis subsp bovis AF2122/97
acgguggcgcggugc

SEQ ID NO: 3038162 - RNA, 21 nt, Mycobacterium bovis subsp bovis AF2122/97
acgguggcgcggugccggcgg

SEQ ID NO: 3038163 - RNA, 20 nt, Mycobacterium bovis subsp bovis AF2122/97
acgguggcuucgacggcggc

SEQ ID NO: 3038164 - RNA, 22 nt, Mycobacterium bovis subsp bovis AF2122/97
acgguggcuucgacggcggcca

SEQ ID NO: 3038165 - RNA, 20 nt, Mycobacterium bovis subsp bovis AF2122/97
acggugggcgccgacaccgg

SEQ ID NO: 3038166 - RNA, 15 nt, Mycobacterium bovis subsp bovis AF2122/97
acggugggugguugu

SEQ ID NO: 3038167 - RNA, 18 nt, Mycobacterium bovis subsp bovis AF2122/97
acggugguaagacgccga

SEQ ID NO: 3038168 - RNA, 20 nt, Mycobacterium bovis subsp bovis AF2122/97
acggugguaagacgccgaac

SEQ ID NO: 3038169 - RNA, 21 nt, Mycobacterium bovis subsp bovis AF2122/97
acggugguaagacgccgaacg

SEQ ID NO: 3038170 - RNA, 18 nt, Mycobacterium bovis subsp bovis AF2122/97
acgguggucccccgcagc

SEQ ID NO: 3038171 - RNA, 17 nt, Mycobacterium bovis subsp bovis AF2122/97
acgguggugaccgcggg

SEQ ID NO: 3038172 - RNA, 18 nt, Mycobacterium bovis subsp bovis AF2122/97
acgguggugaccgcgggc

SEQ ID NO: 3038173 - RNA, 18 nt, Mycobacterium bovis subsp bovis AF2122/97
acgguggugucagccacc

SEQ ID NO: 3038174 - RNA, 15 nt, Mycobacterium bovis subsp bovis AF2122/97
acgguguaacugcgu

SEQ ID NO: 3038175 - RNA, 14 nt, Mycobacterium bovis subsp bovis AF2122/97
acgguguagccgcc

SEQ ID NO: 3038176 - RNA, 16 nt, Mycobacterium bovis subsp bovis AF2122/97
acgguguagccgccgg

SEQ ID NO: 3038177 - RNA, 18 nt, Mycobacterium bovis subsp bovis AF2122/97
acgguguagccgccggca

SEQ ID NO: 3038178 - RNA, 19 nt, Mycobacterium bovis subsp bovis AF2122/97
acgguguagccgccggcag

SEQ ID NO: 3038179 - RNA, 16 nt, Mycobacterium bovis subsp bovis AF2122/97
acggugucaacggcac

SEQ ID NO: 3038180 - RNA, 13 nt, Mycobacterium bovis subsp bovis AF2122/97
acgguguccggau

SEQ ID NO: 3038181 - RNA, 20 nt, Mycobacterium bovis subsp bovis AF2122/97
acggugucgcgaugcuuccc

SEQ ID NO: 3038182 - RNA, 15 nt, Mycobacterium bovis subsp bovis AF2122/97
acgguguggaaaccg

SEQ ID NO: 3038183 - RNA, 18 nt, Mycobacterium bovis subsp bovis AF2122/97
acgguguggaaaccgcgg

SEQ ID NO: 3038184 - RNA, 11 nt, Mycobacterium bovis subsp bovis AF2122/97
acgguguuggu

SEQ ID NO: 3038185 - RNA, 14 nt, Mycobacterium bovis subsp bovis AF2122/97
acgguguuggugac

SEQ ID NO: 3038186 - RNA, 22 nt, Mycobacterium bovis subsp bovis AF2122/97
acgguguuggugaccgggucga

SEQ ID NO: 3038187 - RNA, 16 nt, Mycobacterium bovis subsp bovis AF2122/97
acgguuacccagccgu

SEQ ID NO: 3038188 - RNA, 22 nt, Mycobacterium bovis subsp bovis AF2122/97
acgguucauccacuccgccaac

SEQ ID NO: 3038189 - RNA, 12 nt, Mycobacterium bovis subsp bovis AF2122/97
acgguucgaccc

SEQ ID NO: 3038190 - RNA, 20 nt, Mycobacterium bovis subsp bovis AF2122/97
acgguugccgucagggucag

SEQ ID NO: 3038191 - RNA, 22 nt, Mycobacterium bovis subsp bovis AF2122/97
acgguugcucguccaagccggc

SEQ ID NO: 3038192 - RNA, 14 nt, Mycobacterium bovis subsp bovis AF2122/97
acgguuggccacca

SEQ ID NO: 3038193 - RNA, 19 nt, Mycobacterium bovis subsp bovis AF2122/97
acgguugguccgccgucga

SEQ ID NO: 3038194 - RNA, 20 nt, Mycobacterium bovis subsp bovis AF2122/97
acgguugguccgccgucgac

SEQ ID NO: 3038195 - RNA, 12 nt, Mycobacterium bovis subsp bovis AF2122/97
acguaacccagu

SEQ ID NO: 3038196 - RNA, 20 nt, Mycobacterium bovis subsp bovis AF2122/97
acguaaccguuggagucagg

SEQ ID NO: 3038197 - RNA, 15 nt, Mycobacterium bovis subsp bovis AF2122/97
acguaccacggcgau

SEQ ID NO: 3038198 - RNA, 15 nt, Mycobacterium bovis subsp bovis AF2122/97
acguacgccgccgau

SEQ ID NO: 3038199 - RNA, 17 nt, Mycobacterium bovis subsp bovis AF2122/97
acguagaagucgaucgc

SEQ ID NO: 3038200 - RNA, 16 nt, Mycobacterium bovis subsp bovis AF2122/97
acguagacaaggccaa

SEQ ID NO: 3038201 - RNA, 16 nt, Mycobacterium bovis subsp bovis AF2122/97
acguagacgguccggu

SEQ ID NO: 3038202 - RNA, 14 nt, Mycobacterium bovis subsp bovis AF2122/97
acguagcagcagac

SEQ ID NO: 3038203 - RNA, 14 nt, Mycobacterium bovis subsp bovis AF2122/97
acguagcagcgccg

SEQ ID NO: 3038204 - RNA, 18 nt, Mycobacterium bovis subsp bovis AF2122/97
acguagcagcgccggcac

SEQ ID NO: 3038205 - RNA, 22 nt, Mycobacterium bovis subsp bovis AF2122/97
acguagcagcgccggcaccgac

SEQ ID NO: 3038206 - RNA, 23 nt, Mycobacterium bovis subsp bovis AF2122/97
acguagccguacgguccgaacac

SEQ ID NO: 3038207 - RNA, 15 nt, Mycobacterium bovis subsp bovis AF2122/97
acguaggcgcugaag

SEQ ID NO: 3038208 - RNA, 15 nt, Mycobacterium bovis subsp bovis AF2122/97
acguaggcggcggcc

SEQ ID NO: 3038209 - RNA, 16 nt, Mycobacterium bovis subsp bovis AF2122/97
acguagugcaccgccu

SEQ ID NO: 3038210 - RNA, 14 nt, Mycobacterium bovis subsp bovis AF2122/97
acguauaccgcacc

SEQ ID NO: 3038211 - RNA, 22 nt, Mycobacterium bovis subsp bovis AF2122/97
acguauaucgguugcugcgcga

SEQ ID NO: 3038212 - RNA, 17 nt, Mycobacterium bovis subsp bovis AF2122/97
acguauccacggucgac

SEQ ID NO: 3038213 - RNA, 19 nt, Mycobacterium bovis subsp bovis AF2122/97
acgucaaacccagcgacgc

SEQ ID NO: 3038214 - RNA, 23 nt, Mycobacterium bovis subsp bovis AF2122/97
acgucaaacccagcgacgcggcc

SEQ ID NO: 3038215 - RNA, 18 nt, Mycobacterium bovis subsp bovis AF2122/97
acgugaauuaaggugacc

SEQ ID NO: 3038216 - RNA, 23 nt, Mycobacterium bovis subsp bovis AF2122/97
acgugaauuaaggugaccacggc

SEQ ID NO: 3038217 - RNA, 17 nt, Mycobacterium bovis subsp bovis AF2122/97
acgugacaacugcgccg

SEQ ID NO: 3038218 - RNA, 21 nt, Mycobacterium bovis subsp bovis AF2122/97
acgugacaacugcgccggugc

SEQ ID NO: 3038219 - RNA, 22 nt, Mycobacterium bovis subsp bovis AF2122/97
acgugaccagcuucggcuggcg

SEQ ID NO: 3038220 - RNA, 18 nt, Mycobacterium bovis subsp bovis AF2122/97
acgugacgguccacgacg

SEQ ID NO: 3038221 - RNA, 12 nt, Mycobacterium bovis subsp bovis AF2122/97
acgugacgucgu

SEQ ID NO: 3038222 - RNA, 20 nt, Mycobacterium bovis subsp bovis AF2122/97
acgugaggucccggcuggga

SEQ ID NO: 3038223 - RNA, 16 nt, Mycobacterium bovis subsp bovis AF2122/97
acgugagugccggcgu

SEQ ID NO: 3038224 - RNA, 17 nt, Mycobacterium bovis subsp bovis AF2122/97
acgugaguuucaccacu

SEQ ID NO: 3038225 - RNA, 20 nt, Mycobacterium bovis subsp bovis AF2122/97
acgugauagcuugcgucgca

SEQ ID NO: 3038226 - RNA, 16 nt, Mycobacterium bovis subsp bovis AF2122/97
acgugaucgacgaccg

SEQ ID NO: 3038227 - RNA, 21 nt, Mycobacterium bovis subsp bovis AF2122/97
acgugaucgcgguccaacagc

SEQ ID NO: 3038228 - RNA, 23 nt, Mycobacterium bovis subsp bovis AF2122/97
acgugaucgcgguccaacagcgc

SEQ ID NO: 3038229 - RNA, 22 nt, Mycobacterium bovis subsp bovis AF2122/97
acgugaugcguucggccgggcc

SEQ ID NO: 3038230 - RNA, 19 nt, Mycobacterium bovis subsp bovis AF2122/97
acgugauguagcugcaggu

SEQ ID NO: 3038231 - RNA, 21 nt, Mycobacterium bovis subsp bovis AF2122/97
acgugcaaccacggcggcauc

SEQ ID NO: 3038232 - RNA, 16 nt, Mycobacterium bovis subsp bovis AF2122/97
acgugcaccagguugc

SEQ ID NO: 3038233 - RNA, 16 nt, Mycobacterium bovis subsp bovis AF2122/97
acgugcacggcgaggu

SEQ ID NO: 3038234 - RNA, 15 nt, Mycobacterium bovis subsp bovis AF2122/97
acgugcaggaacacc

SEQ ID NO: 3038235 - RNA, 17 nt, Mycobacterium bovis subsp bovis AF2122/97
acgugcaggaacaccca

SEQ ID NO: 3038236 - RNA, 19 nt, Mycobacterium bovis subsp bovis AF2122/97
acgugcaggaacacccaua

SEQ ID NO: 3038237 - RNA, 18 nt, Mycobacterium bovis subsp bovis AF2122/97
acgugcaugagcguucag

SEQ ID NO: 3038238 - RNA, 20 nt, Mycobacterium bovis subsp bovis AF2122/97
acgugccaaugauucggcac

SEQ ID NO: 3038239 - RNA, 22 nt, Mycobacterium bovis subsp bovis AF2122/97
acgugccaaugauucggcacgc

SEQ ID NO: 3038240 - RNA, 17 nt, Mycobacterium bovis subsp bovis AF2122/97
acgugccccaugcgcag

SEQ ID NO: 3038241 - RNA, 22 nt, Mycobacterium bovis subsp bovis AF2122/97
acgugccgaacgccagaccgcc

SEQ ID NO: 3038242 - RNA, 21 nt, Mycobacterium bovis subsp bovis AF2122/97
acgugcgaaucgagacggcca

SEQ ID NO: 3038243 - RNA, 23 nt, Mycobacterium bovis subsp bovis AF2122/97
acgugcgaaucgagacggccacg

SEQ ID NO: 3038244 - RNA, 16 nt, Mycobacterium bovis subsp bovis AF2122/97
acgugcgagcccaccu

SEQ ID NO: 3038245 - RNA, 23 nt, Mycobacterium bovis subsp bovis AF2122/97
acgugcgagcccaccuggggccg

SEQ ID NO: 3038246 - RNA, 14 nt, Mycobacterium bovis subsp bovis AF2122/97
acgugcgcgccaag

SEQ ID NO: 3038247 - RNA, 12 nt, Mycobacterium bovis subsp bovis AF2122/97
acgugcggcgcg

SEQ ID NO: 3038248 - RNA, 15 nt, Mycobacterium bovis subsp bovis AF2122/97
acgugcgucggcccg

SEQ ID NO: 3038249 - RNA, 20 nt, Mycobacterium bovis subsp bovis AF2122/97
acgugcucguagacuugcug

SEQ ID NO: 3038250 - RNA, 21 nt, Mycobacterium bovis subsp bovis AF2122/97
acgugcucguagacuugcugc

SEQ ID NO: 3038251 - RNA, 23 nt, Mycobacterium bovis subsp bovis AF2122/97
acgugcucguagacuugcugcuc

SEQ ID NO: 3038252 - RNA, 16 nt, Mycobacterium bovis subsp bovis AF2122/97
acgugcuggugggccg

SEQ ID NO: 3038253 - RNA, 17 nt, Mycobacterium bovis subsp bovis AF2122/97
acguggacugaccucgu

SEQ ID NO: 3038254 - RNA, 16 nt, Mycobacterium bovis subsp bovis AF2122/97
acguggaugucucgau

SEQ ID NO: 3038255 - RNA, 16 nt, Mycobacterium bovis subsp bovis AF2122/97
acguggccacggcauu

SEQ ID NO: 3038256 - RNA, 17 nt, Mycobacterium bovis subsp bovis AF2122/97
acguggccauccucgag

SEQ ID NO: 3038257 - RNA, 15 nt, Mycobacterium bovis subsp bovis AF2122/97
acguggcgaccggcg

SEQ ID NO: 3038258 - RNA, 19 nt, Mycobacterium bovis subsp bovis AF2122/97
acguggcgcuggaccgggu

SEQ ID NO: 3038259 - RNA, 13 nt, Mycobacterium bovis subsp bovis AF2122/97
acguggcucggcg

SEQ ID NO: 3038260 - RNA, 19 nt, Mycobacterium bovis subsp bovis AF2122/97
acguggcugcguucgccgg

SEQ ID NO: 3038261 - RNA, 19 nt, Mycobacterium bovis subsp bovis AF2122/97
acgugggccaacgacgcca

SEQ ID NO: 3038262 - RNA, 18 nt, Mycobacterium bovis subsp bovis AF2122/97
acgugguccaaccgggcc

SEQ ID NO: 3038263 - RNA, 21 nt, Mycobacterium bovis subsp bovis AF2122/97
acgugguccaaccgggccggc

SEQ ID NO: 3038264 - RNA, 21 nt, Mycobacterium bovis subsp bovis AF2122/97
acguggucggagcgggugcgg

SEQ ID NO: 3038265 - RNA, 13 nt, Mycobacterium bovis subsp bovis AF2122/97
acguggucggcca

SEQ ID NO: 3038266 - RNA, 16 nt, Mycobacterium bovis subsp bovis AF2122/97
acguggucggccaccc

SEQ ID NO: 3038267 - RNA, 13 nt, Mycobacterium bovis subsp bovis AF2122/97
acguggugcggcc

SEQ ID NO: 3038268 - RNA, 18 nt, Mycobacterium bovis subsp bovis AF2122/97
acgugguggaccucacug

SEQ ID NO: 3038269 - RNA, 16 nt, Mycobacterium bovis subsp bovis AF2122/97
acguggugggcgcaga

SEQ ID NO: 3038270 - RNA, 16 nt, Mycobacterium bovis subsp bovis AF2122/97
acguggugggcuuggc

SEQ ID NO: 3038271 - RNA, 17 nt, Mycobacterium bovis subsp bovis AF2122/97
acgugguguaucgacgg

SEQ ID NO: 3038272 - RNA, 22 nt, Mycobacterium bovis subsp bovis AF2122/97
acgugucaucacggucagccgu

SEQ ID NO: 3038273 - RNA, 14 nt, Mycobacterium bovis subsp bovis AF2122/97
acgugucccgcaug

SEQ ID NO: 3038274 - RNA, 15 nt, Mycobacterium bovis subsp bovis AF2122/97
acgugucccgcaugc

SEQ ID NO: 3038275 - RNA, 20 nt, Mycobacterium bovis subsp bovis AF2122/97
acguguggugugucaccgga

SEQ ID NO: 3038276 - RNA, 15 nt, Mycobacterium bovis subsp bovis AF2122/97
acguguuaaccgggc

SEQ ID NO: 3038277 - RNA, 13 nt, Mycobacterium bovis subsp bovis AF2122/97
acguguucugguc

SEQ ID NO: 3038278 - RNA, 16 nt, Mycobacterium bovis subsp bovis AF2122/97
acguguucuggucgcg

SEQ ID NO: 3038279 - RNA, 14 nt, Mycobacterium bovis subsp bovis AF2122/97
acguucggcacaac

SEQ ID NO: 3038280 - RNA, 17 nt, Mycobacterium bovis subsp bovis AF2122/97
acguucggcacaaccaa

SEQ ID NO: 3038281 - RNA, 19 nt, Mycobacterium bovis subsp bovis AF2122/97
acguucggcacaaccaacg

SEQ ID NO: 3038282 - RNA, 21 nt, Mycobacterium bovis subsp bovis AF2122/97
acguucuuguccaggaucgcg

SEQ ID NO: 3038283 - RNA, 21 nt, Mycobacterium bovis subsp bovis AF2122/97
acguugacguccaacagcgcu

SEQ ID NO: 3038284 - RNA, 18 nt, Mycobacterium bovis subsp bovis AF2122/97
acguugaugaugccggcg

SEQ ID NO: 3038285 - RNA, 12 nt, Mycobacterium bovis subsp bovis AF2122/97
acguugcagccg

SEQ ID NO: 3038286 - RNA, 16 nt, Mycobacterium bovis subsp bovis AF2122/97
acguugcagccggcau

SEQ ID NO: 3038287 - RNA, 17 nt, Mycobacterium bovis subsp bovis AF2122/97
acguugcagccggcaua

SEQ ID NO: 3038288 - RNA, 18 nt, Mycobacterium bovis subsp bovis AF2122/97
acguugccaacaccggcg

SEQ ID NO: 3038289 - RNA, 22 nt, Mycobacterium bovis subsp bovis AF2122/97
acguugccaacaccggcgauca

SEQ ID NO: 3038290 - RNA, 16 nt, Mycobacterium bovis subsp bovis AF2122/97
acguugccgaacgucg

SEQ ID NO: 3038291 - RNA, 23 nt, Mycobacterium bovis subsp bovis AF2122/97
acguugcgaggccgcacgucgac

SEQ ID NO: 3038292 - RNA, 16 nt, Mycobacterium bovis subsp bovis AF2122/97
acguugcggacggcgu

SEQ ID NO: 3038293 - RNA, 22 nt, Mycobacterium bovis subsp bovis AF2122/97
acguugcguagcaggucgacgg

SEQ ID NO: 3038294 - RNA, 14 nt, Mycobacterium bovis subsp bovis AF2122/97
acguuggccaggcc

SEQ ID NO: 3038295 - RNA, 14 nt, Mycobacterium bovis subsp bovis AF2122/97
acguuggcggccag

SEQ ID NO: 3038296 - RNA, 18 nt, Mycobacterium bovis subsp bovis AF2122/97
acguuggcggccagcgca

SEQ ID NO: 3038297 - RNA, 22 nt, Mycobacterium bovis subsp bovis AF2122/97
acguuggcggccagcgcaccgc

SEQ ID NO: 3038298 - RNA, 18 nt, Mycobacterium bovis subsp bovis AF2122/97
acguuggcgugcaccgca

SEQ ID NO: 3038299 - RNA, 22 nt, Mycobacterium bovis subsp bovis AF2122/97
acguuggggauggucccgcucu

SEQ ID NO: 3038300 - RNA, 19 nt, Mycobacterium bovis subsp bovis AF2122/97
acguuguaggagaacguca

SEQ ID NO: 3038301 - RNA, 12 nt, Mycobacterium bovis subsp bovis AF2122/97
acucggcccaca

SEQ ID NO: 3038302 - RNA, 17 nt, Mycobacterium bovis subsp bovis AF2122/97
acucggcccacacgguc

SEQ ID NO: 3038303 - RNA, 15 nt, Mycobacterium bovis subsp bovis AF2122/97
acucggcccggguga

SEQ ID NO: 3038304 - RNA, 13 nt, Mycobacterium bovis subsp bovis AF2122/97
acucggccgggcu

SEQ ID NO: 3038305 - RNA, 16 nt, Mycobacterium bovis subsp bovis AF2122/97
acucggccgggcucua

SEQ ID NO: 3038306 - RNA, 20 nt, Mycobacterium bovis subsp bovis AF2122/97
acucggcgaccugccggacc

SEQ ID NO: 3038307 - RNA, 21 nt, Mycobacterium bovis subsp bovis AF2122/97
acucggcgaugacaucaccga

SEQ ID NO: 3038308 - RNA, 15 nt, Mycobacterium bovis subsp bovis AF2122/97
acucggcggaagacc

SEQ ID NO: 3038309 - RNA, 13 nt, Mycobacterium bovis subsp bovis AF2122/97
acucggcggccac

SEQ ID NO: 3038310 - RNA, 14 nt, Mycobacterium bovis subsp bovis AF2122/97
acucggcggccacc

SEQ ID NO: 3038311 - RNA, 11 nt, Mycobacterium bovis subsp bovis AF2122/97
acucggcggcu

SEQ ID NO: 3038312 - RNA, 22 nt, Mycobacterium bovis subsp bovis AF2122/97
acucgggcaaugucgacaccgg

SEQ ID NO: 3038313 - RNA, 15 nt, Mycobacterium bovis subsp bovis AF2122/97
acucgggcacgggug

SEQ ID NO: 3038314 - RNA, 14 nt, Mycobacterium bovis subsp bovis AF2122/97
acucgggcagcgcg

SEQ ID NO: 3038315 - RNA, 19 nt, Mycobacterium bovis subsp bovis AF2122/97
acucgggcagcgcggccag

SEQ ID NO: 3038316 - RNA, 21 nt, Mycobacterium bovis subsp bovis AF2122/97
acucgggcagcuucaacaccg

SEQ ID NO: 3038317 - RNA, 23 nt, Mycobacterium bovis subsp bovis AF2122/97
acucgggcagcuucaacaccggc

SEQ ID NO: 3038318 - RNA, 24 nt, Mycobacterium bovis subsp bovis AF2122/97
acucggucguugccgcggucggcg

SEQ ID NO: 3038319 - RNA, 19 nt, Mycobacterium bovis subsp bovis AF2122/97
acucggucucauagugcag

SEQ ID NO: 3038320 - RNA, 13 nt, Mycobacterium bovis subsp bovis AF2122/97
acucggucucgau

SEQ ID NO: 3038321 - RNA, 20 nt, Mycobacterium bovis subsp bovis AF2122/97
acucggugaucgcgguggcu

SEQ ID NO: 3038322 - RNA, 12 nt, Mycobacterium bovis subsp bovis AF2122/97
acucggugcggu

SEQ ID NO: 3038323 - RNA, 17 nt, Mycobacterium bovis subsp bovis AF2122/97
acucggugucggccgcg

SEQ ID NO: 3038324 - RNA, 20 nt, Mycobacterium bovis subsp bovis AF2122/97
acucgguguuucgugccaug

SEQ ID NO: 3038325 - RNA, 23 nt, Mycobacterium bovis subsp bovis AF2122/97
acucgguguuucgugccaugguu

SEQ ID NO: 3038326 - RNA, 23 nt, Mycobacterium bovis subsp bovis AF2122/97
acucgguuugacgagacgacgac

SEQ ID NO: 3038327 - RNA, 12 nt, Mycobacterium bovis subsp bovis AF2122/97
acucguagaacg

SEQ ID NO: 3038328 - RNA, 15 nt, Mycobacterium bovis subsp bovis AF2122/97
acucgucgaugcggu

SEQ ID NO: 3038329 - RNA, 15 nt, Mycobacterium bovis subsp bovis AF2122/97
acucgucgucgguca

SEQ ID NO: 3038330 - RNA, 21 nt, Mycobacterium bovis subsp bovis AF2122/97
acucguggcgccacggcagcg

SEQ ID NO: 3038331 - RNA, 17 nt, Mycobacterium bovis subsp bovis AF2122/97
acucguugaccggccgg

SEQ ID NO: 3038332 - RNA, 19 nt, Mycobacterium bovis subsp bovis AF2122/97
acucguugccgaccaugca

SEQ ID NO: 3038333 - RNA, 15 nt, Mycobacterium bovis subsp bovis AF2122/97
acucguuggcgaacu

SEQ ID NO: 3038334 - RNA, 17 nt, Mycobacterium bovis subsp bovis AF2122/97
acucucgcgacaucacc

SEQ ID NO: 3038335 - RNA, 17 nt, Mycobacterium bovis subsp bovis AF2122/97
acucucggugaacgccg

SEQ ID NO: 3038336 - RNA, 17 nt, Mycobacterium bovis subsp bovis AF2122/97
acucugcgacaccacga

SEQ ID NO: 3038337 - RNA, 20 nt, Mycobacterium bovis subsp bovis AF2122/97
acucuguggugucgauuggc

SEQ ID NO: 3038338 - RNA, 16 nt, Mycobacterium bovis subsp bovis AF2122/97
acucuucggaccggcu

SEQ ID NO: 3038339 - RNA, 15 nt, Mycobacterium bovis subsp bovis AF2122/97
acucuucgggcggcg

SEQ ID NO: 3038340 - RNA, 15 nt, Mycobacterium bovis subsp bovis AF2122/97
acugaaccgagugca

SEQ ID NO: 3038341 - RNA, 15 nt, Mycobacterium bovis subsp bovis AF2122/97
acugaauuuggugaa

SEQ ID NO: 3038342 - RNA, 21 nt, Mycobacterium bovis subsp bovis AF2122/97
acugaauuuggugaagccgua

SEQ ID NO: 3038343 - RNA, 14 nt, Mycobacterium bovis subsp bovis AF2122/97
acugaccacgucgg

SEQ ID NO: 3038344 - RNA, 15 nt, Mycobacterium bovis subsp bovis AF2122/97
acugaccaggucugc

SEQ ID NO: 3038345 - RNA, 14 nt, Mycobacterium bovis subsp bovis AF2122/97
acugaccccgccgc

SEQ ID NO: 3038346 - RNA, 16 nt, Mycobacterium bovis subsp bovis AF2122/97
acugaccccgccgcca

SEQ ID NO: 3038347 - RNA, 14 nt, Mycobacterium bovis subsp bovis AF2122/97
acugacccugaucg

SEQ ID NO: 3038348 - RNA, 17 nt, Mycobacterium bovis subsp bovis AF2122/97
acugaccgcgaucgccg

SEQ ID NO: 3038349 - RNA, 20 nt, Mycobacterium bovis subsp bovis AF2122/97
acugaccgcggcugucacgc

SEQ ID NO: 3038350 - RNA, 22 nt, Mycobacterium bovis subsp bovis AF2122/97
acugaccgucugcgacccgggc

SEQ ID NO: 3038351 - RNA, 17 nt, Mycobacterium bovis subsp bovis AF2122/97
acugaccucgucaauca

SEQ ID NO: 3038352 - RNA, 18 nt, Mycobacterium bovis subsp bovis AF2122/97
acugacuuugggucggcg

SEQ ID NO: 3038353 - RNA, 15 nt, Mycobacterium bovis subsp bovis AF2122/97
acugagccacaggga

SEQ ID NO: 3038354 - RNA, 17 nt, Mycobacterium bovis subsp bovis AF2122/97
acugaggcucaggugcu

SEQ ID NO: 3038355 - RNA, 15 nt, Mycobacterium bovis subsp bovis AF2122/97
acugauagacccugg

SEQ ID NO: 3038356 - RNA, 19 nt, Mycobacterium bovis subsp bovis AF2122/97
acugaucaagugccagcgu

SEQ ID NO: 3038357 - RNA, 21 nt, Mycobacterium bovis subsp bovis AF2122/97
acugaucaggccgaugacgau

SEQ ID NO: 3038358 - RNA, 20 nt, Mycobacterium bovis subsp bovis AF2122/97
acugaucgaccgccuccucg

SEQ ID NO: 3038359 - RNA, 20 nt, Mycobacterium bovis subsp bovis AF2122/97
acugaucgccacccgguccc

SEQ ID NO: 3038360 - RNA, 19 nt, Mycobacterium bovis subsp bovis AF2122/97
acugaucgcgauccacccg

SEQ ID NO: 3038361 - RNA, 19 nt, Mycobacterium bovis subsp bovis AF2122/97
acugaucuucgagccggcg

SEQ ID NO: 3038362 - RNA, 18 nt, Mycobacterium bovis subsp bovis AF2122/97
acugaucuuggcccgggc

SEQ ID NO: 3038363 - RNA, 19 nt, Mycobacterium bovis subsp bovis AF2122/97
acugaucuuggcccgggcc

SEQ ID NO: 3038364 - RNA, 21 nt, Mycobacterium bovis subsp bovis AF2122/97
acugaugaaccacggcaggca

SEQ ID NO: 3038365 - RNA, 19 nt, Mycobacterium bovis subsp bovis AF2122/97
acugauggcgcgcaacgag

SEQ ID NO: 3038366 - RNA, 15 nt, Mycobacterium bovis subsp bovis AF2122/97
acugaugucacccgc

SEQ ID NO: 3038367 - RNA, 17 nt, Mycobacterium bovis subsp bovis AF2122/97
acugcaacucuucccau

SEQ ID NO: 3038368 - RNA, 17 nt, Mycobacterium bovis subsp bovis AF2122/97
acugcacaccaccgccg

SEQ ID NO: 3038369 - RNA, 13 nt, Mycobacterium bovis subsp bovis AF2122/97
acugcaccuggcc

SEQ ID NO: 3038370 - RNA, 21 nt, Mycobacterium bovis subsp bovis AF2122/97
acugcaccuggccgcccgcuc

SEQ ID NO: 3038371 - RNA, 18 nt, Mycobacterium bovis subsp bovis AF2122/97
acugcacggagccgccgg

SEQ ID NO: 3038372 - RNA, 23 nt, Mycobacterium bovis subsp bovis AF2122/97
acugcacuugaaauugagccggc

SEQ ID NO: 3038373 - RNA, 13 nt, Mycobacterium bovis subsp bovis AF2122/97
acugcagcccugc

SEQ ID NO: 3038374 - RNA, 22 nt, Mycobacterium bovis subsp bovis AF2122/97
acugcagcgccucgauccgcau

SEQ ID NO: 3038375 - RNA, 13 nt, Mycobacterium bovis subsp bovis AF2122/97
acugcagcgcggu

SEQ ID NO: 3038376 - RNA, 19 nt, Mycobacterium bovis subsp bovis AF2122/97
acugcaggcugucgagucg

SEQ ID NO: 3038377 - RNA, 19 nt, Mycobacterium bovis subsp bovis AF2122/97
acugcaguaguagcgcaac

SEQ ID NO: 3038378 - RNA, 23 nt, Mycobacterium bovis subsp bovis AF2122/97
acugcaguaguagcgcaaccgcg

SEQ ID NO: 3038379 - RNA, 18 nt, Mycobacterium bovis subsp bovis AF2122/97
acugcaugaacugcucgc

SEQ ID NO: 3038380 - RNA, 18 nt, Mycobacterium bovis subsp bovis AF2122/97
acugcaugguggcgccga

SEQ ID NO: 3038381 - RNA, 13 nt, Mycobacterium bovis subsp bovis AF2122/97
acugccaccgcga

SEQ ID NO: 3038382 - RNA, 21 nt, Mycobacterium bovis subsp bovis AF2122/97
acugccaccgugugcacgcga

SEQ ID NO: 3038383 - RNA, 12 nt, Mycobacterium bovis subsp bovis AF2122/97
acugccacuccu

SEQ ID NO: 3038384 - RNA, 17 nt, Mycobacterium bovis subsp bovis AF2122/97
acugccagcgccgcggc

SEQ ID NO: 3038385 - RNA, 13 nt, Mycobacterium bovis subsp bovis AF2122/97
acugccccagcac

SEQ ID NO: 3038386 - RNA, 18 nt, Mycobacterium bovis subsp bovis AF2122/97
acugccccgcaucgccca

SEQ ID NO: 3038387 - RNA, 22 nt, Mycobacterium bovis subsp bovis AF2122/97
acugcccgauggcuaccuugga

SEQ ID NO: 3038388 - RNA, 15 nt, Mycobacterium bovis subsp bovis AF2122/97
acugggcuggccagc

SEQ ID NO: 3038389 - RNA, 16 nt, Mycobacterium bovis subsp bovis AF2122/97
acuggggaggccaacc

SEQ ID NO: 3038390 - RNA, 23 nt, Mycobacterium bovis subsp bovis AF2122/97
acuggggcgccaccacccggcgc

SEQ ID NO: 3038391 - RNA, 13 nt, Mycobacterium bovis subsp bovis AF2122/97
acugggggccggc

SEQ ID NO: 3038392 - RNA, 21 nt, Mycobacterium bovis subsp bovis AF2122/97
acugggggccggcacugccga

SEQ ID NO: 3038393 - RNA, 14 nt, Mycobacterium bovis subsp bovis AF2122/97
acuggggugcugcg

SEQ ID NO: 3038394 - RNA, 13 nt, Mycobacterium bovis subsp bovis AF2122/97
acugggucgccuc

SEQ ID NO: 3038395 - RNA, 22 nt, Mycobacterium bovis subsp bovis AF2122/97
acugggugucggugucgacguu

SEQ ID NO: 3038396 - RNA, 22 nt, Mycobacterium bovis subsp bovis AF2122/97
acugguagcccggaccgcccgu

SEQ ID NO: 3038397 - RNA, 21 nt, Mycobacterium bovis subsp bovis AF2122/97
acuggucaacgggaugccggc

SEQ ID NO: 3038398 - RNA, 22 nt, Mycobacterium bovis subsp bovis AF2122/97
acuggucaacgggaugccggcg

SEQ ID NO: 3038399 - RNA, 23 nt, Mycobacterium bovis subsp bovis AF2122/97
acuggucaacgggaugccggcga

SEQ ID NO: 3038400 - RNA, 12 nt, Mycobacterium bovis subsp bovis AF2122/97
acuggucgccaa

SEQ ID NO: 3038401 - RNA, 13 nt, Mycobacterium bovis subsp bovis AF2122/97
acuggucgccaac

SEQ ID NO: 3038402 - RNA, 19 nt, Mycobacterium bovis subsp bovis AF2122/97
acuggucgccaacgccagc

SEQ ID NO: 3038403 - RNA, 14 nt, Mycobacterium bovis subsp bovis AF2122/97
acuggucgcggcgc

SEQ ID NO: 3038404 - RNA, 24 nt, Mycobacterium bovis subsp bovis AF2122/97
acuggucucccagaggucgagcgc

SEQ ID NO: 3038405 - RNA, 14 nt, Mycobacterium bovis subsp bovis AF2122/97
acuggugacccuga

SEQ ID NO: 3038406 - RNA, 13 nt, Mycobacterium bovis subsp bovis AF2122/97
acuggugcagcgc

SEQ ID NO: 3038407 - RNA, 21 nt, Mycobacterium bovis subsp bovis AF2122/97
acuggugcccgacccgccgau

SEQ ID NO: 3038408 - RNA, 13 nt, Mycobacterium bovis subsp bovis AF2122/97
acuggugccugcc

SEQ ID NO: 3038409 - RNA, 18 nt, Mycobacterium bovis subsp bovis AF2122/97
acugguggcgauccguag

SEQ ID NO: 3038410 - RNA, 18 nt, Mycobacterium bovis subsp bovis AF2122/97
acugguugacgucgaugu

SEQ ID NO: 3038411 - RNA, 15 nt, Mycobacterium bovis subsp bovis AF2122/97
acuguagggccggug

SEQ ID NO: 3038412 - RNA, 23 nt, Mycobacterium bovis subsp bovis AF2122/97
acuguccgggugggcgcugucac

SEQ ID NO: 3038413 - RNA, 16 nt, Mycobacterium bovis subsp bovis AF2122/97
acugucuggucggcua

SEQ ID NO: 3038414 - RNA, 18 nt, Mycobacterium bovis subsp bovis AF2122/97
acugugaaucucacgacg

SEQ ID NO: 3038415 - RNA, 19 nt, Mycobacterium bovis subsp bovis AF2122/97
acugugaaucucacgacgc

SEQ ID NO: 3038416 - RNA, 19 nt, Mycobacterium bovis subsp bovis AF2122/97
acugugaaucugacgacgc

SEQ ID NO: 3038417 - RNA, 15 nt, Mycobacterium bovis subsp bovis AF2122/97
acugugacgccgggc

SEQ ID NO: 3038418 - RNA, 20 nt, Mycobacterium bovis subsp bovis AF2122/97
acugugccgcugcauccgca

SEQ ID NO: 3038419 - RNA, 21 nt, Mycobacterium bovis subsp bovis AF2122/97
acugugccgcugcauccgcag

SEQ ID NO: 3038420 - RNA, 16 nt, Mycobacterium bovis subsp bovis AF2122/97
acugugcgccgcagcc

SEQ ID NO: 3038421 - RNA, 15 nt, Mycobacterium bovis subsp bovis AF2122/97
acugugcgccugcgu

SEQ ID NO: 3038422 - RNA, 16 nt, Mycobacterium bovis subsp bovis AF2122/97
acugugcguccgcaac

SEQ ID NO: 3038423 - RNA, 17 nt, Mycobacterium bovis subsp bovis AF2122/97
acugugcguccgcaaca

SEQ ID NO: 3038424 - RNA, 11 nt, Mycobacterium bovis subsp bovis AF2122/97
acuguggcgcc

SEQ ID NO: 3038425 - RNA, 13 nt, Mycobacterium bovis subsp bovis AF2122/97
acuguucccacag

SEQ ID NO: 3038426 - RNA, 14 nt, Mycobacterium bovis subsp bovis AF2122/97
acuguugaagaagc

SEQ ID NO: 3038427 - RNA, 17 nt, Mycobacterium bovis subsp bovis AF2122/97
acuguuggugccgccac

SEQ ID NO: 3038428 - RNA, 22 nt, Mycobacterium bovis subsp bovis AF2122/97
acuuaaccaggcgagccgccac

SEQ ID NO: 3038429 - RNA, 16 nt, Mycobacterium bovis subsp bovis AF2122/97
acuuaccgagccguca

SEQ ID NO: 3038430 - RNA, 19 nt, Mycobacterium bovis subsp bovis AF2122/97
acuuaccgaggccaugcuc

SEQ ID NO: 3038431 - RNA, 13 nt, Mycobacterium bovis subsp bovis AF2122/97
acuuacgcgacgc

SEQ ID NO: 3038432 - RNA, 22 nt, Mycobacterium bovis subsp bovis AF2122/97
acuuagcccgauggugccgacc

SEQ ID NO: 3038433 - RNA, 22 nt, Mycobacterium bovis subsp bovis AF2122/97
acuuagcgcuugacccgcggac

SEQ ID NO: 3038434 - RNA, 18 nt, Mycobacterium bovis subsp bovis AF2122/97
acuuagcgggugccagcc

SEQ ID NO: 3038435 - RNA, 15 nt, Mycobacterium bovis subsp bovis AF2122/97
acuuauccggccagu

SEQ ID NO: 3038436 - RNA, 11 nt, Mycobacterium bovis subsp bovis AF2122/97
acuucaccacc

SEQ ID NO: 3038437 - RNA, 22 nt, Mycobacterium bovis subsp bovis AF2122/97
acuuccaagccgaccugcugga

SEQ ID NO: 3038438 - RNA, 13 nt, Mycobacterium bovis subsp bovis AF2122/97
acuuccagcccgg

SEQ ID NO: 3038439 - RNA, 19 nt, Mycobacterium bovis subsp bovis AF2122/97
acuuccauucauggccgcg

SEQ ID NO: 3038440 - RNA, 15 nt, Mycobacterium bovis subsp bovis AF2122/97
acuucccacccggcc

SEQ ID NO: 3038441 - RNA, 12 nt, Mycobacterium bovis subsp bovis AF2122/97
acuucccccggg

SEQ ID NO: 3038442 - RNA, 20 nt, Mycobacterium bovis subsp bovis AF2122/97
acuucccgcgcgagccgcuc

SEQ ID NO: 3038443 - RNA, 17 nt, Mycobacterium bovis subsp bovis AF2122/97
acuuccgcgucgccggc

SEQ ID NO: 3038444 - RNA, 22 nt, Mycobacterium bovis subsp bovis AF2122/97
acuuccggauucggacucgccg

SEQ ID NO: 3038445 - RNA, 19 nt, Mycobacterium bovis subsp bovis AF2122/97
acuuccgggcagcugggca

SEQ ID NO: 3038446 - RNA, 14 nt, Mycobacterium bovis subsp bovis AF2122/97
acuucgcccgggcc

SEQ ID NO: 3038447 - RNA, 21 nt, Mycobacterium bovis subsp bovis AF2122/97
acuucgcuggaaaccucuucg

SEQ ID NO: 3038448 - RNA, 23 nt, Mycobacterium bovis subsp bovis AF2122/97
acuucgcuuucccgucggcggcg

SEQ ID NO: 3038449 - RNA, 12 nt, Mycobacterium bovis subsp bovis AF2122/97
acuucggccaca

SEQ ID NO: 3038450 - RNA, 12 nt, Mycobacterium bovis subsp bovis AF2122/97
acuucggcgaag

SEQ ID NO: 3038451 - RNA, 16 nt, Mycobacterium bovis subsp bovis AF2122/97
acuucggcgccgcgcc

SEQ ID NO: 3038452 - RNA, 23 nt, Mycobacterium bovis subsp bovis AF2122/97
acuucggcgccgucucgaucgcg

SEQ ID NO: 3038453 - RNA, 17 nt, Mycobacterium bovis subsp bovis AF2122/97
acuucggggucaccggc

SEQ ID NO: 3038454 - RNA, 17 nt, Mycobacterium bovis subsp bovis AF2122/97
acuucggugagcagggc

SEQ ID NO: 3038455 - RNA, 19 nt, Mycobacterium bovis subsp bovis AF2122/97
acuucggugagcagggcgg

SEQ ID NO: 3038456 - RNA, 23 nt, Mycobacterium bovis subsp bovis AF2122/97
acuucgguggcgggcuugccguc

SEQ ID NO: 3038457 - RNA, 13 nt, Mycobacterium bovis subsp bovis AF2122/97
acuucgugccucg

SEQ ID NO: 3038458 - RNA, 15 nt, Mycobacterium bovis subsp bovis AF2122/97
acuucguuccgugcc

SEQ ID NO: 3038459 - RNA, 19 nt, Mycobacterium bovis subsp bovis AF2122/97
acuucucgucgaacgacgc

SEQ ID NO: 3038460 - RNA, 15 nt, Mycobacterium bovis subsp bovis AF2122/97
acuucugcugcagcc

SEQ ID NO: 3038461 - RNA, 15 nt, Mycobacterium bovis subsp bovis AF2122/97
acuucuucacuggcg

SEQ ID NO: 3038462 - RNA, 18 nt, Mycobacterium bovis subsp bovis AF2122/97
acuucuucagcagcggcg

SEQ ID NO: 3038463 - RNA, 13 nt, Mycobacterium bovis subsp bovis AF2122/97
acuucuucgacgc

SEQ ID NO: 3038464 - RNA, 17 nt, Mycobacterium bovis subsp bovis AF2122/97
acuucuucgacgcgcau

SEQ ID NO: 3038465 - RNA, 22 nt, Mycobacterium bovis subsp bovis AF2122/97
acuucuucgcgcaaccagccca

SEQ ID NO: 3038466 - RNA, 18 nt, Mycobacterium bovis subsp bovis AF2122/97
acuugaccguccaccgac

SEQ ID NO: 3038467 - RNA, 16 nt, Mycobacterium bovis subsp bovis AF2122/97
acuugauaucggcggg

SEQ ID NO: 3038468 - RNA, 23 nt, Mycobacterium bovis subsp bovis AF2122/97
acuugccggugcgcaccagcaca

SEQ ID NO: 3038469 - RNA, 21 nt, Mycobacterium bovis subsp bovis AF2122/97
acuugcgagguaagcgagucg

SEQ ID NO: 3038470 - RNA, 24 nt, Mycobacterium bovis subsp bovis AF2122/97
acuugcucgacgaucugcagcacu

SEQ ID NO: 3038471 - RNA, 12 nt, Mycobacterium bovis subsp bovis AF2122/97
acuugcugcucc

SEQ ID NO: 3038472 - RNA, 14 nt, Mycobacterium bovis subsp bovis AF2122/97
acuuggacccggcc

SEQ ID NO: 3038473 - RNA, 14 nt, Mycobacterium bovis subsp bovis AF2122/97
acuuggcaucgcga

SEQ ID NO: 3038474 - RNA, 14 nt, Mycobacterium bovis subsp bovis AF2122/97
acuuggcggccagc

SEQ ID NO: 3038475 - RNA, 18 nt, Mycobacterium bovis subsp bovis AF2122/97
agacaccggcuauauccc

SEQ ID NO: 3038476 - RNA, 20 nt, Mycobacterium bovis subsp bovis AF2122/97
agacaccggcuauaucccgc

SEQ ID NO: 3038477 - RNA, 19 nt, Mycobacterium bovis subsp bovis AF2122/97
agacacgagucgccagacc

SEQ ID NO: 3038478 - RNA, 18 nt, Mycobacterium bovis subsp bovis AF2122/97
agacacggcagcugcaau

SEQ ID NO: 3038479 - RNA, 18 nt, Mycobacterium bovis subsp bovis AF2122/97
agacacuaaagcccucga

SEQ ID NO: 3038480 - RNA, 20 nt, Mycobacterium bovis subsp bovis AF2122/97
agacagacaggauugccgag

SEQ ID NO: 3038481 - RNA, 14 nt, Mycobacterium bovis subsp bovis AF2122/97
agacagcaccgccg

SEQ ID NO: 3038482 - RNA, 18 nt, Mycobacterium bovis subsp bovis AF2122/97
agacagcaccgccggugc

SEQ ID NO: 3038483 - RNA, 21 nt, Mycobacterium bovis subsp bovis AF2122/97
agacagccguuguacauagcc

SEQ ID NO: 3038484 - RNA, 19 nt, Mycobacterium bovis subsp bovis AF2122/97
agacagcgccaugcccucg

SEQ ID NO: 3038485 - RNA, 14 nt, Mycobacterium bovis subsp bovis AF2122/97
agacaggcggcggc

SEQ ID NO: 3038486 - RNA, 15 nt, Mycobacterium bovis subsp bovis AF2122/97
agacaggcggcggcc

SEQ ID NO: 3038487 - RNA, 19 nt, Mycobacterium bovis subsp bovis AF2122/97
agacaggcggcggccuggc

SEQ ID NO: 3038488 - RNA, 12 nt, Mycobacterium bovis subsp bovis AF2122/97
agacaucagugc

SEQ ID NO: 3038489 - RNA, 20 nt, Mycobacterium bovis subsp bovis AF2122/97
agacaucagugcgccggcga

SEQ ID NO: 3038490 - RNA, 20 nt, Mycobacterium bovis subsp bovis AF2122/97
agacaugccggcgagggcgc

SEQ ID NO: 3038491 - RNA, 19 nt, Mycobacterium bovis subsp bovis AF2122/97
agacaugucgcugccgccg

SEQ ID NO: 3038492 - RNA, 19 nt, Mycobacterium bovis subsp bovis AF2122/97
agaccaacauacagcaauc

SEQ ID NO: 3038493 - RNA, 21 nt, Mycobacterium bovis subsp bovis AF2122/97
agaccaagagcgcgcagcagu

SEQ ID NO: 3038494 - RNA, 17 nt, Mycobacterium bovis subsp bovis AF2122/97
agaccaaguccggucgc

SEQ ID NO: 3038495 - RNA, 18 nt, Mycobacterium bovis subsp bovis AF2122/97
agaccaaugaccgccagc

SEQ ID NO: 3038496 - RNA, 15 nt, Mycobacterium bovis subsp bovis AF2122/97
agaccaccgcccaca

SEQ ID NO: 3038497 - RNA, 14 nt, Mycobacterium bovis subsp bovis AF2122/97
agaccaccggcagc

SEQ ID NO: 3038498 - RNA, 17 nt, Mycobacterium bovis subsp bovis AF2122/97
agaccagcaggcccugg

SEQ ID NO: 3038499 - RNA, 16 nt, Mycobacterium bovis subsp bovis AF2122/97
agaccaggcccagguc

SEQ ID NO: 3038500 - RNA, 16 nt, Mycobacterium bovis subsp bovis AF2122/97
agaccaggccggugac

SEQ ID NO: 3038501 - RNA, 13 nt, Mycobacterium bovis subsp bovis AF2122/97
agaccagggcagc

SEQ ID NO: 3038502 - RNA, 18 nt, Mycobacterium bovis subsp bovis AF2122/97
agaccagggcagcggcca

SEQ ID NO: 3038503 - RNA, 20 nt, Mycobacterium bovis subsp bovis AF2122/97
agaccagggcagcggccagg

SEQ ID NO: 3038504 - RNA, 18 nt, Mycobacterium bovis subsp bovis AF2122/97
agaccagucucguggcgc

SEQ ID NO: 3038505 - RNA, 23 nt, Mycobacterium bovis subsp bovis AF2122/97
agaccaugaagaacuggcugcug

SEQ ID NO: 3038506 - RNA, 13 nt, Mycobacterium bovis subsp bovis AF2122/97
agacccaccaccg

SEQ ID NO: 3038507 - RNA, 18 nt, Mycobacterium bovis subsp bovis AF2122/97
agacccaccaccgcaacc

SEQ ID NO: 3038508 - RNA, 22 nt, Mycobacterium bovis subsp bovis AF2122/97
agacccaccaccgcaaccaaag

SEQ ID NO: 3038509 - RNA, 12 nt, Mycobacterium bovis subsp bovis AF2122/97
agacccacgaug

SEQ ID NO: 3038510 - RNA, 23 nt, Mycobacterium bovis subsp bovis AF2122/97
agacccacgauggcaaacgcacc

SEQ ID NO: 3038511 - RNA, 17 nt, Mycobacterium bovis subsp bovis AF2122/97
agacccagcgcggcaac

SEQ ID NO: 3038512 - RNA, 19 nt, Mycobacterium bovis subsp bovis AF2122/97
agacccgaauccaccagcu

SEQ ID NO: 3038513 - RNA, 21 nt, Mycobacterium bovis subsp bovis AF2122/97
agacccgcauccacgucgccc

SEQ ID NO: 3038514 - RNA, 12 nt, Mycobacterium bovis subsp bovis AF2122/97
agacccggcacc

SEQ ID NO: 3038515 - RNA, 14 nt, Mycobacterium bovis subsp bovis AF2122/97
agacccguccggag

SEQ ID NO: 3038516 - RNA, 17 nt, Mycobacterium bovis subsp bovis AF2122/97
agaccgaacagcggcag

SEQ ID NO: 3038517 - RNA, 18 nt, Mycobacterium bovis subsp bovis AF2122/97
agaccgaacagcggcagc

SEQ ID NO: 3038518 - RNA, 22 nt, Mycobacterium bovis subsp bovis AF2122/97
agaccgaaucgggucggccgcu

SEQ ID NO: 3038519 - RNA, 13 nt, Mycobacterium bovis subsp bovis AF2122/97
agaccgacagcgg

SEQ ID NO: 3038520 - RNA, 14 nt, Mycobacterium bovis subsp bovis AF2122/97
agaccgacagcggc

SEQ ID NO: 3038521 - RNA, 16 nt, Mycobacterium bovis subsp bovis AF2122/97
agaccgacagcggcac

SEQ ID NO: 3038522 - RNA, 17 nt, Mycobacterium bovis subsp bovis AF2122/97
agaccgacagcggcacc

SEQ ID NO: 3038523 - RNA, 16 nt, Mycobacterium bovis subsp bovis AF2122/97
agaccgaucggcaggc

SEQ ID NO: 3038524 - RNA, 13 nt, Mycobacterium bovis subsp bovis AF2122/97
agaccgccgacgc

SEQ ID NO: 3038525 - RNA, 12 nt, Mycobacterium bovis subsp bovis AF2122/97
agaccgccgcug

SEQ ID NO: 3038526 - RNA, 21 nt, Mycobacterium bovis subsp bovis AF2122/97
agaccgccgcugccgccgagc

SEQ ID NO: 3038527 - RNA, 14 nt, Mycobacterium bovis subsp bovis AF2122/97
agaccgccuccacc

SEQ ID NO: 3038528 - RNA, 21 nt, Mycobacterium bovis subsp bovis AF2122/97
agaccgccuccaccgccgcgc

SEQ ID NO: 3038529 - RNA, 14 nt, Mycobacterium bovis subsp bovis AF2122/97
agaccgcgagcagc

SEQ ID NO: 3038530 - RNA, 16 nt, Mycobacterium bovis subsp bovis AF2122/97
agaccgcgucggcggc

SEQ ID NO: 3038531 - RNA, 20 nt, Mycobacterium bovis subsp bovis AF2122/97
agaccgcgucggcggccagu

SEQ ID NO: 3038532 - RNA, 18 nt, Mycobacterium bovis subsp bovis AF2122/97
agaccgcgugcucgagca

SEQ ID NO: 3038533 - RNA, 21 nt, Mycobacterium bovis subsp bovis AF2122/97
agaccggaaaccacagcgcca

SEQ ID NO: 3038534 - RNA, 12 nt, Mycobacterium bovis subsp bovis AF2122/97
agaccgggcggu

SEQ ID NO: 3038535 - RNA, 19 nt, Mycobacterium bovis subsp bovis AF2122/97
agaccgggcgguugguggu

SEQ ID NO: 3038536 - RNA, 21 nt, Mycobacterium bovis subsp bovis AF2122/97
agaccgggugggucguucacc

SEQ ID NO: 3038537 - RNA, 19 nt, Mycobacterium bovis subsp bovis AF2122/97
agaccggugagcaccggau

SEQ ID NO: 3038538 - RNA, 14 nt, Mycobacterium bovis subsp bovis AF2122/97
agaccguccagcaa

SEQ ID NO: 3038539 - RNA, 19 nt, Mycobacterium bovis subsp bovis AF2122/97
agaccguccagcaacagcg

SEQ ID NO: 3038540 - RNA, 18 nt, Mycobacterium bovis subsp bovis AF2122/97
agaccgucgauccgucgg

SEQ ID NO: 3038541 - RNA, 20 nt, Mycobacterium bovis subsp bovis AF2122/97
agaccgucgauccgucggcg

SEQ ID NO: 3038542 - RNA, 22 nt, Mycobacterium bovis subsp bovis AF2122/97
agaccguggauaacgacugaca

SEQ ID NO: 3038543 - RNA, 18 nt, Mycobacterium bovis subsp bovis AF2122/97
agaccguuacaccaucaa

SEQ ID NO: 3038544 - RNA, 23 nt, Mycobacterium bovis subsp bovis AF2122/97
agaccguucguucccgcucgggc

SEQ ID NO: 3038545 - RNA, 17 nt, Mycobacterium bovis subsp bovis AF2122/97
agaccuagcaccgcgcc

SEQ ID NO: 3038546 - RNA, 15 nt, Mycobacterium bovis subsp bovis AF2122/97
agaccucaacccccu

SEQ ID NO: 3038547 - RNA, 21 nt, Mycobacterium bovis subsp bovis AF2122/97
agaccucggcgugucugcccg

SEQ ID NO: 3038548 - RNA, 13 nt, Mycobacterium bovis subsp bovis AF2122/97
agaccucgucgcg

SEQ ID NO: 3038549 - RNA, 19 nt, Mycobacterium bovis subsp bovis AF2122/97
agaccucucugcgccaggc

SEQ ID NO: 3038550 - RNA, 17 nt, Mycobacterium bovis subsp bovis AF2122/97
agaccuggccgucgcug

SEQ ID NO: 3038551 - RNA, 22 nt, Mycobacterium bovis subsp bovis AF2122/97
agaccuggccgucgcugguggc

SEQ ID NO: 3038552 - RNA, 23 nt, Mycobacterium bovis subsp bovis AF2122/97
agaccugucgguaccgcccaguu

SEQ ID NO: 3038553 - RNA, 11 nt, Mycobacterium bovis subsp bovis AF2122/97
agaccuucuug

SEQ ID NO: 3038554 - RNA, 20 nt, Mycobacterium bovis subsp bovis AF2122/97
agacgaaccgccgacggcgc

SEQ ID NO: 3038555 - RNA, 18 nt, Mycobacterium bovis subsp bovis AF2122/97
agacgaaguagccgacca

SEQ ID NO: 3038556 - RNA, 16 nt, Mycobacterium bovis subsp bovis AF2122/97
agacgaauaacgccgc

SEQ ID NO: 3038557 - RNA, 22 nt, Mycobacterium bovis subsp bovis AF2122/97
agacgacaucgucaucagcgcg

SEQ ID NO: 3038558 - RNA, 15 nt, Mycobacterium bovis subsp bovis AF2122/97
agacgacgaucagcc

SEQ ID NO: 3038559 - RNA, 11 nt, Mycobacterium bovis subsp bovis AF2122/97
agacgagccac

SEQ ID NO: 3038560 - RNA, 16 nt, Mycobacterium bovis subsp bovis AF2122/97
agacgaucgccaggcc

SEQ ID NO: 3038561 - RNA, 21 nt, Mycobacterium bovis subsp bovis AF2122/97
agagccgccguugccgccggc

SEQ ID NO: 3038562 - RNA, 14 nt, Mycobacterium bovis subsp bovis AF2122/97
agagccgcgagcac

SEQ ID NO: 3038563 - RNA, 14 nt, Mycobacterium bovis subsp bovis AF2122/97
agagccgcugcggc

SEQ ID NO: 3038564 - RNA, 20 nt, Mycobacterium bovis subsp bovis AF2122/97
agagccgggcucgucgagug

SEQ ID NO: 3038565 - RNA, 14 nt, Mycobacterium bovis subsp bovis AF2122/97
agagcgcaccgcga

SEQ ID NO: 3038566 - RNA, 15 nt, Mycobacterium bovis subsp bovis AF2122/97
agagcggcaccagau

SEQ ID NO: 3038567 - RNA, 19 nt, Mycobacterium bovis subsp bovis AF2122/97
agagcgucaaccacggccg

SEQ ID NO: 3038568 - RNA, 16 nt, Mycobacterium bovis subsp bovis AF2122/97
agagcuccgucgcggc

SEQ ID NO: 3038569 - RNA, 23 nt, Mycobacterium bovis subsp bovis AF2122/97
agagcucgaaguuggcuuucggu

SEQ ID NO: 3038570 - RNA, 21 nt, Mycobacterium bovis subsp bovis AF2122/97
agagcucugguuuuacacacc

SEQ ID NO: 3038571 - RNA, 20 nt, Mycobacterium bovis subsp bovis AF2122/97
agagcugguccuccaaggcg

SEQ ID NO: 3038572 - RNA, 12 nt, Mycobacterium bovis subsp bovis AF2122/97
agaggacugcgg

SEQ ID NO: 3038573 - RNA, 18 nt, Mycobacterium bovis subsp bovis AF2122/97
agaggacugcggucugga

SEQ ID NO: 3038574 - RNA, 18 nt, Mycobacterium bovis subsp bovis AF2122/97
agaggauggucagcagcu

SEQ ID NO: 3038575 - RNA, 20 nt, Mycobacterium bovis subsp bovis AF2122/97
agaggcgauccaaugcgagg

SEQ ID NO: 3038576 - RNA, 14 nt, Mycobacterium bovis subsp bovis AF2122/97
agaggcgcaccucc

SEQ ID NO: 3038577 - RNA, 18 nt, Mycobacterium bovis subsp bovis AF2122/97
agaggcgcaccuccugcg

SEQ ID NO: 3038578 - RNA, 13 nt, Mycobacterium bovis subsp bovis AF2122/97
agaggcggcuggc

SEQ ID NO: 3038579 - RNA, 17 nt, Mycobacterium bovis subsp bovis AF2122/97
agagggccgcgguuugg

SEQ ID NO: 3038580 - RNA, 20 nt, Mycobacterium bovis subsp bovis AF2122/97
agagggcggggcagaagucg

SEQ ID NO: 3038581 - RNA, 17 nt, Mycobacterium bovis subsp bovis AF2122/97
agaggugcugcaccugg

SEQ ID NO: 3038582 - RNA, 14 nt, Mycobacterium bovis subsp bovis AF2122/97
agagguuggcggcc

SEQ ID NO: 3038583 - RNA, 23 nt, Mycobacterium bovis subsp bovis AF2122/97
agaguaucgaauccgucccaggu

SEQ ID NO: 3038584 - RNA, 15 nt, Mycobacterium bovis subsp bovis AF2122/97
agagucgcacugcgc

SEQ ID NO: 3038585 - RNA, 19 nt, Mycobacterium bovis subsp bovis AF2122/97
agagucgcacugcgccggc

SEQ ID NO: 3038586 - RNA, 11 nt, Mycobacterium bovis subsp bovis AF2122/97
agagugaaucc

SEQ ID NO: 3038587 - RNA, 17 nt, Mycobacterium bovis subsp bovis AF2122/97
agagugcucagcgcgcg

SEQ ID NO: 3038588 - RNA, 22 nt, Mycobacterium bovis subsp bovis AF2122/97
agaguguccccggcugccagcg

SEQ ID NO: 3038589 - RNA, 13 nt, Mycobacterium bovis subsp bovis AF2122/97
agaguucccgaaa

SEQ ID NO: 3038590 - RNA, 15 nt, Mycobacterium bovis subsp bovis AF2122/97
agaguucgcgcgccg

SEQ ID NO: 3038591 - RNA, 21 nt, Mycobacterium bovis subsp bovis AF2122/97
agaguucgcgcgccgcgacga

SEQ ID NO: 3038592 - RNA, 19 nt, Mycobacterium bovis subsp bovis AF2122/97
agaguuggggcacaaccgg

SEQ ID NO: 3038593 - RNA, 14 nt, Mycobacterium bovis subsp bovis AF2122/97
agauaccaccgccg

SEQ ID NO: 3038594 - RNA, 15 nt, Mycobacterium bovis subsp bovis AF2122/97
agauaccaccgccgc

SEQ ID NO: 3038595 - RNA, 17 nt, Mycobacterium bovis subsp bovis AF2122/97
agauacccgcggcagca

SEQ ID NO: 3038596 - RNA, 13 nt, Mycobacterium bovis subsp bovis AF2122/97
agauacgagcugu

SEQ ID NO: 3038597 - RNA, 13 nt, Mycobacterium bovis subsp bovis AF2122/97
agauacggccacc

SEQ ID NO: 3038598 - RNA, 20 nt, Mycobacterium bovis subsp bovis AF2122/97
agauagacguuguugaaggc

SEQ ID NO: 3038599 - RNA, 12 nt, Mycobacterium bovis subsp bovis AF2122/97
agauaugcagga

SEQ ID NO: 3038600 - RNA, 19 nt, Mycobacterium bovis subsp bovis AF2122/97
agaucaacgcgucgcccgc

SEQ ID NO: 3038601 - RNA, 15 nt, Mycobacterium bovis subsp bovis AF2122/97
agaucacccgcagcc

SEQ ID NO: 3038602 - RNA, 14 nt, Mycobacterium bovis subsp bovis AF2122/97
agaucaccgccacc

SEQ ID NO: 3038603 - RNA, 15 nt, Mycobacterium bovis subsp bovis AF2122/97
agaucaccgccacca

SEQ ID NO: 3038604 - RNA, 24 nt, Mycobacterium bovis subsp bovis AF2122/97
agaucaccgccaccaccagggcaa

SEQ ID NO: 3038605 - RNA, 22 nt, Mycobacterium bovis subsp bovis AF2122/97
agaucaccgccagcugggcagc

SEQ ID NO: 3038606 - RNA, 19 nt, Mycobacterium bovis subsp bovis AF2122/97
agaucaccucggugccggc

SEQ ID NO: 3038607 - RNA, 23 nt, Mycobacterium bovis subsp bovis AF2122/97
agaucaccucggugccggccgca

SEQ ID NO: 3038608 - RNA, 22 nt, Mycobacterium bovis subsp bovis AF2122/97
agaucaccuugccuagccgcag

SEQ ID NO: 3038609 - RNA, 15 nt, Mycobacterium bovis subsp bovis AF2122/97
agaucacgccgggcg

SEQ ID NO: 3038610 - RNA, 16 nt, Mycobacterium bovis subsp bovis AF2122/97
agaucacgccgggcga

SEQ ID NO: 3038611 - RNA, 17 nt, Mycobacterium bovis subsp bovis AF2122/97
agaucagcacccaagaa

SEQ ID NO: 3038612 - RNA, 20 nt, Mycobacterium bovis subsp bovis AF2122/97
agaucagcaccgacagcccg

SEQ ID NO: 3038613 - RNA, 21 nt, Mycobacterium bovis subsp bovis AF2122/97
agaucagcaccgacagcccga

SEQ ID NO: 3038614 - RNA, 13 nt, Mycobacterium bovis subsp bovis AF2122/97
agaucagcaccgu

SEQ ID NO: 3038615 - RNA, 23 nt, Mycobacterium bovis subsp bovis AF2122/97
agaucagcaccgugacagcggca

SEQ ID NO: 3038616 - RNA, 19 nt, Mycobacterium bovis subsp bovis AF2122/97
agaucagcagcggcgaccg

SEQ ID NO: 3038617 - RNA, 22 nt, Mycobacterium bovis subsp bovis AF2122/97
agaucagcagcggcgaccgcgg

SEQ ID NO: 3038618 - RNA, 23 nt, Mycobacterium bovis subsp bovis AF2122/97
agaucagcaugccuucggccaac

SEQ ID NO: 3038619 - RNA, 20 nt, Mycobacterium bovis subsp bovis AF2122/97
agaucagcaugguccacagc

SEQ ID NO: 3038620 - RNA, 22 nt, Mycobacterium bovis subsp bovis AF2122/97
agaucagcaugguccacagccg

SEQ ID NO: 3038621 - RNA, 14 nt, Mycobacterium bovis subsp bovis AF2122/97
agaucagccggcag

SEQ ID NO: 3038622 - RNA, 19 nt, Mycobacterium bovis subsp bovis AF2122/97
agaucagcgccugguccuc

SEQ ID NO: 3038623 - RNA, 16 nt, Mycobacterium bovis subsp bovis AF2122/97
agauccacgccgacca

SEQ ID NO: 3038624 - RNA, 12 nt, Mycobacterium bovis subsp bovis AF2122/97
agauccaggugu

SEQ ID NO: 3038625 - RNA, 23 nt, Mycobacterium bovis subsp bovis AF2122/97
agauccauuggaugccauaggac

SEQ ID NO: 3038626 - RNA, 17 nt, Mycobacterium bovis subsp bovis AF2122/97
agaucccaguccgaugg

SEQ ID NO: 3038627 - RNA, 14 nt, Mycobacterium bovis subsp bovis AF2122/97
agauccccaaaucg

SEQ ID NO: 3038628 - RNA, 15 nt, Mycobacterium bovis subsp bovis AF2122/97
agaucccggucccaa

SEQ ID NO: 3038629 - RNA, 20 nt, Mycobacterium bovis subsp bovis AF2122/97
agauccgccacgcucaaccc

SEQ ID NO: 3038630 - RNA, 22 nt, Mycobacterium bovis subsp bovis AF2122/97
agauccggccaacggcacccug

SEQ ID NO: 3038631 - RNA, 22 nt, Mycobacterium bovis subsp bovis AF2122/97
agauccgggccuugcgcgcgca

SEQ ID NO: 3038632 - RNA, 18 nt, Mycobacterium bovis subsp bovis AF2122/97
agauccguccgcuggugg

SEQ ID NO: 3038633 - RNA, 15 nt, Mycobacterium bovis subsp bovis AF2122/97
agauccucgucgagg

SEQ ID NO: 3038634 - RNA, 19 nt, Mycobacterium bovis subsp bovis AF2122/97
agauccuuaucgcucucgg

SEQ ID NO: 3038635 - RNA, 20 nt, Mycobacterium bovis subsp bovis AF2122/97
agaucgaacgcagccagcgc

SEQ ID NO: 3038636 - RNA, 15 nt, Mycobacterium bovis subsp bovis AF2122/97
agaucgaagcgcagc

SEQ ID NO: 3038637 - RNA, 24 nt, Mycobacterium bovis subsp bovis AF2122/97
agaucgacuucauagcgccggagu

SEQ ID NO: 3038638 - RNA, 16 nt, Mycobacterium bovis subsp bovis AF2122/97
agaucgagaucaccuu

SEQ ID NO: 3038639 - RNA, 22 nt, Mycobacterium bovis subsp bovis AF2122/97
agaucgcacaccaacaccgcgg

SEQ ID NO: 3038640 - RNA, 12 nt, Mycobacterium bovis subsp bovis AF2122/97
agaucgccccag

SEQ ID NO: 3038641 - RNA, 17 nt, Mycobacterium bovis subsp bovis AF2122/97
agaucgcccgaguugaa

SEQ ID NO: 3038642 - RNA, 15 nt, Mycobacterium bovis subsp bovis AF2122/97
agaucgccugggggu

SEQ ID NO: 3038643 - RNA, 16 nt, Mycobacterium bovis subsp bovis AF2122/97
agaucgccugggggua

SEQ ID NO: 3038644 - RNA, 13 nt, Mycobacterium bovis subsp bovis AF2122/97
agaucgcgcccug

SEQ ID NO: 3038645 - RNA, 17 nt, Mycobacterium bovis subsp bovis AF2122/97
agaucgcgcccugcgga

SEQ ID NO: 3038646 - RNA, 22 nt, Mycobacterium bovis subsp bovis AF2122/97
agaucgcggcgacccggucgcg

SEQ ID NO: 3038647 - RNA, 14 nt, Mycobacterium bovis subsp bovis AF2122/97
agcaacgcugcggc

SEQ ID NO: 3038648 - RNA, 15 nt, Mycobacterium bovis subsp bovis AF2122/97
agcaacgcugcggca

SEQ ID NO: 3038649 - RNA, 17 nt, Mycobacterium bovis subsp bovis AF2122/97
agcaacggacgaagcac

SEQ ID NO: 3038650 - RNA, 15 nt, Mycobacterium bovis subsp bovis AF2122/97
agcaacggcggcagg

SEQ ID NO: 3038651 - RNA, 16 nt, Mycobacterium bovis subsp bovis AF2122/97
agcaacggcggcaggc

SEQ ID NO: 3038652 - RNA, 22 nt, Mycobacterium bovis subsp bovis AF2122/97
agcaacggcggcaggccggcca

SEQ ID NO: 3038653 - RNA, 18 nt, Mycobacterium bovis subsp bovis AF2122/97
agcaacggcggcgucgcg

SEQ ID NO: 3038654 - RNA, 19 nt, Mycobacterium bovis subsp bovis AF2122/97
agcaacggcggcgucgcgg

SEQ ID NO: 3038655 - RNA, 19 nt, Mycobacterium bovis subsp bovis AF2122/97
agcaacgucacgucgacgg

SEQ ID NO: 3038656 - RNA, 20 nt, Mycobacterium bovis subsp bovis AF2122/97
agcaacgucacgucgacggc

SEQ ID NO: 3038657 - RNA, 22 nt, Mycobacterium bovis subsp bovis AF2122/97
agcaacgugugcaccaucauca

SEQ ID NO: 3038658 - RNA, 21 nt, Mycobacterium bovis subsp bovis AF2122/97
agcaacucauuacgguagacg

SEQ ID NO: 3038659 - RNA, 15 nt, Mycobacterium bovis subsp bovis AF2122/97
agcaacucggccacg

SEQ ID NO: 3038660 - RNA, 16 nt, Mycobacterium bovis subsp bovis AF2122/97
agcaacucguccagca

SEQ ID NO: 3038661 - RNA, 20 nt, Mycobacterium bovis subsp bovis AF2122/97
agcaacucguccagcagugc

SEQ ID NO: 3038662 - RNA, 20 nt, Mycobacterium bovis subsp bovis AF2122/97
agcaagaaguacgugcacag

SEQ ID NO: 3038663 - RNA, 14 nt, Mycobacterium bovis subsp bovis AF2122/97
agcaagagccgcag

SEQ ID NO: 3038664 - RNA, 16 nt, Mycobacterium bovis subsp bovis AF2122/97
agcaagagccgcagcc

SEQ ID NO: 3038665 - RNA, 19 nt, Mycobacterium bovis subsp bovis AF2122/97
agcaagaucggcagcgugg

SEQ ID NO: 3038666 - RNA, 16 nt, Mycobacterium bovis subsp bovis AF2122/97
agcaagccaacccaau

SEQ ID NO: 3038667 - RNA, 23 nt, Mycobacterium bovis subsp bovis AF2122/97
agcaagccagcaucggcagcagc

SEQ ID NO: 3038668 - RNA, 15 nt, Mycobacterium bovis subsp bovis AF2122/97
agcaaggcccgaaac

SEQ ID NO: 3038669 - RNA, 13 nt, Mycobacterium bovis subsp bovis AF2122/97
agcaagucgccga

SEQ ID NO: 3038670 - RNA, 18 nt, Mycobacterium bovis subsp bovis AF2122/97
agcaagugggugccggca

SEQ ID NO: 3038671 - RNA, 15 nt, Mycobacterium bovis subsp bovis AF2122/97
agcaauacggcggcg

SEQ ID NO: 3038672 - RNA, 22 nt, Mycobacterium bovis subsp bovis AF2122/97
agcaauacggcggcgccgccca

SEQ ID NO: 3038673 - RNA, 22 nt, Mycobacterium bovis subsp bovis AF2122/97
agcaauccaaggcucagcagcg

SEQ ID NO: 3038674 - RNA, 21 nt, Mycobacterium bovis subsp bovis AF2122/97
agcaauccgcacagcgacgag

SEQ ID NO: 3038675 - RNA, 17 nt, Mycobacterium bovis subsp bovis AF2122/97
agcaaugacccgcgggu

SEQ ID NO: 3038676 - RNA, 13 nt, Mycobacterium bovis subsp bovis AF2122/97
agcaaugcccgca

SEQ ID NO: 3038677 - RNA, 15 nt, Mycobacterium bovis subsp bovis AF2122/97
agcaaugcccgcacc

SEQ ID NO: 3038678 - RNA, 17 nt, Mycobacterium bovis subsp bovis AF2122/97
agcaaugcccgcaccgc

SEQ ID NO: 3038679 - RNA, 12 nt, Mycobacterium bovis subsp bovis AF2122/97
agcacacccaga

SEQ ID NO: 3038680 - RNA, 19 nt, Mycobacterium bovis subsp bovis AF2122/97
agcacacccagaugcaggc

SEQ ID NO: 3038681 - RNA, 16 nt, Mycobacterium bovis subsp bovis AF2122/97
agcacaccgacagcac

SEQ ID NO: 3038682 - RNA, 14 nt, Mycobacterium bovis subsp bovis AF2122/97
agcacaccgccagc

SEQ ID NO: 3038683 - RNA, 15 nt, Mycobacterium bovis subsp bovis AF2122/97
agcacaccgccagcg

SEQ ID NO: 3038684 - RNA, 18 nt, Mycobacterium bovis subsp bovis AF2122/97
agcacaccguccgucggc

SEQ ID NO: 3038685 - RNA, 19 nt, Mycobacterium bovis subsp bovis AF2122/97
agcacacgucgggaguaag

SEQ ID NO: 3038686 - RNA, 23 nt, Mycobacterium bovis subsp bovis AF2122/97
agcacacuggccacaaucgcggu

SEQ ID NO: 3038687 - RNA, 12 nt, Mycobacterium bovis subsp bovis AF2122/97
agcacagcccgg

SEQ ID NO: 3038688 - RNA, 17 nt, Mycobacterium bovis subsp bovis AF2122/97
agcacagcccggcgacg

SEQ ID NO: 3038689 - RNA, 14 nt, Mycobacterium bovis subsp bovis AF2122/97
agcacagcccggcu

SEQ ID NO: 3038690 - RNA, 13 nt, Mycobacterium bovis subsp bovis AF2122/97
agcacagcgcagc

SEQ ID NO: 3038691 - RNA, 19 nt, Mycobacterium bovis subsp bovis AF2122/97
agcacauaugugcccggcg

SEQ ID NO: 3038692 - RNA, 15 nt, Mycobacterium bovis subsp bovis AF2122/97
agcacauccugcagc

SEQ ID NO: 3038693 - RNA, 17 nt, Mycobacterium bovis subsp bovis AF2122/97
agcacauccugcagcuc

SEQ ID NO: 3038694 - RNA, 16 nt, Mycobacterium bovis subsp bovis AF2122/97
agcacaucgccggagu

SEQ ID NO: 3038695 - RNA, 15 nt, Mycobacterium bovis subsp bovis AF2122/97
agcacaugcugccgc

SEQ ID NO: 3038696 - RNA, 22 nt, Mycobacterium bovis subsp bovis AF2122/97
agcacaugguccaaccagcacc

SEQ ID NO: 3038697 - RNA, 22 nt, Mycobacterium bovis subsp bovis AF2122/97
agcacauuauucuucgcggcga

SEQ ID NO: 3038698 - RNA, 16 nt, Mycobacterium bovis subsp bovis AF2122/97
agcaccaaaugccccg

SEQ ID NO: 3038699 - RNA, 17 nt, Mycobacterium bovis subsp bovis AF2122/97
agcaccaaaugccccga

SEQ ID NO: 3038700 - RNA, 19 nt, Mycobacterium bovis subsp bovis AF2122/97
agcaccacaacgucggcac

SEQ ID NO: 3038701 - RNA, 20 nt, Mycobacterium bovis subsp bovis AF2122/97
agcaccacauccaucuccau

SEQ ID NO: 3038702 - RNA, 16 nt, Mycobacterium bovis subsp bovis AF2122/97
agcaccacaucgaagg

SEQ ID NO: 3038703 - RNA, 21 nt, Mycobacterium bovis subsp bovis AF2122/97
agcaccaccccagcggccacc

SEQ ID NO: 3038704 - RNA, 22 nt, Mycobacterium bovis subsp bovis AF2122/97
agcaccaccccagcggccaccg

SEQ ID NO: 3038705 - RNA, 19 nt, Mycobacterium bovis subsp bovis AF2122/97
agcaccacccgcaccucac

SEQ ID NO: 3038706 - RNA, 14 nt, Mycobacterium bovis subsp bovis AF2122/97
agcaccacggccag

SEQ ID NO: 3038707 - RNA, 16 nt, Mycobacterium bovis subsp bovis AF2122/97
agcaccacggccagcg

SEQ ID NO: 3038708 - RNA, 15 nt, Mycobacterium bovis subsp bovis AF2122/97
agcaccacgucgacg

SEQ ID NO: 3038709 - RNA, 19 nt, Mycobacterium bovis subsp bovis AF2122/97
agcaccagcacggcaacca

SEQ ID NO: 3038710 - RNA, 12 nt, Mycobacterium bovis subsp bovis AF2122/97
agcaccagcagc

SEQ ID NO: 3038711 - RNA, 16 nt, Mycobacterium bovis subsp bovis AF2122/97
agcaccagcagcacca

SEQ ID NO: 3038712 - RNA, 17 nt, Mycobacterium bovis subsp bovis AF2122/97
agcaccagcagcaccaa

SEQ ID NO: 3038713 - RNA, 20 nt, Mycobacterium bovis subsp bovis AF2122/97
agcaccagccagccugcugg

SEQ ID NO: 3038714 - RNA, 14 nt, Mycobacterium bovis subsp bovis AF2122/97
agcaccagcgucgc

SEQ ID NO: 3038715 - RNA, 15 nt, Mycobacterium bovis subsp bovis AF2122/97
agcaccagcgucgcg

SEQ ID NO: 3038716 - RNA, 21 nt, Mycobacterium bovis subsp bovis AF2122/97
agcaccagcgucgcggccacg

SEQ ID NO: 3038717 - RNA, 21 nt, Mycobacterium bovis subsp bovis AF2122/97
agcaccagggcgcggaucugc

SEQ ID NO: 3038718 - RNA, 13 nt, Mycobacterium bovis subsp bovis AF2122/97
agcaccagguugu

SEQ ID NO: 3038719 - RNA, 17 nt, Mycobacterium bovis subsp bovis AF2122/97
agcaccaguucccuaca

SEQ ID NO: 3038720 - RNA, 18 nt, Mycobacterium bovis subsp bovis AF2122/97
agcacccaaugccaccgc

SEQ ID NO: 3038721 - RNA, 13 nt, Mycobacterium bovis subsp bovis AF2122/97
agcacccacgccg

SEQ ID NO: 3038722 - RNA, 20 nt, Mycobacterium bovis subsp bovis AF2122/97
agcacccagacgauggccag

SEQ ID NO: 3038723 - RNA, 12 nt, Mycobacterium bovis subsp bovis AF2122/97
agcacccauacg

SEQ ID NO: 3038724 - RNA, 19 nt, Mycobacterium bovis subsp bovis AF2122/97
agcaccccaaaaccgccgg

SEQ ID NO: 3038725 - RNA, 22 nt, Mycobacterium bovis subsp bovis AF2122/97
agcaccccagggguugcggagc

SEQ ID NO: 3038726 - RNA, 17 nt, Mycobacterium bovis subsp bovis AF2122/97
agcaccccauggccacc

SEQ ID NO: 3038727 - RNA, 18 nt, Mycobacterium bovis subsp bovis AF2122/97
agcaccccauggccaccg

SEQ ID NO: 3038728 - RNA, 14 nt, Mycobacterium bovis subsp bovis AF2122/97
agcaccccgccggg

SEQ ID NO: 3038729 - RNA, 17 nt, Mycobacterium bovis subsp bovis AF2122/97
agcacccgauaguucug

SEQ ID NO: 3038730 - RNA, 18 nt, Mycobacterium bovis subsp bovis AF2122/97
agcacccgcgcgacgccg

SEQ ID NO: 3038731 - RNA, 22 nt, Mycobacterium bovis subsp bovis AF2122/97
agcacccgcucggccgccgggu

SEQ ID NO: 3038732 - RNA, 23 nt, Mycobacterium bovis subsp bovis AF2122/97
agcacccgcuggucgagcagugc

SEQ ID NO: 3038733 - RNA, 21 nt, Mycobacterium bovis subsp bovis AF2122/97
agcacccggcuguucucgccg

SEQ ID NO: 3038734 - RNA, 14 nt, Mycobacterium bovis subsp bovis AF2122/97
agcacgucgucgcg

SEQ ID NO: 3038735 - RNA, 15 nt, Mycobacterium bovis subsp bovis AF2122/97
agcacgucgucgcgg

SEQ ID NO: 3038736 - RNA, 19 nt, Mycobacterium bovis subsp bovis AF2122/97
agcacgucuugcugcacgc

SEQ ID NO: 3038737 - RNA, 20 nt, Mycobacterium bovis subsp bovis AF2122/97
agcacgugccccaugcgcag

SEQ ID NO: 3038738 - RNA, 15 nt, Mycobacterium bovis subsp bovis AF2122/97
agcacgugggccaac

SEQ ID NO: 3038739 - RNA, 20 nt, Mycobacterium bovis subsp bovis AF2122/97
agcacguucaccgcgcgcuc

SEQ ID NO: 3038740 - RNA, 15 nt, Mycobacterium bovis subsp bovis AF2122/97
agcacguugcacagc

SEQ ID NO: 3038741 - RNA, 16 nt, Mycobacterium bovis subsp bovis AF2122/97
agcacguugcacagcu

SEQ ID NO: 3038742 - RNA, 12 nt, Mycobacterium bovis subsp bovis AF2122/97
agcacuccaccg

SEQ ID NO: 3038743 - RNA, 20 nt, Mycobacterium bovis subsp bovis AF2122/97
agcacuccaccgcuggcccg

SEQ ID NO: 3038744 - RNA, 15 nt, Mycobacterium bovis subsp bovis AF2122/97
agcacuccggcgacg

SEQ ID NO: 3038745 - RNA, 13 nt, Mycobacterium bovis subsp bovis AF2122/97
agcacucggccac

SEQ ID NO: 3038746 - RNA, 21 nt, Mycobacterium bovis subsp bovis AF2122/97
agcacucuucgaugaagcugg

SEQ ID NO: 3038747 - RNA, 20 nt, Mycobacterium bovis subsp bovis AF2122/97
agcacuuccaagccgaccug

SEQ ID NO: 3038748 - RNA, 21 nt, Mycobacterium bovis subsp bovis AF2122/97
agcacuuggacccggccggcc

SEQ ID NO: 3038749 - RNA, 23 nt, Mycobacterium bovis subsp bovis AF2122/97
agcacuuggacccggccggcccg

SEQ ID NO: 3038750 - RNA, 16 nt, Mycobacterium bovis subsp bovis AF2122/97
agcagaaacggcgacu

SEQ ID NO: 3038751 - RNA, 15 nt, Mycobacterium bovis subsp bovis AF2122/97
agcagaaggccagcg

SEQ ID NO: 3038752 - RNA, 23 nt, Mycobacterium bovis subsp bovis AF2122/97
agcagaaguccucggcggacccg

SEQ ID NO: 3038753 - RNA, 20 nt, Mycobacterium bovis subsp bovis AF2122/97
agcagaauccugcgcugcac

SEQ ID NO: 3038754 - RNA, 15 nt, Mycobacterium bovis subsp bovis AF2122/97
agcagacacagaauc

SEQ ID NO: 3038755 - RNA, 18 nt, Mycobacterium bovis subsp bovis AF2122/97
agcagacacagaaucgca

SEQ ID NO: 3038756 - RNA, 19 nt, Mycobacterium bovis subsp bovis AF2122/97
agcagacacagaaucgccc

SEQ ID NO: 3038757 - RNA, 17 nt, Mycobacterium bovis subsp bovis AF2122/97
agcagaccaagcccuag

SEQ ID NO: 3038758 - RNA, 22 nt, Mycobacterium bovis subsp bovis AF2122/97
agcagaccaagcccuagcgcau

SEQ ID NO: 3038759 - RNA, 21 nt, Mycobacterium bovis subsp bovis AF2122/97
agcagacgacgaucagcccca

SEQ ID NO: 3038760 - RNA, 22 nt, Mycobacterium bovis subsp bovis AF2122/97
agcagacgacgaucagccccag

SEQ ID NO: 3038761 - RNA, 16 nt, Mycobacterium bovis subsp bovis AF2122/97
agcagacgcaaaagaa

SEQ ID NO: 3038762 - RNA, 20 nt, Mycobacterium bovis subsp bovis AF2122/97
agcagacgcaaaagccaccg

SEQ ID NO: 3038763 - RNA, 20 nt, Mycobacterium bovis subsp bovis AF2122/97
agcagacgcaaaagcccccu

SEQ ID NO: 3038764 - RNA, 20 nt, Mycobacterium bovis subsp bovis AF2122/97
agcagacgcaaaauccccuc

SEQ ID NO: 3038765 - RNA, 21 nt, Mycobacterium bovis subsp bovis AF2122/97
agcagacgcaaaauccccucg

SEQ ID NO: 3038766 - RNA, 17 nt, Mycobacterium bovis subsp bovis AF2122/97
agcagacgcaaaaucgc

SEQ ID NO: 3038767 - RNA, 19 nt, Mycobacterium bovis subsp bovis AF2122/97
agcagacgcaaaaucgcac

SEQ ID NO: 3038768 - RNA, 20 nt, Mycobacterium bovis subsp bovis AF2122/97
agcagacgcaaaaucgcacg

SEQ ID NO: 3038769 - RNA, 20 nt, Mycobacterium bovis subsp bovis AF2122/97
agcagacgcaaaaucgccca

SEQ ID NO: 3038770 - RNA, 13 nt, Mycobacterium bovis subsp bovis AF2122/97
agcagacgcagaa

SEQ ID NO: 3038771 - RNA, 20 nt, Mycobacterium bovis subsp bovis AF2122/97
agcagacgcagaagccccca

SEQ ID NO: 3038772 - RNA, 18 nt, Mycobacterium bovis subsp bovis AF2122/97
agcagacgcagaaucgca

SEQ ID NO: 3038773 - RNA, 20 nt, Mycobacterium bovis subsp bovis AF2122/97
agcagacgcagaaucgcacg

SEQ ID NO: 3038774 - RNA, 20 nt, Mycobacterium bovis subsp bovis AF2122/97
agcagacgcagaaucgcauu

SEQ ID NO: 3038775 - RNA, 18 nt, Mycobacterium bovis subsp bovis AF2122/97
agcagacgcagaaucgcc

SEQ ID NO: 3038776 - RNA, 19 nt, Mycobacterium bovis subsp bovis AF2122/97
agcagacgcagaaucgccc

SEQ ID NO: 3038777 - RNA, 20 nt, Mycobacterium bovis subsp bovis AF2122/97
agcagacgcagaaucgccua

SEQ ID NO: 3038778 - RNA, 16 nt, Mycobacterium bovis subsp bovis AF2122/97
agcagacgcagccacg

SEQ ID NO: 3038779 - RNA, 20 nt, Mycobacterium bovis subsp bovis AF2122/97
agcagacgcauaagcccccg

SEQ ID NO: 3038780 - RNA, 22 nt, Mycobacterium bovis subsp bovis AF2122/97
agcagacgcauaagcccccgca

SEQ ID NO: 3038781 - RNA, 21 nt, Mycobacterium bovis subsp bovis AF2122/97
agcagacgccguagccggccg

SEQ ID NO: 3038782 - RNA, 21 nt, Mycobacterium bovis subsp bovis AF2122/97
agcagacgcgaaagcacccca

SEQ ID NO: 3038783 - RNA, 17 nt, Mycobacterium bovis subsp bovis AF2122/97
agcagacgcgaaauccc

SEQ ID NO: 3038784 - RNA, 19 nt, Mycobacterium bovis subsp bovis AF2122/97
agcagacgcgaaauccccc

SEQ ID NO: 3038785 - RNA, 20 nt, Mycobacterium bovis subsp bovis AF2122/97
agcagacgcgaaaucccccg

SEQ ID NO: 3038786 - RNA, 19 nt, Mycobacterium bovis subsp bovis AF2122/97
agcagacgcggaaucgcac

SEQ ID NO: 3038787 - RNA, 20 nt, Mycobacterium bovis subsp bovis AF2122/97
agcagacgcggaaucgcacc

SEQ ID NO: 3038788 - RNA, 20 nt, Mycobacterium bovis subsp bovis AF2122/97
agcagacgcggaaucgcauc

SEQ ID NO: 3038789 - RNA, 20 nt, Mycobacterium bovis subsp bovis AF2122/97
agcagacgcuaaagcccccg

SEQ ID NO: 3038790 - RNA, 20 nt, Mycobacterium bovis subsp bovis AF2122/97
agcagacguaaaagccccca

SEQ ID NO: 3038791 - RNA, 18 nt, Mycobacterium bovis subsp bovis AF2122/97
agcagacgucaugcggau

SEQ ID NO: 3038792 - RNA, 14 nt, Mycobacterium bovis subsp bovis AF2122/97
agcagacugccgau

SEQ ID NO: 3038793 - RNA, 21 nt, Mycobacterium bovis subsp bovis AF2122/97
agcagagccccggcaagcgca

SEQ ID NO: 3038794 - RNA, 14 nt, Mycobacterium bovis subsp bovis AF2122/97
agcagagcggcacg

SEQ ID NO: 3038795 - RNA, 19 nt, Mycobacterium bovis subsp bovis AF2122/97
agcagagcggcacgcacgc

SEQ ID NO: 3038796 - RNA, 16 nt, Mycobacterium bovis subsp bovis AF2122/97
agcagauccuggccgg

SEQ ID NO: 3038797 - RNA, 15 nt, Mycobacterium bovis subsp bovis AF2122/97
agcagaugggcgucg

SEQ ID NO: 3038798 - RNA, 16 nt, Mycobacterium bovis subsp bovis AF2122/97
agcagcaacgacccga

SEQ ID NO: 3038799 - RNA, 21 nt, Mycobacterium bovis subsp bovis AF2122/97
agcagcaacgcggugccggga

SEQ ID NO: 3038800 - RNA, 17 nt, Mycobacterium bovis subsp bovis AF2122/97
agcagcaagaccgcgcc

SEQ ID NO: 3038801 - RNA, 15 nt, Mycobacterium bovis subsp bovis AF2122/97
agcagcaagccgccg

SEQ ID NO: 3038802 - RNA, 19 nt, Mycobacterium bovis subsp bovis AF2122/97
agcagcaauccaaggcuca

SEQ ID NO: 3038803 - RNA, 14 nt, Mycobacterium bovis subsp bovis AF2122/97
agcagcaccaacug

SEQ ID NO: 3038804 - RNA, 15 nt, Mycobacterium bovis subsp bovis AF2122/97
agcagcaccgcgacc

SEQ ID NO: 3038805 - RNA, 12 nt, Mycobacterium bovis subsp bovis AF2122/97
agcagcaccugc

SEQ ID NO: 3038806 - RNA, 15 nt, Mycobacterium bovis subsp bovis AF2122/97
agcagcaccugcacc

SEQ ID NO: 3038807 - RNA, 18 nt, Mycobacterium bovis subsp bovis AF2122/97
agcagcaccugcaccgca

SEQ ID NO: 3038808 - RNA, 19 nt, Mycobacterium bovis subsp bovis AF2122/97
agcagcacuccggcgacga

SEQ ID NO: 3038809 - RNA, 15 nt, Mycobacterium bovis subsp bovis AF2122/97
agcagcagcccgaca

SEQ ID NO: 3038810 - RNA, 20 nt, Mycobacterium bovis subsp bovis AF2122/97
agcagcagguacaucaccac

SEQ ID NO: 3038811 - RNA, 12 nt, Mycobacterium bovis subsp bovis AF2122/97
agcagcagugcc

SEQ ID NO: 3038812 - RNA, 23 nt, Mycobacterium bovis subsp bovis AF2122/97
agcagcaucuggggguagccgcc

SEQ ID NO: 3038813 - RNA, 14 nt, Mycobacterium bovis subsp bovis AF2122/97
agcagcaugucgua

SEQ ID NO: 3038814 - RNA, 14 nt, Mycobacterium bovis subsp bovis AF2122/97
agcagccacccgac

SEQ ID NO: 3038815 - RNA, 16 nt, Mycobacterium bovis subsp bovis AF2122/97
agcagccagcccagcc

SEQ ID NO: 3038816 - RNA, 21 nt, Mycobacterium bovis subsp bovis AF2122/97
agcagccagcccagccgccag

SEQ ID NO: 3038817 - RNA, 15 nt, Mycobacterium bovis subsp bovis AF2122/97
agcagccagcgucca

SEQ ID NO: 3038818 - RNA, 12 nt, Mycobacterium bovis subsp bovis AF2122/97
agcagcccgcgg

SEQ ID NO: 3038819 - RNA, 18 nt, Mycobacterium bovis subsp bovis AF2122/97
agcagcccggggaugccu

SEQ ID NO: 3038820 - RNA, 16 nt, Mycobacterium bovis subsp bovis AF2122/97
agcaguggaguauccg

SEQ ID NO: 3038821 - RNA, 13 nt, Mycobacterium bovis subsp bovis AF2122/97
agcauaccgccgc

SEQ ID NO: 3038822 - RNA, 18 nt, Mycobacterium bovis subsp bovis AF2122/97
agcauaccgccgcugcca

SEQ ID NO: 3038823 - RNA, 20 nt, Mycobacterium bovis subsp bovis AF2122/97
agcaucaacgaaccagcuug

SEQ ID NO: 3038824 - RNA, 14 nt, Mycobacterium bovis subsp bovis AF2122/97
agcaucacgcccac

SEQ ID NO: 3038825 - RNA, 17 nt, Mycobacterium bovis subsp bovis AF2122/97
agcaucacgcccacgau

SEQ ID NO: 3038826 - RNA, 14 nt, Mycobacterium bovis subsp bovis AF2122/97
agcauccagcgcgc

SEQ ID NO: 3038827 - RNA, 13 nt, Mycobacterium bovis subsp bovis AF2122/97
agcauccggccgu

SEQ ID NO: 3038828 - RNA, 11 nt, Mycobacterium bovis subsp bovis AF2122/97
agcaucggcac

SEQ ID NO: 3038829 - RNA, 13 nt, Mycobacterium bovis subsp bovis AF2122/97
agcaucggcaccc

SEQ ID NO: 3038830 - RNA, 14 nt, Mycobacterium bovis subsp bovis AF2122/97
agcaucggcacccc

SEQ ID NO: 3038831 - RNA, 15 nt, Mycobacterium bovis subsp bovis AF2122/97
agcaucggcagcagc

SEQ ID NO: 3038832 - RNA, 14 nt, Mycobacterium bovis subsp bovis AF2122/97
agcaucgggcgagc

SEQ ID NO: 3038833 - RNA, 21 nt, Mycobacterium bovis subsp bovis AF2122/97
agcaucggguggcgaggcagc

SEQ ID NO: 3038834 - RNA, 17 nt, Mycobacterium bovis subsp bovis AF2122/97
agcaucuccgucggcca

SEQ ID NO: 3038835 - RNA, 22 nt, Mycobacterium bovis subsp bovis AF2122/97
agcaucucggccuugacgcacg

SEQ ID NO: 3038836 - RNA, 16 nt, Mycobacterium bovis subsp bovis AF2122/97
agcaucuuuggcggcc

SEQ ID NO: 3038837 - RNA, 17 nt, Mycobacterium bovis subsp bovis AF2122/97
agcaucuuuggcggccg

SEQ ID NO: 3038838 - RNA, 18 nt, Mycobacterium bovis subsp bovis AF2122/97
agcaucuuuggcggccgc

SEQ ID NO: 3038839 - RNA, 18 nt, Mycobacterium bovis subsp bovis AF2122/97
agcaugacaccggccacc

SEQ ID NO: 3038840 - RNA, 19 nt, Mycobacterium bovis subsp bovis AF2122/97
agcaugacaccggccacca

SEQ ID NO: 3038841 - RNA, 18 nt, Mycobacterium bovis subsp bovis AF2122/97
agcaugauccgcugggcc

SEQ ID NO: 3038842 - RNA, 22 nt, Mycobacterium bovis subsp bovis AF2122/97
agcaugcccucgcuguuggccg

SEQ ID NO: 3038843 - RNA, 17 nt, Mycobacterium bovis subsp bovis AF2122/97
agcaugccgcccgcgcc

SEQ ID NO: 3038844 - RNA, 23 nt, Mycobacterium bovis subsp bovis AF2122/97
agcaugccuucggccaaccaugc

SEQ ID NO: 3038845 - RNA, 21 nt, Mycobacterium bovis subsp bovis AF2122/97
agcaugcgauacacggcggcg

SEQ ID NO: 3038846 - RNA, 21 nt, Mycobacterium bovis subsp bovis AF2122/97
agcauggcuuuugcgccgaau

SEQ ID NO: 3038847 - RNA, 14 nt, Mycobacterium bovis subsp bovis AF2122/97
agcaugguccacag

SEQ ID NO: 3038848 - RNA, 12 nt, Mycobacterium bovis subsp bovis AF2122/97
agcauggugcgg

SEQ ID NO: 3038849 - RNA, 18 nt, Mycobacterium bovis subsp bovis AF2122/97
agcauggugcggcggcgu

SEQ ID NO: 3038850 - RNA, 17 nt, Mycobacterium bovis subsp bovis AF2122/97
agcaugguggacgaggc

SEQ ID NO: 3038851 - RNA, 15 nt, Mycobacterium bovis subsp bovis AF2122/97
agcauucucgccgac

SEQ ID NO: 3038852 - RNA, 12 nt, Mycobacterium bovis subsp bovis AF2122/97
agcauugaagaa

SEQ ID NO: 3038853 - RNA, 19 nt, Mycobacterium bovis subsp bovis AF2122/97
agcauugaguucggccacc

SEQ ID NO: 3038854 - RNA, 20 nt, Mycobacterium bovis subsp bovis AF2122/97
agcauugaguucggccacca

SEQ ID NO: 3038855 - RNA, 23 nt, Mycobacterium bovis subsp bovis AF2122/97
agcauugaguucggccaccaacc

SEQ ID NO: 3038856 - RNA, 15 nt, Mycobacterium bovis subsp bovis AF2122/97
agcauugucgccgga

SEQ ID NO: 3038857 - RNA, 23 nt, Mycobacterium bovis subsp bovis AF2122/97
agccaaaaacgcugccgccguuc

SEQ ID NO: 3038858 - RNA, 18 nt, Mycobacterium bovis subsp bovis AF2122/97
agccaaacuacccgccca

SEQ ID NO: 3038859 - RNA, 14 nt, Mycobacterium bovis subsp bovis AF2122/97
agccaaaggcggcu

SEQ ID NO: 3038860 - RNA, 17 nt, Mycobacterium bovis subsp bovis AF2122/97
agccaaaucagccaggc

SEQ ID NO: 3038861 - RNA, 23 nt, Mycobacterium bovis subsp bovis AF2122/97
agccaaaugcgcugucgcccucg

SEQ ID NO: 3038862 - RNA, 17 nt, Mycobacterium bovis subsp bovis AF2122/97
agccaaccagcccggcc

SEQ ID NO: 3038863 - RNA, 14 nt, Mycobacterium bovis subsp bovis AF2122/97
agccaaccguccgg

SEQ ID NO: 3038864 - RNA, 15 nt, Mycobacterium bovis subsp bovis AF2122/97
agccaaccguccggg

SEQ ID NO: 3038865 - RNA, 17 nt, Mycobacterium bovis subsp bovis AF2122/97
agccaaccugaagccag

SEQ ID NO: 3038866 - RNA, 19 nt, Mycobacterium bovis subsp bovis AF2122/97
agccaaccugaagccagcg

SEQ ID NO: 3038867 - RNA, 14 nt, Mycobacterium bovis subsp bovis AF2122/97
agccaacgagcgcg

SEQ ID NO: 3038868 - RNA, 19 nt, Mycobacterium bovis subsp bovis AF2122/97
agccaacgagcgcgcugcg

SEQ ID NO: 3038869 - RNA, 22 nt, Mycobacterium bovis subsp bovis AF2122/97
agccaacgcgucccgccgcacc

SEQ ID NO: 3038870 - RNA, 17 nt, Mycobacterium bovis subsp bovis AF2122/97
agccaacgucaccaagu

SEQ ID NO: 3038871 - RNA, 21 nt, Mycobacterium bovis subsp bovis AF2122/97
agccaacucaggccgguaccg

SEQ ID NO: 3038872 - RNA, 16 nt, Mycobacterium bovis subsp bovis AF2122/97
agccaacuggucgcca

SEQ ID NO: 3038873 - RNA, 14 nt, Mycobacterium bovis subsp bovis AF2122/97
agccaagaaucacg

SEQ ID NO: 3038874 - RNA, 18 nt, Mycobacterium bovis subsp bovis AF2122/97
agccaagaaucacggcca

SEQ ID NO: 3038875 - RNA, 18 nt, Mycobacterium bovis subsp bovis AF2122/97
agccaaggcuuccuccga

SEQ ID NO: 3038876 - RNA, 18 nt, Mycobacterium bovis subsp bovis AF2122/97
agccaagugagcgaucgg

SEQ ID NO: 3038877 - RNA, 22 nt, Mycobacterium bovis subsp bovis AF2122/97
agccaaugcccuuggccagcag

SEQ ID NO: 3038878 - RNA, 18 nt, Mycobacterium bovis subsp bovis AF2122/97
agccaaugucuacgcauc

SEQ ID NO: 3038879 - RNA, 19 nt, Mycobacterium bovis subsp bovis AF2122/97
agccacaaaggcgccgggu

SEQ ID NO: 3038880 - RNA, 15 nt, Mycobacterium bovis subsp bovis AF2122/97
agccacagcccggcg

SEQ ID NO: 3038881 - RNA, 16 nt, Mycobacterium bovis subsp bovis AF2122/97
agccacagggaagcaa

SEQ ID NO: 3038882 - RNA, 22 nt, Mycobacterium bovis subsp bovis AF2122/97
agccacauacaggcccgccagc

SEQ ID NO: 3038883 - RNA, 12 nt, Mycobacterium bovis subsp bovis AF2122/97
agccaccaacac

SEQ ID NO: 3038884 - RNA, 15 nt, Mycobacterium bovis subsp bovis AF2122/97
agccaccaacaccgc

SEQ ID NO: 3038885 - RNA, 21 nt, Mycobacterium bovis subsp bovis AF2122/97
agccaccacaucgcgggcgug

SEQ ID NO: 3038886 - RNA, 12 nt, Mycobacterium bovis subsp bovis AF2122/97
agccaccaccag

SEQ ID NO: 3038887 - RNA, 14 nt, Mycobacterium bovis subsp bovis AF2122/97
agccaccagccggg

SEQ ID NO: 3038888 - RNA, 16 nt, Mycobacterium bovis subsp bovis AF2122/97
agccaccagccgggca

SEQ ID NO: 3038889 - RNA, 19 nt, Mycobacterium bovis subsp bovis AF2122/97
agccaccagcgacgaccac

SEQ ID NO: 3038890 - RNA, 23 nt, Mycobacterium bovis subsp bovis AF2122/97
agccaccccggguacgccgggca

SEQ ID NO: 3038891 - RNA, 12 nt, Mycobacterium bovis subsp bovis AF2122/97
agccaccgacga

SEQ ID NO: 3038892 - RNA, 22 nt, Mycobacterium bovis subsp bovis AF2122/97
agccaccgaucgacugcagccc

SEQ ID NO: 3038893 - RNA, 18 nt, Mycobacterium bovis subsp bovis AF2122/97
agccaccgcacguucggc

SEQ ID NO: 3038894 - RNA, 13 nt, Mycobacterium bovis subsp bovis AF2122/97
agccaccgggugg

SEQ ID NO: 3038895 - RNA, 14 nt, Mycobacterium bovis subsp bovis AF2122/97
agccaccgggugga

SEQ ID NO: 3038896 - RNA, 19 nt, Mycobacterium bovis subsp bovis AF2122/97
agccaccggugagcgcagc

SEQ ID NO: 3038897 - RNA, 18 nt, Mycobacterium bovis subsp bovis AF2122/97
agccaccugacaaacggc

SEQ ID NO: 3038898 - RNA, 23 nt, Mycobacterium bovis subsp bovis AF2122/97
agccaccugccgacucaucggcc

SEQ ID NO: 3038899 - RNA, 21 nt, Mycobacterium bovis subsp bovis AF2122/97
agccaccuuggacaccacgag

SEQ ID NO: 3038900 - RNA, 14 nt, Mycobacterium bovis subsp bovis AF2122/97
agccacgacccagc

SEQ ID NO: 3038901 - RNA, 13 nt, Mycobacterium bovis subsp bovis AF2122/97
agccacgcaagca

SEQ ID NO: 3038902 - RNA, 22 nt, Mycobacterium bovis subsp bovis AF2122/97
agccacgcacaauacggucagc

SEQ ID NO: 3038903 - RNA, 12 nt, Mycobacterium bovis subsp bovis AF2122/97
agccacgcaugg

SEQ ID NO: 3038904 - RNA, 17 nt, Mycobacterium bovis subsp bovis AF2122/97
agccacgcaugggccag

SEQ ID NO: 3038905 - RNA, 17 nt, Mycobacterium bovis subsp bovis AF2122/97
agccacgccacguccaa

SEQ ID NO: 3038906 - RNA, 17 nt, Mycobacterium bovis subsp bovis AF2122/97
agccacgccggucgcgg

SEQ ID NO: 3038907 - RNA, 16 nt, Mycobacterium bovis subsp bovis AF2122/97
agcccaugucgagcac

SEQ ID NO: 3038908 - RNA, 17 nt, Mycobacterium bovis subsp bovis AF2122/97
agcccaugucgagcacg

SEQ ID NO: 3038909 - RNA, 17 nt, Mycobacterium bovis subsp bovis AF2122/97
agccccacccgccgccg

SEQ ID NO: 3038910 - RNA, 22 nt, Mycobacterium bovis subsp bovis AF2122/97
agccccaucaccaccggcaccg

SEQ ID NO: 3038911 - RNA, 18 nt, Mycobacterium bovis subsp bovis AF2122/97
agccccauugccgucgcg

SEQ ID NO: 3038912 - RNA, 19 nt, Mycobacterium bovis subsp bovis AF2122/97
agccccauugccgucgcgg

SEQ ID NO: 3038913 - RNA, 22 nt, Mycobacterium bovis subsp bovis AF2122/97
agccccauugccgucgcgguca

SEQ ID NO: 3038914 - RNA, 13 nt, Mycobacterium bovis subsp bovis AF2122/97
agccccccggcga

SEQ ID NO: 3038915 - RNA, 20 nt, Mycobacterium bovis subsp bovis AF2122/97
agcccccgacacgccgugcg

SEQ ID NO: 3038916 - RNA, 17 nt, Mycobacterium bovis subsp bovis AF2122/97
agcccccgcacgcucgg

SEQ ID NO: 3038917 - RNA, 15 nt, Mycobacterium bovis subsp bovis AF2122/97
agccccgaagccggu

SEQ ID NO: 3038918 - RNA, 16 nt, Mycobacterium bovis subsp bovis AF2122/97
agccccgaccagcaga

SEQ ID NO: 3038919 - RNA, 14 nt, Mycobacterium bovis subsp bovis AF2122/97
agccccgcaggggg

SEQ ID NO: 3038920 - RNA, 13 nt, Mycobacterium bovis subsp bovis AF2122/97
agccccgcgccca

SEQ ID NO: 3038921 - RNA, 21 nt, Mycobacterium bovis subsp bovis AF2122/97
agccccgcgcguucggcgagc

SEQ ID NO: 3038922 - RNA, 15 nt, Mycobacterium bovis subsp bovis AF2122/97
agccccgcuccgcgc

SEQ ID NO: 3038923 - RNA, 19 nt, Mycobacterium bovis subsp bovis AF2122/97
agccccgcuggucgaccgg

SEQ ID NO: 3038924 - RNA, 13 nt, Mycobacterium bovis subsp bovis AF2122/97
agccccgucgacc

SEQ ID NO: 3038925 - RNA, 14 nt, Mycobacterium bovis subsp bovis AF2122/97
agccccgucgaccu

SEQ ID NO: 3038926 - RNA, 18 nt, Mycobacterium bovis subsp bovis AF2122/97
agccccgucgaccuccac

SEQ ID NO: 3038927 - RNA, 18 nt, Mycobacterium bovis subsp bovis AF2122/97
agccccucaccucggcuu

SEQ ID NO: 3038928 - RNA, 15 nt, Mycobacterium bovis subsp bovis AF2122/97
agccccuccgcgccg

SEQ ID NO: 3038929 - RNA, 17 nt, Mycobacterium bovis subsp bovis AF2122/97
agccccugaaggccagc

SEQ ID NO: 3038930 - RNA, 19 nt, Mycobacterium bovis subsp bovis AF2122/97
agccccugaaggccagcca

SEQ ID NO: 3038931 - RNA, 21 nt, Mycobacterium bovis subsp bovis AF2122/97
agccccugaaggccagccaac

SEQ ID NO: 3038932 - RNA, 12 nt, Mycobacterium bovis subsp bovis AF2122/97
agccccugccga

SEQ ID NO: 3038933 - RNA, 14 nt, Mycobacterium bovis subsp bovis AF2122/97
agcccgaaggcggc

SEQ ID NO: 3038934 - RNA, 17 nt, Mycobacterium bovis subsp bovis AF2122/97
agcccgacaccguccag

SEQ ID NO: 3038935 - RNA, 14 nt, Mycobacterium bovis subsp bovis AF2122/97
agcccgaccggucc

SEQ ID NO: 3038936 - RNA, 14 nt, Mycobacterium bovis subsp bovis AF2122/97
agcccgagcucgcc

SEQ ID NO: 3038937 - RNA, 16 nt, Mycobacterium bovis subsp bovis AF2122/97
agcccgagcucgccgc

SEQ ID NO: 3038938 - RNA, 20 nt, Mycobacterium bovis subsp bovis AF2122/97
agcccgaguuguucgugccg

SEQ ID NO: 3038939 - RNA, 21 nt, Mycobacterium bovis subsp bovis AF2122/97
agcccgaguuguuggugcccg

SEQ ID NO: 3038940 - RNA, 22 nt, Mycobacterium bovis subsp bovis AF2122/97
agcccgaucgcggcccggcccu

SEQ ID NO: 3038941 - RNA, 19 nt, Mycobacterium bovis subsp bovis AF2122/97
agcccgaucggcgggcugg

SEQ ID NO: 3038942 - RNA, 20 nt, Mycobacterium bovis subsp bovis AF2122/97
agcccgaucggcgggcuggu

SEQ ID NO: 3038943 - RNA, 15 nt, Mycobacterium bovis subsp bovis AF2122/97
agcccgauggugccg

SEQ ID NO: 3038944 - RNA, 19 nt, Mycobacterium bovis subsp bovis AF2122/97
agcccgauggugccgaccc

SEQ ID NO: 3038945 - RNA, 22 nt, Mycobacterium bovis subsp bovis AF2122/97
agcccgaugguggugccgaccu

SEQ ID NO: 3038946 - RNA, 19 nt, Mycobacterium bovis subsp bovis AF2122/97
agcccgauucagcgcccca

SEQ ID NO: 3038947 - RNA, 16 nt, Mycobacterium bovis subsp bovis AF2122/97
agcccgcaucgcacca

SEQ ID NO: 3038948 - RNA, 17 nt, Mycobacterium bovis subsp bovis AF2122/97
agcccgcaucgcaccag

SEQ ID NO: 3038949 - RNA, 13 nt, Mycobacterium bovis subsp bovis AF2122/97
agcccgccacccu

SEQ ID NO: 3038950 - RNA, 22 nt, Mycobacterium bovis subsp bovis AF2122/97
agcccgccgaucgggcuucggc

SEQ ID NO: 3038951 - RNA, 14 nt, Mycobacterium bovis subsp bovis AF2122/97
agcccgccgcgacc

SEQ ID NO: 3038952 - RNA, 15 nt, Mycobacterium bovis subsp bovis AF2122/97
agcccgccgcgacca

SEQ ID NO: 3038953 - RNA, 19 nt, Mycobacterium bovis subsp bovis AF2122/97
agcccgccggacccgccgg

SEQ ID NO: 3038954 - RNA, 17 nt, Mycobacterium bovis subsp bovis AF2122/97
agcccgccggccucugg

SEQ ID NO: 3038955 - RNA, 13 nt, Mycobacterium bovis subsp bovis AF2122/97
agcccgccgggcu

SEQ ID NO: 3038956 - RNA, 13 nt, Mycobacterium bovis subsp bovis AF2122/97
agcccgcgaucac

SEQ ID NO: 3038957 - RNA, 16 nt, Mycobacterium bovis subsp bovis AF2122/97
agcccgcgaucaccau

SEQ ID NO: 3038958 - RNA, 14 nt, Mycobacterium bovis subsp bovis AF2122/97
agcccgcgaucucg

SEQ ID NO: 3038959 - RNA, 12 nt, Mycobacterium bovis subsp bovis AF2122/97
agcccgcgcagc

SEQ ID NO: 3038960 - RNA, 14 nt, Mycobacterium bovis subsp bovis AF2122/97
agcccgcugcgccg

SEQ ID NO: 3038961 - RNA, 22 nt, Mycobacterium bovis subsp bovis AF2122/97
agcccggaccgcccgugccguc

SEQ ID NO: 3038962 - RNA, 23 nt, Mycobacterium bovis subsp bovis AF2122/97
agcccggacgcgcggauggccuc

SEQ ID NO: 3038963 - RNA, 17 nt, Mycobacterium bovis subsp bovis AF2122/97
agcccggagcggucagc

SEQ ID NO: 3038964 - RNA, 18 nt, Mycobacterium bovis subsp bovis AF2122/97
agcccggcacugaccgcg

SEQ ID NO: 3038965 - RNA, 18 nt, Mycobacterium bovis subsp bovis AF2122/97
agcccggcauuaggccgg

SEQ ID NO: 3038966 - RNA, 13 nt, Mycobacterium bovis subsp bovis AF2122/97
agcccggccagcc

SEQ ID NO: 3038967 - RNA, 14 nt, Mycobacterium bovis subsp bovis AF2122/97
agcccggccgccga

SEQ ID NO: 3038968 - RNA, 16 nt, Mycobacterium bovis subsp bovis AF2122/97
agcccggccgccgagg

SEQ ID NO: 3038969 - RNA, 17 nt, Mycobacterium bovis subsp bovis AF2122/97
agcccggccgcgcccca

SEQ ID NO: 3038970 - RNA, 21 nt, Mycobacterium bovis subsp bovis AF2122/97
agcccggccuugccgccggcg

SEQ ID NO: 3038971 - RNA, 23 nt, Mycobacterium bovis subsp bovis AF2122/97
agcccggcgacgacccgggucgg

SEQ ID NO: 3038972 - RNA, 23 nt, Mycobacterium bovis subsp bovis AF2122/97
agcccggcgaugagcaugcccag

SEQ ID NO: 3038973 - RNA, 14 nt, Mycobacterium bovis subsp bovis AF2122/97
agcccggcgcgccg

SEQ ID NO: 3038974 - RNA, 14 nt, Mycobacterium bovis subsp bovis AF2122/97
agcccggcggcagc

SEQ ID NO: 3038975 - RNA, 21 nt, Mycobacterium bovis subsp bovis AF2122/97
agcccggcggcaugggucgug

SEQ ID NO: 3038976 - RNA, 16 nt, Mycobacterium bovis subsp bovis AF2122/97
agcccgggccguacgg

SEQ ID NO: 3038977 - RNA, 17 nt, Mycobacterium bovis subsp bovis AF2122/97
agcccgggccugaacca

SEQ ID NO: 3038978 - RNA, 18 nt, Mycobacterium bovis subsp bovis AF2122/97
agcccgguaucgucccgg

SEQ ID NO: 3038979 - RNA, 22 nt, Mycobacterium bovis subsp bovis AF2122/97
agcccggucccuuuguggggcc

SEQ ID NO: 3038980 - RNA, 22 nt, Mycobacterium bovis subsp bovis AF2122/97
agcccggucgcugauccgggcg

SEQ ID NO: 3038981 - RNA, 13 nt, Mycobacterium bovis subsp bovis AF2122/97
agcccggugcuac

SEQ ID NO: 3038982 - RNA, 18 nt, Mycobacterium bovis subsp bovis AF2122/97
agcccggugcuaccggcu

SEQ ID NO: 3038983 - RNA, 22 nt, Mycobacterium bovis subsp bovis AF2122/97
agcccggugcuaccggcuuggc

SEQ ID NO: 3038984 - RNA, 15 nt, Mycobacterium bovis subsp bovis AF2122/97
agcccggugugcugc

SEQ ID NO: 3038985 - RNA, 22 nt, Mycobacterium bovis subsp bovis AF2122/97
agcccguagcacaccgguggac

SEQ ID NO: 3038986 - RNA, 14 nt, Mycobacterium bovis subsp bovis AF2122/97
agcccguagccgau

SEQ ID NO: 3038987 - RNA, 14 nt, Mycobacterium bovis subsp bovis AF2122/97
agcccguccaggcc

SEQ ID NO: 3038988 - RNA, 22 nt, Mycobacterium bovis subsp bovis AF2122/97
agcccguccaggcgcugcagca

SEQ ID NO: 3038989 - RNA, 13 nt, Mycobacterium bovis subsp bovis AF2122/97
agcccgucgauca

SEQ ID NO: 3038990 - RNA, 19 nt, Mycobacterium bovis subsp bovis AF2122/97
agcccgucggcgccgaaca

SEQ ID NO: 3038991 - RNA, 18 nt, Mycobacterium bovis subsp bovis AF2122/97
agcccgucggugguguuc

SEQ ID NO: 3038992 - RNA, 17 nt, Mycobacterium bovis subsp bovis AF2122/97
agcccgucgucgugcac

SEQ ID NO: 3038993 - RNA, 23 nt, Mycobacterium bovis subsp bovis AF2122/97
agcccguggucgaucaugacgag

SEQ ID NO: 3038994 - RNA, 21 nt, Mycobacterium bovis subsp bovis AF2122/97
agccgauguccgacgccaccg

SEQ ID NO: 3038995 - RNA, 18 nt, Mycobacterium bovis subsp bovis AF2122/97
agccgcaacaccccccgu

SEQ ID NO: 3038996 - RNA, 14 nt, Mycobacterium bovis subsp bovis AF2122/97
agccgcacagcaug

SEQ ID NO: 3038997 - RNA, 18 nt, Mycobacterium bovis subsp bovis AF2122/97
agccgcaccagaucgucg

SEQ ID NO: 3038998 - RNA, 18 nt, Mycobacterium bovis subsp bovis AF2122/97
agccgcaccaguggcgcc

SEQ ID NO: 3038999 - RNA, 12 nt, Mycobacterium bovis subsp bovis AF2122/97
agccgcaccccg

SEQ ID NO: 3039000 - RNA, 15 nt, Mycobacterium bovis subsp bovis AF2122/97
agccgcaccccgccc

SEQ ID NO: 3039001 - RNA, 15 nt, Mycobacterium bovis subsp bovis AF2122/97
agccgcaccgcuguu

SEQ ID NO: 3039002 - RNA, 13 nt, Mycobacterium bovis subsp bovis AF2122/97
agccgcacgaugc

SEQ ID NO: 3039003 - RNA, 14 nt, Mycobacterium bovis subsp bovis AF2122/97
agccgcacgaugcc

SEQ ID NO: 3039004 - RNA, 15 nt, Mycobacterium bovis subsp bovis AF2122/97
agccgcacgaugccg

SEQ ID NO: 3039005 - RNA, 17 nt, Mycobacterium bovis subsp bovis AF2122/97
agccgcacgaugccggg

SEQ ID NO: 3039006 - RNA, 15 nt, Mycobacterium bovis subsp bovis AF2122/97
agccgcacgguugcc

SEQ ID NO: 3039007 - RNA, 16 nt, Mycobacterium bovis subsp bovis AF2122/97
agccgcacgguugccg

SEQ ID NO: 3039008 - RNA, 17 nt, Mycobacterium bovis subsp bovis AF2122/97
agccgcagaugcaccug

SEQ ID NO: 3039009 - RNA, 18 nt, Mycobacterium bovis subsp bovis AF2122/97
agccgcagaugcaccugc

SEQ ID NO: 3039010 - RNA, 21 nt, Mycobacterium bovis subsp bovis AF2122/97
agccgcagcaccucggucccg

SEQ ID NO: 3039011 - RNA, 21 nt, Mycobacterium bovis subsp bovis AF2122/97
agccgcagcaccucgucgauc

SEQ ID NO: 3039012 - RNA, 23 nt, Mycobacterium bovis subsp bovis AF2122/97
agccgcagcaccucgucgaucgc

SEQ ID NO: 3039013 - RNA, 16 nt, Mycobacterium bovis subsp bovis AF2122/97
agccgcagccccgaca

SEQ ID NO: 3039014 - RNA, 14 nt, Mycobacterium bovis subsp bovis AF2122/97
agccgcagccgcag

SEQ ID NO: 3039015 - RNA, 15 nt, Mycobacterium bovis subsp bovis AF2122/97
agccgcagcggccug

SEQ ID NO: 3039016 - RNA, 18 nt, Mycobacterium bovis subsp bovis AF2122/97
agccgcagcugagccgug

SEQ ID NO: 3039017 - RNA, 16 nt, Mycobacterium bovis subsp bovis AF2122/97
agccgcagcuuggccu

SEQ ID NO: 3039018 - RNA, 21 nt, Mycobacterium bovis subsp bovis AF2122/97
agccgcagcuuggccucagcc

SEQ ID NO: 3039019 - RNA, 18 nt, Mycobacterium bovis subsp bovis AF2122/97
agccgcauaggccccgcc

SEQ ID NO: 3039020 - RNA, 20 nt, Mycobacterium bovis subsp bovis AF2122/97
agccgcauaggccccgccag

SEQ ID NO: 3039021 - RNA, 21 nt, Mycobacterium bovis subsp bovis AF2122/97
agccgcauaggccccgccagc

SEQ ID NO: 3039022 - RNA, 18 nt, Mycobacterium bovis subsp bovis AF2122/97
agccgcaucuugucgagc

SEQ ID NO: 3039023 - RNA, 20 nt, Mycobacterium bovis subsp bovis AF2122/97
agccgcaucuugucgagcac

SEQ ID NO: 3039024 - RNA, 14 nt, Mycobacterium bovis subsp bovis AF2122/97
agccgccaaccgca

SEQ ID NO: 3039025 - RNA, 12 nt, Mycobacterium bovis subsp bovis AF2122/97
agccgccaccgu

SEQ ID NO: 3039026 - RNA, 22 nt, Mycobacterium bovis subsp bovis AF2122/97
agccgccaccguacgacagucg

SEQ ID NO: 3039027 - RNA, 14 nt, Mycobacterium bovis subsp bovis AF2122/97
agccgccaggugcu

SEQ ID NO: 3039028 - RNA, 21 nt, Mycobacterium bovis subsp bovis AF2122/97
agccgccauguacaggcccca

SEQ ID NO: 3039029 - RNA, 19 nt, Mycobacterium bovis subsp bovis AF2122/97
agccgccauugagcucccg

SEQ ID NO: 3039030 - RNA, 18 nt, Mycobacterium bovis subsp bovis AF2122/97
agccgcccaagccgccgg

SEQ ID NO: 3039031 - RNA, 21 nt, Mycobacterium bovis subsp bovis AF2122/97
agccgcccaagccgccggcgc

SEQ ID NO: 3039032 - RNA, 11 nt, Mycobacterium bovis subsp bovis AF2122/97
agccgccgacu

SEQ ID NO: 3039033 - RNA, 15 nt, Mycobacterium bovis subsp bovis AF2122/97
agccgccgacucggc

SEQ ID NO: 3039034 - RNA, 14 nt, Mycobacterium bovis subsp bovis AF2122/97
agccgccgccggca

SEQ ID NO: 3039035 - RNA, 20 nt, Mycobacterium bovis subsp bovis AF2122/97
agccgccgccugugcgcggu

SEQ ID NO: 3039036 - RNA, 16 nt, Mycobacterium bovis subsp bovis AF2122/97
agccgccgcgacggca

SEQ ID NO: 3039037 - RNA, 15 nt, Mycobacterium bovis subsp bovis AF2122/97
agccgccgcgccccg

SEQ ID NO: 3039038 - RNA, 18 nt, Mycobacterium bovis subsp bovis AF2122/97
agccgccgcgccccgcgg

SEQ ID NO: 3039039 - RNA, 22 nt, Mycobacterium bovis subsp bovis AF2122/97
agccgccgcgccccgcggcaga

SEQ ID NO: 3039040 - RNA, 23 nt, Mycobacterium bovis subsp bovis AF2122/97
agccgccggccccgccagcgccg

SEQ ID NO: 3039041 - RNA, 13 nt, Mycobacterium bovis subsp bovis AF2122/97
agccgccggccgg

SEQ ID NO: 3039042 - RNA, 17 nt, Mycobacterium bovis subsp bovis AF2122/97
agccgccggccggcauc

SEQ ID NO: 3039043 - RNA, 22 nt, Mycobacterium bovis subsp bovis AF2122/97
agccgccggccggcauccgguu

SEQ ID NO: 3039044 - RNA, 12 nt, Mycobacterium bovis subsp bovis AF2122/97
agccgccggcgc

SEQ ID NO: 3039045 - RNA, 16 nt, Mycobacterium bovis subsp bovis AF2122/97
agccgccggcgccagc

SEQ ID NO: 3039046 - RNA, 19 nt, Mycobacterium bovis subsp bovis AF2122/97
agccgccggcgccagcgcc

SEQ ID NO: 3039047 - RNA, 23 nt, Mycobacterium bovis subsp bovis AF2122/97
agccgccggcgccagcgccgcca

SEQ ID NO: 3039048 - RNA, 14 nt, Mycobacterium bovis subsp bovis AF2122/97
agccgccggcgccg

SEQ ID NO: 3039049 - RNA, 13 nt, Mycobacterium bovis subsp bovis AF2122/97
agccgccggcggu

SEQ ID NO: 3039050 - RNA, 12 nt, Mycobacterium bovis subsp bovis AF2122/97
agccgccgggca

SEQ ID NO: 3039051 - RNA, 17 nt, Mycobacterium bovis subsp bovis AF2122/97
agccgccgggugcgccg

SEQ ID NO: 3039052 - RNA, 23 nt, Mycobacterium bovis subsp bovis AF2122/97
agccgccgggugcgccguugccg

SEQ ID NO: 3039053 - RNA, 14 nt, Mycobacterium bovis subsp bovis AF2122/97
agccgccggugccg

SEQ ID NO: 3039054 - RNA, 21 nt, Mycobacterium bovis subsp bovis AF2122/97
agccgccggugccgccggugc

SEQ ID NO: 3039055 - RNA, 15 nt, Mycobacterium bovis subsp bovis AF2122/97
agccgccgucgccgg

SEQ ID NO: 3039056 - RNA, 16 nt, Mycobacterium bovis subsp bovis AF2122/97
agccgccgucgccggu

SEQ ID NO: 3039057 - RNA, 23 nt, Mycobacterium bovis subsp bovis AF2122/97
agccgccguggaacacgaagucg

SEQ ID NO: 3039058 - RNA, 18 nt, Mycobacterium bovis subsp bovis AF2122/97
agccgccguggauacgca

SEQ ID NO: 3039059 - RNA, 14 nt, Mycobacterium bovis subsp bovis AF2122/97
agccgccguugccg

SEQ ID NO: 3039060 - RNA, 18 nt, Mycobacterium bovis subsp bovis AF2122/97
agccgccguugccgccgg

SEQ ID NO: 3039061 - RNA, 17 nt, Mycobacterium bovis subsp bovis AF2122/97
agccgcgaccagaggcg

SEQ ID NO: 3039062 - RNA, 14 nt, Mycobacterium bovis subsp bovis AF2122/97
agccgcgacgcggc

SEQ ID NO: 3039063 - RNA, 23 nt, Mycobacterium bovis subsp bovis AF2122/97
agccgcgacgcggcgucggucgg

SEQ ID NO: 3039064 - RNA, 13 nt, Mycobacterium bovis subsp bovis AF2122/97
agccgcgagcacg

SEQ ID NO: 3039065 - RNA, 20 nt, Mycobacterium bovis subsp bovis AF2122/97
agccgcgagcacgucggggu

SEQ ID NO: 3039066 - RNA, 21 nt, Mycobacterium bovis subsp bovis AF2122/97
agccgcgagcacgucggggug

SEQ ID NO: 3039067 - RNA, 13 nt, Mycobacterium bovis subsp bovis AF2122/97
agccgcgagccgg

SEQ ID NO: 3039068 - RNA, 14 nt, Mycobacterium bovis subsp bovis AF2122/97
agccgcgagccggu

SEQ ID NO: 3039069 - RNA, 20 nt, Mycobacterium bovis subsp bovis AF2122/97
agccgcgaguccaggcugau

SEQ ID NO: 3039070 - RNA, 12 nt, Mycobacterium bovis subsp bovis AF2122/97
agccgcgaucgg

SEQ ID NO: 3039071 - RNA, 22 nt, Mycobacterium bovis subsp bovis AF2122/97
agccgcgaugugguggacgcca

SEQ ID NO: 3039072 - RNA, 20 nt, Mycobacterium bovis subsp bovis AF2122/97
agccgcgccuugauggucuc

SEQ ID NO: 3039073 - RNA, 16 nt, Mycobacterium bovis subsp bovis AF2122/97
agccgcgcgccaucgc

SEQ ID NO: 3039074 - RNA, 21 nt, Mycobacterium bovis subsp bovis AF2122/97
agccgcgcgccaucgccucca

SEQ ID NO: 3039075 - RNA, 17 nt, Mycobacterium bovis subsp bovis AF2122/97
agccgcgcgccggccau

SEQ ID NO: 3039076 - RNA, 22 nt, Mycobacterium bovis subsp bovis AF2122/97
agccgcgcgggucacgaccugc

SEQ ID NO: 3039077 - RNA, 21 nt, Mycobacterium bovis subsp bovis AF2122/97
agccgcgcgguacugcgcagc

SEQ ID NO: 3039078 - RNA, 19 nt, Mycobacterium bovis subsp bovis AF2122/97
agccgcgcguccgggcagc

SEQ ID NO: 3039079 - RNA, 13 nt, Mycobacterium bovis subsp bovis AF2122/97
agccgcggccaca

SEQ ID NO: 3039080 - RNA, 15 nt, Mycobacterium bovis subsp bovis AF2122/97
agccgcggccacaau

SEQ ID NO: 3039081 - RNA, 18 nt, Mycobacterium bovis subsp bovis AF2122/97
agccgggcgcgccggcca

SEQ ID NO: 3039082 - RNA, 17 nt, Mycobacterium bovis subsp bovis AF2122/97
agccgggcucgucgagu

SEQ ID NO: 3039083 - RNA, 23 nt, Mycobacterium bovis subsp bovis AF2122/97
agccgggugaggcgggucgccgc

SEQ ID NO: 3039084 - RNA, 15 nt, Mycobacterium bovis subsp bovis AF2122/97
agccgggugccggca

SEQ ID NO: 3039085 - RNA, 15 nt, Mycobacterium bovis subsp bovis AF2122/97
agccgggugcgcacc

SEQ ID NO: 3039086 - RNA, 12 nt, Mycobacterium bovis subsp bovis AF2122/97
agccggguggac

SEQ ID NO: 3039087 - RNA, 19 nt, Mycobacterium bovis subsp bovis AF2122/97
agccgggugggagcagccg

SEQ ID NO: 3039088 - RNA, 20 nt, Mycobacterium bovis subsp bovis AF2122/97
agccggguguuggggaucgc

SEQ ID NO: 3039089 - RNA, 23 nt, Mycobacterium bovis subsp bovis AF2122/97
agccggguguuggggaucgcacc

SEQ ID NO: 3039090 - RNA, 23 nt, Mycobacterium bovis subsp bovis AF2122/97
agccggguugccugcgcgagugc

SEQ ID NO: 3039091 - RNA, 14 nt, Mycobacterium bovis subsp bovis AF2122/97
agccggguugguac

SEQ ID NO: 3039092 - RNA, 14 nt, Mycobacterium bovis subsp bovis AF2122/97
agccgguaaccgcg

SEQ ID NO: 3039093 - RNA, 17 nt, Mycobacterium bovis subsp bovis AF2122/97
agccgguagaucagcgc

SEQ ID NO: 3039094 - RNA, 19 nt, Mycobacterium bovis subsp bovis AF2122/97
agccgguagaucagcgccu

SEQ ID NO: 3039095 - RNA, 21 nt, Mycobacterium bovis subsp bovis AF2122/97
agccgguagaucagcgccugg

SEQ ID NO: 3039096 - RNA, 15 nt, Mycobacterium bovis subsp bovis AF2122/97
agccgguagccgggc

SEQ ID NO: 3039097 - RNA, 13 nt, Mycobacterium bovis subsp bovis AF2122/97
agccgguccagca

SEQ ID NO: 3039098 - RNA, 18 nt, Mycobacterium bovis subsp bovis AF2122/97
agccggucuugcaucgcc

SEQ ID NO: 3039099 - RNA, 21 nt, Mycobacterium bovis subsp bovis AF2122/97
agccggucuugcaucgccaau

SEQ ID NO: 3039100 - RNA, 14 nt, Mycobacterium bovis subsp bovis AF2122/97
agccggugaccgcg

SEQ ID NO: 3039101 - RNA, 18 nt, Mycobacterium bovis subsp bovis AF2122/97
agccggugacgugguggg

SEQ ID NO: 3039102 - RNA, 17 nt, Mycobacterium bovis subsp bovis AF2122/97
agccggugagcgagcgc

SEQ ID NO: 3039103 - RNA, 18 nt, Mycobacterium bovis subsp bovis AF2122/97
agccggugagcgagcgcg

SEQ ID NO: 3039104 - RNA, 19 nt, Mycobacterium bovis subsp bovis AF2122/97
agccggugagcgagcgcgc

SEQ ID NO: 3039105 - RNA, 12 nt, Mycobacterium bovis subsp bovis AF2122/97
agccggugccgc

SEQ ID NO: 3039106 - RNA, 15 nt, Mycobacterium bovis subsp bovis AF2122/97
agccggugccgccgu

SEQ ID NO: 3039107 - RNA, 13 nt, Mycobacterium bovis subsp bovis AF2122/97
agccggugccgcg

SEQ ID NO: 3039108 - RNA, 11 nt, Mycobacterium bovis subsp bovis AF2122/97
agccgguggca

SEQ ID NO: 3039109 - RNA, 17 nt, Mycobacterium bovis subsp bovis AF2122/97
agccgguggcccgccgg

SEQ ID NO: 3039110 - RNA, 19 nt, Mycobacterium bovis subsp bovis AF2122/97
agccgguggcccgccggca

SEQ ID NO: 3039111 - RNA, 14 nt, Mycobacterium bovis subsp bovis AF2122/97
agccgguggucgcg

SEQ ID NO: 3039112 - RNA, 15 nt, Mycobacterium bovis subsp bovis AF2122/97
agccgguggucgcgc

SEQ ID NO: 3039113 - RNA, 21 nt, Mycobacterium bovis subsp bovis AF2122/97
agccgguguugauguugccgg

SEQ ID NO: 3039114 - RNA, 16 nt, Mycobacterium bovis subsp bovis AF2122/97
agccguacgguccgaa

SEQ ID NO: 3039115 - RNA, 13 nt, Mycobacterium bovis subsp bovis AF2122/97
agccguagccgcc

SEQ ID NO: 3039116 - RNA, 14 nt, Mycobacterium bovis subsp bovis AF2122/97
agccguagccgccg

SEQ ID NO: 3039117 - RNA, 15 nt, Mycobacterium bovis subsp bovis AF2122/97
agccguagccgccgu

SEQ ID NO: 3039118 - RNA, 19 nt, Mycobacterium bovis subsp bovis AF2122/97
agccguagccgccguggau

SEQ ID NO: 3039119 - RNA, 18 nt, Mycobacterium bovis subsp bovis AF2122/97
agccguagcugggcaccc

SEQ ID NO: 3039120 - RNA, 16 nt, Mycobacterium bovis subsp bovis AF2122/97
agccguaguaguggcc

SEQ ID NO: 3039121 - RNA, 19 nt, Mycobacterium bovis subsp bovis AF2122/97
agccguaguaguggccgcc

SEQ ID NO: 3039122 - RNA, 21 nt, Mycobacterium bovis subsp bovis AF2122/97
agccgucaccgcgaccccugg

SEQ ID NO: 3039123 - RNA, 15 nt, Mycobacterium bovis subsp bovis AF2122/97
agccgucacgccgga

SEQ ID NO: 3039124 - RNA, 17 nt, Mycobacterium bovis subsp bovis AF2122/97
agccgucacgccggaug

SEQ ID NO: 3039125 - RNA, 19 nt, Mycobacterium bovis subsp bovis AF2122/97
agccguccaauuccgcaga

SEQ ID NO: 3039126 - RNA, 18 nt, Mycobacterium bovis subsp bovis AF2122/97
agccguccgaccagggau

SEQ ID NO: 3039127 - RNA, 16 nt, Mycobacterium bovis subsp bovis AF2122/97
agccgucgagcagccg

SEQ ID NO: 3039128 - RNA, 20 nt, Mycobacterium bovis subsp bovis AF2122/97
agccgucgaucccggucggu

SEQ ID NO: 3039129 - RNA, 14 nt, Mycobacterium bovis subsp bovis AF2122/97
agccgucgauguug

SEQ ID NO: 3039130 - RNA, 17 nt, Mycobacterium bovis subsp bovis AF2122/97
agccgucgcgacgucgg

SEQ ID NO: 3039131 - RNA, 20 nt, Mycobacterium bovis subsp bovis AF2122/97
agccgucguccgcugacccg

SEQ ID NO: 3039132 - RNA, 21 nt, Mycobacterium bovis subsp bovis AF2122/97
agccgucguccgcugacccgc

SEQ ID NO: 3039133 - RNA, 23 nt, Mycobacterium bovis subsp bovis AF2122/97
agccgucguccgcugacccgcca

SEQ ID NO: 3039134 - RNA, 16 nt, Mycobacterium bovis subsp bovis AF2122/97
agccgugauauccgua

SEQ ID NO: 3039135 - RNA, 20 nt, Mycobacterium bovis subsp bovis AF2122/97
agccgugauauccguacagu

SEQ ID NO: 3039136 - RNA, 19 nt, Mycobacterium bovis subsp bovis AF2122/97
agccgugcaccagcgacca

SEQ ID NO: 3039137 - RNA, 15 nt, Mycobacterium bovis subsp bovis AF2122/97
agccgugcaccucgu

SEQ ID NO: 3039138 - RNA, 16 nt, Mycobacterium bovis subsp bovis AF2122/97
agccgugcaccucgug

SEQ ID NO: 3039139 - RNA, 14 nt, Mycobacterium bovis subsp bovis AF2122/97
agccgugcagcucg

SEQ ID NO: 3039140 - RNA, 20 nt, Mycobacterium bovis subsp bovis AF2122/97
agccgugcagcucggucagc

SEQ ID NO: 3039141 - RNA, 18 nt, Mycobacterium bovis subsp bovis AF2122/97
agccgugcccaggccacc

SEQ ID NO: 3039142 - RNA, 15 nt, Mycobacterium bovis subsp bovis AF2122/97
agccgugccgccagc

SEQ ID NO: 3039143 - RNA, 17 nt, Mycobacterium bovis subsp bovis AF2122/97
agccgugccgccagcaa

SEQ ID NO: 3039144 - RNA, 16 nt, Mycobacterium bovis subsp bovis AF2122/97
agccgugccgugguga

SEQ ID NO: 3039145 - RNA, 18 nt, Mycobacterium bovis subsp bovis AF2122/97
agccgugccguggugaaa

SEQ ID NO: 3039146 - RNA, 12 nt, Mycobacterium bovis subsp bovis AF2122/97
agccgugccucg

SEQ ID NO: 3039147 - RNA, 14 nt, Mycobacterium bovis subsp bovis AF2122/97
agccgugcggcggc

SEQ ID NO: 3039148 - RNA, 19 nt, Mycobacterium bovis subsp bovis AF2122/97
agccgugcgggccggucgu

SEQ ID NO: 3039149 - RNA, 16 nt, Mycobacterium bovis subsp bovis AF2122/97
agccgugcggucgcgc

SEQ ID NO: 3039150 - RNA, 15 nt, Mycobacterium bovis subsp bovis AF2122/97
agccgugcugcccau

SEQ ID NO: 3039151 - RNA, 23 nt, Mycobacterium bovis subsp bovis AF2122/97
agccgugcugcccaucccggccg

SEQ ID NO: 3039152 - RNA, 18 nt, Mycobacterium bovis subsp bovis AF2122/97
agccgugcuuguugcgcg

SEQ ID NO: 3039153 - RNA, 22 nt, Mycobacterium bovis subsp bovis AF2122/97
agccgugcuuguugcgcgacgc

SEQ ID NO: 3039154 - RNA, 15 nt, Mycobacterium bovis subsp bovis AF2122/97
agccguggccggacc

SEQ ID NO: 3039155 - RNA, 16 nt, Mycobacterium bovis subsp bovis AF2122/97
agccguggccggaccc

SEQ ID NO: 3039156 - RNA, 14 nt, Mycobacterium bovis subsp bovis AF2122/97
agccguggcggcgg

SEQ ID NO: 3039157 - RNA, 17 nt, Mycobacterium bovis subsp bovis AF2122/97
agccgugggccacgaug

SEQ ID NO: 3039158 - RNA, 18 nt, Mycobacterium bovis subsp bovis AF2122/97
agccgugggccacgauga

SEQ ID NO: 3039159 - RNA, 12 nt, Mycobacterium bovis subsp bovis AF2122/97
agccgugguggu

SEQ ID NO: 3039160 - RNA, 22 nt, Mycobacterium bovis subsp bovis AF2122/97
agccguggugguugaucagcca

SEQ ID NO: 3039161 - RNA, 18 nt, Mycobacterium bovis subsp bovis AF2122/97
agccgugucaaccggucg

SEQ ID NO: 3039162 - RNA, 19 nt, Mycobacterium bovis subsp bovis AF2122/97
agccgugucaaccggucgg

SEQ ID NO: 3039163 - RNA, 14 nt, Mycobacterium bovis subsp bovis AF2122/97
agccguucccggug

SEQ ID NO: 3039164 - RNA, 18 nt, Mycobacterium bovis subsp bovis AF2122/97
agccguucgcgucgccga

SEQ ID NO: 3039165 - RNA, 17 nt, Mycobacterium bovis subsp bovis AF2122/97
agccguucggcaucugg

SEQ ID NO: 3039166 - RNA, 13 nt, Mycobacterium bovis subsp bovis AF2122/97
agccguucggcua

SEQ ID NO: 3039167 - RNA, 15 nt, Mycobacterium bovis subsp bovis AF2122/97
agccguucgucgcgg

SEQ ID NO: 3039168 - RNA, 15 nt, Mycobacterium bovis subsp bovis AF2122/97
agcgacucgccggcg

SEQ ID NO: 3039169 - RNA, 16 nt, Mycobacterium bovis subsp bovis AF2122/97
agcgacucgccggcga

SEQ ID NO: 3039170 - RNA, 16 nt, Mycobacterium bovis subsp bovis AF2122/97
agcgagaaucacgguc

SEQ ID NO: 3039171 - RNA, 21 nt, Mycobacterium bovis subsp bovis AF2122/97
agcgagacuucgacgcggcga

SEQ ID NO: 3039172 - RNA, 14 nt, Mycobacterium bovis subsp bovis AF2122/97
agcgagcccagcug

SEQ ID NO: 3039173 - RNA, 20 nt, Mycobacterium bovis subsp bovis AF2122/97
agcgagcccagcugcgccga

SEQ ID NO: 3039174 - RNA, 20 nt, Mycobacterium bovis subsp bovis AF2122/97
agcgagcgcaaaucgauugc

SEQ ID NO: 3039175 - RNA, 22 nt, Mycobacterium bovis subsp bovis AF2122/97
agcgagcgcgcguagcggggga

SEQ ID NO: 3039176 - RNA, 15 nt, Mycobacterium bovis subsp bovis AF2122/97
agcgaggagcagggc

SEQ ID NO: 3039177 - RNA, 14 nt, Mycobacterium bovis subsp bovis AF2122/97
agcgaggagcccgg

SEQ ID NO: 3039178 - RNA, 23 nt, Mycobacterium bovis subsp bovis AF2122/97
agcgaguccucgagugccgccgu

SEQ ID NO: 3039179 - RNA, 22 nt, Mycobacterium bovis subsp bovis AF2122/97
agcgagucgacgaacgccucac

SEQ ID NO: 3039180 - RNA, 15 nt, Mycobacterium bovis subsp bovis AF2122/97
agcgagucgacgucg

SEQ ID NO: 3039181 - RNA, 20 nt, Mycobacterium bovis subsp bovis AF2122/97
agcgagucgacgucgaucac

SEQ ID NO: 3039182 - RNA, 22 nt, Mycobacterium bovis subsp bovis AF2122/97
agcgagucgggguacaggcugc

SEQ ID NO: 3039183 - RNA, 22 nt, Mycobacterium bovis subsp bovis AF2122/97
agcgauaucggcggcuuggccg

SEQ ID NO: 3039184 - RNA, 15 nt, Mycobacterium bovis subsp bovis AF2122/97
agcgaucccggcaac

SEQ ID NO: 3039185 - RNA, 14 nt, Mycobacterium bovis subsp bovis AF2122/97
agcgauccgauccg

SEQ ID NO: 3039186 - RNA, 15 nt, Mycobacterium bovis subsp bovis AF2122/97
agcgaucgccggccg

SEQ ID NO: 3039187 - RNA, 14 nt, Mycobacterium bovis subsp bovis AF2122/97
agcgaucgggugca

SEQ ID NO: 3039188 - RNA, 15 nt, Mycobacterium bovis subsp bovis AF2122/97
agcgaucgugcugcc

SEQ ID NO: 3039189 - RNA, 20 nt, Mycobacterium bovis subsp bovis AF2122/97
agcgaucuccgugagccgga

SEQ ID NO: 3039190 - RNA, 21 nt, Mycobacterium bovis subsp bovis AF2122/97
agcgaucuccgugagccggac

SEQ ID NO: 3039191 - RNA, 21 nt, Mycobacterium bovis subsp bovis AF2122/97
agcgaucuugguggccucauc

SEQ ID NO: 3039192 - RNA, 18 nt, Mycobacterium bovis subsp bovis AF2122/97
agcgaugggaacggggug

SEQ ID NO: 3039193 - RNA, 17 nt, Mycobacterium bovis subsp bovis AF2122/97
agcgcaaagcccuccuc

SEQ ID NO: 3039194 - RNA, 12 nt, Mycobacterium bovis subsp bovis AF2122/97
agcgcaacaucg

SEQ ID NO: 3039195 - RNA, 13 nt, Mycobacterium bovis subsp bovis AF2122/97
agcgcaaccgcgc

SEQ ID NO: 3039196 - RNA, 15 nt, Mycobacterium bovis subsp bovis AF2122/97
agcgcaacggccagc

SEQ ID NO: 3039197 - RNA, 18 nt, Mycobacterium bovis subsp bovis AF2122/97
agcgcaacggccagcgcu

SEQ ID NO: 3039198 - RNA, 17 nt, Mycobacterium bovis subsp bovis AF2122/97
agcgcaacucccagcac

SEQ ID NO: 3039199 - RNA, 22 nt, Mycobacterium bovis subsp bovis AF2122/97
agcgcaagguugccaacgccuu

SEQ ID NO: 3039200 - RNA, 18 nt, Mycobacterium bovis subsp bovis AF2122/97
agcgcacaaacgacucgc

SEQ ID NO: 3039201 - RNA, 17 nt, Mycobacterium bovis subsp bovis AF2122/97
agcgcacacuaccgccg

SEQ ID NO: 3039202 - RNA, 20 nt, Mycobacterium bovis subsp bovis AF2122/97
agcgcacccggucggcggca

SEQ ID NO: 3039203 - RNA, 12 nt, Mycobacterium bovis subsp bovis AF2122/97
agcgcaccgcga

SEQ ID NO: 3039204 - RNA, 14 nt, Mycobacterium bovis subsp bovis AF2122/97
agcgcaccgcgaaa

SEQ ID NO: 3039205 - RNA, 19 nt, Mycobacterium bovis subsp bovis AF2122/97
agcgcaccgcugaccgcaa

SEQ ID NO: 3039206 - RNA, 18 nt, Mycobacterium bovis subsp bovis AF2122/97
agcgcacgauagccaccg

SEQ ID NO: 3039207 - RNA, 22 nt, Mycobacterium bovis subsp bovis AF2122/97
agcgcacgauagccaccgacga

SEQ ID NO: 3039208 - RNA, 23 nt, Mycobacterium bovis subsp bovis AF2122/97
agcgcacgauagccaccgacgac

SEQ ID NO: 3039209 - RNA, 14 nt, Mycobacterium bovis subsp bovis AF2122/97
agcgcacgcagccg

SEQ ID NO: 3039210 - RNA, 16 nt, Mycobacterium bovis subsp bovis AF2122/97
agcgcacgcagccgau

SEQ ID NO: 3039211 - RNA, 17 nt, Mycobacterium bovis subsp bovis AF2122/97
agcgcacgcagccgaua

SEQ ID NO: 3039212 - RNA, 13 nt, Mycobacterium bovis subsp bovis AF2122/97
agcgcacgcucgg

SEQ ID NO: 3039213 - RNA, 21 nt, Mycobacterium bovis subsp bovis AF2122/97
agcgcacgcugaguccccagg

SEQ ID NO: 3039214 - RNA, 20 nt, Mycobacterium bovis subsp bovis AF2122/97
agcgcacggaccaucgccag

SEQ ID NO: 3039215 - RNA, 23 nt, Mycobacterium bovis subsp bovis AF2122/97
agcgcacggaccaucgccaggcc

SEQ ID NO: 3039216 - RNA, 15 nt, Mycobacterium bovis subsp bovis AF2122/97
agcgcacugcccggg

SEQ ID NO: 3039217 - RNA, 15 nt, Mycobacterium bovis subsp bovis AF2122/97
agcgcacugccgggu

SEQ ID NO: 3039218 - RNA, 17 nt, Mycobacterium bovis subsp bovis AF2122/97
agcgcacugccgggugg

SEQ ID NO: 3039219 - RNA, 21 nt, Mycobacterium bovis subsp bovis AF2122/97
agcgcagcaacugggcggccu

SEQ ID NO: 3039220 - RNA, 19 nt, Mycobacterium bovis subsp bovis AF2122/97
agcgcagcaucgucgccac

SEQ ID NO: 3039221 - RNA, 21 nt, Mycobacterium bovis subsp bovis AF2122/97
agcgcagcauugaccaaucca

SEQ ID NO: 3039222 - RNA, 14 nt, Mycobacterium bovis subsp bovis AF2122/97
agcgcagccaggcu

SEQ ID NO: 3039223 - RNA, 13 nt, Mycobacterium bovis subsp bovis AF2122/97
agcgcagccgauc

SEQ ID NO: 3039224 - RNA, 18 nt, Mycobacterium bovis subsp bovis AF2122/97
agcgcagccuggucgcgc

SEQ ID NO: 3039225 - RNA, 21 nt, Mycobacterium bovis subsp bovis AF2122/97
agcgcagcguguugagggcug

SEQ ID NO: 3039226 - RNA, 17 nt, Mycobacterium bovis subsp bovis AF2122/97
agcgcaggagcgcgaug

SEQ ID NO: 3039227 - RNA, 20 nt, Mycobacterium bovis subsp bovis AF2122/97
agcgcaggauucugcugacc

SEQ ID NO: 3039228 - RNA, 19 nt, Mycobacterium bovis subsp bovis AF2122/97
agcgcaggguucgucggga

SEQ ID NO: 3039229 - RNA, 20 nt, Mycobacterium bovis subsp bovis AF2122/97
agcgcaggguucgucgggac

SEQ ID NO: 3039230 - RNA, 15 nt, Mycobacterium bovis subsp bovis AF2122/97
agcgcaguaacgucg

SEQ ID NO: 3039231 - RNA, 20 nt, Mycobacterium bovis subsp bovis AF2122/97
agcgcauccaauaucgcuuu

SEQ ID NO: 3039232 - RNA, 18 nt, Mycobacterium bovis subsp bovis AF2122/97
agcgcauccacaaucaca

SEQ ID NO: 3039233 - RNA, 16 nt, Mycobacterium bovis subsp bovis AF2122/97
agcgcaucgagcccgg

SEQ ID NO: 3039234 - RNA, 21 nt, Mycobacterium bovis subsp bovis AF2122/97
agcgcaucgccgcuggccagc

SEQ ID NO: 3039235 - RNA, 23 nt, Mycobacterium bovis subsp bovis AF2122/97
agcgcaucgccgcuggccagcac

SEQ ID NO: 3039236 - RNA, 24 nt, Mycobacterium bovis subsp bovis AF2122/97
agcgcaucgccgcuggccagcaca

SEQ ID NO: 3039237 - RNA, 18 nt, Mycobacterium bovis subsp bovis AF2122/97
agcgcaucggccagcagc

SEQ ID NO: 3039238 - RNA, 22 nt, Mycobacterium bovis subsp bovis AF2122/97
agcgcauuuguugcugcugccg

SEQ ID NO: 3039239 - RNA, 16 nt, Mycobacterium bovis subsp bovis AF2122/97
agcgccaaacccggcg

SEQ ID NO: 3039240 - RNA, 19 nt, Mycobacterium bovis subsp bovis AF2122/97
agcgccaaacccggcgggc

SEQ ID NO: 3039241 - RNA, 22 nt, Mycobacterium bovis subsp bovis AF2122/97
agcgccaaacccggcgggcccg

SEQ ID NO: 3039242 - RNA, 15 nt, Mycobacterium bovis subsp bovis AF2122/97
agcgccaacucgaga

SEQ ID NO: 3039243 - RNA, 15 nt, Mycobacterium bovis subsp bovis AF2122/97
agcgccaagacgucg

SEQ ID NO: 3039244 - RNA, 17 nt, Mycobacterium bovis subsp bovis AF2122/97
agcgccaagacgucggc

SEQ ID NO: 3039245 - RNA, 18 nt, Mycobacterium bovis subsp bovis AF2122/97
agcgccaagacgucggcg

SEQ ID NO: 3039246 - RNA, 16 nt, Mycobacterium bovis subsp bovis AF2122/97
agcgccacauacaccg

SEQ ID NO: 3039247 - RNA, 17 nt, Mycobacterium bovis subsp bovis AF2122/97
agcgccacauacaccgg

SEQ ID NO: 3039248 - RNA, 22 nt, Mycobacterium bovis subsp bovis AF2122/97
agcgccaccacaugcgagucgc

SEQ ID NO: 3039249 - RNA, 13 nt, Mycobacterium bovis subsp bovis AF2122/97
agcgccaccguua

SEQ ID NO: 3039250 - RNA, 12 nt, Mycobacterium bovis subsp bovis AF2122/97
agcgccagcagc

SEQ ID NO: 3039251 - RNA, 13 nt, Mycobacterium bovis subsp bovis AF2122/97
agcgccagcagcc

SEQ ID NO: 3039252 - RNA, 17 nt, Mycobacterium bovis subsp bovis AF2122/97
agcgccagcagccaccc

SEQ ID NO: 3039253 - RNA, 13 nt, Mycobacterium bovis subsp bovis AF2122/97
agcgccagcagcu

SEQ ID NO: 3039254 - RNA, 17 nt, Mycobacterium bovis subsp bovis AF2122/97
agcgcgaccgucagggu

SEQ ID NO: 3039255 - RNA, 23 nt, Mycobacterium bovis subsp bovis AF2122/97
agcgcgacguccaccagccgguu

SEQ ID NO: 3039256 - RNA, 23 nt, Mycobacterium bovis subsp bovis AF2122/97
agcgcgagaucagccggcagcga

SEQ ID NO: 3039257 - RNA, 12 nt, Mycobacterium bovis subsp bovis AF2122/97
agcgcgaucacc

SEQ ID NO: 3039258 - RNA, 13 nt, Mycobacterium bovis subsp bovis AF2122/97
agcgcgaucaccg

SEQ ID NO: 3039259 - RNA, 14 nt, Mycobacterium bovis subsp bovis AF2122/97
agcgcgaucgcggu

SEQ ID NO: 3039260 - RNA, 22 nt, Mycobacterium bovis subsp bovis AF2122/97
agcgcgaucgggccggcgcggu

SEQ ID NO: 3039261 - RNA, 20 nt, Mycobacterium bovis subsp bovis AF2122/97
agcgcgaugaccucggcgau

SEQ ID NO: 3039262 - RNA, 17 nt, Mycobacterium bovis subsp bovis AF2122/97
agcgcgaugcagugcga

SEQ ID NO: 3039263 - RNA, 20 nt, Mycobacterium bovis subsp bovis AF2122/97
agcgcgaugcagugcgaccc

SEQ ID NO: 3039264 - RNA, 20 nt, Mycobacterium bovis subsp bovis AF2122/97
agcgcgcaacguacgcacgc

SEQ ID NO: 3039265 - RNA, 19 nt, Mycobacterium bovis subsp bovis AF2122/97
agcgcgcacacggcuaccc

SEQ ID NO: 3039266 - RNA, 22 nt, Mycobacterium bovis subsp bovis AF2122/97
agcgcgcagcaguuggucgcgg

SEQ ID NO: 3039267 - RNA, 15 nt, Mycobacterium bovis subsp bovis AF2122/97
agcgcgccaaucgcc

SEQ ID NO: 3039268 - RNA, 13 nt, Mycobacterium bovis subsp bovis AF2122/97
agcgcgccaccca

SEQ ID NO: 3039269 - RNA, 17 nt, Mycobacterium bovis subsp bovis AF2122/97
agcgcgccacccagcac

SEQ ID NO: 3039270 - RNA, 22 nt, Mycobacterium bovis subsp bovis AF2122/97
agcgcgccagcuugucgggcac

SEQ ID NO: 3039271 - RNA, 13 nt, Mycobacterium bovis subsp bovis AF2122/97
agcgcgcccgaca

SEQ ID NO: 3039272 - RNA, 18 nt, Mycobacterium bovis subsp bovis AF2122/97
agcgcgcccgacacccgu

SEQ ID NO: 3039273 - RNA, 22 nt, Mycobacterium bovis subsp bovis AF2122/97
agcgcgcccgacacccguaagc

SEQ ID NO: 3039274 - RNA, 22 nt, Mycobacterium bovis subsp bovis AF2122/97
agcgcgcccgcggccgccagcg

SEQ ID NO: 3039275 - RNA, 19 nt, Mycobacterium bovis subsp bovis AF2122/97
agcgcgccgaaggccgcca

SEQ ID NO: 3039276 - RNA, 12 nt, Mycobacterium bovis subsp bovis AF2122/97
agcgcgccggcc

SEQ ID NO: 3039277 - RNA, 15 nt, Mycobacterium bovis subsp bovis AF2122/97
agcgcgccgucgggu

SEQ ID NO: 3039278 - RNA, 16 nt, Mycobacterium bovis subsp bovis AF2122/97
agcgcgccguugccgc

SEQ ID NO: 3039279 - RNA, 17 nt, Mycobacterium bovis subsp bovis AF2122/97
agcgcgccguugccgcc

SEQ ID NO: 3039280 - RNA, 19 nt, Mycobacterium bovis subsp bovis AF2122/97
agcgcgccguugccgccca

SEQ ID NO: 3039281 - RNA, 15 nt, Mycobacterium bovis subsp bovis AF2122/97
agcgcgccucgccca

SEQ ID NO: 3039282 - RNA, 20 nt, Mycobacterium bovis subsp bovis AF2122/97
agcgcgccucgcccagcaag

SEQ ID NO: 3039283 - RNA, 18 nt, Mycobacterium bovis subsp bovis AF2122/97
agcgcgcgcaacccugcc

SEQ ID NO: 3039284 - RNA, 22 nt, Mycobacterium bovis subsp bovis AF2122/97
agcgcgcgcaacccugccgcga

SEQ ID NO: 3039285 - RNA, 15 nt, Mycobacterium bovis subsp bovis AF2122/97
agcgcgcgccgagcc

SEQ ID NO: 3039286 - RNA, 14 nt, Mycobacterium bovis subsp bovis AF2122/97
agcgcgcgccgcag

SEQ ID NO: 3039287 - RNA, 19 nt, Mycobacterium bovis subsp bovis AF2122/97
agcgcgcgccgcuggguga

SEQ ID NO: 3039288 - RNA, 20 nt, Mycobacterium bovis subsp bovis AF2122/97
agcgcgcgcgggugcaaccg

SEQ ID NO: 3039289 - RNA, 22 nt, Mycobacterium bovis subsp bovis AF2122/97
agcgcgcgcgggugcaaccgga

SEQ ID NO: 3039290 - RNA, 21 nt, Mycobacterium bovis subsp bovis AF2122/97
agcgcgcgcggugcggccacu

SEQ ID NO: 3039291 - RNA, 14 nt, Mycobacterium bovis subsp bovis AF2122/97
agcgcgcggguggc

SEQ ID NO: 3039292 - RNA, 16 nt, Mycobacterium bovis subsp bovis AF2122/97
agcgcgcguagcgggg

SEQ ID NO: 3039293 - RNA, 17 nt, Mycobacterium bovis subsp bovis AF2122/97
agcgcgcguagcggggg

SEQ ID NO: 3039294 - RNA, 18 nt, Mycobacterium bovis subsp bovis AF2122/97
agcgcgcguagcggggga

SEQ ID NO: 3039295 - RNA, 16 nt, Mycobacterium bovis subsp bovis AF2122/97
agcgcgcuacgcggcc

SEQ ID NO: 3039296 - RNA, 19 nt, Mycobacterium bovis subsp bovis AF2122/97
agcgcgcugagguggcggu

SEQ ID NO: 3039297 - RNA, 22 nt, Mycobacterium bovis subsp bovis AF2122/97
agcgcgcuggcuacccaccggc

SEQ ID NO: 3039298 - RNA, 24 nt, Mycobacterium bovis subsp bovis AF2122/97
agcgcgcuggcuacccaccggccg

SEQ ID NO: 3039299 - RNA, 20 nt, Mycobacterium bovis subsp bovis AF2122/97
agcgcggcaagcucguccgg

SEQ ID NO: 3039300 - RNA, 21 nt, Mycobacterium bovis subsp bovis AF2122/97
agcgcggcaagcucguccggu

SEQ ID NO: 3039301 - RNA, 12 nt, Mycobacterium bovis subsp bovis AF2122/97
agcgcggcacca

SEQ ID NO: 3039302 - RNA, 15 nt, Mycobacterium bovis subsp bovis AF2122/97
agcgcggcaccagca

SEQ ID NO: 3039303 - RNA, 17 nt, Mycobacterium bovis subsp bovis AF2122/97
agcgcggcaccagcacc

SEQ ID NO: 3039304 - RNA, 13 nt, Mycobacterium bovis subsp bovis AF2122/97
agcgcggcacggu

SEQ ID NO: 3039305 - RNA, 19 nt, Mycobacterium bovis subsp bovis AF2122/97
agcgcggccaauugcgccg

SEQ ID NO: 3039306 - RNA, 20 nt, Mycobacterium bovis subsp bovis AF2122/97
agcgcggccaauugcgccgc

SEQ ID NO: 3039307 - RNA, 22 nt, Mycobacterium bovis subsp bovis AF2122/97
agcgcggccaccagaucgcaca

SEQ ID NO: 3039308 - RNA, 13 nt, Mycobacterium bovis subsp bovis AF2122/97
agcgcggccaccc

SEQ ID NO: 3039309 - RNA, 14 nt, Mycobacterium bovis subsp bovis AF2122/97
agcgcggccacccg

SEQ ID NO: 3039310 - RNA, 18 nt, Mycobacterium bovis subsp bovis AF2122/97
agcgcggccagagccgcg

SEQ ID NO: 3039311 - RNA, 12 nt, Mycobacterium bovis subsp bovis AF2122/97
agcgcggccagc

SEQ ID NO: 3039312 - RNA, 13 nt, Mycobacterium bovis subsp bovis AF2122/97
agcgcggccagca

SEQ ID NO: 3039313 - RNA, 14 nt, Mycobacterium bovis subsp bovis AF2122/97
agcgcggccagcag

SEQ ID NO: 3039314 - RNA, 15 nt, Mycobacterium bovis subsp bovis AF2122/97
agcgcggccagcagc

SEQ ID NO: 3039315 - RNA, 16 nt, Mycobacterium bovis subsp bovis AF2122/97
agcgcggccagcagca

SEQ ID NO: 3039316 - RNA, 17 nt, Mycobacterium bovis subsp bovis AF2122/97
agcgcggccagcagcag

SEQ ID NO: 3039317 - RNA, 15 nt, Mycobacterium bovis subsp bovis AF2122/97
agcgcggccccgaau

SEQ ID NO: 3039318 - RNA, 13 nt, Mycobacterium bovis subsp bovis AF2122/97
agcgcggccggaa

SEQ ID NO: 3039319 - RNA, 17 nt, Mycobacterium bovis subsp bovis AF2122/97
agcgcggccuugguggg

SEQ ID NO: 3039320 - RNA, 18 nt, Mycobacterium bovis subsp bovis AF2122/97
agcgcggcgaagccgggu

SEQ ID NO: 3039321 - RNA, 20 nt, Mycobacterium bovis subsp bovis AF2122/97
agcgcggcgaccuguccggu

SEQ ID NO: 3039322 - RNA, 23 nt, Mycobacterium bovis subsp bovis AF2122/97
agcgcggcgacgauucgagcggu

SEQ ID NO: 3039323 - RNA, 14 nt, Mycobacterium bovis subsp bovis AF2122/97
agcgcggcgagggc

SEQ ID NO: 3039324 - RNA, 14 nt, Mycobacterium bovis subsp bovis AF2122/97
agcgcggcgaucga

SEQ ID NO: 3039325 - RNA, 13 nt, Mycobacterium bovis subsp bovis AF2122/97
agcgcggcgcaca

SEQ ID NO: 3039326 - RNA, 23 nt, Mycobacterium bovis subsp bovis AF2122/97
agcgcggcgcacaacccgucgag

SEQ ID NO: 3039327 - RNA, 20 nt, Mycobacterium bovis subsp bovis AF2122/97
agcgcggcgcccuggccgcc

SEQ ID NO: 3039328 - RNA, 13 nt, Mycobacterium bovis subsp bovis AF2122/97
agcgcggcgcgca

SEQ ID NO: 3039329 - RNA, 18 nt, Mycobacterium bovis subsp bovis AF2122/97
agcgcggcgcgcggggcc

SEQ ID NO: 3039330 - RNA, 16 nt, Mycobacterium bovis subsp bovis AF2122/97
agcgcggcggagccgg

SEQ ID NO: 3039331 - RNA, 19 nt, Mycobacterium bovis subsp bovis AF2122/97
agcgcggcggcaucucgca

SEQ ID NO: 3039332 - RNA, 13 nt, Mycobacterium bovis subsp bovis AF2122/97
agcgcggcgucgc

SEQ ID NO: 3039333 - RNA, 20 nt, Mycobacterium bovis subsp bovis AF2122/97
agcgcggcguguacgucgau

SEQ ID NO: 3039334 - RNA, 20 nt, Mycobacterium bovis subsp bovis AF2122/97
agcgcggcuacggucgcagu

SEQ ID NO: 3039335 - RNA, 22 nt, Mycobacterium bovis subsp bovis AF2122/97
agcgcggcuggggccccgcgcc

SEQ ID NO: 3039336 - RNA, 21 nt, Mycobacterium bovis subsp bovis AF2122/97
agcgcgggacacgucgcgcca

SEQ ID NO: 3039337 - RNA, 14 nt, Mycobacterium bovis subsp bovis AF2122/97
agcgcgggcucaca

SEQ ID NO: 3039338 - RNA, 15 nt, Mycobacterium bovis subsp bovis AF2122/97
agcgcggguggcagc

SEQ ID NO: 3039339 - RNA, 20 nt, Mycobacterium bovis subsp bovis AF2122/97
agcgcggguggcucgggugg

SEQ ID NO: 3039340 - RNA, 16 nt, Mycobacterium bovis subsp bovis AF2122/97
agcggcaccgcgccgg

SEQ ID NO: 3039341 - RNA, 18 nt, Mycobacterium bovis subsp bovis AF2122/97
agcggcaccgcgccggcg

SEQ ID NO: 3039342 - RNA, 18 nt, Mycobacterium bovis subsp bovis AF2122/97
agcggcacgaucggcagu

SEQ ID NO: 3039343 - RNA, 23 nt, Mycobacterium bovis subsp bovis AF2122/97
agcggcagccuggccucgccauu

SEQ ID NO: 3039344 - RNA, 18 nt, Mycobacterium bovis subsp bovis AF2122/97
agcggcagcggcgucguc

SEQ ID NO: 3039345 - RNA, 21 nt, Mycobacterium bovis subsp bovis AF2122/97
agcggcaguuguggcgcugcg

SEQ ID NO: 3039346 - RNA, 20 nt, Mycobacterium bovis subsp bovis AF2122/97
agcggcaucgcgggcggcgc

SEQ ID NO: 3039347 - RNA, 21 nt, Mycobacterium bovis subsp bovis AF2122/97
agcggcaucgcgggcggcgcu

SEQ ID NO: 3039348 - RNA, 16 nt, Mycobacterium bovis subsp bovis AF2122/97
agcggcaucggccagc

SEQ ID NO: 3039349 - RNA, 22 nt, Mycobacterium bovis subsp bovis AF2122/97
agcggcaucggccagccguucu

SEQ ID NO: 3039350 - RNA, 19 nt, Mycobacterium bovis subsp bovis AF2122/97
agcggcaugcagaucucac

SEQ ID NO: 3039351 - RNA, 17 nt, Mycobacterium bovis subsp bovis AF2122/97
agcggcauugccagccg

SEQ ID NO: 3039352 - RNA, 16 nt, Mycobacterium bovis subsp bovis AF2122/97
agcggccaccgaggcg

SEQ ID NO: 3039353 - RNA, 16 nt, Mycobacterium bovis subsp bovis AF2122/97
agcggccaccgccgcc

SEQ ID NO: 3039354 - RNA, 20 nt, Mycobacterium bovis subsp bovis AF2122/97
agcggccaccgccgccgcca

SEQ ID NO: 3039355 - RNA, 21 nt, Mycobacterium bovis subsp bovis AF2122/97
agcggccaccgccgccgccac

SEQ ID NO: 3039356 - RNA, 21 nt, Mycobacterium bovis subsp bovis AF2122/97
agcggccaccguagccagcag

SEQ ID NO: 3039357 - RNA, 13 nt, Mycobacterium bovis subsp bovis AF2122/97
agcggccagcagu

SEQ ID NO: 3039358 - RNA, 18 nt, Mycobacterium bovis subsp bovis AF2122/97
agcggccagcagugcggu

SEQ ID NO: 3039359 - RNA, 19 nt, Mycobacterium bovis subsp bovis AF2122/97
agcggccagcagugcggua

SEQ ID NO: 3039360 - RNA, 12 nt, Mycobacterium bovis subsp bovis AF2122/97
agcggccagcau

SEQ ID NO: 3039361 - RNA, 16 nt, Mycobacterium bovis subsp bovis AF2122/97
agcggccagcccagcc

SEQ ID NO: 3039362 - RNA, 19 nt, Mycobacterium bovis subsp bovis AF2122/97
agcggccagcccagccggg

SEQ ID NO: 3039363 - RNA, 20 nt, Mycobacterium bovis subsp bovis AF2122/97
agcggccagcccagccggga

SEQ ID NO: 3039364 - RNA, 16 nt, Mycobacterium bovis subsp bovis AF2122/97
agcggccaggucgguc

SEQ ID NO: 3039365 - RNA, 20 nt, Mycobacterium bovis subsp bovis AF2122/97
agcggccauaucgcccacca

SEQ ID NO: 3039366 - RNA, 22 nt, Mycobacterium bovis subsp bovis AF2122/97
agcggccauccggcggcggcca

SEQ ID NO: 3039367 - RNA, 23 nt, Mycobacterium bovis subsp bovis AF2122/97
agcggccauccggcggcggccag

SEQ ID NO: 3039368 - RNA, 23 nt, Mycobacterium bovis subsp bovis AF2122/97
agcggccaucgggauggacacca

SEQ ID NO: 3039369 - RNA, 20 nt, Mycobacterium bovis subsp bovis AF2122/97
agcggcccaucgggcgccca

SEQ ID NO: 3039370 - RNA, 19 nt, Mycobacterium bovis subsp bovis AF2122/97
agcggcccgaucaccagcc

SEQ ID NO: 3039371 - RNA, 21 nt, Mycobacterium bovis subsp bovis AF2122/97
agcggcccgaucaccagcccc

SEQ ID NO: 3039372 - RNA, 23 nt, Mycobacterium bovis subsp bovis AF2122/97
agcggcccuucaccagccacccc

SEQ ID NO: 3039373 - RNA, 19 nt, Mycobacterium bovis subsp bovis AF2122/97
agcggcccuucgacgagga

SEQ ID NO: 3039374 - RNA, 23 nt, Mycobacterium bovis subsp bovis AF2122/97
agcggcccuucgacgaggacggc

SEQ ID NO: 3039375 - RNA, 14 nt, Mycobacterium bovis subsp bovis AF2122/97
agcggccgaccgcg

SEQ ID NO: 3039376 - RNA, 15 nt, Mycobacterium bovis subsp bovis AF2122/97
agcggccgaccgcga

SEQ ID NO: 3039377 - RNA, 12 nt, Mycobacterium bovis subsp bovis AF2122/97
agcggccgcagg

SEQ ID NO: 3039378 - RNA, 14 nt, Mycobacterium bovis subsp bovis AF2122/97
agcggccgcaggcg

SEQ ID NO: 3039379 - RNA, 23 nt, Mycobacterium bovis subsp bovis AF2122/97
agcggccgcgauggugcgccggg

SEQ ID NO: 3039380 - RNA, 18 nt, Mycobacterium bovis subsp bovis AF2122/97
agcggccgcgcgcaucgc

SEQ ID NO: 3039381 - RNA, 12 nt, Mycobacterium bovis subsp bovis AF2122/97
agcggccgggac

SEQ ID NO: 3039382 - RNA, 12 nt, Mycobacterium bovis subsp bovis AF2122/97
agcggccgggcg

SEQ ID NO: 3039383 - RNA, 17 nt, Mycobacterium bovis subsp bovis AF2122/97
agcggccgggcggccag

SEQ ID NO: 3039384 - RNA, 19 nt, Mycobacterium bovis subsp bovis AF2122/97
agcggccgggcggccaggc

SEQ ID NO: 3039385 - RNA, 20 nt, Mycobacterium bovis subsp bovis AF2122/97
agcggccgggcggccaggcg

SEQ ID NO: 3039386 - RNA, 19 nt, Mycobacterium bovis subsp bovis AF2122/97
agcggccgguacacgucca

SEQ ID NO: 3039387 - RNA, 14 nt, Mycobacterium bovis subsp bovis AF2122/97
agcggccuccagca

SEQ ID NO: 3039388 - RNA, 16 nt, Mycobacterium bovis subsp bovis AF2122/97
agcggccuccagcacc

SEQ ID NO: 3039389 - RNA, 18 nt, Mycobacterium bovis subsp bovis AF2122/97
agcggccuccagcacccg

SEQ ID NO: 3039390 - RNA, 14 nt, Mycobacterium bovis subsp bovis AF2122/97
agcggccucgggac

SEQ ID NO: 3039391 - RNA, 24 nt, Mycobacterium bovis subsp bovis AF2122/97
agcggccugcucgggggccgacca

SEQ ID NO: 3039392 - RNA, 18 nt, Mycobacterium bovis subsp bovis AF2122/97
agcggcgaccgcggucgc

SEQ ID NO: 3039393 - RNA, 16 nt, Mycobacterium bovis subsp bovis AF2122/97
agcggcgagccaaacu

SEQ ID NO: 3039394 - RNA, 20 nt, Mycobacterium bovis subsp bovis AF2122/97
agcggcgaucggaggcccgc

SEQ ID NO: 3039395 - RNA, 17 nt, Mycobacterium bovis subsp bovis AF2122/97
agcggcgcauaggcggc

SEQ ID NO: 3039396 - RNA, 22 nt, Mycobacterium bovis subsp bovis AF2122/97
agcggcgccaguauggccgcca

SEQ ID NO: 3039397 - RNA, 19 nt, Mycobacterium bovis subsp bovis AF2122/97
agcggcgcccgccaccgga

SEQ ID NO: 3039398 - RNA, 20 nt, Mycobacterium bovis subsp bovis AF2122/97
agcggcgcccgccaccggag

SEQ ID NO: 3039399 - RNA, 21 nt, Mycobacterium bovis subsp bovis AF2122/97
agcggcgccgcccuaaggggc

SEQ ID NO: 3039400 - RNA, 22 nt, Mycobacterium bovis subsp bovis AF2122/97
agcggcgccgccuggacgccgc

SEQ ID NO: 3039401 - RNA, 20 nt, Mycobacterium bovis subsp bovis AF2122/97
agcggcgcgaccgucuggag

SEQ ID NO: 3039402 - RNA, 22 nt, Mycobacterium bovis subsp bovis AF2122/97
agcggcgcgaggaacgccgggg

SEQ ID NO: 3039403 - RNA, 14 nt, Mycobacterium bovis subsp bovis AF2122/97
agcggcgcgggggu

SEQ ID NO: 3039404 - RNA, 18 nt, Mycobacterium bovis subsp bovis AF2122/97
agcggcggcaacccugcc

SEQ ID NO: 3039405 - RNA, 13 nt, Mycobacterium bovis subsp bovis AF2122/97
agcggcggccacg

SEQ ID NO: 3039406 - RNA, 18 nt, Mycobacterium bovis subsp bovis AF2122/97
agcggcggccacggccau

SEQ ID NO: 3039407 - RNA, 12 nt, Mycobacterium bovis subsp bovis AF2122/97
agcggcggcccu

SEQ ID NO: 3039408 - RNA, 21 nt, Mycobacterium bovis subsp bovis AF2122/97
agcggcggcccuaaacaccgc

SEQ ID NO: 3039409 - RNA, 15 nt, Mycobacterium bovis subsp bovis AF2122/97
agcggcggcgacgag

SEQ ID NO: 3039410 - RNA, 17 nt, Mycobacterium bovis subsp bovis AF2122/97
agcggcggcggcggcaa

SEQ ID NO: 3039411 - RNA, 19 nt, Mycobacterium bovis subsp bovis AF2122/97
agcggcgggcgaugacccg

SEQ ID NO: 3039412 - RNA, 19 nt, Mycobacterium bovis subsp bovis AF2122/97
agcggcgggggcgucgccg

SEQ ID NO: 3039413 - RNA, 23 nt, Mycobacterium bovis subsp bovis AF2122/97
agcggcgggggcgucgccgccgg

SEQ ID NO: 3039414 - RNA, 15 nt, Mycobacterium bovis subsp bovis AF2122/97
agcggcgggucccgc

SEQ ID NO: 3039415 - RNA, 12 nt, Mycobacterium bovis subsp bovis AF2122/97
agcggcguuccg

SEQ ID NO: 3039416 - RNA, 17 nt, Mycobacterium bovis subsp bovis AF2122/97
agcggcguucgaugcca

SEQ ID NO: 3039417 - RNA, 22 nt, Mycobacterium bovis subsp bovis AF2122/97
agcggcuccacuuggggcgcca

SEQ ID NO: 3039418 - RNA, 13 nt, Mycobacterium bovis subsp bovis AF2122/97
agcggcuccggga

SEQ ID NO: 3039419 - RNA, 22 nt, Mycobacterium bovis subsp bovis AF2122/97
agcggcucgccuaucgacucag

SEQ ID NO: 3039420 - RNA, 22 nt, Mycobacterium bovis subsp bovis AF2122/97
agcggcucggcgggggaccccg

SEQ ID NO: 3039421 - RNA, 21 nt, Mycobacterium bovis subsp bovis AF2122/97
agcggcucuauccggcgcagg

SEQ ID NO: 3039422 - RNA, 14 nt, Mycobacterium bovis subsp bovis AF2122/97
agcggcugcccgag

SEQ ID NO: 3039423 - RNA, 20 nt, Mycobacterium bovis subsp bovis AF2122/97
agcggcugcccgagaucgcg

SEQ ID NO: 3039424 - RNA, 21 nt, Mycobacterium bovis subsp bovis AF2122/97
agcggcugcccgagaucgcgu

SEQ ID NO: 3039425 - RNA, 17 nt, Mycobacterium bovis subsp bovis AF2122/97
agcggcugcugcgcggu

SEQ ID NO: 3039426 - RNA, 18 nt, Mycobacterium bovis subsp bovis AF2122/97
agcgucaaccacggccgc

SEQ ID NO: 3039427 - RNA, 22 nt, Mycobacterium bovis subsp bovis AF2122/97
agcgucaaccacggccgccgcg

SEQ ID NO: 3039428 - RNA, 12 nt, Mycobacterium bovis subsp bovis AF2122/97
agcgucacccug

SEQ ID NO: 3039429 - RNA, 19 nt, Mycobacterium bovis subsp bovis AF2122/97
agcgucacccugucgcgca

SEQ ID NO: 3039430 - RNA, 23 nt, Mycobacterium bovis subsp bovis AF2122/97
agcgucacccugucgcgcaccgg

SEQ ID NO: 3039431 - RNA, 13 nt, Mycobacterium bovis subsp bovis AF2122/97
agcguccaaccca

SEQ ID NO: 3039432 - RNA, 21 nt, Mycobacterium bovis subsp bovis AF2122/97
agcguccagcgccugcgccca

SEQ ID NO: 3039433 - RNA, 19 nt, Mycobacterium bovis subsp bovis AF2122/97
agcguccauggucgcgcca

SEQ ID NO: 3039434 - RNA, 18 nt, Mycobacterium bovis subsp bovis AF2122/97
agcgucccggucgccaaa

SEQ ID NO: 3039435 - RNA, 16 nt, Mycobacterium bovis subsp bovis AF2122/97
agcguccgcgcccgag

SEQ ID NO: 3039436 - RNA, 16 nt, Mycobacterium bovis subsp bovis AF2122/97
agcguccgguggucag

SEQ ID NO: 3039437 - RNA, 13 nt, Mycobacterium bovis subsp bovis AF2122/97
agcguccuggcgu

SEQ ID NO: 3039438 - RNA, 19 nt, Mycobacterium bovis subsp bovis AF2122/97
agcgucgacacacccaccg

SEQ ID NO: 3039439 - RNA, 22 nt, Mycobacterium bovis subsp bovis AF2122/97
agcgucgaucaccugccagugg

SEQ ID NO: 3039440 - RNA, 17 nt, Mycobacterium bovis subsp bovis AF2122/97
agcgucgaucacgucgu

SEQ ID NO: 3039441 - RNA, 12 nt, Mycobacterium bovis subsp bovis AF2122/97
agcgucgcaccc

SEQ ID NO: 3039442 - RNA, 19 nt, Mycobacterium bovis subsp bovis AF2122/97
agcgucgcacccagggcgu

SEQ ID NO: 3039443 - RNA, 14 nt, Mycobacterium bovis subsp bovis AF2122/97
agcgucgccauucc

SEQ ID NO: 3039444 - RNA, 23 nt, Mycobacterium bovis subsp bovis AF2122/97
agcgucgccuucguaaccacgac

SEQ ID NO: 3039445 - RNA, 18 nt, Mycobacterium bovis subsp bovis AF2122/97
agcgucgcggccacgguc

SEQ ID NO: 3039446 - RNA, 20 nt, Mycobacterium bovis subsp bovis AF2122/97
agcgucgcuaucgugcgccg

SEQ ID NO: 3039447 - RNA, 17 nt, Mycobacterium bovis subsp bovis AF2122/97
agcgucgcugaccgcgu

SEQ ID NO: 3039448 - RNA, 18 nt, Mycobacterium bovis subsp bovis AF2122/97
agcgucgcugcccgcggu

SEQ ID NO: 3039449 - RNA, 19 nt, Mycobacterium bovis subsp bovis AF2122/97
agcgucggcgcaucaccac

SEQ ID NO: 3039450 - RNA, 15 nt, Mycobacterium bovis subsp bovis AF2122/97
agcgucggugccacc

SEQ ID NO: 3039451 - RNA, 17 nt, Mycobacterium bovis subsp bovis AF2122/97
agcgucguaaccgucgc

SEQ ID NO: 3039452 - RNA, 15 nt, Mycobacterium bovis subsp bovis AF2122/97
agcgucguugcucgg

SEQ ID NO: 3039453 - RNA, 19 nt, Mycobacterium bovis subsp bovis AF2122/97
agcgucucgccgggaaaca

SEQ ID NO: 3039454 - RNA, 16 nt, Mycobacterium bovis subsp bovis AF2122/97
agcgucugagcgccgg

SEQ ID NO: 3039455 - RNA, 17 nt, Mycobacterium bovis subsp bovis AF2122/97
agcgucuggccgucgcu

SEQ ID NO: 3039456 - RNA, 19 nt, Mycobacterium bovis subsp bovis AF2122/97
agcgugaaccuggcgacgc

SEQ ID NO: 3039457 - RNA, 22 nt, Mycobacterium bovis subsp bovis AF2122/97
agcgugaaccuuacgacgccgu

SEQ ID NO: 3039458 - RNA, 16 nt, Mycobacterium bovis subsp bovis AF2122/97
agcgugaacugagggc

SEQ ID NO: 3039459 - RNA, 14 nt, Mycobacterium bovis subsp bovis AF2122/97
agcgugaccaccgc

SEQ ID NO: 3039460 - RNA, 19 nt, Mycobacterium bovis subsp bovis AF2122/97
agcgugaccaccgccgaca

SEQ ID NO: 3039461 - RNA, 23 nt, Mycobacterium bovis subsp bovis AF2122/97
agcgugagccaugccgcucggca

SEQ ID NO: 3039462 - RNA, 14 nt, Mycobacterium bovis subsp bovis AF2122/97
agcgugagugcagc

SEQ ID NO: 3039463 - RNA, 17 nt, Mycobacterium bovis subsp bovis AF2122/97
agcgugagugcagcacg

SEQ ID NO: 3039464 - RNA, 22 nt, Mycobacterium bovis subsp bovis AF2122/97
agcgugcagcggcgggcgauga

SEQ ID NO: 3039465 - RNA, 15 nt, Mycobacterium bovis subsp bovis AF2122/97
agcgugcccgccacc

SEQ ID NO: 3039466 - RNA, 22 nt, Mycobacterium bovis subsp bovis AF2122/97
agcgugcccgccaccggcgcga

SEQ ID NO: 3039467 - RNA, 19 nt, Mycobacterium bovis subsp bovis AF2122/97
agcgugccgaacagggagg

SEQ ID NO: 3039468 - RNA, 22 nt, Mycobacterium bovis subsp bovis AF2122/97
agcgugccgcagcggcggcaac

SEQ ID NO: 3039469 - RNA, 15 nt, Mycobacterium bovis subsp bovis AF2122/97
agcgugccugcaguu

SEQ ID NO: 3039470 - RNA, 22 nt, Mycobacterium bovis subsp bovis AF2122/97
agcgugccugcaguucggcgua

SEQ ID NO: 3039471 - RNA, 19 nt, Mycobacterium bovis subsp bovis AF2122/97
agcgugcgcugguggcggc

SEQ ID NO: 3039472 - RNA, 13 nt, Mycobacterium bovis subsp bovis AF2122/97
agcgugcggggcg

SEQ ID NO: 3039473 - RNA, 23 nt, Mycobacterium bovis subsp bovis AF2122/97
agcguggacaucgggcggcaccg

SEQ ID NO: 3039474 - RNA, 23 nt, Mycobacterium bovis subsp bovis AF2122/97
agcguggacguacugucgucgcc

SEQ ID NO: 3039475 - RNA, 15 nt, Mycobacterium bovis subsp bovis AF2122/97
agcguggagaucacg

SEQ ID NO: 3039476 - RNA, 21 nt, Mycobacterium bovis subsp bovis AF2122/97
agcguggagcgcaaguugagc

SEQ ID NO: 3039477 - RNA, 21 nt, Mycobacterium bovis subsp bovis AF2122/97
agcguggccaauccggcggcg

SEQ ID NO: 3039478 - RNA, 17 nt, Mycobacterium bovis subsp bovis AF2122/97
agcguggcgcccgugcc

SEQ ID NO: 3039479 - RNA, 23 nt, Mycobacterium bovis subsp bovis AF2122/97
agcguggcgcccgugccgcccgc

SEQ ID NO: 3039480 - RNA, 12 nt, Mycobacterium bovis subsp bovis AF2122/97
agcguggcuggc

SEQ ID NO: 3039481 - RNA, 16 nt, Mycobacterium bovis subsp bovis AF2122/97
agcgugggcagcgcga

SEQ ID NO: 3039482 - RNA, 15 nt, Mycobacterium bovis subsp bovis AF2122/97
agcgugggcauuccc

SEQ ID NO: 3039483 - RNA, 21 nt, Mycobacterium bovis subsp bovis AF2122/97
agcguggguucgaaucccauc

SEQ ID NO: 3039484 - RNA, 22 nt, Mycobacterium bovis subsp bovis AF2122/97
agcgugguacuuucacgcucgu

SEQ ID NO: 3039485 - RNA, 15 nt, Mycobacterium bovis subsp bovis AF2122/97
agcguggugaagucg

SEQ ID NO: 3039486 - RNA, 20 nt, Mycobacterium bovis subsp bovis AF2122/97
agcguggugaagucggugcc

SEQ ID NO: 3039487 - RNA, 16 nt, Mycobacterium bovis subsp bovis AF2122/97
agcguggugauccggu

SEQ ID NO: 3039488 - RNA, 22 nt, Mycobacterium bovis subsp bovis AF2122/97
agcguggugauccggucuccgc

SEQ ID NO: 3039489 - RNA, 13 nt, Mycobacterium bovis subsp bovis AF2122/97
agcgugucgccga

SEQ ID NO: 3039490 - RNA, 21 nt, Mycobacterium bovis subsp bovis AF2122/97
agcgugucggccggccaggug

SEQ ID NO: 3039491 - RNA, 20 nt, Mycobacterium bovis subsp bovis AF2122/97
agcguguggagcucgcggcg

SEQ ID NO: 3039492 - RNA, 13 nt, Mycobacterium bovis subsp bovis AF2122/97
agcguguggcgca

SEQ ID NO: 3039493 - RNA, 16 nt, Mycobacterium bovis subsp bovis AF2122/97
agcguuaggucgccgg

SEQ ID NO: 3039494 - RNA, 17 nt, Mycobacterium bovis subsp bovis AF2122/97
agcguuaggucgccggc

SEQ ID NO: 3039495 - RNA, 16 nt, Mycobacterium bovis subsp bovis AF2122/97
agcguucccgccggcu

SEQ ID NO: 3039496 - RNA, 18 nt, Mycobacterium bovis subsp bovis AF2122/97
agcguucccgccggcucc

SEQ ID NO: 3039497 - RNA, 17 nt, Mycobacterium bovis subsp bovis AF2122/97
agcguuccgcucgaauc

SEQ ID NO: 3039498 - RNA, 15 nt, Mycobacterium bovis subsp bovis AF2122/97
agcguugaccgcggu

SEQ ID NO: 3039499 - RNA, 16 nt, Mycobacterium bovis subsp bovis AF2122/97
agcguugccaggugcu

SEQ ID NO: 3039500 - RNA, 17 nt, Mycobacterium bovis subsp bovis AF2122/97
agcguuggccgcugucg

SEQ ID NO: 3039501 - RNA, 20 nt, Mycobacterium bovis subsp bovis AF2122/97
agcguuggcuucuucgguca

SEQ ID NO: 3039502 - RNA, 14 nt, Mycobacterium bovis subsp bovis AF2122/97
agcguugucgccca

SEQ ID NO: 3039503 - RNA, 13 nt, Mycobacterium bovis subsp bovis AF2122/97
agcuaacacccga

SEQ ID NO: 3039504 - RNA, 15 nt, Mycobacterium bovis subsp bovis AF2122/97
agcuaacccgccacg

SEQ ID NO: 3039505 - RNA, 19 nt, Mycobacterium bovis subsp bovis AF2122/97
agcuaaugcacgcccaggc

SEQ ID NO: 3039506 - RNA, 21 nt, Mycobacterium bovis subsp bovis AF2122/97
agcuaaugcacgcccaggcga

SEQ ID NO: 3039507 - RNA, 17 nt, Mycobacterium bovis subsp bovis AF2122/97
agcuaccccgacggcga

SEQ ID NO: 3039508 - RNA, 21 nt, Mycobacterium bovis subsp bovis AF2122/97
agcuaccccggcggucaggcu

SEQ ID NO: 3039509 - RNA, 21 nt, Mycobacterium bovis subsp bovis AF2122/97
agcuacgucggcucgucgcuc

SEQ ID NO: 3039510 - RNA, 16 nt, Mycobacterium bovis subsp bovis AF2122/97
agcuacucacggugau

SEQ ID NO: 3039511 - RNA, 21 nt, Mycobacterium bovis subsp bovis AF2122/97
agcuagacccgucaccgccga

SEQ ID NO: 3039512 - RNA, 15 nt, Mycobacterium bovis subsp bovis AF2122/97
agcucgguaggccgg

SEQ ID NO: 3039513 - RNA, 18 nt, Mycobacterium bovis subsp bovis AF2122/97
agcucgguaggccggcaa

SEQ ID NO: 3039514 - RNA, 17 nt, Mycobacterium bovis subsp bovis AF2122/97
agcucggucaccacggc

SEQ ID NO: 3039515 - RNA, 15 nt, Mycobacterium bovis subsp bovis AF2122/97
agcucggucagcguc

SEQ ID NO: 3039516 - RNA, 17 nt, Mycobacterium bovis subsp bovis AF2122/97
agcucggucagcgucag

SEQ ID NO: 3039517 - RNA, 23 nt, Mycobacterium bovis subsp bovis AF2122/97
agcucggucagcgucaggugcgc

SEQ ID NO: 3039518 - RNA, 17 nt, Mycobacterium bovis subsp bovis AF2122/97
agcucggugcacggcgc

SEQ ID NO: 3039519 - RNA, 23 nt, Mycobacterium bovis subsp bovis AF2122/97
agcucggugcuguugcgcggucg

SEQ ID NO: 3039520 - RNA, 18 nt, Mycobacterium bovis subsp bovis AF2122/97
agcucguaggugaagagc

SEQ ID NO: 3039521 - RNA, 20 nt, Mycobacterium bovis subsp bovis AF2122/97
agcucgucgagcgcgucggu

SEQ ID NO: 3039522 - RNA, 12 nt, Mycobacterium bovis subsp bovis AF2122/97
agcucgucgagg

SEQ ID NO: 3039523 - RNA, 14 nt, Mycobacterium bovis subsp bovis AF2122/97
agcucgugaccgcc

SEQ ID NO: 3039524 - RNA, 21 nt, Mycobacterium bovis subsp bovis AF2122/97
agcucguugcuggcggccagc

SEQ ID NO: 3039525 - RNA, 20 nt, Mycobacterium bovis subsp bovis AF2122/97
agcucugcgucgugcccgua

SEQ ID NO: 3039526 - RNA, 22 nt, Mycobacterium bovis subsp bovis AF2122/97
agcucuugcgggcagccgcccg

SEQ ID NO: 3039527 - RNA, 23 nt, Mycobacterium bovis subsp bovis AF2122/97
agcucuugcgggcagccgcccgc

SEQ ID NO: 3039528 - RNA, 20 nt, Mycobacterium bovis subsp bovis AF2122/97
agcugaaaauaggccgggca

SEQ ID NO: 3039529 - RNA, 22 nt, Mycobacterium bovis subsp bovis AF2122/97
agcugaacuacugcgaucgcga

SEQ ID NO: 3039530 - RNA, 21 nt, Mycobacterium bovis subsp bovis AF2122/97
agcugacacccgcagcugugg

SEQ ID NO: 3039531 - RNA, 24 nt, Mycobacterium bovis subsp bovis AF2122/97
agcugacaccgaaccgccgcugcc

SEQ ID NO: 3039532 - RNA, 17 nt, Mycobacterium bovis subsp bovis AF2122/97
agcugaccacgguagac

SEQ ID NO: 3039533 - RNA, 12 nt, Mycobacterium bovis subsp bovis AF2122/97
agcugaccgcca

SEQ ID NO: 3039534 - RNA, 14 nt, Mycobacterium bovis subsp bovis AF2122/97
agcugacgcugcuc

SEQ ID NO: 3039535 - RNA, 23 nt, Mycobacterium bovis subsp bovis AF2122/97
agcugacgugucggcugcuaugg

SEQ ID NO: 3039536 - RNA, 15 nt, Mycobacterium bovis subsp bovis AF2122/97
agcugagcggccagc

SEQ ID NO: 3039537 - RNA, 13 nt, Mycobacterium bovis subsp bovis AF2122/97
agcugagcggccg

SEQ ID NO: 3039538 - RNA, 15 nt, Mycobacterium bovis subsp bovis AF2122/97
agcugagcggccggc

SEQ ID NO: 3039539 - RNA, 17 nt, Mycobacterium bovis subsp bovis AF2122/97
agcugauacgcaugcga

SEQ ID NO: 3039540 - RNA, 13 nt, Mycobacterium bovis subsp bovis AF2122/97
agcugaugccugg

SEQ ID NO: 3039541 - RNA, 20 nt, Mycobacterium bovis subsp bovis AF2122/97
agcugaugccuggucgcggg

SEQ ID NO: 3039542 - RNA, 21 nt, Mycobacterium bovis subsp bovis AF2122/97
agcugauuguguuccaccagc

SEQ ID NO: 3039543 - RNA, 20 nt, Mycobacterium bovis subsp bovis AF2122/97
agcugcaccuccgacggccg

SEQ ID NO: 3039544 - RNA, 21 nt, Mycobacterium bovis subsp bovis AF2122/97
agcugcaccuccgacggccgc

SEQ ID NO: 3039545 - RNA, 16 nt, Mycobacterium bovis subsp bovis AF2122/97
agcugcagcagacccg

SEQ ID NO: 3039546 - RNA, 22 nt, Mycobacterium bovis subsp bovis AF2122/97
agcugcagcagacccgguggcg

SEQ ID NO: 3039547 - RNA, 18 nt, Mycobacterium bovis subsp bovis AF2122/97
agcugccaggcccgugcc

SEQ ID NO: 3039548 - RNA, 21 nt, Mycobacterium bovis subsp bovis AF2122/97
agcugccaggcccgugccugg

SEQ ID NO: 3039549 - RNA, 15 nt, Mycobacterium bovis subsp bovis AF2122/97
agcugccccgccacc

SEQ ID NO: 3039550 - RNA, 23 nt, Mycobacterium bovis subsp bovis AF2122/97
agcugccgaucaauggcaacgaa

SEQ ID NO: 3039551 - RNA, 13 nt, Mycobacterium bovis subsp bovis AF2122/97
agcugccgcggcc

SEQ ID NO: 3039552 - RNA, 16 nt, Mycobacterium bovis subsp bovis AF2122/97
agcugccgcggccggc

SEQ ID NO: 3039553 - RNA, 14 nt, Mycobacterium bovis subsp bovis AF2122/97
agcugccgucgcug

SEQ ID NO: 3039554 - RNA, 13 nt, Mycobacterium bovis subsp bovis AF2122/97
agcugccgucggu

SEQ ID NO: 3039555 - RNA, 17 nt, Mycobacterium bovis subsp bovis AF2122/97
agcugccguuggggugg

SEQ ID NO: 3039556 - RNA, 20 nt, Mycobacterium bovis subsp bovis AF2122/97
agcugcgacgaugccgccug

SEQ ID NO: 3039557 - RNA, 19 nt, Mycobacterium bovis subsp bovis AF2122/97
agcugcgcagcgcaaacau

SEQ ID NO: 3039558 - RNA, 23 nt, Mycobacterium bovis subsp bovis AF2122/97
agcugcgcagcgcaaacaucuug

SEQ ID NO: 3039559 - RNA, 16 nt, Mycobacterium bovis subsp bovis AF2122/97
agcugcgcaucgccac

SEQ ID NO: 3039560 - RNA, 17 nt, Mycobacterium bovis subsp bovis AF2122/97
agcugcgcaucgccacc

SEQ ID NO: 3039561 - RNA, 22 nt, Mycobacterium bovis subsp bovis AF2122/97
agcugcgcaucgccaccaucac

SEQ ID NO: 3039562 - RNA, 14 nt, Mycobacterium bovis subsp bovis AF2122/97
agcugcgcgggcga

SEQ ID NO: 3039563 - RNA, 16 nt, Mycobacterium bovis subsp bovis AF2122/97
agcugcgcgggcgagu

SEQ ID NO: 3039564 - RNA, 23 nt, Mycobacterium bovis subsp bovis AF2122/97
agcugcggaggguucgccgaagc

SEQ ID NO: 3039565 - RNA, 20 nt, Mycobacterium bovis subsp bovis AF2122/97
agcugcggauccaccacgcu

SEQ ID NO: 3039566 - RNA, 23 nt, Mycobacterium bovis subsp bovis AF2122/97
agcugcggauuaagucggcggcc

SEQ ID NO: 3039567 - RNA, 14 nt, Mycobacterium bovis subsp bovis AF2122/97
agcugcggcggcca

SEQ ID NO: 3039568 - RNA, 18 nt, Mycobacterium bovis subsp bovis AF2122/97
agcugcgggucucgccga

SEQ ID NO: 3039569 - RNA, 21 nt, Mycobacterium bovis subsp bovis AF2122/97
agcugcgguaagaaucgaagc

SEQ ID NO: 3039570 - RNA, 18 nt, Mycobacterium bovis subsp bovis AF2122/97
agcugcguccggaaccaa

SEQ ID NO: 3039571 - RNA, 15 nt, Mycobacterium bovis subsp bovis AF2122/97
agcugcuccacccga

SEQ ID NO: 3039572 - RNA, 15 nt, Mycobacterium bovis subsp bovis AF2122/97
agcugcucgagcaga

SEQ ID NO: 3039573 - RNA, 15 nt, Mycobacterium bovis subsp bovis AF2122/97
agcugcucgucggcg

SEQ ID NO: 3039574 - RNA, 17 nt, Mycobacterium bovis subsp bovis AF2122/97
agcugcucgucggcgcc

SEQ ID NO: 3039575 - RNA, 20 nt, Mycobacterium bovis subsp bovis AF2122/97
agcugcucgucggcgccggc

SEQ ID NO: 3039576 - RNA, 21 nt, Mycobacterium bovis subsp bovis AF2122/97
agcugcucgucggcgccggcg

SEQ ID NO: 3039577 - RNA, 15 nt, Mycobacterium bovis subsp bovis AF2122/97
agcugcucgucuugg

SEQ ID NO: 3039578 - RNA, 20 nt, Mycobacterium bovis subsp bovis AF2122/97
agcugcucgucuuggcggcg

SEQ ID NO: 3039579 - RNA, 21 nt, Mycobacterium bovis subsp bovis AF2122/97
agcugcucgucuuggcggcgg

SEQ ID NO: 3039580 - RNA, 17 nt, Mycobacterium bovis subsp bovis AF2122/97
agcugcucuccgucgcg

SEQ ID NO: 3039581 - RNA, 15 nt, Mycobacterium bovis subsp bovis AF2122/97
agcugcuggcgcgcc

SEQ ID NO: 3039582 - RNA, 18 nt, Mycobacterium bovis subsp bovis AF2122/97
agcugcuggcgcgccugu

SEQ ID NO: 3039583 - RNA, 16 nt, Mycobacterium bovis subsp bovis AF2122/97
agcugcuuggcggucu

SEQ ID NO: 3039584 - RNA, 14 nt, Mycobacterium bovis subsp bovis AF2122/97
agcuggaccuccga

SEQ ID NO: 3039585 - RNA, 14 nt, Mycobacterium bovis subsp bovis AF2122/97
agcuggacggccuc

SEQ ID NO: 3039586 - RNA, 15 nt, Mycobacterium bovis subsp bovis AF2122/97
agcuggacggccucc

SEQ ID NO: 3039587 - RNA, 22 nt, Mycobacterium bovis subsp bovis AF2122/97
agcuggacggccuccaucgcga

SEQ ID NO: 3039588 - RNA, 18 nt, Mycobacterium bovis subsp bovis AF2122/97
agcuggcaacgccgcgcc

SEQ ID NO: 3039589 - RNA, 19 nt, Mycobacterium bovis subsp bovis AF2122/97
agcuggcaacgccgcgccg

SEQ ID NO: 3039590 - RNA, 15 nt, Mycobacterium bovis subsp bovis AF2122/97
agcuggccaccgcau

SEQ ID NO: 3039591 - RNA, 20 nt, Mycobacterium bovis subsp bovis AF2122/97
agcuggccaccgcaucgccg

SEQ ID NO: 3039592 - RNA, 12 nt, Mycobacterium bovis subsp bovis AF2122/97
agcuggccaggu

SEQ ID NO: 3039593 - RNA, 14 nt, Mycobacterium bovis subsp bovis AF2122/97
agcuggccgcggcg

SEQ ID NO: 3039594 - RNA, 22 nt, Mycobacterium bovis subsp bovis AF2122/97
agcuggccgcggcgaguacuga

SEQ ID NO: 3039595 - RNA, 16 nt, Mycobacterium bovis subsp bovis AF2122/97
agcuggccgucagcgu

SEQ ID NO: 3039596 - RNA, 21 nt, Mycobacterium bovis subsp bovis AF2122/97
agcuggcgaccuggucgcugg

SEQ ID NO: 3039597 - RNA, 18 nt, Mycobacterium bovis subsp bovis AF2122/97
agcuggcgauacagcgac

SEQ ID NO: 3039598 - RNA, 20 nt, Mycobacterium bovis subsp bovis AF2122/97
aggaacuacccgccagcaaa

SEQ ID NO: 3039599 - RNA, 15 nt, Mycobacterium bovis subsp bovis AF2122/97
aggaacucggaccca

SEQ ID NO: 3039600 - RNA, 18 nt, Mycobacterium bovis subsp bovis AF2122/97
aggaacucggacccaccc

SEQ ID NO: 3039601 - RNA, 23 nt, Mycobacterium bovis subsp bovis AF2122/97
aggaacuggaccggugccagcag

SEQ ID NO: 3039602 - RNA, 14 nt, Mycobacterium bovis subsp bovis AF2122/97
aggaagaagccgaa

SEQ ID NO: 3039603 - RNA, 18 nt, Mycobacterium bovis subsp bovis AF2122/97
aggaagccguuggcgacg

SEQ ID NO: 3039604 - RNA, 17 nt, Mycobacterium bovis subsp bovis AF2122/97
aggaagcggccggugga

SEQ ID NO: 3039605 - RNA, 23 nt, Mycobacterium bovis subsp bovis AF2122/97
aggaagggcuaucguggcggcgu

SEQ ID NO: 3039606 - RNA, 22 nt, Mycobacterium bovis subsp bovis AF2122/97
aggaaggugugcgucuccagcu

SEQ ID NO: 3039607 - RNA, 20 nt, Mycobacterium bovis subsp bovis AF2122/97
aggaaguccagcuggccggg

SEQ ID NO: 3039608 - RNA, 21 nt, Mycobacterium bovis subsp bovis AF2122/97
aggaaguccagcuggccgggu

SEQ ID NO: 3039609 - RNA, 20 nt, Mycobacterium bovis subsp bovis AF2122/97
aggaaucccucggccgcagg

SEQ ID NO: 3039610 - RNA, 22 nt, Mycobacterium bovis subsp bovis AF2122/97
aggaaucccucggccgcaggcu

SEQ ID NO: 3039611 - RNA, 22 nt, Mycobacterium bovis subsp bovis AF2122/97
aggaaucguucgggguggugga

SEQ ID NO: 3039612 - RNA, 16 nt, Mycobacterium bovis subsp bovis AF2122/97
aggaaugccgcgggga

SEQ ID NO: 3039613 - RNA, 14 nt, Mycobacterium bovis subsp bovis AF2122/97
aggacaagugccgg

SEQ ID NO: 3039614 - RNA, 16 nt, Mycobacterium bovis subsp bovis AF2122/97
aggacaauggacacca

SEQ ID NO: 3039615 - RNA, 19 nt, Mycobacterium bovis subsp bovis AF2122/97
aggacaauggacaccaacc

SEQ ID NO: 3039616 - RNA, 20 nt, Mycobacterium bovis subsp bovis AF2122/97
aggacaccaccguggccucg

SEQ ID NO: 3039617 - RNA, 15 nt, Mycobacterium bovis subsp bovis AF2122/97
aggacaccggcacca

SEQ ID NO: 3039618 - RNA, 18 nt, Mycobacterium bovis subsp bovis AF2122/97
aggacaccgucaugccgu

SEQ ID NO: 3039619 - RNA, 23 nt, Mycobacterium bovis subsp bovis AF2122/97
aggacacguggugggcgcagagu

SEQ ID NO: 3039620 - RNA, 16 nt, Mycobacterium bovis subsp bovis AF2122/97
aggacagcagccgccg

SEQ ID NO: 3039621 - RNA, 18 nt, Mycobacterium bovis subsp bovis AF2122/97
aggacagcugguugugcu

SEQ ID NO: 3039622 - RNA, 20 nt, Mycobacterium bovis subsp bovis AF2122/97
aggacagcugguugugcugg

SEQ ID NO: 3039623 - RNA, 15 nt, Mycobacterium bovis subsp bovis AF2122/97
aggacaucacgaagg

SEQ ID NO: 3039624 - RNA, 15 nt, Mycobacterium bovis subsp bovis AF2122/97
aggacauucccgagu

SEQ ID NO: 3039625 - RNA, 15 nt, Mycobacterium bovis subsp bovis AF2122/97
aggaccagcaccgcc

SEQ ID NO: 3039626 - RNA, 15 nt, Mycobacterium bovis subsp bovis AF2122/97
aggaccaucccgccg

SEQ ID NO: 3039627 - RNA, 16 nt, Mycobacterium bovis subsp bovis AF2122/97
aggacccaucgccagc

SEQ ID NO: 3039628 - RNA, 13 nt, Mycobacterium bovis subsp bovis AF2122/97
aggaccgcgccga

SEQ ID NO: 3039629 - RNA, 11 nt, Mycobacterium bovis subsp bovis AF2122/97
aggaccgcucu

SEQ ID NO: 3039630 - RNA, 17 nt, Mycobacterium bovis subsp bovis AF2122/97
aggaccgcucugcggcc

SEQ ID NO: 3039631 - RNA, 20 nt, Mycobacterium bovis subsp bovis AF2122/97
aggaccgcucugcggccacg

SEQ ID NO: 3039632 - RNA, 21 nt, Mycobacterium bovis subsp bovis AF2122/97
aggaccggugggucugcucag

SEQ ID NO: 3039633 - RNA, 23 nt, Mycobacterium bovis subsp bovis AF2122/97
aggaccugcgucaucgcggguga

SEQ ID NO: 3039634 - RNA, 20 nt, Mycobacterium bovis subsp bovis AF2122/97
aggaccuucugucccugcag

SEQ ID NO: 3039635 - RNA, 22 nt, Mycobacterium bovis subsp bovis AF2122/97
aggaccuucugucccugcaguc

SEQ ID NO: 3039636 - RNA, 20 nt, Mycobacterium bovis subsp bovis AF2122/97
aggacgagguucugccgcga

SEQ ID NO: 3039637 - RNA, 15 nt, Mycobacterium bovis subsp bovis AF2122/97
aggacgaguccuagc

SEQ ID NO: 3039638 - RNA, 16 nt, Mycobacterium bovis subsp bovis AF2122/97
aggacgcaccgccagu

SEQ ID NO: 3039639 - RNA, 20 nt, Mycobacterium bovis subsp bovis AF2122/97
aggacgcccacaugcucagg

SEQ ID NO: 3039640 - RNA, 13 nt, Mycobacterium bovis subsp bovis AF2122/97
aggacgccggcgc

SEQ ID NO: 3039641 - RNA, 15 nt, Mycobacterium bovis subsp bovis AF2122/97
aggacgccggcgccg

SEQ ID NO: 3039642 - RNA, 21 nt, Mycobacterium bovis subsp bovis AF2122/97
aggacgcgggcuaucgguuca

SEQ ID NO: 3039643 - RNA, 15 nt, Mycobacterium bovis subsp bovis AF2122/97
aggacggcagccacc

SEQ ID NO: 3039644 - RNA, 16 nt, Mycobacterium bovis subsp bovis AF2122/97
aggacggcagccacca

SEQ ID NO: 3039645 - RNA, 18 nt, Mycobacterium bovis subsp bovis AF2122/97
aggacggcagccaccagc

SEQ ID NO: 3039646 - RNA, 16 nt, Mycobacterium bovis subsp bovis AF2122/97
aggacggcguagacgu

SEQ ID NO: 3039647 - RNA, 18 nt, Mycobacterium bovis subsp bovis AF2122/97
aggacggcuaccaccgca

SEQ ID NO: 3039648 - RNA, 19 nt, Mycobacterium bovis subsp bovis AF2122/97
aggacggcuaccaccgcac

SEQ ID NO: 3039649 - RNA, 18 nt, Mycobacterium bovis subsp bovis AF2122/97
aggacggcugccgucagc

SEQ ID NO: 3039650 - RNA, 13 nt, Mycobacterium bovis subsp bovis AF2122/97
aggacggucgcca

SEQ ID NO: 3039651 - RNA, 12 nt, Mycobacterium bovis subsp bovis AF2122/97
aggacgguucau

SEQ ID NO: 3039652 - RNA, 16 nt, Mycobacterium bovis subsp bovis AF2122/97
aggacguggcgcugga

SEQ ID NO: 3039653 - RNA, 19 nt, Mycobacterium bovis subsp bovis AF2122/97
aggacguuucagccgggug

SEQ ID NO: 3039654 - RNA, 18 nt, Mycobacterium bovis subsp bovis AF2122/97
aggacguuugagacccca

SEQ ID NO: 3039655 - RNA, 20 nt, Mycobacterium bovis subsp bovis AF2122/97
aggacucggacgcgccggcg

SEQ ID NO: 3039656 - RNA, 17 nt, Mycobacterium bovis subsp bovis AF2122/97
aggacugaccgucugcg

SEQ ID NO: 3039657 - RNA, 22 nt, Mycobacterium bovis subsp bovis AF2122/97
aggacugcgccaccggugaggc

SEQ ID NO: 3039658 - RNA, 15 nt, Mycobacterium bovis subsp bovis AF2122/97
aggacuggcaccgcc

SEQ ID NO: 3039659 - RNA, 18 nt, Mycobacterium bovis subsp bovis AF2122/97
aggacuggcaccgccagc

SEQ ID NO: 3039660 - RNA, 23 nt, Mycobacterium bovis subsp bovis AF2122/97
aggacuggcaccgccagccacca

SEQ ID NO: 3039661 - RNA, 13 nt, Mycobacterium bovis subsp bovis AF2122/97
aggagaaccaaac

SEQ ID NO: 3039662 - RNA, 21 nt, Mycobacterium bovis subsp bovis AF2122/97
aggagaucaacauccugggca

SEQ ID NO: 3039663 - RNA, 19 nt, Mycobacterium bovis subsp bovis AF2122/97
aggagaucgaucgacagcg

SEQ ID NO: 3039664 - RNA, 17 nt, Mycobacterium bovis subsp bovis AF2122/97
aggagaugagcaccaaa

SEQ ID NO: 3039665 - RNA, 22 nt, Mycobacterium bovis subsp bovis AF2122/97
aggagccccagguagucgacca

SEQ ID NO: 3039666 - RNA, 12 nt, Mycobacterium bovis subsp bovis AF2122/97
aggagccgggcc

SEQ ID NO: 3039667 - RNA, 14 nt, Mycobacterium bovis subsp bovis AF2122/97
aggagccgucacgc

SEQ ID NO: 3039668 - RNA, 13 nt, Mycobacterium bovis subsp bovis AF2122/97
aggagcgggugca

SEQ ID NO: 3039669 - RNA, 14 nt, Mycobacterium bovis subsp bovis AF2122/97
aggagggccgcgau

SEQ ID NO: 3039670 - RNA, 19 nt, Mycobacterium bovis subsp bovis AF2122/97
aggagggccgcgaucgacg

SEQ ID NO: 3039671 - RNA, 13 nt, Mycobacterium bovis subsp bovis AF2122/97
aggaguggccggg

SEQ ID NO: 3039672 - RNA, 15 nt, Mycobacterium bovis subsp bovis AF2122/97
aggaguggccgggcg

SEQ ID NO: 3039673 - RNA, 18 nt, Mycobacterium bovis subsp bovis AF2122/97
aggagugguugcccgcac

SEQ ID NO: 3039674 - RNA, 16 nt, Mycobacterium bovis subsp bovis AF2122/97
aggaguuugaccaccu

SEQ ID NO: 3039675 - RNA, 12 nt, Mycobacterium bovis subsp bovis AF2122/97
aggaucacgccg

SEQ ID NO: 3039676 - RNA, 17 nt, Mycobacterium bovis subsp bovis AF2122/97
aggaucagaacgcggcc

SEQ ID NO: 3039677 - RNA, 18 nt, Mycobacterium bovis subsp bovis AF2122/97
aggaucagcgcacuggcc

SEQ ID NO: 3039678 - RNA, 20 nt, Mycobacterium bovis subsp bovis AF2122/97
aggaucccgccgcugccgcc

SEQ ID NO: 3039679 - RNA, 18 nt, Mycobacterium bovis subsp bovis AF2122/97
aggauccgaccccgcgcc

SEQ ID NO: 3039680 - RNA, 16 nt, Mycobacterium bovis subsp bovis AF2122/97
aggauccgcugcggcc

SEQ ID NO: 3039681 - RNA, 18 nt, Mycobacterium bovis subsp bovis AF2122/97
aggauccgcugcggcccg

SEQ ID NO: 3039682 - RNA, 19 nt, Mycobacterium bovis subsp bovis AF2122/97
aggauccggcugcggauca

SEQ ID NO: 3039683 - RNA, 18 nt, Mycobacterium bovis subsp bovis AF2122/97
aggaucgcgccuauccaa

SEQ ID NO: 3039684 - RNA, 23 nt, Mycobacterium bovis subsp bovis AF2122/97
aggcccagcaaccgcucggcgau

SEQ ID NO: 3039685 - RNA, 12 nt, Mycobacterium bovis subsp bovis AF2122/97
aggcccagcacg

SEQ ID NO: 3039686 - RNA, 18 nt, Mycobacterium bovis subsp bovis AF2122/97
aggcccagcacggucaac

SEQ ID NO: 3039687 - RNA, 11 nt, Mycobacterium bovis subsp bovis AF2122/97
aggcccagcua

SEQ ID NO: 3039688 - RNA, 12 nt, Mycobacterium bovis subsp bovis AF2122/97
aggcccaugccg

SEQ ID NO: 3039689 - RNA, 20 nt, Mycobacterium bovis subsp bovis AF2122/97
aggccccaccauucgcgggc

SEQ ID NO: 3039690 - RNA, 19 nt, Mycobacterium bovis subsp bovis AF2122/97
aggccccccgcgccugccu

SEQ ID NO: 3039691 - RNA, 13 nt, Mycobacterium bovis subsp bovis AF2122/97
aggccccgccagc

SEQ ID NO: 3039692 - RNA, 18 nt, Mycobacterium bovis subsp bovis AF2122/97
aggccccuggccgccgca

SEQ ID NO: 3039693 - RNA, 14 nt, Mycobacterium bovis subsp bovis AF2122/97
aggcccgcaccgcu

SEQ ID NO: 3039694 - RNA, 19 nt, Mycobacterium bovis subsp bovis AF2122/97
aggcccgcacguuggcggc

SEQ ID NO: 3039695 - RNA, 21 nt, Mycobacterium bovis subsp bovis AF2122/97
aggcccgccacaacggcggcg

SEQ ID NO: 3039696 - RNA, 13 nt, Mycobacterium bovis subsp bovis AF2122/97
aggcccgccagca

SEQ ID NO: 3039697 - RNA, 23 nt, Mycobacterium bovis subsp bovis AF2122/97
aggcccgcgcgagagccuccaug

SEQ ID NO: 3039698 - RNA, 23 nt, Mycobacterium bovis subsp bovis AF2122/97
aggcccgcgguggaccgggcaag

SEQ ID NO: 3039699 - RNA, 23 nt, Mycobacterium bovis subsp bovis AF2122/97
aggcccgggugcuacuggguggg

SEQ ID NO: 3039700 - RNA, 21 nt, Mycobacterium bovis subsp bovis AF2122/97
aggcccggucuuacggucggc

SEQ ID NO: 3039701 - RNA, 18 nt, Mycobacterium bovis subsp bovis AF2122/97
aggcccgguucgaggauc

SEQ ID NO: 3039702 - RNA, 19 nt, Mycobacterium bovis subsp bovis AF2122/97
aggcccguugucgaccgaa

SEQ ID NO: 3039703 - RNA, 16 nt, Mycobacterium bovis subsp bovis AF2122/97
aggcccucgacggcgu

SEQ ID NO: 3039704 - RNA, 19 nt, Mycobacterium bovis subsp bovis AF2122/97
aggcccucgacggcgucga

SEQ ID NO: 3039705 - RNA, 15 nt, Mycobacterium bovis subsp bovis AF2122/97
aggcccugccgacgc

SEQ ID NO: 3039706 - RNA, 16 nt, Mycobacterium bovis subsp bovis AF2122/97
aggcccugcggccacg

SEQ ID NO: 3039707 - RNA, 15 nt, Mycobacterium bovis subsp bovis AF2122/97
aggcccuggccaccc

SEQ ID NO: 3039708 - RNA, 16 nt, Mycobacterium bovis subsp bovis AF2122/97
aggcccuggccaccca

SEQ ID NO: 3039709 - RNA, 17 nt, Mycobacterium bovis subsp bovis AF2122/97
aggcccuggccacccag

SEQ ID NO: 3039710 - RNA, 14 nt, Mycobacterium bovis subsp bovis AF2122/97
aggcccuggccagc

SEQ ID NO: 3039711 - RNA, 19 nt, Mycobacterium bovis subsp bovis AF2122/97
aggcccuggccgcgccggg

SEQ ID NO: 3039712 - RNA, 15 nt, Mycobacterium bovis subsp bovis AF2122/97
aggccgaaauccaga

SEQ ID NO: 3039713 - RNA, 20 nt, Mycobacterium bovis subsp bovis AF2122/97
aggccgaacagccgagccag

SEQ ID NO: 3039714 - RNA, 22 nt, Mycobacterium bovis subsp bovis AF2122/97
aggccgaacagccgagccagca

SEQ ID NO: 3039715 - RNA, 20 nt, Mycobacterium bovis subsp bovis AF2122/97
aggccgaagacgugccggcu

SEQ ID NO: 3039716 - RNA, 20 nt, Mycobacterium bovis subsp bovis AF2122/97
aggccgacaaugucggcgau

SEQ ID NO: 3039717 - RNA, 21 nt, Mycobacterium bovis subsp bovis AF2122/97
aggccgacaaugucggcgaug

SEQ ID NO: 3039718 - RNA, 13 nt, Mycobacterium bovis subsp bovis AF2122/97
aggccgaccagca

SEQ ID NO: 3039719 - RNA, 14 nt, Mycobacterium bovis subsp bovis AF2122/97
aggccgaccgcgca

SEQ ID NO: 3039720 - RNA, 19 nt, Mycobacterium bovis subsp bovis AF2122/97
aggccgaccuguaugccgc

SEQ ID NO: 3039721 - RNA, 19 nt, Mycobacterium bovis subsp bovis AF2122/97
aggccgagcagauacuugu

SEQ ID NO: 3039722 - RNA, 16 nt, Mycobacterium bovis subsp bovis AF2122/97
aggccgagccgcccgc

SEQ ID NO: 3039723 - RNA, 17 nt, Mycobacterium bovis subsp bovis AF2122/97
aggccgaggccgcugcc

SEQ ID NO: 3039724 - RNA, 21 nt, Mycobacterium bovis subsp bovis AF2122/97
aggccgaucagcgcggcgccc

SEQ ID NO: 3039725 - RNA, 16 nt, Mycobacterium bovis subsp bovis AF2122/97
aggccgaugacgaugc

SEQ ID NO: 3039726 - RNA, 22 nt, Mycobacterium bovis subsp bovis AF2122/97
aggccgaugacgaugccgccga

SEQ ID NO: 3039727 - RNA, 23 nt, Mycobacterium bovis subsp bovis AF2122/97
aggccgaugacgaugccgccgaa

SEQ ID NO: 3039728 - RNA, 22 nt, Mycobacterium bovis subsp bovis AF2122/97
aggccgaugugucgaugaggau

SEQ ID NO: 3039729 - RNA, 16 nt, Mycobacterium bovis subsp bovis AF2122/97
aggccgcaauacccga

SEQ ID NO: 3039730 - RNA, 17 nt, Mycobacterium bovis subsp bovis AF2122/97
aggccgcaauacccgag

SEQ ID NO: 3039731 - RNA, 14 nt, Mycobacterium bovis subsp bovis AF2122/97
aggccgcacagcac

SEQ ID NO: 3039732 - RNA, 15 nt, Mycobacterium bovis subsp bovis AF2122/97
aggccgcacagcacc

SEQ ID NO: 3039733 - RNA, 13 nt, Mycobacterium bovis subsp bovis AF2122/97
aggccgcacgucg

SEQ ID NO: 3039734 - RNA, 18 nt, Mycobacterium bovis subsp bovis AF2122/97
aggccgcaugccacggca

SEQ ID NO: 3039735 - RNA, 20 nt, Mycobacterium bovis subsp bovis AF2122/97
aggccgccacaaacccgaug

SEQ ID NO: 3039736 - RNA, 17 nt, Mycobacterium bovis subsp bovis AF2122/97
aggccgccaccgucacc

SEQ ID NO: 3039737 - RNA, 20 nt, Mycobacterium bovis subsp bovis AF2122/97
aggccgccaucgccgccaac

SEQ ID NO: 3039738 - RNA, 21 nt, Mycobacterium bovis subsp bovis AF2122/97
aggccgccaucgccgccaacc

SEQ ID NO: 3039739 - RNA, 12 nt, Mycobacterium bovis subsp bovis AF2122/97
aggccgccgaga

SEQ ID NO: 3039740 - RNA, 17 nt, Mycobacterium bovis subsp bovis AF2122/97
aggccgccgagguguuu

SEQ ID NO: 3039741 - RNA, 10 nt, Mycobacterium bovis subsp bovis AF2122/97
aggccgccgc

SEQ ID NO: 3039742 - RNA, 14 nt, Mycobacterium bovis subsp bovis AF2122/97
aggccgccgccagu

SEQ ID NO: 3039743 - RNA, 13 nt, Mycobacterium bovis subsp bovis AF2122/97
aggccgccgcgcc

SEQ ID NO: 3039744 - RNA, 20 nt, Mycobacterium bovis subsp bovis AF2122/97
aggccgccggacccgucgag

SEQ ID NO: 3039745 - RNA, 15 nt, Mycobacterium bovis subsp bovis AF2122/97
aggccgccggccagc

SEQ ID NO: 3039746 - RNA, 17 nt, Mycobacterium bovis subsp bovis AF2122/97
aggccgcgcggacccag

SEQ ID NO: 3039747 - RNA, 19 nt, Mycobacterium bovis subsp bovis AF2122/97
aggccgcgcggacccagca

SEQ ID NO: 3039748 - RNA, 22 nt, Mycobacterium bovis subsp bovis AF2122/97
aggccgcggcaccuggcuugag

SEQ ID NO: 3039749 - RNA, 12 nt, Mycobacterium bovis subsp bovis AF2122/97
aggccgcgucga

SEQ ID NO: 3039750 - RNA, 23 nt, Mycobacterium bovis subsp bovis AF2122/97
aggccgcguugccggucgcaugg

SEQ ID NO: 3039751 - RNA, 19 nt, Mycobacterium bovis subsp bovis AF2122/97
aggccgcugacacccgcca

SEQ ID NO: 3039752 - RNA, 15 nt, Mycobacterium bovis subsp bovis AF2122/97
aggccgcugccaggg

SEQ ID NO: 3039753 - RNA, 17 nt, Mycobacterium bovis subsp bovis AF2122/97
aggccgcuugccccgcc

SEQ ID NO: 3039754 - RNA, 17 nt, Mycobacterium bovis subsp bovis AF2122/97
aggccggaagauccggg

SEQ ID NO: 3039755 - RNA, 22 nt, Mycobacterium bovis subsp bovis AF2122/97
aggccggacuuuaaaccgaacc

SEQ ID NO: 3039756 - RNA, 17 nt, Mycobacterium bovis subsp bovis AF2122/97
aggccggcaagaccgaa

SEQ ID NO: 3039757 - RNA, 21 nt, Mycobacterium bovis subsp bovis AF2122/97
aggccggcaagaccgaacagc

SEQ ID NO: 3039758 - RNA, 20 nt, Mycobacterium bovis subsp bovis AF2122/97
aggccggcagcuugcagugc

SEQ ID NO: 3039759 - RNA, 20 nt, Mycobacterium bovis subsp bovis AF2122/97
aggccggccaccaccgcgcc

SEQ ID NO: 3039760 - RNA, 14 nt, Mycobacterium bovis subsp bovis AF2122/97
aggccggccaccga

SEQ ID NO: 3039761 - RNA, 21 nt, Mycobacterium bovis subsp bovis AF2122/97
aggccggccaccgagucgauc

SEQ ID NO: 3039762 - RNA, 15 nt, Mycobacterium bovis subsp bovis AF2122/97
aggccggcccgcaac

SEQ ID NO: 3039763 - RNA, 20 nt, Mycobacterium bovis subsp bovis AF2122/97
aggccggccgcgauccagcg

SEQ ID NO: 3039764 - RNA, 22 nt, Mycobacterium bovis subsp bovis AF2122/97
aggccggcgaccgggcccccag

SEQ ID NO: 3039765 - RNA, 12 nt, Mycobacterium bovis subsp bovis AF2122/97
aggccggcggcg

SEQ ID NO: 3039766 - RNA, 13 nt, Mycobacterium bovis subsp bovis AF2122/97
aggccggcggcgg

SEQ ID NO: 3039767 - RNA, 21 nt, Mycobacterium bovis subsp bovis AF2122/97
aggccggcgggcucgcccgcu

SEQ ID NO: 3039768 - RNA, 19 nt, Mycobacterium bovis subsp bovis AF2122/97
aggccggcggucagcagcg

SEQ ID NO: 3039769 - RNA, 15 nt, Mycobacterium bovis subsp bovis AF2122/97
aggccggcgucgauc

SEQ ID NO: 3039770 - RNA, 18 nt, Mycobacterium bovis subsp bovis AF2122/97
aggcgcccaacaggcggg

SEQ ID NO: 3039771 - RNA, 22 nt, Mycobacterium bovis subsp bovis AF2122/97
aggcgcccagcgacaacaccac

SEQ ID NO: 3039772 - RNA, 14 nt, Mycobacterium bovis subsp bovis AF2122/97
aggcgccgcagggc

SEQ ID NO: 3039773 - RNA, 16 nt, Mycobacterium bovis subsp bovis AF2122/97
aggcgccgcagggccg

SEQ ID NO: 3039774 - RNA, 13 nt, Mycobacterium bovis subsp bovis AF2122/97
aggcgccgcgaca

SEQ ID NO: 3039775 - RNA, 13 nt, Mycobacterium bovis subsp bovis AF2122/97
aggcgccgucucg

SEQ ID NO: 3039776 - RNA, 17 nt, Mycobacterium bovis subsp bovis AF2122/97
aggcgccgucucgcggu

SEQ ID NO: 3039777 - RNA, 19 nt, Mycobacterium bovis subsp bovis AF2122/97
aggcgcgaucgcgcccgcu

SEQ ID NO: 3039778 - RNA, 15 nt, Mycobacterium bovis subsp bovis AF2122/97
aggcgcgcaccaccg

SEQ ID NO: 3039779 - RNA, 18 nt, Mycobacterium bovis subsp bovis AF2122/97
aggcgcgcaccaccgcgg

SEQ ID NO: 3039780 - RNA, 16 nt, Mycobacterium bovis subsp bovis AF2122/97
aggcgcggucaccgcg

SEQ ID NO: 3039781 - RNA, 20 nt, Mycobacterium bovis subsp bovis AF2122/97
aggcgcucagcgcggccacg

SEQ ID NO: 3039782 - RNA, 14 nt, Mycobacterium bovis subsp bovis AF2122/97
aggcgcugaacgcg

SEQ ID NO: 3039783 - RNA, 18 nt, Mycobacterium bovis subsp bovis AF2122/97
aggcgcugaacgcgagca

SEQ ID NO: 3039784 - RNA, 22 nt, Mycobacterium bovis subsp bovis AF2122/97
aggcgcugaagaucaacaggcg

SEQ ID NO: 3039785 - RNA, 13 nt, Mycobacterium bovis subsp bovis AF2122/97
aggcgcuucgcca

SEQ ID NO: 3039786 - RNA, 20 nt, Mycobacterium bovis subsp bovis AF2122/97
aggcgcuucgccacaccaug

SEQ ID NO: 3039787 - RNA, 15 nt, Mycobacterium bovis subsp bovis AF2122/97
aggcggaccaggccg

SEQ ID NO: 3039788 - RNA, 17 nt, Mycobacterium bovis subsp bovis AF2122/97
aggcggacgccgcgccg

SEQ ID NO: 3039789 - RNA, 13 nt, Mycobacterium bovis subsp bovis AF2122/97
aggcggccagcau

SEQ ID NO: 3039790 - RNA, 14 nt, Mycobacterium bovis subsp bovis AF2122/97
aggcggccagcgcg

SEQ ID NO: 3039791 - RNA, 15 nt, Mycobacterium bovis subsp bovis AF2122/97
aggcggccagcgcgc

SEQ ID NO: 3039792 - RNA, 17 nt, Mycobacterium bovis subsp bovis AF2122/97
aggcggccaggugcagg

SEQ ID NO: 3039793 - RNA, 13 nt, Mycobacterium bovis subsp bovis AF2122/97
aggcggcccccgg

SEQ ID NO: 3039794 - RNA, 17 nt, Mycobacterium bovis subsp bovis AF2122/97
aggcggcccccggcagc

SEQ ID NO: 3039795 - RNA, 13 nt, Mycobacterium bovis subsp bovis AF2122/97
aggcggccgccgg

SEQ ID NO: 3039796 - RNA, 15 nt, Mycobacterium bovis subsp bovis AF2122/97
aggcggccgccggga

SEQ ID NO: 3039797 - RNA, 15 nt, Mycobacterium bovis subsp bovis AF2122/97
aggcggccgucgucg

SEQ ID NO: 3039798 - RNA, 16 nt, Mycobacterium bovis subsp bovis AF2122/97
aggcggccgucgucgg

SEQ ID NO: 3039799 - RNA, 19 nt, Mycobacterium bovis subsp bovis AF2122/97
aggcggcgacgaccgucgg

SEQ ID NO: 3039800 - RNA, 14 nt, Mycobacterium bovis subsp bovis AF2122/97
aggcggcgccgcac

SEQ ID NO: 3039801 - RNA, 16 nt, Mycobacterium bovis subsp bovis AF2122/97
aggcggcgccgcaccc

SEQ ID NO: 3039802 - RNA, 21 nt, Mycobacterium bovis subsp bovis AF2122/97
aggcggcgcgggucggcgacc

SEQ ID NO: 3039803 - RNA, 16 nt, Mycobacterium bovis subsp bovis AF2122/97
aggcggcggacccgcu

SEQ ID NO: 3039804 - RNA, 14 nt, Mycobacterium bovis subsp bovis AF2122/97
aggcggcggccagc

SEQ ID NO: 3039805 - RNA, 13 nt, Mycobacterium bovis subsp bovis AF2122/97
aggcggcggcccg

SEQ ID NO: 3039806 - RNA, 15 nt, Mycobacterium bovis subsp bovis AF2122/97
aggcggcggccuggc

SEQ ID NO: 3039807 - RNA, 20 nt, Mycobacterium bovis subsp bovis AF2122/97
aggcggcgucgagcaccucc

SEQ ID NO: 3039808 - RNA, 13 nt, Mycobacterium bovis subsp bovis AF2122/97
aggcggcugaacg

SEQ ID NO: 3039809 - RNA, 18 nt, Mycobacterium bovis subsp bovis AF2122/97
aggcggcugaacggcagc

SEQ ID NO: 3039810 - RNA, 20 nt, Mycobacterium bovis subsp bovis AF2122/97
aggcggcugaacggcagccg

SEQ ID NO: 3039811 - RNA, 14 nt, Mycobacterium bovis subsp bovis AF2122/97
aggcggcuggcggu

SEQ ID NO: 3039812 - RNA, 21 nt, Mycobacterium bovis subsp bovis AF2122/97
aggcggcuugaucagccgcca

SEQ ID NO: 3039813 - RNA, 21 nt, Mycobacterium bovis subsp bovis AF2122/97
aggcgggaaaauauaugcgca

SEQ ID NO: 3039814 - RNA, 16 nt, Mycobacterium bovis subsp bovis AF2122/97
aggcgggggagcccag

SEQ ID NO: 3039815 - RNA, 20 nt, Mycobacterium bovis subsp bovis AF2122/97
aggcgguacgggucgccgga

SEQ ID NO: 3039816 - RNA, 20 nt, Mycobacterium bovis subsp bovis AF2122/97
aggcgguaguggcgaucugc

SEQ ID NO: 3039817 - RNA, 11 nt, Mycobacterium bovis subsp bovis AF2122/97
aggcggucacc

SEQ ID NO: 3039818 - RNA, 16 nt, Mycobacterium bovis subsp bovis AF2122/97
aggcggucaccaccgu

SEQ ID NO: 3039819 - RNA, 20 nt, Mycobacterium bovis subsp bovis AF2122/97
aggcggucaccaccguggcg

SEQ ID NO: 3039820 - RNA, 15 nt, Mycobacterium bovis subsp bovis AF2122/97
aggcggucgccgaau

SEQ ID NO: 3039821 - RNA, 13 nt, Mycobacterium bovis subsp bovis AF2122/97
aggcggugacccg

SEQ ID NO: 3039822 - RNA, 15 nt, Mycobacterium bovis subsp bovis AF2122/97
aggcggugacccguu

SEQ ID NO: 3039823 - RNA, 18 nt, Mycobacterium bovis subsp bovis AF2122/97
aggcguaaucaagcagcg

SEQ ID NO: 3039824 - RNA, 21 nt, Mycobacterium bovis subsp bovis AF2122/97
aggcguacaccagggugccgg

SEQ ID NO: 3039825 - RNA, 15 nt, Mycobacterium bovis subsp bovis AF2122/97
aggcguccaucagag

SEQ ID NO: 3039826 - RNA, 14 nt, Mycobacterium bovis subsp bovis AF2122/97
aggcgucccagccg

SEQ ID NO: 3039827 - RNA, 14 nt, Mycobacterium bovis subsp bovis AF2122/97
aggcguccgagcgc

SEQ ID NO: 3039828 - RNA, 16 nt, Mycobacterium bovis subsp bovis AF2122/97
aggcgugcacagguca

SEQ ID NO: 3039829 - RNA, 18 nt, Mycobacterium bovis subsp bovis AF2122/97
aggcgugcacugaccgcg

SEQ ID NO: 3039830 - RNA, 19 nt, Mycobacterium bovis subsp bovis AF2122/97
aggcgugcacugaccgcgg

SEQ ID NO: 3039831 - RNA, 13 nt, Mycobacterium bovis subsp bovis AF2122/97
aggcgugcaucgc

SEQ ID NO: 3039832 - RNA, 17 nt, Mycobacterium bovis subsp bovis AF2122/97
aggcgugcuugaccgcc

SEQ ID NO: 3039833 - RNA, 18 nt, Mycobacterium bovis subsp bovis AF2122/97
aggcgugucgucgcggcc

SEQ ID NO: 3039834 - RNA, 18 nt, Mycobacterium bovis subsp bovis AF2122/97
aggcguuggaucccagcc

SEQ ID NO: 3039835 - RNA, 14 nt, Mycobacterium bovis subsp bovis AF2122/97
aggcguuuccgcug

SEQ ID NO: 3039836 - RNA, 22 nt, Mycobacterium bovis subsp bovis AF2122/97
aggcguuuggcgugccgucgcc

SEQ ID NO: 3039837 - RNA, 15 nt, Mycobacterium bovis subsp bovis AF2122/97
aggcuaaucagccag

SEQ ID NO: 3039838 - RNA, 15 nt, Mycobacterium bovis subsp bovis AF2122/97
aggcucauccgccgg

SEQ ID NO: 3039839 - RNA, 23 nt, Mycobacterium bovis subsp bovis AF2122/97
aggcucauccgccgggccaggcc

SEQ ID NO: 3039840 - RNA, 22 nt, Mycobacterium bovis subsp bovis AF2122/97
aggcuccaagcaauuccaccgc

SEQ ID NO: 3039841 - RNA, 16 nt, Mycobacterium bovis subsp bovis AF2122/97
aggcucccccaccagg

SEQ ID NO: 3039842 - RNA, 13 nt, Mycobacterium bovis subsp bovis AF2122/97
aggcuccggccgg

SEQ ID NO: 3039843 - RNA, 18 nt, Mycobacterium bovis subsp bovis AF2122/97
aggcuccggccggccagc

SEQ ID NO: 3039844 - RNA, 21 nt, Mycobacterium bovis subsp bovis AF2122/97
aggcucgagguguagcccucc

SEQ ID NO: 3039845 - RNA, 20 nt, Mycobacterium bovis subsp bovis AF2122/97
aggcucgccaguucgcgcca

SEQ ID NO: 3039846 - RNA, 18 nt, Mycobacterium bovis subsp bovis AF2122/97
aggcucgcguggccgccg

SEQ ID NO: 3039847 - RNA, 19 nt, Mycobacterium bovis subsp bovis AF2122/97
aggcucgcguggccgccgg

SEQ ID NO: 3039848 - RNA, 13 nt, Mycobacterium bovis subsp bovis AF2122/97
aggcucgggcaag

SEQ ID NO: 3039849 - RNA, 16 nt, Mycobacterium bovis subsp bovis AF2122/97
aggcucggucggcagc

SEQ ID NO: 3039850 - RNA, 17 nt, Mycobacterium bovis subsp bovis AF2122/97
aggcugaccguggcgcc

SEQ ID NO: 3039851 - RNA, 19 nt, Mycobacterium bovis subsp bovis AF2122/97
aggcugaccguggcgccgg

SEQ ID NO: 3039852 - RNA, 22 nt, Mycobacterium bovis subsp bovis AF2122/97
aggcugaccguggcgccggucg

SEQ ID NO: 3039853 - RNA, 15 nt, Mycobacterium bovis subsp bovis AF2122/97
aggcugaucccgaug

SEQ ID NO: 3039854 - RNA, 14 nt, Mycobacterium bovis subsp bovis AF2122/97
aggcugcagugccg

SEQ ID NO: 3039855 - RNA, 21 nt, Mycobacterium bovis subsp bovis AF2122/97
aggcugcagugccgcacccag

SEQ ID NO: 3039856 - RNA, 23 nt, Mycobacterium bovis subsp bovis AF2122/97
aggcugccgaaguugaagaagcc

SEQ ID NO: 3039857 - RNA, 15 nt, Mycobacterium bovis subsp bovis AF2122/97
agggcgacauugcga

SEQ ID NO: 3039858 - RNA, 21 nt, Mycobacterium bovis subsp bovis AF2122/97
agggcgacgagaucugcgaug

SEQ ID NO: 3039859 - RNA, 18 nt, Mycobacterium bovis subsp bovis AF2122/97
agggcgauuuccaucgcg

SEQ ID NO: 3039860 - RNA, 21 nt, Mycobacterium bovis subsp bovis AF2122/97
agggcgauuuccaucgcgacc

SEQ ID NO: 3039861 - RNA, 22 nt, Mycobacterium bovis subsp bovis AF2122/97
agggcgauuuccaucgcgaccu

SEQ ID NO: 3039862 - RNA, 18 nt, Mycobacterium bovis subsp bovis AF2122/97
agggcgccacugaccgcg

SEQ ID NO: 3039863 - RNA, 21 nt, Mycobacterium bovis subsp bovis AF2122/97
agggcgccacugaccgcgauc

SEQ ID NO: 3039864 - RNA, 12 nt, Mycobacterium bovis subsp bovis AF2122/97
agggcgcccgcc

SEQ ID NO: 3039865 - RNA, 14 nt, Mycobacterium bovis subsp bovis AF2122/97
agggcgcccgcccc

SEQ ID NO: 3039866 - RNA, 12 nt, Mycobacterium bovis subsp bovis AF2122/97
agggcgccgaau

SEQ ID NO: 3039867 - RNA, 19 nt, Mycobacterium bovis subsp bovis AF2122/97
agggcgccgacgacuccgg

SEQ ID NO: 3039868 - RNA, 13 nt, Mycobacterium bovis subsp bovis AF2122/97
agggcgccgcgcg

SEQ ID NO: 3039869 - RNA, 20 nt, Mycobacterium bovis subsp bovis AF2122/97
agggcgccgggggcgccgcc

SEQ ID NO: 3039870 - RNA, 22 nt, Mycobacterium bovis subsp bovis AF2122/97
agggcgcgagcagacgcagaau

SEQ ID NO: 3039871 - RNA, 16 nt, Mycobacterium bovis subsp bovis AF2122/97
agggcgcgcaucugcu

SEQ ID NO: 3039872 - RNA, 23 nt, Mycobacterium bovis subsp bovis AF2122/97
agggcggaaaaucggcuggcccg

SEQ ID NO: 3039873 - RNA, 18 nt, Mycobacterium bovis subsp bovis AF2122/97
agggcggccuccccgacc

SEQ ID NO: 3039874 - RNA, 22 nt, Mycobacterium bovis subsp bovis AF2122/97
agggcggcgaccucggcggcgg

SEQ ID NO: 3039875 - RNA, 14 nt, Mycobacterium bovis subsp bovis AF2122/97
agggcggcggcgcg

SEQ ID NO: 3039876 - RNA, 19 nt, Mycobacterium bovis subsp bovis AF2122/97
agggcggcguugagcuggc

SEQ ID NO: 3039877 - RNA, 15 nt, Mycobacterium bovis subsp bovis AF2122/97
agggcggucagcggc

SEQ ID NO: 3039878 - RNA, 20 nt, Mycobacterium bovis subsp bovis AF2122/97
agggcgucgaccgcggcccg

SEQ ID NO: 3039879 - RNA, 14 nt, Mycobacterium bovis subsp bovis AF2122/97
agggcgucgccgcc

SEQ ID NO: 3039880 - RNA, 15 nt, Mycobacterium bovis subsp bovis AF2122/97
agggcgucgccgccg

SEQ ID NO: 3039881 - RNA, 15 nt, Mycobacterium bovis subsp bovis AF2122/97
agggcguuggcggcu

SEQ ID NO: 3039882 - RNA, 22 nt, Mycobacterium bovis subsp bovis AF2122/97
agggcguuggcggcuucgcccc

SEQ ID NO: 3039883 - RNA, 20 nt, Mycobacterium bovis subsp bovis AF2122/97
agggcuaccggcgccgcgcg

SEQ ID NO: 3039884 - RNA, 15 nt, Mycobacterium bovis subsp bovis AF2122/97
agggcucggcggccc

SEQ ID NO: 3039885 - RNA, 16 nt, Mycobacterium bovis subsp bovis AF2122/97
agggcucggcggcccg

SEQ ID NO: 3039886 - RNA, 21 nt, Mycobacterium bovis subsp bovis AF2122/97
agggcugacgggaugguuccg

SEQ ID NO: 3039887 - RNA, 13 nt, Mycobacterium bovis subsp bovis AF2122/97
agggcugcuccug

SEQ ID NO: 3039888 - RNA, 21 nt, Mycobacterium bovis subsp bovis AF2122/97
agggcugguaucgagcacccc

SEQ ID NO: 3039889 - RNA, 23 nt, Mycobacterium bovis subsp bovis AF2122/97
agggcuggucuacccgcggcgcg

SEQ ID NO: 3039890 - RNA, 19 nt, Mycobacterium bovis subsp bovis AF2122/97
agggcuguugacgccacga

SEQ ID NO: 3039891 - RNA, 20 nt, Mycobacterium bovis subsp bovis AF2122/97
agggcuguugacgccacgac

SEQ ID NO: 3039892 - RNA, 14 nt, Mycobacterium bovis subsp bovis AF2122/97
agggcuugcaccug

SEQ ID NO: 3039893 - RNA, 19 nt, Mycobacterium bovis subsp bovis AF2122/97
agggcuugcaccugcaacc

SEQ ID NO: 3039894 - RNA, 17 nt, Mycobacterium bovis subsp bovis AF2122/97
agggcuugucgccggca

SEQ ID NO: 3039895 - RNA, 18 nt, Mycobacterium bovis subsp bovis AF2122/97
agggcuugucgccggcau

SEQ ID NO: 3039896 - RNA, 21 nt, Mycobacterium bovis subsp bovis AF2122/97
agggcuuucgcuuccugggca

SEQ ID NO: 3039897 - RNA, 20 nt, Mycobacterium bovis subsp bovis AF2122/97
aggggacccagcggcggucu

SEQ ID NO: 3039898 - RNA, 15 nt, Mycobacterium bovis subsp bovis AF2122/97
aggggacccggggcc

SEQ ID NO: 3039899 - RNA, 14 nt, Mycobacterium bovis subsp bovis AF2122/97
aggggacgggcggc

SEQ ID NO: 3039900 - RNA, 22 nt, Mycobacterium bovis subsp bovis AF2122/97
aggggaguugcgacgauacacg

SEQ ID NO: 3039901 - RNA, 20 nt, Mycobacterium bovis subsp bovis AF2122/97
aggggaucguccggccgggg

SEQ ID NO: 3039902 - RNA, 15 nt, Mycobacterium bovis subsp bovis AF2122/97
aggggaucugagugg

SEQ ID NO: 3039903 - RNA, 18 nt, Mycobacterium bovis subsp bovis AF2122/97
aggggaucugaguggacg

SEQ ID NO: 3039904 - RNA, 14 nt, Mycobacterium bovis subsp bovis AF2122/97
aggggcaacagggg

SEQ ID NO: 3039905 - RNA, 14 nt, Mycobacterium bovis subsp bovis AF2122/97
aggggcaccagcga

SEQ ID NO: 3039906 - RNA, 17 nt, Mycobacterium bovis subsp bovis AF2122/97
aggggcagcgcggccac

SEQ ID NO: 3039907 - RNA, 18 nt, Mycobacterium bovis subsp bovis AF2122/97
aggggcgcuuccguggcc

SEQ ID NO: 3039908 - RNA, 23 nt, Mycobacterium bovis subsp bovis AF2122/97
aggggcgucgcaacgcgaucacc

SEQ ID NO: 3039909 - RNA, 18 nt, Mycobacterium bovis subsp bovis AF2122/97
aggggcucagcgguggcg

SEQ ID NO: 3039910 - RNA, 19 nt, Mycobacterium bovis subsp bovis AF2122/97
aggggcuuuugcgucugcu

SEQ ID NO: 3039911 - RNA, 22 nt, Mycobacterium bovis subsp bovis AF2122/97
aggggcuuuugcgucugcucgc

SEQ ID NO: 3039912 - RNA, 16 nt, Mycobacterium bovis subsp bovis AF2122/97
agggggcaagcuccag

SEQ ID NO: 3039913 - RNA, 15 nt, Mycobacterium bovis subsp bovis AF2122/97
agggggucgagcgcu

SEQ ID NO: 3039914 - RNA, 20 nt, Mycobacterium bovis subsp bovis AF2122/97
agggguggcgcgggccggcg

SEQ ID NO: 3039915 - RNA, 17 nt, Mycobacterium bovis subsp bovis AF2122/97
aggguaagaguucgcgc

SEQ ID NO: 3039916 - RNA, 23 nt, Mycobacterium bovis subsp bovis AF2122/97
aggguagacggggcgagcaugcc

SEQ ID NO: 3039917 - RNA, 16 nt, Mycobacterium bovis subsp bovis AF2122/97
agggucacaaacccag

SEQ ID NO: 3039918 - RNA, 15 nt, Mycobacterium bovis subsp bovis AF2122/97
agggucaucgccagc

SEQ ID NO: 3039919 - RNA, 16 nt, Mycobacterium bovis subsp bovis AF2122/97
agggucaugucgauca

SEQ ID NO: 3039920 - RNA, 19 nt, Mycobacterium bovis subsp bovis AF2122/97
agggucgaguucgcagucg

SEQ ID NO: 3039921 - RNA, 20 nt, Mycobacterium bovis subsp bovis AF2122/97
agggucgaguucgcagucga

SEQ ID NO: 3039922 - RNA, 18 nt, Mycobacterium bovis subsp bovis AF2122/97
agggucgaugucgucgac

SEQ ID NO: 3039923 - RNA, 19 nt, Mycobacterium bovis subsp bovis AF2122/97
agggucugcgccgccggcg

SEQ ID NO: 3039924 - RNA, 22 nt, Mycobacterium bovis subsp bovis AF2122/97
agggucugcucauccgggugcu

SEQ ID NO: 3039925 - RNA, 18 nt, Mycobacterium bovis subsp bovis AF2122/97
agggugaaguggcgcagc

SEQ ID NO: 3039926 - RNA, 14 nt, Mycobacterium bovis subsp bovis AF2122/97
agggugagcggcau

SEQ ID NO: 3039927 - RNA, 13 nt, Mycobacterium bovis subsp bovis AF2122/97
agggugcccgcgu

SEQ ID NO: 3039928 - RNA, 16 nt, Mycobacterium bovis subsp bovis AF2122/97
agggugccggcgguga

SEQ ID NO: 3039929 - RNA, 15 nt, Mycobacterium bovis subsp bovis AF2122/97
agggugccgucgggu

SEQ ID NO: 3039930 - RNA, 17 nt, Mycobacterium bovis subsp bovis AF2122/97
agggugcguuggaugaa

SEQ ID NO: 3039931 - RNA, 17 nt, Mycobacterium bovis subsp bovis AF2122/97
agggugcucgucaccaa

SEQ ID NO: 3039932 - RNA, 14 nt, Mycobacterium bovis subsp bovis AF2122/97
aggguggaccgguc

SEQ ID NO: 3039933 - RNA, 12 nt, Mycobacterium bovis subsp bovis AF2122/97
aggguggccggu

SEQ ID NO: 3039934 - RNA, 13 nt, Mycobacterium bovis subsp bovis AF2122/97
aggguggccgguc

SEQ ID NO: 3039935 - RNA, 16 nt, Mycobacterium bovis subsp bovis AF2122/97
aggguggcgcgguacc

SEQ ID NO: 3039936 - RNA, 15 nt, Mycobacterium bovis subsp bovis AF2122/97
aggguggggccggcg

SEQ ID NO: 3039937 - RNA, 18 nt, Mycobacterium bovis subsp bovis AF2122/97
aggguguauggccaccac

SEQ ID NO: 3039938 - RNA, 23 nt, Mycobacterium bovis subsp bovis AF2122/97
agggugucgaagagcaggcccau

SEQ ID NO: 3039939 - RNA, 14 nt, Mycobacterium bovis subsp bovis AF2122/97
agggugugcgucug

SEQ ID NO: 3039940 - RNA, 13 nt, Mycobacterium bovis subsp bovis AF2122/97
aggguguugcggc

SEQ ID NO: 3039941 - RNA, 14 nt, Mycobacterium bovis subsp bovis AF2122/97
aggguugccgccga

SEQ ID NO: 3039942 - RNA, 16 nt, Mycobacterium bovis subsp bovis AF2122/97
aggguuuccaagucgg

SEQ ID NO: 3039943 - RNA, 18 nt, Mycobacterium bovis subsp bovis AF2122/97
aggugauguucagcgcca

SEQ ID NO: 3039944 - RNA, 21 nt, Mycobacterium bovis subsp bovis AF2122/97
aggugauguuggccgccacac

SEQ ID NO: 3039945 - RNA, 19 nt, Mycobacterium bovis subsp bovis AF2122/97
aggugauuggucacaccca

SEQ ID NO: 3039946 - RNA, 16 nt, Mycobacterium bovis subsp bovis AF2122/97
aggugcacugccgggu

SEQ ID NO: 3039947 - RNA, 16 nt, Mycobacterium bovis subsp bovis AF2122/97
aggugcagcaccagcc

SEQ ID NO: 3039948 - RNA, 13 nt, Mycobacterium bovis subsp bovis AF2122/97
aggugccaccugu

SEQ ID NO: 3039949 - RNA, 13 nt, Mycobacterium bovis subsp bovis AF2122/97
aggugccagacca

SEQ ID NO: 3039950 - RNA, 23 nt, Mycobacterium bovis subsp bovis AF2122/97
aggugcccaucgggugguacagg

SEQ ID NO: 3039951 - RNA, 18 nt, Mycobacterium bovis subsp bovis AF2122/97
aggugccgcgcagcugcc

SEQ ID NO: 3039952 - RNA, 19 nt, Mycobacterium bovis subsp bovis AF2122/97
aggugccgcgcagcugccg

SEQ ID NO: 3039953 - RNA, 11 nt, Mycobacterium bovis subsp bovis AF2122/97
aggugccggcg

SEQ ID NO: 3039954 - RNA, 13 nt, Mycobacterium bovis subsp bovis AF2122/97
aggugccuucuuc

SEQ ID NO: 3039955 - RNA, 14 nt, Mycobacterium bovis subsp bovis AF2122/97
aggugccuucuucg

SEQ ID NO: 3039956 - RNA, 14 nt, Mycobacterium bovis subsp bovis AF2122/97
aggugcgauccggc

SEQ ID NO: 3039957 - RNA, 13 nt, Mycobacterium bovis subsp bovis AF2122/97
aggugcgcacagg

SEQ ID NO: 3039958 - RNA, 15 nt, Mycobacterium bovis subsp bovis AF2122/97
aggugcgcgugacga

SEQ ID NO: 3039959 - RNA, 15 nt, Mycobacterium bovis subsp bovis AF2122/97
aggugcgcuggguga

SEQ ID NO: 3039960 - RNA, 13 nt, Mycobacterium bovis subsp bovis AF2122/97
aggugcggcggca

SEQ ID NO: 3039961 - RNA, 17 nt, Mycobacterium bovis subsp bovis AF2122/97
aggugcgggccggugga

SEQ ID NO: 3039962 - RNA, 16 nt, Mycobacterium bovis subsp bovis AF2122/97
aggugcguuugcacug

SEQ ID NO: 3039963 - RNA, 13 nt, Mycobacterium bovis subsp bovis AF2122/97
aggugcugcaccu

SEQ ID NO: 3039964 - RNA, 15 nt, Mycobacterium bovis subsp bovis AF2122/97
aggugcugggcgagg

SEQ ID NO: 3039965 - RNA, 19 nt, Mycobacterium bovis subsp bovis AF2122/97
aggugcugguauagccggc

SEQ ID NO: 3039966 - RNA, 23 nt, Mycobacterium bovis subsp bovis AF2122/97
aggugcuggugaucugcugggca

SEQ ID NO: 3039967 - RNA, 18 nt, Mycobacterium bovis subsp bovis AF2122/97
agguggaagugcaccugg

SEQ ID NO: 3039968 - RNA, 20 nt, Mycobacterium bovis subsp bovis AF2122/97
agguggaagugcaccuggau

SEQ ID NO: 3039969 - RNA, 12 nt, Mycobacterium bovis subsp bovis AF2122/97
agguggcccgcg

SEQ ID NO: 3039970 - RNA, 14 nt, Mycobacterium bovis subsp bovis AF2122/97
agguggcccgcgcg

SEQ ID NO: 3039971 - RNA, 21 nt, Mycobacterium bovis subsp bovis AF2122/97
agguggccgcgcaggggcggc

SEQ ID NO: 3039972 - RNA, 23 nt, Mycobacterium bovis subsp bovis AF2122/97
agguggccgcgcaggggcggcgu

SEQ ID NO: 3039973 - RNA, 15 nt, Mycobacterium bovis subsp bovis AF2122/97
agguggccgucgccg

SEQ ID NO: 3039974 - RNA, 16 nt, Mycobacterium bovis subsp bovis AF2122/97
agguggccgucgccga

SEQ ID NO: 3039975 - RNA, 13 nt, Mycobacterium bovis subsp bovis AF2122/97
agguggcgagcgc

SEQ ID NO: 3039976 - RNA, 15 nt, Mycobacterium bovis subsp bovis AF2122/97
agguggcgcacaucg

SEQ ID NO: 3039977 - RNA, 21 nt, Mycobacterium bovis subsp bovis AF2122/97
agguggcgggcgaugcgggcc

SEQ ID NO: 3039978 - RNA, 21 nt, Mycobacterium bovis subsp bovis AF2122/97
aggugggauugaagcuggcca

SEQ ID NO: 3039979 - RNA, 23 nt, Mycobacterium bovis subsp bovis AF2122/97
aggugggauugaagcuggccacc

SEQ ID NO: 3039980 - RNA, 13 nt, Mycobacterium bovis subsp bovis AF2122/97
aggugggcagcag

SEQ ID NO: 3039981 - RNA, 15 nt, Mycobacterium bovis subsp bovis AF2122/97
aggugggcagcaggc

SEQ ID NO: 3039982 - RNA, 11 nt, Mycobacterium bovis subsp bovis AF2122/97
aggugggcucg

SEQ ID NO: 3039983 - RNA, 15 nt, Mycobacterium bovis subsp bovis AF2122/97
agguggggugguggu

SEQ ID NO: 3039984 - RNA, 12 nt, Mycobacterium bovis subsp bovis AF2122/97
aggugggugaac

SEQ ID NO: 3039985 - RNA, 23 nt, Mycobacterium bovis subsp bovis AF2122/97
agguggucacgcagucgggcagc

SEQ ID NO: 3039986 - RNA, 13 nt, Mycobacterium bovis subsp bovis AF2122/97
aggugucaacgcg

SEQ ID NO: 3039987 - RNA, 16 nt, Mycobacterium bovis subsp bovis AF2122/97
aggugucgacgcgggc

SEQ ID NO: 3039988 - RNA, 17 nt, Mycobacterium bovis subsp bovis AF2122/97
aggugucgacgcgggcg

SEQ ID NO: 3039989 - RNA, 19 nt, Mycobacterium bovis subsp bovis AF2122/97
aggugugcgacgacggcgc

SEQ ID NO: 3039990 - RNA, 18 nt, Mycobacterium bovis subsp bovis AF2122/97
aggugugcgucuccagcu

SEQ ID NO: 3039991 - RNA, 14 nt, Mycobacterium bovis subsp bovis AF2122/97
agguguggugacag

SEQ ID NO: 3039992 - RNA, 15 nt, Mycobacterium bovis subsp bovis AF2122/97
aggugugguucccgg

SEQ ID NO: 3039993 - RNA, 13 nt, Mycobacterium bovis subsp bovis AF2122/97
aggugugugacga

SEQ ID NO: 3039994 - RNA, 16 nt, Mycobacterium bovis subsp bovis AF2122/97
agguguguggcgccgg

SEQ ID NO: 3039995 - RNA, 14 nt, Mycobacterium bovis subsp bovis AF2122/97
agguguugacgauc

SEQ ID NO: 3039996 - RNA, 15 nt, Mycobacterium bovis subsp bovis AF2122/97
agguguugcgguggg

SEQ ID NO: 3039997 - RNA, 19 nt, Mycobacterium bovis subsp bovis AF2122/97
agguguugcggugggugaa

SEQ ID NO: 3039998 - RNA, 13 nt, Mycobacterium bovis subsp bovis AF2122/97
agguucaaagcag

SEQ ID NO: 3039999 - RNA, 15 nt, Mycobacterium bovis subsp bovis AF2122/97
agguucagccugagc

SEQ ID NO: 3040000 - RNA, 20 nt, Mycobacterium bovis subsp bovis AF2122/97
agguuccacggccaggucga

SEQ ID NO: 3040001 - RNA, 19 nt, Mycobacterium bovis subsp bovis AF2122/97
agguucccgcauugacgaa

SEQ ID NO: 3040002 - RNA, 15 nt, Mycobacterium bovis subsp bovis AF2122/97
agguucgaucgcggu

SEQ ID NO: 3040003 - RNA, 22 nt, Mycobacterium bovis subsp bovis AF2122/97
agguucgcaccggagucggcgu

SEQ ID NO: 3040004 - RNA, 13 nt, Mycobacterium bovis subsp bovis AF2122/97
agguucgggugga

SEQ ID NO: 3040005 - RNA, 18 nt, Mycobacterium bovis subsp bovis AF2122/97
agguucgguagucgaugc

SEQ ID NO: 3040006 - RNA, 13 nt, Mycobacterium bovis subsp bovis AF2122/97
agguucgugcguu

SEQ ID NO: 3040007 - RNA, 18 nt, Mycobacterium bovis subsp bovis AF2122/97
agguucgugcguugucgg

SEQ ID NO: 3040008 - RNA, 18 nt, Mycobacterium bovis subsp bovis AF2122/97
agguucuucuccaccacc

SEQ ID NO: 3040009 - RNA, 14 nt, Mycobacterium bovis subsp bovis AF2122/97
agguugaccaccag

SEQ ID NO: 3040010 - RNA, 16 nt, Mycobacterium bovis subsp bovis AF2122/97
agguugacccccgggu

SEQ ID NO: 3040011 - RNA, 19 nt, Mycobacterium bovis subsp bovis AF2122/97
agguugacgucaggcugaa

SEQ ID NO: 3040012 - RNA, 21 nt, Mycobacterium bovis subsp bovis AF2122/97
agguugauuggggccagguug

SEQ ID NO: 3040013 - RNA, 13 nt, Mycobacterium bovis subsp bovis AF2122/97
agguugccgucgg

SEQ ID NO: 3040014 - RNA, 14 nt, Mycobacterium bovis subsp bovis AF2122/97
agguugcgccauaa

SEQ ID NO: 3040015 - RNA, 14 nt, Mycobacterium bovis subsp bovis AF2122/97
agguugcggacggu

SEQ ID NO: 3040016 - RNA, 15 nt, Mycobacterium bovis subsp bovis AF2122/97
agguugcguugcagg

SEQ ID NO: 3040017 - RNA, 17 nt, Mycobacterium bovis subsp bovis AF2122/97
agguugcguugcaggaa

SEQ ID NO: 3040018 - RNA, 14 nt, Mycobacterium bovis subsp bovis AF2122/97
agguugggaacagc

SEQ ID NO: 3040019 - RNA, 18 nt, Mycobacterium bovis subsp bovis AF2122/97
agguuguaguccgcgccg

SEQ ID NO: 3040020 - RNA, 16 nt, Mycobacterium bovis subsp bovis AF2122/97
agguugucgcuacgag

SEQ ID NO: 3040021 - RNA, 14 nt, Mycobacterium bovis subsp bovis AF2122/97
agguugucgucggu

SEQ ID NO: 3040022 - RNA, 18 nt, Mycobacterium bovis subsp bovis AF2122/97
agguugugugacagcccg

SEQ ID NO: 3040023 - RNA, 15 nt, Mycobacterium bovis subsp bovis AF2122/97
aguaacgucgucgcg

SEQ ID NO: 3040024 - RNA, 12 nt, Mycobacterium bovis subsp bovis AF2122/97
aguaaguccucg

SEQ ID NO: 3040025 - RNA, 19 nt, Mycobacterium bovis subsp bovis AF2122/97
aguaaugcccaugcuucgg

SEQ ID NO: 3040026 - RNA, 20 nt, Mycobacterium bovis subsp bovis AF2122/97
aguaauggaacggcuugcga

SEQ ID NO: 3040027 - RNA, 14 nt, Mycobacterium bovis subsp bovis AF2122/97
aguacagaucgagg

SEQ ID NO: 3040028 - RNA, 16 nt, Mycobacterium bovis subsp bovis AF2122/97
aguaccaccggcaccg

SEQ ID NO: 3040029 - RNA, 21 nt, Mycobacterium bovis subsp bovis AF2122/97
aguaccacuguuacggccaca

SEQ ID NO: 3040030 - RNA, 12 nt, Mycobacterium bovis subsp bovis AF2122/97
aguaccagccca

SEQ ID NO: 3040031 - RNA, 20 nt, Mycobacterium bovis subsp bovis AF2122/97
aguccgguagcugugguggu

SEQ ID NO: 3040032 - RNA, 17 nt, Mycobacterium bovis subsp bovis AF2122/97
aguccgguuacgcucgc

SEQ ID NO: 3040033 - RNA, 19 nt, Mycobacterium bovis subsp bovis AF2122/97
aguccguacuugccaccca

SEQ ID NO: 3040034 - RNA, 19 nt, Mycobacterium bovis subsp bovis AF2122/97
aguccguucaccgucugcg

SEQ ID NO: 3040035 - RNA, 21 nt, Mycobacterium bovis subsp bovis AF2122/97
aguccuccacuuuuccgccgg

SEQ ID NO: 3040036 - RNA, 23 nt, Mycobacterium bovis subsp bovis AF2122/97
aguccuccacuuuuccgccggcc

SEQ ID NO: 3040037 - RNA, 17 nt, Mycobacterium bovis subsp bovis AF2122/97
aguccucgagugccgcc

SEQ ID NO: 3040038 - RNA, 21 nt, Mycobacterium bovis subsp bovis AF2122/97
agucgaacccgcgagcaucga

SEQ ID NO: 3040039 - RNA, 20 nt, Mycobacterium bovis subsp bovis AF2122/97
agucgaagaaccugagcacc

SEQ ID NO: 3040040 - RNA, 14 nt, Mycobacterium bovis subsp bovis AF2122/97
agucgaagaagacc

SEQ ID NO: 3040041 - RNA, 20 nt, Mycobacterium bovis subsp bovis AF2122/97
agucgaaggucagcaccgcu

SEQ ID NO: 3040042 - RNA, 15 nt, Mycobacterium bovis subsp bovis AF2122/97
agucgaaucgucauc

SEQ ID NO: 3040043 - RNA, 22 nt, Mycobacterium bovis subsp bovis AF2122/97
agucgaccauauuggcgcggcc

SEQ ID NO: 3040044 - RNA, 22 nt, Mycobacterium bovis subsp bovis AF2122/97
agucgaccaugagccggcgccg

SEQ ID NO: 3040045 - RNA, 18 nt, Mycobacterium bovis subsp bovis AF2122/97
agucgacgaacucgccca

SEQ ID NO: 3040046 - RNA, 16 nt, Mycobacterium bovis subsp bovis AF2122/97
agucgacgacguccuc

SEQ ID NO: 3040047 - RNA, 19 nt, Mycobacterium bovis subsp bovis AF2122/97
agucgacgacguccucgac

SEQ ID NO: 3040048 - RNA, 15 nt, Mycobacterium bovis subsp bovis AF2122/97
agucgacgacguggc

SEQ ID NO: 3040049 - RNA, 12 nt, Mycobacterium bovis subsp bovis AF2122/97
agucgacggcca

SEQ ID NO: 3040050 - RNA, 16 nt, Mycobacterium bovis subsp bovis AF2122/97
agucgacggccagugc

SEQ ID NO: 3040051 - RNA, 14 nt, Mycobacterium bovis subsp bovis AF2122/97
agucgacggucacg

SEQ ID NO: 3040052 - RNA, 16 nt, Mycobacterium bovis subsp bovis AF2122/97
agucgacggucacggu

SEQ ID NO: 3040053 - RNA, 14 nt, Mycobacterium bovis subsp bovis AF2122/97
agucgacgguggcg

SEQ ID NO: 3040054 - RNA, 21 nt, Mycobacterium bovis subsp bovis AF2122/97
agucgacgguggcgccgucgg

SEQ ID NO: 3040055 - RNA, 22 nt, Mycobacterium bovis subsp bovis AF2122/97
agucgagcaccugccgaucggg

SEQ ID NO: 3040056 - RNA, 19 nt, Mycobacterium bovis subsp bovis AF2122/97
agucgagcagauacagcgg

SEQ ID NO: 3040057 - RNA, 22 nt, Mycobacterium bovis subsp bovis AF2122/97
agucgaucacguggugcggccg

SEQ ID NO: 3040058 - RNA, 12 nt, Mycobacterium bovis subsp bovis AF2122/97
agucgaucgccg

SEQ ID NO: 3040059 - RNA, 14 nt, Mycobacterium bovis subsp bovis AF2122/97
agucgaucgcggcc

SEQ ID NO: 3040060 - RNA, 16 nt, Mycobacterium bovis subsp bovis AF2122/97
agucgaugaccccggu

SEQ ID NO: 3040061 - RNA, 17 nt, Mycobacterium bovis subsp bovis AF2122/97
agucgaugaugcccauc

SEQ ID NO: 3040062 - RNA, 20 nt, Mycobacterium bovis subsp bovis AF2122/97
agucgaugaugcccauccgg

SEQ ID NO: 3040063 - RNA, 16 nt, Mycobacterium bovis subsp bovis AF2122/97
agucgauguacaccgg

SEQ ID NO: 3040064 - RNA, 20 nt, Mycobacterium bovis subsp bovis AF2122/97
agucgauguacaccgugcgc

SEQ ID NO: 3040065 - RNA, 15 nt, Mycobacterium bovis subsp bovis AF2122/97
agucgaugucaagga

SEQ ID NO: 3040066 - RNA, 23 nt, Mycobacterium bovis subsp bovis AF2122/97
agucgcacucauagaacucgccg

SEQ ID NO: 3040067 - RNA, 13 nt, Mycobacterium bovis subsp bovis AF2122/97
agucgcacugcgc

SEQ ID NO: 3040068 - RNA, 20 nt, Mycobacterium bovis subsp bovis AF2122/97
agucgcacugcgccggccgg

SEQ ID NO: 3040069 - RNA, 14 nt, Mycobacterium bovis subsp bovis AF2122/97
agucgcagccaggc

SEQ ID NO: 3040070 - RNA, 19 nt, Mycobacterium bovis subsp bovis AF2122/97
agucgcagccaggcacguc

SEQ ID NO: 3040071 - RNA, 13 nt, Mycobacterium bovis subsp bovis AF2122/97
agucgcagcgagg

SEQ ID NO: 3040072 - RNA, 12 nt, Mycobacterium bovis subsp bovis AF2122/97
agucgcaggauc

SEQ ID NO: 3040073 - RNA, 13 nt, Mycobacterium bovis subsp bovis AF2122/97
agucgccagaccg

SEQ ID NO: 3040074 - RNA, 11 nt, Mycobacterium bovis subsp bovis AF2122/97
agucgccgagg

SEQ ID NO: 3040075 - RNA, 19 nt, Mycobacterium bovis subsp bovis AF2122/97
agucgccgaggacgccggc

SEQ ID NO: 3040076 - RNA, 21 nt, Mycobacterium bovis subsp bovis AF2122/97
agucgccgaggucgaaccgcc

SEQ ID NO: 3040077 - RNA, 16 nt, Mycobacterium bovis subsp bovis AF2122/97
agucgccgaucgagac

SEQ ID NO: 3040078 - RNA, 11 nt, Mycobacterium bovis subsp bovis AF2122/97
agucgccggcc

SEQ ID NO: 3040079 - RNA, 12 nt, Mycobacterium bovis subsp bovis AF2122/97
agucgccggccg

SEQ ID NO: 3040080 - RNA, 14 nt, Mycobacterium bovis subsp bovis AF2122/97
agucgccggucagg

SEQ ID NO: 3040081 - RNA, 19 nt, Mycobacterium bovis subsp bovis AF2122/97
agucgcgaacucaugcccg

SEQ ID NO: 3040082 - RNA, 16 nt, Mycobacterium bovis subsp bovis AF2122/97
agucgcgaccgcgggc

SEQ ID NO: 3040083 - RNA, 18 nt, Mycobacterium bovis subsp bovis AF2122/97
agucgcgcagggcgacau

SEQ ID NO: 3040084 - RNA, 18 nt, Mycobacterium bovis subsp bovis AF2122/97
agucgcggacgucgcccc

SEQ ID NO: 3040085 - RNA, 18 nt, Mycobacterium bovis subsp bovis AF2122/97
agucgcggcguucggcuu

SEQ ID NO: 3040086 - RNA, 15 nt, Mycobacterium bovis subsp bovis AF2122/97
agucgcgggccaagc

SEQ ID NO: 3040087 - RNA, 19 nt, Mycobacterium bovis subsp bovis AF2122/97
agucgcgggugcggacacc

SEQ ID NO: 3040088 - RNA, 18 nt, Mycobacterium bovis subsp bovis AF2122/97
agucgcgguaccaucacc

SEQ ID NO: 3040089 - RNA, 21 nt, Mycobacterium bovis subsp bovis AF2122/97
agucgcgguaccaucaccgcg

SEQ ID NO: 3040090 - RNA, 14 nt, Mycobacterium bovis subsp bovis AF2122/97
agucgcuaagacuu

SEQ ID NO: 3040091 - RNA, 23 nt, Mycobacterium bovis subsp bovis AF2122/97
agucgcucgcugaugcaucccaa

SEQ ID NO: 3040092 - RNA, 14 nt, Mycobacterium bovis subsp bovis AF2122/97
agucggagcgggga

SEQ ID NO: 3040093 - RNA, 21 nt, Mycobacterium bovis subsp bovis AF2122/97
agucggagugguauccaggcc

SEQ ID NO: 3040094 - RNA, 13 nt, Mycobacterium bovis subsp bovis AF2122/97
agucggcaaacaa

SEQ ID NO: 3040095 - RNA, 21 nt, Mycobacterium bovis subsp bovis AF2122/97
agucggcaaacaacgacuccu

SEQ ID NO: 3040096 - RNA, 21 nt, Mycobacterium bovis subsp bovis AF2122/97
agucggcauugcugguugcgc

SEQ ID NO: 3040097 - RNA, 14 nt, Mycobacterium bovis subsp bovis AF2122/97
agucggccagcucg

SEQ ID NO: 3040098 - RNA, 13 nt, Mycobacterium bovis subsp bovis AF2122/97
agucggccggcgg

SEQ ID NO: 3040099 - RNA, 19 nt, Mycobacterium bovis subsp bovis AF2122/97
agucggccuccucgucgcu

SEQ ID NO: 3040100 - RNA, 19 nt, Mycobacterium bovis subsp bovis AF2122/97
agucggcgggcgacaucga

SEQ ID NO: 3040101 - RNA, 19 nt, Mycobacterium bovis subsp bovis AF2122/97
agucggcgucacgguggac

SEQ ID NO: 3040102 - RNA, 17 nt, Mycobacterium bovis subsp bovis AF2122/97
agucgggaagcgagcag

SEQ ID NO: 3040103 - RNA, 19 nt, Mycobacterium bovis subsp bovis AF2122/97
agucgggaagcgagcagcu

SEQ ID NO: 3040104 - RNA, 13 nt, Mycobacterium bovis subsp bovis AF2122/97
agucgggcaaggc

SEQ ID NO: 3040105 - RNA, 20 nt, Mycobacterium bovis subsp bovis AF2122/97
agucgggcaaggcggcggcc

SEQ ID NO: 3040106 - RNA, 15 nt, Mycobacterium bovis subsp bovis AF2122/97
agucggggucgcgga

SEQ ID NO: 3040107 - RNA, 17 nt, Mycobacterium bovis subsp bovis AF2122/97
agucggggugggacagg

SEQ ID NO: 3040108 - RNA, 22 nt, Mycobacterium bovis subsp bovis AF2122/97
agucgguagcugaccgugcuga

SEQ ID NO: 3040109 - RNA, 22 nt, Mycobacterium bovis subsp bovis AF2122/97
agucggugaaaugacggcugaa

SEQ ID NO: 3040110 - RNA, 16 nt, Mycobacterium bovis subsp bovis AF2122/97
agucgguugucggggu

SEQ ID NO: 3040111 - RNA, 17 nt, Mycobacterium bovis subsp bovis AF2122/97
agucguagacggcgaaa

SEQ ID NO: 3040112 - RNA, 21 nt, Mycobacterium bovis subsp bovis AF2122/97
agucguagcagguguaggugc

SEQ ID NO: 3040113 - RNA, 19 nt, Mycobacterium bovis subsp bovis AF2122/97
agucguaguaggcgccgcg

SEQ ID NO: 3040114 - RNA, 18 nt, Mycobacterium bovis subsp bovis AF2122/97
agucgucgacuugcaggc

SEQ ID NO: 3040115 - RNA, 14 nt, Mycobacterium bovis subsp bovis AF2122/97
agucgucgagcuga

SEQ ID NO: 3040116 - RNA, 17 nt, Mycobacterium bovis subsp bovis AF2122/97
agucgucgcuugcuggg

SEQ ID NO: 3040117 - RNA, 15 nt, Mycobacterium bovis subsp bovis AF2122/97
agucgucggcgcuga

SEQ ID NO: 3040118 - RNA, 20 nt, Mycobacterium bovis subsp bovis AF2122/97
agugcggacuucgccgcccg

SEQ ID NO: 3040119 - RNA, 20 nt, Mycobacterium bovis subsp bovis AF2122/97
agugcggcacgaucgccaac

SEQ ID NO: 3040120 - RNA, 15 nt, Mycobacterium bovis subsp bovis AF2122/97
agugcggcagcggug

SEQ ID NO: 3040121 - RNA, 23 nt, Mycobacterium bovis subsp bovis AF2122/97
agugcggccuuggcgacgucgcg

SEQ ID NO: 3040122 - RNA, 19 nt, Mycobacterium bovis subsp bovis AF2122/97
agugcgggcaugccggcga

SEQ ID NO: 3040123 - RNA, 23 nt, Mycobacterium bovis subsp bovis AF2122/97
agugcgggccgugacccucagca

SEQ ID NO: 3040124 - RNA, 19 nt, Mycobacterium bovis subsp bovis AF2122/97
agugcgggggcgaccuggu

SEQ ID NO: 3040125 - RNA, 19 nt, Mycobacterium bovis subsp bovis AF2122/97
agugcggguggugagcuga

SEQ ID NO: 3040126 - RNA, 20 nt, Mycobacterium bovis subsp bovis AF2122/97
agugcggugugugcaagccg

SEQ ID NO: 3040127 - RNA, 12 nt, Mycobacterium bovis subsp bovis AF2122/97
agugcugcaccg

SEQ ID NO: 3040128 - RNA, 22 nt, Mycobacterium bovis subsp bovis AF2122/97
agugcugccuugggaccgcgcc

SEQ ID NO: 3040129 - RNA, 15 nt, Mycobacterium bovis subsp bovis AF2122/97
agugcuuccggccau

SEQ ID NO: 3040130 - RNA, 17 nt, Mycobacterium bovis subsp bovis AF2122/97
agugcuugggccgcuga

SEQ ID NO: 3040131 - RNA, 19 nt, Mycobacterium bovis subsp bovis AF2122/97
agugcuuuggguccgggcg

SEQ ID NO: 3040132 - RNA, 23 nt, Mycobacterium bovis subsp bovis AF2122/97
agugcuuuggguccgggcggccg

SEQ ID NO: 3040133 - RNA, 17 nt, Mycobacterium bovis subsp bovis AF2122/97
aguggaacagucgaggu

SEQ ID NO: 3040134 - RNA, 11 nt, Mycobacterium bovis subsp bovis AF2122/97
aguggaagccg

SEQ ID NO: 3040135 - RNA, 15 nt, Mycobacterium bovis subsp bovis AF2122/97
aguggagggcccggc

SEQ ID NO: 3040136 - RNA, 18 nt, Mycobacterium bovis subsp bovis AF2122/97
aguggaucuggcgcagca

SEQ ID NO: 3040137 - RNA, 15 nt, Mycobacterium bovis subsp bovis AF2122/97
aguggcaaucccgcc

SEQ ID NO: 3040138 - RNA, 15 nt, Mycobacterium bovis subsp bovis AF2122/97
aguggccaccaucac

SEQ ID NO: 3040139 - RNA, 16 nt, Mycobacterium bovis subsp bovis AF2122/97
aguggccacguugcgc

SEQ ID NO: 3040140 - RNA, 20 nt, Mycobacterium bovis subsp bovis AF2122/97
aguggccaguuggccggcca

SEQ ID NO: 3040141 - RNA, 14 nt, Mycobacterium bovis subsp bovis AF2122/97
aguggcccgcgggc

SEQ ID NO: 3040142 - RNA, 17 nt, Mycobacterium bovis subsp bovis AF2122/97
aguggcccgcgggcaag

SEQ ID NO: 3040143 - RNA, 13 nt, Mycobacterium bovis subsp bovis AF2122/97
aguggccgccacc

SEQ ID NO: 3040144 - RNA, 17 nt, Mycobacterium bovis subsp bovis AF2122/97
aguggccgccacccgca

SEQ ID NO: 3040145 - RNA, 15 nt, Mycobacterium bovis subsp bovis AF2122/97
aguggccgccgggca

SEQ ID NO: 3040146 - RNA, 14 nt, Mycobacterium bovis subsp bovis AF2122/97
aguggccgggcggu

SEQ ID NO: 3040147 - RNA, 19 nt, Mycobacterium bovis subsp bovis AF2122/97
aguggccucguccagcucg

SEQ ID NO: 3040148 - RNA, 21 nt, Mycobacterium bovis subsp bovis AF2122/97
aguggccucguccagcucggu

SEQ ID NO: 3040149 - RNA, 14 nt, Mycobacterium bovis subsp bovis AF2122/97
aguggcgaguggcu

SEQ ID NO: 3040150 - RNA, 16 nt, Mycobacterium bovis subsp bovis AF2122/97
aguggcgaucugcugc

SEQ ID NO: 3040151 - RNA, 21 nt, Mycobacterium bovis subsp bovis AF2122/97
aguggcgcaccaccuccccga

SEQ ID NO: 3040152 - RNA, 20 nt, Mycobacterium bovis subsp bovis AF2122/97
aguggcgcagcaccguucgc

SEQ ID NO: 3040153 - RNA, 19 nt, Mycobacterium bovis subsp bovis AF2122/97
aguggcgcccauggccacc

SEQ ID NO: 3040154 - RNA, 15 nt, Mycobacterium bovis subsp bovis AF2122/97
aguggcgcgcggcgc

SEQ ID NO: 3040155 - RNA, 22 nt, Mycobacterium bovis subsp bovis AF2122/97
aguggcguuacgcucggcgaac

SEQ ID NO: 3040156 - RNA, 16 nt, Mycobacterium bovis subsp bovis AF2122/97
aguggcucgcucugcg

SEQ ID NO: 3040157 - RNA, 22 nt, Mycobacterium bovis subsp bovis AF2122/97
agugggacaaagacgccgucgg

SEQ ID NO: 3040158 - RNA, 17 nt, Mycobacterium bovis subsp bovis AF2122/97
agugggacuggcgugaa

SEQ ID NO: 3040159 - RNA, 19 nt, Mycobacterium bovis subsp bovis AF2122/97
agugggcaauccggucagc

SEQ ID NO: 3040160 - RNA, 22 nt, Mycobacterium bovis subsp bovis AF2122/97
agugggcgcgaacggcggugug

SEQ ID NO: 3040161 - RNA, 17 nt, Mycobacterium bovis subsp bovis AF2122/97
agugggcguuggcggca

SEQ ID NO: 3040162 - RNA, 23 nt, Mycobacterium bovis subsp bovis AF2122/97
aguggggauucguugucgagcac

SEQ ID NO: 3040163 - RNA, 20 nt, Mycobacterium bovis subsp bovis AF2122/97
agugggggugguaccggcgg

SEQ ID NO: 3040164 - RNA, 21 nt, Mycobacterium bovis subsp bovis AF2122/97
agugguacggcucggcgcuga

SEQ ID NO: 3040165 - RNA, 13 nt, Mycobacterium bovis subsp bovis AF2122/97
agugguaggccgc

SEQ ID NO: 3040166 - RNA, 14 nt, Mycobacterium bovis subsp bovis AF2122/97
agugguccagccag

SEQ ID NO: 3040167 - RNA, 18 nt, Mycobacterium bovis subsp bovis AF2122/97
aguggucccggugaugac

SEQ ID NO: 3040168 - RNA, 12 nt, Mycobacterium bovis subsp bovis AF2122/97
aguggucgauga

SEQ ID NO: 3040169 - RNA, 22 nt, Mycobacterium bovis subsp bovis AF2122/97
aguggucggcccgcucaccuug

SEQ ID NO: 3040170 - RNA, 19 nt, Mycobacterium bovis subsp bovis AF2122/97
aguggugaccgacgcggac

SEQ ID NO: 3040171 - RNA, 23 nt, Mycobacterium bovis subsp bovis AF2122/97
aguggugaccgacgcggacagga

SEQ ID NO: 3040172 - RNA, 17 nt, Mycobacterium bovis subsp bovis AF2122/97
aguggugauccagccgu

SEQ ID NO: 3040173 - RNA, 16 nt, Mycobacterium bovis subsp bovis AF2122/97
agugguuagucggccu

SEQ ID NO: 3040174 - RNA, 14 nt, Mycobacterium bovis subsp bovis AF2122/97
aguguacaccgcgc

SEQ ID NO: 3040175 - RNA, 12 nt, Mycobacterium bovis subsp bovis AF2122/97
agugucagcaga

SEQ ID NO: 3040176 - RNA, 13 nt, Mycobacterium bovis subsp bovis AF2122/97
agugucagcagau

SEQ ID NO: 3040177 - RNA, 20 nt, Mycobacterium bovis subsp bovis AF2122/97
agugucgauagcccgccacc

SEQ ID NO: 3040178 - RNA, 15 nt, Mycobacterium bovis subsp bovis AF2122/97
agugucguaggcgau

SEQ ID NO: 3040179 - RNA, 19 nt, Mycobacterium bovis subsp bovis AF2122/97
agugucuccggcaacagca

SEQ ID NO: 3040180 - RNA, 13 nt, Mycobacterium bovis subsp bovis AF2122/97
agugucugcucgc

SEQ ID NO: 3040181 - RNA, 18 nt, Mycobacterium bovis subsp bovis AF2122/97
agugucuuagccagcagc

SEQ ID NO: 3040182 - RNA, 14 nt, Mycobacterium bovis subsp bovis AF2122/97
agugugaacugucc

SEQ ID NO: 3040183 - RNA, 19 nt, Mycobacterium bovis subsp bovis AF2122/97
agugugaaucgcacgacgc

SEQ ID NO: 3040184 - RNA, 15 nt, Mycobacterium bovis subsp bovis AF2122/97
agugugacggcggcc

SEQ ID NO: 3040185 - RNA, 17 nt, Mycobacterium bovis subsp bovis AF2122/97
agugugagaucguaggg

SEQ ID NO: 3040186 - RNA, 20 nt, Mycobacterium bovis subsp bovis AF2122/97
agugugagcagacccagucc

SEQ ID NO: 3040187 - RNA, 16 nt, Mycobacterium bovis subsp bovis AF2122/97
agugugauuccggguc

SEQ ID NO: 3040188 - RNA, 13 nt, Mycobacterium bovis subsp bovis AF2122/97
agugugcccugcu

SEQ ID NO: 3040189 - RNA, 23 nt, Mycobacterium bovis subsp bovis AF2122/97
agugugcccugcuggugucggcu

SEQ ID NO: 3040190 - RNA, 18 nt, Mycobacterium bovis subsp bovis AF2122/97
aguguggccgaaagccag

SEQ ID NO: 3040191 - RNA, 19 nt, Mycobacterium bovis subsp bovis AF2122/97
aguguguuugaguugcccg

SEQ ID NO: 3040192 - RNA, 14 nt, Mycobacterium bovis subsp bovis AF2122/97
aguguguuuggugg

SEQ ID NO: 3040193 - RNA, 15 nt, Mycobacterium bovis subsp bovis AF2122/97
aguguguuugguggu

SEQ ID NO: 3040194 - RNA, 20 nt, Mycobacterium bovis subsp bovis AF2122/97
aguguugcgcugcggccagc

SEQ ID NO: 3040195 - RNA, 22 nt, Mycobacterium bovis subsp bovis AF2122/97
aguguugcgcugcggccagcgc

SEQ ID NO: 3040196 - RNA, 20 nt, Mycobacterium bovis subsp bovis AF2122/97
aguguuuggguuuuguuugg

SEQ ID NO: 3040197 - RNA, 21 nt, Mycobacterium bovis subsp bovis AF2122/97
aguuaccgguggugcggcccu

SEQ ID NO: 3040198 - RNA, 21 nt, Mycobacterium bovis subsp bovis AF2122/97
aguuagccaccuuggacacca

SEQ ID NO: 3040199 - RNA, 17 nt, Mycobacterium bovis subsp bovis AF2122/97
aguuaggccgccagccg

SEQ ID NO: 3040200 - RNA, 18 nt, Mycobacterium bovis subsp bovis AF2122/97
aguuaggccgccagccgg

SEQ ID NO: 3040201 - RNA, 14 nt, Mycobacterium bovis subsp bovis AF2122/97
aguuaucagccgcg

SEQ ID NO: 3040202 - RNA, 16 nt, Mycobacterium bovis subsp bovis AF2122/97
aguucaccaacgcggg

SEQ ID NO: 3040203 - RNA, 19 nt, Mycobacterium bovis subsp bovis AF2122/97
aguucaccaacgcgggaac

SEQ ID NO: 3040204 - RNA, 22 nt, Mycobacterium bovis subsp bovis AF2122/97
auaauucaacagcaccgcgacg

SEQ ID NO: 3040205 - RNA, 20 nt, Mycobacterium bovis subsp bovis AF2122/97
auacacauuuccaacguaug

SEQ ID NO: 3040206 - RNA, 14 nt, Mycobacterium bovis subsp bovis AF2122/97
auacacccaacuca

SEQ ID NO: 3040207 - RNA, 15 nt, Mycobacterium bovis subsp bovis AF2122/97
auacaccugcuggaa

SEQ ID NO: 3040208 - RNA, 20 nt, Mycobacterium bovis subsp bovis AF2122/97
auacaccugcuggaagccgu

SEQ ID NO: 3040209 - RNA, 15 nt, Mycobacterium bovis subsp bovis AF2122/97
auacacggcggcgau

SEQ ID NO: 3040210 - RNA, 16 nt, Mycobacterium bovis subsp bovis AF2122/97
auacagcaauccgcaa

SEQ ID NO: 3040211 - RNA, 11 nt, Mycobacterium bovis subsp bovis AF2122/97
auacagcgccc

SEQ ID NO: 3040212 - RNA, 21 nt, Mycobacterium bovis subsp bovis AF2122/97
auacaggccacgcaccgggug

SEQ ID NO: 3040213 - RNA, 23 nt, Mycobacterium bovis subsp bovis AF2122/97
auacauuucgucgucgcagugca

SEQ ID NO: 3040214 - RNA, 17 nt, Mycobacterium bovis subsp bovis AF2122/97
auaccaagcgcgguggu

SEQ ID NO: 3040215 - RNA, 23 nt, Mycobacterium bovis subsp bovis AF2122/97
auaccagaccggccgacgugaca

SEQ ID NO: 3040216 - RNA, 24 nt, Mycobacterium bovis subsp bovis AF2122/97
auaccaguccggcggacgugacca

SEQ ID NO: 3040217 - RNA, 21 nt, Mycobacterium bovis subsp bovis AF2122/97
auaccauguucugcacguuga

SEQ ID NO: 3040218 - RNA, 18 nt, Mycobacterium bovis subsp bovis AF2122/97
auacccagcgcagcagcg

SEQ ID NO: 3040219 - RNA, 21 nt, Mycobacterium bovis subsp bovis AF2122/97
auacccagcgcagcagcggca

SEQ ID NO: 3040220 - RNA, 13 nt, Mycobacterium bovis subsp bovis AF2122/97
auacccagcgccc

SEQ ID NO: 3040221 - RNA, 15 nt, Mycobacterium bovis subsp bovis AF2122/97
auacccgcuggcccg

SEQ ID NO: 3040222 - RNA, 19 nt, Mycobacterium bovis subsp bovis AF2122/97
auaccgaaaucaccucacc

SEQ ID NO: 3040223 - RNA, 16 nt, Mycobacterium bovis subsp bovis AF2122/97
auaccgaggaucucgc

SEQ ID NO: 3040224 - RNA, 13 nt, Mycobacterium bovis subsp bovis AF2122/97
auaccgcaccaaa

SEQ ID NO: 3040225 - RNA, 15 nt, Mycobacterium bovis subsp bovis AF2122/97
auaccgccggcccca

SEQ ID NO: 3040226 - RNA, 23 nt, Mycobacterium bovis subsp bovis AF2122/97
auaccgcgaugauggcgguaccg

SEQ ID NO: 3040227 - RNA, 19 nt, Mycobacterium bovis subsp bovis AF2122/97
auaccgcucagggugcgcc

SEQ ID NO: 3040228 - RNA, 19 nt, Mycobacterium bovis subsp bovis AF2122/97
auaccggccgccaucaucg

SEQ ID NO: 3040229 - RNA, 15 nt, Mycobacterium bovis subsp bovis AF2122/97
auaccggcggcgagc

SEQ ID NO: 3040230 - RNA, 23 nt, Mycobacterium bovis subsp bovis AF2122/97
auaccggcggcgagcggccucca

SEQ ID NO: 3040231 - RNA, 17 nt, Mycobacterium bovis subsp bovis AF2122/97
auaccggcgugcaguac

SEQ ID NO: 3040232 - RNA, 14 nt, Mycobacterium bovis subsp bovis AF2122/97
auaccgguggcagc

SEQ ID NO: 3040233 - RNA, 15 nt, Mycobacterium bovis subsp bovis AF2122/97
auaccgguggcagcc

SEQ ID NO: 3040234 - RNA, 23 nt, Mycobacterium bovis subsp bovis AF2122/97
auaccgguugcggucaucggcgc

SEQ ID NO: 3040235 - RNA, 15 nt, Mycobacterium bovis subsp bovis AF2122/97
auaccucgccgcccu

SEQ ID NO: 3040236 - RNA, 20 nt, Mycobacterium bovis subsp bovis AF2122/97
auaccugggacaggacgacu

SEQ ID NO: 3040237 - RNA, 18 nt, Mycobacterium bovis subsp bovis AF2122/97
auaccuuccagaucgcgg

SEQ ID NO: 3040238 - RNA, 18 nt, Mycobacterium bovis subsp bovis AF2122/97
auacgaacucaccgccau

SEQ ID NO: 3040239 - RNA, 20 nt, Mycobacterium bovis subsp bovis AF2122/97
auacgcguugugcccgccgg

SEQ ID NO: 3040240 - RNA, 15 nt, Mycobacterium bovis subsp bovis AF2122/97
auacggguguggccg

SEQ ID NO: 3040241 - RNA, 16 nt, Mycobacterium bovis subsp bovis AF2122/97
auacggguguggccgu

SEQ ID NO: 3040242 - RNA, 15 nt, Mycobacterium bovis subsp bovis AF2122/97
auacucaccgacgcg

SEQ ID NO: 3040243 - RNA, 19 nt, Mycobacterium bovis subsp bovis AF2122/97
auacucgaguggcgaacgg

SEQ ID NO: 3040244 - RNA, 19 nt, Mycobacterium bovis subsp bovis AF2122/97
auacucucgcgacaucacc

SEQ ID NO: 3040245 - RNA, 23 nt, Mycobacterium bovis subsp bovis AF2122/97
auacugggaccauuaccgugggu

SEQ ID NO: 3040246 - RNA, 15 nt, Mycobacterium bovis subsp bovis AF2122/97
auagaacaacgucgc

SEQ ID NO: 3040247 - RNA, 15 nt, Mycobacterium bovis subsp bovis AF2122/97
auagaagcacgucgu

SEQ ID NO: 3040248 - RNA, 21 nt, Mycobacterium bovis subsp bovis AF2122/97
auagacuagccgauccagcag

SEQ ID NO: 3040249 - RNA, 15 nt, Mycobacterium bovis subsp bovis AF2122/97
auagauucccggcuc

SEQ ID NO: 3040250 - RNA, 17 nt, Mycobacterium bovis subsp bovis AF2122/97
auagcaccaguuugugc

SEQ ID NO: 3040251 - RNA, 11 nt, Mycobacterium bovis subsp bovis AF2122/97
auagcagugca

SEQ ID NO: 3040252 - RNA, 13 nt, Mycobacterium bovis subsp bovis AF2122/97
auagcagugcagc

SEQ ID NO: 3040253 - RNA, 16 nt, Mycobacterium bovis subsp bovis AF2122/97
auagcaucugaugacg

SEQ ID NO: 3040254 - RNA, 14 nt, Mycobacterium bovis subsp bovis AF2122/97
auagccaccgacga

SEQ ID NO: 3040255 - RNA, 17 nt, Mycobacterium bovis subsp bovis AF2122/97
auagccaccgacgacau

SEQ ID NO: 3040256 - RNA, 14 nt, Mycobacterium bovis subsp bovis AF2122/97
auagcccaagccga

SEQ ID NO: 3040257 - RNA, 20 nt, Mycobacterium bovis subsp bovis AF2122/97
auagccgaaaaagaccgaca

SEQ ID NO: 3040258 - RNA, 13 nt, Mycobacterium bovis subsp bovis AF2122/97
auagccgaacagc

SEQ ID NO: 3040259 - RNA, 19 nt, Mycobacterium bovis subsp bovis AF2122/97
auagccgacgucgccgacg

SEQ ID NO: 3040260 - RNA, 15 nt, Mycobacterium bovis subsp bovis AF2122/97
auagccgcgacccgc

SEQ ID NO: 3040261 - RNA, 11 nt, Mycobacterium bovis subsp bovis AF2122/97
auagccggcgc

SEQ ID NO: 3040262 - RNA, 17 nt, Mycobacterium bovis subsp bovis AF2122/97
auagccggcgcagcugu

SEQ ID NO: 3040263 - RNA, 23 nt, Mycobacterium bovis subsp bovis AF2122/97
auagccggucaguauggcgacga

SEQ ID NO: 3040264 - RNA, 15 nt, Mycobacterium bovis subsp bovis AF2122/97
auagccgguggucgc

SEQ ID NO: 3040265 - RNA, 19 nt, Mycobacterium bovis subsp bovis AF2122/97
auagccgguggucgcgccc

SEQ ID NO: 3040266 - RNA, 16 nt, Mycobacterium bovis subsp bovis AF2122/97
auagccguucggcauc

SEQ ID NO: 3040267 - RNA, 18 nt, Mycobacterium bovis subsp bovis AF2122/97
auagccguugcgggccag

SEQ ID NO: 3040268 - RNA, 18 nt, Mycobacterium bovis subsp bovis AF2122/97
auagccuuacgcggguga

SEQ ID NO: 3040269 - RNA, 16 nt, Mycobacterium bovis subsp bovis AF2122/97
auagcgacagcagcgc

SEQ ID NO: 3040270 - RNA, 12 nt, Mycobacterium bovis subsp bovis AF2122/97
auagcgcacugc

SEQ ID NO: 3040271 - RNA, 16 nt, Mycobacterium bovis subsp bovis AF2122/97
auagcgcggcaccagc

SEQ ID NO: 3040272 - RNA, 19 nt, Mycobacterium bovis subsp bovis AF2122/97
auagcgcggcaccagcacc

SEQ ID NO: 3040273 - RNA, 17 nt, Mycobacterium bovis subsp bovis AF2122/97
auagcgcgugugcgucg

SEQ ID NO: 3040274 - RNA, 18 nt, Mycobacterium bovis subsp bovis AF2122/97
auagcggcaaagccgggu

SEQ ID NO: 3040275 - RNA, 17 nt, Mycobacterium bovis subsp bovis AF2122/97
auagcgggcgguagcca

SEQ ID NO: 3040276 - RNA, 15 nt, Mycobacterium bovis subsp bovis AF2122/97
auagcucagaccggc

SEQ ID NO: 3040277 - RNA, 18 nt, Mycobacterium bovis subsp bovis AF2122/97
auagcugccggcccacca

SEQ ID NO: 3040278 - RNA, 19 nt, Mycobacterium bovis subsp bovis AF2122/97
auagcugcgcgaagccacc

SEQ ID NO: 3040279 - RNA, 20 nt, Mycobacterium bovis subsp bovis AF2122/97
auagcugcgcgaagccacca

SEQ ID NO: 3040280 - RNA, 14 nt, Mycobacterium bovis subsp bovis AF2122/97
auaggaagguugaa

SEQ ID NO: 3040281 - RNA, 17 nt, Mycobacterium bovis subsp bovis AF2122/97
auaggccccgccagcgc

SEQ ID NO: 3040282 - RNA, 23 nt, Mycobacterium bovis subsp bovis AF2122/97
auaggccggcggucagcagcgcc

SEQ ID NO: 3040283 - RNA, 16 nt, Mycobacterium bovis subsp bovis AF2122/97
auaggccgggcagugc

SEQ ID NO: 3040284 - RNA, 22 nt, Mycobacterium bovis subsp bovis AF2122/97
auaggucagaauugugugcagc

SEQ ID NO: 3040285 - RNA, 18 nt, Mycobacterium bovis subsp bovis AF2122/97
auaggucgggcaugacga

SEQ ID NO: 3040286 - RNA, 14 nt, Mycobacterium bovis subsp bovis AF2122/97
auaggugaacgcug

SEQ ID NO: 3040287 - RNA, 21 nt, Mycobacterium bovis subsp bovis AF2122/97
auagguguguggcgccgggga

SEQ ID NO: 3040288 - RNA, 18 nt, Mycobacterium bovis subsp bovis AF2122/97
auaguccuugcgccagcg

SEQ ID NO: 3040289 - RNA, 19 nt, Mycobacterium bovis subsp bovis AF2122/97
auagugcggcagcgguggc

SEQ ID NO: 3040290 - RNA, 23 nt, Mycobacterium bovis subsp bovis AF2122/97
auauaccagggcaucagcagagc

SEQ ID NO: 3040291 - RNA, 23 nt, Mycobacterium bovis subsp bovis AF2122/97
aucaccgcgcccgccgcggcagc

SEQ ID NO: 3040292 - RNA, 13 nt, Mycobacterium bovis subsp bovis AF2122/97
aucaccgcggcgg

SEQ ID NO: 3040293 - RNA, 20 nt, Mycobacterium bovis subsp bovis AF2122/97
aucaccggaacccccagcug

SEQ ID NO: 3040294 - RNA, 18 nt, Mycobacterium bovis subsp bovis AF2122/97
aucaccggagcgccgagc

SEQ ID NO: 3040295 - RNA, 16 nt, Mycobacterium bovis subsp bovis AF2122/97
aucaccggugcgcugg

SEQ ID NO: 3040296 - RNA, 18 nt, Mycobacterium bovis subsp bovis AF2122/97
aucaccgguucggugagc

SEQ ID NO: 3040297 - RNA, 19 nt, Mycobacterium bovis subsp bovis AF2122/97
aucaccgguucggugagcg

SEQ ID NO: 3040298 - RNA, 11 nt, Mycobacterium bovis subsp bovis AF2122/97
aucaccgucgc

SEQ ID NO: 3040299 - RNA, 18 nt, Mycobacterium bovis subsp bovis AF2122/97
aucaccucaccagucagg

SEQ ID NO: 3040300 - RNA, 16 nt, Mycobacterium bovis subsp bovis AF2122/97
aucaccucccgcggca

SEQ ID NO: 3040301 - RNA, 15 nt, Mycobacterium bovis subsp bovis AF2122/97
aucaccucgaugccg

SEQ ID NO: 3040302 - RNA, 22 nt, Mycobacterium bovis subsp bovis AF2122/97
aucaccucgaugccgcccguga

SEQ ID NO: 3040303 - RNA, 15 nt, Mycobacterium bovis subsp bovis AF2122/97
aucaccucggugccg

SEQ ID NO: 3040304 - RNA, 19 nt, Mycobacterium bovis subsp bovis AF2122/97
aucaccucggugccggccg

SEQ ID NO: 3040305 - RNA, 13 nt, Mycobacterium bovis subsp bovis AF2122/97
aucaccugcagca

SEQ ID NO: 3040306 - RNA, 19 nt, Mycobacterium bovis subsp bovis AF2122/97
aucaccuggcgugucgccg

SEQ ID NO: 3040307 - RNA, 19 nt, Mycobacterium bovis subsp bovis AF2122/97
aucaccuucggccgaccgg

SEQ ID NO: 3040308 - RNA, 21 nt, Mycobacterium bovis subsp bovis AF2122/97
aucaccuucggccgaccgggc

SEQ ID NO: 3040309 - RNA, 21 nt, Mycobacterium bovis subsp bovis AF2122/97
aucaccuugccuagccgcagc

SEQ ID NO: 3040310 - RNA, 13 nt, Mycobacterium bovis subsp bovis AF2122/97
aucacgaccgcgc

SEQ ID NO: 3040311 - RNA, 20 nt, Mycobacterium bovis subsp bovis AF2122/97
aucacgacguugccucgcga

SEQ ID NO: 3040312 - RNA, 12 nt, Mycobacterium bovis subsp bovis AF2122/97
aucacgaucaca

SEQ ID NO: 3040313 - RNA, 16 nt, Mycobacterium bovis subsp bovis AF2122/97
aucacgaucacaccac

SEQ ID NO: 3040314 - RNA, 20 nt, Mycobacterium bovis subsp bovis AF2122/97
aucacgauguccucgaugcg

SEQ ID NO: 3040315 - RNA, 13 nt, Mycobacterium bovis subsp bovis AF2122/97
aucacgccgggcg

SEQ ID NO: 3040316 - RNA, 21 nt, Mycobacterium bovis subsp bovis AF2122/97
aucacgcugccccgccgccau

SEQ ID NO: 3040317 - RNA, 17 nt, Mycobacterium bovis subsp bovis AF2122/97
aucacggcaccgaagug

SEQ ID NO: 3040318 - RNA, 13 nt, Mycobacterium bovis subsp bovis AF2122/97
aucacggcggccc

SEQ ID NO: 3040319 - RNA, 17 nt, Mycobacterium bovis subsp bovis AF2122/97
aucacggcggccccggc

SEQ ID NO: 3040320 - RNA, 20 nt, Mycobacterium bovis subsp bovis AF2122/97
aucacggcgggaugcagcug

SEQ ID NO: 3040321 - RNA, 19 nt, Mycobacterium bovis subsp bovis AF2122/97
aucacgggacgacggcaag

SEQ ID NO: 3040322 - RNA, 13 nt, Mycobacterium bovis subsp bovis AF2122/97
aucacggucagcc

SEQ ID NO: 3040323 - RNA, 20 nt, Mycobacterium bovis subsp bovis AF2122/97
aucacgguugccgcgaucgg

SEQ ID NO: 3040324 - RNA, 17 nt, Mycobacterium bovis subsp bovis AF2122/97
aucacguacgccgccga

SEQ ID NO: 3040325 - RNA, 17 nt, Mycobacterium bovis subsp bovis AF2122/97
aucacgucgucagccac

SEQ ID NO: 3040326 - RNA, 15 nt, Mycobacterium bovis subsp bovis AF2122/97
aucacguggaccacg

SEQ ID NO: 3040327 - RNA, 17 nt, Mycobacterium bovis subsp bovis AF2122/97
aucacguggaccacggc

SEQ ID NO: 3040328 - RNA, 19 nt, Mycobacterium bovis subsp bovis AF2122/97
aucacgugguccaaccggg

SEQ ID NO: 3040329 - RNA, 18 nt, Mycobacterium bovis subsp bovis AF2122/97
aucacguggugcggccgg

SEQ ID NO: 3040330 - RNA, 23 nt, Mycobacterium bovis subsp bovis AF2122/97
aucacguggugcggccgggucgc

SEQ ID NO: 3040331 - RNA, 22 nt, Mycobacterium bovis subsp bovis AF2122/97
aucacuaaccuggcguagauca

SEQ ID NO: 3040332 - RNA, 22 nt, Mycobacterium bovis subsp bovis AF2122/97
aucacucccccacacacccgac

SEQ ID NO: 3040333 - RNA, 13 nt, Mycobacterium bovis subsp bovis AF2122/97
aucagaacgugac

SEQ ID NO: 3040334 - RNA, 22 nt, Mycobacterium bovis subsp bovis AF2122/97
aucagaaucaggcucgccgaug

SEQ ID NO: 3040335 - RNA, 20 nt, Mycobacterium bovis subsp bovis AF2122/97
aucagacgauucggcggccg

SEQ ID NO: 3040336 - RNA, 20 nt, Mycobacterium bovis subsp bovis AF2122/97
aucagacgcucgaccugccu

SEQ ID NO: 3040337 - RNA, 19 nt, Mycobacterium bovis subsp bovis AF2122/97
aucagacggcgaguaggcg

SEQ ID NO: 3040338 - RNA, 21 nt, Mycobacterium bovis subsp bovis AF2122/97
aucagagcguucuucagccag

SEQ ID NO: 3040339 - RNA, 22 nt, Mycobacterium bovis subsp bovis AF2122/97
aucagagcguucuucagccagg

SEQ ID NO: 3040340 - RNA, 16 nt, Mycobacterium bovis subsp bovis AF2122/97
aucagaggacccgugc

SEQ ID NO: 3040341 - RNA, 13 nt, Mycobacterium bovis subsp bovis AF2122/97
aucagaucccgcc

SEQ ID NO: 3040342 - RNA, 12 nt, Mycobacterium bovis subsp bovis AF2122/97
aucagaucgccg

SEQ ID NO: 3040343 - RNA, 16 nt, Mycobacterium bovis subsp bovis AF2122/97
aucagauucgcgcugg

SEQ ID NO: 3040344 - RNA, 16 nt, Mycobacterium bovis subsp bovis AF2122/97
aucagcaacacgucgg

SEQ ID NO: 3040345 - RNA, 19 nt, Mycobacterium bovis subsp bovis AF2122/97
aucagcaagagccgcagcc

SEQ ID NO: 3040346 - RNA, 17 nt, Mycobacterium bovis subsp bovis AF2122/97
aucagcaccgacagccc

SEQ ID NO: 3040347 - RNA, 21 nt, Mycobacterium bovis subsp bovis AF2122/97
aucagcacguaacgccgcuca

SEQ ID NO: 3040348 - RNA, 13 nt, Mycobacterium bovis subsp bovis AF2122/97
aucagcacgucgc

SEQ ID NO: 3040349 - RNA, 17 nt, Mycobacterium bovis subsp bovis AF2122/97
aucagcagagccccggc

SEQ ID NO: 3040350 - RNA, 18 nt, Mycobacterium bovis subsp bovis AF2122/97
aucagcaugguccacagc

SEQ ID NO: 3040351 - RNA, 19 nt, Mycobacterium bovis subsp bovis AF2122/97
aucagcaugguccacagcc

SEQ ID NO: 3040352 - RNA, 15 nt, Mycobacterium bovis subsp bovis AF2122/97
aucagccaccgggug

SEQ ID NO: 3040353 - RNA, 13 nt, Mycobacterium bovis subsp bovis AF2122/97
aucagcccgccca

SEQ ID NO: 3040354 - RNA, 22 nt, Mycobacterium bovis subsp bovis AF2122/97
aucagcccggccuugccgccgg

SEQ ID NO: 3040355 - RNA, 17 nt, Mycobacterium bovis subsp bovis AF2122/97
aucagcccuucagcgaa

SEQ ID NO: 3040356 - RNA, 17 nt, Mycobacterium bovis subsp bovis AF2122/97
aucagccgccaaccgca

SEQ ID NO: 3040357 - RNA, 12 nt, Mycobacterium bovis subsp bovis AF2122/97
aucagccgugcg

SEQ ID NO: 3040358 - RNA, 17 nt, Mycobacterium bovis subsp bovis AF2122/97
aucagccgugcgggccg

SEQ ID NO: 3040359 - RNA, 19 nt, Mycobacterium bovis subsp bovis AF2122/97
aucagccguggcagucgca

SEQ ID NO: 3040360 - RNA, 21 nt, Mycobacterium bovis subsp bovis AF2122/97
aucagccguggcagucgcacg

SEQ ID NO: 3040361 - RNA, 23 nt, Mycobacterium bovis subsp bovis AF2122/97
aucagcgaaccaccggcgccgcc

SEQ ID NO: 3040362 - RNA, 20 nt, Mycobacterium bovis subsp bovis AF2122/97
aucagcgacuccaccccacc

SEQ ID NO: 3040363 - RNA, 16 nt, Mycobacterium bovis subsp bovis AF2122/97
aucagcgccagcgagc

SEQ ID NO: 3040364 - RNA, 18 nt, Mycobacterium bovis subsp bovis AF2122/97
aucagcgccagcgagcau

SEQ ID NO: 3040365 - RNA, 19 nt, Mycobacterium bovis subsp bovis AF2122/97
aucagcggcagcaccgcac

SEQ ID NO: 3040366 - RNA, 12 nt, Mycobacterium bovis subsp bovis AF2122/97
aucagcggcagu

SEQ ID NO: 3040367 - RNA, 22 nt, Mycobacterium bovis subsp bovis AF2122/97
aucagcggcaguuccugacgcc

SEQ ID NO: 3040368 - RNA, 14 nt, Mycobacterium bovis subsp bovis AF2122/97
aucagcguggcgcc

SEQ ID NO: 3040369 - RNA, 23 nt, Mycobacterium bovis subsp bovis AF2122/97
aucagcguggcgcccgugccgcc

SEQ ID NO: 3040370 - RNA, 14 nt, Mycobacterium bovis subsp bovis AF2122/97
aucagcgugggcau

SEQ ID NO: 3040371 - RNA, 16 nt, Mycobacterium bovis subsp bovis AF2122/97
aucagcgugucgccga

SEQ ID NO: 3040372 - RNA, 14 nt, Mycobacterium bovis subsp bovis AF2122/97
aucagcuccuccga

SEQ ID NO: 3040373 - RNA, 13 nt, Mycobacterium bovis subsp bovis AF2122/97
aucagcucgaugc

SEQ ID NO: 3040374 - RNA, 18 nt, Mycobacterium bovis subsp bovis AF2122/97
aucagcucgaugccgugu

SEQ ID NO: 3040375 - RNA, 18 nt, Mycobacterium bovis subsp bovis AF2122/97
aucagcuugggcagcagc

SEQ ID NO: 3040376 - RNA, 20 nt, Mycobacterium bovis subsp bovis AF2122/97
aucagcuugggcagcagcgc

SEQ ID NO: 3040377 - RNA, 15 nt, Mycobacterium bovis subsp bovis AF2122/97
auccagagacauguc

SEQ ID NO: 3040378 - RNA, 22 nt, Mycobacterium bovis subsp bovis AF2122/97
auccagaucggauugccuccgg

SEQ ID NO: 3040379 - RNA, 17 nt, Mycobacterium bovis subsp bovis AF2122/97
auccagaugcccagcag

SEQ ID NO: 3040380 - RNA, 15 nt, Mycobacterium bovis subsp bovis AF2122/97
auccagcaacgcggu

SEQ ID NO: 3040381 - RNA, 20 nt, Mycobacterium bovis subsp bovis AF2122/97
auccagcagccaggagccga

SEQ ID NO: 3040382 - RNA, 18 nt, Mycobacterium bovis subsp bovis AF2122/97
auccagcaggccgucgau

SEQ ID NO: 3040383 - RNA, 13 nt, Mycobacterium bovis subsp bovis AF2122/97
auccagccgucgg

SEQ ID NO: 3040384 - RNA, 15 nt, Mycobacterium bovis subsp bovis AF2122/97
auccagccgucggcg

SEQ ID NO: 3040385 - RNA, 16 nt, Mycobacterium bovis subsp bovis AF2122/97
auccagccgugcggcg

SEQ ID NO: 3040386 - RNA, 17 nt, Mycobacterium bovis subsp bovis AF2122/97
auccaggccaguuuggc

SEQ ID NO: 3040387 - RNA, 14 nt, Mycobacterium bovis subsp bovis AF2122/97
auccaggcccagcc

SEQ ID NO: 3040388 - RNA, 15 nt, Mycobacterium bovis subsp bovis AF2122/97
auccaggcgugcauc

SEQ ID NO: 3040389 - RNA, 19 nt, Mycobacterium bovis subsp bovis AF2122/97
auccaggcgugcaucgcga

SEQ ID NO: 3040390 - RNA, 20 nt, Mycobacterium bovis subsp bovis AF2122/97
auccaggcgugcaucgcgau

SEQ ID NO: 3040391 - RNA, 22 nt, Mycobacterium bovis subsp bovis AF2122/97
auccagggccgacgcgaaccca

SEQ ID NO: 3040392 - RNA, 21 nt, Mycobacterium bovis subsp bovis AF2122/97
auccaggggcgcaacucaucg

SEQ ID NO: 3040393 - RNA, 19 nt, Mycobacterium bovis subsp bovis AF2122/97
auccagggugccggucacg

SEQ ID NO: 3040394 - RNA, 16 nt, Mycobacterium bovis subsp bovis AF2122/97
auccagguagaccgga

SEQ ID NO: 3040395 - RNA, 19 nt, Mycobacterium bovis subsp bovis AF2122/97
auccaguaaccguccgcgg

SEQ ID NO: 3040396 - RNA, 20 nt, Mycobacterium bovis subsp bovis AF2122/97
auccauccgggccgcggcca

SEQ ID NO: 3040397 - RNA, 13 nt, Mycobacterium bovis subsp bovis AF2122/97
auccaugucgcgc

SEQ ID NO: 3040398 - RNA, 16 nt, Mycobacterium bovis subsp bovis AF2122/97
auccaugucgcgccag

SEQ ID NO: 3040399 - RNA, 17 nt, Mycobacterium bovis subsp bovis AF2122/97
auccauguugaccucgc

SEQ ID NO: 3040400 - RNA, 23 nt, Mycobacterium bovis subsp bovis AF2122/97
auccauuagcacaucgccggagu

SEQ ID NO: 3040401 - RNA, 19 nt, Mycobacterium bovis subsp bovis AF2122/97
auccauucggcggcggcgu

SEQ ID NO: 3040402 - RNA, 15 nt, Mycobacterium bovis subsp bovis AF2122/97
aucccaacgcccggg

SEQ ID NO: 3040403 - RNA, 21 nt, Mycobacterium bovis subsp bovis AF2122/97
aucccaagcguccgcugcagg

SEQ ID NO: 3040404 - RNA, 24 nt, Mycobacterium bovis subsp bovis AF2122/97
aucccaccggcuaugcuggcgcag

SEQ ID NO: 3040405 - RNA, 14 nt, Mycobacterium bovis subsp bovis AF2122/97
aucccacgcccggc

SEQ ID NO: 3040406 - RNA, 23 nt, Mycobacterium bovis subsp bovis AF2122/97
aucccacgcccggccccgcggcc

SEQ ID NO: 3040407 - RNA, 16 nt, Mycobacterium bovis subsp bovis AF2122/97
aucccacggugguggg

SEQ ID NO: 3040408 - RNA, 19 nt, Mycobacterium bovis subsp bovis AF2122/97
aucccagauaugcaggacu

SEQ ID NO: 3040409 - RNA, 16 nt, Mycobacterium bovis subsp bovis AF2122/97
aucccagcccgaaggu

SEQ ID NO: 3040410 - RNA, 21 nt, Mycobacterium bovis subsp bovis AF2122/97
aucccaggggcaccgagcuga

SEQ ID NO: 3040411 - RNA, 15 nt, Mycobacterium bovis subsp bovis AF2122/97
aucccaucggggcua

SEQ ID NO: 3040412 - RNA, 15 nt, Mycobacterium bovis subsp bovis AF2122/97
auccccaagcccgau

SEQ ID NO: 3040413 - RNA, 12 nt, Mycobacterium bovis subsp bovis AF2122/97
auccccagcaca

SEQ ID NO: 3040414 - RNA, 13 nt, Mycobacterium bovis subsp bovis AF2122/97
auccccagcacaa

SEQ ID NO: 3040415 - RNA, 19 nt, Mycobacterium bovis subsp bovis AF2122/97
auccccaguugugcggcca

SEQ ID NO: 3040416 - RNA, 17 nt, Mycobacterium bovis subsp bovis AF2122/97
auccccauugcgcccca

SEQ ID NO: 3040417 - RNA, 17 nt, Mycobacterium bovis subsp bovis AF2122/97
aucccccagccgcggcg

SEQ ID NO: 3040418 - RNA, 22 nt, Mycobacterium bovis subsp bovis AF2122/97
auccccgaccacugaucggcau

SEQ ID NO: 3040419 - RNA, 21 nt, Mycobacterium bovis subsp bovis AF2122/97
auccccgacugaacauacgaa

SEQ ID NO: 3040420 - RNA, 15 nt, Mycobacterium bovis subsp bovis AF2122/97
auccccgcaauuccc

SEQ ID NO: 3040421 - RNA, 22 nt, Mycobacterium bovis subsp bovis AF2122/97
auccccgcaauucccaucggcc

SEQ ID NO: 3040422 - RNA, 15 nt, Mycobacterium bovis subsp bovis AF2122/97
auccccgccggcgcc

SEQ ID NO: 3040423 - RNA, 20 nt, Mycobacterium bovis subsp bovis AF2122/97
auccccgcggcgguaaaccu

SEQ ID NO: 3040424 - RNA, 15 nt, Mycobacterium bovis subsp bovis AF2122/97
auccccgguacgucg

SEQ ID NO: 3040425 - RNA, 23 nt, Mycobacterium bovis subsp bovis AF2122/97
auccccuggccagcagagcggca

SEQ ID NO: 3040426 - RNA, 23 nt, Mycobacterium bovis subsp bovis AF2122/97
auccccuugguggccagccagcg

SEQ ID NO: 3040427 - RNA, 18 nt, Mycobacterium bovis subsp bovis AF2122/97
aucccgaccaccucagcu

SEQ ID NO: 3040428 - RNA, 15 nt, Mycobacterium bovis subsp bovis AF2122/97
aucccgaccagcaga

SEQ ID NO: 3040429 - RNA, 15 nt, Mycobacterium bovis subsp bovis AF2122/97
aucccgacccugcug

SEQ ID NO: 3040430 - RNA, 14 nt, Mycobacterium bovis subsp bovis AF2122/97
aucccgaggcgccc

SEQ ID NO: 3040431 - RNA, 14 nt, Mycobacterium bovis subsp bovis AF2122/97
aucccgaucccggc

SEQ ID NO: 3040432 - RNA, 17 nt, Mycobacterium bovis subsp bovis AF2122/97
aucccgaucccggccag

SEQ ID NO: 3040433 - RNA, 18 nt, Mycobacterium bovis subsp bovis AF2122/97
aucccgauccugcccacc

SEQ ID NO: 3040434 - RNA, 19 nt, Mycobacterium bovis subsp bovis AF2122/97
aucccgaucgaucagcaac

SEQ ID NO: 3040435 - RNA, 20 nt, Mycobacterium bovis subsp bovis AF2122/97
aucccgauguaccccagcgc

SEQ ID NO: 3040436 - RNA, 11 nt, Mycobacterium bovis subsp bovis AF2122/97
aucccgccacc

SEQ ID NO: 3040437 - RNA, 13 nt, Mycobacterium bovis subsp bovis AF2122/97
aucccgccaccga

SEQ ID NO: 3040438 - RNA, 11 nt, Mycobacterium bovis subsp bovis AF2122/97
aucccgcccaa

SEQ ID NO: 3040439 - RNA, 15 nt, Mycobacterium bovis subsp bovis AF2122/97
aucccgccgcccgca

SEQ ID NO: 3040440 - RNA, 16 nt, Mycobacterium bovis subsp bovis AF2122/97
aucccgccgcccgcau

SEQ ID NO: 3040441 - RNA, 22 nt, Mycobacterium bovis subsp bovis AF2122/97
aucccgccgcccgcaucgcggc

SEQ ID NO: 3040442 - RNA, 14 nt, Mycobacterium bovis subsp bovis AF2122/97
aucccgccgcugcc

SEQ ID NO: 3040443 - RNA, 19 nt, Mycobacterium bovis subsp bovis AF2122/97
aucccgccgcugccgccgg

SEQ ID NO: 3040444 - RNA, 22 nt, Mycobacterium bovis subsp bovis AF2122/97
aucccgccggggcccugggaga

SEQ ID NO: 3040445 - RNA, 17 nt, Mycobacterium bovis subsp bovis AF2122/97
aucccgcgcccggccgg

SEQ ID NO: 3040446 - RNA, 18 nt, Mycobacterium bovis subsp bovis AF2122/97
aucccgcucccccgccaa

SEQ ID NO: 3040447 - RNA, 12 nt, Mycobacterium bovis subsp bovis AF2122/97
aucccggccagg

SEQ ID NO: 3040448 - RNA, 13 nt, Mycobacterium bovis subsp bovis AF2122/97
aucccggccaggc

SEQ ID NO: 3040449 - RNA, 14 nt, Mycobacterium bovis subsp bovis AF2122/97
aucccggccaggcc

SEQ ID NO: 3040450 - RNA, 16 nt, Mycobacterium bovis subsp bovis AF2122/97
aucccggccaggccga

SEQ ID NO: 3040451 - RNA, 20 nt, Mycobacterium bovis subsp bovis AF2122/97
aucccggccaggggcgcagc

SEQ ID NO: 3040452 - RNA, 20 nt, Mycobacterium bovis subsp bovis AF2122/97
aucccggccuccauaucgca

SEQ ID NO: 3040453 - RNA, 18 nt, Mycobacterium bovis subsp bovis AF2122/97
aucccgggcaguccaggc

SEQ ID NO: 3040454 - RNA, 23 nt, Mycobacterium bovis subsp bovis AF2122/97
aucccggucgguguggacugggc

SEQ ID NO: 3040455 - RNA, 22 nt, Mycobacterium bovis subsp bovis AF2122/97
aucccggucuuuaauccagcgc

SEQ ID NO: 3040456 - RNA, 14 nt, Mycobacterium bovis subsp bovis AF2122/97
aucccgguggcagc

SEQ ID NO: 3040457 - RNA, 17 nt, Mycobacterium bovis subsp bovis AF2122/97
aucccgguggcagcaca

SEQ ID NO: 3040458 - RNA, 21 nt, Mycobacterium bovis subsp bovis AF2122/97
aucccggugucgaugcgcagc

SEQ ID NO: 3040459 - RNA, 20 nt, Mycobacterium bovis subsp bovis AF2122/97
aucccgguuccggcgaucaa

SEQ ID NO: 3040460 - RNA, 21 nt, Mycobacterium bovis subsp bovis AF2122/97
aucccguagccgugccaauga

SEQ ID NO: 3040461 - RNA, 18 nt, Mycobacterium bovis subsp bovis AF2122/97
aucccguauucgaugccg

SEQ ID NO: 3040462 - RNA, 21 nt, Mycobacterium bovis subsp bovis AF2122/97
aucccguauugauacugcccg

SEQ ID NO: 3040463 - RNA, 16 nt, Mycobacterium bovis subsp bovis AF2122/97
auccgucggcggagag

SEQ ID NO: 3040464 - RNA, 17 nt, Mycobacterium bovis subsp bovis AF2122/97
auccgugaauggcagca

SEQ ID NO: 3040465 - RNA, 21 nt, Mycobacterium bovis subsp bovis AF2122/97
auccgugaauggcagcacgac

SEQ ID NO: 3040466 - RNA, 14 nt, Mycobacterium bovis subsp bovis AF2122/97
auccgugcagggca

SEQ ID NO: 3040467 - RNA, 22 nt, Mycobacterium bovis subsp bovis AF2122/97
auccgugccgaaaaucgcagcc

SEQ ID NO: 3040468 - RNA, 20 nt, Mycobacterium bovis subsp bovis AF2122/97
auccguguuucgaacaccgu

SEQ ID NO: 3040469 - RNA, 23 nt, Mycobacterium bovis subsp bovis AF2122/97
auccguguuucgaacaccgucca

SEQ ID NO: 3040470 - RNA, 22 nt, Mycobacterium bovis subsp bovis AF2122/97
auccuaggguggcgauccacag

SEQ ID NO: 3040471 - RNA, 19 nt, Mycobacterium bovis subsp bovis AF2122/97
auccuccggguuggcgacg

SEQ ID NO: 3040472 - RNA, 18 nt, Mycobacterium bovis subsp bovis AF2122/97
auccuccugcgccgcagu

SEQ ID NO: 3040473 - RNA, 18 nt, Mycobacterium bovis subsp bovis AF2122/97
auccucgacuucggcggg

SEQ ID NO: 3040474 - RNA, 20 nt, Mycobacterium bovis subsp bovis AF2122/97
auccucgaugacaucgguca

SEQ ID NO: 3040475 - RNA, 22 nt, Mycobacterium bovis subsp bovis AF2122/97
auccucgaugacaucggucagc

SEQ ID NO: 3040476 - RNA, 13 nt, Mycobacterium bovis subsp bovis AF2122/97
auccucucgauca

SEQ ID NO: 3040477 - RNA, 17 nt, Mycobacterium bovis subsp bovis AF2122/97
auccugcaguacggcca

SEQ ID NO: 3040478 - RNA, 23 nt, Mycobacterium bovis subsp bovis AF2122/97
auccugccgcacgggcccaggac

SEQ ID NO: 3040479 - RNA, 24 nt, Mycobacterium bovis subsp bovis AF2122/97
auccugcgguugaguugcagaccg

SEQ ID NO: 3040480 - RNA, 13 nt, Mycobacterium bovis subsp bovis AF2122/97
auccuggacaagu

SEQ ID NO: 3040481 - RNA, 15 nt, Mycobacterium bovis subsp bovis AF2122/97
auccuggcggcugca

SEQ ID NO: 3040482 - RNA, 19 nt, Mycobacterium bovis subsp bovis AF2122/97
auccuggcggcugcagccg

SEQ ID NO: 3040483 - RNA, 19 nt, Mycobacterium bovis subsp bovis AF2122/97
auccugguggcagacaugg

SEQ ID NO: 3040484 - RNA, 18 nt, Mycobacterium bovis subsp bovis AF2122/97
auccuucgcgcucauugc

SEQ ID NO: 3040485 - RNA, 16 nt, Mycobacterium bovis subsp bovis AF2122/97
auccuucggggugaau

SEQ ID NO: 3040486 - RNA, 16 nt, Mycobacterium bovis subsp bovis AF2122/97
auccuugacgcggcca

SEQ ID NO: 3040487 - RNA, 18 nt, Mycobacterium bovis subsp bovis AF2122/97
auccuugacgcggccaca

SEQ ID NO: 3040488 - RNA, 23 nt, Mycobacterium bovis subsp bovis AF2122/97
auccuugaucaaggugucgacgg

SEQ ID NO: 3040489 - RNA, 18 nt, Mycobacterium bovis subsp bovis AF2122/97
auccuugccaaucgccgu

SEQ ID NO: 3040490 - RNA, 18 nt, Mycobacterium bovis subsp bovis AF2122/97
auccuugcgacguucuug

SEQ ID NO: 3040491 - RNA, 19 nt, Mycobacterium bovis subsp bovis AF2122/97
aucgaaagccaacucgacc

SEQ ID NO: 3040492 - RNA, 14 nt, Mycobacterium bovis subsp bovis AF2122/97
aucgaaccgcugcu

SEQ ID NO: 3040493 - RNA, 20 nt, Mycobacterium bovis subsp bovis AF2122/97
aucgaaccgcugcuccucgc

SEQ ID NO: 3040494 - RNA, 21 nt, Mycobacterium bovis subsp bovis AF2122/97
aucgaagcggcugcugcgcgg

SEQ ID NO: 3040495 - RNA, 21 nt, Mycobacterium bovis subsp bovis AF2122/97
aucgaaggugacaaaucggcc

SEQ ID NO: 3040496 - RNA, 19 nt, Mycobacterium bovis subsp bovis AF2122/97
aucgaauuaaagccaccag

SEQ ID NO: 3040497 - RNA, 21 nt, Mycobacterium bovis subsp bovis AF2122/97
aucgaauuccagccagccgcc

SEQ ID NO: 3040498 - RNA, 21 nt, Mycobacterium bovis subsp bovis AF2122/97
aucgaauugcguucgccgccc

SEQ ID NO: 3040499 - RNA, 22 nt, Mycobacterium bovis subsp bovis AF2122/97
aucgaauugcguucgccgcccg

SEQ ID NO: 3040500 - RNA, 13 nt, Mycobacterium bovis subsp bovis AF2122/97
aucgacaaucgca

SEQ ID NO: 3040501 - RNA, 19 nt, Mycobacterium bovis subsp bovis AF2122/97
aucgacaccgagccacgac

SEQ ID NO: 3040502 - RNA, 19 nt, Mycobacterium bovis subsp bovis AF2122/97
aucgacaccgugaccgccg

SEQ ID NO: 3040503 - RNA, 13 nt, Mycobacterium bovis subsp bovis AF2122/97
aucgacagcagcg

SEQ ID NO: 3040504 - RNA, 16 nt, Mycobacterium bovis subsp bovis AF2122/97
aucgacagccccgcgg

SEQ ID NO: 3040505 - RNA, 18 nt, Mycobacterium bovis subsp bovis AF2122/97
aucgacagccccgcggcc

SEQ ID NO: 3040506 - RNA, 22 nt, Mycobacterium bovis subsp bovis AF2122/97
aucgacagccccgcggccagca

SEQ ID NO: 3040507 - RNA, 22 nt, Mycobacterium bovis subsp bovis AF2122/97
aucgacagugugaagaccaccg

SEQ ID NO: 3040508 - RNA, 17 nt, Mycobacterium bovis subsp bovis AF2122/97
aucgacaucaccaccgc

SEQ ID NO: 3040509 - RNA, 23 nt, Mycobacterium bovis subsp bovis AF2122/97
aucgacaucaccaccgccggggu

SEQ ID NO: 3040510 - RNA, 21 nt, Mycobacterium bovis subsp bovis AF2122/97
aucgacaucguuggccgggca

SEQ ID NO: 3040511 - RNA, 17 nt, Mycobacterium bovis subsp bovis AF2122/97
aucgaccaauucgaccg

SEQ ID NO: 3040512 - RNA, 22 nt, Mycobacterium bovis subsp bovis AF2122/97
aucgaccaccggguagccggcg

SEQ ID NO: 3040513 - RNA, 13 nt, Mycobacterium bovis subsp bovis AF2122/97
aucgaccaugguc

SEQ ID NO: 3040514 - RNA, 14 nt, Mycobacterium bovis subsp bovis AF2122/97
aucgaccauggucg

SEQ ID NO: 3040515 - RNA, 16 nt, Mycobacterium bovis subsp bovis AF2122/97
aucgacccgaugaccc

SEQ ID NO: 3040516 - RNA, 17 nt, Mycobacterium bovis subsp bovis AF2122/97
aucgacccuccagcacg

SEQ ID NO: 3040517 - RNA, 17 nt, Mycobacterium bovis subsp bovis AF2122/97
aucgaccgaggcacguc

SEQ ID NO: 3040518 - RNA, 12 nt, Mycobacterium bovis subsp bovis AF2122/97
aucgaccgcccg

SEQ ID NO: 3040519 - RNA, 14 nt, Mycobacterium bovis subsp bovis AF2122/97
aucgaccgcccgcc

SEQ ID NO: 3040520 - RNA, 17 nt, Mycobacterium bovis subsp bovis AF2122/97
aucgaccgccgcgagca

SEQ ID NO: 3040521 - RNA, 11 nt, Mycobacterium bovis subsp bovis AF2122/97
aucgaccgcgg

SEQ ID NO: 3040522 - RNA, 16 nt, Mycobacterium bovis subsp bovis AF2122/97
aucgaccggacaaaca

SEQ ID NO: 3040523 - RNA, 15 nt, Mycobacterium bovis subsp bovis AF2122/97
aucgaccuggccacg

SEQ ID NO: 3040524 - RNA, 14 nt, Mycobacterium bovis subsp bovis AF2122/97
aucgacgaccguca

SEQ ID NO: 3040525 - RNA, 16 nt, Mycobacterium bovis subsp bovis AF2122/97
aucgacgagccgcggu

SEQ ID NO: 3040526 - RNA, 22 nt, Mycobacterium bovis subsp bovis AF2122/97
aucgacgagccgcggucggcgu

SEQ ID NO: 3040527 - RNA, 18 nt, Mycobacterium bovis subsp bovis AF2122/97
aucgacgcauuccucgac

SEQ ID NO: 3040528 - RNA, 16 nt, Mycobacterium bovis subsp bovis AF2122/97
aucgacgccgccaccc

SEQ ID NO: 3040529 - RNA, 18 nt, Mycobacterium bovis subsp bovis AF2122/97
aucgacgccgccacccgg

SEQ ID NO: 3040530 - RNA, 15 nt, Mycobacterium bovis subsp bovis AF2122/97
aucgacgcggccaac

SEQ ID NO: 3040531 - RNA, 18 nt, Mycobacterium bovis subsp bovis AF2122/97
aucgacgcggccaacgaa

SEQ ID NO: 3040532 - RNA, 19 nt, Mycobacterium bovis subsp bovis AF2122/97
aucgacggccagcccagca

SEQ ID NO: 3040533 - RNA, 13 nt, Mycobacterium bovis subsp bovis AF2122/97
aucgacggcggcc

SEQ ID NO: 3040534 - RNA, 17 nt, Mycobacterium bovis subsp bovis AF2122/97
aucgacguuccagcagu

SEQ ID NO: 3040535 - RNA, 16 nt, Mycobacterium bovis subsp bovis AF2122/97
aucgacucacacaccg

SEQ ID NO: 3040536 - RNA, 21 nt, Mycobacterium bovis subsp bovis AF2122/97
aucgacugaucgccacccggu

SEQ ID NO: 3040537 - RNA, 22 nt, Mycobacterium bovis subsp bovis AF2122/97
aucgacugaucgccacccgguc

SEQ ID NO: 3040538 - RNA, 17 nt, Mycobacterium bovis subsp bovis AF2122/97
aucgacugcagcccguu

SEQ ID NO: 3040539 - RNA, 19 nt, Mycobacterium bovis subsp bovis AF2122/97
aucgacuucggcgucggac

SEQ ID NO: 3040540 - RNA, 13 nt, Mycobacterium bovis subsp bovis AF2122/97
aucgagacgcacg

SEQ ID NO: 3040541 - RNA, 19 nt, Mycobacterium bovis subsp bovis AF2122/97
aucgagacuucuucgacgc

SEQ ID NO: 3040542 - RNA, 21 nt, Mycobacterium bovis subsp bovis AF2122/97
aucgagacuucuucgacgcgc

SEQ ID NO: 3040543 - RNA, 15 nt, Mycobacterium bovis subsp bovis AF2122/97
aucgagagccgaccg

SEQ ID NO: 3040544 - RNA, 21 nt, Mycobacterium bovis subsp bovis AF2122/97
aucgagaguugaauccgggaa

SEQ ID NO: 3040545 - RNA, 19 nt, Mycobacterium bovis subsp bovis AF2122/97
aucgagauauugcgcgccu

SEQ ID NO: 3040546 - RNA, 13 nt, Mycobacterium bovis subsp bovis AF2122/97
aucgagaucgccg

SEQ ID NO: 3040547 - RNA, 14 nt, Mycobacterium bovis subsp bovis AF2122/97
aucgagaucgccgu

SEQ ID NO: 3040548 - RNA, 22 nt, Mycobacterium bovis subsp bovis AF2122/97
aucgagaucgccguugccggcg

SEQ ID NO: 3040549 - RNA, 19 nt, Mycobacterium bovis subsp bovis AF2122/97
aucgcccugacacccaucg

SEQ ID NO: 3040550 - RNA, 16 nt, Mycobacterium bovis subsp bovis AF2122/97
aucgccgaaucggcag

SEQ ID NO: 3040551 - RNA, 20 nt, Mycobacterium bovis subsp bovis AF2122/97
aucgccgacgccagaacgug

SEQ ID NO: 3040552 - RNA, 15 nt, Mycobacterium bovis subsp bovis AF2122/97
aucgccgacgcccag

SEQ ID NO: 3040553 - RNA, 22 nt, Mycobacterium bovis subsp bovis AF2122/97
aucgccgacgcccaggcauggc

SEQ ID NO: 3040554 - RNA, 18 nt, Mycobacterium bovis subsp bovis AF2122/97
aucgccgacuacgaagac

SEQ ID NO: 3040555 - RNA, 20 nt, Mycobacterium bovis subsp bovis AF2122/97
aucgccgaggccucggccag

SEQ ID NO: 3040556 - RNA, 23 nt, Mycobacterium bovis subsp bovis AF2122/97
aucgccgccaaccacuuuccggc

SEQ ID NO: 3040557 - RNA, 11 nt, Mycobacterium bovis subsp bovis AF2122/97
aucgccgccgg

SEQ ID NO: 3040558 - RNA, 15 nt, Mycobacterium bovis subsp bovis AF2122/97
aucgccgccggugcc

SEQ ID NO: 3040559 - RNA, 17 nt, Mycobacterium bovis subsp bovis AF2122/97
aucgccgcgaagcgcuc

SEQ ID NO: 3040560 - RNA, 21 nt, Mycobacterium bovis subsp bovis AF2122/97
aucgccgcgaagcgcucggca

SEQ ID NO: 3040561 - RNA, 23 nt, Mycobacterium bovis subsp bovis AF2122/97
aucgccgcgaagcgcucggcagc

SEQ ID NO: 3040562 - RNA, 17 nt, Mycobacterium bovis subsp bovis AF2122/97
aucgccgcgauggcggu

SEQ ID NO: 3040563 - RNA, 23 nt, Mycobacterium bovis subsp bovis AF2122/97
aucgccgcgcuggucggagacca

SEQ ID NO: 3040564 - RNA, 13 nt, Mycobacterium bovis subsp bovis AF2122/97
aucgccgcgggcg

SEQ ID NO: 3040565 - RNA, 23 nt, Mycobacterium bovis subsp bovis AF2122/97
aucgccgcgggugaucugggcgg

SEQ ID NO: 3040566 - RNA, 17 nt, Mycobacterium bovis subsp bovis AF2122/97
aucgccgcuaacgcacc

SEQ ID NO: 3040567 - RNA, 19 nt, Mycobacterium bovis subsp bovis AF2122/97
aucgccgcuaccgucagua

SEQ ID NO: 3040568 - RNA, 16 nt, Mycobacterium bovis subsp bovis AF2122/97
aucgccgcuacgccgg

SEQ ID NO: 3040569 - RNA, 15 nt, Mycobacterium bovis subsp bovis AF2122/97
aucgccgcuggccag

SEQ ID NO: 3040570 - RNA, 21 nt, Mycobacterium bovis subsp bovis AF2122/97
aucgccgcuugacgcagcucg

SEQ ID NO: 3040571 - RNA, 18 nt, Mycobacterium bovis subsp bovis AF2122/97
aucgccggcuucgcccag

SEQ ID NO: 3040572 - RNA, 12 nt, Mycobacterium bovis subsp bovis AF2122/97
aucgccgggaac

SEQ ID NO: 3040573 - RNA, 19 nt, Mycobacterium bovis subsp bovis AF2122/97
aucgccgggaacaucccag

SEQ ID NO: 3040574 - RNA, 20 nt, Mycobacterium bovis subsp bovis AF2122/97
aucgccgggaacaucccagc

SEQ ID NO: 3040575 - RNA, 20 nt, Mycobacterium bovis subsp bovis AF2122/97
aucgccgggcuuggccgcgc

SEQ ID NO: 3040576 - RNA, 17 nt, Mycobacterium bovis subsp bovis AF2122/97
aucgccggggacgccgc

SEQ ID NO: 3040577 - RNA, 18 nt, Mycobacterium bovis subsp bovis AF2122/97
aucgccggggacgccgcg

SEQ ID NO: 3040578 - RNA, 13 nt, Mycobacterium bovis subsp bovis AF2122/97
aucgccgggugca

SEQ ID NO: 3040579 - RNA, 17 nt, Mycobacterium bovis subsp bovis AF2122/97
aucgccgucagcaccgc

SEQ ID NO: 3040580 - RNA, 18 nt, Mycobacterium bovis subsp bovis AF2122/97
aucgccgucagcaccgcu

SEQ ID NO: 3040581 - RNA, 15 nt, Mycobacterium bovis subsp bovis AF2122/97
aucgccguccagcaa

SEQ ID NO: 3040582 - RNA, 16 nt, Mycobacterium bovis subsp bovis AF2122/97
aucgccucaccacguc

SEQ ID NO: 3040583 - RNA, 17 nt, Mycobacterium bovis subsp bovis AF2122/97
aucgccuccagccggcg

SEQ ID NO: 3040584 - RNA, 18 nt, Mycobacterium bovis subsp bovis AF2122/97
aucgccuccagccggcga

SEQ ID NO: 3040585 - RNA, 23 nt, Mycobacterium bovis subsp bovis AF2122/97
aucgccuccagccggcgaaugcg

SEQ ID NO: 3040586 - RNA, 24 nt, Mycobacterium bovis subsp bovis AF2122/97
aucgccuccagccggcgaaugcgg

SEQ ID NO: 3040587 - RNA, 20 nt, Mycobacterium bovis subsp bovis AF2122/97
aucgccuccaggcgccaccc

SEQ ID NO: 3040588 - RNA, 14 nt, Mycobacterium bovis subsp bovis AF2122/97
aucgccucgacgcg

SEQ ID NO: 3040589 - RNA, 17 nt, Mycobacterium bovis subsp bovis AF2122/97
aucgccucgacgcggca

SEQ ID NO: 3040590 - RNA, 19 nt, Mycobacterium bovis subsp bovis AF2122/97
aucgccucggcgcugcgca

SEQ ID NO: 3040591 - RNA, 17 nt, Mycobacterium bovis subsp bovis AF2122/97
aucgccugagcgccgcg

SEQ ID NO: 3040592 - RNA, 18 nt, Mycobacterium bovis subsp bovis AF2122/97
aucgccugagcgccgcgg

SEQ ID NO: 3040593 - RNA, 16 nt, Mycobacterium bovis subsp bovis AF2122/97
aucgccuggaugccga

SEQ ID NO: 3040594 - RNA, 14 nt, Mycobacterium bovis subsp bovis AF2122/97
aucgccuugcccag

SEQ ID NO: 3040595 - RNA, 20 nt, Mycobacterium bovis subsp bovis AF2122/97
aucgcgaaacagcacgcccg

SEQ ID NO: 3040596 - RNA, 13 nt, Mycobacterium bovis subsp bovis AF2122/97
aucgcgaaaccgg

SEQ ID NO: 3040597 - RNA, 13 nt, Mycobacterium bovis subsp bovis AF2122/97
aucgcgaacaucg

SEQ ID NO: 3040598 - RNA, 22 nt, Mycobacterium bovis subsp bovis AF2122/97
aucgcgaagcggaccgagccga

SEQ ID NO: 3040599 - RNA, 18 nt, Mycobacterium bovis subsp bovis AF2122/97
aucgcgaauauagcggcg

SEQ ID NO: 3040600 - RNA, 17 nt, Mycobacterium bovis subsp bovis AF2122/97
aucgcgacacgcggccc

SEQ ID NO: 3040601 - RNA, 18 nt, Mycobacterium bovis subsp bovis AF2122/97
aucgcgacacgcggcccg

SEQ ID NO: 3040602 - RNA, 23 nt, Mycobacterium bovis subsp bovis AF2122/97
aucgcgacggggucgcgaugcuc

SEQ ID NO: 3040603 - RNA, 20 nt, Mycobacterium bovis subsp bovis AF2122/97
aucgcgacuagacgccgccg

SEQ ID NO: 3040604 - RNA, 20 nt, Mycobacterium bovis subsp bovis AF2122/97
aucgcgagaaggugcugcgc

SEQ ID NO: 3040605 - RNA, 22 nt, Mycobacterium bovis subsp bovis AF2122/97
aucgcgagaaggugcugcgcgg

SEQ ID NO: 3040606 - RNA, 17 nt, Mycobacterium bovis subsp bovis AF2122/97
aucgcgagcgccgcuau

SEQ ID NO: 3040607 - RNA, 15 nt, Mycobacterium bovis subsp bovis AF2122/97
aucgcgagcugcgac

SEQ ID NO: 3040608 - RNA, 24 nt, Mycobacterium bovis subsp bovis AF2122/97
aucgcgagcugcgacgaugccgcc

SEQ ID NO: 3040609 - RNA, 18 nt, Mycobacterium bovis subsp bovis AF2122/97
aucgcgagcuuggccggc

SEQ ID NO: 3040610 - RNA, 20 nt, Mycobacterium bovis subsp bovis AF2122/97
aucgcgagcuuggccggcag

SEQ ID NO: 3040611 - RNA, 21 nt, Mycobacterium bovis subsp bovis AF2122/97
aucgcgaggcuguccgaaccg

SEQ ID NO: 3040612 - RNA, 16 nt, Mycobacterium bovis subsp bovis AF2122/97
aucgcgauccacccgg

SEQ ID NO: 3040613 - RNA, 19 nt, Mycobacterium bovis subsp bovis AF2122/97
aucgcgauccacccggcau

SEQ ID NO: 3040614 - RNA, 13 nt, Mycobacterium bovis subsp bovis AF2122/97
aucgcgcaccgca

SEQ ID NO: 3040615 - RNA, 24 nt, Mycobacterium bovis subsp bovis AF2122/97
aucgcgcagauggcauugcgccca

SEQ ID NO: 3040616 - RNA, 15 nt, Mycobacterium bovis subsp bovis AF2122/97
aucgcgcagcgccgc

SEQ ID NO: 3040617 - RNA, 18 nt, Mycobacterium bovis subsp bovis AF2122/97
aucgcgccgucggcgaug

SEQ ID NO: 3040618 - RNA, 22 nt, Mycobacterium bovis subsp bovis AF2122/97
aucgcgccgucgucgaccacga

SEQ ID NO: 3040619 - RNA, 23 nt, Mycobacterium bovis subsp bovis AF2122/97
aucgcgccgucgucgaccacgac

SEQ ID NO: 3040620 - RNA, 21 nt, Mycobacterium bovis subsp bovis AF2122/97
aucgcgccuuugagcccgcga

SEQ ID NO: 3040621 - RNA, 12 nt, Mycobacterium bovis subsp bovis AF2122/97
aucgcgcgccga

SEQ ID NO: 3040622 - RNA, 16 nt, Mycobacterium bovis subsp bovis AF2122/97
aucgcgcgcggcuccg

SEQ ID NO: 3040623 - RNA, 17 nt, Mycobacterium bovis subsp bovis AF2122/97
aucgcgcggaccagagu

SEQ ID NO: 3040624 - RNA, 17 nt, Mycobacterium bovis subsp bovis AF2122/97
aucgcgcggcugugccc

SEQ ID NO: 3040625 - RNA, 20 nt, Mycobacterium bovis subsp bovis AF2122/97
aucgcgcggcugugcccgau

SEQ ID NO: 3040626 - RNA, 15 nt, Mycobacterium bovis subsp bovis AF2122/97
aucgcgcuggcgccc

SEQ ID NO: 3040627 - RNA, 16 nt, Mycobacterium bovis subsp bovis AF2122/97
aucgcggaagcgggcg

SEQ ID NO: 3040628 - RNA, 22 nt, Mycobacterium bovis subsp bovis AF2122/97
aucgcggaagcgggcgaugccg

SEQ ID NO: 3040629 - RNA, 19 nt, Mycobacterium bovis subsp bovis AF2122/97
aucgcggacccgucggcgu

SEQ ID NO: 3040630 - RNA, 17 nt, Mycobacterium bovis subsp bovis AF2122/97
aucgcggcaucgacgcg

SEQ ID NO: 3040631 - RNA, 21 nt, Mycobacterium bovis subsp bovis AF2122/97
aucgcggcccggcccuccggg

SEQ ID NO: 3040632 - RNA, 12 nt, Mycobacterium bovis subsp bovis AF2122/97
aucgcggccgaa

SEQ ID NO: 3040633 - RNA, 14 nt, Mycobacterium bovis subsp bovis AF2122/97
aucgcggcgagcac

SEQ ID NO: 3040634 - RNA, 22 nt, Mycobacterium bovis subsp bovis AF2122/97
aucgcggcgccgucgucagcgg

SEQ ID NO: 3040635 - RNA, 18 nt, Mycobacterium bovis subsp bovis AF2122/97
aucggccgcggucggcca

SEQ ID NO: 3040636 - RNA, 21 nt, Mycobacterium bovis subsp bovis AF2122/97
aucggccggcgucagccccga

SEQ ID NO: 3040637 - RNA, 21 nt, Mycobacterium bovis subsp bovis AF2122/97
aucggccggguuaucggcagc

SEQ ID NO: 3040638 - RNA, 22 nt, Mycobacterium bovis subsp bovis AF2122/97
aucggccggguuaucggcagca

SEQ ID NO: 3040639 - RNA, 21 nt, Mycobacterium bovis subsp bovis AF2122/97
aucggccuguccaccgaugcc

SEQ ID NO: 3040640 - RNA, 22 nt, Mycobacterium bovis subsp bovis AF2122/97
aucggccuguccaccgaugcca

SEQ ID NO: 3040641 - RNA, 15 nt, Mycobacterium bovis subsp bovis AF2122/97
aucggccuguucgcc

SEQ ID NO: 3040642 - RNA, 16 nt, Mycobacterium bovis subsp bovis AF2122/97
aucggccuguucgccg

SEQ ID NO: 3040643 - RNA, 18 nt, Mycobacterium bovis subsp bovis AF2122/97
aucggccuguucgccguc

SEQ ID NO: 3040644 - RNA, 16 nt, Mycobacterium bovis subsp bovis AF2122/97
aucggcgaggccucgg

SEQ ID NO: 3040645 - RNA, 21 nt, Mycobacterium bovis subsp bovis AF2122/97
aucggcgauccgacgaccucg

SEQ ID NO: 3040646 - RNA, 14 nt, Mycobacterium bovis subsp bovis AF2122/97
aucggcgccgcaua

SEQ ID NO: 3040647 - RNA, 17 nt, Mycobacterium bovis subsp bovis AF2122/97
aucggcgccuugguccg

SEQ ID NO: 3040648 - RNA, 13 nt, Mycobacterium bovis subsp bovis AF2122/97
aucggcgcgccga

SEQ ID NO: 3040649 - RNA, 15 nt, Mycobacterium bovis subsp bovis AF2122/97
aucggcgcuagccag

SEQ ID NO: 3040650 - RNA, 16 nt, Mycobacterium bovis subsp bovis AF2122/97
aucggcggaccgcagc

SEQ ID NO: 3040651 - RNA, 21 nt, Mycobacterium bovis subsp bovis AF2122/97
aucggcggaugaugcaacgcc

SEQ ID NO: 3040652 - RNA, 16 nt, Mycobacterium bovis subsp bovis AF2122/97
aucggcggcaaccgcc

SEQ ID NO: 3040653 - RNA, 20 nt, Mycobacterium bovis subsp bovis AF2122/97
aucggcggcaaccgccgcca

SEQ ID NO: 3040654 - RNA, 15 nt, Mycobacterium bovis subsp bovis AF2122/97
aucggcggcaacggc

SEQ ID NO: 3040655 - RNA, 15 nt, Mycobacterium bovis subsp bovis AF2122/97
aucggcggcccuguu

SEQ ID NO: 3040656 - RNA, 13 nt, Mycobacterium bovis subsp bovis AF2122/97
aucggcggccggc

SEQ ID NO: 3040657 - RNA, 17 nt, Mycobacterium bovis subsp bovis AF2122/97
aucggcggccggcgccg

SEQ ID NO: 3040658 - RNA, 19 nt, Mycobacterium bovis subsp bovis AF2122/97
aucggcggcgcgccgaucg

SEQ ID NO: 3040659 - RNA, 16 nt, Mycobacterium bovis subsp bovis AF2122/97
aucggcggcguccagc

SEQ ID NO: 3040660 - RNA, 17 nt, Mycobacterium bovis subsp bovis AF2122/97
aucggcggcguccagca

SEQ ID NO: 3040661 - RNA, 19 nt, Mycobacterium bovis subsp bovis AF2122/97
aucggcggcguccagcagc

SEQ ID NO: 3040662 - RNA, 18 nt, Mycobacterium bovis subsp bovis AF2122/97
aucggcggcgucuucguc

SEQ ID NO: 3040663 - RNA, 17 nt, Mycobacterium bovis subsp bovis AF2122/97
aucggcggggcccacac

SEQ ID NO: 3040664 - RNA, 15 nt, Mycobacterium bovis subsp bovis AF2122/97
aucggcgguggcggu

SEQ ID NO: 3040665 - RNA, 13 nt, Mycobacterium bovis subsp bovis AF2122/97
aucggcgucacga

SEQ ID NO: 3040666 - RNA, 22 nt, Mycobacterium bovis subsp bovis AF2122/97
aucggcgucaggcacaacgcga

SEQ ID NO: 3040667 - RNA, 14 nt, Mycobacterium bovis subsp bovis AF2122/97
aucggcguccauca

SEQ ID NO: 3040668 - RNA, 15 nt, Mycobacterium bovis subsp bovis AF2122/97
aucggcguccaucac

SEQ ID NO: 3040669 - RNA, 19 nt, Mycobacterium bovis subsp bovis AF2122/97
aucggcguuagucgaucac

SEQ ID NO: 3040670 - RNA, 20 nt, Mycobacterium bovis subsp bovis AF2122/97
aucggcguuagucgaucacg

SEQ ID NO: 3040671 - RNA, 14 nt, Mycobacterium bovis subsp bovis AF2122/97
aucggcguuaucga

SEQ ID NO: 3040672 - RNA, 20 nt, Mycobacterium bovis subsp bovis AF2122/97
aucggcguuaucgaaggcga

SEQ ID NO: 3040673 - RNA, 19 nt, Mycobacterium bovis subsp bovis AF2122/97
aucggcuaccuaacccgca

SEQ ID NO: 3040674 - RNA, 23 nt, Mycobacterium bovis subsp bovis AF2122/97
aucggcuaccuaacccgcaccgg

SEQ ID NO: 3040675 - RNA, 20 nt, Mycobacterium bovis subsp bovis AF2122/97
aucggcuaccuaacccgcgc

SEQ ID NO: 3040676 - RNA, 23 nt, Mycobacterium bovis subsp bovis AF2122/97
aucggcuaccuaacccgcgccgg

SEQ ID NO: 3040677 - RNA, 15 nt, Mycobacterium bovis subsp bovis AF2122/97
aucggcuaggccggc

SEQ ID NO: 3040678 - RNA, 18 nt, Mycobacterium bovis subsp bovis AF2122/97
aucggcuaggccggccgg

SEQ ID NO: 3040679 - RNA, 18 nt, Mycobacterium bovis subsp bovis AF2122/97
aucggcuggccgcgccuc

SEQ ID NO: 3040680 - RNA, 18 nt, Mycobacterium bovis subsp bovis AF2122/97
aucggcuucuucuucuug

SEQ ID NO: 3040681 - RNA, 21 nt, Mycobacterium bovis subsp bovis AF2122/97
aucggcuuggcugugauguug

SEQ ID NO: 3040682 - RNA, 19 nt, Mycobacterium bovis subsp bovis AF2122/97
aucggcuugggaaacccgg

SEQ ID NO: 3040683 - RNA, 20 nt, Mycobacterium bovis subsp bovis AF2122/97
aucggcuugggaaacccggc

SEQ ID NO: 3040684 - RNA, 20 nt, Mycobacterium bovis subsp bovis AF2122/97
aucgggaagccgccgggcau

SEQ ID NO: 3040685 - RNA, 19 nt, Mycobacterium bovis subsp bovis AF2122/97
aucgggaaguacggcaggc

SEQ ID NO: 3040686 - RNA, 18 nt, Mycobacterium bovis subsp bovis AF2122/97
aucgggacgccuugaucg

SEQ ID NO: 3040687 - RNA, 18 nt, Mycobacterium bovis subsp bovis AF2122/97
aucgggagccgcacccga

SEQ ID NO: 3040688 - RNA, 17 nt, Mycobacterium bovis subsp bovis AF2122/97
aucgggaucgcugccag

SEQ ID NO: 3040689 - RNA, 19 nt, Mycobacterium bovis subsp bovis AF2122/97
aucgggaucugcgccgcgc

SEQ ID NO: 3040690 - RNA, 22 nt, Mycobacterium bovis subsp bovis AF2122/97
aucgggaucugcgccgcgcgcg

SEQ ID NO: 3040691 - RNA, 18 nt, Mycobacterium bovis subsp bovis AF2122/97
aucgggccacagcaacgu

SEQ ID NO: 3040692 - RNA, 19 nt, Mycobacterium bovis subsp bovis AF2122/97
aucgggcccaccgcugcgg

SEQ ID NO: 3040693 - RNA, 21 nt, Mycobacterium bovis subsp bovis AF2122/97
aucgggcccaccgcugcggca

SEQ ID NO: 3040694 - RNA, 13 nt, Mycobacterium bovis subsp bovis AF2122/97
aucgggcccagca

SEQ ID NO: 3040695 - RNA, 20 nt, Mycobacterium bovis subsp bovis AF2122/97
aucgggcccccuggaucgcg

SEQ ID NO: 3040696 - RNA, 15 nt, Mycobacterium bovis subsp bovis AF2122/97
aucgggcccguccug

SEQ ID NO: 3040697 - RNA, 17 nt, Mycobacterium bovis subsp bovis AF2122/97
aucgggcccuccggcgc

SEQ ID NO: 3040698 - RNA, 22 nt, Mycobacterium bovis subsp bovis AF2122/97
aucgggccgaucucuccggcgg

SEQ ID NO: 3040699 - RNA, 13 nt, Mycobacterium bovis subsp bovis AF2122/97
aucgggccggcgc

SEQ ID NO: 3040700 - RNA, 14 nt, Mycobacterium bovis subsp bovis AF2122/97
aucgggcgagcucg

SEQ ID NO: 3040701 - RNA, 23 nt, Mycobacterium bovis subsp bovis AF2122/97
aucgggcguggugagcaguguga

SEQ ID NO: 3040702 - RNA, 16 nt, Mycobacterium bovis subsp bovis AF2122/97
aucgggcucacucgcc

SEQ ID NO: 3040703 - RNA, 14 nt, Mycobacterium bovis subsp bovis AF2122/97
aucgggcucagcgg

SEQ ID NO: 3040704 - RNA, 15 nt, Mycobacterium bovis subsp bovis AF2122/97
aucgggcucagcggc

SEQ ID NO: 3040705 - RNA, 16 nt, Mycobacterium bovis subsp bovis AF2122/97
aucgggcucagcggcg

SEQ ID NO: 3040706 - RNA, 15 nt, Mycobacterium bovis subsp bovis AF2122/97
aucgggcuucggcca

SEQ ID NO: 3040707 - RNA, 21 nt, Mycobacterium bovis subsp bovis AF2122/97
aucgggcuucggccagaucac

SEQ ID NO: 3040708 - RNA, 20 nt, Mycobacterium bovis subsp bovis AF2122/97
aucgggcuugcgcagcagcg

SEQ ID NO: 3040709 - RNA, 16 nt, Mycobacterium bovis subsp bovis AF2122/97
aucggggcaccgugcg

SEQ ID NO: 3040710 - RNA, 20 nt, Mycobacterium bovis subsp bovis AF2122/97
aucggggcgacgauccgcac

SEQ ID NO: 3040711 - RNA, 24 nt, Mycobacterium bovis subsp bovis AF2122/97
aucggggucgaacaugauccgccg

SEQ ID NO: 3040712 - RNA, 21 nt, Mycobacterium bovis subsp bovis AF2122/97
aucgggucacccccggccagc

SEQ ID NO: 3040713 - RNA, 21 nt, Mycobacterium bovis subsp bovis AF2122/97
aucgggucagcaccaccagca

SEQ ID NO: 3040714 - RNA, 17 nt, Mycobacterium bovis subsp bovis AF2122/97
aucggguccacgucucc

SEQ ID NO: 3040715 - RNA, 17 nt, Mycobacterium bovis subsp bovis AF2122/97
aucgggucgcugccggc

SEQ ID NO: 3040716 - RNA, 14 nt, Mycobacterium bovis subsp bovis AF2122/97
aucggucaccgcgg

SEQ ID NO: 3040717 - RNA, 13 nt, Mycobacterium bovis subsp bovis AF2122/97
aucggucaugucc

SEQ ID NO: 3040718 - RNA, 18 nt, Mycobacterium bovis subsp bovis AF2122/97
aucggucauguccguccg

SEQ ID NO: 3040719 - RNA, 14 nt, Mycobacterium bovis subsp bovis AF2122/97
aucgguccggcgaa

SEQ ID NO: 3040720 - RNA, 12 nt, Mycobacterium bovis subsp bovis AF2122/97
aucggucgacga

SEQ ID NO: 3040721 - RNA, 14 nt, Mycobacterium bovis subsp bovis AF2122/97
aucggucggcacca

SEQ ID NO: 3040722 - RNA, 20 nt, Mycobacterium bovis subsp bovis AF2122/97
aucggugaaucgucugacga

SEQ ID NO: 3040723 - RNA, 16 nt, Mycobacterium bovis subsp bovis AF2122/97
aucggugaccguggcg

SEQ ID NO: 3040724 - RNA, 20 nt, Mycobacterium bovis subsp bovis AF2122/97
aucggugaccguggcgggga

SEQ ID NO: 3040725 - RNA, 24 nt, Mycobacterium bovis subsp bovis AF2122/97
aucggugagcccguugaccugcgc

SEQ ID NO: 3040726 - RNA, 22 nt, Mycobacterium bovis subsp bovis AF2122/97
aucggugaucaaaccggcggcg

SEQ ID NO: 3040727 - RNA, 15 nt, Mycobacterium bovis subsp bovis AF2122/97
aucggugaucgaggu

SEQ ID NO: 3040728 - RNA, 18 nt, Mycobacterium bovis subsp bovis AF2122/97
aucggugcacaacgccca

SEQ ID NO: 3040729 - RNA, 20 nt, Mycobacterium bovis subsp bovis AF2122/97
aucggugcacaacgcccacc

SEQ ID NO: 3040730 - RNA, 22 nt, Mycobacterium bovis subsp bovis AF2122/97
aucggugcacaacgcccaccac

SEQ ID NO: 3040731 - RNA, 13 nt, Mycobacterium bovis subsp bovis AF2122/97
aucggugccggcc

SEQ ID NO: 3040732 - RNA, 14 nt, Mycobacterium bovis subsp bovis AF2122/97
aucggugccggccu

SEQ ID NO: 3040733 - RNA, 19 nt, Mycobacterium bovis subsp bovis AF2122/97
aucggugcgcacggcggcc

SEQ ID NO: 3040734 - RNA, 20 nt, Mycobacterium bovis subsp bovis AF2122/97
aucggugcgguucgcugcgg

SEQ ID NO: 3040735 - RNA, 17 nt, Mycobacterium bovis subsp bovis AF2122/97
aucggugcuggucgccg

SEQ ID NO: 3040736 - RNA, 19 nt, Mycobacterium bovis subsp bovis AF2122/97
aucgguggccaccaccgug

SEQ ID NO: 3040737 - RNA, 17 nt, Mycobacterium bovis subsp bovis AF2122/97
aucgguggccaucgcga

SEQ ID NO: 3040738 - RNA, 16 nt, Mycobacterium bovis subsp bovis AF2122/97
aucgguggcgccgaac

SEQ ID NO: 3040739 - RNA, 23 nt, Mycobacterium bovis subsp bovis AF2122/97
aucgguggcgccgaacgccagca

SEQ ID NO: 3040740 - RNA, 23 nt, Mycobacterium bovis subsp bovis AF2122/97
aucgguggucgauggacaacagc

SEQ ID NO: 3040741 - RNA, 14 nt, Mycobacterium bovis subsp bovis AF2122/97
aucggugguggcgu

SEQ ID NO: 3040742 - RNA, 21 nt, Mycobacterium bovis subsp bovis AF2122/97
aucggugguuagguggcuggc

SEQ ID NO: 3040743 - RNA, 23 nt, Mycobacterium bovis subsp bovis AF2122/97
aucgguguggacuucagcaggcc

SEQ ID NO: 3040744 - RNA, 16 nt, Mycobacterium bovis subsp bovis AF2122/97
aucgguguggcccaac

SEQ ID NO: 3040745 - RNA, 23 nt, Mycobacterium bovis subsp bovis AF2122/97
aucgguguggcccaacaccgcca

SEQ ID NO: 3040746 - RNA, 21 nt, Mycobacterium bovis subsp bovis AF2122/97
aucgguuccauugcgaacucg

SEQ ID NO: 3040747 - RNA, 15 nt, Mycobacterium bovis subsp bovis AF2122/97
aucgguucggccaga

SEQ ID NO: 3040748 - RNA, 14 nt, Mycobacterium bovis subsp bovis AF2122/97
aucgguugaccggu

SEQ ID NO: 3040749 - RNA, 16 nt, Mycobacterium bovis subsp bovis AF2122/97
aucgguugaucggcca

SEQ ID NO: 3040750 - RNA, 16 nt, Mycobacterium bovis subsp bovis AF2122/97
aucgguugcacccgcg

SEQ ID NO: 3040751 - RNA, 12 nt, Mycobacterium bovis subsp bovis AF2122/97
aucguaggccgg

SEQ ID NO: 3040752 - RNA, 20 nt, Mycobacterium bovis subsp bovis AF2122/97
aucgucaagccgggcacggg

SEQ ID NO: 3040753 - RNA, 13 nt, Mycobacterium bovis subsp bovis AF2122/97
aucgucacgcggg

SEQ ID NO: 3040754 - RNA, 19 nt, Mycobacterium bovis subsp bovis AF2122/97
aucgucacgcggguugcgc

SEQ ID NO: 3040755 - RNA, 15 nt, Mycobacterium bovis subsp bovis AF2122/97
aucgucagccagcgu

SEQ ID NO: 3040756 - RNA, 12 nt, Mycobacterium bovis subsp bovis AF2122/97
aucgucaggccc

SEQ ID NO: 3040757 - RNA, 15 nt, Mycobacterium bovis subsp bovis AF2122/97
aucgucaguuacgca

SEQ ID NO: 3040758 - RNA, 22 nt, Mycobacterium bovis subsp bovis AF2122/97
aucgucaguuacgcaucgucag

SEQ ID NO: 3040759 - RNA, 14 nt, Mycobacterium bovis subsp bovis AF2122/97
aucgucccgcggcg

SEQ ID NO: 3040760 - RNA, 13 nt, Mycobacterium bovis subsp bovis AF2122/97
aucguccggccgg

SEQ ID NO: 3040761 - RNA, 15 nt, Mycobacterium bovis subsp bovis AF2122/97
aucgucgaaccggau

SEQ ID NO: 3040762 - RNA, 17 nt, Mycobacterium bovis subsp bovis AF2122/97
aucgucgacgaugucgg

SEQ ID NO: 3040763 - RNA, 14 nt, Mycobacterium bovis subsp bovis AF2122/97
aucgucgagcaccu

SEQ ID NO: 3040764 - RNA, 23 nt, Mycobacterium bovis subsp bovis AF2122/97
aucgucgagcaccuugcgauugc

SEQ ID NO: 3040765 - RNA, 19 nt, Mycobacterium bovis subsp bovis AF2122/97
aucgucgagccgaucgccc

SEQ ID NO: 3040766 - RNA, 20 nt, Mycobacterium bovis subsp bovis AF2122/97
aucgucgagccgaucgcccg

SEQ ID NO: 3040767 - RNA, 14 nt, Mycobacterium bovis subsp bovis AF2122/97
aucgucgccacgau

SEQ ID NO: 3040768 - RNA, 19 nt, Mycobacterium bovis subsp bovis AF2122/97
aucgucgccacgaugccgg

SEQ ID NO: 3040769 - RNA, 19 nt, Mycobacterium bovis subsp bovis AF2122/97
aucgucgccaugcugcccu

SEQ ID NO: 3040770 - RNA, 16 nt, Mycobacterium bovis subsp bovis AF2122/97
aucgucgccgagcggg

SEQ ID NO: 3040771 - RNA, 14 nt, Mycobacterium bovis subsp bovis AF2122/97
aucgucgccgauca

SEQ ID NO: 3040772 - RNA, 13 nt, Mycobacterium bovis subsp bovis AF2122/97
aucgucggccagc

SEQ ID NO: 3040773 - RNA, 21 nt, Mycobacterium bovis subsp bovis AF2122/97
aucgucggguaccagcaccga

SEQ ID NO: 3040774 - RNA, 17 nt, Mycobacterium bovis subsp bovis AF2122/97
aucgucgucaacccggu

SEQ ID NO: 3040775 - RNA, 15 nt, Mycobacterium bovis subsp bovis AF2122/97
aucgucgucgcugcc

SEQ ID NO: 3040776 - RNA, 16 nt, Mycobacterium bovis subsp bovis AF2122/97
aucgucgugcacggcg

SEQ ID NO: 3040777 - RNA, 17 nt, Mycobacterium bovis subsp bovis AF2122/97
aucgucgugucgccgcc

SEQ ID NO: 3040778 - RNA, 18 nt, Mycobacterium bovis subsp bovis AF2122/97
aucgucgugucgccgccg

SEQ ID NO: 3040779 - RNA, 19 nt, Mycobacterium bovis subsp bovis AF2122/97
aucgucgugucgccgccgu

SEQ ID NO: 3040780 - RNA, 20 nt, Mycobacterium bovis subsp bovis AF2122/97
aucgucgugucgccgccguu

SEQ ID NO: 3040781 - RNA, 23 nt, Mycobacterium bovis subsp bovis AF2122/97
aucgucgugucgccgccguugcc

SEQ ID NO: 3040782 - RNA, 15 nt, Mycobacterium bovis subsp bovis AF2122/97
aucgucucggccacg

SEQ ID NO: 3040783 - RNA, 22 nt, Mycobacterium bovis subsp bovis AF2122/97
aucgucugacgaaauccgccgg

SEQ ID NO: 3040784 - RNA, 19 nt, Mycobacterium bovis subsp bovis AF2122/97
aucgucugguggcagcgca

SEQ ID NO: 3040785 - RNA, 19 nt, Mycobacterium bovis subsp bovis AF2122/97
aucgucuugucgccgagua

SEQ ID NO: 3040786 - RNA, 18 nt, Mycobacterium bovis subsp bovis AF2122/97
aucgugaucgaccggaca

SEQ ID NO: 3040787 - RNA, 13 nt, Mycobacterium bovis subsp bovis AF2122/97
aucgugccgaaca

SEQ ID NO: 3040788 - RNA, 15 nt, Mycobacterium bovis subsp bovis AF2122/97
aucgugccggcgaac

SEQ ID NO: 3040789 - RNA, 16 nt, Mycobacterium bovis subsp bovis AF2122/97
aucgugcgccgacggu

SEQ ID NO: 3040790 - RNA, 12 nt, Mycobacterium bovis subsp bovis AF2122/97
aucguggcgacc

SEQ ID NO: 3040791 - RNA, 17 nt, Mycobacterium bovis subsp bovis AF2122/97
aucguggcgaccacgau

SEQ ID NO: 3040792 - RNA, 15 nt, Mycobacterium bovis subsp bovis AF2122/97
aucguggcgcccguc

SEQ ID NO: 3040793 - RNA, 13 nt, Mycobacterium bovis subsp bovis AF2122/97
aucgugguucggc

SEQ ID NO: 3040794 - RNA, 21 nt, Mycobacterium bovis subsp bovis AF2122/97
aucguguacauugccgacccg

SEQ ID NO: 3040795 - RNA, 16 nt, Mycobacterium bovis subsp bovis AF2122/97
aucguguacugcuccu

SEQ ID NO: 3040796 - RNA, 18 nt, Mycobacterium bovis subsp bovis AF2122/97
aucguguacuggucugga

SEQ ID NO: 3040797 - RNA, 18 nt, Mycobacterium bovis subsp bovis AF2122/97
aucguucaugaucggcag

SEQ ID NO: 3040798 - RNA, 20 nt, Mycobacterium bovis subsp bovis AF2122/97
aucguucaugaucggcagaa

SEQ ID NO: 3040799 - RNA, 16 nt, Mycobacterium bovis subsp bovis AF2122/97
aucguuccaggccgcg

SEQ ID NO: 3040800 - RNA, 17 nt, Mycobacterium bovis subsp bovis AF2122/97
aucguuccaggccgcgu

SEQ ID NO: 3040801 - RNA, 15 nt, Mycobacterium bovis subsp bovis AF2122/97
aucguugccggugcc

SEQ ID NO: 3040802 - RNA, 16 nt, Mycobacterium bovis subsp bovis AF2122/97
aucguugccucgucgc

SEQ ID NO: 3040803 - RNA, 14 nt, Mycobacterium bovis subsp bovis AF2122/97
aucguugugcaccc

SEQ ID NO: 3040804 - RNA, 18 nt, Mycobacterium bovis subsp bovis AF2122/97
aucguuguugaccaccac

SEQ ID NO: 3040805 - RNA, 18 nt, Mycobacterium bovis subsp bovis AF2122/97
aucuagaggcggcccccg

SEQ ID NO: 3040806 - RNA, 14 nt, Mycobacterium bovis subsp bovis AF2122/97
aucuauggaugacc

SEQ ID NO: 3040807 - RNA, 18 nt, Mycobacterium bovis subsp bovis AF2122/97
aucuccacccgccggccg

SEQ ID NO: 3040808 - RNA, 22 nt, Mycobacterium bovis subsp bovis AF2122/97
aucuggguccgucgagucgccg

SEQ ID NO: 3040809 - RNA, 19 nt, Mycobacterium bovis subsp bovis AF2122/97
aucugguaagucagcucga

SEQ ID NO: 3040810 - RNA, 20 nt, Mycobacterium bovis subsp bovis AF2122/97
aucugguauucaugcccguc

SEQ ID NO: 3040811 - RNA, 15 nt, Mycobacterium bovis subsp bovis AF2122/97
aucuggucaagaccc

SEQ ID NO: 3040812 - RNA, 19 nt, Mycobacterium bovis subsp bovis AF2122/97
aucuggucaagguugacgu

SEQ ID NO: 3040813 - RNA, 18 nt, Mycobacterium bovis subsp bovis AF2122/97
aucuggugcgcggagagc

SEQ ID NO: 3040814 - RNA, 13 nt, Mycobacterium bovis subsp bovis AF2122/97
aucugguggaccu

SEQ ID NO: 3040815 - RNA, 20 nt, Mycobacterium bovis subsp bovis AF2122/97
aucugguugaaccgguacaa

SEQ ID NO: 3040816 - RNA, 14 nt, Mycobacterium bovis subsp bovis AF2122/97
aucugucgcgccgg

SEQ ID NO: 3040817 - RNA, 21 nt, Mycobacterium bovis subsp bovis AF2122/97
aucugugagauaccgacgcgc

SEQ ID NO: 3040818 - RNA, 21 nt, Mycobacterium bovis subsp bovis AF2122/97
aucuguguuugcggcuucggc

SEQ ID NO: 3040819 - RNA, 20 nt, Mycobacterium bovis subsp bovis AF2122/97
aucuuccggaaagcucuugc

SEQ ID NO: 3040820 - RNA, 19 nt, Mycobacterium bovis subsp bovis AF2122/97
aucuucgcgcagccgccgc

SEQ ID NO: 3040821 - RNA, 16 nt, Mycobacterium bovis subsp bovis AF2122/97
aucuucggacgccagc

SEQ ID NO: 3040822 - RNA, 18 nt, Mycobacterium bovis subsp bovis AF2122/97
aucuucggacgccagcuc

SEQ ID NO: 3040823 - RNA, 22 nt, Mycobacterium bovis subsp bovis AF2122/97
aucuucgggaguguaguagagc

SEQ ID NO: 3040824 - RNA, 16 nt, Mycobacterium bovis subsp bovis AF2122/97
aucuucucgagccgcc

SEQ ID NO: 3040825 - RNA, 19 nt, Mycobacterium bovis subsp bovis AF2122/97
aucuucucgagccgccgga

SEQ ID NO: 3040826 - RNA, 15 nt, Mycobacterium bovis subsp bovis AF2122/97
aucuucugccuuggc

SEQ ID NO: 3040827 - RNA, 16 nt, Mycobacterium bovis subsp bovis AF2122/97
aucuucuucagguagc

SEQ ID NO: 3040828 - RNA, 22 nt, Mycobacterium bovis subsp bovis AF2122/97
aucuugcgacgcccgccuucga

SEQ ID NO: 3040829 - RNA, 12 nt, Mycobacterium bovis subsp bovis AF2122/97
aucuugcgcaug

SEQ ID NO: 3040830 - RNA, 17 nt, Mycobacterium bovis subsp bovis AF2122/97
aucuuggccagcagcgc

SEQ ID NO: 3040831 - RNA, 19 nt, Mycobacterium bovis subsp bovis AF2122/97
aucuuggcgcccgccggca

SEQ ID NO: 3040832 - RNA, 14 nt, Mycobacterium bovis subsp bovis AF2122/97
aucuugggccacgc

SEQ ID NO: 3040833 - RNA, 12 nt, Mycobacterium bovis subsp bovis AF2122/97
aucuugguguug

SEQ ID NO: 3040834 - RNA, 16 nt, Mycobacterium bovis subsp bovis AF2122/97
aucuugguguuggugg

SEQ ID NO: 3040835 - RNA, 19 nt, Mycobacterium bovis subsp bovis AF2122/97
aucuugucgagcaccucga

SEQ ID NO: 3040836 - RNA, 13 nt, Mycobacterium bovis subsp bovis AF2122/97
aucuugucgaucu

SEQ ID NO: 3040837 - RNA, 14 nt, Mycobacterium bovis subsp bovis AF2122/97
aucuugugccaggc

SEQ ID NO: 3040838 - RNA, 15 nt, Mycobacterium bovis subsp bovis AF2122/97
aucuugugccaggcg

SEQ ID NO: 3040839 - RNA, 20 nt, Mycobacterium bovis subsp bovis AF2122/97
aucuuuccggcguauagccc

SEQ ID NO: 3040840 - RNA, 20 nt, Mycobacterium bovis subsp bovis AF2122/97
aucuuuucaccaccucgguu

SEQ ID NO: 3040841 - RNA, 17 nt, Mycobacterium bovis subsp bovis AF2122/97
augaaccacggcaggca

SEQ ID NO: 3040842 - RNA, 22 nt, Mycobacterium bovis subsp bovis AF2122/97
augaaccacggcaggcagggca

SEQ ID NO: 3040843 - RNA, 16 nt, Mycobacterium bovis subsp bovis AF2122/97
augaacgcaaccgagg

SEQ ID NO: 3040844 - RNA, 20 nt, Mycobacterium bovis subsp bovis AF2122/97
augaacgcaaccgagggcau

SEQ ID NO: 3040845 - RNA, 23 nt, Mycobacterium bovis subsp bovis AF2122/97
augaacgcaagcagcgcgaucug

SEQ ID NO: 3040846 - RNA, 15 nt, Mycobacterium bovis subsp bovis AF2122/97
augaacguggcgaca

SEQ ID NO: 3040847 - RNA, 16 nt, Mycobacterium bovis subsp bovis AF2122/97
augaacuucccacccg

SEQ ID NO: 3040848 - RNA, 13 nt, Mycobacterium bovis subsp bovis AF2122/97
augaagauccaga

SEQ ID NO: 3040849 - RNA, 12 nt, Mycobacterium bovis subsp bovis AF2122/97
augaagccaccc

SEQ ID NO: 3040850 - RNA, 15 nt, Mycobacterium bovis subsp bovis AF2122/97
augaaggccggcgac

SEQ ID NO: 3040851 - RNA, 19 nt, Mycobacterium bovis subsp bovis AF2122/97
augaauucuuuggggcgcg

SEQ ID NO: 3040852 - RNA, 15 nt, Mycobacterium bovis subsp bovis AF2122/97
augaauugccgggcg

SEQ ID NO: 3040853 - RNA, 14 nt, Mycobacterium bovis subsp bovis AF2122/97
augacaaaccugca

SEQ ID NO: 3040854 - RNA, 22 nt, Mycobacterium bovis subsp bovis AF2122/97
augacaaaccugcaugcccaga

SEQ ID NO: 3040855 - RNA, 16 nt, Mycobacterium bovis subsp bovis AF2122/97
augacaccgaccgggu

SEQ ID NO: 3040856 - RNA, 15 nt, Mycobacterium bovis subsp bovis AF2122/97
augacaccggccacc

SEQ ID NO: 3040857 - RNA, 15 nt, Mycobacterium bovis subsp bovis AF2122/97
augaccacgccgacg

SEQ ID NO: 3040858 - RNA, 21 nt, Mycobacterium bovis subsp bovis AF2122/97
augaccagcacaccgcccgca

SEQ ID NO: 3040859 - RNA, 21 nt, Mycobacterium bovis subsp bovis AF2122/97
augaccaucgaggcgaucacc

SEQ ID NO: 3040860 - RNA, 22 nt, Mycobacterium bovis subsp bovis AF2122/97
augaccccggcguugccgccgu

SEQ ID NO: 3040861 - RNA, 16 nt, Mycobacterium bovis subsp bovis AF2122/97
augaccccgucagcgg

SEQ ID NO: 3040862 - RNA, 15 nt, Mycobacterium bovis subsp bovis AF2122/97
augacccgcggguga

SEQ ID NO: 3040863 - RNA, 17 nt, Mycobacterium bovis subsp bovis AF2122/97
augacccgcgggugaug

SEQ ID NO: 3040864 - RNA, 14 nt, Mycobacterium bovis subsp bovis AF2122/97
augaccgacaggug

SEQ ID NO: 3040865 - RNA, 18 nt, Mycobacterium bovis subsp bovis AF2122/97
augaccgacaggugcucg

SEQ ID NO: 3040866 - RNA, 22 nt, Mycobacterium bovis subsp bovis AF2122/97
augaccgccagcagcaggccag

SEQ ID NO: 3040867 - RNA, 17 nt, Mycobacterium bovis subsp bovis AF2122/97
augaccgggaggcggcg

SEQ ID NO: 3040868 - RNA, 22 nt, Mycobacterium bovis subsp bovis AF2122/97
augaccgguauuaccgccgugg

SEQ ID NO: 3040869 - RNA, 18 nt, Mycobacterium bovis subsp bovis AF2122/97
augaccguauagccgacg

SEQ ID NO: 3040870 - RNA, 14 nt, Mycobacterium bovis subsp bovis AF2122/97
augaccuggccgcc

SEQ ID NO: 3040871 - RNA, 17 nt, Mycobacterium bovis subsp bovis AF2122/97
augaccuggccgcccgc

SEQ ID NO: 3040872 - RNA, 21 nt, Mycobacterium bovis subsp bovis AF2122/97
augaccuguagaucagcagcg

SEQ ID NO: 3040873 - RNA, 18 nt, Mycobacterium bovis subsp bovis AF2122/97
augaccuucccgucgacg

SEQ ID NO: 3040874 - RNA, 16 nt, Mycobacterium bovis subsp bovis AF2122/97
augacgaagugcaggu

SEQ ID NO: 3040875 - RNA, 13 nt, Mycobacterium bovis subsp bovis AF2122/97
augacgacgccgu

SEQ ID NO: 3040876 - RNA, 15 nt, Mycobacterium bovis subsp bovis AF2122/97
augacgacggugacc

SEQ ID NO: 3040877 - RNA, 14 nt, Mycobacterium bovis subsp bovis AF2122/97
augacgaucgcggc

SEQ ID NO: 3040878 - RNA, 14 nt, Mycobacterium bovis subsp bovis AF2122/97
augacgaucggcgg

SEQ ID NO: 3040879 - RNA, 17 nt, Mycobacterium bovis subsp bovis AF2122/97
augacgaugccgccgaa

SEQ ID NO: 3040880 - RNA, 22 nt, Mycobacterium bovis subsp bovis AF2122/97
augacgauggccgccgcgagga

SEQ ID NO: 3040881 - RNA, 19 nt, Mycobacterium bovis subsp bovis AF2122/97
augacgaugguguacugcu

SEQ ID NO: 3040882 - RNA, 17 nt, Mycobacterium bovis subsp bovis AF2122/97
augacgcccagggcguc

SEQ ID NO: 3040883 - RNA, 19 nt, Mycobacterium bovis subsp bovis AF2122/97
augacgccggcggguggcc

SEQ ID NO: 3040884 - RNA, 15 nt, Mycobacterium bovis subsp bovis AF2122/97
augacggucgggcgg

SEQ ID NO: 3040885 - RNA, 14 nt, Mycobacterium bovis subsp bovis AF2122/97
augacgguguggaa

SEQ ID NO: 3040886 - RNA, 22 nt, Mycobacterium bovis subsp bovis AF2122/97
augacgucgacaacgaucgcgc

SEQ ID NO: 3040887 - RNA, 16 nt, Mycobacterium bovis subsp bovis AF2122/97
augacguugcagccgg

SEQ ID NO: 3040888 - RNA, 17 nt, Mycobacterium bovis subsp bovis AF2122/97
augacguugcagccggc

SEQ ID NO: 3040889 - RNA, 19 nt, Mycobacterium bovis subsp bovis AF2122/97
augacugggcaaacccgga

SEQ ID NO: 3040890 - RNA, 23 nt, Mycobacterium bovis subsp bovis AF2122/97
augagaucauccacugcgagggc

SEQ ID NO: 3040891 - RNA, 13 nt, Mycobacterium bovis subsp bovis AF2122/97
augagaucgggac

SEQ ID NO: 3040892 - RNA, 12 nt, Mycobacterium bovis subsp bovis AF2122/97
augagcaugccc

SEQ ID NO: 3040893 - RNA, 17 nt, Mycobacterium bovis subsp bovis AF2122/97
augagcaugcccagcgc

SEQ ID NO: 3040894 - RNA, 18 nt, Mycobacterium bovis subsp bovis AF2122/97
augagcaugcccagcgca

SEQ ID NO: 3040895 - RNA, 17 nt, Mycobacterium bovis subsp bovis AF2122/97
augccagcggcacaccc

SEQ ID NO: 3040896 - RNA, 22 nt, Mycobacterium bovis subsp bovis AF2122/97
augccaggacuggcaccgccag

SEQ ID NO: 3040897 - RNA, 19 nt, Mycobacterium bovis subsp bovis AF2122/97
augccagugcaucggucag

SEQ ID NO: 3040898 - RNA, 19 nt, Mycobacterium bovis subsp bovis AF2122/97
augccauaaccggugggga

SEQ ID NO: 3040899 - RNA, 19 nt, Mycobacterium bovis subsp bovis AF2122/97
augccauuucgucgucgcu

SEQ ID NO: 3040900 - RNA, 19 nt, Mycobacterium bovis subsp bovis AF2122/97
augcccacgcugccgcagu

SEQ ID NO: 3040901 - RNA, 20 nt, Mycobacterium bovis subsp bovis AF2122/97
augcccagcgaauccaggcc

SEQ ID NO: 3040902 - RNA, 15 nt, Mycobacterium bovis subsp bovis AF2122/97
augcccauccggccg

SEQ ID NO: 3040903 - RNA, 15 nt, Mycobacterium bovis subsp bovis AF2122/97
augcccgaccggucu

SEQ ID NO: 3040904 - RNA, 15 nt, Mycobacterium bovis subsp bovis AF2122/97
augcccgcaccgcgu

SEQ ID NO: 3040905 - RNA, 19 nt, Mycobacterium bovis subsp bovis AF2122/97
augcccgccguagaccagc

SEQ ID NO: 3040906 - RNA, 21 nt, Mycobacterium bovis subsp bovis AF2122/97
augcccgcugaucagauccuc

SEQ ID NO: 3040907 - RNA, 19 nt, Mycobacterium bovis subsp bovis AF2122/97
augcccgguuucuucuuca

SEQ ID NO: 3040908 - RNA, 20 nt, Mycobacterium bovis subsp bovis AF2122/97
augcccguagacgccgagca

SEQ ID NO: 3040909 - RNA, 19 nt, Mycobacterium bovis subsp bovis AF2122/97
augcccuccucgaccgcgg

SEQ ID NO: 3040910 - RNA, 21 nt, Mycobacterium bovis subsp bovis AF2122/97
augcccugcgcucgggcugcc

SEQ ID NO: 3040911 - RNA, 12 nt, Mycobacterium bovis subsp bovis AF2122/97
augcccuugaga

SEQ ID NO: 3040912 - RNA, 15 nt, Mycobacterium bovis subsp bovis AF2122/97
augcccuuggccagc

SEQ ID NO: 3040913 - RNA, 17 nt, Mycobacterium bovis subsp bovis AF2122/97
augccgaacuccgcgga

SEQ ID NO: 3040914 - RNA, 17 nt, Mycobacterium bovis subsp bovis AF2122/97
augccgacgacaacagc

SEQ ID NO: 3040915 - RNA, 22 nt, Mycobacterium bovis subsp bovis AF2122/97
augccgacgacaacagccagcu

SEQ ID NO: 3040916 - RNA, 18 nt, Mycobacterium bovis subsp bovis AF2122/97
augccgagaagugggcgg

SEQ ID NO: 3040917 - RNA, 20 nt, Mycobacterium bovis subsp bovis AF2122/97
augccgagaagugggcggua

SEQ ID NO: 3040918 - RNA, 15 nt, Mycobacterium bovis subsp bovis AF2122/97
augccgaucggccug

SEQ ID NO: 3040919 - RNA, 16 nt, Mycobacterium bovis subsp bovis AF2122/97
augccgaugaccgccu

SEQ ID NO: 3040920 - RNA, 12 nt, Mycobacterium bovis subsp bovis AF2122/97
augccgaugccc

SEQ ID NO: 3040921 - RNA, 15 nt, Mycobacterium bovis subsp bovis AF2122/97
augccgaugcgacgc

SEQ ID NO: 3040922 - RNA, 17 nt, Mycobacterium bovis subsp bovis AF2122/97
augccgaugucgaugcc

SEQ ID NO: 3040923 - RNA, 20 nt, Mycobacterium bovis subsp bovis AF2122/97
augccgauuacggugaucgc

SEQ ID NO: 3040924 - RNA, 14 nt, Mycobacterium bovis subsp bovis AF2122/97
augccgccaaccgc

SEQ ID NO: 3040925 - RNA, 17 nt, Mycobacterium bovis subsp bovis AF2122/97
augccgccaugcgcacc

SEQ ID NO: 3040926 - RNA, 18 nt, Mycobacterium bovis subsp bovis AF2122/97
augccgcccagcgaccgc

SEQ ID NO: 3040927 - RNA, 19 nt, Mycobacterium bovis subsp bovis AF2122/97
augccgcccagcgaccgcu

SEQ ID NO: 3040928 - RNA, 19 nt, Mycobacterium bovis subsp bovis AF2122/97
augccgcccgcgccgccgg

SEQ ID NO: 3040929 - RNA, 20 nt, Mycobacterium bovis subsp bovis AF2122/97
augccgcccgcgccgccgga

SEQ ID NO: 3040930 - RNA, 12 nt, Mycobacterium bovis subsp bovis AF2122/97
augccgccgacg

SEQ ID NO: 3040931 - RNA, 17 nt, Mycobacterium bovis subsp bovis AF2122/97
augccgccgacgggaac

SEQ ID NO: 3040932 - RNA, 10 nt, Mycobacterium bovis subsp bovis AF2122/97
augccgccgg

SEQ ID NO: 3040933 - RNA, 13 nt, Mycobacterium bovis subsp bovis AF2122/97
augccgccggccc

SEQ ID NO: 3040934 - RNA, 17 nt, Mycobacterium bovis subsp bovis AF2122/97
augccgccggccccgcc

SEQ ID NO: 3040935 - RNA, 15 nt, Mycobacterium bovis subsp bovis AF2122/97
augccgccggcgggc

SEQ ID NO: 3040936 - RNA, 18 nt, Mycobacterium bovis subsp bovis AF2122/97
augccgccggugccgccg

SEQ ID NO: 3040937 - RNA, 21 nt, Mycobacterium bovis subsp bovis AF2122/97
augccgcgaucgugcagguug

SEQ ID NO: 3040938 - RNA, 16 nt, Mycobacterium bovis subsp bovis AF2122/97
augccgcggaggcggc

SEQ ID NO: 3040939 - RNA, 21 nt, Mycobacterium bovis subsp bovis AF2122/97
augccgcggaggcggccagcc

SEQ ID NO: 3040940 - RNA, 22 nt, Mycobacterium bovis subsp bovis AF2122/97
augccgcggccaguacgucgau

SEQ ID NO: 3040941 - RNA, 12 nt, Mycobacterium bovis subsp bovis AF2122/97
augccgcgggga

SEQ ID NO: 3040942 - RNA, 19 nt, Mycobacterium bovis subsp bovis AF2122/97
augccgcgguggaugcgau

SEQ ID NO: 3040943 - RNA, 21 nt, Mycobacterium bovis subsp bovis AF2122/97
augccgcgguggaugcgaugc

SEQ ID NO: 3040944 - RNA, 19 nt, Mycobacterium bovis subsp bovis AF2122/97
augccgcucggcaaccugc

SEQ ID NO: 3040945 - RNA, 16 nt, Mycobacterium bovis subsp bovis AF2122/97
augccggacagcucgc

SEQ ID NO: 3040946 - RNA, 18 nt, Mycobacterium bovis subsp bovis AF2122/97
augccggacgccaugccc

SEQ ID NO: 3040947 - RNA, 22 nt, Mycobacterium bovis subsp bovis AF2122/97
augccggacgccaugcccgcac

SEQ ID NO: 3040948 - RNA, 15 nt, Mycobacterium bovis subsp bovis AF2122/97
augccggaucgggac

SEQ ID NO: 3040949 - RNA, 18 nt, Mycobacterium bovis subsp bovis AF2122/97
augccggcgaaggccagc

SEQ ID NO: 3040950 - RNA, 22 nt, Mycobacterium bovis subsp bovis AF2122/97
augccggcgaaggccagcagaa

SEQ ID NO: 3040951 - RNA, 15 nt, Mycobacterium bovis subsp bovis AF2122/97
augccggcgagggcc

SEQ ID NO: 3040952 - RNA, 19 nt, Mycobacterium bovis subsp bovis AF2122/97
augccgggauugccgucgg

SEQ ID NO: 3040953 - RNA, 17 nt, Mycobacterium bovis subsp bovis AF2122/97
augccgggcccgacguu

SEQ ID NO: 3040954 - RNA, 15 nt, Mycobacterium bovis subsp bovis AF2122/97
augccgggucgcggg

SEQ ID NO: 3040955 - RNA, 18 nt, Mycobacterium bovis subsp bovis AF2122/97
augccggucauccgggcg

SEQ ID NO: 3040956 - RNA, 21 nt, Mycobacterium bovis subsp bovis AF2122/97
augccggugccgggcaccacc

SEQ ID NO: 3040957 - RNA, 21 nt, Mycobacterium bovis subsp bovis AF2122/97
augccgguguugccgaagccc

SEQ ID NO: 3040958 - RNA, 24 nt, Mycobacterium bovis subsp bovis AF2122/97
augccguaguaaggagccgggccg

SEQ ID NO: 3040959 - RNA, 12 nt, Mycobacterium bovis subsp bovis AF2122/97
augccgucgccg

SEQ ID NO: 3040960 - RNA, 15 nt, Mycobacterium bovis subsp bovis AF2122/97
augccgucgccgguc

SEQ ID NO: 3040961 - RNA, 18 nt, Mycobacterium bovis subsp bovis AF2122/97
augccgucuuugucacgc

SEQ ID NO: 3040962 - RNA, 14 nt, Mycobacterium bovis subsp bovis AF2122/97
augccgugccgggc

SEQ ID NO: 3040963 - RNA, 19 nt, Mycobacterium bovis subsp bovis AF2122/97
augccgugcugggccgacg

SEQ ID NO: 3040964 - RNA, 20 nt, Mycobacterium bovis subsp bovis AF2122/97
augccgugcugggccgacgg

SEQ ID NO: 3040965 - RNA, 18 nt, Mycobacterium bovis subsp bovis AF2122/97
augccgugugugcgaucc

SEQ ID NO: 3040966 - RNA, 20 nt, Mycobacterium bovis subsp bovis AF2122/97
augccguugagugggagcua

SEQ ID NO: 3040967 - RNA, 17 nt, Mycobacterium bovis subsp bovis AF2122/97
augccguugaucgcaaa

SEQ ID NO: 3040968 - RNA, 20 nt, Mycobacterium bovis subsp bovis AF2122/97
augccucggcggccucgcug

SEQ ID NO: 3040969 - RNA, 22 nt, Mycobacterium bovis subsp bovis AF2122/97
augccugacacgaugcccggca

SEQ ID NO: 3040970 - RNA, 16 nt, Mycobacterium bovis subsp bovis AF2122/97
augccugcccaccuuc

SEQ ID NO: 3040971 - RNA, 22 nt, Mycobacterium bovis subsp bovis AF2122/97
augccugcgaaacgcuggccac

SEQ ID NO: 3040972 - RNA, 16 nt, Mycobacterium bovis subsp bovis AF2122/97
augccugcgcgaugcg

SEQ ID NO: 3040973 - RNA, 19 nt, Mycobacterium bovis subsp bovis AF2122/97
augccugcgcgaugcgauu

SEQ ID NO: 3040974 - RNA, 17 nt, Mycobacterium bovis subsp bovis AF2122/97
augccuggaaucgcgga

SEQ ID NO: 3040975 - RNA, 20 nt, Mycobacterium bovis subsp bovis AF2122/97
augccuucggccaaccaugc

SEQ ID NO: 3040976 - RNA, 16 nt, Mycobacterium bovis subsp bovis AF2122/97
augccuugaaacggug

SEQ ID NO: 3040977 - RNA, 18 nt, Mycobacterium bovis subsp bovis AF2122/97
augccuugaccgcggucu

SEQ ID NO: 3040978 - RNA, 16 nt, Mycobacterium bovis subsp bovis AF2122/97
augccuuggcagccca

SEQ ID NO: 3040979 - RNA, 23 nt, Mycobacterium bovis subsp bovis AF2122/97
augccuuugggcuguggccgcgu

SEQ ID NO: 3040980 - RNA, 18 nt, Mycobacterium bovis subsp bovis AF2122/97
augcgaaggcaucgcgga

SEQ ID NO: 3040981 - RNA, 12 nt, Mycobacterium bovis subsp bovis AF2122/97
augcugaacacg

SEQ ID NO: 3040982 - RNA, 16 nt, Mycobacterium bovis subsp bovis AF2122/97
augcugacgaacaugc

SEQ ID NO: 3040983 - RNA, 14 nt, Mycobacterium bovis subsp bovis AF2122/97
augcugacggugca

SEQ ID NO: 3040984 - RNA, 18 nt, Mycobacterium bovis subsp bovis AF2122/97
augcugagcgccaggccg

SEQ ID NO: 3040985 - RNA, 21 nt, Mycobacterium bovis subsp bovis AF2122/97
augcugccagccauggccgcc

SEQ ID NO: 3040986 - RNA, 13 nt, Mycobacterium bovis subsp bovis AF2122/97
augcugcccggca

SEQ ID NO: 3040987 - RNA, 12 nt, Mycobacterium bovis subsp bovis AF2122/97
augcugccgccg

SEQ ID NO: 3040988 - RNA, 21 nt, Mycobacterium bovis subsp bovis AF2122/97
augcugccgccgccgccggcg

SEQ ID NO: 3040989 - RNA, 15 nt, Mycobacterium bovis subsp bovis AF2122/97
augcugcguccugga

SEQ ID NO: 3040990 - RNA, 14 nt, Mycobacterium bovis subsp bovis AF2122/97
augcuggcagcucg

SEQ ID NO: 3040991 - RNA, 15 nt, Mycobacterium bovis subsp bovis AF2122/97
augcuggcagcucgg

SEQ ID NO: 3040992 - RNA, 16 nt, Mycobacterium bovis subsp bovis AF2122/97
augcuggcgcagcgcc

SEQ ID NO: 3040993 - RNA, 17 nt, Mycobacterium bovis subsp bovis AF2122/97
augcuggcgcagcgcca

SEQ ID NO: 3040994 - RNA, 22 nt, Mycobacterium bovis subsp bovis AF2122/97
augcuggcggccucgccggcgc

SEQ ID NO: 3040995 - RNA, 23 nt, Mycobacterium bovis subsp bovis AF2122/97
augcuggcggcgcgacaggugcu

SEQ ID NO: 3040996 - RNA, 19 nt, Mycobacterium bovis subsp bovis AF2122/97
augcugggcccgccagccc

SEQ ID NO: 3040997 - RNA, 23 nt, Mycobacterium bovis subsp bovis AF2122/97
augcugggcccgccagcccagca

SEQ ID NO: 3040998 - RNA, 24 nt, Mycobacterium bovis subsp bovis AF2122/97
augcugucagacggcgucugcggu

SEQ ID NO: 3040999 - RNA, 13 nt, Mycobacterium bovis subsp bovis AF2122/97
augcuuccagcau

SEQ ID NO: 3041000 - RNA, 21 nt, Mycobacterium bovis subsp bovis AF2122/97
augcuuucguauucggccgcg

SEQ ID NO: 3041001 - RNA, 17 nt, Mycobacterium bovis subsp bovis AF2122/97
auggaaggcggccaggu

SEQ ID NO: 3041002 - RNA, 14 nt, Mycobacterium bovis subsp bovis AF2122/97
auggacaccaaccc

SEQ ID NO: 3041003 - RNA, 17 nt, Mycobacterium bovis subsp bovis AF2122/97
auggacaccaacccacc

SEQ ID NO: 3041004 - RNA, 17 nt, Mycobacterium bovis subsp bovis AF2122/97
auggacaccagccagau

SEQ ID NO: 3041005 - RNA, 19 nt, Mycobacterium bovis subsp bovis AF2122/97
auggacagcugcggguuca

SEQ ID NO: 3041006 - RNA, 13 nt, Mycobacterium bovis subsp bovis AF2122/97
auggaccagcgcc

SEQ ID NO: 3041007 - RNA, 14 nt, Mycobacterium bovis subsp bovis AF2122/97
auggaccgccgccg

SEQ ID NO: 3041008 - RNA, 20 nt, Mycobacterium bovis subsp bovis AF2122/97
auggacggcagccagccacc

SEQ ID NO: 3041009 - RNA, 23 nt, Mycobacterium bovis subsp bovis AF2122/97
auggacggugcgcagggccugga

SEQ ID NO: 3041010 - RNA, 18 nt, Mycobacterium bovis subsp bovis AF2122/97
auggagccgcgaccaugg

SEQ ID NO: 3041011 - RNA, 14 nt, Mycobacterium bovis subsp bovis AF2122/97
auggagccggugac

SEQ ID NO: 3041012 - RNA, 20 nt, Mycobacterium bovis subsp bovis AF2122/97
auggaguggcuguacccgac

SEQ ID NO: 3041013 - RNA, 21 nt, Mycobacterium bovis subsp bovis AF2122/97
auggcaaccagcuucucagca

SEQ ID NO: 3041014 - RNA, 18 nt, Mycobacterium bovis subsp bovis AF2122/97
auggcaccaccccgaggc

SEQ ID NO: 3041015 - RNA, 22 nt, Mycobacterium bovis subsp bovis AF2122/97
auggcaccgcccccgucggccu

SEQ ID NO: 3041016 - RNA, 13 nt, Mycobacterium bovis subsp bovis AF2122/97
auggcaccggcgu

SEQ ID NO: 3041017 - RNA, 14 nt, Mycobacterium bovis subsp bovis AF2122/97
auggcacugccggc

SEQ ID NO: 3041018 - RNA, 16 nt, Mycobacterium bovis subsp bovis AF2122/97
auggcacugccggcac

SEQ ID NO: 3041019 - RNA, 22 nt, Mycobacterium bovis subsp bovis AF2122/97
auggcagcggcgguaugcucgc

SEQ ID NO: 3041020 - RNA, 19 nt, Mycobacterium bovis subsp bovis AF2122/97
auggcagugucguggucgu

SEQ ID NO: 3041021 - RNA, 19 nt, Mycobacterium bovis subsp bovis AF2122/97
auggccaccgaacgcggcc

SEQ ID NO: 3041022 - RNA, 14 nt, Mycobacterium bovis subsp bovis AF2122/97
auggccaccggcgg

SEQ ID NO: 3041023 - RNA, 14 nt, Mycobacterium bovis subsp bovis AF2122/97
auggccagcaccac

SEQ ID NO: 3041024 - RNA, 15 nt, Mycobacterium bovis subsp bovis AF2122/97
auggccagcaccacg

SEQ ID NO: 3041025 - RNA, 16 nt, Mycobacterium bovis subsp bovis AF2122/97
auggccagcaccacgg

SEQ ID NO: 3041026 - RNA, 12 nt, Mycobacterium bovis subsp bovis AF2122/97
auggccagcauc

SEQ ID NO: 3041027 - RNA, 17 nt, Mycobacterium bovis subsp bovis AF2122/97
auggccagcaucagcgc

SEQ ID NO: 3041028 - RNA, 19 nt, Mycobacterium bovis subsp bovis AF2122/97
auggccaggcuggcgucac

SEQ ID NO: 3041029 - RNA, 22 nt, Mycobacterium bovis subsp bovis AF2122/97
auggccaggcuggcgucaccgc

SEQ ID NO: 3041030 - RNA, 23 nt, Mycobacterium bovis subsp bovis AF2122/97
auggccagguuguagacggcacc

SEQ ID NO: 3041031 - RNA, 20 nt, Mycobacterium bovis subsp bovis AF2122/97
auggccaucuggccgcgggc

SEQ ID NO: 3041032 - RNA, 15 nt, Mycobacterium bovis subsp bovis AF2122/97
auggccccgccaaac

SEQ ID NO: 3041033 - RNA, 12 nt, Mycobacterium bovis subsp bovis AF2122/97
auggccccgggc

SEQ ID NO: 3041034 - RNA, 17 nt, Mycobacterium bovis subsp bovis AF2122/97
auggccccugucauguc

SEQ ID NO: 3041035 - RNA, 17 nt, Mycobacterium bovis subsp bovis AF2122/97
auggcccgaucgaccgc

SEQ ID NO: 3041036 - RNA, 18 nt, Mycobacterium bovis subsp bovis AF2122/97
auggcccgaucgaccgcu

SEQ ID NO: 3041037 - RNA, 15 nt, Mycobacterium bovis subsp bovis AF2122/97
auggcccuggcgacc

SEQ ID NO: 3041038 - RNA, 20 nt, Mycobacterium bovis subsp bovis AF2122/97
auggcccuuccggccgacac

SEQ ID NO: 3041039 - RNA, 20 nt, Mycobacterium bovis subsp bovis AF2122/97
auggcccuugcucguccagg

SEQ ID NO: 3041040 - RNA, 19 nt, Mycobacterium bovis subsp bovis AF2122/97
auggccgaacauucccaug

SEQ ID NO: 3041041 - RNA, 17 nt, Mycobacterium bovis subsp bovis AF2122/97
auggccgaaccguucgg

SEQ ID NO: 3041042 - RNA, 17 nt, Mycobacterium bovis subsp bovis AF2122/97
auggccgaccagccgau

SEQ ID NO: 3041043 - RNA, 16 nt, Mycobacterium bovis subsp bovis AF2122/97
auggccgccaccgcga

SEQ ID NO: 3041044 - RNA, 18 nt, Mycobacterium bovis subsp bovis AF2122/97
auggccgccaccgcgacg

SEQ ID NO: 3041045 - RNA, 12 nt, Mycobacterium bovis subsp bovis AF2122/97
auggccgccgac

SEQ ID NO: 3041046 - RNA, 13 nt, Mycobacterium bovis subsp bovis AF2122/97
auggccgccgaca

SEQ ID NO: 3041047 - RNA, 14 nt, Mycobacterium bovis subsp bovis AF2122/97
auggccgccgacaa

SEQ ID NO: 3041048 - RNA, 16 nt, Mycobacterium bovis subsp bovis AF2122/97
auggccgccgcagcuc

SEQ ID NO: 3041049 - RNA, 16 nt, Mycobacterium bovis subsp bovis AF2122/97
auggccgccgcgagga

SEQ ID NO: 3041050 - RNA, 15 nt, Mycobacterium bovis subsp bovis AF2122/97
auggccgcgcccgcc

SEQ ID NO: 3041051 - RNA, 23 nt, Mycobacterium bovis subsp bovis AF2122/97
auggccgcgcccgccucgaccgc

SEQ ID NO: 3041052 - RNA, 11 nt, Mycobacterium bovis subsp bovis AF2122/97
auggccggcca

SEQ ID NO: 3041053 - RNA, 23 nt, Mycobacterium bovis subsp bovis AF2122/97
auggccguccgaccgauaacacc

SEQ ID NO: 3041054 - RNA, 22 nt, Mycobacterium bovis subsp bovis AF2122/97
auggccguugaggaacuccgcg

SEQ ID NO: 3041055 - RNA, 15 nt, Mycobacterium bovis subsp bovis AF2122/97
auggccuugcugcgc

SEQ ID NO: 3041056 - RNA, 19 nt, Mycobacterium bovis subsp bovis AF2122/97
auggcgaacacgucggcca

SEQ ID NO: 3041057 - RNA, 16 nt, Mycobacterium bovis subsp bovis AF2122/97
auggcgaaccgucagc

SEQ ID NO: 3041058 - RNA, 22 nt, Mycobacterium bovis subsp bovis AF2122/97
auggcgagcguuuggacgggcg

SEQ ID NO: 3041059 - RNA, 20 nt, Mycobacterium bovis subsp bovis AF2122/97
auggcgaugagguggccgcg

SEQ ID NO: 3041060 - RNA, 14 nt, Mycobacterium bovis subsp bovis AF2122/97
auggcgcaccggcg

SEQ ID NO: 3041061 - RNA, 18 nt, Mycobacterium bovis subsp bovis AF2122/97
auggcgcaccggcgucgg

SEQ ID NO: 3041062 - RNA, 16 nt, Mycobacterium bovis subsp bovis AF2122/97
auggcgccaccggccg

SEQ ID NO: 3041063 - RNA, 16 nt, Mycobacterium bovis subsp bovis AF2122/97
auggcgccgcggcugg

SEQ ID NO: 3041064 - RNA, 13 nt, Mycobacterium bovis subsp bovis AF2122/97
auggcgccggccg

SEQ ID NO: 3041065 - RNA, 15 nt, Mycobacterium bovis subsp bovis AF2122/97
auggcgccggccggc

SEQ ID NO: 3041066 - RNA, 17 nt, Mycobacterium bovis subsp bovis AF2122/97
auggcgccguugccggc

SEQ ID NO: 3041067 - RNA, 22 nt, Mycobacterium bovis subsp bovis AF2122/97
auggcgcgaauggcggacaggg

SEQ ID NO: 3041068 - RNA, 20 nt, Mycobacterium bovis subsp bovis AF2122/97
augguggacgaggcggucga

SEQ ID NO: 3041069 - RNA, 12 nt, Mycobacterium bovis subsp bovis AF2122/97
augguggcaacg

SEQ ID NO: 3041070 - RNA, 15 nt, Mycobacterium bovis subsp bovis AF2122/97
augguggccgccacc

SEQ ID NO: 3041071 - RNA, 12 nt, Mycobacterium bovis subsp bovis AF2122/97
augguggccgcg

SEQ ID NO: 3041072 - RNA, 21 nt, Mycobacterium bovis subsp bovis AF2122/97
augguggcgaucaucggcccc

SEQ ID NO: 3041073 - RNA, 14 nt, Mycobacterium bovis subsp bovis AF2122/97
augguggcgccgac

SEQ ID NO: 3041074 - RNA, 22 nt, Mycobacterium bovis subsp bovis AF2122/97
auggugggaaaugaaguggcgu

SEQ ID NO: 3041075 - RNA, 18 nt, Mycobacterium bovis subsp bovis AF2122/97
augguggggaccgcgaug

SEQ ID NO: 3041076 - RNA, 15 nt, Mycobacterium bovis subsp bovis AF2122/97
auggugggucgacga

SEQ ID NO: 3041077 - RNA, 17 nt, Mycobacterium bovis subsp bovis AF2122/97
auggugggugccggcgu

SEQ ID NO: 3041078 - RNA, 17 nt, Mycobacterium bovis subsp bovis AF2122/97
augguggugaugccauc

SEQ ID NO: 3041079 - RNA, 21 nt, Mycobacterium bovis subsp bovis AF2122/97
augguggugccaaccugggcc

SEQ ID NO: 3041080 - RNA, 20 nt, Mycobacterium bovis subsp bovis AF2122/97
augguggugccgaccugucc

SEQ ID NO: 3041081 - RNA, 16 nt, Mycobacterium bovis subsp bovis AF2122/97
auggugguggcccggc

SEQ ID NO: 3041082 - RNA, 20 nt, Mycobacterium bovis subsp bovis AF2122/97
augguguaacggcggcugaa

SEQ ID NO: 3041083 - RNA, 19 nt, Mycobacterium bovis subsp bovis AF2122/97
augguguccucgucgaggu

SEQ ID NO: 3041084 - RNA, 16 nt, Mycobacterium bovis subsp bovis AF2122/97
auggugugcagcagca

SEQ ID NO: 3041085 - RNA, 16 nt, Mycobacterium bovis subsp bovis AF2122/97
augguugcgacggcgu

SEQ ID NO: 3041086 - RNA, 22 nt, Mycobacterium bovis subsp bovis AF2122/97
augguugcucgagcgguggcgu

SEQ ID NO: 3041087 - RNA, 15 nt, Mycobacterium bovis subsp bovis AF2122/97
augguuggaucgcca

SEQ ID NO: 3041088 - RNA, 12 nt, Mycobacterium bovis subsp bovis AF2122/97
auguaccccggc

SEQ ID NO: 3041089 - RNA, 21 nt, Mycobacterium bovis subsp bovis AF2122/97
auguacugugccgcccccggc

SEQ ID NO: 3041090 - RNA, 15 nt, Mycobacterium bovis subsp bovis AF2122/97
auguagggcugcucc

SEQ ID NO: 3041091 - RNA, 14 nt, Mycobacterium bovis subsp bovis AF2122/97
auguaguccagcuc

SEQ ID NO: 3041092 - RNA, 19 nt, Mycobacterium bovis subsp bovis AF2122/97
auguaugacaggucacggu

SEQ ID NO: 3041093 - RNA, 20 nt, Mycobacterium bovis subsp bovis AF2122/97
augucaacgugucccaagcc

SEQ ID NO: 3041094 - RNA, 18 nt, Mycobacterium bovis subsp bovis AF2122/97
augucaaguucgccagca

SEQ ID NO: 3041095 - RNA, 18 nt, Mycobacterium bovis subsp bovis AF2122/97
augucaccccgcccagcg

SEQ ID NO: 3041096 - RNA, 14 nt, Mycobacterium bovis subsp bovis AF2122/97
augucacccucccg

SEQ ID NO: 3041097 - RNA, 17 nt, Mycobacterium bovis subsp bovis AF2122/97
augucaccugggccagc

SEQ ID NO: 3041098 - RNA, 16 nt, Mycobacterium bovis subsp bovis AF2122/97
augucagccaccaucu

SEQ ID NO: 3041099 - RNA, 17 nt, Mycobacterium bovis subsp bovis AF2122/97
augucagcggccugcuc

SEQ ID NO: 3041100 - RNA, 15 nt, Mycobacterium bovis subsp bovis AF2122/97
augucagggaugauc

SEQ ID NO: 3041101 - RNA, 21 nt, Mycobacterium bovis subsp bovis AF2122/97
auguccaggcgcgcaccaccg

SEQ ID NO: 3041102 - RNA, 14 nt, Mycobacterium bovis subsp bovis AF2122/97
auguccagguggcg

SEQ ID NO: 3041103 - RNA, 15 nt, Mycobacterium bovis subsp bovis AF2122/97
auguccauagccggc

SEQ ID NO: 3041104 - RNA, 21 nt, Mycobacterium bovis subsp bovis AF2122/97
auguccauguuuugcugcaug

SEQ ID NO: 3041105 - RNA, 20 nt, Mycobacterium bovis subsp bovis AF2122/97
auguccgacgccaccgccac

SEQ ID NO: 3041106 - RNA, 22 nt, Mycobacterium bovis subsp bovis AF2122/97
auguccgacgccaccgccacca

SEQ ID NO: 3041107 - RNA, 23 nt, Mycobacterium bovis subsp bovis AF2122/97
auguccgacgccaccgccaccac

SEQ ID NO: 3041108 - RNA, 17 nt, Mycobacterium bovis subsp bovis AF2122/97
auguccgcagcaccguc

SEQ ID NO: 3041109 - RNA, 21 nt, Mycobacterium bovis subsp bovis AF2122/97
auguccgcagcaccgucgggc

SEQ ID NO: 3041110 - RNA, 16 nt, Mycobacterium bovis subsp bovis AF2122/97
auguccgcggccacca

SEQ ID NO: 3041111 - RNA, 18 nt, Mycobacterium bovis subsp bovis AF2122/97
auguccuauuugcagccu

SEQ ID NO: 3041112 - RNA, 15 nt, Mycobacterium bovis subsp bovis AF2122/97
auguccucgauccgg

SEQ ID NO: 3041113 - RNA, 19 nt, Mycobacterium bovis subsp bovis AF2122/97
auguccugggccgccgccc

SEQ ID NO: 3041114 - RNA, 22 nt, Mycobacterium bovis subsp bovis AF2122/97
auguccuugcgguccaggccgg

SEQ ID NO: 3041115 - RNA, 19 nt, Mycobacterium bovis subsp bovis AF2122/97
auguccuuggagaugucgg

SEQ ID NO: 3041116 - RNA, 13 nt, Mycobacterium bovis subsp bovis AF2122/97
augucgacgacaa

SEQ ID NO: 3041117 - RNA, 20 nt, Mycobacterium bovis subsp bovis AF2122/97
augucgacgagcaccgcgcc

SEQ ID NO: 3041118 - RNA, 14 nt, Mycobacterium bovis subsp bovis AF2122/97
augucgacgucgcg

SEQ ID NO: 3041119 - RNA, 15 nt, Mycobacterium bovis subsp bovis AF2122/97
augucgacgucgcgu

SEQ ID NO: 3041120 - RNA, 19 nt, Mycobacterium bovis subsp bovis AF2122/97
augucgagcacgccaacgu

SEQ ID NO: 3041121 - RNA, 14 nt, Mycobacterium bovis subsp bovis AF2122/97
augucgaugccgug

SEQ ID NO: 3041122 - RNA, 15 nt, Mycobacterium bovis subsp bovis AF2122/97
augucgaugccgugu

SEQ ID NO: 3041123 - RNA, 20 nt, Mycobacterium bovis subsp bovis AF2122/97
augucgauuucgaugacgaa

SEQ ID NO: 3041124 - RNA, 16 nt, Mycobacterium bovis subsp bovis AF2122/97
augucgccgccuggcu

SEQ ID NO: 3041125 - RNA, 14 nt, Mycobacterium bovis subsp bovis AF2122/97
augucgcgccaggc

SEQ ID NO: 3041126 - RNA, 15 nt, Mycobacterium bovis subsp bovis AF2122/97
augucgcgccaggcu

SEQ ID NO: 3041127 - RNA, 18 nt, Mycobacterium bovis subsp bovis AF2122/97
augucgcggacccgcgcg

SEQ ID NO: 3041128 - RNA, 16 nt, Mycobacterium bovis subsp bovis AF2122/97
augucgcggucgaggu

SEQ ID NO: 3041129 - RNA, 17 nt, Mycobacterium bovis subsp bovis AF2122/97
augucgcggucgcccgc

SEQ ID NO: 3041130 - RNA, 16 nt, Mycobacterium bovis subsp bovis AF2122/97
augucgcugccgccgc

SEQ ID NO: 3041131 - RNA, 21 nt, Mycobacterium bovis subsp bovis AF2122/97
augucgcugccgccgccggcg

SEQ ID NO: 3041132 - RNA, 17 nt, Mycobacterium bovis subsp bovis AF2122/97
augucggccaggucggc

SEQ ID NO: 3041133 - RNA, 16 nt, Mycobacterium bovis subsp bovis AF2122/97
augucggcgaugcguc

SEQ ID NO: 3041134 - RNA, 23 nt, Mycobacterium bovis subsp bovis AF2122/97
augucggcgaugcguccgcccag

SEQ ID NO: 3041135 - RNA, 17 nt, Mycobacterium bovis subsp bovis AF2122/97
augucggcgcgccgcac

SEQ ID NO: 3041136 - RNA, 18 nt, Mycobacterium bovis subsp bovis AF2122/97
augucggcucggcccccg

SEQ ID NO: 3041137 - RNA, 15 nt, Mycobacterium bovis subsp bovis AF2122/97
augucgggccaggcg

SEQ ID NO: 3041138 - RNA, 22 nt, Mycobacterium bovis subsp bovis AF2122/97
augucggggccgucgucgguca

SEQ ID NO: 3041139 - RNA, 20 nt, Mycobacterium bovis subsp bovis AF2122/97
augucgggguuucaggcggc

SEQ ID NO: 3041140 - RNA, 23 nt, Mycobacterium bovis subsp bovis AF2122/97
augucggugacaccaacaccggu

SEQ ID NO: 3041141 - RNA, 20 nt, Mycobacterium bovis subsp bovis AF2122/97
augucggugaggaagcggcc

SEQ ID NO: 3041142 - RNA, 17 nt, Mycobacterium bovis subsp bovis AF2122/97
augucggugcguccggu

SEQ ID NO: 3041143 - RNA, 12 nt, Mycobacterium bovis subsp bovis AF2122/97
augucgucgaca

SEQ ID NO: 3041144 - RNA, 17 nt, Mycobacterium bovis subsp bovis AF2122/97
augucgucgaccaggcc

SEQ ID NO: 3041145 - RNA, 23 nt, Mycobacterium bovis subsp bovis AF2122/97
augucgucgacgaggucagcggu

SEQ ID NO: 3041146 - RNA, 15 nt, Mycobacterium bovis subsp bovis AF2122/97
augucguugucugcc

SEQ ID NO: 3041147 - RNA, 20 nt, Mycobacterium bovis subsp bovis AF2122/97
augucuaccaacaccgcccg

SEQ ID NO: 3041148 - RNA, 17 nt, Mycobacterium bovis subsp bovis AF2122/97
augucucggcaccacag

SEQ ID NO: 3041149 - RNA, 23 nt, Mycobacterium bovis subsp bovis AF2122/97
augucugcgcagguggucgauca

SEQ ID NO: 3041150 - RNA, 21 nt, Mycobacterium bovis subsp bovis AF2122/97
augucuugcaguaacuucacc

SEQ ID NO: 3041151 - RNA, 15 nt, Mycobacterium bovis subsp bovis AF2122/97
augucuuguggugga

SEQ ID NO: 3041152 - RNA, 17 nt, Mycobacterium bovis subsp bovis AF2122/97
augucuugugguggaaa

SEQ ID NO: 3041153 - RNA, 17 nt, Mycobacterium bovis subsp bovis AF2122/97
augucuuuggucgccgg

SEQ ID NO: 3041154 - RNA, 22 nt, Mycobacterium bovis subsp bovis AF2122/97
auucgaccucaauuggcucggc

SEQ ID NO: 3041155 - RNA, 23 nt, Mycobacterium bovis subsp bovis AF2122/97
auucgacucuuucuuugccggag

SEQ ID NO: 3041156 - RNA, 19 nt, Mycobacterium bovis subsp bovis AF2122/97
auucgacugcaacucuucc

SEQ ID NO: 3041157 - RNA, 14 nt, Mycobacterium bovis subsp bovis AF2122/97
auucgcaaucggcg

SEQ ID NO: 3041158 - RNA, 15 nt, Mycobacterium bovis subsp bovis AF2122/97
auucgcccgcucgcg

SEQ ID NO: 3041159 - RNA, 23 nt, Mycobacterium bovis subsp bovis AF2122/97
auucgccgaacgguugcucgucc

SEQ ID NO: 3041160 - RNA, 15 nt, Mycobacterium bovis subsp bovis AF2122/97
auucgcucaccaccg

SEQ ID NO: 3041161 - RNA, 14 nt, Mycobacterium bovis subsp bovis AF2122/97
auucggccaucgcg

SEQ ID NO: 3041162 - RNA, 15 nt, Mycobacterium bovis subsp bovis AF2122/97
auucggccaucgcga

SEQ ID NO: 3041163 - RNA, 17 nt, Mycobacterium bovis subsp bovis AF2122/97
auucggccgccgacguu

SEQ ID NO: 3041164 - RNA, 12 nt, Mycobacterium bovis subsp bovis AF2122/97
auucggccggcg

SEQ ID NO: 3041165 - RNA, 16 nt, Mycobacterium bovis subsp bovis AF2122/97
auucggccggcgcggc

SEQ ID NO: 3041166 - RNA, 19 nt, Mycobacterium bovis subsp bovis AF2122/97
auucggcgagcgcccuggc

SEQ ID NO: 3041167 - RNA, 16 nt, Mycobacterium bovis subsp bovis AF2122/97
auucggcucaucccga

SEQ ID NO: 3041168 - RNA, 17 nt, Mycobacterium bovis subsp bovis AF2122/97
auucggcugccaccgca

SEQ ID NO: 3041169 - RNA, 18 nt, Mycobacterium bovis subsp bovis AF2122/97
auucgggcgugcucgccg

SEQ ID NO: 3041170 - RNA, 14 nt, Mycobacterium bovis subsp bovis AF2122/97
auucgggcuucucc

SEQ ID NO: 3041171 - RNA, 16 nt, Mycobacterium bovis subsp bovis AF2122/97
auucggugcgcuggcg

SEQ ID NO: 3041172 - RNA, 21 nt, Mycobacterium bovis subsp bovis AF2122/97
auucguacagugucugccaug

SEQ ID NO: 3041173 - RNA, 21 nt, Mycobacterium bovis subsp bovis AF2122/97
auucguaucccgcaaaccggu

SEQ ID NO: 3041174 - RNA, 14 nt, Mycobacterium bovis subsp bovis AF2122/97
auucgucgcgucgg

SEQ ID NO: 3041175 - RNA, 18 nt, Mycobacterium bovis subsp bovis AF2122/97
auucguuuguagucacgg

SEQ ID NO: 3041176 - RNA, 19 nt, Mycobacterium bovis subsp bovis AF2122/97
auucuccgcccucaguuca

SEQ ID NO: 3041177 - RNA, 20 nt, Mycobacterium bovis subsp bovis AF2122/97
auucugcgucugcucgccgu

SEQ ID NO: 3041178 - RNA, 11 nt, Mycobacterium bovis subsp bovis AF2122/97
auucuggaugc

SEQ ID NO: 3041179 - RNA, 22 nt, Mycobacterium bovis subsp bovis AF2122/97
auucugugucugcucgcgccgc

SEQ ID NO: 3041180 - RNA, 17 nt, Mycobacterium bovis subsp bovis AF2122/97
auucuucggugaagaac

SEQ ID NO: 3041181 - RNA, 18 nt, Mycobacterium bovis subsp bovis AF2122/97
auucuugacgccgaugug

SEQ ID NO: 3041182 - RNA, 20 nt, Mycobacterium bovis subsp bovis AF2122/97
auucuuggucgaggucggcg

SEQ ID NO: 3041183 - RNA, 14 nt, Mycobacterium bovis subsp bovis AF2122/97
auugaacagcggau

SEQ ID NO: 3041184 - RNA, 18 nt, Mycobacterium bovis subsp bovis AF2122/97
auugaagccccccgagcu

SEQ ID NO: 3041185 - RNA, 20 nt, Mycobacterium bovis subsp bovis AF2122/97
auugacccccuagaccgggc

SEQ ID NO: 3041186 - RNA, 12 nt, Mycobacterium bovis subsp bovis AF2122/97
auugacccgacg

SEQ ID NO: 3041187 - RNA, 17 nt, Mycobacterium bovis subsp bovis AF2122/97
auugacgccguugccgc

SEQ ID NO: 3041188 - RNA, 20 nt, Mycobacterium bovis subsp bovis AF2122/97
auugacgccguugccgccgu

SEQ ID NO: 3041189 - RNA, 23 nt, Mycobacterium bovis subsp bovis AF2122/97
auugagcccggggagacgagcac

SEQ ID NO: 3041190 - RNA, 12 nt, Mycobacterium bovis subsp bovis AF2122/97
auugagccggcc

SEQ ID NO: 3041191 - RNA, 18 nt, Mycobacterium bovis subsp bovis AF2122/97
auugagcucagguucagc

SEQ ID NO: 3041192 - RNA, 17 nt, Mycobacterium bovis subsp bovis AF2122/97
auugauacugcccgcgu

SEQ ID NO: 3041193 - RNA, 18 nt, Mycobacterium bovis subsp bovis AF2122/97
auugauaggccccgaggc

SEQ ID NO: 3041194 - RNA, 15 nt, Mycobacterium bovis subsp bovis AF2122/97
auugaugaucugcag

SEQ ID NO: 3041195 - RNA, 16 nt, Mycobacterium bovis subsp bovis AF2122/97
auugaugcgugguugg

SEQ ID NO: 3041196 - RNA, 22 nt, Mycobacterium bovis subsp bovis AF2122/97
auugaugucagggaugaucacc

SEQ ID NO: 3041197 - RNA, 17 nt, Mycobacterium bovis subsp bovis AF2122/97
auugauuccgaccccgc

SEQ ID NO: 3041198 - RNA, 17 nt, Mycobacterium bovis subsp bovis AF2122/97
auugcacccaccccgaa

SEQ ID NO: 3041199 - RNA, 22 nt, Mycobacterium bovis subsp bovis AF2122/97
auugcagaaccgccaacauugg

SEQ ID NO: 3041200 - RNA, 16 nt, Mycobacterium bovis subsp bovis AF2122/97
auugcagaauccgguc

SEQ ID NO: 3041201 - RNA, 13 nt, Mycobacterium bovis subsp bovis AF2122/97
auugcagcgcgau

SEQ ID NO: 3041202 - RNA, 22 nt, Mycobacterium bovis subsp bovis AF2122/97
auugccaccagaaacaccgacg

SEQ ID NO: 3041203 - RNA, 16 nt, Mycobacterium bovis subsp bovis AF2122/97
auugccaggaccgcgc

SEQ ID NO: 3041204 - RNA, 18 nt, Mycobacterium bovis subsp bovis AF2122/97
auugccauacagcacccc

SEQ ID NO: 3041205 - RNA, 15 nt, Mycobacterium bovis subsp bovis AF2122/97
auugcccgcgcucgc

SEQ ID NO: 3041206 - RNA, 23 nt, Mycobacterium bovis subsp bovis AF2122/97
auugcccgucagguacgucuugg

SEQ ID NO: 3041207 - RNA, 15 nt, Mycobacterium bovis subsp bovis AF2122/97
auugccgaccgccug

SEQ ID NO: 3041208 - RNA, 15 nt, Mycobacterium bovis subsp bovis AF2122/97
auugccgagaacacc

SEQ ID NO: 3041209 - RNA, 17 nt, Mycobacterium bovis subsp bovis AF2122/97
auugccgcaugcucagc

SEQ ID NO: 3041210 - RNA, 12 nt, Mycobacterium bovis subsp bovis AF2122/97
auugccgccacc

SEQ ID NO: 3041211 - RNA, 16 nt, Mycobacterium bovis subsp bovis AF2122/97
auugccgccaccuugg

SEQ ID NO: 3041212 - RNA, 16 nt, Mycobacterium bovis subsp bovis AF2122/97
auugccgccgccggga

SEQ ID NO: 3041213 - RNA, 11 nt, Mycobacterium bovis subsp bovis AF2122/97
auugccgccgg

SEQ ID NO: 3041214 - RNA, 13 nt, Mycobacterium bovis subsp bovis AF2122/97
auugccgccggcg

SEQ ID NO: 3041215 - RNA, 18 nt, Mycobacterium bovis subsp bovis AF2122/97
auugccgccggcgccgcc

SEQ ID NO: 3041216 - RNA, 19 nt, Mycobacterium bovis subsp bovis AF2122/97
auugccgccggcgccgccg

SEQ ID NO: 3041217 - RNA, 21 nt, Mycobacterium bovis subsp bovis AF2122/97
auugccgccggcgccgccggc

SEQ ID NO: 3041218 - RNA, 19 nt, Mycobacterium bovis subsp bovis AF2122/97
auugccgccgucgccgccg

SEQ ID NO: 3041219 - RNA, 21 nt, Mycobacterium bovis subsp bovis AF2122/97
auugccgccguugccgccguu

SEQ ID NO: 3041220 - RNA, 23 nt, Mycobacterium bovis subsp bovis AF2122/97
auugccgcgguugugcugggugc

SEQ ID NO: 3041221 - RNA, 21 nt, Mycobacterium bovis subsp bovis AF2122/97
auugccggccaccagccuggc

SEQ ID NO: 3041222 - RNA, 17 nt, Mycobacterium bovis subsp bovis AF2122/97
auugccggcgacgauau

SEQ ID NO: 3041223 - RNA, 18 nt, Mycobacterium bovis subsp bovis AF2122/97
auugccgggccgccgagc

SEQ ID NO: 3041224 - RNA, 19 nt, Mycobacterium bovis subsp bovis AF2122/97
auugccgucgugaucggcg

SEQ ID NO: 3041225 - RNA, 20 nt, Mycobacterium bovis subsp bovis AF2122/97
auugcgaagggcaccggcga

SEQ ID NO: 3041226 - RNA, 17 nt, Mycobacterium bovis subsp bovis AF2122/97
auugcgaccgcgccaac

SEQ ID NO: 3041227 - RNA, 21 nt, Mycobacterium bovis subsp bovis AF2122/97
auugcgcccagcgacccggcc

SEQ ID NO: 3041228 - RNA, 13 nt, Mycobacterium bovis subsp bovis AF2122/97
auugcgcccggcc

SEQ ID NO: 3041229 - RNA, 17 nt, Mycobacterium bovis subsp bovis AF2122/97
auugcgcggccauggca

SEQ ID NO: 3041230 - RNA, 19 nt, Mycobacterium bovis subsp bovis AF2122/97
auugcgcugcaccggguca

SEQ ID NO: 3041231 - RNA, 22 nt, Mycobacterium bovis subsp bovis AF2122/97
auugcggaaacccggccgccga

SEQ ID NO: 3041232 - RNA, 15 nt, Mycobacterium bovis subsp bovis AF2122/97
auugcggccgccgag

SEQ ID NO: 3041233 - RNA, 14 nt, Mycobacterium bovis subsp bovis AF2122/97
auugcggccgccgg

SEQ ID NO: 3041234 - RNA, 18 nt, Mycobacterium bovis subsp bovis AF2122/97
auugcggcgcgggugcgg

SEQ ID NO: 3041235 - RNA, 17 nt, Mycobacterium bovis subsp bovis AF2122/97
auugcguucgccgcccg

SEQ ID NO: 3041236 - RNA, 19 nt, Mycobacterium bovis subsp bovis AF2122/97
auugcuauuccgcggcacg

SEQ ID NO: 3041237 - RNA, 17 nt, Mycobacterium bovis subsp bovis AF2122/97
auugcugcggcuuucag

SEQ ID NO: 3041238 - RNA, 18 nt, Mycobacterium bovis subsp bovis AF2122/97
auugcugcggcuuucagc

SEQ ID NO: 3041239 - RNA, 15 nt, Mycobacterium bovis subsp bovis AF2122/97
auugcuuggccgcgc

SEQ ID NO: 3041240 - RNA, 22 nt, Mycobacterium bovis subsp bovis AF2122/97
auugcuugggugccucgccaac

SEQ ID NO: 3041241 - RNA, 15 nt, Mycobacterium bovis subsp bovis AF2122/97
caacaacuccagcag

SEQ ID NO: 3041242 - RNA, 16 nt, Mycobacterium bovis subsp bovis AF2122/97
caacaacuccagcagg

SEQ ID NO: 3041243 - RNA, 17 nt, Mycobacterium bovis subsp bovis AF2122/97
caacaaggggcagcacg

SEQ ID NO: 3041244 - RNA, 16 nt, Mycobacterium bovis subsp bovis AF2122/97
caacacagccgucgca

SEQ ID NO: 3041245 - RNA, 13 nt, Mycobacterium bovis subsp bovis AF2122/97
caacacagcugau

SEQ ID NO: 3041246 - RNA, 20 nt, Mycobacterium bovis subsp bovis AF2122/97
caacacauugccggccacca

SEQ ID NO: 3041247 - RNA, 23 nt, Mycobacterium bovis subsp bovis AF2122/97
caacacauuucuuugggcggccc

SEQ ID NO: 3041248 - RNA, 13 nt, Mycobacterium bovis subsp bovis AF2122/97
caacaccaccagc

SEQ ID NO: 3041249 - RNA, 14 nt, Mycobacterium bovis subsp bovis AF2122/97
caacaccaccagca

SEQ ID NO: 3041250 - RNA, 18 nt, Mycobacterium bovis subsp bovis AF2122/97
caacaccaccucgacgag

SEQ ID NO: 3041251 - RNA, 16 nt, Mycobacterium bovis subsp bovis AF2122/97
caacaccacuagcggc

SEQ ID NO: 3041252 - RNA, 17 nt, Mycobacterium bovis subsp bovis AF2122/97
caacaccagaugcaccu

SEQ ID NO: 3041253 - RNA, 11 nt, Mycobacterium bovis subsp bovis AF2122/97
caacaccagca

SEQ ID NO: 3041254 - RNA, 14 nt, Mycobacterium bovis subsp bovis AF2122/97
caacaccagcagca

SEQ ID NO: 3041255 - RNA, 15 nt, Mycobacterium bovis subsp bovis AF2122/97
caacaccagccgguc

SEQ ID NO: 3041256 - RNA, 13 nt, Mycobacterium bovis subsp bovis AF2122/97
caacaccagguca

SEQ ID NO: 3041257 - RNA, 17 nt, Mycobacterium bovis subsp bovis AF2122/97
caacaccccccccccca

SEQ ID NO: 3041258 - RNA, 16 nt, Mycobacterium bovis subsp bovis AF2122/97
caacaccccgagccgc

SEQ ID NO: 3041259 - RNA, 13 nt, Mycobacterium bovis subsp bovis AF2122/97
caacacccgcccg

SEQ ID NO: 3041260 - RNA, 15 nt, Mycobacterium bovis subsp bovis AF2122/97
caacacccggccgac

SEQ ID NO: 3041261 - RNA, 17 nt, Mycobacterium bovis subsp bovis AF2122/97
caacacccggccgaccu

SEQ ID NO: 3041262 - RNA, 14 nt, Mycobacterium bovis subsp bovis AF2122/97
caacacccgggcga

SEQ ID NO: 3041263 - RNA, 14 nt, Mycobacterium bovis subsp bovis AF2122/97
caacaccgcaccgg

SEQ ID NO: 3041264 - RNA, 14 nt, Mycobacterium bovis subsp bovis AF2122/97
caacaccgccaacu

SEQ ID NO: 3041265 - RNA, 22 nt, Mycobacterium bovis subsp bovis AF2122/97
caacaccgccaacuccucagcc

SEQ ID NO: 3041266 - RNA, 13 nt, Mycobacterium bovis subsp bovis AF2122/97
caacaccgcccgc

SEQ ID NO: 3041267 - RNA, 14 nt, Mycobacterium bovis subsp bovis AF2122/97
caacaccgcccgca

SEQ ID NO: 3041268 - RNA, 14 nt, Mycobacterium bovis subsp bovis AF2122/97
caacaccgcgccga

SEQ ID NO: 3041269 - RNA, 17 nt, Mycobacterium bovis subsp bovis AF2122/97
caacaccgcgccgacga

SEQ ID NO: 3041270 - RNA, 13 nt, Mycobacterium bovis subsp bovis AF2122/97
caacaccgcggcg

SEQ ID NO: 3041271 - RNA, 15 nt, Mycobacterium bovis subsp bovis AF2122/97
caacaccggcaucgg

SEQ ID NO: 3041272 - RNA, 23 nt, Mycobacterium bovis subsp bovis AF2122/97
caacaccgguaacgccaacaccg

SEQ ID NO: 3041273 - RNA, 19 nt, Mycobacterium bovis subsp bovis AF2122/97
caacaccgguggcuucaac

SEQ ID NO: 3041274 - RNA, 17 nt, Mycobacterium bovis subsp bovis AF2122/97
caacaccgugcaccagc

SEQ ID NO: 3041275 - RNA, 15 nt, Mycobacterium bovis subsp bovis AF2122/97
caacaccucaccgcg

SEQ ID NO: 3041276 - RNA, 20 nt, Mycobacterium bovis subsp bovis AF2122/97
caacaccucaccgcggaucg

SEQ ID NO: 3041277 - RNA, 15 nt, Mycobacterium bovis subsp bovis AF2122/97
caacaccucgucggc

SEQ ID NO: 3041278 - RNA, 14 nt, Mycobacterium bovis subsp bovis AF2122/97
caacacgagcgcau

SEQ ID NO: 3041279 - RNA, 14 nt, Mycobacterium bovis subsp bovis AF2122/97
caacacgccggccc

SEQ ID NO: 3041280 - RNA, 13 nt, Mycobacterium bovis subsp bovis AF2122/97
caacacgggcagc

SEQ ID NO: 3041281 - RNA, 16 nt, Mycobacterium bovis subsp bovis AF2122/97
caacacgggcgccgga

SEQ ID NO: 3041282 - RNA, 20 nt, Mycobacterium bovis subsp bovis AF2122/97
caacagacauuugucaacca

SEQ ID NO: 3041283 - RNA, 17 nt, Mycobacterium bovis subsp bovis AF2122/97
caacagaccuagcaccg

SEQ ID NO: 3041284 - RNA, 15 nt, Mycobacterium bovis subsp bovis AF2122/97
caacagaugccaccc

SEQ ID NO: 3041285 - RNA, 16 nt, Mycobacterium bovis subsp bovis AF2122/97
caacagaugccaccca

SEQ ID NO: 3041286 - RNA, 18 nt, Mycobacterium bovis subsp bovis AF2122/97
caacagaugccacccaga

SEQ ID NO: 3041287 - RNA, 21 nt, Mycobacterium bovis subsp bovis AF2122/97
caacagaugccacccagaugc

SEQ ID NO: 3041288 - RNA, 23 nt, Mycobacterium bovis subsp bovis AF2122/97
caacagcacccgggccacgucga

SEQ ID NO: 3041289 - RNA, 17 nt, Mycobacterium bovis subsp bovis AF2122/97
caacagcaccgcgacga

SEQ ID NO: 3041290 - RNA, 17 nt, Mycobacterium bovis subsp bovis AF2122/97
caacagcacguacugcu

SEQ ID NO: 3041291 - RNA, 20 nt, Mycobacterium bovis subsp bovis AF2122/97
caacagcaggugccaaccgc

SEQ ID NO: 3041292 - RNA, 21 nt, Mycobacterium bovis subsp bovis AF2122/97
caacagcaggugccaaccgcg

SEQ ID NO: 3041293 - RNA, 15 nt, Mycobacterium bovis subsp bovis AF2122/97
caacagcccaccggu

SEQ ID NO: 3041294 - RNA, 17 nt, Mycobacterium bovis subsp bovis AF2122/97
caacagcccaccggugc

SEQ ID NO: 3041295 - RNA, 22 nt, Mycobacterium bovis subsp bovis AF2122/97
caacagcccaccggugccgccc

SEQ ID NO: 3041296 - RNA, 13 nt, Mycobacterium bovis subsp bovis AF2122/97
caacagccgaacu

SEQ ID NO: 3041297 - RNA, 14 nt, Mycobacterium bovis subsp bovis AF2122/97
caacagccgcagcc

SEQ ID NO: 3041298 - RNA, 17 nt, Mycobacterium bovis subsp bovis AF2122/97
caacagccgcagccagg

SEQ ID NO: 3041299 - RNA, 19 nt, Mycobacterium bovis subsp bovis AF2122/97
caacagccgcagccagguc

SEQ ID NO: 3041300 - RNA, 17 nt, Mycobacterium bovis subsp bovis AF2122/97
caacagccgcucgcaca

SEQ ID NO: 3041301 - RNA, 22 nt, Mycobacterium bovis subsp bovis AF2122/97
caacagccgcucgcacagccgc

SEQ ID NO: 3041302 - RNA, 23 nt, Mycobacterium bovis subsp bovis AF2122/97
caacagccgcucgcacagccgcu

SEQ ID NO: 3041303 - RNA, 20 nt, Mycobacterium bovis subsp bovis AF2122/97
caacagcgcuccagccgcgc

SEQ ID NO: 3041304 - RNA, 16 nt, Mycobacterium bovis subsp bovis AF2122/97
caacagcguggagcgc

SEQ ID NO: 3041305 - RNA, 20 nt, Mycobacterium bovis subsp bovis AF2122/97
caacagcugggucaugccgu

SEQ ID NO: 3041306 - RNA, 16 nt, Mycobacterium bovis subsp bovis AF2122/97
caacagcuuggagauc

SEQ ID NO: 3041307 - RNA, 17 nt, Mycobacterium bovis subsp bovis AF2122/97
caacaggccaacuuggc

SEQ ID NO: 3041308 - RNA, 12 nt, Mycobacterium bovis subsp bovis AF2122/97
caacaggccggc

SEQ ID NO: 3041309 - RNA, 12 nt, Mycobacterium bovis subsp bovis AF2122/97
caacaggccggu

SEQ ID NO: 3041310 - RNA, 11 nt, Mycobacterium bovis subsp bovis AF2122/97
caacaggccgu

SEQ ID NO: 3041311 - RNA, 16 nt, Mycobacterium bovis subsp bovis AF2122/97
caacaggccgucgaug

SEQ ID NO: 3041312 - RNA, 23 nt, Mycobacterium bovis subsp bovis AF2122/97
caacaggccuaggucgacgccga

SEQ ID NO: 3041313 - RNA, 12 nt, Mycobacterium bovis subsp bovis AF2122/97
caacaggcgcgu

SEQ ID NO: 3041314 - RNA, 16 nt, Mycobacterium bovis subsp bovis AF2122/97
caacaggcgcgucggu

SEQ ID NO: 3041315 - RNA, 19 nt, Mycobacterium bovis subsp bovis AF2122/97
caacaggcgucccgcccgg

SEQ ID NO: 3041316 - RNA, 14 nt, Mycobacterium bovis subsp bovis AF2122/97
caacagggccagga

SEQ ID NO: 3041317 - RNA, 19 nt, Mycobacterium bovis subsp bovis AF2122/97
caacagggccaggacaacc

SEQ ID NO: 3041318 - RNA, 16 nt, Mycobacterium bovis subsp bovis AF2122/97
caacagggcgccgacg

SEQ ID NO: 3041319 - RNA, 22 nt, Mycobacterium bovis subsp bovis AF2122/97
caacagggcgccgacgacuccg

SEQ ID NO: 3041320 - RNA, 19 nt, Mycobacterium bovis subsp bovis AF2122/97
caacagggcggcagggugu

SEQ ID NO: 3041321 - RNA, 16 nt, Mycobacterium bovis subsp bovis AF2122/97
caacagguccaccggc

SEQ ID NO: 3041322 - RNA, 13 nt, Mycobacterium bovis subsp bovis AF2122/97
caacagucgcagc

SEQ ID NO: 3041323 - RNA, 16 nt, Mycobacterium bovis subsp bovis AF2122/97
caacaguucacgaccc

SEQ ID NO: 3041324 - RNA, 22 nt, Mycobacterium bovis subsp bovis AF2122/97
caacauccgguggugcucgucg

SEQ ID NO: 3041325 - RNA, 15 nt, Mycobacterium bovis subsp bovis AF2122/97
caacauccuccgggc

SEQ ID NO: 3041326 - RNA, 17 nt, Mycobacterium bovis subsp bovis AF2122/97
caacaucgaaaaccgag

SEQ ID NO: 3041327 - RNA, 15 nt, Mycobacterium bovis subsp bovis AF2122/97
caacaucggaugacc

SEQ ID NO: 3041328 - RNA, 19 nt, Mycobacterium bovis subsp bovis AF2122/97
caaccggacgaccggaacg

SEQ ID NO: 3041329 - RNA, 15 nt, Mycobacterium bovis subsp bovis AF2122/97
caaccggacgcccuc

SEQ ID NO: 3041330 - RNA, 15 nt, Mycobacterium bovis subsp bovis AF2122/97
caaccggcgaucggu

SEQ ID NO: 3041331 - RNA, 15 nt, Mycobacterium bovis subsp bovis AF2122/97
caaccggcggacacc

SEQ ID NO: 3041332 - RNA, 17 nt, Mycobacterium bovis subsp bovis AF2122/97
caaccggcgugucgagg

SEQ ID NO: 3041333 - RNA, 14 nt, Mycobacterium bovis subsp bovis AF2122/97
caaccgggacaacc

SEQ ID NO: 3041334 - RNA, 15 nt, Mycobacterium bovis subsp bovis AF2122/97
caaccgggacaaccc

SEQ ID NO: 3041335 - RNA, 18 nt, Mycobacterium bovis subsp bovis AF2122/97
caaccgggacaaccccuu

SEQ ID NO: 3041336 - RNA, 18 nt, Mycobacterium bovis subsp bovis AF2122/97
caaccgggaggccaccgc

SEQ ID NO: 3041337 - RNA, 15 nt, Mycobacterium bovis subsp bovis AF2122/97
caaccgggaucugcu

SEQ ID NO: 3041338 - RNA, 16 nt, Mycobacterium bovis subsp bovis AF2122/97
caaccgggaucugcuc

SEQ ID NO: 3041339 - RNA, 19 nt, Mycobacterium bovis subsp bovis AF2122/97
caaccgggaucugcuccgc

SEQ ID NO: 3041340 - RNA, 22 nt, Mycobacterium bovis subsp bovis AF2122/97
caaccgggccggcuagggcagc

SEQ ID NO: 3041341 - RNA, 19 nt, Mycobacterium bovis subsp bovis AF2122/97
caaccggguguggucggug

SEQ ID NO: 3041342 - RNA, 17 nt, Mycobacterium bovis subsp bovis AF2122/97
caaccgguagccaggcg

SEQ ID NO: 3041343 - RNA, 21 nt, Mycobacterium bovis subsp bovis AF2122/97
caaccgguagccaggcgcgcu

SEQ ID NO: 3041344 - RNA, 17 nt, Mycobacterium bovis subsp bovis AF2122/97
caaccgguaucgccgcu

SEQ ID NO: 3041345 - RNA, 19 nt, Mycobacterium bovis subsp bovis AF2122/97
caaccgguaucgccgcuac

SEQ ID NO: 3041346 - RNA, 18 nt, Mycobacterium bovis subsp bovis AF2122/97
caaccggucaaacgcgcg

SEQ ID NO: 3041347 - RNA, 20 nt, Mycobacterium bovis subsp bovis AF2122/97
caaccggucaaacgcgcgcg

SEQ ID NO: 3041348 - RNA, 16 nt, Mycobacterium bovis subsp bovis AF2122/97
caaccggucacgucga

SEQ ID NO: 3041349 - RNA, 15 nt, Mycobacterium bovis subsp bovis AF2122/97
caaccggucagccug

SEQ ID NO: 3041350 - RNA, 22 nt, Mycobacterium bovis subsp bovis AF2122/97
caaccggucgguguagcaacgg

SEQ ID NO: 3041351 - RNA, 22 nt, Mycobacterium bovis subsp bovis AF2122/97
caaccggucgucugucucggug

SEQ ID NO: 3041352 - RNA, 14 nt, Mycobacterium bovis subsp bovis AF2122/97
caaccggugcgcau

SEQ ID NO: 3041353 - RNA, 19 nt, Mycobacterium bovis subsp bovis AF2122/97
caaccgguggaugaacacc

SEQ ID NO: 3041354 - RNA, 23 nt, Mycobacterium bovis subsp bovis AF2122/97
caaccgguggaugaacaccucau

SEQ ID NO: 3041355 - RNA, 17 nt, Mycobacterium bovis subsp bovis AF2122/97
caaccgguggccggucg

SEQ ID NO: 3041356 - RNA, 21 nt, Mycobacterium bovis subsp bovis AF2122/97
caaccgguguaauugccgacg

SEQ ID NO: 3041357 - RNA, 22 nt, Mycobacterium bovis subsp bovis AF2122/97
caaccgguuggcgauccgcggc

SEQ ID NO: 3041358 - RNA, 15 nt, Mycobacterium bovis subsp bovis AF2122/97
caaccguccggggcc

SEQ ID NO: 3041359 - RNA, 22 nt, Mycobacterium bovis subsp bovis AF2122/97
caaccguccggggccgcggccc

SEQ ID NO: 3041360 - RNA, 15 nt, Mycobacterium bovis subsp bovis AF2122/97
caaccgugagcacca

SEQ ID NO: 3041361 - RNA, 16 nt, Mycobacterium bovis subsp bovis AF2122/97
caaccgugagcaccag

SEQ ID NO: 3041362 - RNA, 23 nt, Mycobacterium bovis subsp bovis AF2122/97
caaccgugccgcaucacccggga

SEQ ID NO: 3041363 - RNA, 19 nt, Mycobacterium bovis subsp bovis AF2122/97
caaccguuguaccccagca

SEQ ID NO: 3041364 - RNA, 18 nt, Mycobacterium bovis subsp bovis AF2122/97
caaccuaaauugccgggc

SEQ ID NO: 3041365 - RNA, 17 nt, Mycobacterium bovis subsp bovis AF2122/97
caaccucaugcacgccg

SEQ ID NO: 3041366 - RNA, 14 nt, Mycobacterium bovis subsp bovis AF2122/97
caaccucgccgucg

SEQ ID NO: 3041367 - RNA, 15 nt, Mycobacterium bovis subsp bovis AF2122/97
caaccucgccgucgu

SEQ ID NO: 3041368 - RNA, 18 nt, Mycobacterium bovis subsp bovis AF2122/97
caaccucgccgucgucga

SEQ ID NO: 3041369 - RNA, 21 nt, Mycobacterium bovis subsp bovis AF2122/97
caaccucggaucgccaggccg

SEQ ID NO: 3041370 - RNA, 23 nt, Mycobacterium bovis subsp bovis AF2122/97
caaccucgguugguccucggcgg

SEQ ID NO: 3041371 - RNA, 18 nt, Mycobacterium bovis subsp bovis AF2122/97
caaccucgucgucaucga

SEQ ID NO: 3041372 - RNA, 16 nt, Mycobacterium bovis subsp bovis AF2122/97
caaccugaagccagcg

SEQ ID NO: 3041373 - RNA, 17 nt, Mycobacterium bovis subsp bovis AF2122/97
caaccugaauccagacc

SEQ ID NO: 3041374 - RNA, 19 nt, Mycobacterium bovis subsp bovis AF2122/97
caaccugccgggccacggc

SEQ ID NO: 3041375 - RNA, 19 nt, Mycobacterium bovis subsp bovis AF2122/97
caaccugcgaccaggcgcg

SEQ ID NO: 3041376 - RNA, 14 nt, Mycobacterium bovis subsp bovis AF2122/97
caaccugcgcggcg

SEQ ID NO: 3041377 - RNA, 18 nt, Mycobacterium bovis subsp bovis AF2122/97
caaccugcgcggcgaucg

SEQ ID NO: 3041378 - RNA, 16 nt, Mycobacterium bovis subsp bovis AF2122/97
caaccuggacugcagc

SEQ ID NO: 3041379 - RNA, 19 nt, Mycobacterium bovis subsp bovis AF2122/97
caaccugggaaugacggag

SEQ ID NO: 3041380 - RNA, 13 nt, Mycobacterium bovis subsp bovis AF2122/97
caaccuggggcca

SEQ ID NO: 3041381 - RNA, 15 nt, Mycobacterium bovis subsp bovis AF2122/97
caaccuggggccacc

SEQ ID NO: 3041382 - RNA, 17 nt, Mycobacterium bovis subsp bovis AF2122/97
caaccuggggccaccag

SEQ ID NO: 3041383 - RNA, 12 nt, Mycobacterium bovis subsp bovis AF2122/97
caaccuuuggcc

SEQ ID NO: 3041384 - RNA, 14 nt, Mycobacterium bovis subsp bovis AF2122/97
caacgaaccgcuca

SEQ ID NO: 3041385 - RNA, 19 nt, Mycobacterium bovis subsp bovis AF2122/97
caacgaaccgcucagcgca

SEQ ID NO: 3041386 - RNA, 16 nt, Mycobacterium bovis subsp bovis AF2122/97
caacgaagagggcgcc

SEQ ID NO: 3041387 - RNA, 17 nt, Mycobacterium bovis subsp bovis AF2122/97
caacgaagccggcgccg

SEQ ID NO: 3041388 - RNA, 16 nt, Mycobacterium bovis subsp bovis AF2122/97
caacgaaugguaucga

SEQ ID NO: 3041389 - RNA, 13 nt, Mycobacterium bovis subsp bovis AF2122/97
caacgacaccaga

SEQ ID NO: 3041390 - RNA, 15 nt, Mycobacterium bovis subsp bovis AF2122/97
caacgacaccagauc

SEQ ID NO: 3041391 - RNA, 15 nt, Mycobacterium bovis subsp bovis AF2122/97
caacgacacgccgca

SEQ ID NO: 3041392 - RNA, 18 nt, Mycobacterium bovis subsp bovis AF2122/97
caacgacaggcgcccaca

SEQ ID NO: 3041393 - RNA, 17 nt, Mycobacterium bovis subsp bovis AF2122/97
caacgacaugagcgcca

SEQ ID NO: 3041394 - RNA, 19 nt, Mycobacterium bovis subsp bovis AF2122/97
caacgacaugagcgccacg

SEQ ID NO: 3041395 - RNA, 13 nt, Mycobacterium bovis subsp bovis AF2122/97
caacgaccaccac

SEQ ID NO: 3041396 - RNA, 15 nt, Mycobacterium bovis subsp bovis AF2122/97
caacgaccaccacca

SEQ ID NO: 3041397 - RNA, 18 nt, Mycobacterium bovis subsp bovis AF2122/97
caacgacccgaagccgac

SEQ ID NO: 3041398 - RNA, 19 nt, Mycobacterium bovis subsp bovis AF2122/97
caacgacgacgacaagugc

SEQ ID NO: 3041399 - RNA, 16 nt, Mycobacterium bovis subsp bovis AF2122/97
caacgacggcugaccu

SEQ ID NO: 3041400 - RNA, 18 nt, Mycobacterium bovis subsp bovis AF2122/97
caacgacgucgccgaccc

SEQ ID NO: 3041401 - RNA, 20 nt, Mycobacterium bovis subsp bovis AF2122/97
caacgacgucgccgacccgg

SEQ ID NO: 3041402 - RNA, 20 nt, Mycobacterium bovis subsp bovis AF2122/97
caacgacgucgucgccgccg

SEQ ID NO: 3041403 - RNA, 15 nt, Mycobacterium bovis subsp bovis AF2122/97
caacgacuccuggcg

SEQ ID NO: 3041404 - RNA, 16 nt, Mycobacterium bovis subsp bovis AF2122/97
caacgacucucaucaa

SEQ ID NO: 3041405 - RNA, 21 nt, Mycobacterium bovis subsp bovis AF2122/97
caacgacuguggcgccgccgg

SEQ ID NO: 3041406 - RNA, 18 nt, Mycobacterium bovis subsp bovis AF2122/97
caacgacuuucaucgcga

SEQ ID NO: 3041407 - RNA, 21 nt, Mycobacterium bovis subsp bovis AF2122/97
caacgagauucggagucacca

SEQ ID NO: 3041408 - RNA, 20 nt, Mycobacterium bovis subsp bovis AF2122/97
caacgagcaggauaaacccg

SEQ ID NO: 3041409 - RNA, 22 nt, Mycobacterium bovis subsp bovis AF2122/97
caacgagcaggauaaacccggc

SEQ ID NO: 3041410 - RNA, 18 nt, Mycobacterium bovis subsp bovis AF2122/97
caacgaggucugcggccg

SEQ ID NO: 3041411 - RNA, 12 nt, Mycobacterium bovis subsp bovis AF2122/97
caacgaucaggu

SEQ ID NO: 3041412 - RNA, 20 nt, Mycobacterium bovis subsp bovis AF2122/97
caacgaucccggggugccga

SEQ ID NO: 3041413 - RNA, 13 nt, Mycobacterium bovis subsp bovis AF2122/97
caacgaucgcgcc

SEQ ID NO: 3041414 - RNA, 13 nt, Mycobacterium bovis subsp bovis AF2122/97
caacggcggcgca

SEQ ID NO: 3041415 - RNA, 14 nt, Mycobacterium bovis subsp bovis AF2122/97
caacggcggcgucg

SEQ ID NO: 3041416 - RNA, 17 nt, Mycobacterium bovis subsp bovis AF2122/97
caacggcggcgucgcgg

SEQ ID NO: 3041417 - RNA, 20 nt, Mycobacterium bovis subsp bovis AF2122/97
caacggcggcgucgcgguug

SEQ ID NO: 3041418 - RNA, 17 nt, Mycobacterium bovis subsp bovis AF2122/97
caacggcggggccggcg

SEQ ID NO: 3041419 - RNA, 19 nt, Mycobacterium bovis subsp bovis AF2122/97
caacggcggggccggcggc

SEQ ID NO: 3041420 - RNA, 20 nt, Mycobacterium bovis subsp bovis AF2122/97
caacggcggugaagugggcg

SEQ ID NO: 3041421 - RNA, 16 nt, Mycobacterium bovis subsp bovis AF2122/97
caacggcuccgggcgc

SEQ ID NO: 3041422 - RNA, 17 nt, Mycobacterium bovis subsp bovis AF2122/97
caacggcuccgggcgcu

SEQ ID NO: 3041423 - RNA, 16 nt, Mycobacterium bovis subsp bovis AF2122/97
caacgggaacaacggc

SEQ ID NO: 3041424 - RNA, 16 nt, Mycobacterium bovis subsp bovis AF2122/97
caacgggauccgcgcg

SEQ ID NO: 3041425 - RNA, 21 nt, Mycobacterium bovis subsp bovis AF2122/97
caacgggauccgcgcgcugga

SEQ ID NO: 3041426 - RNA, 23 nt, Mycobacterium bovis subsp bovis AF2122/97
caacgggauccgcgcgcuggacc

SEQ ID NO: 3041427 - RNA, 16 nt, Mycobacterium bovis subsp bovis AF2122/97
caacgggaugccggcg

SEQ ID NO: 3041428 - RNA, 17 nt, Mycobacterium bovis subsp bovis AF2122/97
caacgggaugccggcga

SEQ ID NO: 3041429 - RNA, 23 nt, Mycobacterium bovis subsp bovis AF2122/97
caacgggccauggguagccgccc

SEQ ID NO: 3041430 - RNA, 22 nt, Mycobacterium bovis subsp bovis AF2122/97
caacgggcugccccuccgggcg

SEQ ID NO: 3041431 - RNA, 22 nt, Mycobacterium bovis subsp bovis AF2122/97
caacggggcagucaacucccga

SEQ ID NO: 3041432 - RNA, 22 nt, Mycobacterium bovis subsp bovis AF2122/97
caacggguaguucuuggucagg

SEQ ID NO: 3041433 - RNA, 17 nt, Mycobacterium bovis subsp bovis AF2122/97
caacggguccgacggug

SEQ ID NO: 3041434 - RNA, 16 nt, Mycobacterium bovis subsp bovis AF2122/97
caacgggucggcauug

SEQ ID NO: 3041435 - RNA, 18 nt, Mycobacterium bovis subsp bovis AF2122/97
caacgguaguugcgcggc

SEQ ID NO: 3041436 - RNA, 19 nt, Mycobacterium bovis subsp bovis AF2122/97
caacgguaguugcgcggca

SEQ ID NO: 3041437 - RNA, 22 nt, Mycobacterium bovis subsp bovis AF2122/97
caacgguaguugcgcggcaucc

SEQ ID NO: 3041438 - RNA, 17 nt, Mycobacterium bovis subsp bovis AF2122/97
caacggugaucagccac

SEQ ID NO: 3041439 - RNA, 21 nt, Mycobacterium bovis subsp bovis AF2122/97
caacggugggugggcgccgca

SEQ ID NO: 3041440 - RNA, 19 nt, Mycobacterium bovis subsp bovis AF2122/97
caacgguuggucgaacaga

SEQ ID NO: 3041441 - RNA, 13 nt, Mycobacterium bovis subsp bovis AF2122/97
caacgucaccccc

SEQ ID NO: 3041442 - RNA, 17 nt, Mycobacterium bovis subsp bovis AF2122/97
caacgucacgucgacgg

SEQ ID NO: 3041443 - RNA, 23 nt, Mycobacterium bovis subsp bovis AF2122/97
caacgucgacuucagcggccggu

SEQ ID NO: 3041444 - RNA, 22 nt, Mycobacterium bovis subsp bovis AF2122/97
caacgucgauguccccggcggc

SEQ ID NO: 3041445 - RNA, 14 nt, Mycobacterium bovis subsp bovis AF2122/97
caacgucgccgcgg

SEQ ID NO: 3041446 - RNA, 20 nt, Mycobacterium bovis subsp bovis AF2122/97
caacgucgcguucuccggca

SEQ ID NO: 3041447 - RNA, 14 nt, Mycobacterium bovis subsp bovis AF2122/97
caacgucggcaccg

SEQ ID NO: 3041448 - RNA, 17 nt, Mycobacterium bovis subsp bovis AF2122/97
caacgucugcagccucg

SEQ ID NO: 3041449 - RNA, 19 nt, Mycobacterium bovis subsp bovis AF2122/97
caacgugcgcaacgcgucg

SEQ ID NO: 3041450 - RNA, 20 nt, Mycobacterium bovis subsp bovis AF2122/97
caacgugguauugacguggc

SEQ ID NO: 3041451 - RNA, 15 nt, Mycobacterium bovis subsp bovis AF2122/97
caacgugucccaagc

SEQ ID NO: 3041452 - RNA, 21 nt, Mycobacterium bovis subsp bovis AF2122/97
caacgugucccaagccugccg

SEQ ID NO: 3041453 - RNA, 19 nt, Mycobacterium bovis subsp bovis AF2122/97
caacguucaacgacggcaa

SEQ ID NO: 3041454 - RNA, 22 nt, Mycobacterium bovis subsp bovis AF2122/97
caacguucggcacaaccaacga

SEQ ID NO: 3041455 - RNA, 20 nt, Mycobacterium bovis subsp bovis AF2122/97
caacguuuugggcgccggag

SEQ ID NO: 3041456 - RNA, 20 nt, Mycobacterium bovis subsp bovis AF2122/97
caacuaccuguugacacaac

SEQ ID NO: 3041457 - RNA, 22 nt, Mycobacterium bovis subsp bovis AF2122/97
caacuaccuguugacacaacga

SEQ ID NO: 3041458 - RNA, 16 nt, Mycobacterium bovis subsp bovis AF2122/97
caacuacgccagccgc

SEQ ID NO: 3041459 - RNA, 17 nt, Mycobacterium bovis subsp bovis AF2122/97
caacuacgccagccgcg

SEQ ID NO: 3041460 - RNA, 18 nt, Mycobacterium bovis subsp bovis AF2122/97
caacuagccgcugccugg

SEQ ID NO: 3041461 - RNA, 20 nt, Mycobacterium bovis subsp bovis AF2122/97
caacuaucgucgugucgccg

SEQ ID NO: 3041462 - RNA, 22 nt, Mycobacterium bovis subsp bovis AF2122/97
caacuaucgucgugucgccgcc

SEQ ID NO: 3041463 - RNA, 23 nt, Mycobacterium bovis subsp bovis AF2122/97
caacuaucgucgugucgccgccg

SEQ ID NO: 3041464 - RNA, 13 nt, Mycobacterium bovis subsp bovis AF2122/97
caacucaggccgg

SEQ ID NO: 3041465 - RNA, 23 nt, Mycobacterium bovis subsp bovis AF2122/97
caacucaggccgguaccgggacg

SEQ ID NO: 3041466 - RNA, 19 nt, Mycobacterium bovis subsp bovis AF2122/97
caacuccaagaugccgccc

SEQ ID NO: 3041467 - RNA, 20 nt, Mycobacterium bovis subsp bovis AF2122/97
caacuccaagaugccgcccc

SEQ ID NO: 3041468 - RNA, 20 nt, Mycobacterium bovis subsp bovis AF2122/97
caacuccacccaacgcggug

SEQ ID NO: 3041469 - RNA, 14 nt, Mycobacterium bovis subsp bovis AF2122/97
caacuccacgcgga

SEQ ID NO: 3041470 - RNA, 18 nt, Mycobacterium bovis subsp bovis AF2122/97
caacuccagcacccgcug

SEQ ID NO: 3041471 - RNA, 17 nt, Mycobacterium bovis subsp bovis AF2122/97
caacuccaucagcgcga

SEQ ID NO: 3041472 - RNA, 18 nt, Mycobacterium bovis subsp bovis AF2122/97
caacucccgaacuggcug

SEQ ID NO: 3041473 - RNA, 16 nt, Mycobacterium bovis subsp bovis AF2122/97
caacuccggcaccggc

SEQ ID NO: 3041474 - RNA, 21 nt, Mycobacterium bovis subsp bovis AF2122/97
caacuccggucaacacccgcc

SEQ ID NO: 3041475 - RNA, 22 nt, Mycobacterium bovis subsp bovis AF2122/97
caacuccggucaacacccgccc

SEQ ID NO: 3041476 - RNA, 13 nt, Mycobacterium bovis subsp bovis AF2122/97
caacuccucagcc

SEQ ID NO: 3041477 - RNA, 16 nt, Mycobacterium bovis subsp bovis AF2122/97
caacuccucagccgcc

SEQ ID NO: 3041478 - RNA, 13 nt, Mycobacterium bovis subsp bovis AF2122/97
caacuccucgacc

SEQ ID NO: 3041479 - RNA, 17 nt, Mycobacterium bovis subsp bovis AF2122/97
caacuccugcagcccgg

SEQ ID NO: 3041480 - RNA, 22 nt, Mycobacterium bovis subsp bovis AF2122/97
caacuccugcagcccgggcagc

SEQ ID NO: 3041481 - RNA, 17 nt, Mycobacterium bovis subsp bovis AF2122/97
caacucgaacgucacca

SEQ ID NO: 3041482 - RNA, 19 nt, Mycobacterium bovis subsp bovis AF2122/97
caacucgaauccggcccac

SEQ ID NO: 3041483 - RNA, 18 nt, Mycobacterium bovis subsp bovis AF2122/97
caacucggcauucaccgc

SEQ ID NO: 3041484 - RNA, 22 nt, Mycobacterium bovis subsp bovis AF2122/97
caacucggccaacgacggccga

SEQ ID NO: 3041485 - RNA, 16 nt, Mycobacterium bovis subsp bovis AF2122/97
caacucggccacggcg

SEQ ID NO: 3041486 - RNA, 21 nt, Mycobacterium bovis subsp bovis AF2122/97
caacucggccacggcgucggc

SEQ ID NO: 3041487 - RNA, 14 nt, Mycobacterium bovis subsp bovis AF2122/97
caacucggccagcu

SEQ ID NO: 3041488 - RNA, 15 nt, Mycobacterium bovis subsp bovis AF2122/97
caacucggcccgggu

SEQ ID NO: 3041489 - RNA, 19 nt, Mycobacterium bovis subsp bovis AF2122/97
caacucggcgaugacauca

SEQ ID NO: 3041490 - RNA, 23 nt, Mycobacterium bovis subsp bovis AF2122/97
caacucggcgaugacaucaccga

SEQ ID NO: 3041491 - RNA, 13 nt, Mycobacterium bovis subsp bovis AF2122/97
caacucgggcagc

SEQ ID NO: 3041492 - RNA, 17 nt, Mycobacterium bovis subsp bovis AF2122/97
caacucgggcagcgcgg

SEQ ID NO: 3041493 - RNA, 19 nt, Mycobacterium bovis subsp bovis AF2122/97
caacucgggcagcuucaac

SEQ ID NO: 3041494 - RNA, 20 nt, Mycobacterium bovis subsp bovis AF2122/97
caacucgggcagcuucaaca

SEQ ID NO: 3041495 - RNA, 22 nt, Mycobacterium bovis subsp bovis AF2122/97
caacucgggcagcuucaacacc

SEQ ID NO: 3041496 - RNA, 17 nt, Mycobacterium bovis subsp bovis AF2122/97
caacucguccagcagug

SEQ ID NO: 3041497 - RNA, 16 nt, Mycobacterium bovis subsp bovis AF2122/97
caacucuucagcaagc

SEQ ID NO: 3041498 - RNA, 22 nt, Mycobacterium bovis subsp bovis AF2122/97
caacucuucagcaagccaaccc

SEQ ID NO: 3041499 - RNA, 22 nt, Mycobacterium bovis subsp bovis AF2122/97
caacucuucccauuucggcaaa

SEQ ID NO: 3041500 - RNA, 18 nt, Mycobacterium bovis subsp bovis AF2122/97
caagccgugcugcccauc

SEQ ID NO: 3041501 - RNA, 11 nt, Mycobacterium bovis subsp bovis AF2122/97
caagccguggc

SEQ ID NO: 3041502 - RNA, 24 nt, Mycobacterium bovis subsp bovis AF2122/97
caagccguucugucccggcgcgcc

SEQ ID NO: 3041503 - RNA, 16 nt, Mycobacterium bovis subsp bovis AF2122/97
caagccguugcacggc

SEQ ID NO: 3041504 - RNA, 19 nt, Mycobacterium bovis subsp bovis AF2122/97
caagccguugcacggccgg

SEQ ID NO: 3041505 - RNA, 20 nt, Mycobacterium bovis subsp bovis AF2122/97
caagccucguggugagauca

SEQ ID NO: 3041506 - RNA, 14 nt, Mycobacterium bovis subsp bovis AF2122/97
caagccugccgaac

SEQ ID NO: 3041507 - RNA, 13 nt, Mycobacterium bovis subsp bovis AF2122/97
caagccugcgcug

SEQ ID NO: 3041508 - RNA, 15 nt, Mycobacterium bovis subsp bovis AF2122/97
caagccuuaccccgc

SEQ ID NO: 3041509 - RNA, 24 nt, Mycobacterium bovis subsp bovis AF2122/97
caagccuuaccccgcagcucaccu

SEQ ID NO: 3041510 - RNA, 17 nt, Mycobacterium bovis subsp bovis AF2122/97
caagccuucgucgaugc

SEQ ID NO: 3041511 - RNA, 16 nt, Mycobacterium bovis subsp bovis AF2122/97
caagcgacucgccggc

SEQ ID NO: 3041512 - RNA, 19 nt, Mycobacterium bovis subsp bovis AF2122/97
caagcgacucgccggcgaa

SEQ ID NO: 3041513 - RNA, 22 nt, Mycobacterium bovis subsp bovis AF2122/97
caagcgauccgagaccgcgugc

SEQ ID NO: 3041514 - RNA, 22 nt, Mycobacterium bovis subsp bovis AF2122/97
caagcgaugucccaucgcgucg

SEQ ID NO: 3041515 - RNA, 17 nt, Mycobacterium bovis subsp bovis AF2122/97
caagcgcagacacgacc

SEQ ID NO: 3041516 - RNA, 13 nt, Mycobacterium bovis subsp bovis AF2122/97
caagcgcagccug

SEQ ID NO: 3041517 - RNA, 14 nt, Mycobacterium bovis subsp bovis AF2122/97
caagcgcagccugg

SEQ ID NO: 3041518 - RNA, 19 nt, Mycobacterium bovis subsp bovis AF2122/97
caagcgccaacaacccaac

SEQ ID NO: 3041519 - RNA, 16 nt, Mycobacterium bovis subsp bovis AF2122/97
caagcgccgcgcuugc

SEQ ID NO: 3041520 - RNA, 15 nt, Mycobacterium bovis subsp bovis AF2122/97
caagcgccugagcgg

SEQ ID NO: 3041521 - RNA, 19 nt, Mycobacterium bovis subsp bovis AF2122/97
caagcgcgcgaaccccagc

SEQ ID NO: 3041522 - RNA, 23 nt, Mycobacterium bovis subsp bovis AF2122/97
caagcguccgcugcagguccagg

SEQ ID NO: 3041523 - RNA, 22 nt, Mycobacterium bovis subsp bovis AF2122/97
caagcguuguaguccugcgggc

SEQ ID NO: 3041524 - RNA, 14 nt, Mycobacterium bovis subsp bovis AF2122/97
caagcuaacucgac

SEQ ID NO: 3041525 - RNA, 14 nt, Mycobacterium bovis subsp bovis AF2122/97
caagcuaccggccc

SEQ ID NO: 3041526 - RNA, 21 nt, Mycobacterium bovis subsp bovis AF2122/97
caagcucagggugggcgacgu

SEQ ID NO: 3041527 - RNA, 21 nt, Mycobacterium bovis subsp bovis AF2122/97
caagcuccaguagucggccga

SEQ ID NO: 3041528 - RNA, 21 nt, Mycobacterium bovis subsp bovis AF2122/97
caagcuccucgcgagucggcg

SEQ ID NO: 3041529 - RNA, 18 nt, Mycobacterium bovis subsp bovis AF2122/97
caagcucggccaccagcg

SEQ ID NO: 3041530 - RNA, 21 nt, Mycobacterium bovis subsp bovis AF2122/97
caagcucggccaccagcgccc

SEQ ID NO: 3041531 - RNA, 18 nt, Mycobacterium bovis subsp bovis AF2122/97
caagcucggccagcacgc

SEQ ID NO: 3041532 - RNA, 21 nt, Mycobacterium bovis subsp bovis AF2122/97
caagcucggcccagcgcgcca

SEQ ID NO: 3041533 - RNA, 12 nt, Mycobacterium bovis subsp bovis AF2122/97
caagcucguccg

SEQ ID NO: 3041534 - RNA, 15 nt, Mycobacterium bovis subsp bovis AF2122/97
caagcucugcgucgu

SEQ ID NO: 3041535 - RNA, 14 nt, Mycobacterium bovis subsp bovis AF2122/97
caagcugaccgcca

SEQ ID NO: 3041536 - RNA, 19 nt, Mycobacterium bovis subsp bovis AF2122/97
caagcugccccgccaccuc

SEQ ID NO: 3041537 - RNA, 18 nt, Mycobacterium bovis subsp bovis AF2122/97
caagcugggcguaaaccg

SEQ ID NO: 3041538 - RNA, 22 nt, Mycobacterium bovis subsp bovis AF2122/97
caagcugggcguaaaccguggc

SEQ ID NO: 3041539 - RNA, 23 nt, Mycobacterium bovis subsp bovis AF2122/97
caagcuguuuggggucgcgcugc

SEQ ID NO: 3041540 - RNA, 19 nt, Mycobacterium bovis subsp bovis AF2122/97
caaggaacaguaccaaagc

SEQ ID NO: 3041541 - RNA, 14 nt, Mycobacterium bovis subsp bovis AF2122/97
caaggaagccgcgg

SEQ ID NO: 3041542 - RNA, 19 nt, Mycobacterium bovis subsp bovis AF2122/97
caaggaagccgcggccacg

SEQ ID NO: 3041543 - RNA, 15 nt, Mycobacterium bovis subsp bovis AF2122/97
caaggaccgcucugc

SEQ ID NO: 3041544 - RNA, 17 nt, Mycobacterium bovis subsp bovis AF2122/97
caaggaccugugcggcc

SEQ ID NO: 3041545 - RNA, 18 nt, Mycobacterium bovis subsp bovis AF2122/97
caaggacgaacgcgccgg

SEQ ID NO: 3041546 - RNA, 17 nt, Mycobacterium bovis subsp bovis AF2122/97
caaggacucggacgcgc

SEQ ID NO: 3041547 - RNA, 20 nt, Mycobacterium bovis subsp bovis AF2122/97
caaggacucggacgcgccgg

SEQ ID NO: 3041548 - RNA, 22 nt, Mycobacterium bovis subsp bovis AF2122/97
caaggagaucucugagcgggcg

SEQ ID NO: 3041549 - RNA, 14 nt, Mycobacterium bovis subsp bovis AF2122/97
caaggauggucgcc

SEQ ID NO: 3041550 - RNA, 23 nt, Mycobacterium bovis subsp bovis AF2122/97
caaggaugucggggcgaagcuug

SEQ ID NO: 3041551 - RNA, 18 nt, Mycobacterium bovis subsp bovis AF2122/97
caaggcauccaacgcggc

SEQ ID NO: 3041552 - RNA, 17 nt, Mycobacterium bovis subsp bovis AF2122/97
caaggccaagcgccaac

SEQ ID NO: 3041553 - RNA, 15 nt, Mycobacterium bovis subsp bovis AF2122/97
caaggccaccggcgg

SEQ ID NO: 3041554 - RNA, 14 nt, Mycobacterium bovis subsp bovis AF2122/97
caaggccgccgccg

SEQ ID NO: 3041555 - RNA, 23 nt, Mycobacterium bovis subsp bovis AF2122/97
caaggcgauagaugcgugcggca

SEQ ID NO: 3041556 - RNA, 22 nt, Mycobacterium bovis subsp bovis AF2122/97
caaggcgauugucggggccgca

SEQ ID NO: 3041557 - RNA, 20 nt, Mycobacterium bovis subsp bovis AF2122/97
caaggcgccgauaccggcgg

SEQ ID NO: 3041558 - RNA, 12 nt, Mycobacterium bovis subsp bovis AF2122/97
caaggcgcgcug

SEQ ID NO: 3041559 - RNA, 20 nt, Mycobacterium bovis subsp bovis AF2122/97
caaggcgcgcugggcgccgu

SEQ ID NO: 3041560 - RNA, 19 nt, Mycobacterium bovis subsp bovis AF2122/97
caaggcgcuaaaacgccag

SEQ ID NO: 3041561 - RNA, 23 nt, Mycobacterium bovis subsp bovis AF2122/97
caaggcgcuaaaacgccagucga

SEQ ID NO: 3041562 - RNA, 20 nt, Mycobacterium bovis subsp bovis AF2122/97
caaggcgcucccggagcaca

SEQ ID NO: 3041563 - RNA, 22 nt, Mycobacterium bovis subsp bovis AF2122/97
caaggcgugagcuaugcuggca

SEQ ID NO: 3041564 - RNA, 20 nt, Mycobacterium bovis subsp bovis AF2122/97
caaggcguugguagccaggg

SEQ ID NO: 3041565 - RNA, 17 nt, Mycobacterium bovis subsp bovis AF2122/97
caaggcucagcagcgcc

SEQ ID NO: 3041566 - RNA, 20 nt, Mycobacterium bovis subsp bovis AF2122/97
caaggcucagcagcgccgcg

SEQ ID NO: 3041567 - RNA, 22 nt, Mycobacterium bovis subsp bovis AF2122/97
caaggcucagcagcgccgcgcg

SEQ ID NO: 3041568 - RNA, 17 nt, Mycobacterium bovis subsp bovis AF2122/97
caagggauccgaagagc

SEQ ID NO: 3041569 - RNA, 18 nt, Mycobacterium bovis subsp bovis AF2122/97
caagggcaucaaccaacu

SEQ ID NO: 3041570 - RNA, 19 nt, Mycobacterium bovis subsp bovis AF2122/97
caagggccccuccggccac

SEQ ID NO: 3041571 - RNA, 23 nt, Mycobacterium bovis subsp bovis AF2122/97
caagggcgcgagcagacgcagaa

SEQ ID NO: 3041572 - RNA, 16 nt, Mycobacterium bovis subsp bovis AF2122/97
caaggggcagcacguc

SEQ ID NO: 3041573 - RNA, 13 nt, Mycobacterium bovis subsp bovis AF2122/97
caaggggcgucgc

SEQ ID NO: 3041574 - RNA, 14 nt, Mycobacterium bovis subsp bovis AF2122/97
caagggugcccgga

SEQ ID NO: 3041575 - RNA, 21 nt, Mycobacterium bovis subsp bovis AF2122/97
caagggugcuugucgccgcgu

SEQ ID NO: 3041576 - RNA, 16 nt, Mycobacterium bovis subsp bovis AF2122/97
caaggguggggccggc

SEQ ID NO: 3041577 - RNA, 16 nt, Mycobacterium bovis subsp bovis AF2122/97
caaggguggugacgcc

SEQ ID NO: 3041578 - RNA, 19 nt, Mycobacterium bovis subsp bovis AF2122/97
caagguauggccggagcgc

SEQ ID NO: 3041579 - RNA, 22 nt, Mycobacterium bovis subsp bovis AF2122/97
caaggucaucacuaaccuggcg

SEQ ID NO: 3041580 - RNA, 21 nt, Mycobacterium bovis subsp bovis AF2122/97
caagguccgcacgaucugcag

SEQ ID NO: 3041581 - RNA, 14 nt, Mycobacterium bovis subsp bovis AF2122/97
caaggucggccagg

SEQ ID NO: 3041582 - RNA, 16 nt, Mycobacterium bovis subsp bovis AF2122/97
caaggucuucaggccg

SEQ ID NO: 3041583 - RNA, 17 nt, Mycobacterium bovis subsp bovis AF2122/97
caaggugagcagcaaga

SEQ ID NO: 3041584 - RNA, 15 nt, Mycobacterium bovis subsp bovis AF2122/97
caaggugcgccgcca

SEQ ID NO: 3041585 - RNA, 15 nt, Mycobacterium bovis subsp bovis AF2122/97
caagguggcaugcga

SEQ ID NO: 3041586 - RNA, 17 nt, Mycobacterium bovis subsp bovis AF2122/97
caauccggucagcgcgg

SEQ ID NO: 3041587 - RNA, 18 nt, Mycobacterium bovis subsp bovis AF2122/97
caauccggucagcgcggc

SEQ ID NO: 3041588 - RNA, 20 nt, Mycobacterium bovis subsp bovis AF2122/97
caauccugcgggacuggcug

SEQ ID NO: 3041589 - RNA, 15 nt, Mycobacterium bovis subsp bovis AF2122/97
caauccugguguucg

SEQ ID NO: 3041590 - RNA, 14 nt, Mycobacterium bovis subsp bovis AF2122/97
caaucgaccacgac

SEQ ID NO: 3041591 - RNA, 18 nt, Mycobacterium bovis subsp bovis AF2122/97
caaucgagaacgcccgcu

SEQ ID NO: 3041592 - RNA, 18 nt, Mycobacterium bovis subsp bovis AF2122/97
caaucgaggaaggugugc

SEQ ID NO: 3041593 - RNA, 19 nt, Mycobacterium bovis subsp bovis AF2122/97
caaucgaguagcugaccga

SEQ ID NO: 3041594 - RNA, 16 nt, Mycobacterium bovis subsp bovis AF2122/97
caaucgaugagcgcga

SEQ ID NO: 3041595 - RNA, 23 nt, Mycobacterium bovis subsp bovis AF2122/97
caaucgcaaugaccugcagcgca

SEQ ID NO: 3041596 - RNA, 14 nt, Mycobacterium bovis subsp bovis AF2122/97
caaucgcgacgggg

SEQ ID NO: 3041597 - RNA, 17 nt, Mycobacterium bovis subsp bovis AF2122/97
caaucgcgacggggucg

SEQ ID NO: 3041598 - RNA, 17 nt, Mycobacterium bovis subsp bovis AF2122/97
caaucgcgggcgauggc

SEQ ID NO: 3041599 - RNA, 14 nt, Mycobacterium bovis subsp bovis AF2122/97
caaucgcggucagg

SEQ ID NO: 3041600 - RNA, 20 nt, Mycobacterium bovis subsp bovis AF2122/97
caaucggauacccagccggc

SEQ ID NO: 3041601 - RNA, 16 nt, Mycobacterium bovis subsp bovis AF2122/97
caaucgggaucgcugc

SEQ ID NO: 3041602 - RNA, 14 nt, Mycobacterium bovis subsp bovis AF2122/97
caaucggguccacg

SEQ ID NO: 3041603 - RNA, 20 nt, Mycobacterium bovis subsp bovis AF2122/97
caaucguccacccgagcucu

SEQ ID NO: 3041604 - RNA, 16 nt, Mycobacterium bovis subsp bovis AF2122/97
caaucgucggccagca

SEQ ID NO: 3041605 - RNA, 20 nt, Mycobacterium bovis subsp bovis AF2122/97
caaucgugguucggcgucga

SEQ ID NO: 3041606 - RNA, 23 nt, Mycobacterium bovis subsp bovis AF2122/97
caaucgugguucggcgucgaccc

SEQ ID NO: 3041607 - RNA, 14 nt, Mycobacterium bovis subsp bovis AF2122/97
caaucugcgggccg

SEQ ID NO: 3041608 - RNA, 18 nt, Mycobacterium bovis subsp bovis AF2122/97
caaucuucucgagccgcc

SEQ ID NO: 3041609 - RNA, 16 nt, Mycobacterium bovis subsp bovis AF2122/97
caaugaccugcagcgc

SEQ ID NO: 3041610 - RNA, 17 nt, Mycobacterium bovis subsp bovis AF2122/97
caaugaccugcagcgca

SEQ ID NO: 3041611 - RNA, 17 nt, Mycobacterium bovis subsp bovis AF2122/97
caaugaccuggccgccc

SEQ ID NO: 3041612 - RNA, 19 nt, Mycobacterium bovis subsp bovis AF2122/97
caaugaccuggccgcccgc

SEQ ID NO: 3041613 - RNA, 15 nt, Mycobacterium bovis subsp bovis AF2122/97
caaugacgucgucgg

SEQ ID NO: 3041614 - RNA, 19 nt, Mycobacterium bovis subsp bovis AF2122/97
caaugacgucgucggccaa

SEQ ID NO: 3041615 - RNA, 15 nt, Mycobacterium bovis subsp bovis AF2122/97
caaugacucggccgc

SEQ ID NO: 3041616 - RNA, 17 nt, Mycobacterium bovis subsp bovis AF2122/97
caaugaucgcggcggcg

SEQ ID NO: 3041617 - RNA, 16 nt, Mycobacterium bovis subsp bovis AF2122/97
caaugcaaauagccuu

SEQ ID NO: 3041618 - RNA, 20 nt, Mycobacterium bovis subsp bovis AF2122/97
caaugcaaauagccuuguuc

SEQ ID NO: 3041619 - RNA, 18 nt, Mycobacterium bovis subsp bovis AF2122/97
caaugccgacgccaacgc

SEQ ID NO: 3041620 - RNA, 19 nt, Mycobacterium bovis subsp bovis AF2122/97
caaugccgacucaggucgg

SEQ ID NO: 3041621 - RNA, 23 nt, Mycobacterium bovis subsp bovis AF2122/97
caaugccgcggaggcggccagcc

SEQ ID NO: 3041622 - RNA, 22 nt, Mycobacterium bovis subsp bovis AF2122/97
caaugccggaucgggaccggga

SEQ ID NO: 3041623 - RNA, 14 nt, Mycobacterium bovis subsp bovis AF2122/97
caaugccggccgcg

SEQ ID NO: 3041624 - RNA, 19 nt, Mycobacterium bovis subsp bovis AF2122/97
caaugccguugaucgcaaa

SEQ ID NO: 3041625 - RNA, 23 nt, Mycobacterium bovis subsp bovis AF2122/97
caaugcgagcacccguugaucgc

SEQ ID NO: 3041626 - RNA, 17 nt, Mycobacterium bovis subsp bovis AF2122/97
caaugcgagcgcgccgg

SEQ ID NO: 3041627 - RNA, 19 nt, Mycobacterium bovis subsp bovis AF2122/97
caaugcgagcgcgccggcc

SEQ ID NO: 3041628 - RNA, 16 nt, Mycobacterium bovis subsp bovis AF2122/97
caaugcgaugcggucg

SEQ ID NO: 3041629 - RNA, 14 nt, Mycobacterium bovis subsp bovis AF2122/97
caaugcgcgacggu

SEQ ID NO: 3041630 - RNA, 17 nt, Mycobacterium bovis subsp bovis AF2122/97
caaugcgcgacggucaa

SEQ ID NO: 3041631 - RNA, 18 nt, Mycobacterium bovis subsp bovis AF2122/97
caaugcgcuggcgccgcc

SEQ ID NO: 3041632 - RNA, 19 nt, Mycobacterium bovis subsp bovis AF2122/97
caaugcgcuggcgccgccg

SEQ ID NO: 3041633 - RNA, 19 nt, Mycobacterium bovis subsp bovis AF2122/97
caaugcgguaccaaccugc

SEQ ID NO: 3041634 - RNA, 17 nt, Mycobacterium bovis subsp bovis AF2122/97
caaugcggugacaaccg

SEQ ID NO: 3041635 - RNA, 20 nt, Mycobacterium bovis subsp bovis AF2122/97
caaugcgucgaugcgcugcu

SEQ ID NO: 3041636 - RNA, 18 nt, Mycobacterium bovis subsp bovis AF2122/97
caaugcguugacgucgag

SEQ ID NO: 3041637 - RNA, 20 nt, Mycobacterium bovis subsp bovis AF2122/97
caaugcguugacgucgagca

SEQ ID NO: 3041638 - RNA, 23 nt, Mycobacterium bovis subsp bovis AF2122/97
caaugcguugacgucgagcagcg

SEQ ID NO: 3041639 - RNA, 20 nt, Mycobacterium bovis subsp bovis AF2122/97
caaugcuggcagcggccucc

SEQ ID NO: 3041640 - RNA, 13 nt, Mycobacterium bovis subsp bovis AF2122/97
caaugcuggcggc

SEQ ID NO: 3041641 - RNA, 16 nt, Mycobacterium bovis subsp bovis AF2122/97
caaugcuggcggcgcg

SEQ ID NO: 3041642 - RNA, 14 nt, Mycobacterium bovis subsp bovis AF2122/97
caauggaaccgguu

SEQ ID NO: 3041643 - RNA, 20 nt, Mycobacterium bovis subsp bovis AF2122/97
caauggacaccaacccaccc

SEQ ID NO: 3041644 - RNA, 14 nt, Mycobacterium bovis subsp bovis AF2122/97
caauggaccgaacg

SEQ ID NO: 3041645 - RNA, 17 nt, Mycobacterium bovis subsp bovis AF2122/97
caauggccagcaccacg

SEQ ID NO: 3041646 - RNA, 14 nt, Mycobacterium bovis subsp bovis AF2122/97
caauggccugcagc

SEQ ID NO: 3041647 - RNA, 17 nt, Mycobacterium bovis subsp bovis AF2122/97
caauggccugcagcgcg

SEQ ID NO: 3041648 - RNA, 23 nt, Mycobacterium bovis subsp bovis AF2122/97
caauggcucugaggucaccggcg

SEQ ID NO: 3041649 - RNA, 19 nt, Mycobacterium bovis subsp bovis AF2122/97
caaugguucgugcacggcg

SEQ ID NO: 3041650 - RNA, 12 nt, Mycobacterium bovis subsp bovis AF2122/97
caauguccaggc

SEQ ID NO: 3041651 - RNA, 21 nt, Mycobacterium bovis subsp bovis AF2122/97
caauguccaggcgcgcaccac

SEQ ID NO: 3041652 - RNA, 16 nt, Mycobacterium bovis subsp bovis AF2122/97
caaugucgacaccggc

SEQ ID NO: 3041653 - RNA, 14 nt, Mycobacterium bovis subsp bovis AF2122/97
caaugugccgccgg

SEQ ID NO: 3041654 - RNA, 20 nt, Mycobacterium bovis subsp bovis AF2122/97
caauuaggucgaccacccgc

SEQ ID NO: 3041655 - RNA, 19 nt, Mycobacterium bovis subsp bovis AF2122/97
caauucacgcaccacaaac

SEQ ID NO: 3041656 - RNA, 19 nt, Mycobacterium bovis subsp bovis AF2122/97
caauuccacgaucggcuca

SEQ ID NO: 3041657 - RNA, 22 nt, Mycobacterium bovis subsp bovis AF2122/97
caauuccacgaucggcucacga

SEQ ID NO: 3041658 - RNA, 12 nt, Mycobacterium bovis subsp bovis AF2122/97
caauuccagccc

SEQ ID NO: 3041659 - RNA, 22 nt, Mycobacterium bovis subsp bovis AF2122/97
caauuccagccccccggcgacg

SEQ ID NO: 3041660 - RNA, 18 nt, Mycobacterium bovis subsp bovis AF2122/97
caauuccaugcaguuguc

SEQ ID NO: 3041661 - RNA, 18 nt, Mycobacterium bovis subsp bovis AF2122/97
caauucccaucggccugg

SEQ ID NO: 3041662 - RNA, 18 nt, Mycobacterium bovis subsp bovis AF2122/97
caauucccgcgcggcgug

SEQ ID NO: 3041663 - RNA, 15 nt, Mycobacterium bovis subsp bovis AF2122/97
caauuccgccgagcg

SEQ ID NO: 3041664 - RNA, 17 nt, Mycobacterium bovis subsp bovis AF2122/97
caauuccggugaucgcg

SEQ ID NO: 3041665 - RNA, 18 nt, Mycobacterium bovis subsp bovis AF2122/97
caauuccguuaggcucca

SEQ ID NO: 3041666 - RNA, 13 nt, Mycobacterium bovis subsp bovis AF2122/97
caauuccucagcc

SEQ ID NO: 3041667 - RNA, 12 nt, Mycobacterium bovis subsp bovis AF2122/97
caauucgacugc

SEQ ID NO: 3041668 - RNA, 19 nt, Mycobacterium bovis subsp bovis AF2122/97
caauucgcaaucggcguua

SEQ ID NO: 3041669 - RNA, 19 nt, Mycobacterium bovis subsp bovis AF2122/97
caauucgggcauggucgcc

SEQ ID NO: 3041670 - RNA, 18 nt, Mycobacterium bovis subsp bovis AF2122/97
caauucggugcgcuggcg

SEQ ID NO: 3041671 - RNA, 16 nt, Mycobacterium bovis subsp bovis AF2122/97
caauugaacgcaccaa

SEQ ID NO: 3041672 - RNA, 14 nt, Mycobacterium bovis subsp bovis AF2122/97
cacaccgggcacca

SEQ ID NO: 3041673 - RNA, 12 nt, Mycobacterium bovis subsp bovis AF2122/97
cacaccgggcgg

SEQ ID NO: 3041674 - RNA, 13 nt, Mycobacterium bovis subsp bovis AF2122/97
cacaccgggcggg

SEQ ID NO: 3041675 - RNA, 18 nt, Mycobacterium bovis subsp bovis AF2122/97
cacaccguaccgacgaag

SEQ ID NO: 3041676 - RNA, 12 nt, Mycobacterium bovis subsp bovis AF2122/97
cacaccgucgca

SEQ ID NO: 3041677 - RNA, 23 nt, Mycobacterium bovis subsp bovis AF2122/97
cacaccgugggcgacggcggcgu

SEQ ID NO: 3041678 - RNA, 16 nt, Mycobacterium bovis subsp bovis AF2122/97
cacaccuaccguacgc

SEQ ID NO: 3041679 - RNA, 15 nt, Mycobacterium bovis subsp bovis AF2122/97
cacaccuccucgacc

SEQ ID NO: 3041680 - RNA, 17 nt, Mycobacterium bovis subsp bovis AF2122/97
cacaccuccucgagcag

SEQ ID NO: 3041681 - RNA, 16 nt, Mycobacterium bovis subsp bovis AF2122/97
cacaccugcgccaccu

SEQ ID NO: 3041682 - RNA, 19 nt, Mycobacterium bovis subsp bovis AF2122/97
cacaccuuggccgccggcc

SEQ ID NO: 3041683 - RNA, 16 nt, Mycobacterium bovis subsp bovis AF2122/97
cacacgaucgcgguga

SEQ ID NO: 3041684 - RNA, 14 nt, Mycobacterium bovis subsp bovis AF2122/97
cacacgccagccgg

SEQ ID NO: 3041685 - RNA, 22 nt, Mycobacterium bovis subsp bovis AF2122/97
cacacgcccucgacgccgcgca

SEQ ID NO: 3041686 - RNA, 15 nt, Mycobacterium bovis subsp bovis AF2122/97
cacacgccgccggug

SEQ ID NO: 3041687 - RNA, 15 nt, Mycobacterium bovis subsp bovis AF2122/97
cacacgcgugcacca

SEQ ID NO: 3041688 - RNA, 21 nt, Mycobacterium bovis subsp bovis AF2122/97
cacacgcuuguacaagucgac

SEQ ID NO: 3041689 - RNA, 14 nt, Mycobacterium bovis subsp bovis AF2122/97
cacacggggccgcc

SEQ ID NO: 3041690 - RNA, 17 nt, Mycobacterium bovis subsp bovis AF2122/97
cacacggggccgccagc

SEQ ID NO: 3041691 - RNA, 18 nt, Mycobacterium bovis subsp bovis AF2122/97
cacacggggccgccagcu

SEQ ID NO: 3041692 - RNA, 14 nt, Mycobacterium bovis subsp bovis AF2122/97
cacacggucaccgg

SEQ ID NO: 3041693 - RNA, 16 nt, Mycobacterium bovis subsp bovis AF2122/97
cacacggucgucgcga

SEQ ID NO: 3041694 - RNA, 21 nt, Mycobacterium bovis subsp bovis AF2122/97
cacacggugcgauuccgcguc

SEQ ID NO: 3041695 - RNA, 20 nt, Mycobacterium bovis subsp bovis AF2122/97
cacacguccgcgcaccgcag

SEQ ID NO: 3041696 - RNA, 16 nt, Mycobacterium bovis subsp bovis AF2122/97
cacacguuggcagccc

SEQ ID NO: 3041697 - RNA, 17 nt, Mycobacterium bovis subsp bovis AF2122/97
cacacucagcacccaau

SEQ ID NO: 3041698 - RNA, 15 nt, Mycobacterium bovis subsp bovis AF2122/97
cacacucccgcgccc

SEQ ID NO: 3041699 - RNA, 17 nt, Mycobacterium bovis subsp bovis AF2122/97
cacacucccgcgcccga

SEQ ID NO: 3041700 - RNA, 15 nt, Mycobacterium bovis subsp bovis AF2122/97
cacacuccuagccaa

SEQ ID NO: 3041701 - RNA, 21 nt, Mycobacterium bovis subsp bovis AF2122/97
cacacuccuagccaacgagcg

SEQ ID NO: 3041702 - RNA, 14 nt, Mycobacterium bovis subsp bovis AF2122/97
cacacucgccaggg

SEQ ID NO: 3041703 - RNA, 22 nt, Mycobacterium bovis subsp bovis AF2122/97
cacacucucggugaacgccgcc

SEQ ID NO: 3041704 - RNA, 19 nt, Mycobacterium bovis subsp bovis AF2122/97
cacacugaagaucgcgccc

SEQ ID NO: 3041705 - RNA, 16 nt, Mycobacterium bovis subsp bovis AF2122/97
cacacugaccccgccg

SEQ ID NO: 3041706 - RNA, 22 nt, Mycobacterium bovis subsp bovis AF2122/97
cacacugaccccgccgccacgg

SEQ ID NO: 3041707 - RNA, 22 nt, Mycobacterium bovis subsp bovis AF2122/97
cacacugcccucaacgaucgcg

SEQ ID NO: 3041708 - RNA, 15 nt, Mycobacterium bovis subsp bovis AF2122/97
cacacuggcagugug

SEQ ID NO: 3041709 - RNA, 18 nt, Mycobacterium bovis subsp bovis AF2122/97
cacacuggccugcucaac

SEQ ID NO: 3041710 - RNA, 15 nt, Mycobacterium bovis subsp bovis AF2122/97
cacacuguucccaca

SEQ ID NO: 3041711 - RNA, 16 nt, Mycobacterium bovis subsp bovis AF2122/97
cacagaacucaccgac

SEQ ID NO: 3041712 - RNA, 17 nt, Mycobacterium bovis subsp bovis AF2122/97
cacagaacucaccgacg

SEQ ID NO: 3041713 - RNA, 22 nt, Mycobacterium bovis subsp bovis AF2122/97
cacagaacucaccgacggauga

SEQ ID NO: 3041714 - RNA, 13 nt, Mycobacterium bovis subsp bovis AF2122/97
cacagacagacag

SEQ ID NO: 3041715 - RNA, 18 nt, Mycobacterium bovis subsp bovis AF2122/97
cacagaccgaacagcacc

SEQ ID NO: 3041716 - RNA, 19 nt, Mycobacterium bovis subsp bovis AF2122/97
cacagaccgaacagcaccg

SEQ ID NO: 3041717 - RNA, 13 nt, Mycobacterium bovis subsp bovis AF2122/97
cacagaccgugac

SEQ ID NO: 3041718 - RNA, 17 nt, Mycobacterium bovis subsp bovis AF2122/97
cacagacugcgcggcac

SEQ ID NO: 3041719 - RNA, 19 nt, Mycobacterium bovis subsp bovis AF2122/97
cacagcaacgugugcacca

SEQ ID NO: 3041720 - RNA, 15 nt, Mycobacterium bovis subsp bovis AF2122/97
cacagcacagcgcag

SEQ ID NO: 3041721 - RNA, 20 nt, Mycobacterium bovis subsp bovis AF2122/97
cacagcaccacaucgaaggu

SEQ ID NO: 3041722 - RNA, 16 nt, Mycobacterium bovis subsp bovis AF2122/97
cacagcacccacgccg

SEQ ID NO: 3041723 - RNA, 13 nt, Mycobacterium bovis subsp bovis AF2122/97
cacagcaccgucc

SEQ ID NO: 3041724 - RNA, 15 nt, Mycobacterium bovis subsp bovis AF2122/97
cacagcagcaccgcg

SEQ ID NO: 3041725 - RNA, 14 nt, Mycobacterium bovis subsp bovis AF2122/97
cacagcaggcucga

SEQ ID NO: 3041726 - RNA, 16 nt, Mycobacterium bovis subsp bovis AF2122/97
cacagcauuguccggc

SEQ ID NO: 3041727 - RNA, 17 nt, Mycobacterium bovis subsp bovis AF2122/97
cacagcauuguccggcg

SEQ ID NO: 3041728 - RNA, 13 nt, Mycobacterium bovis subsp bovis AF2122/97
cacagccaccagc

SEQ ID NO: 3041729 - RNA, 22 nt, Mycobacterium bovis subsp bovis AF2122/97
cacagccaguaaaaaggcagga

SEQ ID NO: 3041730 - RNA, 15 nt, Mycobacterium bovis subsp bovis AF2122/97
cacagcccggcgacg

SEQ ID NO: 3041731 - RNA, 21 nt, Mycobacterium bovis subsp bovis AF2122/97
cacagcccggcgacgacccgg

SEQ ID NO: 3041732 - RNA, 22 nt, Mycobacterium bovis subsp bovis AF2122/97
cacagcccggcgacgacccggg

SEQ ID NO: 3041733 - RNA, 14 nt, Mycobacterium bovis subsp bovis AF2122/97
cacagcccggcggc

SEQ ID NO: 3041734 - RNA, 14 nt, Mycobacterium bovis subsp bovis AF2122/97
cacagccgaccucg

SEQ ID NO: 3041735 - RNA, 12 nt, Mycobacterium bovis subsp bovis AF2122/97
cacagccgcgcc

SEQ ID NO: 3041736 - RNA, 14 nt, Mycobacterium bovis subsp bovis AF2122/97
cacagccgcgccga

SEQ ID NO: 3041737 - RNA, 17 nt, Mycobacterium bovis subsp bovis AF2122/97
cacagccgcgcugcgac

SEQ ID NO: 3041738 - RNA, 14 nt, Mycobacterium bovis subsp bovis AF2122/97
cacagccggcggcu

SEQ ID NO: 3041739 - RNA, 12 nt, Mycobacterium bovis subsp bovis AF2122/97
cacagccggguu

SEQ ID NO: 3041740 - RNA, 14 nt, Mycobacterium bovis subsp bovis AF2122/97
cacagcgaacagac

SEQ ID NO: 3041741 - RNA, 13 nt, Mycobacterium bovis subsp bovis AF2122/97
cacagcgacgaga

SEQ ID NO: 3041742 - RNA, 13 nt, Mycobacterium bovis subsp bovis AF2122/97
cacagcgcagccu

SEQ ID NO: 3041743 - RNA, 21 nt, Mycobacterium bovis subsp bovis AF2122/97
cacagcgcguagcgggcgccc

SEQ ID NO: 3041744 - RNA, 13 nt, Mycobacterium bovis subsp bovis AF2122/97
cacagcggagacg

SEQ ID NO: 3041745 - RNA, 17 nt, Mycobacterium bovis subsp bovis AF2122/97
cacagcggagacgaucg

SEQ ID NO: 3041746 - RNA, 13 nt, Mycobacterium bovis subsp bovis AF2122/97
cacagcggcaucg

SEQ ID NO: 3041747 - RNA, 12 nt, Mycobacterium bovis subsp bovis AF2122/97
cacagcggccau

SEQ ID NO: 3041748 - RNA, 21 nt, Mycobacterium bovis subsp bovis AF2122/97
cacagcggccauaucgcccac

SEQ ID NO: 3041749 - RNA, 21 nt, Mycobacterium bovis subsp bovis AF2122/97
cacagcgucgaaaagccgugc

SEQ ID NO: 3041750 - RNA, 21 nt, Mycobacterium bovis subsp bovis AF2122/97
cacagcuugagcacacguccg

SEQ ID NO: 3041751 - RNA, 21 nt, Mycobacterium bovis subsp bovis AF2122/97
cacagcuugcaauugcgcggc

SEQ ID NO: 3041752 - RNA, 17 nt, Mycobacterium bovis subsp bovis AF2122/97
cacagcuugcccgagcc

SEQ ID NO: 3041753 - RNA, 19 nt, Mycobacterium bovis subsp bovis AF2122/97
cacagcuugcccgagccca

SEQ ID NO: 3041754 - RNA, 22 nt, Mycobacterium bovis subsp bovis AF2122/97
cacaggaagcguugucgcccac

SEQ ID NO: 3041755 - RNA, 19 nt, Mycobacterium bovis subsp bovis AF2122/97
cacaggacaauggacacca

SEQ ID NO: 3041756 - RNA, 14 nt, Mycobacterium bovis subsp bovis AF2122/97
cacaggaucaccca

SEQ ID NO: 3041757 - RNA, 16 nt, Mycobacterium bovis subsp bovis AF2122/97
cacaggauuggccgcu

SEQ ID NO: 3041758 - RNA, 17 nt, Mycobacterium bovis subsp bovis AF2122/97
cacaggcaucguccgcc

SEQ ID NO: 3041759 - RNA, 15 nt, Mycobacterium bovis subsp bovis AF2122/97
caccaagacgccacc

SEQ ID NO: 3041760 - RNA, 16 nt, Mycobacterium bovis subsp bovis AF2122/97
caccaagacgccaccc

SEQ ID NO: 3041761 - RNA, 14 nt, Mycobacterium bovis subsp bovis AF2122/97
caccaagcucggcc

SEQ ID NO: 3041762 - RNA, 16 nt, Mycobacterium bovis subsp bovis AF2122/97
caccaagcucggccag

SEQ ID NO: 3041763 - RNA, 18 nt, Mycobacterium bovis subsp bovis AF2122/97
caccaagcucggccagca

SEQ ID NO: 3041764 - RNA, 20 nt, Mycobacterium bovis subsp bovis AF2122/97
caccaagcucggccagcacg

SEQ ID NO: 3041765 - RNA, 22 nt, Mycobacterium bovis subsp bovis AF2122/97
caccaagcucggccagcacgcc

SEQ ID NO: 3041766 - RNA, 20 nt, Mycobacterium bovis subsp bovis AF2122/97
caccaaggccgccugcaaca

SEQ ID NO: 3041767 - RNA, 21 nt, Mycobacterium bovis subsp bovis AF2122/97
caccaaggccgugaugccacg

SEQ ID NO: 3041768 - RNA, 15 nt, Mycobacterium bovis subsp bovis AF2122/97
caccaaggucggcga

SEQ ID NO: 3041769 - RNA, 19 nt, Mycobacterium bovis subsp bovis AF2122/97
caccaaggucuucaggccg

SEQ ID NO: 3041770 - RNA, 23 nt, Mycobacterium bovis subsp bovis AF2122/97
caccaaggucuucaggccgcgca

SEQ ID NO: 3041771 - RNA, 19 nt, Mycobacterium bovis subsp bovis AF2122/97
caccaagguuggucggugc

SEQ ID NO: 3041772 - RNA, 13 nt, Mycobacterium bovis subsp bovis AF2122/97
caccaauaccgca

SEQ ID NO: 3041773 - RNA, 20 nt, Mycobacterium bovis subsp bovis AF2122/97
caccaauaccgcacccgcuc

SEQ ID NO: 3041774 - RNA, 18 nt, Mycobacterium bovis subsp bovis AF2122/97
caccaaucugcgggccgg

SEQ ID NO: 3041775 - RNA, 14 nt, Mycobacterium bovis subsp bovis AF2122/97
caccaaugcuccug

SEQ ID NO: 3041776 - RNA, 15 nt, Mycobacterium bovis subsp bovis AF2122/97
caccacaauccacgc

SEQ ID NO: 3041777 - RNA, 17 nt, Mycobacterium bovis subsp bovis AF2122/97
caccacaauccacgcac

SEQ ID NO: 3041778 - RNA, 18 nt, Mycobacterium bovis subsp bovis AF2122/97
caccacaauccacgcacu

SEQ ID NO: 3041779 - RNA, 14 nt, Mycobacterium bovis subsp bovis AF2122/97
caccacaccgagca

SEQ ID NO: 3041780 - RNA, 17 nt, Mycobacterium bovis subsp bovis AF2122/97
caccacaccgagcaccu

SEQ ID NO: 3041781 - RNA, 17 nt, Mycobacterium bovis subsp bovis AF2122/97
caccacaccggagccga

SEQ ID NO: 3041782 - RNA, 17 nt, Mycobacterium bovis subsp bovis AF2122/97
caccacaccugcggcug

SEQ ID NO: 3041783 - RNA, 13 nt, Mycobacterium bovis subsp bovis AF2122/97
caccacagugcca

SEQ ID NO: 3041784 - RNA, 17 nt, Mycobacterium bovis subsp bovis AF2122/97
caccacauccaucucca

SEQ ID NO: 3041785 - RNA, 13 nt, Mycobacterium bovis subsp bovis AF2122/97
caccacaucggug

SEQ ID NO: 3041786 - RNA, 22 nt, Mycobacterium bovis subsp bovis AF2122/97
caccacaucggugccacguucg

SEQ ID NO: 3041787 - RNA, 15 nt, Mycobacterium bovis subsp bovis AF2122/97
caccacaugggagcc

SEQ ID NO: 3041788 - RNA, 19 nt, Mycobacterium bovis subsp bovis AF2122/97
caccacaugggagccguuc

SEQ ID NO: 3041789 - RNA, 21 nt, Mycobacterium bovis subsp bovis AF2122/97
caccacauuggcgaucagcag

SEQ ID NO: 3041790 - RNA, 20 nt, Mycobacterium bovis subsp bovis AF2122/97
caccaccaagcucggccagc

SEQ ID NO: 3041791 - RNA, 22 nt, Mycobacterium bovis subsp bovis AF2122/97
caccaccaagguguggccuugc

SEQ ID NO: 3041792 - RNA, 14 nt, Mycobacterium bovis subsp bovis AF2122/97
caccaccacaccgg

SEQ ID NO: 3041793 - RNA, 13 nt, Mycobacterium bovis subsp bovis AF2122/97
caccaccaccgcc

SEQ ID NO: 3041794 - RNA, 14 nt, Mycobacterium bovis subsp bovis AF2122/97
caccaccaccgccg

SEQ ID NO: 3041795 - RNA, 15 nt, Mycobacterium bovis subsp bovis AF2122/97
caccaccaccgccgg

SEQ ID NO: 3041796 - RNA, 14 nt, Mycobacterium bovis subsp bovis AF2122/97
caccaccacgccga

SEQ ID NO: 3041797 - RNA, 14 nt, Mycobacterium bovis subsp bovis AF2122/97
caccaccacggcca

SEQ ID NO: 3041798 - RNA, 15 nt, Mycobacterium bovis subsp bovis AF2122/97
caccaccacgugauc

SEQ ID NO: 3041799 - RNA, 21 nt, Mycobacterium bovis subsp bovis AF2122/97
caccaccagggcaacggccgc

SEQ ID NO: 3041800 - RNA, 12 nt, Mycobacterium bovis subsp bovis AF2122/97
caccaccagguc

SEQ ID NO: 3041801 - RNA, 14 nt, Mycobacterium bovis subsp bovis AF2122/97
caccacccaggcca

SEQ ID NO: 3041802 - RNA, 15 nt, Mycobacterium bovis subsp bovis AF2122/97
caccaccccagcggc

SEQ ID NO: 3041803 - RNA, 20 nt, Mycobacterium bovis subsp bovis AF2122/97
caccaccccagcggccaccg

SEQ ID NO: 3041804 - RNA, 21 nt, Mycobacterium bovis subsp bovis AF2122/97
caccaccccagcggccaccga

SEQ ID NO: 3041805 - RNA, 16 nt, Mycobacterium bovis subsp bovis AF2122/97
caccaccccgucgagg

SEQ ID NO: 3041806 - RNA, 13 nt, Mycobacterium bovis subsp bovis AF2122/97
caccacccgaccg

SEQ ID NO: 3041807 - RNA, 16 nt, Mycobacterium bovis subsp bovis AF2122/97
caccacccgaccgcca

SEQ ID NO: 3041808 - RNA, 17 nt, Mycobacterium bovis subsp bovis AF2122/97
caccacccgauuggcca

SEQ ID NO: 3041809 - RNA, 21 nt, Mycobacterium bovis subsp bovis AF2122/97
caccacccgauuggccaaccc

SEQ ID NO: 3041810 - RNA, 13 nt, Mycobacterium bovis subsp bovis AF2122/97
caccacccggcga

SEQ ID NO: 3041811 - RNA, 14 nt, Mycobacterium bovis subsp bovis AF2122/97
caccacccggcgca

SEQ ID NO: 3041812 - RNA, 20 nt, Mycobacterium bovis subsp bovis AF2122/97
caccacccgggccucggcgc

SEQ ID NO: 3041813 - RNA, 21 nt, Mycobacterium bovis subsp bovis AF2122/97
caccacccgggccucggcgcc

SEQ ID NO: 3041814 - RNA, 22 nt, Mycobacterium bovis subsp bovis AF2122/97
caccacccgggccucggcgccg

SEQ ID NO: 3041815 - RNA, 14 nt, Mycobacterium bovis subsp bovis AF2122/97
caccacccgucggc

SEQ ID NO: 3041816 - RNA, 22 nt, Mycobacterium bovis subsp bovis AF2122/97
caccacccgucggcccgcucau

SEQ ID NO: 3041817 - RNA, 16 nt, Mycobacterium bovis subsp bovis AF2122/97
caccacccugcacugc

SEQ ID NO: 3041818 - RNA, 14 nt, Mycobacterium bovis subsp bovis AF2122/97
caccacccuugccg

SEQ ID NO: 3041819 - RNA, 17 nt, Mycobacterium bovis subsp bovis AF2122/97
caccaccgacagcaccc

SEQ ID NO: 3041820 - RNA, 21 nt, Mycobacterium bovis subsp bovis AF2122/97
caccaccgacagcacccggcc

SEQ ID NO: 3041821 - RNA, 22 nt, Mycobacterium bovis subsp bovis AF2122/97
caccaccgacagcacccggcca

SEQ ID NO: 3041822 - RNA, 12 nt, Mycobacterium bovis subsp bovis AF2122/97
caccaccgaccu

SEQ ID NO: 3041823 - RNA, 18 nt, Mycobacterium bovis subsp bovis AF2122/97
caccaccgcacaucgucc

SEQ ID NO: 3041824 - RNA, 14 nt, Mycobacterium bovis subsp bovis AF2122/97
caccaccgcacggg

SEQ ID NO: 3041825 - RNA, 13 nt, Mycobacterium bovis subsp bovis AF2122/97
caccaccgccccg

SEQ ID NO: 3041826 - RNA, 22 nt, Mycobacterium bovis subsp bovis AF2122/97
caccaccgccccgcgcccaacg

SEQ ID NO: 3041827 - RNA, 12 nt, Mycobacterium bovis subsp bovis AF2122/97
caccaccgccga

SEQ ID NO: 3041828 - RNA, 15 nt, Mycobacterium bovis subsp bovis AF2122/97
caccaccgccgaccc

SEQ ID NO: 3041829 - RNA, 17 nt, Mycobacterium bovis subsp bovis AF2122/97
caccaccgccgccggca

SEQ ID NO: 3041830 - RNA, 21 nt, Mycobacterium bovis subsp bovis AF2122/97
caccaccgccgccggcaccgc

SEQ ID NO: 3041831 - RNA, 12 nt, Mycobacterium bovis subsp bovis AF2122/97
caccaccgccgg

SEQ ID NO: 3041832 - RNA, 15 nt, Mycobacterium bovis subsp bovis AF2122/97
caccaccgccggggu

SEQ ID NO: 3041833 - RNA, 19 nt, Mycobacterium bovis subsp bovis AF2122/97
caccaccgccggugccgcc

SEQ ID NO: 3041834 - RNA, 14 nt, Mycobacterium bovis subsp bovis AF2122/97
caccaccgcgaccu

SEQ ID NO: 3041835 - RNA, 23 nt, Mycobacterium bovis subsp bovis AF2122/97
caccaccgcgaccucgcggcgcu

SEQ ID NO: 3041836 - RNA, 14 nt, Mycobacterium bovis subsp bovis AF2122/97
caccaccgcgccgu

SEQ ID NO: 3041837 - RNA, 16 nt, Mycobacterium bovis subsp bovis AF2122/97
caccaccgcgccgucg

SEQ ID NO: 3041838 - RNA, 15 nt, Mycobacterium bovis subsp bovis AF2122/97
caccaccgcggcggc

SEQ ID NO: 3041839 - RNA, 19 nt, Mycobacterium bovis subsp bovis AF2122/97
caccaccgcggcggcggcc

SEQ ID NO: 3041840 - RNA, 15 nt, Mycobacterium bovis subsp bovis AF2122/97
caccaccgcucgucg

SEQ ID NO: 3041841 - RNA, 20 nt, Mycobacterium bovis subsp bovis AF2122/97
caccaccgcucgucguccgg

SEQ ID NO: 3041842 - RNA, 18 nt, Mycobacterium bovis subsp bovis AF2122/97
caccaccgcugccggcgc

SEQ ID NO: 3041843 - RNA, 19 nt, Mycobacterium bovis subsp bovis AF2122/97
caccaccggaacgccgucg

SEQ ID NO: 3041844 - RNA, 14 nt, Mycobacterium bovis subsp bovis AF2122/97
caccaccggcaccc

SEQ ID NO: 3041845 - RNA, 16 nt, Mycobacterium bovis subsp bovis AF2122/97
caccaccggcacccgc

SEQ ID NO: 3041846 - RNA, 18 nt, Mycobacterium bovis subsp bovis AF2122/97
caccagaaccagcgaccu

SEQ ID NO: 3041847 - RNA, 15 nt, Mycobacterium bovis subsp bovis AF2122/97
caccagaauccugcu

SEQ ID NO: 3041848 - RNA, 20 nt, Mycobacterium bovis subsp bovis AF2122/97
caccagaauccugcuuucca

SEQ ID NO: 3041849 - RNA, 19 nt, Mycobacterium bovis subsp bovis AF2122/97
caccagacacuggccgucg

SEQ ID NO: 3041850 - RNA, 14 nt, Mycobacterium bovis subsp bovis AF2122/97
caccagaucaggug

SEQ ID NO: 3041851 - RNA, 21 nt, Mycobacterium bovis subsp bovis AF2122/97
caccagaucuucgagcgcauc

SEQ ID NO: 3041852 - RNA, 17 nt, Mycobacterium bovis subsp bovis AF2122/97
caccagaugcaccucgc

SEQ ID NO: 3041853 - RNA, 18 nt, Mycobacterium bovis subsp bovis AF2122/97
caccagaugcaccucgcc

SEQ ID NO: 3041854 - RNA, 22 nt, Mycobacterium bovis subsp bovis AF2122/97
caccagaugcaccucgcccugc

SEQ ID NO: 3041855 - RNA, 16 nt, Mycobacterium bovis subsp bovis AF2122/97
caccagauggcucucg

SEQ ID NO: 3041856 - RNA, 13 nt, Mycobacterium bovis subsp bovis AF2122/97
caccagcaacagc

SEQ ID NO: 3041857 - RNA, 14 nt, Mycobacterium bovis subsp bovis AF2122/97
caccagcaagugug

SEQ ID NO: 3041858 - RNA, 22 nt, Mycobacterium bovis subsp bovis AF2122/97
caccagcaagugugagcagacc

SEQ ID NO: 3041859 - RNA, 14 nt, Mycobacterium bovis subsp bovis AF2122/97
caccagcacacccg

SEQ ID NO: 3041860 - RNA, 14 nt, Mycobacterium bovis subsp bovis AF2122/97
caccagcacacucu

SEQ ID NO: 3041861 - RNA, 12 nt, Mycobacterium bovis subsp bovis AF2122/97
caccagcacccc

SEQ ID NO: 3041862 - RNA, 16 nt, Mycobacterium bovis subsp bovis AF2122/97
caccagcaccgccgcu

SEQ ID NO: 3041863 - RNA, 24 nt, Mycobacterium bovis subsp bovis AF2122/97
caccagcacggcaaccagcgagcc

SEQ ID NO: 3041864 - RNA, 16 nt, Mycobacterium bovis subsp bovis AF2122/97
caccagcagccagccc

SEQ ID NO: 3041865 - RNA, 13 nt, Mycobacterium bovis subsp bovis AF2122/97
caccagcaggcgg

SEQ ID NO: 3041866 - RNA, 17 nt, Mycobacterium bovis subsp bovis AF2122/97
caccagcaguggcgcau

SEQ ID NO: 3041867 - RNA, 15 nt, Mycobacterium bovis subsp bovis AF2122/97
caccagcauucucgc

SEQ ID NO: 3041868 - RNA, 13 nt, Mycobacterium bovis subsp bovis AF2122/97
caccagccacgcc

SEQ ID NO: 3041869 - RNA, 14 nt, Mycobacterium bovis subsp bovis AF2122/97
caccagccacgcca

SEQ ID NO: 3041870 - RNA, 15 nt, Mycobacterium bovis subsp bovis AF2122/97
caccagccacgccag

SEQ ID NO: 3041871 - RNA, 13 nt, Mycobacterium bovis subsp bovis AF2122/97
caccagccagccu

SEQ ID NO: 3041872 - RNA, 21 nt, Mycobacterium bovis subsp bovis AF2122/97
caccagccagccugcuggccg

SEQ ID NO: 3041873 - RNA, 12 nt, Mycobacterium bovis subsp bovis AF2122/97
caccagcccggc

SEQ ID NO: 3041874 - RNA, 18 nt, Mycobacterium bovis subsp bovis AF2122/97
caccagccgguagccggg

SEQ ID NO: 3041875 - RNA, 20 nt, Mycobacterium bovis subsp bovis AF2122/97
caccagccgguagccgggca

SEQ ID NO: 3041876 - RNA, 14 nt, Mycobacterium bovis subsp bovis AF2122/97
caccagccggugag

SEQ ID NO: 3041877 - RNA, 21 nt, Mycobacterium bovis subsp bovis AF2122/97
caccagccgguuggcugccgg

SEQ ID NO: 3041878 - RNA, 14 nt, Mycobacterium bovis subsp bovis AF2122/97
caccagccuggcug

SEQ ID NO: 3041879 - RNA, 18 nt, Mycobacterium bovis subsp bovis AF2122/97
caccagcgaauccagccg

SEQ ID NO: 3041880 - RNA, 15 nt, Mycobacterium bovis subsp bovis AF2122/97
caccagcgaccaggu

SEQ ID NO: 3041881 - RNA, 16 nt, Mycobacterium bovis subsp bovis AF2122/97
caccagcgaccagguc

SEQ ID NO: 3041882 - RNA, 22 nt, Mycobacterium bovis subsp bovis AF2122/97
caccagcgaccaggucgccagc

SEQ ID NO: 3041883 - RNA, 18 nt, Mycobacterium bovis subsp bovis AF2122/97
caccagcgaggccagcgg

SEQ ID NO: 3041884 - RNA, 16 nt, Mycobacterium bovis subsp bovis AF2122/97
caccagcgaguugagc

SEQ ID NO: 3041885 - RNA, 12 nt, Mycobacterium bovis subsp bovis AF2122/97
caccagcgcagc

SEQ ID NO: 3041886 - RNA, 18 nt, Mycobacterium bovis subsp bovis AF2122/97
caccagcgcagccgaucg

SEQ ID NO: 3041887 - RNA, 20 nt, Mycobacterium bovis subsp bovis AF2122/97
caccagcgcagccgaucguc

SEQ ID NO: 3041888 - RNA, 13 nt, Mycobacterium bovis subsp bovis AF2122/97
caccagcgcaucg

SEQ ID NO: 3041889 - RNA, 17 nt, Mycobacterium bovis subsp bovis AF2122/97
caccagcgcaucggcca

SEQ ID NO: 3041890 - RNA, 15 nt, Mycobacterium bovis subsp bovis AF2122/97
caccagcgcccggcc

SEQ ID NO: 3041891 - RNA, 17 nt, Mycobacterium bovis subsp bovis AF2122/97
caccagcgcccggcccg

SEQ ID NO: 3041892 - RNA, 20 nt, Mycobacterium bovis subsp bovis AF2122/97
caccagcgcccggcccgcca

SEQ ID NO: 3041893 - RNA, 23 nt, Mycobacterium bovis subsp bovis AF2122/97
caccagcgcccggcccgccaccc

SEQ ID NO: 3041894 - RNA, 13 nt, Mycobacterium bovis subsp bovis AF2122/97
caccagcgcccgu

SEQ ID NO: 3041895 - RNA, 15 nt, Mycobacterium bovis subsp bovis AF2122/97
caccagcgcccgucg

SEQ ID NO: 3041896 - RNA, 14 nt, Mycobacterium bovis subsp bovis AF2122/97
caccagcgccgacc

SEQ ID NO: 3041897 - RNA, 20 nt, Mycobacterium bovis subsp bovis AF2122/97
caccagcgccgacccguacc

SEQ ID NO: 3041898 - RNA, 23 nt, Mycobacterium bovis subsp bovis AF2122/97
caccagcgcgccguagaccagca

SEQ ID NO: 3041899 - RNA, 15 nt, Mycobacterium bovis subsp bovis AF2122/97
caccagcgcgcgccg

SEQ ID NO: 3041900 - RNA, 19 nt, Mycobacterium bovis subsp bovis AF2122/97
caccagcgcuccagcaccc

SEQ ID NO: 3041901 - RNA, 14 nt, Mycobacterium bovis subsp bovis AF2122/97
caccagcggcaccg

SEQ ID NO: 3041902 - RNA, 20 nt, Mycobacterium bovis subsp bovis AF2122/97
caccagcggcaccgcggcca

SEQ ID NO: 3041903 - RNA, 15 nt, Mycobacterium bovis subsp bovis AF2122/97
caccagcggcggcaa

SEQ ID NO: 3041904 - RNA, 15 nt, Mycobacterium bovis subsp bovis AF2122/97
caccagcggcggccc

SEQ ID NO: 3041905 - RNA, 11 nt, Mycobacterium bovis subsp bovis AF2122/97
caccagcggcu

SEQ ID NO: 3041906 - RNA, 16 nt, Mycobacterium bovis subsp bovis AF2122/97
caccagcggcugaccg

SEQ ID NO: 3041907 - RNA, 15 nt, Mycobacterium bovis subsp bovis AF2122/97
caccagcggucggcg

SEQ ID NO: 3041908 - RNA, 18 nt, Mycobacterium bovis subsp bovis AF2122/97
caccagcgucgcacgcgc

SEQ ID NO: 3041909 - RNA, 21 nt, Mycobacterium bovis subsp bovis AF2122/97
caccagcgucgcacgcgcgca

SEQ ID NO: 3041910 - RNA, 15 nt, Mycobacterium bovis subsp bovis AF2122/97
caccagcgucgcggc

SEQ ID NO: 3041911 - RNA, 17 nt, Mycobacterium bovis subsp bovis AF2122/97
caccagcgucgcggcca

SEQ ID NO: 3041912 - RNA, 19 nt, Mycobacterium bovis subsp bovis AF2122/97
caccagcgucgcggccacg

SEQ ID NO: 3041913 - RNA, 16 nt, Mycobacterium bovis subsp bovis AF2122/97
caccagcgugcugccg

SEQ ID NO: 3041914 - RNA, 21 nt, Mycobacterium bovis subsp bovis AF2122/97
caccagcguguggagcucgcg

SEQ ID NO: 3041915 - RNA, 15 nt, Mycobacterium bovis subsp bovis AF2122/97
caccagcucacccgg

SEQ ID NO: 3041916 - RNA, 14 nt, Mycobacterium bovis subsp bovis AF2122/97
caccagcugucggg

SEQ ID NO: 3041917 - RNA, 18 nt, Mycobacterium bovis subsp bovis AF2122/97
caccagcugucgggcagc

SEQ ID NO: 3041918 - RNA, 18 nt, Mycobacterium bovis subsp bovis AF2122/97
caccaggccgagccgccc

SEQ ID NO: 3041919 - RNA, 19 nt, Mycobacterium bovis subsp bovis AF2122/97
caccaggccgagccgcccg

SEQ ID NO: 3041920 - RNA, 23 nt, Mycobacterium bovis subsp bovis AF2122/97
caccagggcaacggccgcuagcg

SEQ ID NO: 3041921 - RNA, 20 nt, Mycobacterium bovis subsp bovis AF2122/97
caccagggcacguucggcgc

SEQ ID NO: 3041922 - RNA, 15 nt, Mycobacterium bovis subsp bovis AF2122/97
caccagggccaccgc

SEQ ID NO: 3041923 - RNA, 18 nt, Mycobacterium bovis subsp bovis AF2122/97
caccagggccaccgcgcc

SEQ ID NO: 3041924 - RNA, 23 nt, Mycobacterium bovis subsp bovis AF2122/97
caccagggccuccacccgccacg

SEQ ID NO: 3041925 - RNA, 19 nt, Mycobacterium bovis subsp bovis AF2122/97
caccagggccucgaccgcc

SEQ ID NO: 3041926 - RNA, 22 nt, Mycobacterium bovis subsp bovis AF2122/97
caccagggccucgaccgccagc

SEQ ID NO: 3041927 - RNA, 14 nt, Mycobacterium bovis subsp bovis AF2122/97
caccagggcgcgga

SEQ ID NO: 3041928 - RNA, 14 nt, Mycobacterium bovis subsp bovis AF2122/97
caccagggcggccu

SEQ ID NO: 3041929 - RNA, 18 nt, Mycobacterium bovis subsp bovis AF2122/97
caccagggcgugcgcgaa

SEQ ID NO: 3041930 - RNA, 16 nt, Mycobacterium bovis subsp bovis AF2122/97
caccaggggaccgcgg

SEQ ID NO: 3041931 - RNA, 17 nt, Mycobacterium bovis subsp bovis AF2122/97
caccaggggaccgcggc

SEQ ID NO: 3041932 - RNA, 19 nt, Mycobacterium bovis subsp bovis AF2122/97
caccaggggaccgcggcgc

SEQ ID NO: 3041933 - RNA, 19 nt, Mycobacterium bovis subsp bovis AF2122/97
cacccaauggagccgcgac

SEQ ID NO: 3041934 - RNA, 20 nt, Mycobacterium bovis subsp bovis AF2122/97
cacccaauggagccgcgacc

SEQ ID NO: 3041935 - RNA, 23 nt, Mycobacterium bovis subsp bovis AF2122/97
cacccaauggagccgcgaccaug

SEQ ID NO: 3041936 - RNA, 14 nt, Mycobacterium bovis subsp bovis AF2122/97
cacccacacccagc

SEQ ID NO: 3041937 - RNA, 16 nt, Mycobacterium bovis subsp bovis AF2122/97
cacccaccacaccaag

SEQ ID NO: 3041938 - RNA, 14 nt, Mycobacterium bovis subsp bovis AF2122/97
cacccacccgcacc

SEQ ID NO: 3041939 - RNA, 17 nt, Mycobacterium bovis subsp bovis AF2122/97
cacccacccgcaccgcg

SEQ ID NO: 3041940 - RNA, 21 nt, Mycobacterium bovis subsp bovis AF2122/97
cacccacccguucggcugcgc

SEQ ID NO: 3041941 - RNA, 22 nt, Mycobacterium bovis subsp bovis AF2122/97
cacccacccguucggcugcgcu

SEQ ID NO: 3041942 - RNA, 18 nt, Mycobacterium bovis subsp bovis AF2122/97
cacccaccggaccaccgc

SEQ ID NO: 3041943 - RNA, 21 nt, Mycobacterium bovis subsp bovis AF2122/97
cacccaccggaccaccgccga

SEQ ID NO: 3041944 - RNA, 13 nt, Mycobacterium bovis subsp bovis AF2122/97
cacccaccggcca

SEQ ID NO: 3041945 - RNA, 16 nt, Mycobacterium bovis subsp bovis AF2122/97
cacccacgaucagcag

SEQ ID NO: 3041946 - RNA, 17 nt, Mycobacterium bovis subsp bovis AF2122/97
cacccacgaucagcagc

SEQ ID NO: 3041947 - RNA, 14 nt, Mycobacterium bovis subsp bovis AF2122/97
cacccacgccgacu

SEQ ID NO: 3041948 - RNA, 17 nt, Mycobacterium bovis subsp bovis AF2122/97
cacccacgucgagcagg

SEQ ID NO: 3041949 - RNA, 15 nt, Mycobacterium bovis subsp bovis AF2122/97
cacccacgugcugcc

SEQ ID NO: 3041950 - RNA, 20 nt, Mycobacterium bovis subsp bovis AF2122/97
cacccacguugaugaugccg

SEQ ID NO: 3041951 - RNA, 17 nt, Mycobacterium bovis subsp bovis AF2122/97
cacccacuccgccgaua

SEQ ID NO: 3041952 - RNA, 20 nt, Mycobacterium bovis subsp bovis AF2122/97
cacccacuuucgacccgcgg

SEQ ID NO: 3041953 - RNA, 20 nt, Mycobacterium bovis subsp bovis AF2122/97
cacccacuuuucgguggcgg

SEQ ID NO: 3041954 - RNA, 15 nt, Mycobacterium bovis subsp bovis AF2122/97
cacccagacaccggc

SEQ ID NO: 3041955 - RNA, 18 nt, Mycobacterium bovis subsp bovis AF2122/97
cacccagacgauggccag

SEQ ID NO: 3041956 - RNA, 14 nt, Mycobacterium bovis subsp bovis AF2122/97
cacccagaugcagc

SEQ ID NO: 3041957 - RNA, 20 nt, Mycobacterium bovis subsp bovis AF2122/97
cacccagaugcagcggucca

SEQ ID NO: 3041958 - RNA, 17 nt, Mycobacterium bovis subsp bovis AF2122/97
cacccagauugccuggg

SEQ ID NO: 3041959 - RNA, 20 nt, Mycobacterium bovis subsp bovis AF2122/97
cacccagauugccugggcgg

SEQ ID NO: 3041960 - RNA, 23 nt, Mycobacterium bovis subsp bovis AF2122/97
cacccagauugccugggcggccg

SEQ ID NO: 3041961 - RNA, 17 nt, Mycobacterium bovis subsp bovis AF2122/97
cacccagcaccagggcg

SEQ ID NO: 3041962 - RNA, 14 nt, Mycobacterium bovis subsp bovis AF2122/97
cacccagcacgcgc

SEQ ID NO: 3041963 - RNA, 13 nt, Mycobacterium bovis subsp bovis AF2122/97
cacccagcccagc

SEQ ID NO: 3041964 - RNA, 15 nt, Mycobacterium bovis subsp bovis AF2122/97
cacccagccgcagcc

SEQ ID NO: 3041965 - RNA, 19 nt, Mycobacterium bovis subsp bovis AF2122/97
cacccagcgacucggccag

SEQ ID NO: 3041966 - RNA, 17 nt, Mycobacterium bovis subsp bovis AF2122/97
cacccagcgccgaccca

SEQ ID NO: 3041967 - RNA, 17 nt, Mycobacterium bovis subsp bovis AF2122/97
cacccagcgcgcuggga

SEQ ID NO: 3041968 - RNA, 23 nt, Mycobacterium bovis subsp bovis AF2122/97
cacccagcucgcgcacccagccc

SEQ ID NO: 3041969 - RNA, 22 nt, Mycobacterium bovis subsp bovis AF2122/97
cacccagcuuggagaggcggug

SEQ ID NO: 3041970 - RNA, 20 nt, Mycobacterium bovis subsp bovis AF2122/97
cacccaggccauaccgcaau

SEQ ID NO: 3041971 - RNA, 12 nt, Mycobacterium bovis subsp bovis AF2122/97
cacccaggccga

SEQ ID NO: 3041972 - RNA, 16 nt, Mycobacterium bovis subsp bovis AF2122/97
cacccaggccgaugug

SEQ ID NO: 3041973 - RNA, 14 nt, Mycobacterium bovis subsp bovis AF2122/97
cacccaggcgccga

SEQ ID NO: 3041974 - RNA, 12 nt, Mycobacterium bovis subsp bovis AF2122/97
cacccagggcgu

SEQ ID NO: 3041975 - RNA, 18 nt, Mycobacterium bovis subsp bovis AF2122/97
cacccaggugucgcugcu

SEQ ID NO: 3041976 - RNA, 19 nt, Mycobacterium bovis subsp bovis AF2122/97
cacccaggugucgcugcug

SEQ ID NO: 3041977 - RNA, 19 nt, Mycobacterium bovis subsp bovis AF2122/97
cacccagucggcgccgccg

SEQ ID NO: 3041978 - RNA, 23 nt, Mycobacterium bovis subsp bovis AF2122/97
cacccagucggcgccgccgucca

SEQ ID NO: 3041979 - RNA, 16 nt, Mycobacterium bovis subsp bovis AF2122/97
cacccagugccacgcc

SEQ ID NO: 3041980 - RNA, 19 nt, Mycobacterium bovis subsp bovis AF2122/97
cacccagugccacgccuga

SEQ ID NO: 3041981 - RNA, 17 nt, Mycobacterium bovis subsp bovis AF2122/97
cacccaguuccacccgg

SEQ ID NO: 3041982 - RNA, 21 nt, Mycobacterium bovis subsp bovis AF2122/97
cacccauaccuucggcgaucu

SEQ ID NO: 3041983 - RNA, 16 nt, Mycobacterium bovis subsp bovis AF2122/97
cacccauagacccggc

SEQ ID NO: 3041984 - RNA, 18 nt, Mycobacterium bovis subsp bovis AF2122/97
cacccaucaacgccggcg

SEQ ID NO: 3041985 - RNA, 23 nt, Mycobacterium bovis subsp bovis AF2122/97
cacccaucaacgccggcgacggc

SEQ ID NO: 3041986 - RNA, 14 nt, Mycobacterium bovis subsp bovis AF2122/97
cacccaucaccgcc

SEQ ID NO: 3041987 - RNA, 13 nt, Mycobacterium bovis subsp bovis AF2122/97
cacccaucaucgc

SEQ ID NO: 3041988 - RNA, 15 nt, Mycobacterium bovis subsp bovis AF2122/97
cacccaucaucgcca

SEQ ID NO: 3041989 - RNA, 19 nt, Mycobacterium bovis subsp bovis AF2122/97
cacccaucaucgccaccac

SEQ ID NO: 3041990 - RNA, 14 nt, Mycobacterium bovis subsp bovis AF2122/97
cacccaucccguuc

SEQ ID NO: 3041991 - RNA, 21 nt, Mycobacterium bovis subsp bovis AF2122/97
cacccauccucgcggugcgcc

SEQ ID NO: 3041992 - RNA, 16 nt, Mycobacterium bovis subsp bovis AF2122/97
cacccaucgaccgccc

SEQ ID NO: 3041993 - RNA, 17 nt, Mycobacterium bovis subsp bovis AF2122/97
cacccaucgaccgcccg

SEQ ID NO: 3041994 - RNA, 18 nt, Mycobacterium bovis subsp bovis AF2122/97
cacccaucgcacggauga

SEQ ID NO: 3041995 - RNA, 13 nt, Mycobacterium bovis subsp bovis AF2122/97
cacccaugauccc

SEQ ID NO: 3041996 - RNA, 15 nt, Mycobacterium bovis subsp bovis AF2122/97
cacccauggccuccc

SEQ ID NO: 3041997 - RNA, 18 nt, Mycobacterium bovis subsp bovis AF2122/97
cacccauucgucgguacc

SEQ ID NO: 3041998 - RNA, 24 nt, Mycobacterium bovis subsp bovis AF2122/97
cacccauucgucgguaccguccuc

SEQ ID NO: 3041999 - RNA, 20 nt, Mycobacterium bovis subsp bovis AF2122/97
cacccauuuaaacgggccgg

SEQ ID NO: 3042000 - RNA, 17 nt, Mycobacterium bovis subsp bovis AF2122/97
caccccaaaaccgccgg

SEQ ID NO: 3042001 - RNA, 22 nt, Mycobacterium bovis subsp bovis AF2122/97
caccccacccagcgacucggcc

SEQ ID NO: 3042002 - RNA, 14 nt, Mycobacterium bovis subsp bovis AF2122/97
caccccacggccag

SEQ ID NO: 3042003 - RNA, 20 nt, Mycobacterium bovis subsp bovis AF2122/97
caccccacuggcacacgguc

SEQ ID NO: 3042004 - RNA, 12 nt, Mycobacterium bovis subsp bovis AF2122/97
caccccagcggc

SEQ ID NO: 3042005 - RNA, 16 nt, Mycobacterium bovis subsp bovis AF2122/97
caccccagcggccacc

SEQ ID NO: 3042006 - RNA, 12 nt, Mycobacterium bovis subsp bovis AF2122/97
caccccagggca

SEQ ID NO: 3042007 - RNA, 18 nt, Mycobacterium bovis subsp bovis AF2122/97
caccccauacucggcggc

SEQ ID NO: 3042008 - RNA, 19 nt, Mycobacterium bovis subsp bovis AF2122/97
caccccaucgauaaccgaa

SEQ ID NO: 3042009 - RNA, 19 nt, Mycobacterium bovis subsp bovis AF2122/97
caccccaugaccgggaggc

SEQ ID NO: 3042010 - RNA, 16 nt, Mycobacterium bovis subsp bovis AF2122/97
caccccauggccaccg

SEQ ID NO: 3042011 - RNA, 18 nt, Mycobacterium bovis subsp bovis AF2122/97
caccccauggccaccgaa

SEQ ID NO: 3042012 - RNA, 19 nt, Mycobacterium bovis subsp bovis AF2122/97
cacccccaaccgccggcca

SEQ ID NO: 3042013 - RNA, 16 nt, Mycobacterium bovis subsp bovis AF2122/97
cacccccaccgaagcg

SEQ ID NO: 3042014 - RNA, 14 nt, Mycobacterium bovis subsp bovis AF2122/97
caccccccagcgcc

SEQ ID NO: 3042015 - RNA, 18 nt, Mycobacterium bovis subsp bovis AF2122/97
caccccccagcgccgccg

SEQ ID NO: 3042016 - RNA, 21 nt, Mycobacterium bovis subsp bovis AF2122/97
cacccccccccccacccacca

SEQ ID NO: 3042017 - RNA, 13 nt, Mycobacterium bovis subsp bovis AF2122/97
cacccccgacgag

SEQ ID NO: 3042018 - RNA, 23 nt, Mycobacterium bovis subsp bovis AF2122/97
cacccccgacgagauacggccac

SEQ ID NO: 3042019 - RNA, 23 nt, Mycobacterium bovis subsp bovis AF2122/97
cacccgcggcgccguugccaccg

SEQ ID NO: 3042020 - RNA, 20 nt, Mycobacterium bovis subsp bovis AF2122/97
cacccgcggugccugcagcu

SEQ ID NO: 3042021 - RNA, 22 nt, Mycobacterium bovis subsp bovis AF2122/97
cacccgcgucaguccucaucga

SEQ ID NO: 3042022 - RNA, 14 nt, Mycobacterium bovis subsp bovis AF2122/97
cacccgcgucgagu

SEQ ID NO: 3042023 - RNA, 23 nt, Mycobacterium bovis subsp bovis AF2122/97
cacccgcgucgagugccgccacc

SEQ ID NO: 3042024 - RNA, 24 nt, Mycobacterium bovis subsp bovis AF2122/97
cacccgcgucgagugccgccaccg

SEQ ID NO: 3042025 - RNA, 12 nt, Mycobacterium bovis subsp bovis AF2122/97
cacccgcucgcc

SEQ ID NO: 3042026 - RNA, 16 nt, Mycobacterium bovis subsp bovis AF2122/97
cacccgcucgcccgcc

SEQ ID NO: 3042027 - RNA, 21 nt, Mycobacterium bovis subsp bovis AF2122/97
cacccgcucgcccgccgccac

SEQ ID NO: 3042028 - RNA, 16 nt, Mycobacterium bovis subsp bovis AF2122/97
cacccgcucggccgcc

SEQ ID NO: 3042029 - RNA, 17 nt, Mycobacterium bovis subsp bovis AF2122/97
cacccgcucggcgcgcg

SEQ ID NO: 3042030 - RNA, 13 nt, Mycobacterium bovis subsp bovis AF2122/97
cacccgcugcacg

SEQ ID NO: 3042031 - RNA, 16 nt, Mycobacterium bovis subsp bovis AF2122/97
cacccgcugcacgccg

SEQ ID NO: 3042032 - RNA, 18 nt, Mycobacterium bovis subsp bovis AF2122/97
cacccgcuggcgguaagc

SEQ ID NO: 3042033 - RNA, 17 nt, Mycobacterium bovis subsp bovis AF2122/97
cacccgcuuugcacugu

SEQ ID NO: 3042034 - RNA, 22 nt, Mycobacterium bovis subsp bovis AF2122/97
cacccggacauagccgcgcucg

SEQ ID NO: 3042035 - RNA, 18 nt, Mycobacterium bovis subsp bovis AF2122/97
cacccggcaaucucccga

SEQ ID NO: 3042036 - RNA, 19 nt, Mycobacterium bovis subsp bovis AF2122/97
cacccggcauugagccggg

SEQ ID NO: 3042037 - RNA, 17 nt, Mycobacterium bovis subsp bovis AF2122/97
cacccggccaccggacg

SEQ ID NO: 3042038 - RNA, 12 nt, Mycobacterium bovis subsp bovis AF2122/97
cacccggccgac

SEQ ID NO: 3042039 - RNA, 13 nt, Mycobacterium bovis subsp bovis AF2122/97
cacccggccgacc

SEQ ID NO: 3042040 - RNA, 14 nt, Mycobacterium bovis subsp bovis AF2122/97
cacccggccgaccu

SEQ ID NO: 3042041 - RNA, 13 nt, Mycobacterium bovis subsp bovis AF2122/97
cacccggccgccg

SEQ ID NO: 3042042 - RNA, 15 nt, Mycobacterium bovis subsp bovis AF2122/97
cacccggccgccgaa

SEQ ID NO: 3042043 - RNA, 12 nt, Mycobacterium bovis subsp bovis AF2122/97
cacccggccgcg

SEQ ID NO: 3042044 - RNA, 23 nt, Mycobacterium bovis subsp bovis AF2122/97
cacccggccguugggccaccggc

SEQ ID NO: 3042045 - RNA, 19 nt, Mycobacterium bovis subsp bovis AF2122/97
cacccggccucaacacccg

SEQ ID NO: 3042046 - RNA, 20 nt, Mycobacterium bovis subsp bovis AF2122/97
cacccggccucaacacccgg

SEQ ID NO: 3042047 - RNA, 23 nt, Mycobacterium bovis subsp bovis AF2122/97
cacccggccucaacacccggccg

SEQ ID NO: 3042048 - RNA, 14 nt, Mycobacterium bovis subsp bovis AF2122/97
cacccggcgggcgg

SEQ ID NO: 3042049 - RNA, 21 nt, Mycobacterium bovis subsp bovis AF2122/97
cacccggcgggcggugggcag

SEQ ID NO: 3042050 - RNA, 21 nt, Mycobacterium bovis subsp bovis AF2122/97
cacccggcuguucucgccgaa

SEQ ID NO: 3042051 - RNA, 19 nt, Mycobacterium bovis subsp bovis AF2122/97
cacccggcuucgccgcgcu

SEQ ID NO: 3042052 - RNA, 22 nt, Mycobacterium bovis subsp bovis AF2122/97
cacccggcuucgccgcgcuugc

SEQ ID NO: 3042053 - RNA, 18 nt, Mycobacterium bovis subsp bovis AF2122/97
cacccgggacgaaccggc

SEQ ID NO: 3042054 - RNA, 22 nt, Mycobacterium bovis subsp bovis AF2122/97
cacccgggacgaaccggccgac

SEQ ID NO: 3042055 - RNA, 23 nt, Mycobacterium bovis subsp bovis AF2122/97
cacccgggacgaaccggccgacg

SEQ ID NO: 3042056 - RNA, 21 nt, Mycobacterium bovis subsp bovis AF2122/97
cacccgggacguuguccaccg

SEQ ID NO: 3042057 - RNA, 23 nt, Mycobacterium bovis subsp bovis AF2122/97
cacccgggacguuguccaccgcc

SEQ ID NO: 3042058 - RNA, 20 nt, Mycobacterium bovis subsp bovis AF2122/97
cacccgggcagccugcugca

SEQ ID NO: 3042059 - RNA, 18 nt, Mycobacterium bovis subsp bovis AF2122/97
cacccgggccacgucgag

SEQ ID NO: 3042060 - RNA, 18 nt, Mycobacterium bovis subsp bovis AF2122/97
cacccgggccucggcgcc

SEQ ID NO: 3042061 - RNA, 21 nt, Mycobacterium bovis subsp bovis AF2122/97
cacccgggccucggcgccguc

SEQ ID NO: 3042062 - RNA, 18 nt, Mycobacterium bovis subsp bovis AF2122/97
cacccgggcugcuugcgc

SEQ ID NO: 3042063 - RNA, 18 nt, Mycobacterium bovis subsp bovis AF2122/97
cacccggggugcccggcc

SEQ ID NO: 3042064 - RNA, 20 nt, Mycobacterium bovis subsp bovis AF2122/97
cacccggggugcccggccgc

SEQ ID NO: 3042065 - RNA, 21 nt, Mycobacterium bovis subsp bovis AF2122/97
cacccggggugcccggccgcc

SEQ ID NO: 3042066 - RNA, 16 nt, Mycobacterium bovis subsp bovis AF2122/97
cacccggguggcacgc

SEQ ID NO: 3042067 - RNA, 14 nt, Mycobacterium bovis subsp bovis AF2122/97
cacccgguagguga

SEQ ID NO: 3042068 - RNA, 14 nt, Mycobacterium bovis subsp bovis AF2122/97
cacccgguccaccg

SEQ ID NO: 3042069 - RNA, 15 nt, Mycobacterium bovis subsp bovis AF2122/97
cacccgguccggccc

SEQ ID NO: 3042070 - RNA, 16 nt, Mycobacterium bovis subsp bovis AF2122/97
cacccgguccggcccg

SEQ ID NO: 3042071 - RNA, 11 nt, Mycobacterium bovis subsp bovis AF2122/97
cacccggucgg

SEQ ID NO: 3042072 - RNA, 19 nt, Mycobacterium bovis subsp bovis AF2122/97
cacccggugagaagaagcc

SEQ ID NO: 3042073 - RNA, 14 nt, Mycobacterium bovis subsp bovis AF2122/97
cacccggugccgca

SEQ ID NO: 3042074 - RNA, 18 nt, Mycobacterium bovis subsp bovis AF2122/97
cacccggugccgcagcag

SEQ ID NO: 3042075 - RNA, 23 nt, Mycobacterium bovis subsp bovis AF2122/97
cacccgguggcugaucaccguug

SEQ ID NO: 3042076 - RNA, 24 nt, Mycobacterium bovis subsp bovis AF2122/97
cacccgguugugcgcgcgcccgaa

SEQ ID NO: 3042077 - RNA, 20 nt, Mycobacterium bovis subsp bovis AF2122/97
cacccgucacaagcugacac

SEQ ID NO: 3042078 - RNA, 23 nt, Mycobacterium bovis subsp bovis AF2122/97
cacccgucaugcccaccgccugg

SEQ ID NO: 3042079 - RNA, 13 nt, Mycobacterium bovis subsp bovis AF2122/97
cacccguccggcc

SEQ ID NO: 3042080 - RNA, 19 nt, Mycobacterium bovis subsp bovis AF2122/97
cacccguguugagggugcc

SEQ ID NO: 3042081 - RNA, 20 nt, Mycobacterium bovis subsp bovis AF2122/97
cacccguucgugagcggcca

SEQ ID NO: 3042082 - RNA, 20 nt, Mycobacterium bovis subsp bovis AF2122/97
cacccguugaucgcggacac

SEQ ID NO: 3042083 - RNA, 23 nt, Mycobacterium bovis subsp bovis AF2122/97
cacccguugcucccacggcaccc

SEQ ID NO: 3042084 - RNA, 21 nt, Mycobacterium bovis subsp bovis AF2122/97
cacccuauuggucggucgcgc

SEQ ID NO: 3042085 - RNA, 15 nt, Mycobacterium bovis subsp bovis AF2122/97
cacccucaggcaauc

SEQ ID NO: 3042086 - RNA, 16 nt, Mycobacterium bovis subsp bovis AF2122/97
cacccuccacagcggc

SEQ ID NO: 3042087 - RNA, 15 nt, Mycobacterium bovis subsp bovis AF2122/97
cacccuccgccgguc

SEQ ID NO: 3042088 - RNA, 15 nt, Mycobacterium bovis subsp bovis AF2122/97
cacccugacagcgag

SEQ ID NO: 3042089 - RNA, 15 nt, Mycobacterium bovis subsp bovis AF2122/97
cacccugaccaacau

SEQ ID NO: 3042090 - RNA, 21 nt, Mycobacterium bovis subsp bovis AF2122/97
cacccugaugugaguccagcc

SEQ ID NO: 3042091 - RNA, 17 nt, Mycobacterium bovis subsp bovis AF2122/97
cacccugccagagauca

SEQ ID NO: 3042092 - RNA, 22 nt, Mycobacterium bovis subsp bovis AF2122/97
cacccugcgaauagccaccaag

SEQ ID NO: 3042093 - RNA, 15 nt, Mycobacterium bovis subsp bovis AF2122/97
cacccugcggcaccu

SEQ ID NO: 3042094 - RNA, 21 nt, Mycobacterium bovis subsp bovis AF2122/97
cacccugcggcaccucauugc

SEQ ID NO: 3042095 - RNA, 14 nt, Mycobacterium bovis subsp bovis AF2122/97
cacccugggcaaac

SEQ ID NO: 3042096 - RNA, 22 nt, Mycobacterium bovis subsp bovis AF2122/97
cacccugggcaaacugggcacc

SEQ ID NO: 3042097 - RNA, 13 nt, Mycobacterium bovis subsp bovis AF2122/97
cacccugucgcgc

SEQ ID NO: 3042098 - RNA, 14 nt, Mycobacterium bovis subsp bovis AF2122/97
cacccuguuugccc

SEQ ID NO: 3042099 - RNA, 24 nt, Mycobacterium bovis subsp bovis AF2122/97
cacccuguuugcccaacagacauu

SEQ ID NO: 3042100 - RNA, 13 nt, Mycobacterium bovis subsp bovis AF2122/97
cacccuugcccac

SEQ ID NO: 3042101 - RNA, 20 nt, Mycobacterium bovis subsp bovis AF2122/97
cacccuugcccacggcgacc

SEQ ID NO: 3042102 - RNA, 13 nt, Mycobacterium bovis subsp bovis AF2122/97
cacccuugccgcc

SEQ ID NO: 3042103 - RNA, 14 nt, Mycobacterium bovis subsp bovis AF2122/97
cacccuugccgccg

SEQ ID NO: 3042104 - RNA, 13 nt, Mycobacterium bovis subsp bovis AF2122/97
cacccuuggcccg

SEQ ID NO: 3042105 - RNA, 22 nt, Mycobacterium bovis subsp bovis AF2122/97
caccgaggucgagcgaccccac

SEQ ID NO: 3042106 - RNA, 16 nt, Mycobacterium bovis subsp bovis AF2122/97
caccgaggugccgcgc

SEQ ID NO: 3042107 - RNA, 14 nt, Mycobacterium bovis subsp bovis AF2122/97
caccgagguugcgc

SEQ ID NO: 3042108 - RNA, 17 nt, Mycobacterium bovis subsp bovis AF2122/97
caccgagucgacggcca

SEQ ID NO: 3042109 - RNA, 16 nt, Mycobacterium bovis subsp bovis AF2122/97
caccgagucgaucacg

SEQ ID NO: 3042110 - RNA, 16 nt, Mycobacterium bovis subsp bovis AF2122/97
caccgagugcggugug

SEQ ID NO: 3042111 - RNA, 15 nt, Mycobacterium bovis subsp bovis AF2122/97
caccgauauggccgg

SEQ ID NO: 3042112 - RNA, 16 nt, Mycobacterium bovis subsp bovis AF2122/97
caccgauauggccggg

SEQ ID NO: 3042113 - RNA, 17 nt, Mycobacterium bovis subsp bovis AF2122/97
caccgaucccgcggccg

SEQ ID NO: 3042114 - RNA, 15 nt, Mycobacterium bovis subsp bovis AF2122/97
caccgauccggccgc

SEQ ID NO: 3042115 - RNA, 16 nt, Mycobacterium bovis subsp bovis AF2122/97
caccgauccggccgcc

SEQ ID NO: 3042116 - RNA, 19 nt, Mycobacterium bovis subsp bovis AF2122/97
caccgaucggugccggccu

SEQ ID NO: 3042117 - RNA, 20 nt, Mycobacterium bovis subsp bovis AF2122/97
caccgaugccuugaccgcgg

SEQ ID NO: 3042118 - RNA, 19 nt, Mycobacterium bovis subsp bovis AF2122/97
caccgaugcgauaacccgc

SEQ ID NO: 3042119 - RNA, 13 nt, Mycobacterium bovis subsp bovis AF2122/97
caccgaugcgccg

SEQ ID NO: 3042120 - RNA, 16 nt, Mycobacterium bovis subsp bovis AF2122/97
caccgaugcgccggac

SEQ ID NO: 3042121 - RNA, 18 nt, Mycobacterium bovis subsp bovis AF2122/97
caccgaugcugacgaugc

SEQ ID NO: 3042122 - RNA, 21 nt, Mycobacterium bovis subsp bovis AF2122/97
caccgaugcugacgaugcggu

SEQ ID NO: 3042123 - RNA, 23 nt, Mycobacterium bovis subsp bovis AF2122/97
caccgaugcugacgaugcggucg

SEQ ID NO: 3042124 - RNA, 17 nt, Mycobacterium bovis subsp bovis AF2122/97
caccgauggcgcaccgg

SEQ ID NO: 3042125 - RNA, 17 nt, Mycobacterium bovis subsp bovis AF2122/97
caccgauggcgcgcuca

SEQ ID NO: 3042126 - RNA, 17 nt, Mycobacterium bovis subsp bovis AF2122/97
caccgauucggccagcg

SEQ ID NO: 3042127 - RNA, 20 nt, Mycobacterium bovis subsp bovis AF2122/97
caccgauucggccagcgccc

SEQ ID NO: 3042128 - RNA, 15 nt, Mycobacterium bovis subsp bovis AF2122/97
caccgauucggcgac

SEQ ID NO: 3042129 - RNA, 16 nt, Mycobacterium bovis subsp bovis AF2122/97
caccgauucggcgacg

SEQ ID NO: 3042130 - RNA, 18 nt, Mycobacterium bovis subsp bovis AF2122/97
caccgauucggcgacgaa

SEQ ID NO: 3042131 - RNA, 19 nt, Mycobacterium bovis subsp bovis AF2122/97
caccgauucggcgacgaac

SEQ ID NO: 3042132 - RNA, 15 nt, Mycobacterium bovis subsp bovis AF2122/97
caccgcaaccaaagc

SEQ ID NO: 3042133 - RNA, 15 nt, Mycobacterium bovis subsp bovis AF2122/97
caccgcaaccacgcc

SEQ ID NO: 3042134 - RNA, 21 nt, Mycobacterium bovis subsp bovis AF2122/97
caccgcaaccacgccccgauc

SEQ ID NO: 3042135 - RNA, 15 nt, Mycobacterium bovis subsp bovis AF2122/97
caccgcaacgcgugc

SEQ ID NO: 3042136 - RNA, 19 nt, Mycobacterium bovis subsp bovis AF2122/97
caccgcaacgcgugcgcau

SEQ ID NO: 3042137 - RNA, 19 nt, Mycobacterium bovis subsp bovis AF2122/97
caccgcaacgcuucggcag

SEQ ID NO: 3042138 - RNA, 20 nt, Mycobacterium bovis subsp bovis AF2122/97
caccgcaacgcuucggcagc

SEQ ID NO: 3042139 - RNA, 18 nt, Mycobacterium bovis subsp bovis AF2122/97
caccgcaagaaucagcag

SEQ ID NO: 3042140 - RNA, 22 nt, Mycobacterium bovis subsp bovis AF2122/97
caccgcaagaaucagcagcagc

SEQ ID NO: 3042141 - RNA, 13 nt, Mycobacterium bovis subsp bovis AF2122/97
caccgcaccggca

SEQ ID NO: 3042142 - RNA, 18 nt, Mycobacterium bovis subsp bovis AF2122/97
caccgcaccugggcggcg

SEQ ID NO: 3042143 - RNA, 16 nt, Mycobacterium bovis subsp bovis AF2122/97
caccgcacgcacgcca

SEQ ID NO: 3042144 - RNA, 14 nt, Mycobacterium bovis subsp bovis AF2122/97
caccgcacgcuggc

SEQ ID NO: 3042145 - RNA, 23 nt, Mycobacterium bovis subsp bovis AF2122/97
caccgcacggaggcggaccaggc

SEQ ID NO: 3042146 - RNA, 17 nt, Mycobacterium bovis subsp bovis AF2122/97
caccgcacguucggcgu

SEQ ID NO: 3042147 - RNA, 18 nt, Mycobacterium bovis subsp bovis AF2122/97
caccgcagacgccgucug

SEQ ID NO: 3042148 - RNA, 18 nt, Mycobacterium bovis subsp bovis AF2122/97
caccgcagauccccgcca

SEQ ID NO: 3042149 - RNA, 20 nt, Mycobacterium bovis subsp bovis AF2122/97
caccgcagauccccgccacc

SEQ ID NO: 3042150 - RNA, 23 nt, Mycobacterium bovis subsp bovis AF2122/97
caccgcagauccccgccaccgaa

SEQ ID NO: 3042151 - RNA, 22 nt, Mycobacterium bovis subsp bovis AF2122/97
caccgcagccaacgucaccaag

SEQ ID NO: 3042152 - RNA, 14 nt, Mycobacterium bovis subsp bovis AF2122/97
caccgcagcgacca

SEQ ID NO: 3042153 - RNA, 16 nt, Mycobacterium bovis subsp bovis AF2122/97
caccgcagcgaccacc

SEQ ID NO: 3042154 - RNA, 20 nt, Mycobacterium bovis subsp bovis AF2122/97
caccgcauaacgccaguccc

SEQ ID NO: 3042155 - RNA, 23 nt, Mycobacterium bovis subsp bovis AF2122/97
caccgcaucgggcuugcgcagca

SEQ ID NO: 3042156 - RNA, 21 nt, Mycobacterium bovis subsp bovis AF2122/97
caccgcauucguggagccggc

SEQ ID NO: 3042157 - RNA, 20 nt, Mycobacterium bovis subsp bovis AF2122/97
caccgcauuguugaagaaag

SEQ ID NO: 3042158 - RNA, 13 nt, Mycobacterium bovis subsp bovis AF2122/97
caccgccaccacc

SEQ ID NO: 3042159 - RNA, 18 nt, Mycobacterium bovis subsp bovis AF2122/97
caccgccagauaggcacc

SEQ ID NO: 3042160 - RNA, 12 nt, Mycobacterium bovis subsp bovis AF2122/97
caccgccagcca

SEQ ID NO: 3042161 - RNA, 15 nt, Mycobacterium bovis subsp bovis AF2122/97
caccgccagccccgc

SEQ ID NO: 3042162 - RNA, 14 nt, Mycobacterium bovis subsp bovis AF2122/97
caccgccagcggca

SEQ ID NO: 3042163 - RNA, 14 nt, Mycobacterium bovis subsp bovis AF2122/97
caccgccaggucga

SEQ ID NO: 3042164 - RNA, 16 nt, Mycobacterium bovis subsp bovis AF2122/97
caccgccaggucgagg

SEQ ID NO: 3042165 - RNA, 12 nt, Mycobacterium bovis subsp bovis AF2122/97
caccgcccccgu

SEQ ID NO: 3042166 - RNA, 20 nt, Mycobacterium bovis subsp bovis AF2122/97
caccgcccccgucggccuug

SEQ ID NO: 3042167 - RNA, 13 nt, Mycobacterium bovis subsp bovis AF2122/97
caccgccccgccg

SEQ ID NO: 3042168 - RNA, 16 nt, Mycobacterium bovis subsp bovis AF2122/97
caccgccccgcgccca

SEQ ID NO: 3042169 - RNA, 22 nt, Mycobacterium bovis subsp bovis AF2122/97
caccgccccggcggcggcggcc

SEQ ID NO: 3042170 - RNA, 12 nt, Mycobacterium bovis subsp bovis AF2122/97
caccgcccgacc

SEQ ID NO: 3042171 - RNA, 13 nt, Mycobacterium bovis subsp bovis AF2122/97
caccgcccgcacg

SEQ ID NO: 3042172 - RNA, 15 nt, Mycobacterium bovis subsp bovis AF2122/97
caccgcccgccgaac

SEQ ID NO: 3042173 - RNA, 16 nt, Mycobacterium bovis subsp bovis AF2122/97
caccgcccgccgaacg

SEQ ID NO: 3042174 - RNA, 12 nt, Mycobacterium bovis subsp bovis AF2122/97
caccgcccggcc

SEQ ID NO: 3042175 - RNA, 15 nt, Mycobacterium bovis subsp bovis AF2122/97
caccgcccggcccgg

SEQ ID NO: 3042176 - RNA, 15 nt, Mycobacterium bovis subsp bovis AF2122/97
caccgcccuugccgc

SEQ ID NO: 3042177 - RNA, 23 nt, Mycobacterium bovis subsp bovis AF2122/97
caccgcccuugccgccggccccg

SEQ ID NO: 3042178 - RNA, 21 nt, Mycobacterium bovis subsp bovis AF2122/97
caccgccgacaggccggccac

SEQ ID NO: 3042179 - RNA, 22 nt, Mycobacterium bovis subsp bovis AF2122/97
caccgccgacaggccggccacc

SEQ ID NO: 3042180 - RNA, 12 nt, Mycobacterium bovis subsp bovis AF2122/97
caccgccgacau

SEQ ID NO: 3042181 - RNA, 20 nt, Mycobacterium bovis subsp bovis AF2122/97
caccgccgacauggcggugc

SEQ ID NO: 3042182 - RNA, 13 nt, Mycobacterium bovis subsp bovis AF2122/97
caccgccgacccu

SEQ ID NO: 3042183 - RNA, 16 nt, Mycobacterium bovis subsp bovis AF2122/97
caccgccgacgcccga

SEQ ID NO: 3042184 - RNA, 13 nt, Mycobacterium bovis subsp bovis AF2122/97
caccgccgcacgc

SEQ ID NO: 3042185 - RNA, 20 nt, Mycobacterium bovis subsp bovis AF2122/97
caccgccgccaagcucggcc

SEQ ID NO: 3042186 - RNA, 15 nt, Mycobacterium bovis subsp bovis AF2122/97
caccgccgcccccgc

SEQ ID NO: 3042187 - RNA, 17 nt, Mycobacterium bovis subsp bovis AF2122/97
caccgccgcccccgccg

SEQ ID NO: 3042188 - RNA, 21 nt, Mycobacterium bovis subsp bovis AF2122/97
caccgccgcccccgccggccg

SEQ ID NO: 3042189 - RNA, 17 nt, Mycobacterium bovis subsp bovis AF2122/97
caccgccgccgccaccg

SEQ ID NO: 3042190 - RNA, 19 nt, Mycobacterium bovis subsp bovis AF2122/97
caccgccgccgccaccggc

SEQ ID NO: 3042191 - RNA, 14 nt, Mycobacterium bovis subsp bovis AF2122/97
caccgccgccgccc

SEQ ID NO: 3042192 - RNA, 11 nt, Mycobacterium bovis subsp bovis AF2122/97
caccgcgccgu

SEQ ID NO: 3042193 - RNA, 13 nt, Mycobacterium bovis subsp bovis AF2122/97
caccgcgccgucg

SEQ ID NO: 3042194 - RNA, 17 nt, Mycobacterium bovis subsp bovis AF2122/97
caccgcgccgucgucgc

SEQ ID NO: 3042195 - RNA, 20 nt, Mycobacterium bovis subsp bovis AF2122/97
caccgcgccguggacgauca

SEQ ID NO: 3042196 - RNA, 12 nt, Mycobacterium bovis subsp bovis AF2122/97
caccgcgcggcg

SEQ ID NO: 3042197 - RNA, 16 nt, Mycobacterium bovis subsp bovis AF2122/97
caccgcgcggcgcagc

SEQ ID NO: 3042198 - RNA, 22 nt, Mycobacterium bovis subsp bovis AF2122/97
caccgcgcggcgcagcaccguc

SEQ ID NO: 3042199 - RNA, 18 nt, Mycobacterium bovis subsp bovis AF2122/97
caccgcgcuggucagccg

SEQ ID NO: 3042200 - RNA, 17 nt, Mycobacterium bovis subsp bovis AF2122/97
caccgcggaaggccagc

SEQ ID NO: 3042201 - RNA, 18 nt, Mycobacterium bovis subsp bovis AF2122/97
caccgcggaaggccagcu

SEQ ID NO: 3042202 - RNA, 14 nt, Mycobacterium bovis subsp bovis AF2122/97
caccgcggacccgc

SEQ ID NO: 3042203 - RNA, 15 nt, Mycobacterium bovis subsp bovis AF2122/97
caccgcggacccgca

SEQ ID NO: 3042204 - RNA, 22 nt, Mycobacterium bovis subsp bovis AF2122/97
caccgcggagauaccggacccc

SEQ ID NO: 3042205 - RNA, 21 nt, Mycobacterium bovis subsp bovis AF2122/97
caccgcggauaggccgcgcgg

SEQ ID NO: 3042206 - RNA, 22 nt, Mycobacterium bovis subsp bovis AF2122/97
caccgcggauaggccgcgcggc

SEQ ID NO: 3042207 - RNA, 19 nt, Mycobacterium bovis subsp bovis AF2122/97
caccgcggaucgacuucga

SEQ ID NO: 3042208 - RNA, 12 nt, Mycobacterium bovis subsp bovis AF2122/97
caccgcggcaag

SEQ ID NO: 3042209 - RNA, 21 nt, Mycobacterium bovis subsp bovis AF2122/97
caccgcggcaugugacaucgg

SEQ ID NO: 3042210 - RNA, 12 nt, Mycobacterium bovis subsp bovis AF2122/97
caccgcggccga

SEQ ID NO: 3042211 - RNA, 16 nt, Mycobacterium bovis subsp bovis AF2122/97
caccgcggccgcggac

SEQ ID NO: 3042212 - RNA, 17 nt, Mycobacterium bovis subsp bovis AF2122/97
caccgcggccgcggucg

SEQ ID NO: 3042213 - RNA, 12 nt, Mycobacterium bovis subsp bovis AF2122/97
caccgcggcgau

SEQ ID NO: 3042214 - RNA, 21 nt, Mycobacterium bovis subsp bovis AF2122/97
caccgcggcgauuacggccag

SEQ ID NO: 3042215 - RNA, 19 nt, Mycobacterium bovis subsp bovis AF2122/97
caccgcggcgcugaugccg

SEQ ID NO: 3042216 - RNA, 12 nt, Mycobacterium bovis subsp bovis AF2122/97
caccgcggcggc

SEQ ID NO: 3042217 - RNA, 14 nt, Mycobacterium bovis subsp bovis AF2122/97
caccgcggcggcgc

SEQ ID NO: 3042218 - RNA, 16 nt, Mycobacterium bovis subsp bovis AF2122/97
caccgcggcggcggcc

SEQ ID NO: 3042219 - RNA, 17 nt, Mycobacterium bovis subsp bovis AF2122/97
caccgcggcggcggcca

SEQ ID NO: 3042220 - RNA, 18 nt, Mycobacterium bovis subsp bovis AF2122/97
caccgcggcggcggccau

SEQ ID NO: 3042221 - RNA, 23 nt, Mycobacterium bovis subsp bovis AF2122/97
caccgcggcugcuccgucgccga

SEQ ID NO: 3042222 - RNA, 21 nt, Mycobacterium bovis subsp bovis AF2122/97
caccgcgggaucgguggcggc

SEQ ID NO: 3042223 - RNA, 13 nt, Mycobacterium bovis subsp bovis AF2122/97
caccgcgggcagu

SEQ ID NO: 3042224 - RNA, 16 nt, Mycobacterium bovis subsp bovis AF2122/97
caccgcgguacgccgg

SEQ ID NO: 3042225 - RNA, 19 nt, Mycobacterium bovis subsp bovis AF2122/97
caccgcgguacgccggucg

SEQ ID NO: 3042226 - RNA, 15 nt, Mycobacterium bovis subsp bovis AF2122/97
caccgcggucaccga

SEQ ID NO: 3042227 - RNA, 16 nt, Mycobacterium bovis subsp bovis AF2122/97
caccgcgguggcggcg

SEQ ID NO: 3042228 - RNA, 22 nt, Mycobacterium bovis subsp bovis AF2122/97
caccgcggugugcgugucaccc

SEQ ID NO: 3042229 - RNA, 22 nt, Mycobacterium bovis subsp bovis AF2122/97
caccgcguaauucgacuucggg

SEQ ID NO: 3042230 - RNA, 16 nt, Mycobacterium bovis subsp bovis AF2122/97
caccgcguaguccagg

SEQ ID NO: 3042231 - RNA, 19 nt, Mycobacterium bovis subsp bovis AF2122/97
caccgcguaguccaggccg

SEQ ID NO: 3042232 - RNA, 20 nt, Mycobacterium bovis subsp bovis AF2122/97
caccgcguaguccaggccgu

SEQ ID NO: 3042233 - RNA, 12 nt, Mycobacterium bovis subsp bovis AF2122/97
caccgcgucacc

SEQ ID NO: 3042234 - RNA, 22 nt, Mycobacterium bovis subsp bovis AF2122/97
caccgcgucaccggaggccgcc

SEQ ID NO: 3042235 - RNA, 13 nt, Mycobacterium bovis subsp bovis AF2122/97
caccgcguccagg

SEQ ID NO: 3042236 - RNA, 20 nt, Mycobacterium bovis subsp bovis AF2122/97
caccgcguccaggugcgccg

SEQ ID NO: 3042237 - RNA, 21 nt, Mycobacterium bovis subsp bovis AF2122/97
caccgcguccaggugcgccgu

SEQ ID NO: 3042238 - RNA, 18 nt, Mycobacterium bovis subsp bovis AF2122/97
caccgcgucguagccacg

SEQ ID NO: 3042239 - RNA, 20 nt, Mycobacterium bovis subsp bovis AF2122/97
caccgcgucguagccacgca

SEQ ID NO: 3042240 - RNA, 17 nt, Mycobacterium bovis subsp bovis AF2122/97
caccgcguucugguugu

SEQ ID NO: 3042241 - RNA, 20 nt, Mycobacterium bovis subsp bovis AF2122/97
caccgcguugaugaccaggu

SEQ ID NO: 3042242 - RNA, 20 nt, Mycobacterium bovis subsp bovis AF2122/97
caccgcguugaugaccgccg

SEQ ID NO: 3042243 - RNA, 22 nt, Mycobacterium bovis subsp bovis AF2122/97
caccgcguugaugaccgccgcc

SEQ ID NO: 3042244 - RNA, 14 nt, Mycobacterium bovis subsp bovis AF2122/97
caccgcguuggcca

SEQ ID NO: 3042245 - RNA, 16 nt, Mycobacterium bovis subsp bovis AF2122/97
caccgcguuggccaca

SEQ ID NO: 3042246 - RNA, 17 nt, Mycobacterium bovis subsp bovis AF2122/97
caccgcguuggccacac

SEQ ID NO: 3042247 - RNA, 16 nt, Mycobacterium bovis subsp bovis AF2122/97
caccgcguuucgcgac

SEQ ID NO: 3042248 - RNA, 23 nt, Mycobacterium bovis subsp bovis AF2122/97
caccgcguuucgcgacgucugcc

SEQ ID NO: 3042249 - RNA, 20 nt, Mycobacterium bovis subsp bovis AF2122/97
caccgcuacgaccaauagca

SEQ ID NO: 3042250 - RNA, 15 nt, Mycobacterium bovis subsp bovis AF2122/97
caccgcucgguccag

SEQ ID NO: 3042251 - RNA, 16 nt, Mycobacterium bovis subsp bovis AF2122/97
caccgcucgguccagc

SEQ ID NO: 3042252 - RNA, 19 nt, Mycobacterium bovis subsp bovis AF2122/97
caccgcucgguccagccgg

SEQ ID NO: 3042253 - RNA, 23 nt, Mycobacterium bovis subsp bovis AF2122/97
caccgcucgucguccggccacgg

SEQ ID NO: 3042254 - RNA, 17 nt, Mycobacterium bovis subsp bovis AF2122/97
caccgcugaccccggca

SEQ ID NO: 3042255 - RNA, 19 nt, Mycobacterium bovis subsp bovis AF2122/97
caccgcugccgcugccgaa

SEQ ID NO: 3042256 - RNA, 13 nt, Mycobacterium bovis subsp bovis AF2122/97
caccgcugccggc

SEQ ID NO: 3042257 - RNA, 21 nt, Mycobacterium bovis subsp bovis AF2122/97
caccgcugccggcacgcaugc

SEQ ID NO: 3042258 - RNA, 15 nt, Mycobacterium bovis subsp bovis AF2122/97
caccgcugccggcag

SEQ ID NO: 3042259 - RNA, 13 nt, Mycobacterium bovis subsp bovis AF2122/97
caccgcugcggca

SEQ ID NO: 3042260 - RNA, 16 nt, Mycobacterium bovis subsp bovis AF2122/97
caccgcugcggcacca

SEQ ID NO: 3042261 - RNA, 18 nt, Mycobacterium bovis subsp bovis AF2122/97
caccgcugcggcaccacc

SEQ ID NO: 3042262 - RNA, 21 nt, Mycobacterium bovis subsp bovis AF2122/97
caccgcugucagccgaccgac

SEQ ID NO: 3042263 - RNA, 21 nt, Mycobacterium bovis subsp bovis AF2122/97
caccgcuguugcaucgccgcg

SEQ ID NO: 3042264 - RNA, 15 nt, Mycobacterium bovis subsp bovis AF2122/97
caccgcuucaggcgc

SEQ ID NO: 3042265 - RNA, 19 nt, Mycobacterium bovis subsp bovis AF2122/97
caccgcuucaggcgccacu

SEQ ID NO: 3042266 - RNA, 21 nt, Mycobacterium bovis subsp bovis AF2122/97
caccgcuucaggcgccacugc

SEQ ID NO: 3042267 - RNA, 17 nt, Mycobacterium bovis subsp bovis AF2122/97
caccgcuugaccccugg

SEQ ID NO: 3042268 - RNA, 22 nt, Mycobacterium bovis subsp bovis AF2122/97
caccgcuugaccccuggccgcc

SEQ ID NO: 3042269 - RNA, 14 nt, Mycobacterium bovis subsp bovis AF2122/97
caccgcuugcuggc

SEQ ID NO: 3042270 - RNA, 22 nt, Mycobacterium bovis subsp bovis AF2122/97
caccggaaccaccaguaccacc

SEQ ID NO: 3042271 - RNA, 20 nt, Mycobacterium bovis subsp bovis AF2122/97
caccggaacccccagcugca

SEQ ID NO: 3042272 - RNA, 21 nt, Mycobacterium bovis subsp bovis AF2122/97
caccggaacccccagcugcag

SEQ ID NO: 3042273 - RNA, 16 nt, Mycobacterium bovis subsp bovis AF2122/97
caccggaacgccgucg

SEQ ID NO: 3042274 - RNA, 20 nt, Mycobacterium bovis subsp bovis AF2122/97
caccggaauacgcgccgccg

SEQ ID NO: 3042275 - RNA, 21 nt, Mycobacterium bovis subsp bovis AF2122/97
caccggaauacgcgccgccgg

SEQ ID NO: 3042276 - RNA, 23 nt, Mycobacterium bovis subsp bovis AF2122/97
caccggaauccccccugucgccg

SEQ ID NO: 3042277 - RNA, 19 nt, Mycobacterium bovis subsp bovis AF2122/97
caccggaauccuggccgcc

SEQ ID NO: 3042278 - RNA, 16 nt, Mycobacterium bovis subsp bovis AF2122/97
caccggcgcgaccgcg

SEQ ID NO: 3042279 - RNA, 17 nt, Mycobacterium bovis subsp bovis AF2122/97
caccggcgcgaccgcgg

SEQ ID NO: 3042280 - RNA, 24 nt, Mycobacterium bovis subsp bovis AF2122/97
caccggcgcgggcacgcccucguc

SEQ ID NO: 3042281 - RNA, 14 nt, Mycobacterium bovis subsp bovis AF2122/97
caccggcggcaucg

SEQ ID NO: 3042282 - RNA, 15 nt, Mycobacterium bovis subsp bovis AF2122/97
caccggcggcaucga

SEQ ID NO: 3042283 - RNA, 15 nt, Mycobacterium bovis subsp bovis AF2122/97
caccggcggcgacgg

SEQ ID NO: 3042284 - RNA, 19 nt, Mycobacterium bovis subsp bovis AF2122/97
caccggcggucugcagugc

SEQ ID NO: 3042285 - RNA, 22 nt, Mycobacterium bovis subsp bovis AF2122/97
caccggcggucugcagugcagc

SEQ ID NO: 3042286 - RNA, 20 nt, Mycobacterium bovis subsp bovis AF2122/97
caccggcggugccgguggug

SEQ ID NO: 3042287 - RNA, 14 nt, Mycobacterium bovis subsp bovis AF2122/97
caccggcgucgaag

SEQ ID NO: 3042288 - RNA, 13 nt, Mycobacterium bovis subsp bovis AF2122/97
caccggcgucgac

SEQ ID NO: 3042289 - RNA, 15 nt, Mycobacterium bovis subsp bovis AF2122/97
caccggcgucgacgu

SEQ ID NO: 3042290 - RNA, 16 nt, Mycobacterium bovis subsp bovis AF2122/97
caccggcgucgacguc

SEQ ID NO: 3042291 - RNA, 18 nt, Mycobacterium bovis subsp bovis AF2122/97
caccggcgucgcugccuu

SEQ ID NO: 3042292 - RNA, 14 nt, Mycobacterium bovis subsp bovis AF2122/97
caccggcgucugcc

SEQ ID NO: 3042293 - RNA, 21 nt, Mycobacterium bovis subsp bovis AF2122/97
caccggcuauaucccgccccg

SEQ ID NO: 3042294 - RNA, 17 nt, Mycobacterium bovis subsp bovis AF2122/97
caccggcuaugcuggcg

SEQ ID NO: 3042295 - RNA, 20 nt, Mycobacterium bovis subsp bovis AF2122/97
caccggcuaugcuggcgcag

SEQ ID NO: 3042296 - RNA, 21 nt, Mycobacterium bovis subsp bovis AF2122/97
caccggcuaugcuggcgcagc

SEQ ID NO: 3042297 - RNA, 17 nt, Mycobacterium bovis subsp bovis AF2122/97
caccggcugaccgaccc

SEQ ID NO: 3042298 - RNA, 21 nt, Mycobacterium bovis subsp bovis AF2122/97
caccggcugaccgacccggac

SEQ ID NO: 3042299 - RNA, 21 nt, Mycobacterium bovis subsp bovis AF2122/97
caccggcugauucgagccaca

SEQ ID NO: 3042300 - RNA, 14 nt, Mycobacterium bovis subsp bovis AF2122/97
caccggcugcaacc

SEQ ID NO: 3042301 - RNA, 15 nt, Mycobacterium bovis subsp bovis AF2122/97
caccggcugcaacca

SEQ ID NO: 3042302 - RNA, 16 nt, Mycobacterium bovis subsp bovis AF2122/97
caccggcuggugccaa

SEQ ID NO: 3042303 - RNA, 19 nt, Mycobacterium bovis subsp bovis AF2122/97
caccggcuggugccaacug

SEQ ID NO: 3042304 - RNA, 19 nt, Mycobacterium bovis subsp bovis AF2122/97
caccggcugguucaacacc

SEQ ID NO: 3042305 - RNA, 23 nt, Mycobacterium bovis subsp bovis AF2122/97
caccggcugguucaacaccggua

SEQ ID NO: 3042306 - RNA, 16 nt, Mycobacterium bovis subsp bovis AF2122/97
caccggcuucggccag

SEQ ID NO: 3042307 - RNA, 17 nt, Mycobacterium bovis subsp bovis AF2122/97
caccggcuucggccagc

SEQ ID NO: 3042308 - RNA, 19 nt, Mycobacterium bovis subsp bovis AF2122/97
caccggcuucggccagcag

SEQ ID NO: 3042309 - RNA, 17 nt, Mycobacterium bovis subsp bovis AF2122/97
caccggcuucuccucca

SEQ ID NO: 3042310 - RNA, 20 nt, Mycobacterium bovis subsp bovis AF2122/97
caccggcuucuccuccagag

SEQ ID NO: 3042311 - RNA, 17 nt, Mycobacterium bovis subsp bovis AF2122/97
caccggcuugggccagg

SEQ ID NO: 3042312 - RNA, 23 nt, Mycobacterium bovis subsp bovis AF2122/97
caccggcuugggccaggcccagc

SEQ ID NO: 3042313 - RNA, 16 nt, Mycobacterium bovis subsp bovis AF2122/97
caccggcuuggugaac

SEQ ID NO: 3042314 - RNA, 23 nt, Mycobacterium bovis subsp bovis AF2122/97
caccggcuuggugaaccgcgcgg

SEQ ID NO: 3042315 - RNA, 19 nt, Mycobacterium bovis subsp bovis AF2122/97
caccgggaagucggggucg

SEQ ID NO: 3042316 - RNA, 18 nt, Mycobacterium bovis subsp bovis AF2122/97
caccgggauagccgcgac

SEQ ID NO: 3042317 - RNA, 17 nt, Mycobacterium bovis subsp bovis AF2122/97
caccgggauggcucacc

SEQ ID NO: 3042318 - RNA, 19 nt, Mycobacterium bovis subsp bovis AF2122/97
caccgggauggcucaccca

SEQ ID NO: 3042319 - RNA, 18 nt, Mycobacterium bovis subsp bovis AF2122/97
caccgggaugugcggcug

SEQ ID NO: 3042320 - RNA, 15 nt, Mycobacterium bovis subsp bovis AF2122/97
caccgggcaccaguc

SEQ ID NO: 3042321 - RNA, 20 nt, Mycobacterium bovis subsp bovis AF2122/97
caccgggcaccagucgcccc

SEQ ID NO: 3042322 - RNA, 17 nt, Mycobacterium bovis subsp bovis AF2122/97
caccgggcccgacgacg

SEQ ID NO: 3042323 - RNA, 14 nt, Mycobacterium bovis subsp bovis AF2122/97
caccgggcccgccg

SEQ ID NO: 3042324 - RNA, 15 nt, Mycobacterium bovis subsp bovis AF2122/97
caccgggcccgccgg

SEQ ID NO: 3042325 - RNA, 23 nt, Mycobacterium bovis subsp bovis AF2122/97
caccgggcccgccggccccgccg

SEQ ID NO: 3042326 - RNA, 13 nt, Mycobacterium bovis subsp bovis AF2122/97
caccgggcgcugc

SEQ ID NO: 3042327 - RNA, 14 nt, Mycobacterium bovis subsp bovis AF2122/97
caccgggcgcugcu

SEQ ID NO: 3042328 - RNA, 13 nt, Mycobacterium bovis subsp bovis AF2122/97
caccgggcggcgg

SEQ ID NO: 3042329 - RNA, 14 nt, Mycobacterium bovis subsp bovis AF2122/97
caccgggcggcggc

SEQ ID NO: 3042330 - RNA, 16 nt, Mycobacterium bovis subsp bovis AF2122/97
caccgggcggcggcga

SEQ ID NO: 3042331 - RNA, 17 nt, Mycobacterium bovis subsp bovis AF2122/97
caccgggcggcggcgac

SEQ ID NO: 3042332 - RNA, 21 nt, Mycobacterium bovis subsp bovis AF2122/97
caccgggcgucgucggugauc

SEQ ID NO: 3042333 - RNA, 19 nt, Mycobacterium bovis subsp bovis AF2122/97
caccgggcgugcggcggcc

SEQ ID NO: 3042334 - RNA, 17 nt, Mycobacterium bovis subsp bovis AF2122/97
caccggggacagcccgg

SEQ ID NO: 3042335 - RNA, 19 nt, Mycobacterium bovis subsp bovis AF2122/97
caccggggacagcccggca

SEQ ID NO: 3042336 - RNA, 12 nt, Mycobacterium bovis subsp bovis AF2122/97
caccggggcaga

SEQ ID NO: 3042337 - RNA, 18 nt, Mycobacterium bovis subsp bovis AF2122/97
caccggggugugcgggcg

SEQ ID NO: 3042338 - RNA, 20 nt, Mycobacterium bovis subsp bovis AF2122/97
caccggggugugcgggcggu

SEQ ID NO: 3042339 - RNA, 23 nt, Mycobacterium bovis subsp bovis AF2122/97
caccggggugugcgggcggugca

SEQ ID NO: 3042340 - RNA, 18 nt, Mycobacterium bovis subsp bovis AF2122/97
caccgggguuacucgcag

SEQ ID NO: 3042341 - RNA, 23 nt, Mycobacterium bovis subsp bovis AF2122/97
caccgggguuacucgcagcgccg

SEQ ID NO: 3042342 - RNA, 16 nt, Mycobacterium bovis subsp bovis AF2122/97
caccggguagccggcg

SEQ ID NO: 3042343 - RNA, 16 nt, Mycobacterium bovis subsp bovis AF2122/97
caccggguccaccgca

SEQ ID NO: 3042344 - RNA, 17 nt, Mycobacterium bovis subsp bovis AF2122/97
caccggguccaccgcac

SEQ ID NO: 3042345 - RNA, 12 nt, Mycobacterium bovis subsp bovis AF2122/97
caccggguccgg

SEQ ID NO: 3042346 - RNA, 16 nt, Mycobacterium bovis subsp bovis AF2122/97
caccgggugcaccggc

SEQ ID NO: 3042347 - RNA, 14 nt, Mycobacterium bovis subsp bovis AF2122/97
caccggguucaccg

SEQ ID NO: 3042348 - RNA, 15 nt, Mycobacterium bovis subsp bovis AF2122/97
caccggguugagccg

SEQ ID NO: 3042349 - RNA, 19 nt, Mycobacterium bovis subsp bovis AF2122/97
caccggguugagccgccgc

SEQ ID NO: 3042350 - RNA, 20 nt, Mycobacterium bovis subsp bovis AF2122/97
caccggguugagccgccgcg

SEQ ID NO: 3042351 - RNA, 21 nt, Mycobacterium bovis subsp bovis AF2122/97
caccggguuggaagccgcacc

SEQ ID NO: 3042352 - RNA, 18 nt, Mycobacterium bovis subsp bovis AF2122/97
caccgguaacgccaacac

SEQ ID NO: 3042353 - RNA, 19 nt, Mycobacterium bovis subsp bovis AF2122/97
caccgguaacgccaacacc

SEQ ID NO: 3042354 - RNA, 23 nt, Mycobacterium bovis subsp bovis AF2122/97
caccgguaacgccaacaccggca

SEQ ID NO: 3042355 - RNA, 16 nt, Mycobacterium bovis subsp bovis AF2122/97
caccgguaacgcgaca

SEQ ID NO: 3042356 - RNA, 12 nt, Mycobacterium bovis subsp bovis AF2122/97
caccgguaccga

SEQ ID NO: 3042357 - RNA, 13 nt, Mycobacterium bovis subsp bovis AF2122/97
caccgguaccgau

SEQ ID NO: 3042358 - RNA, 15 nt, Mycobacterium bovis subsp bovis AF2122/97
caccgguaccgccac

SEQ ID NO: 3042359 - RNA, 17 nt, Mycobacterium bovis subsp bovis AF2122/97
caccgguaccgccacuu

SEQ ID NO: 3042360 - RNA, 17 nt, Mycobacterium bovis subsp bovis AF2122/97
caccgguaccggcgacg

SEQ ID NO: 3042361 - RNA, 16 nt, Mycobacterium bovis subsp bovis AF2122/97
caccgguacgcaacca

SEQ ID NO: 3042362 - RNA, 23 nt, Mycobacterium bovis subsp bovis AF2122/97
caccgguauguucggcaaugacg

SEQ ID NO: 3042363 - RNA, 13 nt, Mycobacterium bovis subsp bovis AF2122/97
caccggucaccgc

SEQ ID NO: 3042364 - RNA, 18 nt, Mycobacterium bovis subsp bovis AF2122/97
caccgucguacucggcgg

SEQ ID NO: 3042365 - RNA, 19 nt, Mycobacterium bovis subsp bovis AF2122/97
caccgucguacucggcggc

SEQ ID NO: 3042366 - RNA, 20 nt, Mycobacterium bovis subsp bovis AF2122/97
caccgucguacucggcggcc

SEQ ID NO: 3042367 - RNA, 22 nt, Mycobacterium bovis subsp bovis AF2122/97
caccgucgucguuucgccagcc

SEQ ID NO: 3042368 - RNA, 23 nt, Mycobacterium bovis subsp bovis AF2122/97
caccgucgucguuucgccagccg

SEQ ID NO: 3042369 - RNA, 22 nt, Mycobacterium bovis subsp bovis AF2122/97
caccgucguuaagacggcgacg

SEQ ID NO: 3042370 - RNA, 16 nt, Mycobacterium bovis subsp bovis AF2122/97
caccgucuccggcgcc

SEQ ID NO: 3042371 - RNA, 17 nt, Mycobacterium bovis subsp bovis AF2122/97
caccgucuccggcgcca

SEQ ID NO: 3042372 - RNA, 20 nt, Mycobacterium bovis subsp bovis AF2122/97
caccgucuccggcgccaccg

SEQ ID NO: 3042373 - RNA, 17 nt, Mycobacterium bovis subsp bovis AF2122/97
caccgucucgcaccgcg

SEQ ID NO: 3042374 - RNA, 17 nt, Mycobacterium bovis subsp bovis AF2122/97
caccgucucgccgcgca

SEQ ID NO: 3042375 - RNA, 17 nt, Mycobacterium bovis subsp bovis AF2122/97
caccgucugcaccggca

SEQ ID NO: 3042376 - RNA, 16 nt, Mycobacterium bovis subsp bovis AF2122/97
caccgucugcggaccg

SEQ ID NO: 3042377 - RNA, 18 nt, Mycobacterium bovis subsp bovis AF2122/97
caccgucugcggaccggc

SEQ ID NO: 3042378 - RNA, 14 nt, Mycobacterium bovis subsp bovis AF2122/97
caccgucugcuggc

SEQ ID NO: 3042379 - RNA, 16 nt, Mycobacterium bovis subsp bovis AF2122/97
caccgugaaccgcccg

SEQ ID NO: 3042380 - RNA, 17 nt, Mycobacterium bovis subsp bovis AF2122/97
caccgugaaccgcccgc

SEQ ID NO: 3042381 - RNA, 19 nt, Mycobacterium bovis subsp bovis AF2122/97
caccgugaaccgcccgccc

SEQ ID NO: 3042382 - RNA, 22 nt, Mycobacterium bovis subsp bovis AF2122/97
caccgugaagcccuggccagcg

SEQ ID NO: 3042383 - RNA, 15 nt, Mycobacterium bovis subsp bovis AF2122/97
caccgugaccgccgc

SEQ ID NO: 3042384 - RNA, 16 nt, Mycobacterium bovis subsp bovis AF2122/97
caccgugaccgccgcg

SEQ ID NO: 3042385 - RNA, 17 nt, Mycobacterium bovis subsp bovis AF2122/97
caccgugaccgccgcgc

SEQ ID NO: 3042386 - RNA, 18 nt, Mycobacterium bovis subsp bovis AF2122/97
caccgugaccgccgcgcc

SEQ ID NO: 3042387 - RNA, 19 nt, Mycobacterium bovis subsp bovis AF2122/97
caccgugaccgccgcgccg

SEQ ID NO: 3042388 - RNA, 14 nt, Mycobacterium bovis subsp bovis AF2122/97
caccgugcaccagc

SEQ ID NO: 3042389 - RNA, 21 nt, Mycobacterium bovis subsp bovis AF2122/97
caccgugccgacgccccgauc

SEQ ID NO: 3042390 - RNA, 14 nt, Mycobacterium bovis subsp bovis AF2122/97
caccgugccgggcg

SEQ ID NO: 3042391 - RNA, 15 nt, Mycobacterium bovis subsp bovis AF2122/97
caccgugccgggcga

SEQ ID NO: 3042392 - RNA, 19 nt, Mycobacterium bovis subsp bovis AF2122/97
caccgugccgggcgacggu

SEQ ID NO: 3042393 - RNA, 13 nt, Mycobacterium bovis subsp bovis AF2122/97
caccgugcgccga

SEQ ID NO: 3042394 - RNA, 19 nt, Mycobacterium bovis subsp bovis AF2122/97
caccgugcggaucgcgcug

SEQ ID NO: 3042395 - RNA, 21 nt, Mycobacterium bovis subsp bovis AF2122/97
caccgugcggggggcagcucc

SEQ ID NO: 3042396 - RNA, 13 nt, Mycobacterium bovis subsp bovis AF2122/97
caccgugcggucg

SEQ ID NO: 3042397 - RNA, 14 nt, Mycobacterium bovis subsp bovis AF2122/97
caccguggaucggc

SEQ ID NO: 3042398 - RNA, 16 nt, Mycobacterium bovis subsp bovis AF2122/97
caccguggaucggcag

SEQ ID NO: 3042399 - RNA, 13 nt, Mycobacterium bovis subsp bovis AF2122/97
caccguggccucg

SEQ ID NO: 3042400 - RNA, 13 nt, Mycobacterium bovis subsp bovis AF2122/97
caccguggcgccc

SEQ ID NO: 3042401 - RNA, 20 nt, Mycobacterium bovis subsp bovis AF2122/97
caccgugggcccuucacugu

SEQ ID NO: 3042402 - RNA, 23 nt, Mycobacterium bovis subsp bovis AF2122/97
caccgugggccugcccggcgccg

SEQ ID NO: 3042403 - RNA, 19 nt, Mycobacterium bovis subsp bovis AF2122/97
caccgugggguaucgccag

SEQ ID NO: 3042404 - RNA, 13 nt, Mycobacterium bovis subsp bovis AF2122/97
caccgugguggac

SEQ ID NO: 3042405 - RNA, 23 nt, Mycobacterium bovis subsp bovis AF2122/97
caccgugguggacgaccgcgcgg

SEQ ID NO: 3042406 - RNA, 14 nt, Mycobacterium bovis subsp bovis AF2122/97
caccgugguggcgu

SEQ ID NO: 3042407 - RNA, 21 nt, Mycobacterium bovis subsp bovis AF2122/97
caccgugguggcguaucgggc

SEQ ID NO: 3042408 - RNA, 19 nt, Mycobacterium bovis subsp bovis AF2122/97
caccgugucacgcgaccac

SEQ ID NO: 3042409 - RNA, 15 nt, Mycobacterium bovis subsp bovis AF2122/97
caccgugucgacggu

SEQ ID NO: 3042410 - RNA, 14 nt, Mycobacterium bovis subsp bovis AF2122/97
caccgugucgccgg

SEQ ID NO: 3042411 - RNA, 17 nt, Mycobacterium bovis subsp bovis AF2122/97
caccgugucgccggcga

SEQ ID NO: 3042412 - RNA, 18 nt, Mycobacterium bovis subsp bovis AF2122/97
caccgugucgccggcgaa

SEQ ID NO: 3042413 - RNA, 20 nt, Mycobacterium bovis subsp bovis AF2122/97
caccgugugcacgcgauggc

SEQ ID NO: 3042414 - RNA, 22 nt, Mycobacterium bovis subsp bovis AF2122/97
caccgugugggccccgccgaug

SEQ ID NO: 3042415 - RNA, 18 nt, Mycobacterium bovis subsp bovis AF2122/97
caccguguugcacgcggg

SEQ ID NO: 3042416 - RNA, 20 nt, Mycobacterium bovis subsp bovis AF2122/97
caccguguugcacgcgggug

SEQ ID NO: 3042417 - RNA, 16 nt, Mycobacterium bovis subsp bovis AF2122/97
caccguguugcugucg

SEQ ID NO: 3042418 - RNA, 16 nt, Mycobacterium bovis subsp bovis AF2122/97
caccguuaccgccguc

SEQ ID NO: 3042419 - RNA, 17 nt, Mycobacterium bovis subsp bovis AF2122/97
caccguuaccgccgucg

SEQ ID NO: 3042420 - RNA, 18 nt, Mycobacterium bovis subsp bovis AF2122/97
caccguuaccgccgucgc

SEQ ID NO: 3042421 - RNA, 15 nt, Mycobacterium bovis subsp bovis AF2122/97
caccguuagccaggu

SEQ ID NO: 3042422 - RNA, 14 nt, Mycobacterium bovis subsp bovis AF2122/97
caccguugccgaac

SEQ ID NO: 3042423 - RNA, 15 nt, Mycobacterium bovis subsp bovis AF2122/97
caccguugccgaacc

SEQ ID NO: 3042424 - RNA, 14 nt, Mycobacterium bovis subsp bovis AF2122/97
caccguugccgccg

SEQ ID NO: 3042425 - RNA, 12 nt, Mycobacterium bovis subsp bovis AF2122/97
caccguugcguu

SEQ ID NO: 3042426 - RNA, 15 nt, Mycobacterium bovis subsp bovis AF2122/97
caccguugcguuggc

SEQ ID NO: 3042427 - RNA, 17 nt, Mycobacterium bovis subsp bovis AF2122/97
caccguugcguuggcgc

SEQ ID NO: 3042428 - RNA, 19 nt, Mycobacterium bovis subsp bovis AF2122/97
caccguugcguuggcgcca

SEQ ID NO: 3042429 - RNA, 21 nt, Mycobacterium bovis subsp bovis AF2122/97
caccguugcguuggcgccacc

SEQ ID NO: 3042430 - RNA, 16 nt, Mycobacterium bovis subsp bovis AF2122/97
caccguuggccgcgcu

SEQ ID NO: 3042431 - RNA, 21 nt, Mycobacterium bovis subsp bovis AF2122/97
caccguugggccgacugggcg

SEQ ID NO: 3042432 - RNA, 19 nt, Mycobacterium bovis subsp bovis AF2122/97
caccguuugagcggccacc

SEQ ID NO: 3042433 - RNA, 19 nt, Mycobacterium bovis subsp bovis AF2122/97
caccguuugggcgccggug

SEQ ID NO: 3042434 - RNA, 21 nt, Mycobacterium bovis subsp bovis AF2122/97
caccguuugggcgccgguguu

SEQ ID NO: 3042435 - RNA, 17 nt, Mycobacterium bovis subsp bovis AF2122/97
caccuaccgagaucacc

SEQ ID NO: 3042436 - RNA, 21 nt, Mycobacterium bovis subsp bovis AF2122/97
caccuaccgagaucaccgcca

SEQ ID NO: 3042437 - RNA, 22 nt, Mycobacterium bovis subsp bovis AF2122/97
caccuaccgagaucaccgccac

SEQ ID NO: 3042438 - RNA, 20 nt, Mycobacterium bovis subsp bovis AF2122/97
caccuacgaagcguugaccg

SEQ ID NO: 3042439 - RNA, 17 nt, Mycobacterium bovis subsp bovis AF2122/97
caccuagucgcggccgu

SEQ ID NO: 3042440 - RNA, 19 nt, Mycobacterium bovis subsp bovis AF2122/97
caccuaugggaccggcaau

SEQ ID NO: 3042441 - RNA, 12 nt, Mycobacterium bovis subsp bovis AF2122/97
caccucaccagu

SEQ ID NO: 3042442 - RNA, 14 nt, Mycobacterium bovis subsp bovis AF2122/97
caccucaccgcgga

SEQ ID NO: 3042443 - RNA, 18 nt, Mycobacterium bovis subsp bovis AF2122/97
caccucagaaaguccccg

SEQ ID NO: 3042444 - RNA, 18 nt, Mycobacterium bovis subsp bovis AF2122/97
caccucagcugcggacug

SEQ ID NO: 3042445 - RNA, 21 nt, Mycobacterium bovis subsp bovis AF2122/97
caccuccaauugcgaaccggc

SEQ ID NO: 3042446 - RNA, 22 nt, Mycobacterium bovis subsp bovis AF2122/97
caccuccaauugcgaaccggcc

SEQ ID NO: 3042447 - RNA, 16 nt, Mycobacterium bovis subsp bovis AF2122/97
caccuccagcaccacc

SEQ ID NO: 3042448 - RNA, 17 nt, Mycobacterium bovis subsp bovis AF2122/97
caccuccagcaccaccg

SEQ ID NO: 3042449 - RNA, 13 nt, Mycobacterium bovis subsp bovis AF2122/97
caccucccacgcc

SEQ ID NO: 3042450 - RNA, 13 nt, Mycobacterium bovis subsp bovis AF2122/97
caccugggcggca

SEQ ID NO: 3042451 - RNA, 20 nt, Mycobacterium bovis subsp bovis AF2122/97
caccugggcugccggccaga

SEQ ID NO: 3042452 - RNA, 21 nt, Mycobacterium bovis subsp bovis AF2122/97
caccugggcugccggccagac

SEQ ID NO: 3042453 - RNA, 22 nt, Mycobacterium bovis subsp bovis AF2122/97
caccugggucgacgagauccag

SEQ ID NO: 3042454 - RNA, 16 nt, Mycobacterium bovis subsp bovis AF2122/97
caccuggucgcgucca

SEQ ID NO: 3042455 - RNA, 19 nt, Mycobacterium bovis subsp bovis AF2122/97
caccuggucgcguccaccc

SEQ ID NO: 3042456 - RNA, 22 nt, Mycobacterium bovis subsp bovis AF2122/97
caccuggucgcguccacccacg

SEQ ID NO: 3042457 - RNA, 14 nt, Mycobacterium bovis subsp bovis AF2122/97
caccuggucggccg

SEQ ID NO: 3042458 - RNA, 16 nt, Mycobacterium bovis subsp bovis AF2122/97
caccuggucggccgca

SEQ ID NO: 3042459 - RNA, 17 nt, Mycobacterium bovis subsp bovis AF2122/97
caccuggucggccgcaa

SEQ ID NO: 3042460 - RNA, 19 nt, Mycobacterium bovis subsp bovis AF2122/97
caccugguuccagaggccc

SEQ ID NO: 3042461 - RNA, 16 nt, Mycobacterium bovis subsp bovis AF2122/97
caccugguuuacccgc

SEQ ID NO: 3042462 - RNA, 14 nt, Mycobacterium bovis subsp bovis AF2122/97
caccuguucaccaa

SEQ ID NO: 3042463 - RNA, 20 nt, Mycobacterium bovis subsp bovis AF2122/97
caccuguuggcaugccgccc

SEQ ID NO: 3042464 - RNA, 16 nt, Mycobacterium bovis subsp bovis AF2122/97
caccuucggccgaccg

SEQ ID NO: 3042465 - RNA, 17 nt, Mycobacterium bovis subsp bovis AF2122/97
caccuucgucgcggccg

SEQ ID NO: 3042466 - RNA, 19 nt, Mycobacterium bovis subsp bovis AF2122/97
caccuucgucgcggccgcg

SEQ ID NO: 3042467 - RNA, 23 nt, Mycobacterium bovis subsp bovis AF2122/97
caccuucgucgcggccgcggccu

SEQ ID NO: 3042468 - RNA, 17 nt, Mycobacterium bovis subsp bovis AF2122/97
caccuucugguccagca

SEQ ID NO: 3042469 - RNA, 20 nt, Mycobacterium bovis subsp bovis AF2122/97
caccuugaccgggucgauga

SEQ ID NO: 3042470 - RNA, 19 nt, Mycobacterium bovis subsp bovis AF2122/97
caccuugccgaacacucgc

SEQ ID NO: 3042471 - RNA, 13 nt, Mycobacterium bovis subsp bovis AF2122/97
caccuugccuagc

SEQ ID NO: 3042472 - RNA, 18 nt, Mycobacterium bovis subsp bovis AF2122/97
caccuugccuagccgcag

SEQ ID NO: 3042473 - RNA, 13 nt, Mycobacterium bovis subsp bovis AF2122/97
caccuugcguccg

SEQ ID NO: 3042474 - RNA, 14 nt, Mycobacterium bovis subsp bovis AF2122/97
caccuugcuccaca

SEQ ID NO: 3042475 - RNA, 14 nt, Mycobacterium bovis subsp bovis AF2122/97
caccuuggacacca

SEQ ID NO: 3042476 - RNA, 18 nt, Mycobacterium bovis subsp bovis AF2122/97
caccuuggaugcccugcc

SEQ ID NO: 3042477 - RNA, 23 nt, Mycobacterium bovis subsp bovis AF2122/97
caccuuggccagacccaccaccg

SEQ ID NO: 3042478 - RNA, 16 nt, Mycobacterium bovis subsp bovis AF2122/97
caccuuggccggcccc

SEQ ID NO: 3042479 - RNA, 14 nt, Mycobacterium bovis subsp bovis AF2122/97
caccuuggccgggu

SEQ ID NO: 3042480 - RNA, 23 nt, Mycobacterium bovis subsp bovis AF2122/97
caccuuggcggucggcagaccga

SEQ ID NO: 3042481 - RNA, 18 nt, Mycobacterium bovis subsp bovis AF2122/97
caccuuggcugggcccgc

SEQ ID NO: 3042482 - RNA, 20 nt, Mycobacterium bovis subsp bovis AF2122/97
caccuuggcugggcccgccg

SEQ ID NO: 3042483 - RNA, 22 nt, Mycobacterium bovis subsp bovis AF2122/97
caccuuggcugggcccgccguc

SEQ ID NO: 3042484 - RNA, 20 nt, Mycobacterium bovis subsp bovis AF2122/97
caccuuguggacccgccagg

SEQ ID NO: 3042485 - RNA, 18 nt, Mycobacterium bovis subsp bovis AF2122/97
caccuuuggccgcgaccg

SEQ ID NO: 3042486 - RNA, 14 nt, Mycobacterium bovis subsp bovis AF2122/97
cacgaaacccaguc

SEQ ID NO: 3042487 - RNA, 16 nt, Mycobacterium bovis subsp bovis AF2122/97
cacgaaaucagcccgc

SEQ ID NO: 3042488 - RNA, 23 nt, Mycobacterium bovis subsp bovis AF2122/97
cacgaaaucgcccugacccggag

SEQ ID NO: 3042489 - RNA, 15 nt, Mycobacterium bovis subsp bovis AF2122/97
cacgaacccucagcc

SEQ ID NO: 3042490 - RNA, 20 nt, Mycobacterium bovis subsp bovis AF2122/97
cacgaaccgugcugggcauc

SEQ ID NO: 3042491 - RNA, 16 nt, Mycobacterium bovis subsp bovis AF2122/97
cacgaacgcgcgcagc

SEQ ID NO: 3042492 - RNA, 18 nt, Mycobacterium bovis subsp bovis AF2122/97
cacgaacucggccgggcg

SEQ ID NO: 3042493 - RNA, 20 nt, Mycobacterium bovis subsp bovis AF2122/97
cacgaacugaucgaccgccu

SEQ ID NO: 3042494 - RNA, 18 nt, Mycobacterium bovis subsp bovis AF2122/97
cacgaagaccaggccggu

SEQ ID NO: 3042495 - RNA, 17 nt, Mycobacterium bovis subsp bovis AF2122/97
cacgaagaccgcgucgg

SEQ ID NO: 3042496 - RNA, 16 nt, Mycobacterium bovis subsp bovis AF2122/97
cacgaagccggcuucg

SEQ ID NO: 3042497 - RNA, 14 nt, Mycobacterium bovis subsp bovis AF2122/97
cacgaagcuggcgu

SEQ ID NO: 3042498 - RNA, 15 nt, Mycobacterium bovis subsp bovis AF2122/97
cacgaagcuggcgug

SEQ ID NO: 3042499 - RNA, 13 nt, Mycobacterium bovis subsp bovis AF2122/97
cacgaagugaccc

SEQ ID NO: 3042500 - RNA, 17 nt, Mycobacterium bovis subsp bovis AF2122/97
cacgaagugacccgaac

SEQ ID NO: 3042501 - RNA, 14 nt, Mycobacterium bovis subsp bovis AF2122/97
cacgaauccggcca

SEQ ID NO: 3042502 - RNA, 16 nt, Mycobacterium bovis subsp bovis AF2122/97
cacgaauccggccacu

SEQ ID NO: 3042503 - RNA, 21 nt, Mycobacterium bovis subsp bovis AF2122/97
cacgacagcagaguggugauc

SEQ ID NO: 3042504 - RNA, 14 nt, Mycobacterium bovis subsp bovis AF2122/97
cacgacagccagug

SEQ ID NO: 3042505 - RNA, 15 nt, Mycobacterium bovis subsp bovis AF2122/97
cacgacaggucgccc

SEQ ID NO: 3042506 - RNA, 20 nt, Mycobacterium bovis subsp bovis AF2122/97
cacgacaucguaggccggca

SEQ ID NO: 3042507 - RNA, 18 nt, Mycobacterium bovis subsp bovis AF2122/97
cacgacaucgucgcgacg

SEQ ID NO: 3042508 - RNA, 19 nt, Mycobacterium bovis subsp bovis AF2122/97
cacgacaucgucgcgacga

SEQ ID NO: 3042509 - RNA, 18 nt, Mycobacterium bovis subsp bovis AF2122/97
cacgacaugaccgacagg

SEQ ID NO: 3042510 - RNA, 22 nt, Mycobacterium bovis subsp bovis AF2122/97
cacgaccagcugagcuggcagc

SEQ ID NO: 3042511 - RNA, 14 nt, Mycobacterium bovis subsp bovis AF2122/97
cacgacccagcaug

SEQ ID NO: 3042512 - RNA, 15 nt, Mycobacterium bovis subsp bovis AF2122/97
cacgacccagcaugg

SEQ ID NO: 3042513 - RNA, 21 nt, Mycobacterium bovis subsp bovis AF2122/97
cacgaccccggcgguaccgcc

SEQ ID NO: 3042514 - RNA, 22 nt, Mycobacterium bovis subsp bovis AF2122/97
cacgaccccggcgguaccgccg

SEQ ID NO: 3042515 - RNA, 20 nt, Mycobacterium bovis subsp bovis AF2122/97
cacgacccgcuggucgaugc

SEQ ID NO: 3042516 - RNA, 17 nt, Mycobacterium bovis subsp bovis AF2122/97
cacgaccggccaacgcc

SEQ ID NO: 3042517 - RNA, 18 nt, Mycobacterium bovis subsp bovis AF2122/97
cacgaccucgggaucggc

SEQ ID NO: 3042518 - RNA, 19 nt, Mycobacterium bovis subsp bovis AF2122/97
cacgaccucgggaucggcg

SEQ ID NO: 3042519 - RNA, 16 nt, Mycobacterium bovis subsp bovis AF2122/97
cacgaccugcucaucc

SEQ ID NO: 3042520 - RNA, 16 nt, Mycobacterium bovis subsp bovis AF2122/97
cacgacgaacaccagc

SEQ ID NO: 3042521 - RNA, 17 nt, Mycobacterium bovis subsp bovis AF2122/97
cacgacgaacaccagcg

SEQ ID NO: 3042522 - RNA, 21 nt, Mycobacterium bovis subsp bovis AF2122/97
cacgacgaacaccagcgcgcc

SEQ ID NO: 3042523 - RNA, 22 nt, Mycobacterium bovis subsp bovis AF2122/97
cacgacgaacaccagcgcgccg

SEQ ID NO: 3042524 - RNA, 19 nt, Mycobacterium bovis subsp bovis AF2122/97
cacgacgaauccccgacac

SEQ ID NO: 3042525 - RNA, 21 nt, Mycobacterium bovis subsp bovis AF2122/97
cacgacgaauguccgcagacg

SEQ ID NO: 3042526 - RNA, 18 nt, Mycobacterium bovis subsp bovis AF2122/97
cacgacgacaaccggcca

SEQ ID NO: 3042527 - RNA, 19 nt, Mycobacterium bovis subsp bovis AF2122/97
cacgacgacaaccggccag

SEQ ID NO: 3042528 - RNA, 21 nt, Mycobacterium bovis subsp bovis AF2122/97
cacgacgacaaccggccagau

SEQ ID NO: 3042529 - RNA, 18 nt, Mycobacterium bovis subsp bovis AF2122/97
cacgacgacaucgagcca

SEQ ID NO: 3042530 - RNA, 16 nt, Mycobacterium bovis subsp bovis AF2122/97
cacgacgacgucgggg

SEQ ID NO: 3042531 - RNA, 13 nt, Mycobacterium bovis subsp bovis AF2122/97
cacgacgcgacac

SEQ ID NO: 3042532 - RNA, 20 nt, Mycobacterium bovis subsp bovis AF2122/97
cacgacgcgacacgccggcg

SEQ ID NO: 3042533 - RNA, 13 nt, Mycobacterium bovis subsp bovis AF2122/97
cacgacggcacgc

SEQ ID NO: 3042534 - RNA, 15 nt, Mycobacterium bovis subsp bovis AF2122/97
cacgacggcacgcca

SEQ ID NO: 3042535 - RNA, 12 nt, Mycobacterium bovis subsp bovis AF2122/97
cacgacgggccg

SEQ ID NO: 3042536 - RNA, 17 nt, Mycobacterium bovis subsp bovis AF2122/97
cacgcauguuggugauc

SEQ ID NO: 3042537 - RNA, 20 nt, Mycobacterium bovis subsp bovis AF2122/97
cacgccaacguugcgccagc

SEQ ID NO: 3042538 - RNA, 22 nt, Mycobacterium bovis subsp bovis AF2122/97
cacgccaacguugcgccagcgg

SEQ ID NO: 3042539 - RNA, 12 nt, Mycobacterium bovis subsp bovis AF2122/97
cacgccaccgcg

SEQ ID NO: 3042540 - RNA, 20 nt, Mycobacterium bovis subsp bovis AF2122/97
cacgccaccgcggucaccga

SEQ ID NO: 3042541 - RNA, 22 nt, Mycobacterium bovis subsp bovis AF2122/97
cacgccaccgcggucaccgacg

SEQ ID NO: 3042542 - RNA, 14 nt, Mycobacterium bovis subsp bovis AF2122/97
cacgccacguccaa

SEQ ID NO: 3042543 - RNA, 20 nt, Mycobacterium bovis subsp bovis AF2122/97
cacgccacguccaacucggc

SEQ ID NO: 3042544 - RNA, 17 nt, Mycobacterium bovis subsp bovis AF2122/97
cacgccacuucuucggg

SEQ ID NO: 3042545 - RNA, 15 nt, Mycobacterium bovis subsp bovis AF2122/97
cacgccagcccgucc

SEQ ID NO: 3042546 - RNA, 21 nt, Mycobacterium bovis subsp bovis AF2122/97
cacgccagcccguccggcccc

SEQ ID NO: 3042547 - RNA, 12 nt, Mycobacterium bovis subsp bovis AF2122/97
cacgccagccgu

SEQ ID NO: 3042548 - RNA, 15 nt, Mycobacterium bovis subsp bovis AF2122/97
cacgccagccgugcc

SEQ ID NO: 3042549 - RNA, 16 nt, Mycobacterium bovis subsp bovis AF2122/97
cacgccagccgugccg

SEQ ID NO: 3042550 - RNA, 12 nt, Mycobacterium bovis subsp bovis AF2122/97
cacgccagcgcg

SEQ ID NO: 3042551 - RNA, 15 nt, Mycobacterium bovis subsp bovis AF2122/97
cacgccagcgcgacc

SEQ ID NO: 3042552 - RNA, 17 nt, Mycobacterium bovis subsp bovis AF2122/97
cacgccagcgucgacca

SEQ ID NO: 3042553 - RNA, 17 nt, Mycobacterium bovis subsp bovis AF2122/97
cacgccagcucgccggc

SEQ ID NO: 3042554 - RNA, 20 nt, Mycobacterium bovis subsp bovis AF2122/97
cacgccagcucgccggccgg

SEQ ID NO: 3042555 - RNA, 20 nt, Mycobacterium bovis subsp bovis AF2122/97
cacgccaggugaugccgccg

SEQ ID NO: 3042556 - RNA, 15 nt, Mycobacterium bovis subsp bovis AF2122/97
cacgccauaccggcu

SEQ ID NO: 3042557 - RNA, 23 nt, Mycobacterium bovis subsp bovis AF2122/97
cacgccauaccggcuggccaggu

SEQ ID NO: 3042558 - RNA, 22 nt, Mycobacterium bovis subsp bovis AF2122/97
cacgccaugguaugacccgccu

SEQ ID NO: 3042559 - RNA, 20 nt, Mycobacterium bovis subsp bovis AF2122/97
cacgcccaauguccaggcgc

SEQ ID NO: 3042560 - RNA, 13 nt, Mycobacterium bovis subsp bovis AF2122/97
cacgcccacagcu

SEQ ID NO: 3042561 - RNA, 22 nt, Mycobacterium bovis subsp bovis AF2122/97
cacgcccacaggggcagcgcgg

SEQ ID NO: 3042562 - RNA, 14 nt, Mycobacterium bovis subsp bovis AF2122/97
cacgcccaccacug

SEQ ID NO: 3042563 - RNA, 14 nt, Mycobacterium bovis subsp bovis AF2122/97
cacgcccaggcgac

SEQ ID NO: 3042564 - RNA, 14 nt, Mycobacterium bovis subsp bovis AF2122/97
cacgcccaugaccg

SEQ ID NO: 3042565 - RNA, 16 nt, Mycobacterium bovis subsp bovis AF2122/97
cacgcccaugaccggc

SEQ ID NO: 3042566 - RNA, 18 nt, Mycobacterium bovis subsp bovis AF2122/97
cacgcccaugaccggccg

SEQ ID NO: 3042567 - RNA, 15 nt, Mycobacterium bovis subsp bovis AF2122/97
cacgcccgacgagga

SEQ ID NO: 3042568 - RNA, 15 nt, Mycobacterium bovis subsp bovis AF2122/97
cacgcccgacgccag

SEQ ID NO: 3042569 - RNA, 13 nt, Mycobacterium bovis subsp bovis AF2122/97
cacgcccggcccc

SEQ ID NO: 3042570 - RNA, 14 nt, Mycobacterium bovis subsp bovis AF2122/97
cacgcccggccccg

SEQ ID NO: 3042571 - RNA, 21 nt, Mycobacterium bovis subsp bovis AF2122/97
cacgcccggccccgcggccag

SEQ ID NO: 3042572 - RNA, 13 nt, Mycobacterium bovis subsp bovis AF2122/97
cacgcccggcgug

SEQ ID NO: 3042573 - RNA, 16 nt, Mycobacterium bovis subsp bovis AF2122/97
cacgcccucgacgccg

SEQ ID NO: 3042574 - RNA, 18 nt, Mycobacterium bovis subsp bovis AF2122/97
cacgcccucgacgccgcg

SEQ ID NO: 3042575 - RNA, 18 nt, Mycobacterium bovis subsp bovis AF2122/97
cacgcccucgucgaucgc

SEQ ID NO: 3042576 - RNA, 20 nt, Mycobacterium bovis subsp bovis AF2122/97
cacgcccucgucgaucgccg

SEQ ID NO: 3042577 - RNA, 19 nt, Mycobacterium bovis subsp bovis AF2122/97
cacgcccugaagggccgcc

SEQ ID NO: 3042578 - RNA, 13 nt, Mycobacterium bovis subsp bovis AF2122/97
cacgccgaccaau

SEQ ID NO: 3042579 - RNA, 13 nt, Mycobacterium bovis subsp bovis AF2122/97
cacgccgaccagc

SEQ ID NO: 3042580 - RNA, 14 nt, Mycobacterium bovis subsp bovis AF2122/97
cacgccgaccagca

SEQ ID NO: 3042581 - RNA, 16 nt, Mycobacterium bovis subsp bovis AF2122/97
cacgccgaccagcacc

SEQ ID NO: 3042582 - RNA, 17 nt, Mycobacterium bovis subsp bovis AF2122/97
cacgccgaccagcaccc

SEQ ID NO: 3042583 - RNA, 19 nt, Mycobacterium bovis subsp bovis AF2122/97
cacgccgaccaucucaccg

SEQ ID NO: 3042584 - RNA, 13 nt, Mycobacterium bovis subsp bovis AF2122/97
cacgccgaccggc

SEQ ID NO: 3042585 - RNA, 18 nt, Mycobacterium bovis subsp bovis AF2122/97
cacgccgaccggcccgca

SEQ ID NO: 3042586 - RNA, 15 nt, Mycobacterium bovis subsp bovis AF2122/97
cacgccgaccggugg

SEQ ID NO: 3042587 - RNA, 22 nt, Mycobacterium bovis subsp bovis AF2122/97
cacgccgaccgguggcaccggc

SEQ ID NO: 3042588 - RNA, 23 nt, Mycobacterium bovis subsp bovis AF2122/97
cacgccgaccgguggcaccggcg

SEQ ID NO: 3042589 - RNA, 22 nt, Mycobacterium bovis subsp bovis AF2122/97
cacgccgacgauuaccagcggc

SEQ ID NO: 3042590 - RNA, 13 nt, Mycobacterium bovis subsp bovis AF2122/97
cacgccgacggca

SEQ ID NO: 3042591 - RNA, 17 nt, Mycobacterium bovis subsp bovis AF2122/97
cacgccgacguggaugg

SEQ ID NO: 3042592 - RNA, 19 nt, Mycobacterium bovis subsp bovis AF2122/97
cacgccgaucaacaugccg

SEQ ID NO: 3042593 - RNA, 20 nt, Mycobacterium bovis subsp bovis AF2122/97
cacgccgaucaacaugccgg

SEQ ID NO: 3042594 - RNA, 13 nt, Mycobacterium bovis subsp bovis AF2122/97
cacgccgaucugg

SEQ ID NO: 3042595 - RNA, 16 nt, Mycobacterium bovis subsp bovis AF2122/97
cacgccgaugggaacc

SEQ ID NO: 3042596 - RNA, 13 nt, Mycobacterium bovis subsp bovis AF2122/97
cacgccgauucgc

SEQ ID NO: 3042597 - RNA, 12 nt, Mycobacterium bovis subsp bovis AF2122/97
cacgccgccccu

SEQ ID NO: 3042598 - RNA, 14 nt, Mycobacterium bovis subsp bovis AF2122/97
cacgccgccggccg

SEQ ID NO: 3042599 - RNA, 15 nt, Mycobacterium bovis subsp bovis AF2122/97
cacgccgccggccgc

SEQ ID NO: 3042600 - RNA, 23 nt, Mycobacterium bovis subsp bovis AF2122/97
cacgccgccggccgccagcgcac

SEQ ID NO: 3042601 - RNA, 15 nt, Mycobacterium bovis subsp bovis AF2122/97
cacgccgccggcgaa

SEQ ID NO: 3042602 - RNA, 13 nt, Mycobacterium bovis subsp bovis AF2122/97
cacgccgccguug

SEQ ID NO: 3042603 - RNA, 17 nt, Mycobacterium bovis subsp bovis AF2122/97
cacgccggauggucggc

SEQ ID NO: 3042604 - RNA, 19 nt, Mycobacterium bovis subsp bovis AF2122/97
cacgccggcaucgucgacg

SEQ ID NO: 3042605 - RNA, 16 nt, Mycobacterium bovis subsp bovis AF2122/97
cacgccggcccgguga

SEQ ID NO: 3042606 - RNA, 13 nt, Mycobacterium bovis subsp bovis AF2122/97
cacgccggccucg

SEQ ID NO: 3042607 - RNA, 16 nt, Mycobacterium bovis subsp bovis AF2122/97
cacgccggccucgccg

SEQ ID NO: 3042608 - RNA, 13 nt, Mycobacterium bovis subsp bovis AF2122/97
cacgccggcgcug

SEQ ID NO: 3042609 - RNA, 21 nt, Mycobacterium bovis subsp bovis AF2122/97
cacgccgggcaaggccaccgu

SEQ ID NO: 3042610 - RNA, 19 nt, Mycobacterium bovis subsp bovis AF2122/97
cacgccgggcaucggcggu

SEQ ID NO: 3042611 - RNA, 12 nt, Mycobacterium bovis subsp bovis AF2122/97
cacgccgggcga

SEQ ID NO: 3042612 - RNA, 19 nt, Mycobacterium bovis subsp bovis AF2122/97
cacgccgggugccgccacg

SEQ ID NO: 3042613 - RNA, 14 nt, Mycobacterium bovis subsp bovis AF2122/97
cacgccggucgagg

SEQ ID NO: 3042614 - RNA, 15 nt, Mycobacterium bovis subsp bovis AF2122/97
cacgccgguggcacg

SEQ ID NO: 3042615 - RNA, 20 nt, Mycobacterium bovis subsp bovis AF2122/97
cacgccgguggcacggcccc

SEQ ID NO: 3042616 - RNA, 20 nt, Mycobacterium bovis subsp bovis AF2122/97
cacgccguagcgcagcgccu

SEQ ID NO: 3042617 - RNA, 14 nt, Mycobacterium bovis subsp bovis AF2122/97
cacgccgucgaccg

SEQ ID NO: 3042618 - RNA, 18 nt, Mycobacterium bovis subsp bovis AF2122/97
cacgccgucgaccggcgg

SEQ ID NO: 3042619 - RNA, 14 nt, Mycobacterium bovis subsp bovis AF2122/97
cacgccucgccgaa

SEQ ID NO: 3042620 - RNA, 16 nt, Mycobacterium bovis subsp bovis AF2122/97
cacgccugagccacca

SEQ ID NO: 3042621 - RNA, 21 nt, Mycobacterium bovis subsp bovis AF2122/97
cacgccugagccaccaacacc

SEQ ID NO: 3042622 - RNA, 22 nt, Mycobacterium bovis subsp bovis AF2122/97
cacgccugccgaaacgccgacc

SEQ ID NO: 3042623 - RNA, 13 nt, Mycobacterium bovis subsp bovis AF2122/97
cacgcugucgauc

SEQ ID NO: 3042624 - RNA, 15 nt, Mycobacterium bovis subsp bovis AF2122/97
cacgcugugcucgac

SEQ ID NO: 3042625 - RNA, 16 nt, Mycobacterium bovis subsp bovis AF2122/97
cacgcugugcucgacg

SEQ ID NO: 3042626 - RNA, 22 nt, Mycobacterium bovis subsp bovis AF2122/97
cacgcugugcucgacgaagauc

SEQ ID NO: 3042627 - RNA, 14 nt, Mycobacterium bovis subsp bovis AF2122/97
cacgcuguucccga

SEQ ID NO: 3042628 - RNA, 15 nt, Mycobacterium bovis subsp bovis AF2122/97
cacgcuuaacagcgg

SEQ ID NO: 3042629 - RNA, 20 nt, Mycobacterium bovis subsp bovis AF2122/97
cacgcuucuuccgcgcgccg

SEQ ID NO: 3042630 - RNA, 21 nt, Mycobacterium bovis subsp bovis AF2122/97
cacgcuucuuccgcgcgccgg

SEQ ID NO: 3042631 - RNA, 16 nt, Mycobacterium bovis subsp bovis AF2122/97
cacggaaguaucgccg

SEQ ID NO: 3042632 - RNA, 15 nt, Mycobacterium bovis subsp bovis AF2122/97
cacggacaguucccc

SEQ ID NO: 3042633 - RNA, 18 nt, Mycobacterium bovis subsp bovis AF2122/97
cacggaccagcgccggac

SEQ ID NO: 3042634 - RNA, 21 nt, Mycobacterium bovis subsp bovis AF2122/97
cacggaccagcgccggaccgu

SEQ ID NO: 3042635 - RNA, 12 nt, Mycobacterium bovis subsp bovis AF2122/97
cacggaccgcca

SEQ ID NO: 3042636 - RNA, 15 nt, Mycobacterium bovis subsp bovis AF2122/97
cacggaccgccaccu

SEQ ID NO: 3042637 - RNA, 15 nt, Mycobacterium bovis subsp bovis AF2122/97
cacggagaccggccg

SEQ ID NO: 3042638 - RNA, 13 nt, Mycobacterium bovis subsp bovis AF2122/97
cacggagccgccg

SEQ ID NO: 3042639 - RNA, 19 nt, Mycobacterium bovis subsp bovis AF2122/97
cacggagcucuugcgggca

SEQ ID NO: 3042640 - RNA, 20 nt, Mycobacterium bovis subsp bovis AF2122/97
cacggaggguugccgccgac

SEQ ID NO: 3042641 - RNA, 16 nt, Mycobacterium bovis subsp bovis AF2122/97
cacggaucgcggcggc

SEQ ID NO: 3042642 - RNA, 15 nt, Mycobacterium bovis subsp bovis AF2122/97
cacggaugcgauggc

SEQ ID NO: 3042643 - RNA, 19 nt, Mycobacterium bovis subsp bovis AF2122/97
cacggaugcgauggccgac

SEQ ID NO: 3042644 - RNA, 20 nt, Mycobacterium bovis subsp bovis AF2122/97
cacggaugcgauggccgacg

SEQ ID NO: 3042645 - RNA, 21 nt, Mycobacterium bovis subsp bovis AF2122/97
cacggaugcgauggccgacgc

SEQ ID NO: 3042646 - RNA, 24 nt, Mycobacterium bovis subsp bovis AF2122/97
cacggaugucgcccaaccgaaccg

SEQ ID NO: 3042647 - RNA, 16 nt, Mycobacterium bovis subsp bovis AF2122/97
cacggauucgggcgaa

SEQ ID NO: 3042648 - RNA, 23 nt, Mycobacterium bovis subsp bovis AF2122/97
cacggcaagccaaccagcccggc

SEQ ID NO: 3042649 - RNA, 17 nt, Mycobacterium bovis subsp bovis AF2122/97
cacggcaagcgugaccc

SEQ ID NO: 3042650 - RNA, 21 nt, Mycobacterium bovis subsp bovis AF2122/97
cacggcaagcgugacccgccg

SEQ ID NO: 3042651 - RNA, 13 nt, Mycobacterium bovis subsp bovis AF2122/97
cacggcaccacca

SEQ ID NO: 3042652 - RNA, 18 nt, Mycobacterium bovis subsp bovis AF2122/97
cacggcaccaccaagcuc

SEQ ID NO: 3042653 - RNA, 22 nt, Mycobacterium bovis subsp bovis AF2122/97
cacggcaccaccaagcucggcc

SEQ ID NO: 3042654 - RNA, 14 nt, Mycobacterium bovis subsp bovis AF2122/97
cacggcaccgauca

SEQ ID NO: 3042655 - RNA, 23 nt, Mycobacterium bovis subsp bovis AF2122/97
cacggcagacacgcugcaggcgg

SEQ ID NO: 3042656 - RNA, 13 nt, Mycobacterium bovis subsp bovis AF2122/97
cacggcagccaac

SEQ ID NO: 3042657 - RNA, 20 nt, Mycobacterium bovis subsp bovis AF2122/97
cacggcagccaaccggcgca

SEQ ID NO: 3042658 - RNA, 19 nt, Mycobacterium bovis subsp bovis AF2122/97
cacggcagccuugaucucg

SEQ ID NO: 3042659 - RNA, 13 nt, Mycobacterium bovis subsp bovis AF2122/97
cacggcagcgccc

SEQ ID NO: 3042660 - RNA, 14 nt, Mycobacterium bovis subsp bovis AF2122/97
cacggcagcgccca

SEQ ID NO: 3042661 - RNA, 17 nt, Mycobacterium bovis subsp bovis AF2122/97
cacggcagcgccggucg

SEQ ID NO: 3042662 - RNA, 22 nt, Mycobacterium bovis subsp bovis AF2122/97
cacggcagcgccggucggaucg

SEQ ID NO: 3042663 - RNA, 17 nt, Mycobacterium bovis subsp bovis AF2122/97
cacggcaggcagggcag

SEQ ID NO: 3042664 - RNA, 23 nt, Mycobacterium bovis subsp bovis AF2122/97
cacggcaggcagggcagcccggc

SEQ ID NO: 3042665 - RNA, 20 nt, Mycobacterium bovis subsp bovis AF2122/97
cacggcaggcggugaacacc

SEQ ID NO: 3042666 - RNA, 16 nt, Mycobacterium bovis subsp bovis AF2122/97
cacggcaucggccacc

SEQ ID NO: 3042667 - RNA, 17 nt, Mycobacterium bovis subsp bovis AF2122/97
cacggcaucggccaccu

SEQ ID NO: 3042668 - RNA, 14 nt, Mycobacterium bovis subsp bovis AF2122/97
cacggccaccgcgc

SEQ ID NO: 3042669 - RNA, 18 nt, Mycobacterium bovis subsp bovis AF2122/97
cacggccagaaacccggc

SEQ ID NO: 3042670 - RNA, 19 nt, Mycobacterium bovis subsp bovis AF2122/97
cacggccagaaacccggcg

SEQ ID NO: 3042671 - RNA, 17 nt, Mycobacterium bovis subsp bovis AF2122/97
cacggccaggucgacgg

SEQ ID NO: 3042672 - RNA, 15 nt, Mycobacterium bovis subsp bovis AF2122/97
cacggccaugaucac

SEQ ID NO: 3042673 - RNA, 18 nt, Mycobacterium bovis subsp bovis AF2122/97
cacggccaugaucacacc

SEQ ID NO: 3042674 - RNA, 16 nt, Mycobacterium bovis subsp bovis AF2122/97
cacggccccugccacg

SEQ ID NO: 3042675 - RNA, 20 nt, Mycobacterium bovis subsp bovis AF2122/97
cacggccccugccacgacga

SEQ ID NO: 3042676 - RNA, 22 nt, Mycobacterium bovis subsp bovis AF2122/97
cacggccccugccacgacgaac

SEQ ID NO: 3042677 - RNA, 14 nt, Mycobacterium bovis subsp bovis AF2122/97
cacggcccgagccg

SEQ ID NO: 3042678 - RNA, 14 nt, Mycobacterium bovis subsp bovis AF2122/97
cacggccgagcagg

SEQ ID NO: 3042679 - RNA, 22 nt, Mycobacterium bovis subsp bovis AF2122/97
cacggccgccgacuccccgccg

SEQ ID NO: 3042680 - RNA, 18 nt, Mycobacterium bovis subsp bovis AF2122/97
cacggccggccgcugcca

SEQ ID NO: 3042681 - RNA, 12 nt, Mycobacterium bovis subsp bovis AF2122/97
cacggccggguc

SEQ ID NO: 3042682 - RNA, 20 nt, Mycobacterium bovis subsp bovis AF2122/97
cacggccgggucgaacaggc

SEQ ID NO: 3042683 - RNA, 17 nt, Mycobacterium bovis subsp bovis AF2122/97
cacggccgucauuucca

SEQ ID NO: 3042684 - RNA, 15 nt, Mycobacterium bovis subsp bovis AF2122/97
cacggccgucgacga

SEQ ID NO: 3042685 - RNA, 17 nt, Mycobacterium bovis subsp bovis AF2122/97
cacggccuccggaccga

SEQ ID NO: 3042686 - RNA, 20 nt, Mycobacterium bovis subsp bovis AF2122/97
cacggcgaaccggcccaccg

SEQ ID NO: 3042687 - RNA, 23 nt, Mycobacterium bovis subsp bovis AF2122/97
cacggcgaaccggcccaccgacg

SEQ ID NO: 3042688 - RNA, 22 nt, Mycobacterium bovis subsp bovis AF2122/97
cacggcgaaugcauuggcggug

SEQ ID NO: 3042689 - RNA, 20 nt, Mycobacterium bovis subsp bovis AF2122/97
cacggcgacauacccgauca

SEQ ID NO: 3042690 - RNA, 16 nt, Mycobacterium bovis subsp bovis AF2122/97
cacggcgaccacgccg

SEQ ID NO: 3042691 - RNA, 14 nt, Mycobacterium bovis subsp bovis AF2122/97
cacggcgacgccag

SEQ ID NO: 3042692 - RNA, 16 nt, Mycobacterium bovis subsp bovis AF2122/97
cacggcgaggccgaac

SEQ ID NO: 3042693 - RNA, 19 nt, Mycobacterium bovis subsp bovis AF2122/97
cacggcgaggugcucggau

SEQ ID NO: 3042694 - RNA, 15 nt, Mycobacterium bovis subsp bovis AF2122/97
cacggcgauugcccg

SEQ ID NO: 3042695 - RNA, 15 nt, Mycobacterium bovis subsp bovis AF2122/97
cacggcgccgccacg

SEQ ID NO: 3042696 - RNA, 23 nt, Mycobacterium bovis subsp bovis AF2122/97
cacggcgccgccacggaucgcgg

SEQ ID NO: 3042697 - RNA, 18 nt, Mycobacterium bovis subsp bovis AF2122/97
cacggcgccuacaccggc

SEQ ID NO: 3042698 - RNA, 19 nt, Mycobacterium bovis subsp bovis AF2122/97
cacggcgccuacaccggcg

SEQ ID NO: 3042699 - RNA, 20 nt, Mycobacterium bovis subsp bovis AF2122/97
cacggcgccuacaccggcgc

SEQ ID NO: 3042700 - RNA, 12 nt, Mycobacterium bovis subsp bovis AF2122/97
cacggcgcgcca

SEQ ID NO: 3042701 - RNA, 15 nt, Mycobacterium bovis subsp bovis AF2122/97
cacggcgcgcgcgcc

SEQ ID NO: 3042702 - RNA, 16 nt, Mycobacterium bovis subsp bovis AF2122/97
cacggcgcgcgcgccg

SEQ ID NO: 3042703 - RNA, 14 nt, Mycobacterium bovis subsp bovis AF2122/97
cacggcgcggcgga

SEQ ID NO: 3042704 - RNA, 19 nt, Mycobacterium bovis subsp bovis AF2122/97
cacggcgcugcccacgccg

SEQ ID NO: 3042705 - RNA, 22 nt, Mycobacterium bovis subsp bovis AF2122/97
cacggcggaagaagugcacugc

SEQ ID NO: 3042706 - RNA, 15 nt, Mycobacterium bovis subsp bovis AF2122/97
cacggcggccaccug

SEQ ID NO: 3042707 - RNA, 16 nt, Mycobacterium bovis subsp bovis AF2122/97
cacggcggccaccugc

SEQ ID NO: 3042708 - RNA, 22 nt, Mycobacterium bovis subsp bovis AF2122/97
cacggcggccaccugcuggccg

SEQ ID NO: 3042709 - RNA, 19 nt, Mycobacterium bovis subsp bovis AF2122/97
cacggugccgacgaugacg

SEQ ID NO: 3042710 - RNA, 16 nt, Mycobacterium bovis subsp bovis AF2122/97
cacggugccgccgucg

SEQ ID NO: 3042711 - RNA, 20 nt, Mycobacterium bovis subsp bovis AF2122/97
cacggugccgccgucgauga

SEQ ID NO: 3042712 - RNA, 12 nt, Mycobacterium bovis subsp bovis AF2122/97
cacggugcggug

SEQ ID NO: 3042713 - RNA, 21 nt, Mycobacterium bovis subsp bovis AF2122/97
cacggugcugaucgguccggc

SEQ ID NO: 3042714 - RNA, 22 nt, Mycobacterium bovis subsp bovis AF2122/97
cacgguggagcgcgccucgccc

SEQ ID NO: 3042715 - RNA, 18 nt, Mycobacterium bovis subsp bovis AF2122/97
cacgguggccgagccgcg

SEQ ID NO: 3042716 - RNA, 19 nt, Mycobacterium bovis subsp bovis AF2122/97
cacgguggccgagccgcgg

SEQ ID NO: 3042717 - RNA, 20 nt, Mycobacterium bovis subsp bovis AF2122/97
cacgguggccgagccgcggu

SEQ ID NO: 3042718 - RNA, 12 nt, Mycobacterium bovis subsp bovis AF2122/97
cacgguggccgc

SEQ ID NO: 3042719 - RNA, 17 nt, Mycobacterium bovis subsp bovis AF2122/97
cacgguggccgcugcca

SEQ ID NO: 3042720 - RNA, 21 nt, Mycobacterium bovis subsp bovis AF2122/97
cacgguggccgcugccagccg

SEQ ID NO: 3042721 - RNA, 22 nt, Mycobacterium bovis subsp bovis AF2122/97
cacgguggcucuguagcgucgc

SEQ ID NO: 3042722 - RNA, 13 nt, Mycobacterium bovis subsp bovis AF2122/97
cacgguggcuucg

SEQ ID NO: 3042723 - RNA, 22 nt, Mycobacterium bovis subsp bovis AF2122/97
cacggugggcgccgacaccggc

SEQ ID NO: 3042724 - RNA, 22 nt, Mycobacterium bovis subsp bovis AF2122/97
cacggugguggugggaguucgc

SEQ ID NO: 3042725 - RNA, 17 nt, Mycobacterium bovis subsp bovis AF2122/97
cacgguggugucagcca

SEQ ID NO: 3042726 - RNA, 20 nt, Mycobacterium bovis subsp bovis AF2122/97
cacgguggugucagccaccg

SEQ ID NO: 3042727 - RNA, 23 nt, Mycobacterium bovis subsp bovis AF2122/97
cacgguguaccagguggaccggc

SEQ ID NO: 3042728 - RNA, 16 nt, Mycobacterium bovis subsp bovis AF2122/97
cacgguguauuggggu

SEQ ID NO: 3042729 - RNA, 17 nt, Mycobacterium bovis subsp bovis AF2122/97
cacgguguauuggggug

SEQ ID NO: 3042730 - RNA, 19 nt, Mycobacterium bovis subsp bovis AF2122/97
cacgguguauugggguggc

SEQ ID NO: 3042731 - RNA, 16 nt, Mycobacterium bovis subsp bovis AF2122/97
cacggugugcacggcg

SEQ ID NO: 3042732 - RNA, 16 nt, Mycobacterium bovis subsp bovis AF2122/97
cacggugugcuaccaa

SEQ ID NO: 3042733 - RNA, 20 nt, Mycobacterium bovis subsp bovis AF2122/97
cacggugugcuaccaauucg

SEQ ID NO: 3042734 - RNA, 19 nt, Mycobacterium bovis subsp bovis AF2122/97
cacgguugccgcgaucggg

SEQ ID NO: 3042735 - RNA, 14 nt, Mycobacterium bovis subsp bovis AF2122/97
cacgguugccggcg

SEQ ID NO: 3042736 - RNA, 17 nt, Mycobacterium bovis subsp bovis AF2122/97
cacgguugccggcggcg

SEQ ID NO: 3042737 - RNA, 18 nt, Mycobacterium bovis subsp bovis AF2122/97
cacgguugccggcggcga

SEQ ID NO: 3042738 - RNA, 13 nt, Mycobacterium bovis subsp bovis AF2122/97
cacgguuggccac

SEQ ID NO: 3042739 - RNA, 14 nt, Mycobacterium bovis subsp bovis AF2122/97
cacgguuggccacc

SEQ ID NO: 3042740 - RNA, 18 nt, Mycobacterium bovis subsp bovis AF2122/97
cacgguuggccaccagcu

SEQ ID NO: 3042741 - RNA, 19 nt, Mycobacterium bovis subsp bovis AF2122/97
cacgguuggccaccagcug

SEQ ID NO: 3042742 - RNA, 22 nt, Mycobacterium bovis subsp bovis AF2122/97
cacgguuggccaccagcuggcg

SEQ ID NO: 3042743 - RNA, 22 nt, Mycobacterium bovis subsp bovis AF2122/97
cacgguuggcgcucaacucagu

SEQ ID NO: 3042744 - RNA, 19 nt, Mycobacterium bovis subsp bovis AF2122/97
cacgguuuucgagggaugg

SEQ ID NO: 3042745 - RNA, 13 nt, Mycobacterium bovis subsp bovis AF2122/97
cacguaacccagu

SEQ ID NO: 3042746 - RNA, 17 nt, Mycobacterium bovis subsp bovis AF2122/97
cacguacgccgccgauc

SEQ ID NO: 3042747 - RNA, 20 nt, Mycobacterium bovis subsp bovis AF2122/97
cacguagaaguaggcggcga

SEQ ID NO: 3042748 - RNA, 22 nt, Mycobacterium bovis subsp bovis AF2122/97
cacguagaaguaggcggcgacg

SEQ ID NO: 3042749 - RNA, 15 nt, Mycobacterium bovis subsp bovis AF2122/97
cacguagcagcagac

SEQ ID NO: 3042750 - RNA, 23 nt, Mycobacterium bovis subsp bovis AF2122/97
cacguagcagcagacgacgauca

SEQ ID NO: 3042751 - RNA, 15 nt, Mycobacterium bovis subsp bovis AF2122/97
cacguagcagcgccg

SEQ ID NO: 3042752 - RNA, 21 nt, Mycobacterium bovis subsp bovis AF2122/97
cacguagcagcgccggcaccg

SEQ ID NO: 3042753 - RNA, 16 nt, Mycobacterium bovis subsp bovis AF2122/97
cacguagcgaccgcgg

SEQ ID NO: 3042754 - RNA, 20 nt, Mycobacterium bovis subsp bovis AF2122/97
cacguagcgaccgcggucgc

SEQ ID NO: 3042755 - RNA, 17 nt, Mycobacterium bovis subsp bovis AF2122/97
cacguauccacggucga

SEQ ID NO: 3042756 - RNA, 19 nt, Mycobacterium bovis subsp bovis AF2122/97
cacgucaucggcuggccgc

SEQ ID NO: 3042757 - RNA, 18 nt, Mycobacterium bovis subsp bovis AF2122/97
cacguccaagccguagac

SEQ ID NO: 3042758 - RNA, 19 nt, Mycobacterium bovis subsp bovis AF2122/97
cacguccaucaccggcggc

SEQ ID NO: 3042759 - RNA, 21 nt, Mycobacterium bovis subsp bovis AF2122/97
cacguccaucaccggcggccc

SEQ ID NO: 3042760 - RNA, 22 nt, Mycobacterium bovis subsp bovis AF2122/97
cacguccaucaccggcggcccc

SEQ ID NO: 3042761 - RNA, 17 nt, Mycobacterium bovis subsp bovis AF2122/97
cacgucccaggacuccg

SEQ ID NO: 3042762 - RNA, 21 nt, Mycobacterium bovis subsp bovis AF2122/97
cacgucccaggacuccggccg

SEQ ID NO: 3042763 - RNA, 23 nt, Mycobacterium bovis subsp bovis AF2122/97
cacgucccaggacuccggccgca

SEQ ID NO: 3042764 - RNA, 19 nt, Mycobacterium bovis subsp bovis AF2122/97
cacguccgcaaccucgccg

SEQ ID NO: 3042765 - RNA, 22 nt, Mycobacterium bovis subsp bovis AF2122/97
cacguccgcaaccucgccgucg

SEQ ID NO: 3042766 - RNA, 15 nt, Mycobacterium bovis subsp bovis AF2122/97
cacguccgcgcaccg

SEQ ID NO: 3042767 - RNA, 16 nt, Mycobacterium bovis subsp bovis AF2122/97
cacguccgcgcaccgc

SEQ ID NO: 3042768 - RNA, 17 nt, Mycobacterium bovis subsp bovis AF2122/97
cacguccgcggagcuca

SEQ ID NO: 3042769 - RNA, 13 nt, Mycobacterium bovis subsp bovis AF2122/97
cacguccgcgggg

SEQ ID NO: 3042770 - RNA, 22 nt, Mycobacterium bovis subsp bovis AF2122/97
cacguccgcgggggaccgcccg

SEQ ID NO: 3042771 - RNA, 23 nt, Mycobacterium bovis subsp bovis AF2122/97
cacguccucagccgugcccaggc

SEQ ID NO: 3042772 - RNA, 18 nt, Mycobacterium bovis subsp bovis AF2122/97
cacguccugcccgucguc

SEQ ID NO: 3042773 - RNA, 23 nt, Mycobacterium bovis subsp bovis AF2122/97
cacguccugcccgucgucggcaa

SEQ ID NO: 3042774 - RNA, 17 nt, Mycobacterium bovis subsp bovis AF2122/97
cacgucgacaccgagga

SEQ ID NO: 3042775 - RNA, 13 nt, Mycobacterium bovis subsp bovis AF2122/97
cacgucgaccgaa

SEQ ID NO: 3042776 - RNA, 18 nt, Mycobacterium bovis subsp bovis AF2122/97
cacgucgaccgaacccga

SEQ ID NO: 3042777 - RNA, 23 nt, Mycobacterium bovis subsp bovis AF2122/97
cacgucgaccgaacccgacgucg

SEQ ID NO: 3042778 - RNA, 16 nt, Mycobacterium bovis subsp bovis AF2122/97
cacgucgacggcggcc

SEQ ID NO: 3042779 - RNA, 13 nt, Mycobacterium bovis subsp bovis AF2122/97
cacgucgagcacc

SEQ ID NO: 3042780 - RNA, 16 nt, Mycobacterium bovis subsp bovis AF2122/97
cacgucgagcacccgc

SEQ ID NO: 3042781 - RNA, 15 nt, Mycobacterium bovis subsp bovis AF2122/97
cacgucgagcagccg

SEQ ID NO: 3042782 - RNA, 20 nt, Mycobacterium bovis subsp bovis AF2122/97
cacgucgagcaggcuggcug

SEQ ID NO: 3042783 - RNA, 21 nt, Mycobacterium bovis subsp bovis AF2122/97
cacgucgagguccaccacccu

SEQ ID NO: 3042784 - RNA, 23 nt, Mycobacterium bovis subsp bovis AF2122/97
cacgucgagguccaccacccugc

SEQ ID NO: 3042785 - RNA, 19 nt, Mycobacterium bovis subsp bovis AF2122/97
cacgucgaucucccaguga

SEQ ID NO: 3042786 - RNA, 12 nt, Mycobacterium bovis subsp bovis AF2122/97
cacgucgcccag

SEQ ID NO: 3042787 - RNA, 18 nt, Mycobacterium bovis subsp bovis AF2122/97
cacgucgcccaggguguc

SEQ ID NO: 3042788 - RNA, 16 nt, Mycobacterium bovis subsp bovis AF2122/97
cacgucgcgccaggcg

SEQ ID NO: 3042789 - RNA, 19 nt, Mycobacterium bovis subsp bovis AF2122/97
cacgucgcgccaggcgcga

SEQ ID NO: 3042790 - RNA, 17 nt, Mycobacterium bovis subsp bovis AF2122/97
cacgucggauccgcccg

SEQ ID NO: 3042791 - RNA, 18 nt, Mycobacterium bovis subsp bovis AF2122/97
cacgucggauccgcccgc

SEQ ID NO: 3042792 - RNA, 18 nt, Mycobacterium bovis subsp bovis AF2122/97
cacgucgggaugcccgcu

SEQ ID NO: 3042793 - RNA, 12 nt, Mycobacterium bovis subsp bovis AF2122/97
cacgucgggccc

SEQ ID NO: 3042794 - RNA, 16 nt, Mycobacterium bovis subsp bovis AF2122/97
cacgucgucgcccagg

SEQ ID NO: 3042795 - RNA, 16 nt, Mycobacterium bovis subsp bovis AF2122/97
cacucccccacacacc

SEQ ID NO: 3042796 - RNA, 15 nt, Mycobacterium bovis subsp bovis AF2122/97
cacucccgagccaca

SEQ ID NO: 3042797 - RNA, 15 nt, Mycobacterium bovis subsp bovis AF2122/97
cacucccgccccgcu

SEQ ID NO: 3042798 - RNA, 23 nt, Mycobacterium bovis subsp bovis AF2122/97
cacucccggcucggccagccagc

SEQ ID NO: 3042799 - RNA, 19 nt, Mycobacterium bovis subsp bovis AF2122/97
cacucccgggugcgacgcg

SEQ ID NO: 3042800 - RNA, 23 nt, Mycobacterium bovis subsp bovis AF2122/97
cacuccgccaacaucuccgcguc

SEQ ID NO: 3042801 - RNA, 13 nt, Mycobacterium bovis subsp bovis AF2122/97
cacuccgcggggu

SEQ ID NO: 3042802 - RNA, 17 nt, Mycobacterium bovis subsp bovis AF2122/97
cacuccggagcccacac

SEQ ID NO: 3042803 - RNA, 13 nt, Mycobacterium bovis subsp bovis AF2122/97
cacuccggcguug

SEQ ID NO: 3042804 - RNA, 22 nt, Mycobacterium bovis subsp bovis AF2122/97
cacuccggcguugacgaucagu

SEQ ID NO: 3042805 - RNA, 17 nt, Mycobacterium bovis subsp bovis AF2122/97
cacuccgggcucggcgu

SEQ ID NO: 3042806 - RNA, 14 nt, Mycobacterium bovis subsp bovis AF2122/97
cacuccgguggcca

SEQ ID NO: 3042807 - RNA, 19 nt, Mycobacterium bovis subsp bovis AF2122/97
cacuccgguggccaacacc

SEQ ID NO: 3042808 - RNA, 23 nt, Mycobacterium bovis subsp bovis AF2122/97
cacuccgguggccaacaccgcca

SEQ ID NO: 3042809 - RNA, 22 nt, Mycobacterium bovis subsp bovis AF2122/97
cacuccugagaugcggccauga

SEQ ID NO: 3042810 - RNA, 20 nt, Mycobacterium bovis subsp bovis AF2122/97
cacuccugaguuccggucga

SEQ ID NO: 3042811 - RNA, 13 nt, Mycobacterium bovis subsp bovis AF2122/97
cacuccugcacac

SEQ ID NO: 3042812 - RNA, 17 nt, Mycobacterium bovis subsp bovis AF2122/97
cacucgaagucgcccag

SEQ ID NO: 3042813 - RNA, 19 nt, Mycobacterium bovis subsp bovis AF2122/97
cacucgaagucgcccaguc

SEQ ID NO: 3042814 - RNA, 18 nt, Mycobacterium bovis subsp bovis AF2122/97
cacucgaccaggaccggc

SEQ ID NO: 3042815 - RNA, 22 nt, Mycobacterium bovis subsp bovis AF2122/97
cacucgaccaggaccggcugca

SEQ ID NO: 3042816 - RNA, 21 nt, Mycobacterium bovis subsp bovis AF2122/97
cacucgacgucgucgucgacg

SEQ ID NO: 3042817 - RNA, 22 nt, Mycobacterium bovis subsp bovis AF2122/97
cacucgacgucgucgucgacgg

SEQ ID NO: 3042818 - RNA, 23 nt, Mycobacterium bovis subsp bovis AF2122/97
cacucgaugcuuucguauucggc

SEQ ID NO: 3042819 - RNA, 16 nt, Mycobacterium bovis subsp bovis AF2122/97
cacucgccacucagcc

SEQ ID NO: 3042820 - RNA, 17 nt, Mycobacterium bovis subsp bovis AF2122/97
cacucgccacucagccc

SEQ ID NO: 3042821 - RNA, 22 nt, Mycobacterium bovis subsp bovis AF2122/97
cacucgccacucagcccgacac

SEQ ID NO: 3042822 - RNA, 16 nt, Mycobacterium bovis subsp bovis AF2122/97
cacucgccagggccau

SEQ ID NO: 3042823 - RNA, 19 nt, Mycobacterium bovis subsp bovis AF2122/97
cacucgcccaagcgcagcc

SEQ ID NO: 3042824 - RNA, 17 nt, Mycobacterium bovis subsp bovis AF2122/97
cacucgcccgauccgga

SEQ ID NO: 3042825 - RNA, 16 nt, Mycobacterium bovis subsp bovis AF2122/97
cacucgcccgcugccg

SEQ ID NO: 3042826 - RNA, 21 nt, Mycobacterium bovis subsp bovis AF2122/97
cacucgccgaaucgcugaccg

SEQ ID NO: 3042827 - RNA, 22 nt, Mycobacterium bovis subsp bovis AF2122/97
cacucgccgaaucgcugaccgc

SEQ ID NO: 3042828 - RNA, 20 nt, Mycobacterium bovis subsp bovis AF2122/97
cacucgccgcgacugcaccu

SEQ ID NO: 3042829 - RNA, 23 nt, Mycobacterium bovis subsp bovis AF2122/97
cacucgccgcgacugcaccuggc

SEQ ID NO: 3042830 - RNA, 13 nt, Mycobacterium bovis subsp bovis AF2122/97
cacucgccggcgg

SEQ ID NO: 3042831 - RNA, 18 nt, Mycobacterium bovis subsp bovis AF2122/97
cacucgccggcggacgcc

SEQ ID NO: 3042832 - RNA, 16 nt, Mycobacterium bovis subsp bovis AF2122/97
cacucgcggauccggg

SEQ ID NO: 3042833 - RNA, 19 nt, Mycobacterium bovis subsp bovis AF2122/97
cacucgcggauccgggcgu

SEQ ID NO: 3042834 - RNA, 12 nt, Mycobacterium bovis subsp bovis AF2122/97
cacucggaaucg

SEQ ID NO: 3042835 - RNA, 18 nt, Mycobacterium bovis subsp bovis AF2122/97
cacucggccacgacgacu

SEQ ID NO: 3042836 - RNA, 18 nt, Mycobacterium bovis subsp bovis AF2122/97
cacucgggauucggcagc

SEQ ID NO: 3042837 - RNA, 18 nt, Mycobacterium bovis subsp bovis AF2122/97
cacucggugucggccgcg

SEQ ID NO: 3042838 - RNA, 16 nt, Mycobacterium bovis subsp bovis AF2122/97
cacucguugaccggcc

SEQ ID NO: 3042839 - RNA, 15 nt, Mycobacterium bovis subsp bovis AF2122/97
cacucguugccgacc

SEQ ID NO: 3042840 - RNA, 13 nt, Mycobacterium bovis subsp bovis AF2122/97
cacucuagccggg

SEQ ID NO: 3042841 - RNA, 14 nt, Mycobacterium bovis subsp bovis AF2122/97
cacucuagccgggu

SEQ ID NO: 3042842 - RNA, 21 nt, Mycobacterium bovis subsp bovis AF2122/97
cacucucggugaacgccgccc

SEQ ID NO: 3042843 - RNA, 22 nt, Mycobacterium bovis subsp bovis AF2122/97
cacucucggugaacgccgcccc

SEQ ID NO: 3042844 - RNA, 22 nt, Mycobacterium bovis subsp bovis AF2122/97
cacucugaucuguguuugcggc

SEQ ID NO: 3042845 - RNA, 21 nt, Mycobacterium bovis subsp bovis AF2122/97
cacucuggucacugguccaac

SEQ ID NO: 3042846 - RNA, 22 nt, Mycobacterium bovis subsp bovis AF2122/97
cacucuucgggcggcgucgcgg

SEQ ID NO: 3042847 - RNA, 16 nt, Mycobacterium bovis subsp bovis AF2122/97
cacugaacaggccggu

SEQ ID NO: 3042848 - RNA, 23 nt, Mycobacterium bovis subsp bovis AF2122/97
cacugaacaggccgguucccuug

SEQ ID NO: 3042849 - RNA, 19 nt, Mycobacterium bovis subsp bovis AF2122/97
cacugaaccgguugacacc

SEQ ID NO: 3042850 - RNA, 12 nt, Mycobacterium bovis subsp bovis AF2122/97
cacugaaccgua

SEQ ID NO: 3042851 - RNA, 16 nt, Mycobacterium bovis subsp bovis AF2122/97
cacugaagaucgcgcc

SEQ ID NO: 3042852 - RNA, 19 nt, Mycobacterium bovis subsp bovis AF2122/97
cacugaccaggucugcggu

SEQ ID NO: 3042853 - RNA, 19 nt, Mycobacterium bovis subsp bovis AF2122/97
cacugaccccgccgccacg

SEQ ID NO: 3042854 - RNA, 14 nt, Mycobacterium bovis subsp bovis AF2122/97
cacugacgggccgu

SEQ ID NO: 3042855 - RNA, 20 nt, Mycobacterium bovis subsp bovis AF2122/97
cacugacgggccgucaaucg

SEQ ID NO: 3042856 - RNA, 11 nt, Mycobacterium bovis subsp bovis AF2122/97
cacugagaucc

SEQ ID NO: 3042857 - RNA, 21 nt, Mycobacterium bovis subsp bovis AF2122/97
cacugaggagaugagcaccaa

SEQ ID NO: 3042858 - RNA, 22 nt, Mycobacterium bovis subsp bovis AF2122/97
cacugaggagaugagcaccaaa

SEQ ID NO: 3042859 - RNA, 15 nt, Mycobacterium bovis subsp bovis AF2122/97
cacugagucugaugg

SEQ ID NO: 3042860 - RNA, 18 nt, Mycobacterium bovis subsp bovis AF2122/97
cacugaguucggugcugu

SEQ ID NO: 3042861 - RNA, 15 nt, Mycobacterium bovis subsp bovis AF2122/97
cacugaucaggccga

SEQ ID NO: 3042862 - RNA, 15 nt, Mycobacterium bovis subsp bovis AF2122/97
cacugcacccgaucg

SEQ ID NO: 3042863 - RNA, 16 nt, Mycobacterium bovis subsp bovis AF2122/97
cacugcacggagccgc

SEQ ID NO: 3042864 - RNA, 18 nt, Mycobacterium bovis subsp bovis AF2122/97
cacugcacggagccgccg

SEQ ID NO: 3042865 - RNA, 12 nt, Mycobacterium bovis subsp bovis AF2122/97
cacugcagcgcc

SEQ ID NO: 3042866 - RNA, 16 nt, Mycobacterium bovis subsp bovis AF2122/97
cacugccaccgcgagg

SEQ ID NO: 3042867 - RNA, 13 nt, Mycobacterium bovis subsp bovis AF2122/97
cacugccagccgu

SEQ ID NO: 3042868 - RNA, 16 nt, Mycobacterium bovis subsp bovis AF2122/97
cacugccaucgcggcg

SEQ ID NO: 3042869 - RNA, 18 nt, Mycobacterium bovis subsp bovis AF2122/97
cacugccaucgcggcguu

SEQ ID NO: 3042870 - RNA, 17 nt, Mycobacterium bovis subsp bovis AF2122/97
cacugccccgcaucgcc

SEQ ID NO: 3042871 - RNA, 20 nt, Mycobacterium bovis subsp bovis AF2122/97
cacugcccgccgacgccaga

SEQ ID NO: 3042872 - RNA, 15 nt, Mycobacterium bovis subsp bovis AF2122/97
cacugcccggggucc

SEQ ID NO: 3042873 - RNA, 22 nt, Mycobacterium bovis subsp bovis AF2122/97
cacugcccucaacgaucgcgcc

SEQ ID NO: 3042874 - RNA, 23 nt, Mycobacterium bovis subsp bovis AF2122/97
cacugcccucaacgaucgcgccg

SEQ ID NO: 3042875 - RNA, 13 nt, Mycobacterium bovis subsp bovis AF2122/97
cacugccgagcac

SEQ ID NO: 3042876 - RNA, 18 nt, Mycobacterium bovis subsp bovis AF2122/97
cacugccgcgcgcccgcc

SEQ ID NO: 3042877 - RNA, 18 nt, Mycobacterium bovis subsp bovis AF2122/97
cacugccggacagccacg

SEQ ID NO: 3042878 - RNA, 21 nt, Mycobacterium bovis subsp bovis AF2122/97
cacugccggacagccacgcac

SEQ ID NO: 3042879 - RNA, 15 nt, Mycobacterium bovis subsp bovis AF2122/97
cacugccggcacgcc

SEQ ID NO: 3042880 - RNA, 19 nt, Mycobacterium bovis subsp bovis AF2122/97
cacugccggcacgccgacc

SEQ ID NO: 3042881 - RNA, 21 nt, Mycobacterium bovis subsp bovis AF2122/97
cacuugaaauugagccggccc

SEQ ID NO: 3042882 - RNA, 18 nt, Mycobacterium bovis subsp bovis AF2122/97
cacuugaucgacggccau

SEQ ID NO: 3042883 - RNA, 19 nt, Mycobacterium bovis subsp bovis AF2122/97
cacuugaugccgcacccga

SEQ ID NO: 3042884 - RNA, 19 nt, Mycobacterium bovis subsp bovis AF2122/97
cacuugauguucgacgggc

SEQ ID NO: 3042885 - RNA, 16 nt, Mycobacterium bovis subsp bovis AF2122/97
cacuugcagcacaacg

SEQ ID NO: 3042886 - RNA, 20 nt, Mycobacterium bovis subsp bovis AF2122/97
cacuugcagcacaacgucuu

SEQ ID NO: 3042887 - RNA, 18 nt, Mycobacterium bovis subsp bovis AF2122/97
cacuugcccgucggcgcc

SEQ ID NO: 3042888 - RNA, 20 nt, Mycobacterium bovis subsp bovis AF2122/97
cacuugcccgucggcgcccg

SEQ ID NO: 3042889 - RNA, 21 nt, Mycobacterium bovis subsp bovis AF2122/97
cacuugcucggugagccucuu

SEQ ID NO: 3042890 - RNA, 15 nt, Mycobacterium bovis subsp bovis AF2122/97
cacuuggacccggcc

SEQ ID NO: 3042891 - RNA, 19 nt, Mycobacterium bovis subsp bovis AF2122/97
cacuuggacccggccggcc

SEQ ID NO: 3042892 - RNA, 15 nt, Mycobacterium bovis subsp bovis AF2122/97
cacuuggacgaacac

SEQ ID NO: 3042893 - RNA, 17 nt, Mycobacterium bovis subsp bovis AF2122/97
cacuuggaugcgacccg

SEQ ID NO: 3042894 - RNA, 17 nt, Mycobacterium bovis subsp bovis AF2122/97
cacuuggucacccaauu

SEQ ID NO: 3042895 - RNA, 18 nt, Mycobacterium bovis subsp bovis AF2122/97
cacuuuccgaggagggcc

SEQ ID NO: 3042896 - RNA, 13 nt, Mycobacterium bovis subsp bovis AF2122/97
cacuuuccggccg

SEQ ID NO: 3042897 - RNA, 19 nt, Mycobacterium bovis subsp bovis AF2122/97
cagaaacaccgacgacggc

SEQ ID NO: 3042898 - RNA, 23 nt, Mycobacterium bovis subsp bovis AF2122/97
cagaaaccaggacccaucgccag

SEQ ID NO: 3042899 - RNA, 21 nt, Mycobacterium bovis subsp bovis AF2122/97
cagaaacgcgaugguggccgc

SEQ ID NO: 3042900 - RNA, 14 nt, Mycobacterium bovis subsp bovis AF2122/97
cagaaauggcgcca

SEQ ID NO: 3042901 - RNA, 14 nt, Mycobacterium bovis subsp bovis AF2122/97
cagaacaccaccgc

SEQ ID NO: 3042902 - RNA, 14 nt, Mycobacterium bovis subsp bovis AF2122/97
cagaaccagcgacc

SEQ ID NO: 3042903 - RNA, 19 nt, Mycobacterium bovis subsp bovis AF2122/97
cagaaccgccaacauuggu

SEQ ID NO: 3042904 - RNA, 16 nt, Mycobacterium bovis subsp bovis AF2122/97
cagaaccuggagccgu

SEQ ID NO: 3042905 - RNA, 14 nt, Mycobacterium bovis subsp bovis AF2122/97
cagaacgacaccgc

SEQ ID NO: 3042906 - RNA, 20 nt, Mycobacterium bovis subsp bovis AF2122/97
cagaacggaauucagcgacg

SEQ ID NO: 3042907 - RNA, 15 nt, Mycobacterium bovis subsp bovis AF2122/97
cagaacggcgaucac

SEQ ID NO: 3042908 - RNA, 23 nt, Mycobacterium bovis subsp bovis AF2122/97
cagaacggcguugcggaaucagc

SEQ ID NO: 3042909 - RNA, 16 nt, Mycobacterium bovis subsp bovis AF2122/97
cagaacgguggcgcgg

SEQ ID NO: 3042910 - RNA, 18 nt, Mycobacterium bovis subsp bovis AF2122/97
cagaacgguggcgcggug

SEQ ID NO: 3042911 - RNA, 20 nt, Mycobacterium bovis subsp bovis AF2122/97
cagaacgucggugugcgcgc

SEQ ID NO: 3042912 - RNA, 21 nt, Mycobacterium bovis subsp bovis AF2122/97
cagaacgucggugugcgcgcc

SEQ ID NO: 3042913 - RNA, 22 nt, Mycobacterium bovis subsp bovis AF2122/97
cagaacgucggugugcgcgcca

SEQ ID NO: 3042914 - RNA, 17 nt, Mycobacterium bovis subsp bovis AF2122/97
cagaacgugacggucca

SEQ ID NO: 3042915 - RNA, 14 nt, Mycobacterium bovis subsp bovis AF2122/97
cagaacucaccgac

SEQ ID NO: 3042916 - RNA, 20 nt, Mycobacterium bovis subsp bovis AF2122/97
cagaacucaccgacggauga

SEQ ID NO: 3042917 - RNA, 18 nt, Mycobacterium bovis subsp bovis AF2122/97
cagaagaagaugaucgcg

SEQ ID NO: 3042918 - RNA, 21 nt, Mycobacterium bovis subsp bovis AF2122/97
cagaagaccuggcggugccgg

SEQ ID NO: 3042919 - RNA, 15 nt, Mycobacterium bovis subsp bovis AF2122/97
cagaaggaucagcgc

SEQ ID NO: 3042920 - RNA, 19 nt, Mycobacterium bovis subsp bovis AF2122/97
cagaaggaucagcgcacug

SEQ ID NO: 3042921 - RNA, 20 nt, Mycobacterium bovis subsp bovis AF2122/97
cagaaggaucagcgcacugg

SEQ ID NO: 3042922 - RNA, 13 nt, Mycobacterium bovis subsp bovis AF2122/97
cagaaggccagcg

SEQ ID NO: 3042923 - RNA, 15 nt, Mycobacterium bovis subsp bovis AF2122/97
cagaaggccgcggug

SEQ ID NO: 3042924 - RNA, 16 nt, Mycobacterium bovis subsp bovis AF2122/97
cagaaguaggcgaccg

SEQ ID NO: 3042925 - RNA, 23 nt, Mycobacterium bovis subsp bovis AF2122/97
cagaaguagguuuucggcggcuc

SEQ ID NO: 3042926 - RNA, 18 nt, Mycobacterium bovis subsp bovis AF2122/97
cagaaucaggcucgccga

SEQ ID NO: 3042927 - RNA, 21 nt, Mycobacterium bovis subsp bovis AF2122/97
cagaaucaggcucgccgaugc

SEQ ID NO: 3042928 - RNA, 14 nt, Mycobacterium bovis subsp bovis AF2122/97
cagaauccggucgg

SEQ ID NO: 3042929 - RNA, 16 nt, Mycobacterium bovis subsp bovis AF2122/97
cagaauccggucggcc

SEQ ID NO: 3042930 - RNA, 18 nt, Mycobacterium bovis subsp bovis AF2122/97
cagaauccggucggccca

SEQ ID NO: 3042931 - RNA, 20 nt, Mycobacterium bovis subsp bovis AF2122/97
cagaauccggucggcccaca

SEQ ID NO: 3042932 - RNA, 20 nt, Mycobacterium bovis subsp bovis AF2122/97
cagaauccugcgcugcacca

SEQ ID NO: 3042933 - RNA, 16 nt, Mycobacterium bovis subsp bovis AF2122/97
cagaaucgaccgccgc

SEQ ID NO: 3042934 - RNA, 20 nt, Mycobacterium bovis subsp bovis AF2122/97
cagaaucgcccauuucggca

SEQ ID NO: 3042935 - RNA, 15 nt, Mycobacterium bovis subsp bovis AF2122/97
cagaaucucgccggg

SEQ ID NO: 3042936 - RNA, 21 nt, Mycobacterium bovis subsp bovis AF2122/97
cagaaucucgccgggcugcaa

SEQ ID NO: 3042937 - RNA, 13 nt, Mycobacterium bovis subsp bovis AF2122/97
cagaaucugccuc

SEQ ID NO: 3042938 - RNA, 15 nt, Mycobacterium bovis subsp bovis AF2122/97
cagaaucugccucuc

SEQ ID NO: 3042939 - RNA, 14 nt, Mycobacterium bovis subsp bovis AF2122/97
cagaaugccuggcc

SEQ ID NO: 3042940 - RNA, 18 nt, Mycobacterium bovis subsp bovis AF2122/97
cagaaugccuggcccguc

SEQ ID NO: 3042941 - RNA, 15 nt, Mycobacterium bovis subsp bovis AF2122/97
cagaauugccggcga

SEQ ID NO: 3042942 - RNA, 17 nt, Mycobacterium bovis subsp bovis AF2122/97
cagaauugugugcagca

SEQ ID NO: 3042943 - RNA, 12 nt, Mycobacterium bovis subsp bovis AF2122/97
cagacaacaaca

SEQ ID NO: 3042944 - RNA, 16 nt, Mycobacterium bovis subsp bovis AF2122/97
cagacaauccgccgcc

SEQ ID NO: 3042945 - RNA, 13 nt, Mycobacterium bovis subsp bovis AF2122/97
cagacacagaauc

SEQ ID NO: 3042946 - RNA, 19 nt, Mycobacterium bovis subsp bovis AF2122/97
cagacacagaaucgcccau

SEQ ID NO: 3042947 - RNA, 20 nt, Mycobacterium bovis subsp bovis AF2122/97
cagacacagaaucgcccauu

SEQ ID NO: 3042948 - RNA, 14 nt, Mycobacterium bovis subsp bovis AF2122/97
cagacacagcaccg

SEQ ID NO: 3042949 - RNA, 23 nt, Mycobacterium bovis subsp bovis AF2122/97
cagacaccggcuauaucccgccc

SEQ ID NO: 3042950 - RNA, 14 nt, Mycobacterium bovis subsp bovis AF2122/97
cagacacgaccccg

SEQ ID NO: 3042951 - RNA, 13 nt, Mycobacterium bovis subsp bovis AF2122/97
cagacacgcugca

SEQ ID NO: 3042952 - RNA, 16 nt, Mycobacterium bovis subsp bovis AF2122/97
cagacacugcugcggc

SEQ ID NO: 3042953 - RNA, 17 nt, Mycobacterium bovis subsp bovis AF2122/97
cagacacuggccgucgg

SEQ ID NO: 3042954 - RNA, 16 nt, Mycobacterium bovis subsp bovis AF2122/97
cagacagcaccgccgg

SEQ ID NO: 3042955 - RNA, 14 nt, Mycobacterium bovis subsp bovis AF2122/97
cagacagcugcaca

SEQ ID NO: 3042956 - RNA, 20 nt, Mycobacterium bovis subsp bovis AF2122/97
cagacaggauugccgagcgu

SEQ ID NO: 3042957 - RNA, 17 nt, Mycobacterium bovis subsp bovis AF2122/97
cagacaggcggcggccu

SEQ ID NO: 3042958 - RNA, 23 nt, Mycobacterium bovis subsp bovis AF2122/97
cagacaggcggcggccuggcacc

SEQ ID NO: 3042959 - RNA, 15 nt, Mycobacterium bovis subsp bovis AF2122/97
cagacaucgcgacga

SEQ ID NO: 3042960 - RNA, 14 nt, Mycobacterium bovis subsp bovis AF2122/97
cagacaucugggug

SEQ ID NO: 3042961 - RNA, 15 nt, Mycobacterium bovis subsp bovis AF2122/97
cagacaugucaggcc

SEQ ID NO: 3042962 - RNA, 23 nt, Mycobacterium bovis subsp bovis AF2122/97
cagaccaagcccgucgucgugca

SEQ ID NO: 3042963 - RNA, 14 nt, Mycobacterium bovis subsp bovis AF2122/97
cagaccaaggcgaa

SEQ ID NO: 3042964 - RNA, 12 nt, Mycobacterium bovis subsp bovis AF2122/97
cagaccacaacg

SEQ ID NO: 3042965 - RNA, 13 nt, Mycobacterium bovis subsp bovis AF2122/97
cagaccacaacgc

SEQ ID NO: 3042966 - RNA, 13 nt, Mycobacterium bovis subsp bovis AF2122/97
cagaccaccgccu

SEQ ID NO: 3042967 - RNA, 15 nt, Mycobacterium bovis subsp bovis AF2122/97
cagaccaccgccugg

SEQ ID NO: 3042968 - RNA, 13 nt, Mycobacterium bovis subsp bovis AF2122/97
cagagccgccguu

SEQ ID NO: 3042969 - RNA, 19 nt, Mycobacterium bovis subsp bovis AF2122/97
cagagccgccguugccgcc

SEQ ID NO: 3042970 - RNA, 20 nt, Mycobacterium bovis subsp bovis AF2122/97
cagagccgccguugccgccg

SEQ ID NO: 3042971 - RNA, 18 nt, Mycobacterium bovis subsp bovis AF2122/97
cagagccgcgcgccgguu

SEQ ID NO: 3042972 - RNA, 17 nt, Mycobacterium bovis subsp bovis AF2122/97
cagagccgcugcggcac

SEQ ID NO: 3042973 - RNA, 18 nt, Mycobacterium bovis subsp bovis AF2122/97
cagagccgcugcggcacc

SEQ ID NO: 3042974 - RNA, 20 nt, Mycobacterium bovis subsp bovis AF2122/97
cagagccgcugcggcaccga

SEQ ID NO: 3042975 - RNA, 15 nt, Mycobacterium bovis subsp bovis AF2122/97
cagagccgggcuggc

SEQ ID NO: 3042976 - RNA, 16 nt, Mycobacterium bovis subsp bovis AF2122/97
cagagccgucaccgac

SEQ ID NO: 3042977 - RNA, 17 nt, Mycobacterium bovis subsp bovis AF2122/97
cagagcgaacccccgcc

SEQ ID NO: 3042978 - RNA, 22 nt, Mycobacterium bovis subsp bovis AF2122/97
cagagcgaacccccgccgcgca

SEQ ID NO: 3042979 - RNA, 13 nt, Mycobacterium bovis subsp bovis AF2122/97
cagagcgcugguu

SEQ ID NO: 3042980 - RNA, 23 nt, Mycobacterium bovis subsp bovis AF2122/97
cagagcgcugguuggccugccgu

SEQ ID NO: 3042981 - RNA, 14 nt, Mycobacterium bovis subsp bovis AF2122/97
cagagcggcacgca

SEQ ID NO: 3042982 - RNA, 18 nt, Mycobacterium bovis subsp bovis AF2122/97
cagagcguacaggucggc

SEQ ID NO: 3042983 - RNA, 21 nt, Mycobacterium bovis subsp bovis AF2122/97
cagagcguuccgcucgaaucg

SEQ ID NO: 3042984 - RNA, 22 nt, Mycobacterium bovis subsp bovis AF2122/97
cagagcucgaaguuggcuuucg

SEQ ID NO: 3042985 - RNA, 15 nt, Mycobacterium bovis subsp bovis AF2122/97
cagagcuucgccgcg

SEQ ID NO: 3042986 - RNA, 17 nt, Mycobacterium bovis subsp bovis AF2122/97
cagagcuucgccgcgca

SEQ ID NO: 3042987 - RNA, 14 nt, Mycobacterium bovis subsp bovis AF2122/97
cagaggacccgugc

SEQ ID NO: 3042988 - RNA, 22 nt, Mycobacterium bovis subsp bovis AF2122/97
cagaggcgcaagaaugccgccg

SEQ ID NO: 3042989 - RNA, 16 nt, Mycobacterium bovis subsp bovis AF2122/97
cagaggucacgcagca

SEQ ID NO: 3042990 - RNA, 17 nt, Mycobacterium bovis subsp bovis AF2122/97
cagaggucacgcagcac

SEQ ID NO: 3042991 - RNA, 19 nt, Mycobacterium bovis subsp bovis AF2122/97
cagaggucacgcagcaccc

SEQ ID NO: 3042992 - RNA, 19 nt, Mycobacterium bovis subsp bovis AF2122/97
cagaggucggucagccacc

SEQ ID NO: 3042993 - RNA, 12 nt, Mycobacterium bovis subsp bovis AF2122/97
cagagucaacag

SEQ ID NO: 3042994 - RNA, 14 nt, Mycobacterium bovis subsp bovis AF2122/97
cagagucaccgcgc

SEQ ID NO: 3042995 - RNA, 16 nt, Mycobacterium bovis subsp bovis AF2122/97
cagagucgcacugcgc

SEQ ID NO: 3042996 - RNA, 22 nt, Mycobacterium bovis subsp bovis AF2122/97
cagagucgcacugcgccggccg

SEQ ID NO: 3042997 - RNA, 12 nt, Mycobacterium bovis subsp bovis AF2122/97
cagagugaaucc

SEQ ID NO: 3042998 - RNA, 14 nt, Mycobacterium bovis subsp bovis AF2122/97
cagagugaggcgcu

SEQ ID NO: 3042999 - RNA, 14 nt, Mycobacterium bovis subsp bovis AF2122/97
cagaguucccugau

SEQ ID NO: 3043000 - RNA, 16 nt, Mycobacterium bovis subsp bovis AF2122/97
cagauaaggaucagaa

SEQ ID NO: 3043001 - RNA, 18 nt, Mycobacterium bovis subsp bovis AF2122/97
cagauacaggaacaacgc

SEQ ID NO: 3043002 - RNA, 16 nt, Mycobacterium bovis subsp bovis AF2122/97
cagauacaucgggauc

SEQ ID NO: 3043003 - RNA, 15 nt, Mycobacterium bovis subsp bovis AF2122/97
cagauaccaccgccg

SEQ ID NO: 3043004 - RNA, 18 nt, Mycobacterium bovis subsp bovis AF2122/97
cagauacuccgcgguugu

SEQ ID NO: 3043005 - RNA, 21 nt, Mycobacterium bovis subsp bovis AF2122/97
cagauacuuguugaagccgau

SEQ ID NO: 3043006 - RNA, 12 nt, Mycobacterium bovis subsp bovis AF2122/97
cagauagacuag

SEQ ID NO: 3043007 - RNA, 19 nt, Mycobacterium bovis subsp bovis AF2122/97
cagauagacuagccgaucc

SEQ ID NO: 3043008 - RNA, 21 nt, Mycobacterium bovis subsp bovis AF2122/97
cagauagacuagccgauccag

SEQ ID NO: 3043009 - RNA, 21 nt, Mycobacterium bovis subsp bovis AF2122/97
cagauagguuccaccgggcgu

SEQ ID NO: 3043010 - RNA, 17 nt, Mycobacterium bovis subsp bovis AF2122/97
cagauagugcauguauu

SEQ ID NO: 3043011 - RNA, 16 nt, Mycobacterium bovis subsp bovis AF2122/97
cagauagugcuccacg

SEQ ID NO: 3043012 - RNA, 21 nt, Mycobacterium bovis subsp bovis AF2122/97
cagauauuccucgucggucac

SEQ ID NO: 3043013 - RNA, 17 nt, Mycobacterium bovis subsp bovis AF2122/97
cagauauuugucggcgc

SEQ ID NO: 3043014 - RNA, 17 nt, Mycobacterium bovis subsp bovis AF2122/97
cagaucaacaucaucac

SEQ ID NO: 3043015 - RNA, 18 nt, Mycobacterium bovis subsp bovis AF2122/97
cagaucaacgcgaaccgu

SEQ ID NO: 3043016 - RNA, 20 nt, Mycobacterium bovis subsp bovis AF2122/97
cagaucaacgcgaaccgucu

SEQ ID NO: 3043017 - RNA, 14 nt, Mycobacterium bovis subsp bovis AF2122/97
cagaucaacgcguc

SEQ ID NO: 3043018 - RNA, 16 nt, Mycobacterium bovis subsp bovis AF2122/97
cagaucaacgcgucgc

SEQ ID NO: 3043019 - RNA, 13 nt, Mycobacterium bovis subsp bovis AF2122/97
cagaucaccgcca

SEQ ID NO: 3043020 - RNA, 14 nt, Mycobacterium bovis subsp bovis AF2122/97
cagaucaccgccag

SEQ ID NO: 3043021 - RNA, 22 nt, Mycobacterium bovis subsp bovis AF2122/97
cagaucacgcacucgcgucccg

SEQ ID NO: 3043022 - RNA, 13 nt, Mycobacterium bovis subsp bovis AF2122/97
cagaucagcaccg

SEQ ID NO: 3043023 - RNA, 22 nt, Mycobacterium bovis subsp bovis AF2122/97
cagaucagcaccgacagcccga

SEQ ID NO: 3043024 - RNA, 14 nt, Mycobacterium bovis subsp bovis AF2122/97
cagaucagccgccg

SEQ ID NO: 3043025 - RNA, 20 nt, Mycobacterium bovis subsp bovis AF2122/97
cagaucagcgucccggucgc

SEQ ID NO: 3043026 - RNA, 17 nt, Mycobacterium bovis subsp bovis AF2122/97
cagaucaggacgcgauc

SEQ ID NO: 3043027 - RNA, 21 nt, Mycobacterium bovis subsp bovis AF2122/97
cagauccagcaacgcggugga

SEQ ID NO: 3043028 - RNA, 23 nt, Mycobacterium bovis subsp bovis AF2122/97
cagaucccauucguagucguugg

SEQ ID NO: 3043029 - RNA, 14 nt, Mycobacterium bovis subsp bovis AF2122/97
cagauccccgccac

SEQ ID NO: 3043030 - RNA, 23 nt, Mycobacterium bovis subsp bovis AF2122/97
cagauccgccccguaaucggugg

SEQ ID NO: 3043031 - RNA, 13 nt, Mycobacterium bovis subsp bovis AF2122/97
cagauccgcgauu

SEQ ID NO: 3043032 - RNA, 14 nt, Mycobacterium bovis subsp bovis AF2122/97
cagauccuggccgg

SEQ ID NO: 3043033 - RNA, 20 nt, Mycobacterium bovis subsp bovis AF2122/97
cagaucgacgcauuccucga

SEQ ID NO: 3043034 - RNA, 14 nt, Mycobacterium bovis subsp bovis AF2122/97
cagaucgaggggga

SEQ ID NO: 3043035 - RNA, 17 nt, Mycobacterium bovis subsp bovis AF2122/97
cagaucgagggggacgc

SEQ ID NO: 3043036 - RNA, 17 nt, Mycobacterium bovis subsp bovis AF2122/97
cagaucgcacaccaaca

SEQ ID NO: 3043037 - RNA, 23 nt, Mycobacterium bovis subsp bovis AF2122/97
cagaucgcacaccaacaccgcgg

SEQ ID NO: 3043038 - RNA, 14 nt, Mycobacterium bovis subsp bovis AF2122/97
cagaucgccccagc

SEQ ID NO: 3043039 - RNA, 18 nt, Mycobacterium bovis subsp bovis AF2122/97
cagaucgccgggcuuggc

SEQ ID NO: 3043040 - RNA, 18 nt, Mycobacterium bovis subsp bovis AF2122/97
cagaucgcgguccgagcg

SEQ ID NO: 3043041 - RNA, 18 nt, Mycobacterium bovis subsp bovis AF2122/97
cagaucggcgacgccguc

SEQ ID NO: 3043042 - RNA, 19 nt, Mycobacterium bovis subsp bovis AF2122/97
cagaucggcguuggcauga

SEQ ID NO: 3043043 - RNA, 18 nt, Mycobacterium bovis subsp bovis AF2122/97
cagaucguagugcgcgcc

SEQ ID NO: 3043044 - RNA, 17 nt, Mycobacterium bovis subsp bovis AF2122/97
cagaucgucacucccga

SEQ ID NO: 3043045 - RNA, 19 nt, Mycobacterium bovis subsp bovis AF2122/97
cagaucguccaccgccgac

SEQ ID NO: 3043046 - RNA, 21 nt, Mycobacterium bovis subsp bovis AF2122/97
cagaucgucgggcaccuccaa

SEQ ID NO: 3043047 - RNA, 21 nt, Mycobacterium bovis subsp bovis AF2122/97
cagaucuccagguuccagguc

SEQ ID NO: 3043048 - RNA, 17 nt, Mycobacterium bovis subsp bovis AF2122/97
cagaucuccccgaccgc

SEQ ID NO: 3043049 - RNA, 22 nt, Mycobacterium bovis subsp bovis AF2122/97
cagaucuccccgaccgcgcccg

SEQ ID NO: 3043050 - RNA, 17 nt, Mycobacterium bovis subsp bovis AF2122/97
cagaucuggguucccga

SEQ ID NO: 3043051 - RNA, 13 nt, Mycobacterium bovis subsp bovis AF2122/97
cagaucuugcagu

SEQ ID NO: 3043052 - RNA, 19 nt, Mycobacterium bovis subsp bovis AF2122/97
cagaugaaggugacgacga

SEQ ID NO: 3043053 - RNA, 14 nt, Mycobacterium bovis subsp bovis AF2122/97
cagaugagucaaaa

SEQ ID NO: 3043054 - RNA, 15 nt, Mycobacterium bovis subsp bovis AF2122/97
cagcacaaacccagu

SEQ ID NO: 3043055 - RNA, 16 nt, Mycobacterium bovis subsp bovis AF2122/97
cagcacaaacccaguu

SEQ ID NO: 3043056 - RNA, 19 nt, Mycobacterium bovis subsp bovis AF2122/97
cagcacacccgucaugccc

SEQ ID NO: 3043057 - RNA, 13 nt, Mycobacterium bovis subsp bovis AF2122/97
cagcacaccgucg

SEQ ID NO: 3043058 - RNA, 16 nt, Mycobacterium bovis subsp bovis AF2122/97
cagcacaccgucgacg

SEQ ID NO: 3043059 - RNA, 13 nt, Mycobacterium bovis subsp bovis AF2122/97
cagcacacgacga

SEQ ID NO: 3043060 - RNA, 20 nt, Mycobacterium bovis subsp bovis AF2122/97
cagcacagcauuguccggcg

SEQ ID NO: 3043061 - RNA, 16 nt, Mycobacterium bovis subsp bovis AF2122/97
cagcacagcgcagccu

SEQ ID NO: 3043062 - RNA, 17 nt, Mycobacterium bovis subsp bovis AF2122/97
cagcacagcgcagccug

SEQ ID NO: 3043063 - RNA, 19 nt, Mycobacterium bovis subsp bovis AF2122/97
cagcacagcgcagccugca

SEQ ID NO: 3043064 - RNA, 13 nt, Mycobacterium bovis subsp bovis AF2122/97
cagcacaggcugg

SEQ ID NO: 3043065 - RNA, 14 nt, Mycobacterium bovis subsp bovis AF2122/97
cagcacaggcuggc

SEQ ID NO: 3043066 - RNA, 20 nt, Mycobacterium bovis subsp bovis AF2122/97
cagcacaggcuggcgauggc

SEQ ID NO: 3043067 - RNA, 15 nt, Mycobacterium bovis subsp bovis AF2122/97
cagcacauccagccc

SEQ ID NO: 3043068 - RNA, 16 nt, Mycobacterium bovis subsp bovis AF2122/97
cagcacauccugcagc

SEQ ID NO: 3043069 - RNA, 19 nt, Mycobacterium bovis subsp bovis AF2122/97
cagcacauccugcagcucg

SEQ ID NO: 3043070 - RNA, 22 nt, Mycobacterium bovis subsp bovis AF2122/97
cagcacauccugcagcucgggc

SEQ ID NO: 3043071 - RNA, 12 nt, Mycobacterium bovis subsp bovis AF2122/97
cagcacaucggc

SEQ ID NO: 3043072 - RNA, 17 nt, Mycobacterium bovis subsp bovis AF2122/97
cagcacauucugcagcg

SEQ ID NO: 3043073 - RNA, 22 nt, Mycobacterium bovis subsp bovis AF2122/97
cagcaccaaggucuucaggccg

SEQ ID NO: 3043074 - RNA, 18 nt, Mycobacterium bovis subsp bovis AF2122/97
cagcaccacaacgucggc

SEQ ID NO: 3043075 - RNA, 13 nt, Mycobacterium bovis subsp bovis AF2122/97
cagcaccaccagc

SEQ ID NO: 3043076 - RNA, 14 nt, Mycobacterium bovis subsp bovis AF2122/97
cagcaccaccagca

SEQ ID NO: 3043077 - RNA, 14 nt, Mycobacterium bovis subsp bovis AF2122/97
cagcaccaccgcgg

SEQ ID NO: 3043078 - RNA, 19 nt, Mycobacterium bovis subsp bovis AF2122/97
cagcaccaccgcggugugc

SEQ ID NO: 3043079 - RNA, 13 nt, Mycobacterium bovis subsp bovis AF2122/97
cagcaccacggcc

SEQ ID NO: 3043080 - RNA, 19 nt, Mycobacterium bovis subsp bovis AF2122/97
cagcaccacggccagcggg

SEQ ID NO: 3043081 - RNA, 16 nt, Mycobacterium bovis subsp bovis AF2122/97
cagcaccacgucgacg

SEQ ID NO: 3043082 - RNA, 17 nt, Mycobacterium bovis subsp bovis AF2122/97
cagcaccacgucgacga

SEQ ID NO: 3043083 - RNA, 19 nt, Mycobacterium bovis subsp bovis AF2122/97
cagcaccacgucgacgaug

SEQ ID NO: 3043084 - RNA, 11 nt, Mycobacterium bovis subsp bovis AF2122/97
cagcaccagca

SEQ ID NO: 3043085 - RNA, 12 nt, Mycobacterium bovis subsp bovis AF2122/97
cagcaccagcac

SEQ ID NO: 3043086 - RNA, 13 nt, Mycobacterium bovis subsp bovis AF2122/97
cagcaccagcacg

SEQ ID NO: 3043087 - RNA, 14 nt, Mycobacterium bovis subsp bovis AF2122/97
cagcaccagcgccu

SEQ ID NO: 3043088 - RNA, 16 nt, Mycobacterium bovis subsp bovis AF2122/97
cagcaccagcgccuug

SEQ ID NO: 3043089 - RNA, 17 nt, Mycobacterium bovis subsp bovis AF2122/97
cagcaccagcgccuuga

SEQ ID NO: 3043090 - RNA, 19 nt, Mycobacterium bovis subsp bovis AF2122/97
cagcaccagggcgcggauc

SEQ ID NO: 3043091 - RNA, 19 nt, Mycobacterium bovis subsp bovis AF2122/97
cagcaccaggguggcccgg

SEQ ID NO: 3043092 - RNA, 22 nt, Mycobacterium bovis subsp bovis AF2122/97
cagcaccaguguggcgaugacc

SEQ ID NO: 3043093 - RNA, 18 nt, Mycobacterium bovis subsp bovis AF2122/97
cagcacccaacccggcgg

SEQ ID NO: 3043094 - RNA, 22 nt, Mycobacterium bovis subsp bovis AF2122/97
cagcacccaauacacccaacuc

SEQ ID NO: 3043095 - RNA, 18 nt, Mycobacterium bovis subsp bovis AF2122/97
cagcacccaaugccaccg

SEQ ID NO: 3043096 - RNA, 20 nt, Mycobacterium bovis subsp bovis AF2122/97
cagcacccaaugccaccgcg

SEQ ID NO: 3043097 - RNA, 13 nt, Mycobacterium bovis subsp bovis AF2122/97
cagcacccacauc

SEQ ID NO: 3043098 - RNA, 14 nt, Mycobacterium bovis subsp bovis AF2122/97
cagcacccacauca

SEQ ID NO: 3043099 - RNA, 23 nt, Mycobacterium bovis subsp bovis AF2122/97
cagcacccaccgaagcgaacggc

SEQ ID NO: 3043100 - RNA, 14 nt, Mycobacterium bovis subsp bovis AF2122/97
cagcacccacgccg

SEQ ID NO: 3043101 - RNA, 22 nt, Mycobacterium bovis subsp bovis AF2122/97
cagcacccacgccgguggcacg

SEQ ID NO: 3043102 - RNA, 16 nt, Mycobacterium bovis subsp bovis AF2122/97
cagcacccagacgaug

SEQ ID NO: 3043103 - RNA, 18 nt, Mycobacterium bovis subsp bovis AF2122/97
cagcacccagacgauggc

SEQ ID NO: 3043104 - RNA, 15 nt, Mycobacterium bovis subsp bovis AF2122/97
cagcacccauacggc

SEQ ID NO: 3043105 - RNA, 16 nt, Mycobacterium bovis subsp bovis AF2122/97
cagcaccccauggcca

SEQ ID NO: 3043106 - RNA, 19 nt, Mycobacterium bovis subsp bovis AF2122/97
cagcaccccauggccaccg

SEQ ID NO: 3043107 - RNA, 19 nt, Mycobacterium bovis subsp bovis AF2122/97
cagcacccccugcaccguc

SEQ ID NO: 3043108 - RNA, 18 nt, Mycobacterium bovis subsp bovis AF2122/97
cagcaccccgccgggggc

SEQ ID NO: 3043109 - RNA, 13 nt, Mycobacterium bovis subsp bovis AF2122/97
cagcacccgagcg

SEQ ID NO: 3043110 - RNA, 17 nt, Mycobacterium bovis subsp bovis AF2122/97
cagcacccgagcgaugc

SEQ ID NO: 3043111 - RNA, 14 nt, Mycobacterium bovis subsp bovis AF2122/97
cagcacccgcacgg

SEQ ID NO: 3043112 - RNA, 15 nt, Mycobacterium bovis subsp bovis AF2122/97
cagcacccgcagccg

SEQ ID NO: 3043113 - RNA, 13 nt, Mycobacterium bovis subsp bovis AF2122/97
cagcacccgcgcc

SEQ ID NO: 3043114 - RNA, 16 nt, Mycobacterium bovis subsp bovis AF2122/97
cagcacccgcgcgacg

SEQ ID NO: 3043115 - RNA, 16 nt, Mycobacterium bovis subsp bovis AF2122/97
cagcacccgcuccagc

SEQ ID NO: 3043116 - RNA, 17 nt, Mycobacterium bovis subsp bovis AF2122/97
cagcacccgcuccagcu

SEQ ID NO: 3043117 - RNA, 18 nt, Mycobacterium bovis subsp bovis AF2122/97
cagcacccgcucggccgc

SEQ ID NO: 3043118 - RNA, 19 nt, Mycobacterium bovis subsp bovis AF2122/97
cagcacccgcucggccgcc

SEQ ID NO: 3043119 - RNA, 12 nt, Mycobacterium bovis subsp bovis AF2122/97
cagcacccggcu

SEQ ID NO: 3043120 - RNA, 15 nt, Mycobacterium bovis subsp bovis AF2122/97
cagcacccggcuucg

SEQ ID NO: 3043121 - RNA, 22 nt, Mycobacterium bovis subsp bovis AF2122/97
cagcacccgggccacgucgagc

SEQ ID NO: 3043122 - RNA, 21 nt, Mycobacterium bovis subsp bovis AF2122/97
cagcacccugaugugagucca

SEQ ID NO: 3043123 - RNA, 20 nt, Mycobacterium bovis subsp bovis AF2122/97
cagcacccugcgggccgaga

SEQ ID NO: 3043124 - RNA, 19 nt, Mycobacterium bovis subsp bovis AF2122/97
cagcaccgaacccgccacc

SEQ ID NO: 3043125 - RNA, 20 nt, Mycobacterium bovis subsp bovis AF2122/97
cagcaccgaacccgccaccg

SEQ ID NO: 3043126 - RNA, 15 nt, Mycobacterium bovis subsp bovis AF2122/97
cagcaccgacgugau

SEQ ID NO: 3043127 - RNA, 16 nt, Mycobacterium bovis subsp bovis AF2122/97
cagcaccgcagcgacc

SEQ ID NO: 3043128 - RNA, 11 nt, Mycobacterium bovis subsp bovis AF2122/97
cagcaccgccg

SEQ ID NO: 3043129 - RNA, 13 nt, Mycobacterium bovis subsp bovis AF2122/97
cagcaccgccgcg

SEQ ID NO: 3043130 - RNA, 14 nt, Mycobacterium bovis subsp bovis AF2122/97
cagcaccgccgcgc

SEQ ID NO: 3043131 - RNA, 15 nt, Mycobacterium bovis subsp bovis AF2122/97
cagcaccgccgcgcc

SEQ ID NO: 3043132 - RNA, 18 nt, Mycobacterium bovis subsp bovis AF2122/97
cagcaccgccgcgccggc

SEQ ID NO: 3043133 - RNA, 20 nt, Mycobacterium bovis subsp bovis AF2122/97
cagcaccgccgcgccggcgg

SEQ ID NO: 3043134 - RNA, 14 nt, Mycobacterium bovis subsp bovis AF2122/97
cagcaccgccgcug

SEQ ID NO: 3043135 - RNA, 17 nt, Mycobacterium bovis subsp bovis AF2122/97
cagcaccgccgcugcca

SEQ ID NO: 3043136 - RNA, 15 nt, Mycobacterium bovis subsp bovis AF2122/97
cagcaccgccggcga

SEQ ID NO: 3043137 - RNA, 16 nt, Mycobacterium bovis subsp bovis AF2122/97
cagcaccgcgaccauc

SEQ ID NO: 3043138 - RNA, 13 nt, Mycobacterium bovis subsp bovis AF2122/97
cagcaccgcgacg

SEQ ID NO: 3043139 - RNA, 15 nt, Mycobacterium bovis subsp bovis AF2122/97
cagcaccgcgacgac

SEQ ID NO: 3043140 - RNA, 21 nt, Mycobacterium bovis subsp bovis AF2122/97
cagcaccgcgacgacgagguc

SEQ ID NO: 3043141 - RNA, 15 nt, Mycobacterium bovis subsp bovis AF2122/97
cagcagaccaagucc

SEQ ID NO: 3043142 - RNA, 20 nt, Mycobacterium bovis subsp bovis AF2122/97
cagcagaccaaguccggucg

SEQ ID NO: 3043143 - RNA, 23 nt, Mycobacterium bovis subsp bovis AF2122/97
cagcagaccaaguccggucgcgg

SEQ ID NO: 3043144 - RNA, 22 nt, Mycobacterium bovis subsp bovis AF2122/97
cagcagacgacgaucagcccca

SEQ ID NO: 3043145 - RNA, 14 nt, Mycobacterium bovis subsp bovis AF2122/97
cagcagagccccgg

SEQ ID NO: 3043146 - RNA, 14 nt, Mycobacterium bovis subsp bovis AF2122/97
cagcagagcggcac

SEQ ID NO: 3043147 - RNA, 19 nt, Mycobacterium bovis subsp bovis AF2122/97
cagcagagcggcacgcacg

SEQ ID NO: 3043148 - RNA, 20 nt, Mycobacterium bovis subsp bovis AF2122/97
cagcagagcggcacgcacgc

SEQ ID NO: 3043149 - RNA, 19 nt, Mycobacterium bovis subsp bovis AF2122/97
cagcagauuaccgagcugg

SEQ ID NO: 3043150 - RNA, 17 nt, Mycobacterium bovis subsp bovis AF2122/97
cagcagauugaugucag

SEQ ID NO: 3043151 - RNA, 13 nt, Mycobacterium bovis subsp bovis AF2122/97
cagcagauugucg

SEQ ID NO: 3043152 - RNA, 16 nt, Mycobacterium bovis subsp bovis AF2122/97
cagcagcaaccgccau

SEQ ID NO: 3043153 - RNA, 11 nt, Mycobacterium bovis subsp bovis AF2122/97
cagcagcaacg

SEQ ID NO: 3043154 - RNA, 17 nt, Mycobacterium bovis subsp bovis AF2122/97
cagcagcaacgcggugc

SEQ ID NO: 3043155 - RNA, 18 nt, Mycobacterium bovis subsp bovis AF2122/97
cagcagcaaugcgguacc

SEQ ID NO: 3043156 - RNA, 17 nt, Mycobacterium bovis subsp bovis AF2122/97
cagcagcaccgcgacca

SEQ ID NO: 3043157 - RNA, 10 nt, Mycobacterium bovis subsp bovis AF2122/97
cagcagcacu

SEQ ID NO: 3043158 - RNA, 19 nt, Mycobacterium bovis subsp bovis AF2122/97
cagcagcacuccggcgacg

SEQ ID NO: 3043159 - RNA, 21 nt, Mycobacterium bovis subsp bovis AF2122/97
cagcagcacuccggcgacgau

SEQ ID NO: 3043160 - RNA, 17 nt, Mycobacterium bovis subsp bovis AF2122/97
cagcagcagauccuggc

SEQ ID NO: 3043161 - RNA, 14 nt, Mycobacterium bovis subsp bovis AF2122/97
cagcagcagcgccg

SEQ ID NO: 3043162 - RNA, 16 nt, Mycobacterium bovis subsp bovis AF2122/97
cagcagcagcgccgcg

SEQ ID NO: 3043163 - RNA, 14 nt, Mycobacterium bovis subsp bovis AF2122/97
cagcagcagcguga

SEQ ID NO: 3043164 - RNA, 15 nt, Mycobacterium bovis subsp bovis AF2122/97
cagcagcauccggcc

SEQ ID NO: 3043165 - RNA, 14 nt, Mycobacterium bovis subsp bovis AF2122/97
cagcagcaucggca

SEQ ID NO: 3043166 - RNA, 23 nt, Mycobacterium bovis subsp bovis AF2122/97
cagcagcaucggcacgucguugg

SEQ ID NO: 3043167 - RNA, 14 nt, Mycobacterium bovis subsp bovis AF2122/97
cagcagccacccga

SEQ ID NO: 3043168 - RNA, 14 nt, Mycobacterium bovis subsp bovis AF2122/97
cagcagccaggagc

SEQ ID NO: 3043169 - RNA, 20 nt, Mycobacterium bovis subsp bovis AF2122/97
cagcagcccccgcugaccgu

SEQ ID NO: 3043170 - RNA, 20 nt, Mycobacterium bovis subsp bovis AF2122/97
cagcagcccgacaguggucc

SEQ ID NO: 3043171 - RNA, 16 nt, Mycobacterium bovis subsp bovis AF2122/97
cagcagcccgggcagc

SEQ ID NO: 3043172 - RNA, 21 nt, Mycobacterium bovis subsp bovis AF2122/97
cagcagcccgggcagccccuc

SEQ ID NO: 3043173 - RNA, 12 nt, Mycobacterium bovis subsp bovis AF2122/97
cagcagccgccg

SEQ ID NO: 3043174 - RNA, 13 nt, Mycobacterium bovis subsp bovis AF2122/97
cagcagccgccgg

SEQ ID NO: 3043175 - RNA, 16 nt, Mycobacterium bovis subsp bovis AF2122/97
cagcagccgccggccg

SEQ ID NO: 3043176 - RNA, 17 nt, Mycobacterium bovis subsp bovis AF2122/97
cagcagccgccggccgg

SEQ ID NO: 3043177 - RNA, 22 nt, Mycobacterium bovis subsp bovis AF2122/97
cagcagccgccggccggcaucc

SEQ ID NO: 3043178 - RNA, 18 nt, Mycobacterium bovis subsp bovis AF2122/97
cagcagccgcgacgcggc

SEQ ID NO: 3043179 - RNA, 20 nt, Mycobacterium bovis subsp bovis AF2122/97
cagcagccgcgacgcggcgu

SEQ ID NO: 3043180 - RNA, 13 nt, Mycobacterium bovis subsp bovis AF2122/97
cagcagccggcgg

SEQ ID NO: 3043181 - RNA, 19 nt, Mycobacterium bovis subsp bovis AF2122/97
cagcagccugcgccgcgcg

SEQ ID NO: 3043182 - RNA, 22 nt, Mycobacterium bovis subsp bovis AF2122/97
cagcagcgaaaaccgucgcaga

SEQ ID NO: 3043183 - RNA, 13 nt, Mycobacterium bovis subsp bovis AF2122/97
cagcagcgacggu

SEQ ID NO: 3043184 - RNA, 15 nt, Mycobacterium bovis subsp bovis AF2122/97
cagcagcgacgguca

SEQ ID NO: 3043185 - RNA, 16 nt, Mycobacterium bovis subsp bovis AF2122/97
cagcagcgacuccagc

SEQ ID NO: 3043186 - RNA, 19 nt, Mycobacterium bovis subsp bovis AF2122/97
cagcagcgacuccagcgcc

SEQ ID NO: 3043187 - RNA, 22 nt, Mycobacterium bovis subsp bovis AF2122/97
cagcagcgacuccagcgcccgg

SEQ ID NO: 3043188 - RNA, 22 nt, Mycobacterium bovis subsp bovis AF2122/97
cagcagcgagucgaaugucccg

SEQ ID NO: 3043189 - RNA, 14 nt, Mycobacterium bovis subsp bovis AF2122/97
cagcagcgcaacca

SEQ ID NO: 3043190 - RNA, 18 nt, Mycobacterium bovis subsp bovis AF2122/97
cagcagcgcaacggccag

SEQ ID NO: 3043191 - RNA, 22 nt, Mycobacterium bovis subsp bovis AF2122/97
cagcagcgcaacggccagcgcu

SEQ ID NO: 3043192 - RNA, 13 nt, Mycobacterium bovis subsp bovis AF2122/97
cagcagcgccgcg

SEQ ID NO: 3043193 - RNA, 15 nt, Mycobacterium bovis subsp bovis AF2122/97
cagcagcgccgcgcg

SEQ ID NO: 3043194 - RNA, 14 nt, Mycobacterium bovis subsp bovis AF2122/97
cagcagcgcgacaa

SEQ ID NO: 3043195 - RNA, 13 nt, Mycobacterium bovis subsp bovis AF2122/97
cagcagcggcgac

SEQ ID NO: 3043196 - RNA, 16 nt, Mycobacterium bovis subsp bovis AF2122/97
cagcagcggcgaccgc

SEQ ID NO: 3043197 - RNA, 15 nt, Mycobacterium bovis subsp bovis AF2122/97
cagcagcggcgagcc

SEQ ID NO: 3043198 - RNA, 22 nt, Mycobacterium bovis subsp bovis AF2122/97
cagcagcggcggaaggacggca

SEQ ID NO: 3043199 - RNA, 14 nt, Mycobacterium bovis subsp bovis AF2122/97
cagcagcggcggcg

SEQ ID NO: 3043200 - RNA, 21 nt, Mycobacterium bovis subsp bovis AF2122/97
cagcagcggcucuauccggcg

SEQ ID NO: 3043201 - RNA, 14 nt, Mycobacterium bovis subsp bovis AF2122/97
cagcagcgggccga

SEQ ID NO: 3043202 - RNA, 22 nt, Mycobacterium bovis subsp bovis AF2122/97
cagcagcgggccgaagccccga

SEQ ID NO: 3043203 - RNA, 17 nt, Mycobacterium bovis subsp bovis AF2122/97
cagcagcgggcgcgcua

SEQ ID NO: 3043204 - RNA, 15 nt, Mycobacterium bovis subsp bovis AF2122/97
cagcagcgggcuggc

SEQ ID NO: 3043205 - RNA, 18 nt, Mycobacterium bovis subsp bovis AF2122/97
cagcagcggugcagcccg

SEQ ID NO: 3043206 - RNA, 21 nt, Mycobacterium bovis subsp bovis AF2122/97
cagcagcgguugaugcggccg

SEQ ID NO: 3043207 - RNA, 23 nt, Mycobacterium bovis subsp bovis AF2122/97
cagcagcgguugaugcggccgcg

SEQ ID NO: 3043208 - RNA, 15 nt, Mycobacterium bovis subsp bovis AF2122/97
cagcagcgucaucag

SEQ ID NO: 3043209 - RNA, 15 nt, Mycobacterium bovis subsp bovis AF2122/97
cagcagcgucggugc

SEQ ID NO: 3043210 - RNA, 21 nt, Mycobacterium bovis subsp bovis AF2122/97
cagcagcgucggugccaccac

SEQ ID NO: 3043211 - RNA, 22 nt, Mycobacterium bovis subsp bovis AF2122/97
cagcagcgucggugccaccacg

SEQ ID NO: 3043212 - RNA, 23 nt, Mycobacterium bovis subsp bovis AF2122/97
cagcagcgucggugccaccacgc

SEQ ID NO: 3043213 - RNA, 19 nt, Mycobacterium bovis subsp bovis AF2122/97
cagcagcgugaccaccgcc

SEQ ID NO: 3043214 - RNA, 14 nt, Mycobacterium bovis subsp bovis AF2122/97
cagcagcguucggu

SEQ ID NO: 3043215 - RNA, 20 nt, Mycobacterium bovis subsp bovis AF2122/97
cagcagcuccacuggcgucu

SEQ ID NO: 3043216 - RNA, 20 nt, Mycobacterium bovis subsp bovis AF2122/97
cagcagcucgccggcacgca

SEQ ID NO: 3043217 - RNA, 17 nt, Mycobacterium bovis subsp bovis AF2122/97
cagcagcucggccgagg

SEQ ID NO: 3043218 - RNA, 19 nt, Mycobacterium bovis subsp bovis AF2122/97
cagcagcucguugaugcgg

SEQ ID NO: 3043219 - RNA, 20 nt, Mycobacterium bovis subsp bovis AF2122/97
cagcagcucguugaugcggc

SEQ ID NO: 3043220 - RNA, 21 nt, Mycobacterium bovis subsp bovis AF2122/97
cagcagcugaaaauaggccgg

SEQ ID NO: 3043221 - RNA, 18 nt, Mycobacterium bovis subsp bovis AF2122/97
cagcagcuguuggcgugg

SEQ ID NO: 3043222 - RNA, 19 nt, Mycobacterium bovis subsp bovis AF2122/97
cagcagcuugacaucgguc

SEQ ID NO: 3043223 - RNA, 15 nt, Mycobacterium bovis subsp bovis AF2122/97
cagcaggaccaacgc

SEQ ID NO: 3043224 - RNA, 14 nt, Mycobacterium bovis subsp bovis AF2122/97
cagcaggacgauga

SEQ ID NO: 3043225 - RNA, 13 nt, Mycobacterium bovis subsp bovis AF2122/97
cagcaggagauca

SEQ ID NO: 3043226 - RNA, 13 nt, Mycobacterium bovis subsp bovis AF2122/97
cagcaggaucggc

SEQ ID NO: 3043227 - RNA, 17 nt, Mycobacterium bovis subsp bovis AF2122/97
cagcaggaucggcagca

SEQ ID NO: 3043228 - RNA, 18 nt, Mycobacterium bovis subsp bovis AF2122/97
cagcaugacaccggccac

SEQ ID NO: 3043229 - RNA, 23 nt, Mycobacterium bovis subsp bovis AF2122/97
cagcaugacaccggccaccagcc

SEQ ID NO: 3043230 - RNA, 22 nt, Mycobacterium bovis subsp bovis AF2122/97
cagcaugauccgcucguggucg

SEQ ID NO: 3043231 - RNA, 14 nt, Mycobacterium bovis subsp bovis AF2122/97
cagcaugcccgcca

SEQ ID NO: 3043232 - RNA, 19 nt, Mycobacterium bovis subsp bovis AF2122/97
cagcaugcccgccauccga

SEQ ID NO: 3043233 - RNA, 14 nt, Mycobacterium bovis subsp bovis AF2122/97
cagcaugccuucgg

SEQ ID NO: 3043234 - RNA, 16 nt, Mycobacterium bovis subsp bovis AF2122/97
cagcaugccuucggcc

SEQ ID NO: 3043235 - RNA, 15 nt, Mycobacterium bovis subsp bovis AF2122/97
cagcaugggaauccg

SEQ ID NO: 3043236 - RNA, 17 nt, Mycobacterium bovis subsp bovis AF2122/97
cagcaugguccacagcc

SEQ ID NO: 3043237 - RNA, 19 nt, Mycobacterium bovis subsp bovis AF2122/97
cagcauggugcggcggcgu

SEQ ID NO: 3043238 - RNA, 20 nt, Mycobacterium bovis subsp bovis AF2122/97
cagcauggugcggcggcguc

SEQ ID NO: 3043239 - RNA, 13 nt, Mycobacterium bovis subsp bovis AF2122/97
cagcaugguggac

SEQ ID NO: 3043240 - RNA, 15 nt, Mycobacterium bovis subsp bovis AF2122/97
cagcaugguggacga

SEQ ID NO: 3043241 - RNA, 17 nt, Mycobacterium bovis subsp bovis AF2122/97
cagcaugguggacgagg

SEQ ID NO: 3043242 - RNA, 21 nt, Mycobacterium bovis subsp bovis AF2122/97
cagcaugguggacgaggcggu

SEQ ID NO: 3043243 - RNA, 23 nt, Mycobacterium bovis subsp bovis AF2122/97
cagcaugguggacgaggcggucg

SEQ ID NO: 3043244 - RNA, 20 nt, Mycobacterium bovis subsp bovis AF2122/97
cagcaugguuagcggugaug

SEQ ID NO: 3043245 - RNA, 13 nt, Mycobacterium bovis subsp bovis AF2122/97
cagcaugucgcgg

SEQ ID NO: 3043246 - RNA, 23 nt, Mycobacterium bovis subsp bovis AF2122/97
cagcaugucgggccgcucgaaau

SEQ ID NO: 3043247 - RNA, 17 nt, Mycobacterium bovis subsp bovis AF2122/97
cagcaugucucgggcgc

SEQ ID NO: 3043248 - RNA, 21 nt, Mycobacterium bovis subsp bovis AF2122/97
cagcaugucucgggcgcgggu

SEQ ID NO: 3043249 - RNA, 22 nt, Mycobacterium bovis subsp bovis AF2122/97
cagcaugucucgggcgcgggug

SEQ ID NO: 3043250 - RNA, 16 nt, Mycobacterium bovis subsp bovis AF2122/97
cagcauguggccgccg

SEQ ID NO: 3043251 - RNA, 18 nt, Mycobacterium bovis subsp bovis AF2122/97
cagcauuagccaggcccg

SEQ ID NO: 3043252 - RNA, 21 nt, Mycobacterium bovis subsp bovis AF2122/97
cagcauuagccaggcccggcu

SEQ ID NO: 3043253 - RNA, 13 nt, Mycobacterium bovis subsp bovis AF2122/97
cagcauucaccaa

SEQ ID NO: 3043254 - RNA, 18 nt, Mycobacterium bovis subsp bovis AF2122/97
cagcauucucgccgacgg

SEQ ID NO: 3043255 - RNA, 16 nt, Mycobacterium bovis subsp bovis AF2122/97
cagcauugaagaagcc

SEQ ID NO: 3043256 - RNA, 15 nt, Mycobacterium bovis subsp bovis AF2122/97
cagccaaaucagcca

SEQ ID NO: 3043257 - RNA, 17 nt, Mycobacterium bovis subsp bovis AF2122/97
cagccaaaucagccagg

SEQ ID NO: 3043258 - RNA, 14 nt, Mycobacterium bovis subsp bovis AF2122/97
cagccaaccggcgc

SEQ ID NO: 3043259 - RNA, 16 nt, Mycobacterium bovis subsp bovis AF2122/97
cagccaaccguccggg

SEQ ID NO: 3043260 - RNA, 15 nt, Mycobacterium bovis subsp bovis AF2122/97
cagccaacgcguccc

SEQ ID NO: 3043261 - RNA, 16 nt, Mycobacterium bovis subsp bovis AF2122/97
cagccaacucaggccg

SEQ ID NO: 3043262 - RNA, 17 nt, Mycobacterium bovis subsp bovis AF2122/97
cagccacagcccggcgg

SEQ ID NO: 3043263 - RNA, 14 nt, Mycobacterium bovis subsp bovis AF2122/97
cagccacagccgac

SEQ ID NO: 3043264 - RNA, 17 nt, Mycobacterium bovis subsp bovis AF2122/97
cagccacagccgaccuc

SEQ ID NO: 3043265 - RNA, 23 nt, Mycobacterium bovis subsp bovis AF2122/97
cagccacauacaggcccgccagc

SEQ ID NO: 3043266 - RNA, 21 nt, Mycobacterium bovis subsp bovis AF2122/97
cagccaccacaucgcgggcgu

SEQ ID NO: 3043267 - RNA, 13 nt, Mycobacterium bovis subsp bovis AF2122/97
cagccaccaccag

SEQ ID NO: 3043268 - RNA, 16 nt, Mycobacterium bovis subsp bovis AF2122/97
cagccaccaccagguc

SEQ ID NO: 3043269 - RNA, 18 nt, Mycobacterium bovis subsp bovis AF2122/97
cagccaccaccaggucgg

SEQ ID NO: 3043270 - RNA, 12 nt, Mycobacterium bovis subsp bovis AF2122/97
cagccaccagcc

SEQ ID NO: 3043271 - RNA, 15 nt, Mycobacterium bovis subsp bovis AF2122/97
cagccaccagcgacg

SEQ ID NO: 3043272 - RNA, 14 nt, Mycobacterium bovis subsp bovis AF2122/97
cagccaccaucugg

SEQ ID NO: 3043273 - RNA, 15 nt, Mycobacterium bovis subsp bovis AF2122/97
cagccaccgcaugug

SEQ ID NO: 3043274 - RNA, 18 nt, Mycobacterium bovis subsp bovis AF2122/97
cagccaccgcauguggga

SEQ ID NO: 3043275 - RNA, 13 nt, Mycobacterium bovis subsp bovis AF2122/97
cagccaccgcggu

SEQ ID NO: 3043276 - RNA, 17 nt, Mycobacterium bovis subsp bovis AF2122/97
cagccaccgcggucagc

SEQ ID NO: 3043277 - RNA, 19 nt, Mycobacterium bovis subsp bovis AF2122/97
cagccaccgcggucagcuc

SEQ ID NO: 3043278 - RNA, 14 nt, Mycobacterium bovis subsp bovis AF2122/97
cagccaccgggcgu

SEQ ID NO: 3043279 - RNA, 22 nt, Mycobacterium bovis subsp bovis AF2122/97
cagccaccgggcgugcggcggc

SEQ ID NO: 3043280 - RNA, 16 nt, Mycobacterium bovis subsp bovis AF2122/97
cagccaccgucaugcc

SEQ ID NO: 3043281 - RNA, 22 nt, Mycobacterium bovis subsp bovis AF2122/97
cagccacgaacugaucgaccgc

SEQ ID NO: 3043282 - RNA, 23 nt, Mycobacterium bovis subsp bovis AF2122/97
cagccacgaacugaucgaccgcc

SEQ ID NO: 3043283 - RNA, 15 nt, Mycobacterium bovis subsp bovis AF2122/97
cagccacgcaaauac

SEQ ID NO: 3043284 - RNA, 15 nt, Mycobacterium bovis subsp bovis AF2122/97
cagccacgcacaaua

SEQ ID NO: 3043285 - RNA, 15 nt, Mycobacterium bovis subsp bovis AF2122/97
cagccacgccacguc

SEQ ID NO: 3043286 - RNA, 16 nt, Mycobacterium bovis subsp bovis AF2122/97
cagccacgcugucccg

SEQ ID NO: 3043287 - RNA, 18 nt, Mycobacterium bovis subsp bovis AF2122/97
cagccacgcugucccgcg

SEQ ID NO: 3043288 - RNA, 22 nt, Mycobacterium bovis subsp bovis AF2122/97
cagccacggguagcugccgcgg

SEQ ID NO: 3043289 - RNA, 23 nt, Mycobacterium bovis subsp bovis AF2122/97
cagccacggguagcugccgcggc

SEQ ID NO: 3043290 - RNA, 20 nt, Mycobacterium bovis subsp bovis AF2122/97
cagccacguagacaaggcca

SEQ ID NO: 3043291 - RNA, 21 nt, Mycobacterium bovis subsp bovis AF2122/97
cagccacguagacaaggccaa

SEQ ID NO: 3043292 - RNA, 23 nt, Mycobacterium bovis subsp bovis AF2122/97
cagccacguagacaaggccaagc

SEQ ID NO: 3043293 - RNA, 14 nt, Mycobacterium bovis subsp bovis AF2122/97
cagccacgucuccu

SEQ ID NO: 3043294 - RNA, 15 nt, Mycobacterium bovis subsp bovis AF2122/97
cagccacucgccacu

SEQ ID NO: 3043295 - RNA, 20 nt, Mycobacterium bovis subsp bovis AF2122/97
cagccacucgccacucagcc

SEQ ID NO: 3043296 - RNA, 15 nt, Mycobacterium bovis subsp bovis AF2122/97
cagccagaccaacau

SEQ ID NO: 3043297 - RNA, 15 nt, Mycobacterium bovis subsp bovis AF2122/97
cagccagaucuccag

SEQ ID NO: 3043298 - RNA, 17 nt, Mycobacterium bovis subsp bovis AF2122/97
cagccagaucuccccga

SEQ ID NO: 3043299 - RNA, 20 nt, Mycobacterium bovis subsp bovis AF2122/97
cagccagaucuccccgaccg

SEQ ID NO: 3043300 - RNA, 14 nt, Mycobacterium bovis subsp bovis AF2122/97
cagccagaugccgg

SEQ ID NO: 3043301 - RNA, 16 nt, Mycobacterium bovis subsp bovis AF2122/97
cagccagaugccggua

SEQ ID NO: 3043302 - RNA, 12 nt, Mycobacterium bovis subsp bovis AF2122/97
cagccagcaaca

SEQ ID NO: 3043303 - RNA, 11 nt, Mycobacterium bovis subsp bovis AF2122/97
cagccagcaag

SEQ ID NO: 3043304 - RNA, 12 nt, Mycobacterium bovis subsp bovis AF2122/97
cagccagcaagu

SEQ ID NO: 3043305 - RNA, 12 nt, Mycobacterium bovis subsp bovis AF2122/97
cagccagccacc

SEQ ID NO: 3043306 - RNA, 13 nt, Mycobacterium bovis subsp bovis AF2122/97
cagccagccaccg

SEQ ID NO: 3043307 - RNA, 14 nt, Mycobacterium bovis subsp bovis AF2122/97
cagccagccaccga

SEQ ID NO: 3043308 - RNA, 14 nt, Mycobacterium bovis subsp bovis AF2122/97
cagccagcccagcc

SEQ ID NO: 3043309 - RNA, 16 nt, Mycobacterium bovis subsp bovis AF2122/97
cagccagcccagccgc

SEQ ID NO: 3043310 - RNA, 18 nt, Mycobacterium bovis subsp bovis AF2122/97
cagccagcccagccgcca

SEQ ID NO: 3043311 - RNA, 22 nt, Mycobacterium bovis subsp bovis AF2122/97
cagccagcccaggguguccguc

SEQ ID NO: 3043312 - RNA, 13 nt, Mycobacterium bovis subsp bovis AF2122/97
cagccagccgccc

SEQ ID NO: 3043313 - RNA, 13 nt, Mycobacterium bovis subsp bovis AF2122/97
cagccagccgcga

SEQ ID NO: 3043314 - RNA, 12 nt, Mycobacterium bovis subsp bovis AF2122/97
cagccagccgga

SEQ ID NO: 3043315 - RNA, 16 nt, Mycobacterium bovis subsp bovis AF2122/97
cagcccgcccaaugcg

SEQ ID NO: 3043316 - RNA, 16 nt, Mycobacterium bovis subsp bovis AF2122/97
cagcccgccgaucggg

SEQ ID NO: 3043317 - RNA, 22 nt, Mycobacterium bovis subsp bovis AF2122/97
cagcccgccggacccgcccuug

SEQ ID NO: 3043318 - RNA, 14 nt, Mycobacterium bovis subsp bovis AF2122/97
cagcccgccggcgu

SEQ ID NO: 3043319 - RNA, 13 nt, Mycobacterium bovis subsp bovis AF2122/97
cagcccgcgcagc

SEQ ID NO: 3043320 - RNA, 14 nt, Mycobacterium bovis subsp bovis AF2122/97
cagcccgcgcagca

SEQ ID NO: 3043321 - RNA, 16 nt, Mycobacterium bovis subsp bovis AF2122/97
cagcccgcgcagcggu

SEQ ID NO: 3043322 - RNA, 19 nt, Mycobacterium bovis subsp bovis AF2122/97
cagcccggaacccgagccg

SEQ ID NO: 3043323 - RNA, 22 nt, Mycobacterium bovis subsp bovis AF2122/97
cagcccggacguaggcaccccg

SEQ ID NO: 3043324 - RNA, 23 nt, Mycobacterium bovis subsp bovis AF2122/97
cagcccggacguaggcaccccgg

SEQ ID NO: 3043325 - RNA, 13 nt, Mycobacterium bovis subsp bovis AF2122/97
cagcccggccgcc

SEQ ID NO: 3043326 - RNA, 14 nt, Mycobacterium bovis subsp bovis AF2122/97
cagcccggccgccg

SEQ ID NO: 3043327 - RNA, 18 nt, Mycobacterium bovis subsp bovis AF2122/97
cagcccggccgccgagga

SEQ ID NO: 3043328 - RNA, 12 nt, Mycobacterium bovis subsp bovis AF2122/97
cagcccggccgg

SEQ ID NO: 3043329 - RNA, 18 nt, Mycobacterium bovis subsp bovis AF2122/97
cagcccggccggucgaga

SEQ ID NO: 3043330 - RNA, 20 nt, Mycobacterium bovis subsp bovis AF2122/97
cagcccggccggucgagacg

SEQ ID NO: 3043331 - RNA, 16 nt, Mycobacterium bovis subsp bovis AF2122/97
cagcccggccuugccg

SEQ ID NO: 3043332 - RNA, 20 nt, Mycobacterium bovis subsp bovis AF2122/97
cagcccggccuugccgccgg

SEQ ID NO: 3043333 - RNA, 23 nt, Mycobacterium bovis subsp bovis AF2122/97
cagcccggccuugccgccggccc

SEQ ID NO: 3043334 - RNA, 12 nt, Mycobacterium bovis subsp bovis AF2122/97
cagcccggcgac

SEQ ID NO: 3043335 - RNA, 13 nt, Mycobacterium bovis subsp bovis AF2122/97
cagcccggcgacg

SEQ ID NO: 3043336 - RNA, 14 nt, Mycobacterium bovis subsp bovis AF2122/97
cagcccggcgacga

SEQ ID NO: 3043337 - RNA, 16 nt, Mycobacterium bovis subsp bovis AF2122/97
cagcccggcgacgacc

SEQ ID NO: 3043338 - RNA, 20 nt, Mycobacterium bovis subsp bovis AF2122/97
cagcccggcgacgacccggg

SEQ ID NO: 3043339 - RNA, 12 nt, Mycobacterium bovis subsp bovis AF2122/97
cagcccggcgcg

SEQ ID NO: 3043340 - RNA, 16 nt, Mycobacterium bovis subsp bovis AF2122/97
cagcccggcgcuuccg

SEQ ID NO: 3043341 - RNA, 15 nt, Mycobacterium bovis subsp bovis AF2122/97
cagcccggcggcggu

SEQ ID NO: 3043342 - RNA, 20 nt, Mycobacterium bovis subsp bovis AF2122/97
cagcccggcggcggucacca

SEQ ID NO: 3043343 - RNA, 17 nt, Mycobacterium bovis subsp bovis AF2122/97
cagcccggcgugcagaa

SEQ ID NO: 3043344 - RNA, 18 nt, Mycobacterium bovis subsp bovis AF2122/97
cagcccgggcagcaccag

SEQ ID NO: 3043345 - RNA, 14 nt, Mycobacterium bovis subsp bovis AF2122/97
cagcccgggcagcc

SEQ ID NO: 3043346 - RNA, 14 nt, Mycobacterium bovis subsp bovis AF2122/97
cagcccggucaugg

SEQ ID NO: 3043347 - RNA, 16 nt, Mycobacterium bovis subsp bovis AF2122/97
cagcccggucaugguc

SEQ ID NO: 3043348 - RNA, 12 nt, Mycobacterium bovis subsp bovis AF2122/97
cagcccggugau

SEQ ID NO: 3043349 - RNA, 14 nt, Mycobacterium bovis subsp bovis AF2122/97
cagcccggugaugg

SEQ ID NO: 3043350 - RNA, 17 nt, Mycobacterium bovis subsp bovis AF2122/97
cagcccggugugcugca

SEQ ID NO: 3043351 - RNA, 18 nt, Mycobacterium bovis subsp bovis AF2122/97
cagcccggugugcugcac

SEQ ID NO: 3043352 - RNA, 23 nt, Mycobacterium bovis subsp bovis AF2122/97
cagcccggugugcugcacggcca

SEQ ID NO: 3043353 - RNA, 20 nt, Mycobacterium bovis subsp bovis AF2122/97
cagcccguccaggcgcugca

SEQ ID NO: 3043354 - RNA, 22 nt, Mycobacterium bovis subsp bovis AF2122/97
cagcccguccaggcgcugcagc

SEQ ID NO: 3043355 - RNA, 16 nt, Mycobacterium bovis subsp bovis AF2122/97
cagcccguucgugccg

SEQ ID NO: 3043356 - RNA, 17 nt, Mycobacterium bovis subsp bovis AF2122/97
cagcccguucgugccgu

SEQ ID NO: 3043357 - RNA, 12 nt, Mycobacterium bovis subsp bovis AF2122/97
cagcccucuggu

SEQ ID NO: 3043358 - RNA, 19 nt, Mycobacterium bovis subsp bovis AF2122/97
cagcccuguuugacugcga

SEQ ID NO: 3043359 - RNA, 23 nt, Mycobacterium bovis subsp bovis AF2122/97
cagcccuguuugacugcgaccgg

SEQ ID NO: 3043360 - RNA, 13 nt, Mycobacterium bovis subsp bovis AF2122/97
cagcccuucagcg

SEQ ID NO: 3043361 - RNA, 19 nt, Mycobacterium bovis subsp bovis AF2122/97
cagcccuucagcgaagccg

SEQ ID NO: 3043362 - RNA, 16 nt, Mycobacterium bovis subsp bovis AF2122/97
cagcccuucagcgucc

SEQ ID NO: 3043363 - RNA, 19 nt, Mycobacterium bovis subsp bovis AF2122/97
cagcccuucagcguccugg

SEQ ID NO: 3043364 - RNA, 15 nt, Mycobacterium bovis subsp bovis AF2122/97
cagcccuuggcgcgc

SEQ ID NO: 3043365 - RNA, 24 nt, Mycobacterium bovis subsp bovis AF2122/97
cagccgaacaauuucugcagccca

SEQ ID NO: 3043366 - RNA, 18 nt, Mycobacterium bovis subsp bovis AF2122/97
cagccgaaccggcaccag

SEQ ID NO: 3043367 - RNA, 20 nt, Mycobacterium bovis subsp bovis AF2122/97
cagccgaaccggcaccagcg

SEQ ID NO: 3043368 - RNA, 22 nt, Mycobacterium bovis subsp bovis AF2122/97
cagccgaaccggcaccagcggc

SEQ ID NO: 3043369 - RNA, 18 nt, Mycobacterium bovis subsp bovis AF2122/97
cagccgaagaaccggucg

SEQ ID NO: 3043370 - RNA, 18 nt, Mycobacterium bovis subsp bovis AF2122/97
cagccgaagcgcccguug

SEQ ID NO: 3043371 - RNA, 20 nt, Mycobacterium bovis subsp bovis AF2122/97
cagccgaccgaccuggucgg

SEQ ID NO: 3043372 - RNA, 14 nt, Mycobacterium bovis subsp bovis AF2122/97
cagccgaccgaugg

SEQ ID NO: 3043373 - RNA, 21 nt, Mycobacterium bovis subsp bovis AF2122/97
cagccgaccgauggcucacca

SEQ ID NO: 3043374 - RNA, 15 nt, Mycobacterium bovis subsp bovis AF2122/97
cagccgacgcggcgg

SEQ ID NO: 3043375 - RNA, 16 nt, Mycobacterium bovis subsp bovis AF2122/97
cagccgagacaccacg

SEQ ID NO: 3043376 - RNA, 16 nt, Mycobacterium bovis subsp bovis AF2122/97
cagccgagcguggcgu

SEQ ID NO: 3043377 - RNA, 19 nt, Mycobacterium bovis subsp bovis AF2122/97
cagccgagcguggcguugg

SEQ ID NO: 3043378 - RNA, 13 nt, Mycobacterium bovis subsp bovis AF2122/97
cagccgagcucac

SEQ ID NO: 3043379 - RNA, 23 nt, Mycobacterium bovis subsp bovis AF2122/97
cagccgagcucacuucacgccgc

SEQ ID NO: 3043380 - RNA, 20 nt, Mycobacterium bovis subsp bovis AF2122/97
cagccgauacaggccacgca

SEQ ID NO: 3043381 - RNA, 15 nt, Mycobacterium bovis subsp bovis AF2122/97
cagccgaucacgggc

SEQ ID NO: 3043382 - RNA, 17 nt, Mycobacterium bovis subsp bovis AF2122/97
cagccgaucaucaccgg

SEQ ID NO: 3043383 - RNA, 18 nt, Mycobacterium bovis subsp bovis AF2122/97
cagccgaucaucaccggc

SEQ ID NO: 3043384 - RNA, 19 nt, Mycobacterium bovis subsp bovis AF2122/97
cagccgaucaucaccggca

SEQ ID NO: 3043385 - RNA, 13 nt, Mycobacterium bovis subsp bovis AF2122/97
cagccgaugcucg

SEQ ID NO: 3043386 - RNA, 15 nt, Mycobacterium bovis subsp bovis AF2122/97
cagccgaugcucguc

SEQ ID NO: 3043387 - RNA, 16 nt, Mycobacterium bovis subsp bovis AF2122/97
cagccgaugcugcggg

SEQ ID NO: 3043388 - RNA, 18 nt, Mycobacterium bovis subsp bovis AF2122/97
cagccgcaacaccccccg

SEQ ID NO: 3043389 - RNA, 12 nt, Mycobacterium bovis subsp bovis AF2122/97
cagccgcaccag

SEQ ID NO: 3043390 - RNA, 15 nt, Mycobacterium bovis subsp bovis AF2122/97
cagccgcaccagugg

SEQ ID NO: 3043391 - RNA, 14 nt, Mycobacterium bovis subsp bovis AF2122/97
cagccgcaccccgc

SEQ ID NO: 3043392 - RNA, 20 nt, Mycobacterium bovis subsp bovis AF2122/97
cagccgcaccccgcccgacg

SEQ ID NO: 3043393 - RNA, 21 nt, Mycobacterium bovis subsp bovis AF2122/97
cagccgcacgguucggguggu

SEQ ID NO: 3043394 - RNA, 14 nt, Mycobacterium bovis subsp bovis AF2122/97
cagccgcagcggcc

SEQ ID NO: 3043395 - RNA, 18 nt, Mycobacterium bovis subsp bovis AF2122/97
cagccgcauaggccccgc

SEQ ID NO: 3043396 - RNA, 22 nt, Mycobacterium bovis subsp bovis AF2122/97
cagccgcauaggccccgccagc

SEQ ID NO: 3043397 - RNA, 14 nt, Mycobacterium bovis subsp bovis AF2122/97
cagccgccaaccgc

SEQ ID NO: 3043398 - RNA, 20 nt, Mycobacterium bovis subsp bovis AF2122/97
cagccgccaaccgcaggccg

SEQ ID NO: 3043399 - RNA, 21 nt, Mycobacterium bovis subsp bovis AF2122/97
cagccgccaaccgcaggccga

SEQ ID NO: 3043400 - RNA, 17 nt, Mycobacterium bovis subsp bovis AF2122/97
cagccgcccgcccaccu

SEQ ID NO: 3043401 - RNA, 20 nt, Mycobacterium bovis subsp bovis AF2122/97
cagccgcccgcccaccucga

SEQ ID NO: 3043402 - RNA, 19 nt, Mycobacterium bovis subsp bovis AF2122/97
cagccgugcccaggccacc

SEQ ID NO: 3043403 - RNA, 20 nt, Mycobacterium bovis subsp bovis AF2122/97
cagccgugcccaggccaccg

SEQ ID NO: 3043404 - RNA, 21 nt, Mycobacterium bovis subsp bovis AF2122/97
cagccgugcccaggccaccgg

SEQ ID NO: 3043405 - RNA, 24 nt, Mycobacterium bovis subsp bovis AF2122/97
cagccgugcccaggccaccggcug

SEQ ID NO: 3043406 - RNA, 15 nt, Mycobacterium bovis subsp bovis AF2122/97
cagccgugccguggu

SEQ ID NO: 3043407 - RNA, 15 nt, Mycobacterium bovis subsp bovis AF2122/97
cagccgugcggcggc

SEQ ID NO: 3043408 - RNA, 13 nt, Mycobacterium bovis subsp bovis AF2122/97
cagccgugcgggc

SEQ ID NO: 3043409 - RNA, 22 nt, Mycobacterium bovis subsp bovis AF2122/97
cagccguucccggugaccacuu

SEQ ID NO: 3043410 - RNA, 15 nt, Mycobacterium bovis subsp bovis AF2122/97
cagccguucgucgcg

SEQ ID NO: 3043411 - RNA, 17 nt, Mycobacterium bovis subsp bovis AF2122/97
cagccguuugaggucua

SEQ ID NO: 3043412 - RNA, 20 nt, Mycobacterium bovis subsp bovis AF2122/97
cagccguuuuccugaucgcg

SEQ ID NO: 3043413 - RNA, 20 nt, Mycobacterium bovis subsp bovis AF2122/97
cagccuaccggcuacggcga

SEQ ID NO: 3043414 - RNA, 12 nt, Mycobacterium bovis subsp bovis AF2122/97
cagccuccacca

SEQ ID NO: 3043415 - RNA, 21 nt, Mycobacterium bovis subsp bovis AF2122/97
cagccucguagaacgcuagcg

SEQ ID NO: 3043416 - RNA, 18 nt, Mycobacterium bovis subsp bovis AF2122/97
cagccugauauccgcgga

SEQ ID NO: 3043417 - RNA, 23 nt, Mycobacterium bovis subsp bovis AF2122/97
cagccugcaacgucuugcugguc

SEQ ID NO: 3043418 - RNA, 13 nt, Mycobacterium bovis subsp bovis AF2122/97
cagccugcagcga

SEQ ID NO: 3043419 - RNA, 20 nt, Mycobacterium bovis subsp bovis AF2122/97
cagccugcagcgaaacaccg

SEQ ID NO: 3043420 - RNA, 15 nt, Mycobacterium bovis subsp bovis AF2122/97
cagccugccagguac

SEQ ID NO: 3043421 - RNA, 20 nt, Mycobacterium bovis subsp bovis AF2122/97
cagccugccgaugacgaugg

SEQ ID NO: 3043422 - RNA, 16 nt, Mycobacterium bovis subsp bovis AF2122/97
cagccugcgccacaau

SEQ ID NO: 3043423 - RNA, 16 nt, Mycobacterium bovis subsp bovis AF2122/97
cagccugcgccgcgcg

SEQ ID NO: 3043424 - RNA, 20 nt, Mycobacterium bovis subsp bovis AF2122/97
cagccugcuggccgcggccu

SEQ ID NO: 3043425 - RNA, 24 nt, Mycobacterium bovis subsp bovis AF2122/97
cagccugcuggccgcggccucgua

SEQ ID NO: 3043426 - RNA, 14 nt, Mycobacterium bovis subsp bovis AF2122/97
cagccuggcaacca

SEQ ID NO: 3043427 - RNA, 16 nt, Mycobacterium bovis subsp bovis AF2122/97
cagccuggcaaccacg

SEQ ID NO: 3043428 - RNA, 13 nt, Mycobacterium bovis subsp bovis AF2122/97
cagccuggccucg

SEQ ID NO: 3043429 - RNA, 15 nt, Mycobacterium bovis subsp bovis AF2122/97
cagccuggucgcgca

SEQ ID NO: 3043430 - RNA, 14 nt, Mycobacterium bovis subsp bovis AF2122/97
cagccugugcugcc

SEQ ID NO: 3043431 - RNA, 21 nt, Mycobacterium bovis subsp bovis AF2122/97
cagccuugaucucgucccacu

SEQ ID NO: 3043432 - RNA, 15 nt, Mycobacterium bovis subsp bovis AF2122/97
cagcgaaaacccggu

SEQ ID NO: 3043433 - RNA, 17 nt, Mycobacterium bovis subsp bovis AF2122/97
cagcgaaacaccggcca

SEQ ID NO: 3043434 - RNA, 18 nt, Mycobacterium bovis subsp bovis AF2122/97
cagcgaaacaccggccag

SEQ ID NO: 3043435 - RNA, 20 nt, Mycobacterium bovis subsp bovis AF2122/97
cagcgaaacaccggccagcg

SEQ ID NO: 3043436 - RNA, 17 nt, Mycobacterium bovis subsp bovis AF2122/97
cagcgaaacgagccggu

SEQ ID NO: 3043437 - RNA, 21 nt, Mycobacterium bovis subsp bovis AF2122/97
cagcgaaaugcccaucaccag

SEQ ID NO: 3043438 - RNA, 16 nt, Mycobacterium bovis subsp bovis AF2122/97
cagcgaaccaccggcg

SEQ ID NO: 3043439 - RNA, 23 nt, Mycobacterium bovis subsp bovis AF2122/97
cagcgaaccaccggcgccgccgg

SEQ ID NO: 3043440 - RNA, 13 nt, Mycobacterium bovis subsp bovis AF2122/97
cagcgaaccgacc

SEQ ID NO: 3043441 - RNA, 14 nt, Mycobacterium bovis subsp bovis AF2122/97
cagcgaaccgaccc

SEQ ID NO: 3043442 - RNA, 18 nt, Mycobacterium bovis subsp bovis AF2122/97
cagcgaaccgacccggcc

SEQ ID NO: 3043443 - RNA, 19 nt, Mycobacterium bovis subsp bovis AF2122/97
cagcgaaccgacccggccg

SEQ ID NO: 3043444 - RNA, 13 nt, Mycobacterium bovis subsp bovis AF2122/97
cagcgaaccgccg

SEQ ID NO: 3043445 - RNA, 14 nt, Mycobacterium bovis subsp bovis AF2122/97
cagcgaaccgccgg

SEQ ID NO: 3043446 - RNA, 24 nt, Mycobacterium bovis subsp bovis AF2122/97
cagcgaaccggcugggcgccacca

SEQ ID NO: 3043447 - RNA, 13 nt, Mycobacterium bovis subsp bovis AF2122/97
cagcgaacggcca

SEQ ID NO: 3043448 - RNA, 18 nt, Mycobacterium bovis subsp bovis AF2122/97
cagcgaacggccaggaca

SEQ ID NO: 3043449 - RNA, 16 nt, Mycobacterium bovis subsp bovis AF2122/97
cagcgaaggcgccgaa

SEQ ID NO: 3043450 - RNA, 20 nt, Mycobacterium bovis subsp bovis AF2122/97
cagcgaaggcgccgaacacc

SEQ ID NO: 3043451 - RNA, 13 nt, Mycobacterium bovis subsp bovis AF2122/97
cagcgaauccagc

SEQ ID NO: 3043452 - RNA, 19 nt, Mycobacterium bovis subsp bovis AF2122/97
cagcgaaucgcuggugaag

SEQ ID NO: 3043453 - RNA, 17 nt, Mycobacterium bovis subsp bovis AF2122/97
cagcgaaugcugacaug

SEQ ID NO: 3043454 - RNA, 15 nt, Mycobacterium bovis subsp bovis AF2122/97
cagcgacaacaccac

SEQ ID NO: 3043455 - RNA, 13 nt, Mycobacterium bovis subsp bovis AF2122/97
cagcgacaagugc

SEQ ID NO: 3043456 - RNA, 16 nt, Mycobacterium bovis subsp bovis AF2122/97
cagcgacagcgugccg

SEQ ID NO: 3043457 - RNA, 20 nt, Mycobacterium bovis subsp bovis AF2122/97
cagcgaccaaugcagugcga

SEQ ID NO: 3043458 - RNA, 15 nt, Mycobacterium bovis subsp bovis AF2122/97
cagcgaccaccguca

SEQ ID NO: 3043459 - RNA, 19 nt, Mycobacterium bovis subsp bovis AF2122/97
cagcgaccaccgucacgau

SEQ ID NO: 3043460 - RNA, 20 nt, Mycobacterium bovis subsp bovis AF2122/97
cagcgaccaggucgccagcu

SEQ ID NO: 3043461 - RNA, 14 nt, Mycobacterium bovis subsp bovis AF2122/97
cagcgacccggcca

SEQ ID NO: 3043462 - RNA, 17 nt, Mycobacterium bovis subsp bovis AF2122/97
cagcgacccggccagcg

SEQ ID NO: 3043463 - RNA, 18 nt, Mycobacterium bovis subsp bovis AF2122/97
cagcgacccggccagcgg

SEQ ID NO: 3043464 - RNA, 14 nt, Mycobacterium bovis subsp bovis AF2122/97
cagcgaccgguaau

SEQ ID NO: 3043465 - RNA, 20 nt, Mycobacterium bovis subsp bovis AF2122/97
cagcgaccucacgaaucgcu

SEQ ID NO: 3043466 - RNA, 21 nt, Mycobacterium bovis subsp bovis AF2122/97
cagcgaccucacugcggcgcc

SEQ ID NO: 3043467 - RNA, 15 nt, Mycobacterium bovis subsp bovis AF2122/97
cagcgacgaagucgc

SEQ ID NO: 3043468 - RNA, 16 nt, Mycobacterium bovis subsp bovis AF2122/97
cagcgacgaccacacc

SEQ ID NO: 3043469 - RNA, 13 nt, Mycobacterium bovis subsp bovis AF2122/97
cagcgacgcacgc

SEQ ID NO: 3043470 - RNA, 13 nt, Mycobacterium bovis subsp bovis AF2122/97
cagcgacgcauaa

SEQ ID NO: 3043471 - RNA, 11 nt, Mycobacterium bovis subsp bovis AF2122/97
cagcgacgcca

SEQ ID NO: 3043472 - RNA, 15 nt, Mycobacterium bovis subsp bovis AF2122/97
cagcgacgccauguc

SEQ ID NO: 3043473 - RNA, 17 nt, Mycobacterium bovis subsp bovis AF2122/97
cagcgacgccaugucga

SEQ ID NO: 3043474 - RNA, 13 nt, Mycobacterium bovis subsp bovis AF2122/97
cagcgacgccggc

SEQ ID NO: 3043475 - RNA, 16 nt, Mycobacterium bovis subsp bovis AF2122/97
cagcgacgccggcccg

SEQ ID NO: 3043476 - RNA, 18 nt, Mycobacterium bovis subsp bovis AF2122/97
cagcgacgcggucaucga

SEQ ID NO: 3043477 - RNA, 18 nt, Mycobacterium bovis subsp bovis AF2122/97
cagcgacgcuaggacggc

SEQ ID NO: 3043478 - RNA, 19 nt, Mycobacterium bovis subsp bovis AF2122/97
cagcgacgcugccgccagg

SEQ ID NO: 3043479 - RNA, 20 nt, Mycobacterium bovis subsp bovis AF2122/97
cagcgacgcugccgccaggc

SEQ ID NO: 3043480 - RNA, 13 nt, Mycobacterium bovis subsp bovis AF2122/97
cagcgacggcagc

SEQ ID NO: 3043481 - RNA, 20 nt, Mycobacterium bovis subsp bovis AF2122/97
cagcgacgggaaagccaccu

SEQ ID NO: 3043482 - RNA, 13 nt, Mycobacterium bovis subsp bovis AF2122/97
cagcgacuccacc

SEQ ID NO: 3043483 - RNA, 18 nt, Mycobacterium bovis subsp bovis AF2122/97
cagcgacuccaccccacc

SEQ ID NO: 3043484 - RNA, 17 nt, Mycobacterium bovis subsp bovis AF2122/97
cagcgacuccagcgccc

SEQ ID NO: 3043485 - RNA, 18 nt, Mycobacterium bovis subsp bovis AF2122/97
cagcgacuccagcgcccg

SEQ ID NO: 3043486 - RNA, 18 nt, Mycobacterium bovis subsp bovis AF2122/97
cagcgacuugcggugcuc

SEQ ID NO: 3043487 - RNA, 14 nt, Mycobacterium bovis subsp bovis AF2122/97
cagcgacuugcugg

SEQ ID NO: 3043488 - RNA, 14 nt, Mycobacterium bovis subsp bovis AF2122/97
cagcgacuuggcau

SEQ ID NO: 3043489 - RNA, 18 nt, Mycobacterium bovis subsp bovis AF2122/97
cagcgccacccgguccgg

SEQ ID NO: 3043490 - RNA, 23 nt, Mycobacterium bovis subsp bovis AF2122/97
cagcgccaccguuaccgccguuu

SEQ ID NO: 3043491 - RNA, 14 nt, Mycobacterium bovis subsp bovis AF2122/97
cagcgccacgucca

SEQ ID NO: 3043492 - RNA, 12 nt, Mycobacterium bovis subsp bovis AF2122/97
cagcgccacugg

SEQ ID NO: 3043493 - RNA, 20 nt, Mycobacterium bovis subsp bovis AF2122/97
cagcgccacuggaagccaag

SEQ ID NO: 3043494 - RNA, 23 nt, Mycobacterium bovis subsp bovis AF2122/97
cagcgccacuggaagccaagcua

SEQ ID NO: 3043495 - RNA, 13 nt, Mycobacterium bovis subsp bovis AF2122/97
cagcgccagcgag

SEQ ID NO: 3043496 - RNA, 15 nt, Mycobacterium bovis subsp bovis AF2122/97
cagcgccagcgagca

SEQ ID NO: 3043497 - RNA, 16 nt, Mycobacterium bovis subsp bovis AF2122/97
cagcgccagcgccugc

SEQ ID NO: 3043498 - RNA, 16 nt, Mycobacterium bovis subsp bovis AF2122/97
cagcgccaggccguug

SEQ ID NO: 3043499 - RNA, 12 nt, Mycobacterium bovis subsp bovis AF2122/97
cagcgccagggg

SEQ ID NO: 3043500 - RNA, 20 nt, Mycobacterium bovis subsp bovis AF2122/97
cagcgccaggggugugccgu

SEQ ID NO: 3043501 - RNA, 16 nt, Mycobacterium bovis subsp bovis AF2122/97
cagcgccaucgaugcg

SEQ ID NO: 3043502 - RNA, 21 nt, Mycobacterium bovis subsp bovis AF2122/97
cagcgccaugcccucggcgcc

SEQ ID NO: 3043503 - RNA, 19 nt, Mycobacterium bovis subsp bovis AF2122/97
cagcgcccagaucgccgag

SEQ ID NO: 3043504 - RNA, 16 nt, Mycobacterium bovis subsp bovis AF2122/97
cagcgccccaugcaac

SEQ ID NO: 3043505 - RNA, 22 nt, Mycobacterium bovis subsp bovis AF2122/97
cagcgccccaugcaacacaccg

SEQ ID NO: 3043506 - RNA, 14 nt, Mycobacterium bovis subsp bovis AF2122/97
cagcgcccccagca

SEQ ID NO: 3043507 - RNA, 17 nt, Mycobacterium bovis subsp bovis AF2122/97
cagcgcccccagcagcu

SEQ ID NO: 3043508 - RNA, 13 nt, Mycobacterium bovis subsp bovis AF2122/97
cagcgcccccgga

SEQ ID NO: 3043509 - RNA, 14 nt, Mycobacterium bovis subsp bovis AF2122/97
cagcgcccccggac

SEQ ID NO: 3043510 - RNA, 22 nt, Mycobacterium bovis subsp bovis AF2122/97
cagcgcccccggacugcggaac

SEQ ID NO: 3043511 - RNA, 15 nt, Mycobacterium bovis subsp bovis AF2122/97
cagcgccccggcgcg

SEQ ID NO: 3043512 - RNA, 19 nt, Mycobacterium bovis subsp bovis AF2122/97
cagcgcccgccggcauaga

SEQ ID NO: 3043513 - RNA, 23 nt, Mycobacterium bovis subsp bovis AF2122/97
cagcgcccggauguccgccgacg

SEQ ID NO: 3043514 - RNA, 19 nt, Mycobacterium bovis subsp bovis AF2122/97
cagcgcccggccacuccag

SEQ ID NO: 3043515 - RNA, 13 nt, Mycobacterium bovis subsp bovis AF2122/97
cagcgcccggccc

SEQ ID NO: 3043516 - RNA, 16 nt, Mycobacterium bovis subsp bovis AF2122/97
cagcgcccggcccgcc

SEQ ID NO: 3043517 - RNA, 15 nt, Mycobacterium bovis subsp bovis AF2122/97
cagcgcccggucacg

SEQ ID NO: 3043518 - RNA, 16 nt, Mycobacterium bovis subsp bovis AF2122/97
cagcgcccggucacgc

SEQ ID NO: 3043519 - RNA, 18 nt, Mycobacterium bovis subsp bovis AF2122/97
cagcgcccggucacgcug

SEQ ID NO: 3043520 - RNA, 20 nt, Mycobacterium bovis subsp bovis AF2122/97
cagcgcccgucgcugggagg

SEQ ID NO: 3043521 - RNA, 19 nt, Mycobacterium bovis subsp bovis AF2122/97
cagcgcccuuggacgcgau

SEQ ID NO: 3043522 - RNA, 17 nt, Mycobacterium bovis subsp bovis AF2122/97
cagcgccgacagccgau

SEQ ID NO: 3043523 - RNA, 19 nt, Mycobacterium bovis subsp bovis AF2122/97
cagcgccgacagccgaucc

SEQ ID NO: 3043524 - RNA, 11 nt, Mycobacterium bovis subsp bovis AF2122/97
cagcgccgacc

SEQ ID NO: 3043525 - RNA, 21 nt, Mycobacterium bovis subsp bovis AF2122/97
cagcgccgacccaacccgauc

SEQ ID NO: 3043526 - RNA, 13 nt, Mycobacterium bovis subsp bovis AF2122/97
cagcgccgacccg

SEQ ID NO: 3043527 - RNA, 14 nt, Mycobacterium bovis subsp bovis AF2122/97
cagcgccgacccgu

SEQ ID NO: 3043528 - RNA, 16 nt, Mycobacterium bovis subsp bovis AF2122/97
cagcgccgauaccagc

SEQ ID NO: 3043529 - RNA, 17 nt, Mycobacterium bovis subsp bovis AF2122/97
cagcgccgcacccgcuc

SEQ ID NO: 3043530 - RNA, 14 nt, Mycobacterium bovis subsp bovis AF2122/97
cagcgccgcauucg

SEQ ID NO: 3043531 - RNA, 13 nt, Mycobacterium bovis subsp bovis AF2122/97
cagcgccgccacc

SEQ ID NO: 3043532 - RNA, 14 nt, Mycobacterium bovis subsp bovis AF2122/97
cagcgccgccaccc

SEQ ID NO: 3043533 - RNA, 16 nt, Mycobacterium bovis subsp bovis AF2122/97
cagcgccgccaccccg

SEQ ID NO: 3043534 - RNA, 23 nt, Mycobacterium bovis subsp bovis AF2122/97
cagcgccgccaccgaagccgccg

SEQ ID NO: 3043535 - RNA, 11 nt, Mycobacterium bovis subsp bovis AF2122/97
cagcgccgccg

SEQ ID NO: 3043536 - RNA, 12 nt, Mycobacterium bovis subsp bovis AF2122/97
cagcgccgccgc

SEQ ID NO: 3043537 - RNA, 14 nt, Mycobacterium bovis subsp bovis AF2122/97
cagcgccgccgcgu

SEQ ID NO: 3043538 - RNA, 15 nt, Mycobacterium bovis subsp bovis AF2122/97
cagcgccgcgcccca

SEQ ID NO: 3043539 - RNA, 22 nt, Mycobacterium bovis subsp bovis AF2122/97
cagcgccgcgccccagacgcgc

SEQ ID NO: 3043540 - RNA, 14 nt, Mycobacterium bovis subsp bovis AF2122/97
cagcgccgcgcgcg

SEQ ID NO: 3043541 - RNA, 17 nt, Mycobacterium bovis subsp bovis AF2122/97
cagcgccgcgcgcgccg

SEQ ID NO: 3043542 - RNA, 19 nt, Mycobacterium bovis subsp bovis AF2122/97
cagcgccgcgcgcgccgca

SEQ ID NO: 3043543 - RNA, 13 nt, Mycobacterium bovis subsp bovis AF2122/97
cagcgccgcgcgg

SEQ ID NO: 3043544 - RNA, 15 nt, Mycobacterium bovis subsp bovis AF2122/97
cagcgccgcggcccg

SEQ ID NO: 3043545 - RNA, 19 nt, Mycobacterium bovis subsp bovis AF2122/97
cagcgccgcggcccgcucg

SEQ ID NO: 3043546 - RNA, 14 nt, Mycobacterium bovis subsp bovis AF2122/97
cagcgccgcguggc

SEQ ID NO: 3043547 - RNA, 14 nt, Mycobacterium bovis subsp bovis AF2122/97
cagcgccgcguuca

SEQ ID NO: 3043548 - RNA, 19 nt, Mycobacterium bovis subsp bovis AF2122/97
cagcgccgcugacuccugc

SEQ ID NO: 3043549 - RNA, 23 nt, Mycobacterium bovis subsp bovis AF2122/97
cagcgccggauggguggccagca

SEQ ID NO: 3043550 - RNA, 18 nt, Mycobacterium bovis subsp bovis AF2122/97
cagcgccuaccagcaccg

SEQ ID NO: 3043551 - RNA, 11 nt, Mycobacterium bovis subsp bovis AF2122/97
cagcgccucca

SEQ ID NO: 3043552 - RNA, 17 nt, Mycobacterium bovis subsp bovis AF2122/97
cagcgccuccacucuuc

SEQ ID NO: 3043553 - RNA, 19 nt, Mycobacterium bovis subsp bovis AF2122/97
cagcgccuccacucuucgg

SEQ ID NO: 3043554 - RNA, 12 nt, Mycobacterium bovis subsp bovis AF2122/97
cagcgccuccag

SEQ ID NO: 3043555 - RNA, 16 nt, Mycobacterium bovis subsp bovis AF2122/97
cagcgccuccagcacc

SEQ ID NO: 3043556 - RNA, 17 nt, Mycobacterium bovis subsp bovis AF2122/97
cagcgccuccagcacca

SEQ ID NO: 3043557 - RNA, 18 nt, Mycobacterium bovis subsp bovis AF2122/97
cagcgccuccagcaccac

SEQ ID NO: 3043558 - RNA, 21 nt, Mycobacterium bovis subsp bovis AF2122/97
cagcgccuccagcaccacggc

SEQ ID NO: 3043559 - RNA, 14 nt, Mycobacterium bovis subsp bovis AF2122/97
cagcgccuccucga

SEQ ID NO: 3043560 - RNA, 16 nt, Mycobacterium bovis subsp bovis AF2122/97
cagcgccuccucgauc

SEQ ID NO: 3043561 - RNA, 21 nt, Mycobacterium bovis subsp bovis AF2122/97
cagcgccucgauccgcaucau

SEQ ID NO: 3043562 - RNA, 17 nt, Mycobacterium bovis subsp bovis AF2122/97
cagcgccucggcaucgc

SEQ ID NO: 3043563 - RNA, 19 nt, Mycobacterium bovis subsp bovis AF2122/97
cagcgccucggcaucgccg

SEQ ID NO: 3043564 - RNA, 15 nt, Mycobacterium bovis subsp bovis AF2122/97
cagcgccugcgcgca

SEQ ID NO: 3043565 - RNA, 17 nt, Mycobacterium bovis subsp bovis AF2122/97
cagcgccugcggcagca

SEQ ID NO: 3043566 - RNA, 21 nt, Mycobacterium bovis subsp bovis AF2122/97
cagcgccuugaccagcagcug

SEQ ID NO: 3043567 - RNA, 13 nt, Mycobacterium bovis subsp bovis AF2122/97
cagcgccuugacg

SEQ ID NO: 3043568 - RNA, 16 nt, Mycobacterium bovis subsp bovis AF2122/97
cagcgccuugacgcca

SEQ ID NO: 3043569 - RNA, 21 nt, Mycobacterium bovis subsp bovis AF2122/97
cagcgccuugcgggccuggug

SEQ ID NO: 3043570 - RNA, 18 nt, Mycobacterium bovis subsp bovis AF2122/97
cagcgccuuguggcacac

SEQ ID NO: 3043571 - RNA, 19 nt, Mycobacterium bovis subsp bovis AF2122/97
cagcgccuuguggcacacc

SEQ ID NO: 3043572 - RNA, 20 nt, Mycobacterium bovis subsp bovis AF2122/97
cagcgccuuguggcacaccc

SEQ ID NO: 3043573 - RNA, 19 nt, Mycobacterium bovis subsp bovis AF2122/97
cagcgccuuguuggcgaag

SEQ ID NO: 3043574 - RNA, 21 nt, Mycobacterium bovis subsp bovis AF2122/97
cagcgcgaacaccaugaucag

SEQ ID NO: 3043575 - RNA, 22 nt, Mycobacterium bovis subsp bovis AF2122/97
cagcgcgaacaccaugaucagg

SEQ ID NO: 3043576 - RNA, 17 nt, Mycobacterium bovis subsp bovis AF2122/97
cagcgcuucgucggccg

SEQ ID NO: 3043577 - RNA, 18 nt, Mycobacterium bovis subsp bovis AF2122/97
cagcgcuucgucggccgg

SEQ ID NO: 3043578 - RNA, 21 nt, Mycobacterium bovis subsp bovis AF2122/97
cagcgcuucgucggccggcac

SEQ ID NO: 3043579 - RNA, 16 nt, Mycobacterium bovis subsp bovis AF2122/97
cagcgcuuugaugccg

SEQ ID NO: 3043580 - RNA, 22 nt, Mycobacterium bovis subsp bovis AF2122/97
cagcgcuuugaugccgaugucg

SEQ ID NO: 3043581 - RNA, 22 nt, Mycobacterium bovis subsp bovis AF2122/97
cagcggaaccgagggccgucac

SEQ ID NO: 3043582 - RNA, 19 nt, Mycobacterium bovis subsp bovis AF2122/97
cagcggaacugggccccca

SEQ ID NO: 3043583 - RNA, 21 nt, Mycobacterium bovis subsp bovis AF2122/97
cagcggaacugggcccccaau

SEQ ID NO: 3043584 - RNA, 13 nt, Mycobacterium bovis subsp bovis AF2122/97
cagcggaccgcug

SEQ ID NO: 3043585 - RNA, 21 nt, Mycobacterium bovis subsp bovis AF2122/97
cagcggaccgcugccugccgc

SEQ ID NO: 3043586 - RNA, 12 nt, Mycobacterium bovis subsp bovis AF2122/97
cagcggagacga

SEQ ID NO: 3043587 - RNA, 23 nt, Mycobacterium bovis subsp bovis AF2122/97
cagcggagacgaucgccaggccg

SEQ ID NO: 3043588 - RNA, 14 nt, Mycobacterium bovis subsp bovis AF2122/97
cagcggaucccgcc

SEQ ID NO: 3043589 - RNA, 18 nt, Mycobacterium bovis subsp bovis AF2122/97
cagcggauuugccccguu

SEQ ID NO: 3043590 - RNA, 21 nt, Mycobacterium bovis subsp bovis AF2122/97
cagcggcaaggucggacuggc

SEQ ID NO: 3043591 - RNA, 18 nt, Mycobacterium bovis subsp bovis AF2122/97
cagcggcaauggccagca

SEQ ID NO: 3043592 - RNA, 23 nt, Mycobacterium bovis subsp bovis AF2122/97
cagcggcaauggccagcaccacg

SEQ ID NO: 3043593 - RNA, 19 nt, Mycobacterium bovis subsp bovis AF2122/97
cagcggcacacccaucacc

SEQ ID NO: 3043594 - RNA, 20 nt, Mycobacterium bovis subsp bovis AF2122/97
cagcggcacacccaucaccg

SEQ ID NO: 3043595 - RNA, 22 nt, Mycobacterium bovis subsp bovis AF2122/97
cagcggcacacccaucaccgcc

SEQ ID NO: 3043596 - RNA, 23 nt, Mycobacterium bovis subsp bovis AF2122/97
cagcggcacacccaucaccgcca

SEQ ID NO: 3043597 - RNA, 15 nt, Mycobacterium bovis subsp bovis AF2122/97
cagcggcaccgcgcc

SEQ ID NO: 3043598 - RNA, 17 nt, Mycobacterium bovis subsp bovis AF2122/97
cagcggcaccgcgccgg

SEQ ID NO: 3043599 - RNA, 18 nt, Mycobacterium bovis subsp bovis AF2122/97
cagcggcaccgcgccggc

SEQ ID NO: 3043600 - RNA, 17 nt, Mycobacterium bovis subsp bovis AF2122/97
cagcggcaccgcggcca

SEQ ID NO: 3043601 - RNA, 18 nt, Mycobacterium bovis subsp bovis AF2122/97
cagcggcaccgcggccag

SEQ ID NO: 3043602 - RNA, 14 nt, Mycobacterium bovis subsp bovis AF2122/97
cagcggcagcaccg

SEQ ID NO: 3043603 - RNA, 15 nt, Mycobacterium bovis subsp bovis AF2122/97
cagcggcagcggcgu

SEQ ID NO: 3043604 - RNA, 13 nt, Mycobacterium bovis subsp bovis AF2122/97
cagcggcaggaag

SEQ ID NO: 3043605 - RNA, 22 nt, Mycobacterium bovis subsp bovis AF2122/97
cagcggcauauggauguuggug

SEQ ID NO: 3043606 - RNA, 19 nt, Mycobacterium bovis subsp bovis AF2122/97
cagcggcaucgcgggcggc

SEQ ID NO: 3043607 - RNA, 13 nt, Mycobacterium bovis subsp bovis AF2122/97
cagcggccaccga

SEQ ID NO: 3043608 - RNA, 14 nt, Mycobacterium bovis subsp bovis AF2122/97
cagcggccagcagu

SEQ ID NO: 3043609 - RNA, 15 nt, Mycobacterium bovis subsp bovis AF2122/97
cagcggccagcccag

SEQ ID NO: 3043610 - RNA, 15 nt, Mycobacterium bovis subsp bovis AF2122/97
cagcggccauccggc

SEQ ID NO: 3043611 - RNA, 17 nt, Mycobacterium bovis subsp bovis AF2122/97
cagcggcccgucaccgc

SEQ ID NO: 3043612 - RNA, 22 nt, Mycobacterium bovis subsp bovis AF2122/97
cagcggcccgucaccgcgggca

SEQ ID NO: 3043613 - RNA, 12 nt, Mycobacterium bovis subsp bovis AF2122/97
cagcggccgacc

SEQ ID NO: 3043614 - RNA, 13 nt, Mycobacterium bovis subsp bovis AF2122/97
cagcggccgaccg

SEQ ID NO: 3043615 - RNA, 14 nt, Mycobacterium bovis subsp bovis AF2122/97
cagcggccgaccgc

SEQ ID NO: 3043616 - RNA, 15 nt, Mycobacterium bovis subsp bovis AF2122/97
cagcggccgaccgcg

SEQ ID NO: 3043617 - RNA, 16 nt, Mycobacterium bovis subsp bovis AF2122/97
cagcggccgaccgcga

SEQ ID NO: 3043618 - RNA, 11 nt, Mycobacterium bovis subsp bovis AF2122/97
cagcggccgcg

SEQ ID NO: 3043619 - RNA, 13 nt, Mycobacterium bovis subsp bovis AF2122/97
cagcggccgcucc

SEQ ID NO: 3043620 - RNA, 17 nt, Mycobacterium bovis subsp bovis AF2122/97
cagcggccgcuccaccu

SEQ ID NO: 3043621 - RNA, 15 nt, Mycobacterium bovis subsp bovis AF2122/97
cagcggccgggcggc

SEQ ID NO: 3043622 - RNA, 16 nt, Mycobacterium bovis subsp bovis AF2122/97
cagcggccgggcggcc

SEQ ID NO: 3043623 - RNA, 15 nt, Mycobacterium bovis subsp bovis AF2122/97
cagcggccuccgggc

SEQ ID NO: 3043624 - RNA, 23 nt, Mycobacterium bovis subsp bovis AF2122/97
cagcggcgaaggucuggccugcc

SEQ ID NO: 3043625 - RNA, 23 nt, Mycobacterium bovis subsp bovis AF2122/97
cagcggcgaagucuuucuccccc

SEQ ID NO: 3043626 - RNA, 16 nt, Mycobacterium bovis subsp bovis AF2122/97
cagcggcgacaugauc

SEQ ID NO: 3043627 - RNA, 18 nt, Mycobacterium bovis subsp bovis AF2122/97
cagcggcgaguuggccgu

SEQ ID NO: 3043628 - RNA, 15 nt, Mycobacterium bovis subsp bovis AF2122/97
cagcggcgaucaggc

SEQ ID NO: 3043629 - RNA, 17 nt, Mycobacterium bovis subsp bovis AF2122/97
cagcggcgaucaggcgg

SEQ ID NO: 3043630 - RNA, 18 nt, Mycobacterium bovis subsp bovis AF2122/97
cagcggcgauugauccgg

SEQ ID NO: 3043631 - RNA, 19 nt, Mycobacterium bovis subsp bovis AF2122/97
cagcggcgauugauccggu

SEQ ID NO: 3043632 - RNA, 16 nt, Mycobacterium bovis subsp bovis AF2122/97
cagcggcgcauaggcg

SEQ ID NO: 3043633 - RNA, 17 nt, Mycobacterium bovis subsp bovis AF2122/97
cagcggcgcauaggcgg

SEQ ID NO: 3043634 - RNA, 13 nt, Mycobacterium bovis subsp bovis AF2122/97
cagcggcgccacg

SEQ ID NO: 3043635 - RNA, 14 nt, Mycobacterium bovis subsp bovis AF2122/97
cagcggcgccacgu

SEQ ID NO: 3043636 - RNA, 22 nt, Mycobacterium bovis subsp bovis AF2122/97
cagcggcgccaguauggccgcc

SEQ ID NO: 3043637 - RNA, 15 nt, Mycobacterium bovis subsp bovis AF2122/97
cagcggcgccgccaa

SEQ ID NO: 3043638 - RNA, 17 nt, Mycobacterium bovis subsp bovis AF2122/97
cagcggcgccgccugga

SEQ ID NO: 3043639 - RNA, 12 nt, Mycobacterium bovis subsp bovis AF2122/97
cagcggcgcgcu

SEQ ID NO: 3043640 - RNA, 15 nt, Mycobacterium bovis subsp bovis AF2122/97
cagcggcgcgcugca

SEQ ID NO: 3043641 - RNA, 23 nt, Mycobacterium bovis subsp bovis AF2122/97
cagcggcgcgcugcacggaaucg

SEQ ID NO: 3043642 - RNA, 15 nt, Mycobacterium bovis subsp bovis AF2122/97
cagcggcgcucggcg

SEQ ID NO: 3043643 - RNA, 17 nt, Mycobacterium bovis subsp bovis AF2122/97
cagcggcgcucggcgcc

SEQ ID NO: 3043644 - RNA, 19 nt, Mycobacterium bovis subsp bovis AF2122/97
cagcggcgcucggcgccac

SEQ ID NO: 3043645 - RNA, 20 nt, Mycobacterium bovis subsp bovis AF2122/97
cagcggcgcucggcgccacg

SEQ ID NO: 3043646 - RNA, 20 nt, Mycobacterium bovis subsp bovis AF2122/97
cagcggcggaaggacggcag

SEQ ID NO: 3043647 - RNA, 21 nt, Mycobacterium bovis subsp bovis AF2122/97
cagcggcggaaggacggcagc

SEQ ID NO: 3043648 - RNA, 14 nt, Mycobacterium bovis subsp bovis AF2122/97
cagcggcggcaacg

SEQ ID NO: 3043649 - RNA, 18 nt, Mycobacterium bovis subsp bovis AF2122/97
cagcggcggccacggcca

SEQ ID NO: 3043650 - RNA, 13 nt, Mycobacterium bovis subsp bovis AF2122/97
cagcggcggcccu

SEQ ID NO: 3043651 - RNA, 18 nt, Mycobacterium bovis subsp bovis AF2122/97
cagcggcggcgucgacgg

SEQ ID NO: 3043652 - RNA, 19 nt, Mycobacterium bovis subsp bovis AF2122/97
cagcggcggcgucgacggc

SEQ ID NO: 3043653 - RNA, 14 nt, Mycobacterium bovis subsp bovis AF2122/97
cagcggcgggcgau

SEQ ID NO: 3043654 - RNA, 14 nt, Mycobacterium bovis subsp bovis AF2122/97
cagcggcgggggcg

SEQ ID NO: 3043655 - RNA, 22 nt, Mycobacterium bovis subsp bovis AF2122/97
cagcggcgggggcgucgccgcc

SEQ ID NO: 3043656 - RNA, 23 nt, Mycobacterium bovis subsp bovis AF2122/97
cagcggcgggggcgucgccgccg

SEQ ID NO: 3043657 - RNA, 20 nt, Mycobacterium bovis subsp bovis AF2122/97
cagcggcgggucccgccacc

SEQ ID NO: 3043658 - RNA, 12 nt, Mycobacterium bovis subsp bovis AF2122/97
cagcggcgucgu

SEQ ID NO: 3043659 - RNA, 18 nt, Mycobacterium bovis subsp bovis AF2122/97
cagcggcgucgucgucga

SEQ ID NO: 3043660 - RNA, 14 nt, Mycobacterium bovis subsp bovis AF2122/97
cagcggcucggcgg

SEQ ID NO: 3043661 - RNA, 18 nt, Mycobacterium bovis subsp bovis AF2122/97
cagcggcucggcggcgcg

SEQ ID NO: 3043662 - RNA, 19 nt, Mycobacterium bovis subsp bovis AF2122/97
cagcggcucuauccggcgc

SEQ ID NO: 3043663 - RNA, 18 nt, Mycobacterium bovis subsp bovis AF2122/97
cagcgucgucgacgacaa

SEQ ID NO: 3043664 - RNA, 19 nt, Mycobacterium bovis subsp bovis AF2122/97
cagcgucucaaggccuuuc

SEQ ID NO: 3043665 - RNA, 14 nt, Mycobacterium bovis subsp bovis AF2122/97
cagcgucucgccgg

SEQ ID NO: 3043666 - RNA, 17 nt, Mycobacterium bovis subsp bovis AF2122/97
cagcgucucggaggcga

SEQ ID NO: 3043667 - RNA, 22 nt, Mycobacterium bovis subsp bovis AF2122/97
cagcgucucggaggcgaccacg

SEQ ID NO: 3043668 - RNA, 21 nt, Mycobacterium bovis subsp bovis AF2122/97
cagcgucucucgcagcuccuc

SEQ ID NO: 3043669 - RNA, 20 nt, Mycobacterium bovis subsp bovis AF2122/97
cagcgucugagcgccggcau

SEQ ID NO: 3043670 - RNA, 22 nt, Mycobacterium bovis subsp bovis AF2122/97
cagcgucuggccgucgcuggug

SEQ ID NO: 3043671 - RNA, 20 nt, Mycobacterium bovis subsp bovis AF2122/97
cagcgucuucagguccaccg

SEQ ID NO: 3043672 - RNA, 21 nt, Mycobacterium bovis subsp bovis AF2122/97
cagcgucuucagguccaccgc

SEQ ID NO: 3043673 - RNA, 20 nt, Mycobacterium bovis subsp bovis AF2122/97
cagcgugaccaccgccgaca

SEQ ID NO: 3043674 - RNA, 21 nt, Mycobacterium bovis subsp bovis AF2122/97
cagcgugaccaccgccgacag

SEQ ID NO: 3043675 - RNA, 16 nt, Mycobacterium bovis subsp bovis AF2122/97
cagcgugagugcagca

SEQ ID NO: 3043676 - RNA, 24 nt, Mycobacterium bovis subsp bovis AF2122/97
cagcgugagugcagcacgauccag

SEQ ID NO: 3043677 - RNA, 15 nt, Mycobacterium bovis subsp bovis AF2122/97
cagcgugaucuggcc

SEQ ID NO: 3043678 - RNA, 16 nt, Mycobacterium bovis subsp bovis AF2122/97
cagcgugcacacccgc

SEQ ID NO: 3043679 - RNA, 17 nt, Mycobacterium bovis subsp bovis AF2122/97
cagcgugcacacccgca

SEQ ID NO: 3043680 - RNA, 15 nt, Mycobacterium bovis subsp bovis AF2122/97
cagcgugcccaguac

SEQ ID NO: 3043681 - RNA, 14 nt, Mycobacterium bovis subsp bovis AF2122/97
cagcgugcccgcca

SEQ ID NO: 3043682 - RNA, 15 nt, Mycobacterium bovis subsp bovis AF2122/97
cagcgugcccgccac

SEQ ID NO: 3043683 - RNA, 16 nt, Mycobacterium bovis subsp bovis AF2122/97
cagcgugcccgccacc

SEQ ID NO: 3043684 - RNA, 18 nt, Mycobacterium bovis subsp bovis AF2122/97
cagcgugcccgccaccgg

SEQ ID NO: 3043685 - RNA, 22 nt, Mycobacterium bovis subsp bovis AF2122/97
cagcgugcccgccaccggcgcg

SEQ ID NO: 3043686 - RNA, 19 nt, Mycobacterium bovis subsp bovis AF2122/97
cagcgugcgaugcagcgcg

SEQ ID NO: 3043687 - RNA, 20 nt, Mycobacterium bovis subsp bovis AF2122/97
cagcgugcgaugcagcgcgc

SEQ ID NO: 3043688 - RNA, 15 nt, Mycobacterium bovis subsp bovis AF2122/97
cagcgugcgcuggcu

SEQ ID NO: 3043689 - RNA, 23 nt, Mycobacterium bovis subsp bovis AF2122/97
cagcgugcggggcgccugaugcg

SEQ ID NO: 3043690 - RNA, 20 nt, Mycobacterium bovis subsp bovis AF2122/97
cagcguggacaucgggcggc

SEQ ID NO: 3043691 - RNA, 16 nt, Mycobacterium bovis subsp bovis AF2122/97
cagcguggacgcccgc

SEQ ID NO: 3043692 - RNA, 18 nt, Mycobacterium bovis subsp bovis AF2122/97
cagcguggacgcccgccc

SEQ ID NO: 3043693 - RNA, 19 nt, Mycobacterium bovis subsp bovis AF2122/97
cagcguggacgcccgcccg

SEQ ID NO: 3043694 - RNA, 16 nt, Mycobacterium bovis subsp bovis AF2122/97
cagcguggagaucacg

SEQ ID NO: 3043695 - RNA, 20 nt, Mycobacterium bovis subsp bovis AF2122/97
cagcguggcgcccgugccgc

SEQ ID NO: 3043696 - RNA, 20 nt, Mycobacterium bovis subsp bovis AF2122/97
cagcgugggcagcgcgauca

SEQ ID NO: 3043697 - RNA, 19 nt, Mycobacterium bovis subsp bovis AF2122/97
cagcguggggccgccacca

SEQ ID NO: 3043698 - RNA, 23 nt, Mycobacterium bovis subsp bovis AF2122/97
cagcguggggccgccaccagcgc

SEQ ID NO: 3043699 - RNA, 14 nt, Mycobacterium bovis subsp bovis AF2122/97
cagcgugucgccga

SEQ ID NO: 3043700 - RNA, 22 nt, Mycobacterium bovis subsp bovis AF2122/97
cagcgugucuugucgcgcagca

SEQ ID NO: 3043701 - RNA, 23 nt, Mycobacterium bovis subsp bovis AF2122/97
cagcguguggagcucgcggcgca

SEQ ID NO: 3043702 - RNA, 17 nt, Mycobacterium bovis subsp bovis AF2122/97
cagcguuaggucgccgg

SEQ ID NO: 3043703 - RNA, 13 nt, Mycobacterium bovis subsp bovis AF2122/97
cagcguucccgcc

SEQ ID NO: 3043704 - RNA, 14 nt, Mycobacterium bovis subsp bovis AF2122/97
cagcguucccgccg

SEQ ID NO: 3043705 - RNA, 17 nt, Mycobacterium bovis subsp bovis AF2122/97
cagcguucccgccggcu

SEQ ID NO: 3043706 - RNA, 17 nt, Mycobacterium bovis subsp bovis AF2122/97
cagcguugaccgcaucg

SEQ ID NO: 3043707 - RNA, 20 nt, Mycobacterium bovis subsp bovis AF2122/97
cagcguugacggcuucggca

SEQ ID NO: 3043708 - RNA, 19 nt, Mycobacterium bovis subsp bovis AF2122/97
cagcguugacggucagccg

SEQ ID NO: 3043709 - RNA, 15 nt, Mycobacterium bovis subsp bovis AF2122/97
cagcguugucgggug

SEQ ID NO: 3043710 - RNA, 21 nt, Mycobacterium bovis subsp bovis AF2122/97
cagcguugucggguggcugcu

SEQ ID NO: 3043711 - RNA, 15 nt, Mycobacterium bovis subsp bovis AF2122/97
cagcguuugaacgca

SEQ ID NO: 3043712 - RNA, 18 nt, Mycobacterium bovis subsp bovis AF2122/97
cagcuaccuccgccacca

SEQ ID NO: 3043713 - RNA, 19 nt, Mycobacterium bovis subsp bovis AF2122/97
cagcuagcccggcagcacg

SEQ ID NO: 3043714 - RNA, 20 nt, Mycobacterium bovis subsp bovis AF2122/97
cagcuagcccggcagcacgu

SEQ ID NO: 3043715 - RNA, 20 nt, Mycobacterium bovis subsp bovis AF2122/97
cagcuaucccaggggcaccg

SEQ ID NO: 3043716 - RNA, 22 nt, Mycobacterium bovis subsp bovis AF2122/97
cagcuaucccaggggcaccgag

SEQ ID NO: 3043717 - RNA, 16 nt, Mycobacterium bovis subsp bovis AF2122/97
cagcuaugucaccugg

SEQ ID NO: 3043718 - RNA, 21 nt, Mycobacterium bovis subsp bovis AF2122/97
cagcuauugcuauuccgcggc

SEQ ID NO: 3043719 - RNA, 14 nt, Mycobacterium bovis subsp bovis AF2122/97
cagcucaaugucga

SEQ ID NO: 3043720 - RNA, 16 nt, Mycobacterium bovis subsp bovis AF2122/97
cagcucaccacccgca

SEQ ID NO: 3043721 - RNA, 22 nt, Mycobacterium bovis subsp bovis AF2122/97
cagcucaccacccgcacuccaa

SEQ ID NO: 3043722 - RNA, 20 nt, Mycobacterium bovis subsp bovis AF2122/97
cagcucacccggagcacccg

SEQ ID NO: 3043723 - RNA, 17 nt, Mycobacterium bovis subsp bovis AF2122/97
cagcucacccugcucga

SEQ ID NO: 3043724 - RNA, 14 nt, Mycobacterium bovis subsp bovis AF2122/97
cagcucaccgacgg

SEQ ID NO: 3043725 - RNA, 16 nt, Mycobacterium bovis subsp bovis AF2122/97
cagcucacgcugaagc

SEQ ID NO: 3043726 - RNA, 17 nt, Mycobacterium bovis subsp bovis AF2122/97
cagcucacggacgcugg

SEQ ID NO: 3043727 - RNA, 17 nt, Mycobacterium bovis subsp bovis AF2122/97
cagcucacggcggaaga

SEQ ID NO: 3043728 - RNA, 14 nt, Mycobacterium bovis subsp bovis AF2122/97
cagcucagcugcgg

SEQ ID NO: 3043729 - RNA, 14 nt, Mycobacterium bovis subsp bovis AF2122/97
cagcucagugaugc

SEQ ID NO: 3043730 - RNA, 13 nt, Mycobacterium bovis subsp bovis AF2122/97
cagcucaucgcgc

SEQ ID NO: 3043731 - RNA, 17 nt, Mycobacterium bovis subsp bovis AF2122/97
cagcucaucgcgcacgc

SEQ ID NO: 3043732 - RNA, 22 nt, Mycobacterium bovis subsp bovis AF2122/97
cagcuccagcaaaacccgcucc

SEQ ID NO: 3043733 - RNA, 14 nt, Mycobacterium bovis subsp bovis AF2122/97
cagcuccauccccu

SEQ ID NO: 3043734 - RNA, 16 nt, Mycobacterium bovis subsp bovis AF2122/97
cagcuccccgaccgaa

SEQ ID NO: 3043735 - RNA, 14 nt, Mycobacterium bovis subsp bovis AF2122/97
cagcuccccgccgg

SEQ ID NO: 3043736 - RNA, 15 nt, Mycobacterium bovis subsp bovis AF2122/97
cagcuccccgccgga

SEQ ID NO: 3043737 - RNA, 21 nt, Mycobacterium bovis subsp bovis AF2122/97
cagcucccgccacgucgccgg

SEQ ID NO: 3043738 - RNA, 22 nt, Mycobacterium bovis subsp bovis AF2122/97
cagcucccggcuucuugaccac

SEQ ID NO: 3043739 - RNA, 15 nt, Mycobacterium bovis subsp bovis AF2122/97
cagcucccgggcggc

SEQ ID NO: 3043740 - RNA, 19 nt, Mycobacterium bovis subsp bovis AF2122/97
cagcucccgggcggcggcc

SEQ ID NO: 3043741 - RNA, 20 nt, Mycobacterium bovis subsp bovis AF2122/97
cagcucccgggcggcggccu

SEQ ID NO: 3043742 - RNA, 15 nt, Mycobacterium bovis subsp bovis AF2122/97
cagcuccgccgccga

SEQ ID NO: 3043743 - RNA, 21 nt, Mycobacterium bovis subsp bovis AF2122/97
cagcuccgcgcagccagggau

SEQ ID NO: 3043744 - RNA, 13 nt, Mycobacterium bovis subsp bovis AF2122/97
cagcuccggcgac

SEQ ID NO: 3043745 - RNA, 14 nt, Mycobacterium bovis subsp bovis AF2122/97
cagcuccggcgcuc

SEQ ID NO: 3043746 - RNA, 19 nt, Mycobacterium bovis subsp bovis AF2122/97
cagcuccggcgcuccacug

SEQ ID NO: 3043747 - RNA, 19 nt, Mycobacterium bovis subsp bovis AF2122/97
cagcuccgggucgacgacg

SEQ ID NO: 3043748 - RNA, 18 nt, Mycobacterium bovis subsp bovis AF2122/97
cagcuccgugacaccggg

SEQ ID NO: 3043749 - RNA, 20 nt, Mycobacterium bovis subsp bovis AF2122/97
cagcuccgugacaccgggga

SEQ ID NO: 3043750 - RNA, 14 nt, Mycobacterium bovis subsp bovis AF2122/97
cagcuccucagcca

SEQ ID NO: 3043751 - RNA, 18 nt, Mycobacterium bovis subsp bovis AF2122/97
cagcuccucagccaccgc

SEQ ID NO: 3043752 - RNA, 13 nt, Mycobacterium bovis subsp bovis AF2122/97
cagcuccuccgac

SEQ ID NO: 3043753 - RNA, 19 nt, Mycobacterium bovis subsp bovis AF2122/97
cagcuccucgcgcucgccg

SEQ ID NO: 3043754 - RNA, 20 nt, Mycobacterium bovis subsp bovis AF2122/97
cagcuccucgcgcucgccgg

SEQ ID NO: 3043755 - RNA, 23 nt, Mycobacterium bovis subsp bovis AF2122/97
cagcuccucgcgcucgccggugu

SEQ ID NO: 3043756 - RNA, 20 nt, Mycobacterium bovis subsp bovis AF2122/97
cagcuccucgugcucggcca

SEQ ID NO: 3043757 - RNA, 15 nt, Mycobacterium bovis subsp bovis AF2122/97
cagcuccuugagguc

SEQ ID NO: 3043758 - RNA, 21 nt, Mycobacterium bovis subsp bovis AF2122/97
cagcuccuuggcuaacaccgc

SEQ ID NO: 3043759 - RNA, 23 nt, Mycobacterium bovis subsp bovis AF2122/97
cagcuccuuggcuaacaccgcag

SEQ ID NO: 3043760 - RNA, 17 nt, Mycobacterium bovis subsp bovis AF2122/97
cagcucgaacagcucga

SEQ ID NO: 3043761 - RNA, 19 nt, Mycobacterium bovis subsp bovis AF2122/97
cagcucgaacagcucgauc

SEQ ID NO: 3043762 - RNA, 18 nt, Mycobacterium bovis subsp bovis AF2122/97
cagcucgaacagguuggc

SEQ ID NO: 3043763 - RNA, 18 nt, Mycobacterium bovis subsp bovis AF2122/97
cagcucgagcgccucggg

SEQ ID NO: 3043764 - RNA, 19 nt, Mycobacterium bovis subsp bovis AF2122/97
cagcucgagguccucagcg

SEQ ID NO: 3043765 - RNA, 20 nt, Mycobacterium bovis subsp bovis AF2122/97
cagcucgagguccucagcga

SEQ ID NO: 3043766 - RNA, 16 nt, Mycobacterium bovis subsp bovis AF2122/97
cagcucgaucacgccg

SEQ ID NO: 3043767 - RNA, 16 nt, Mycobacterium bovis subsp bovis AF2122/97
cagcucgaucagccgg

SEQ ID NO: 3043768 - RNA, 18 nt, Mycobacterium bovis subsp bovis AF2122/97
cagcucgaucagccgggu

SEQ ID NO: 3043769 - RNA, 16 nt, Mycobacterium bovis subsp bovis AF2122/97
cagcucgcacucguug

SEQ ID NO: 3043770 - RNA, 22 nt, Mycobacterium bovis subsp bovis AF2122/97
cagcucgcacucguugccgacc

SEQ ID NO: 3043771 - RNA, 12 nt, Mycobacterium bovis subsp bovis AF2122/97
cagcucgccggc

SEQ ID NO: 3043772 - RNA, 21 nt, Mycobacterium bovis subsp bovis AF2122/97
cagcucgccggcacgcagcca

SEQ ID NO: 3043773 - RNA, 15 nt, Mycobacterium bovis subsp bovis AF2122/97
cagcucgccggccgg

SEQ ID NO: 3043774 - RNA, 14 nt, Mycobacterium bovis subsp bovis AF2122/97
cagcucgccgugac

SEQ ID NO: 3043775 - RNA, 16 nt, Mycobacterium bovis subsp bovis AF2122/97
cagcucgccgugacca

SEQ ID NO: 3043776 - RNA, 20 nt, Mycobacterium bovis subsp bovis AF2122/97
cagcucgccgugaccaggug

SEQ ID NO: 3043777 - RNA, 15 nt, Mycobacterium bovis subsp bovis AF2122/97
cagcucgcgcucgcu

SEQ ID NO: 3043778 - RNA, 22 nt, Mycobacterium bovis subsp bovis AF2122/97
cagcucgcgcucgcucacgccg

SEQ ID NO: 3043779 - RNA, 17 nt, Mycobacterium bovis subsp bovis AF2122/97
cagcucgcgggccgcgu

SEQ ID NO: 3043780 - RNA, 14 nt, Mycobacterium bovis subsp bovis AF2122/97
cagcucgcgguggg

SEQ ID NO: 3043781 - RNA, 14 nt, Mycobacterium bovis subsp bovis AF2122/97
cagcucggaucggu

SEQ ID NO: 3043782 - RNA, 21 nt, Mycobacterium bovis subsp bovis AF2122/97
cagcucggaucgguuccggcc

SEQ ID NO: 3043783 - RNA, 16 nt, Mycobacterium bovis subsp bovis AF2122/97
cagcucggcacccgcc

SEQ ID NO: 3043784 - RNA, 18 nt, Mycobacterium bovis subsp bovis AF2122/97
cagcucggcacccgccgg

SEQ ID NO: 3043785 - RNA, 12 nt, Mycobacterium bovis subsp bovis AF2122/97
cagcucggccag

SEQ ID NO: 3043786 - RNA, 13 nt, Mycobacterium bovis subsp bovis AF2122/97
cagcucggccagg

SEQ ID NO: 3043787 - RNA, 14 nt, Mycobacterium bovis subsp bovis AF2122/97
cagcucggccaggc

SEQ ID NO: 3043788 - RNA, 17 nt, Mycobacterium bovis subsp bovis AF2122/97
cagcucggccaggcugg

SEQ ID NO: 3043789 - RNA, 18 nt, Mycobacterium bovis subsp bovis AF2122/97
cagcucggccaggcuggc

SEQ ID NO: 3043790 - RNA, 16 nt, Mycobacterium bovis subsp bovis AF2122/97
cagcucggccgaggcg

SEQ ID NO: 3043791 - RNA, 20 nt, Mycobacterium bovis subsp bovis AF2122/97
cagcucggccgaggcggucu

SEQ ID NO: 3043792 - RNA, 23 nt, Mycobacterium bovis subsp bovis AF2122/97
cagcucgggcagggaccgcaucg

SEQ ID NO: 3043793 - RNA, 15 nt, Mycobacterium bovis subsp bovis AF2122/97
cagcucgggcaugaa

SEQ ID NO: 3043794 - RNA, 16 nt, Mycobacterium bovis subsp bovis AF2122/97
cagcucggggcgauga

SEQ ID NO: 3043795 - RNA, 21 nt, Mycobacterium bovis subsp bovis AF2122/97
cagcucgggggcgccggcgcc

SEQ ID NO: 3043796 - RNA, 20 nt, Mycobacterium bovis subsp bovis AF2122/97
cagcucggguugcgcgaugg

SEQ ID NO: 3043797 - RNA, 19 nt, Mycobacterium bovis subsp bovis AF2122/97
cagcucggucagcgucagg

SEQ ID NO: 3043798 - RNA, 19 nt, Mycobacterium bovis subsp bovis AF2122/97
cagcucggugacaagcggc

SEQ ID NO: 3043799 - RNA, 14 nt, Mycobacterium bovis subsp bovis AF2122/97
cagcucggugaugu

SEQ ID NO: 3043800 - RNA, 15 nt, Mycobacterium bovis subsp bovis AF2122/97
cagcucgucgacguc

SEQ ID NO: 3043801 - RNA, 17 nt, Mycobacterium bovis subsp bovis AF2122/97
cagcucgucgacgucgu

SEQ ID NO: 3043802 - RNA, 19 nt, Mycobacterium bovis subsp bovis AF2122/97
cagcucgucgacgucguag

SEQ ID NO: 3043803 - RNA, 16 nt, Mycobacterium bovis subsp bovis AF2122/97
cagcucgucgcugaac

SEQ ID NO: 3043804 - RNA, 17 nt, Mycobacterium bovis subsp bovis AF2122/97
cagcucgucgcugaaca

SEQ ID NO: 3043805 - RNA, 18 nt, Mycobacterium bovis subsp bovis AF2122/97
cagcucgucggcgauggc

SEQ ID NO: 3043806 - RNA, 20 nt, Mycobacterium bovis subsp bovis AF2122/97
cagcucgucggcgauggcca

SEQ ID NO: 3043807 - RNA, 17 nt, Mycobacterium bovis subsp bovis AF2122/97
cagcucgucgucggcgu

SEQ ID NO: 3043808 - RNA, 18 nt, Mycobacterium bovis subsp bovis AF2122/97
cagcucgucgucggcgua

SEQ ID NO: 3043809 - RNA, 23 nt, Mycobacterium bovis subsp bovis AF2122/97
cagcugaaaauaggccgggcagu

SEQ ID NO: 3043810 - RNA, 21 nt, Mycobacterium bovis subsp bovis AF2122/97
cagcugaacacgaauccggcc

SEQ ID NO: 3043811 - RNA, 23 nt, Mycobacterium bovis subsp bovis AF2122/97
cagcugaacacgaauccggccac

SEQ ID NO: 3043812 - RNA, 16 nt, Mycobacterium bovis subsp bovis AF2122/97
cagcugaccagcgucc

SEQ ID NO: 3043813 - RNA, 20 nt, Mycobacterium bovis subsp bovis AF2122/97
cagcugaccagcguccagcc

SEQ ID NO: 3043814 - RNA, 22 nt, Mycobacterium bovis subsp bovis AF2122/97
cagcugaccagcguccagccgc

SEQ ID NO: 3043815 - RNA, 14 nt, Mycobacterium bovis subsp bovis AF2122/97
cagcugacggcgca

SEQ ID NO: 3043816 - RNA, 15 nt, Mycobacterium bovis subsp bovis AF2122/97
cagcugacggcgcaa

SEQ ID NO: 3043817 - RNA, 18 nt, Mycobacterium bovis subsp bovis AF2122/97
cagcugacgggccgcugu

SEQ ID NO: 3043818 - RNA, 19 nt, Mycobacterium bovis subsp bovis AF2122/97
cagcugagccgucggcgcc

SEQ ID NO: 3043819 - RNA, 22 nt, Mycobacterium bovis subsp bovis AF2122/97
cagcugagccgugucaaccggu

SEQ ID NO: 3043820 - RNA, 14 nt, Mycobacterium bovis subsp bovis AF2122/97
cagcugagcuggca

SEQ ID NO: 3043821 - RNA, 22 nt, Mycobacterium bovis subsp bovis AF2122/97
cagcugaucccagaucggcguu

SEQ ID NO: 3043822 - RNA, 18 nt, Mycobacterium bovis subsp bovis AF2122/97
cagcugcaauagccuuac

SEQ ID NO: 3043823 - RNA, 16 nt, Mycobacterium bovis subsp bovis AF2122/97
cagcugcaaugacugg

SEQ ID NO: 3043824 - RNA, 17 nt, Mycobacterium bovis subsp bovis AF2122/97
cagcugcaaugacugga

SEQ ID NO: 3043825 - RNA, 17 nt, Mycobacterium bovis subsp bovis AF2122/97
cagcugcacacagaggu

SEQ ID NO: 3043826 - RNA, 15 nt, Mycobacterium bovis subsp bovis AF2122/97
cagcugcaccuccga

SEQ ID NO: 3043827 - RNA, 21 nt, Mycobacterium bovis subsp bovis AF2122/97
cagcugcaccuccgacggccg

SEQ ID NO: 3043828 - RNA, 15 nt, Mycobacterium bovis subsp bovis AF2122/97
cagcugcccgacguu

SEQ ID NO: 3043829 - RNA, 22 nt, Mycobacterium bovis subsp bovis AF2122/97
cagcugcccgccagcgccgccg

SEQ ID NO: 3043830 - RNA, 19 nt, Mycobacterium bovis subsp bovis AF2122/97
cagcugccgcacccccucc

SEQ ID NO: 3043831 - RNA, 19 nt, Mycobacterium bovis subsp bovis AF2122/97
cagcugcgcacgucgggcc

SEQ ID NO: 3043832 - RNA, 21 nt, Mycobacterium bovis subsp bovis AF2122/97
cagcugcgcagcgcaacaucg

SEQ ID NO: 3043833 - RNA, 13 nt, Mycobacterium bovis subsp bovis AF2122/97
cagcugcgccagg

SEQ ID NO: 3043834 - RNA, 16 nt, Mycobacterium bovis subsp bovis AF2122/97
cagcugcgcgggcgag

SEQ ID NO: 3043835 - RNA, 15 nt, Mycobacterium bovis subsp bovis AF2122/97
caggaacucggccca

SEQ ID NO: 3043836 - RNA, 19 nt, Mycobacterium bovis subsp bovis AF2122/97
caggaacucggcccacacg

SEQ ID NO: 3043837 - RNA, 15 nt, Mycobacterium bovis subsp bovis AF2122/97
caggaagaagccgaa

SEQ ID NO: 3043838 - RNA, 21 nt, Mycobacterium bovis subsp bovis AF2122/97
caggaagauuucugggccgcu

SEQ ID NO: 3043839 - RNA, 12 nt, Mycobacterium bovis subsp bovis AF2122/97
caggaagcccac

SEQ ID NO: 3043840 - RNA, 14 nt, Mycobacterium bovis subsp bovis AF2122/97
caggaagcccacga

SEQ ID NO: 3043841 - RNA, 15 nt, Mycobacterium bovis subsp bovis AF2122/97
caggaagccgagacc

SEQ ID NO: 3043842 - RNA, 15 nt, Mycobacterium bovis subsp bovis AF2122/97
caggaagccggcgug

SEQ ID NO: 3043843 - RNA, 14 nt, Mycobacterium bovis subsp bovis AF2122/97
caggaagcgguggc

SEQ ID NO: 3043844 - RNA, 13 nt, Mycobacterium bovis subsp bovis AF2122/97
caggaaggcgacg

SEQ ID NO: 3043845 - RNA, 19 nt, Mycobacterium bovis subsp bovis AF2122/97
caggaaggcgacgccgaaa

SEQ ID NO: 3043846 - RNA, 16 nt, Mycobacterium bovis subsp bovis AF2122/97
caggaaguacgcgacg

SEQ ID NO: 3043847 - RNA, 14 nt, Mycobacterium bovis subsp bovis AF2122/97
caggaagucccggg

SEQ ID NO: 3043848 - RNA, 15 nt, Mycobacterium bovis subsp bovis AF2122/97
caggaagucgagcag

SEQ ID NO: 3043849 - RNA, 19 nt, Mycobacterium bovis subsp bovis AF2122/97
caggaaucccucggccgca

SEQ ID NO: 3043850 - RNA, 22 nt, Mycobacterium bovis subsp bovis AF2122/97
caggaaucccucggccgcaggc

SEQ ID NO: 3043851 - RNA, 22 nt, Mycobacterium bovis subsp bovis AF2122/97
caggaaucgggucagcaccacc

SEQ ID NO: 3043852 - RNA, 23 nt, Mycobacterium bovis subsp bovis AF2122/97
caggaaugaucguuccgauccgg

SEQ ID NO: 3043853 - RNA, 14 nt, Mycobacterium bovis subsp bovis AF2122/97
caggaaugccgcgg

SEQ ID NO: 3043854 - RNA, 20 nt, Mycobacterium bovis subsp bovis AF2122/97
caggaauuccccaccgucgu

SEQ ID NO: 3043855 - RNA, 11 nt, Mycobacterium bovis subsp bovis AF2122/97
caggaauugcc

SEQ ID NO: 3043856 - RNA, 20 nt, Mycobacterium bovis subsp bovis AF2122/97
caggaauugcccugacgauc

SEQ ID NO: 3043857 - RNA, 17 nt, Mycobacterium bovis subsp bovis AF2122/97
caggacagcagccgccg

SEQ ID NO: 3043858 - RNA, 14 nt, Mycobacterium bovis subsp bovis AF2122/97
caggaccagcaccg

SEQ ID NO: 3043859 - RNA, 16 nt, Mycobacterium bovis subsp bovis AF2122/97
caggacccaucgccag

SEQ ID NO: 3043860 - RNA, 12 nt, Mycobacterium bovis subsp bovis AF2122/97
caggaccgcgcc

SEQ ID NO: 3043861 - RNA, 14 nt, Mycobacterium bovis subsp bovis AF2122/97
caggaccgcgccga

SEQ ID NO: 3043862 - RNA, 16 nt, Mycobacterium bovis subsp bovis AF2122/97
caggaccgcgccgauc

SEQ ID NO: 3043863 - RNA, 16 nt, Mycobacterium bovis subsp bovis AF2122/97
caggaccggcugcagg

SEQ ID NO: 3043864 - RNA, 17 nt, Mycobacterium bovis subsp bovis AF2122/97
caggaccggcugcaggu

SEQ ID NO: 3043865 - RNA, 22 nt, Mycobacterium bovis subsp bovis AF2122/97
caggaccgggaucgucaggccc

SEQ ID NO: 3043866 - RNA, 20 nt, Mycobacterium bovis subsp bovis AF2122/97
caggaccggugggucugcuc

SEQ ID NO: 3043867 - RNA, 16 nt, Mycobacterium bovis subsp bovis AF2122/97
caggaccugcgucauc

SEQ ID NO: 3043868 - RNA, 17 nt, Mycobacterium bovis subsp bovis AF2122/97
caggacgacgccgacga

SEQ ID NO: 3043869 - RNA, 13 nt, Mycobacterium bovis subsp bovis AF2122/97
caggacgacugga

SEQ ID NO: 3043870 - RNA, 22 nt, Mycobacterium bovis subsp bovis AF2122/97
caggacgacuggaaggcgggca

SEQ ID NO: 3043871 - RNA, 18 nt, Mycobacterium bovis subsp bovis AF2122/97
caggacgcccacaugcuc

SEQ ID NO: 3043872 - RNA, 15 nt, Mycobacterium bovis subsp bovis AF2122/97
caggacgcgaucggc

SEQ ID NO: 3043873 - RNA, 22 nt, Mycobacterium bovis subsp bovis AF2122/97
caggacgcgaucggcgucacga

SEQ ID NO: 3043874 - RNA, 14 nt, Mycobacterium bovis subsp bovis AF2122/97
caggacgcgggcua

SEQ ID NO: 3043875 - RNA, 15 nt, Mycobacterium bovis subsp bovis AF2122/97
caggacgcugccggu

SEQ ID NO: 3043876 - RNA, 13 nt, Mycobacterium bovis subsp bovis AF2122/97
caggacggaucgu

SEQ ID NO: 3043877 - RNA, 13 nt, Mycobacterium bovis subsp bovis AF2122/97
caggacggcaccc

SEQ ID NO: 3043878 - RNA, 20 nt, Mycobacterium bovis subsp bovis AF2122/97
caggacggcuaccaccgcac

SEQ ID NO: 3043879 - RNA, 22 nt, Mycobacterium bovis subsp bovis AF2122/97
caggacgguugguccgccgucg

SEQ ID NO: 3043880 - RNA, 16 nt, Mycobacterium bovis subsp bovis AF2122/97
caggacguggucggga

SEQ ID NO: 3043881 - RNA, 20 nt, Mycobacterium bovis subsp bovis AF2122/97
caggacguuugagaccccaa

SEQ ID NO: 3043882 - RNA, 15 nt, Mycobacterium bovis subsp bovis AF2122/97
caggacuccggccgc

SEQ ID NO: 3043883 - RNA, 19 nt, Mycobacterium bovis subsp bovis AF2122/97
caggacucgcguccucggg

SEQ ID NO: 3043884 - RNA, 16 nt, Mycobacterium bovis subsp bovis AF2122/97
caggacuggcaccgcc

SEQ ID NO: 3043885 - RNA, 23 nt, Mycobacterium bovis subsp bovis AF2122/97
caggacuggcaccgccagccacc

SEQ ID NO: 3043886 - RNA, 13 nt, Mycobacterium bovis subsp bovis AF2122/97
caggacuuggugg

SEQ ID NO: 3043887 - RNA, 19 nt, Mycobacterium bovis subsp bovis AF2122/97
caggagaacacauccgcuu

SEQ ID NO: 3043888 - RNA, 22 nt, Mycobacterium bovis subsp bovis AF2122/97
caggagaacacauccgcuugcg

SEQ ID NO: 3043889 - RNA, 19 nt, Mycobacterium bovis subsp bovis AF2122/97
caggagacgguacgccagu

SEQ ID NO: 3043890 - RNA, 21 nt, Mycobacterium bovis subsp bovis AF2122/97
caggagauccaccgguccagg

SEQ ID NO: 3043891 - RNA, 22 nt, Mycobacterium bovis subsp bovis AF2122/97
caggagcaccucgaagugcagg

SEQ ID NO: 3043892 - RNA, 23 nt, Mycobacterium bovis subsp bovis AF2122/97
caggagcaccucgaagugcaggu

SEQ ID NO: 3043893 - RNA, 16 nt, Mycobacterium bovis subsp bovis AF2122/97
caggagccgaucacgc

SEQ ID NO: 3043894 - RNA, 14 nt, Mycobacterium bovis subsp bovis AF2122/97
caggagccggcaac

SEQ ID NO: 3043895 - RNA, 15 nt, Mycobacterium bovis subsp bovis AF2122/97
caggagccggcaacc

SEQ ID NO: 3043896 - RNA, 15 nt, Mycobacterium bovis subsp bovis AF2122/97
caggagccuccagcg

SEQ ID NO: 3043897 - RNA, 18 nt, Mycobacterium bovis subsp bovis AF2122/97
caggagccuccagcgcac

SEQ ID NO: 3043898 - RNA, 17 nt, Mycobacterium bovis subsp bovis AF2122/97
caggagcgccgucaucg

SEQ ID NO: 3043899 - RNA, 15 nt, Mycobacterium bovis subsp bovis AF2122/97
caggagcgcggcccg

SEQ ID NO: 3043900 - RNA, 14 nt, Mycobacterium bovis subsp bovis AF2122/97
caggagugcgggca

SEQ ID NO: 3043901 - RNA, 14 nt, Mycobacterium bovis subsp bovis AF2122/97
caggaguggccacg

SEQ ID NO: 3043902 - RNA, 18 nt, Mycobacterium bovis subsp bovis AF2122/97
caggaguuugaccaccug

SEQ ID NO: 3043903 - RNA, 17 nt, Mycobacterium bovis subsp bovis AF2122/97
caggaucaaccggcccu

SEQ ID NO: 3043904 - RNA, 19 nt, Mycobacterium bovis subsp bovis AF2122/97
caggaucacacuggccugc

SEQ ID NO: 3043905 - RNA, 17 nt, Mycobacterium bovis subsp bovis AF2122/97
caggaucacgccgccgg

SEQ ID NO: 3043906 - RNA, 22 nt, Mycobacterium bovis subsp bovis AF2122/97
caggaucagcccggacguaggc

SEQ ID NO: 3043907 - RNA, 20 nt, Mycobacterium bovis subsp bovis AF2122/97
caggaucagcgacuugcugg

SEQ ID NO: 3043908 - RNA, 15 nt, Mycobacterium bovis subsp bovis AF2122/97
caggaucccgguggc

SEQ ID NO: 3043909 - RNA, 18 nt, Mycobacterium bovis subsp bovis AF2122/97
caggaucccgguggcagc

SEQ ID NO: 3043910 - RNA, 13 nt, Mycobacterium bovis subsp bovis AF2122/97
caggauccgaccc

SEQ ID NO: 3043911 - RNA, 13 nt, Mycobacterium bovis subsp bovis AF2122/97
caggaucgccgcu

SEQ ID NO: 3043912 - RNA, 17 nt, Mycobacterium bovis subsp bovis AF2122/97
caggaucgccgcuugac

SEQ ID NO: 3043913 - RNA, 16 nt, Mycobacterium bovis subsp bovis AF2122/97
caggaucgccugagcg

SEQ ID NO: 3043914 - RNA, 20 nt, Mycobacterium bovis subsp bovis AF2122/97
caggaucgccugagcgccgc

SEQ ID NO: 3043915 - RNA, 22 nt, Mycobacterium bovis subsp bovis AF2122/97
caggaucgccugagcgccgcgg

SEQ ID NO: 3043916 - RNA, 16 nt, Mycobacterium bovis subsp bovis AF2122/97
caggaucgcggcgccg

SEQ ID NO: 3043917 - RNA, 20 nt, Mycobacterium bovis subsp bovis AF2122/97
caggaucgcguggcgcacca

SEQ ID NO: 3043918 - RNA, 15 nt, Mycobacterium bovis subsp bovis AF2122/97
caggaucggcggaua

SEQ ID NO: 3043919 - RNA, 20 nt, Mycobacterium bovis subsp bovis AF2122/97
caggaucggcuugggaaacc

SEQ ID NO: 3043920 - RNA, 14 nt, Mycobacterium bovis subsp bovis AF2122/97
caggaucuccgggu

SEQ ID NO: 3043921 - RNA, 17 nt, Mycobacterium bovis subsp bovis AF2122/97
caggaucucuucucggc

SEQ ID NO: 3043922 - RNA, 13 nt, Mycobacterium bovis subsp bovis AF2122/97
caggcccagcuag

SEQ ID NO: 3043923 - RNA, 19 nt, Mycobacterium bovis subsp bovis AF2122/97
caggcccaggucaacgacg

SEQ ID NO: 3043924 - RNA, 17 nt, Mycobacterium bovis subsp bovis AF2122/97
caggcccauaccgaugg

SEQ ID NO: 3043925 - RNA, 18 nt, Mycobacterium bovis subsp bovis AF2122/97
caggcccauaccgauggu

SEQ ID NO: 3043926 - RNA, 23 nt, Mycobacterium bovis subsp bovis AF2122/97
caggcccaucucgggcaggccgu

SEQ ID NO: 3043927 - RNA, 18 nt, Mycobacterium bovis subsp bovis AF2122/97
caggcccauggcagcccg

SEQ ID NO: 3043928 - RNA, 22 nt, Mycobacterium bovis subsp bovis AF2122/97
caggccccacuggugcagcgcc

SEQ ID NO: 3043929 - RNA, 19 nt, Mycobacterium bovis subsp bovis AF2122/97
caggccccggugccgaccg

SEQ ID NO: 3043930 - RNA, 15 nt, Mycobacterium bovis subsp bovis AF2122/97
caggcccgacggcgc

SEQ ID NO: 3043931 - RNA, 17 nt, Mycobacterium bovis subsp bovis AF2122/97
caggcccgacggcgccc

SEQ ID NO: 3043932 - RNA, 21 nt, Mycobacterium bovis subsp bovis AF2122/97
caggcccgccaucauggcggc

SEQ ID NO: 3043933 - RNA, 16 nt, Mycobacterium bovis subsp bovis AF2122/97
caggcccggcaccgcg

SEQ ID NO: 3043934 - RNA, 20 nt, Mycobacterium bovis subsp bovis AF2122/97
caggcccgggcggaugcugu

SEQ ID NO: 3043935 - RNA, 16 nt, Mycobacterium bovis subsp bovis AF2122/97
caggcccgguggcggc

SEQ ID NO: 3043936 - RNA, 17 nt, Mycobacterium bovis subsp bovis AF2122/97
caggcccgguggcggcu

SEQ ID NO: 3043937 - RNA, 20 nt, Mycobacterium bovis subsp bovis AF2122/97
caggcccgguucgaggaucc

SEQ ID NO: 3043938 - RNA, 20 nt, Mycobacterium bovis subsp bovis AF2122/97
caggcccucgacggcgucga

SEQ ID NO: 3043939 - RNA, 14 nt, Mycobacterium bovis subsp bovis AF2122/97
caggcccucgggac

SEQ ID NO: 3043940 - RNA, 19 nt, Mycobacterium bovis subsp bovis AF2122/97
caggcccucgggacugcgc

SEQ ID NO: 3043941 - RNA, 22 nt, Mycobacterium bovis subsp bovis AF2122/97
caggcccucgggacugcgcggc

SEQ ID NO: 3043942 - RNA, 16 nt, Mycobacterium bovis subsp bovis AF2122/97
caggcccugccgacgc

SEQ ID NO: 3043943 - RNA, 15 nt, Mycobacterium bovis subsp bovis AF2122/97
caggcccuggccacc

SEQ ID NO: 3043944 - RNA, 16 nt, Mycobacterium bovis subsp bovis AF2122/97
caggcccuggccaccc

SEQ ID NO: 3043945 - RNA, 17 nt, Mycobacterium bovis subsp bovis AF2122/97
caggcccuggccaccca

SEQ ID NO: 3043946 - RNA, 19 nt, Mycobacterium bovis subsp bovis AF2122/97
caggcccuggccagcccga

SEQ ID NO: 3043947 - RNA, 16 nt, Mycobacterium bovis subsp bovis AF2122/97
caggccgaagacgugc

SEQ ID NO: 3043948 - RNA, 20 nt, Mycobacterium bovis subsp bovis AF2122/97
caggccgaagacgugccggc

SEQ ID NO: 3043949 - RNA, 22 nt, Mycobacterium bovis subsp bovis AF2122/97
caggccgaccauaaaacucggg

SEQ ID NO: 3043950 - RNA, 14 nt, Mycobacterium bovis subsp bovis AF2122/97
caggccgaccgcgc

SEQ ID NO: 3043951 - RNA, 15 nt, Mycobacterium bovis subsp bovis AF2122/97
caggccgaccgcgca

SEQ ID NO: 3043952 - RNA, 17 nt, Mycobacterium bovis subsp bovis AF2122/97
caggccgacgucgacca

SEQ ID NO: 3043953 - RNA, 14 nt, Mycobacterium bovis subsp bovis AF2122/97
caggccgagcccgg

SEQ ID NO: 3043954 - RNA, 14 nt, Mycobacterium bovis subsp bovis AF2122/97
caggccgagccgcc

SEQ ID NO: 3043955 - RNA, 14 nt, Mycobacterium bovis subsp bovis AF2122/97
caggccgagcucgu

SEQ ID NO: 3043956 - RNA, 18 nt, Mycobacterium bovis subsp bovis AF2122/97
caggccgaucagcgcggc

SEQ ID NO: 3043957 - RNA, 16 nt, Mycobacterium bovis subsp bovis AF2122/97
caggccgaugccgacc

SEQ ID NO: 3043958 - RNA, 18 nt, Mycobacterium bovis subsp bovis AF2122/97
caggccgaugcgggucuc

SEQ ID NO: 3043959 - RNA, 13 nt, Mycobacterium bovis subsp bovis AF2122/97
caggccgcacagc

SEQ ID NO: 3043960 - RNA, 17 nt, Mycobacterium bovis subsp bovis AF2122/97
caggccgcacagcacca

SEQ ID NO: 3043961 - RNA, 17 nt, Mycobacterium bovis subsp bovis AF2122/97
caggccgccaccgucac

SEQ ID NO: 3043962 - RNA, 21 nt, Mycobacterium bovis subsp bovis AF2122/97
caggccgccaccgucaccgcc

SEQ ID NO: 3043963 - RNA, 14 nt, Mycobacterium bovis subsp bovis AF2122/97
caggccgccggcca

SEQ ID NO: 3043964 - RNA, 15 nt, Mycobacterium bovis subsp bovis AF2122/97
caggccgccuggggg

SEQ ID NO: 3043965 - RNA, 15 nt, Mycobacterium bovis subsp bovis AF2122/97
caggccgcgcgacaa

SEQ ID NO: 3043966 - RNA, 17 nt, Mycobacterium bovis subsp bovis AF2122/97
caggccgcgcgacaacc

SEQ ID NO: 3043967 - RNA, 19 nt, Mycobacterium bovis subsp bovis AF2122/97
caggccgcgcgacaacccg

SEQ ID NO: 3043968 - RNA, 21 nt, Mycobacterium bovis subsp bovis AF2122/97
caggccgcgcgacaacccggc

SEQ ID NO: 3043969 - RNA, 22 nt, Mycobacterium bovis subsp bovis AF2122/97
caggccgcgcgacaacccggcg

SEQ ID NO: 3043970 - RNA, 23 nt, Mycobacterium bovis subsp bovis AF2122/97
caggccgcgcgacaacccggcgu

SEQ ID NO: 3043971 - RNA, 14 nt, Mycobacterium bovis subsp bovis AF2122/97
caggccgcgcgcac

SEQ ID NO: 3043972 - RNA, 16 nt, Mycobacterium bovis subsp bovis AF2122/97
caggccgcgcggaccc

SEQ ID NO: 3043973 - RNA, 16 nt, Mycobacterium bovis subsp bovis AF2122/97
caggccgcgcucgucg

SEQ ID NO: 3043974 - RNA, 13 nt, Mycobacterium bovis subsp bovis AF2122/97
caggccgcgucga

SEQ ID NO: 3043975 - RNA, 19 nt, Mycobacterium bovis subsp bovis AF2122/97
caggccgcugggccgaccg

SEQ ID NO: 3043976 - RNA, 17 nt, Mycobacterium bovis subsp bovis AF2122/97
caggccgcuugccccgc

SEQ ID NO: 3043977 - RNA, 19 nt, Mycobacterium bovis subsp bovis AF2122/97
caggccgcuugccccgccu

SEQ ID NO: 3043978 - RNA, 17 nt, Mycobacterium bovis subsp bovis AF2122/97
caggccggcagcuugca

SEQ ID NO: 3043979 - RNA, 18 nt, Mycobacterium bovis subsp bovis AF2122/97
caggccggccaccaccgc

SEQ ID NO: 3043980 - RNA, 15 nt, Mycobacterium bovis subsp bovis AF2122/97
caggccggccaccag

SEQ ID NO: 3043981 - RNA, 14 nt, Mycobacterium bovis subsp bovis AF2122/97
caggccggccaccg

SEQ ID NO: 3043982 - RNA, 15 nt, Mycobacterium bovis subsp bovis AF2122/97
caggccggcccgcaa

SEQ ID NO: 3043983 - RNA, 13 nt, Mycobacterium bovis subsp bovis AF2122/97
caggccggccgcg

SEQ ID NO: 3043984 - RNA, 14 nt, Mycobacterium bovis subsp bovis AF2122/97
caggccggcggcgg

SEQ ID NO: 3043985 - RNA, 15 nt, Mycobacterium bovis subsp bovis AF2122/97
caggccggcggcggc

SEQ ID NO: 3043986 - RNA, 18 nt, Mycobacterium bovis subsp bovis AF2122/97
caggccggcggcggcgcu

SEQ ID NO: 3043987 - RNA, 15 nt, Mycobacterium bovis subsp bovis AF2122/97
caggccggcggcggu

SEQ ID NO: 3043988 - RNA, 14 nt, Mycobacterium bovis subsp bovis AF2122/97
caggccggcgucga

SEQ ID NO: 3043989 - RNA, 18 nt, Mycobacterium bovis subsp bovis AF2122/97
caggccggcgucgaucaa

SEQ ID NO: 3043990 - RNA, 15 nt, Mycobacterium bovis subsp bovis AF2122/97
caggccggcucgccg

SEQ ID NO: 3043991 - RNA, 18 nt, Mycobacterium bovis subsp bovis AF2122/97
caggccggcucgccgacc

SEQ ID NO: 3043992 - RNA, 20 nt, Mycobacterium bovis subsp bovis AF2122/97
caggccggcucgccgacccg

SEQ ID NO: 3043993 - RNA, 15 nt, Mycobacterium bovis subsp bovis AF2122/97
caggccgggacagcg

SEQ ID NO: 3043994 - RNA, 19 nt, Mycobacterium bovis subsp bovis AF2122/97
caggccgggacagcgccgg

SEQ ID NO: 3043995 - RNA, 19 nt, Mycobacterium bovis subsp bovis AF2122/97
caggccgggcaccaauacc

SEQ ID NO: 3043996 - RNA, 14 nt, Mycobacterium bovis subsp bovis AF2122/97
caggccgggcgcaa

SEQ ID NO: 3043997 - RNA, 24 nt, Mycobacterium bovis subsp bovis AF2122/97
caggccgggcgcaagcagcccggg

SEQ ID NO: 3043998 - RNA, 14 nt, Mycobacterium bovis subsp bovis AF2122/97
caggccggugugcg

SEQ ID NO: 3043999 - RNA, 17 nt, Mycobacterium bovis subsp bovis AF2122/97
caggccggugugcgggc

SEQ ID NO: 3044000 - RNA, 19 nt, Mycobacterium bovis subsp bovis AF2122/97
caggccguagcccacgacg

SEQ ID NO: 3044001 - RNA, 21 nt, Mycobacterium bovis subsp bovis AF2122/97
caggccguagcccacgacgaa

SEQ ID NO: 3044002 - RNA, 18 nt, Mycobacterium bovis subsp bovis AF2122/97
caggccguaguggccggc

SEQ ID NO: 3044003 - RNA, 16 nt, Mycobacterium bovis subsp bovis AF2122/97
caggccgucaccgacg

SEQ ID NO: 3044004 - RNA, 17 nt, Mycobacterium bovis subsp bovis AF2122/97
caggccgucaggcgugc

SEQ ID NO: 3044005 - RNA, 13 nt, Mycobacterium bovis subsp bovis AF2122/97
caggccgucgaug

SEQ ID NO: 3044006 - RNA, 19 nt, Mycobacterium bovis subsp bovis AF2122/97
caggccgucgaugaucugc

SEQ ID NO: 3044007 - RNA, 12 nt, Mycobacterium bovis subsp bovis AF2122/97
caggccgucgcg

SEQ ID NO: 3044008 - RNA, 13 nt, Mycobacterium bovis subsp bovis AF2122/97
caggccgucgcgc

SEQ ID NO: 3044009 - RNA, 19 nt, Mycobacterium bovis subsp bovis AF2122/97
caggcggcggacccgcucg

SEQ ID NO: 3044010 - RNA, 22 nt, Mycobacterium bovis subsp bovis AF2122/97
caggcggcggccuggcacccgg

SEQ ID NO: 3044011 - RNA, 23 nt, Mycobacterium bovis subsp bovis AF2122/97
caggcggcucaaccucuggcggc

SEQ ID NO: 3044012 - RNA, 22 nt, Mycobacterium bovis subsp bovis AF2122/97
caggcggcugaacggcagccga

SEQ ID NO: 3044013 - RNA, 15 nt, Mycobacterium bovis subsp bovis AF2122/97
caggcgggaacgauc

SEQ ID NO: 3044014 - RNA, 14 nt, Mycobacterium bovis subsp bovis AF2122/97
caggcgggagcgga

SEQ ID NO: 3044015 - RNA, 15 nt, Mycobacterium bovis subsp bovis AF2122/97
caggcgggcggcacc

SEQ ID NO: 3044016 - RNA, 16 nt, Mycobacterium bovis subsp bovis AF2122/97
caggcgggcggcaccg

SEQ ID NO: 3044017 - RNA, 17 nt, Mycobacterium bovis subsp bovis AF2122/97
caggcgggcggcaccga

SEQ ID NO: 3044018 - RNA, 17 nt, Mycobacterium bovis subsp bovis AF2122/97
caggcgggggaucggug

SEQ ID NO: 3044019 - RNA, 16 nt, Mycobacterium bovis subsp bovis AF2122/97
caggcgggggaucucg

SEQ ID NO: 3044020 - RNA, 22 nt, Mycobacterium bovis subsp bovis AF2122/97
caggcgggggaucucgagccgc

SEQ ID NO: 3044021 - RNA, 15 nt, Mycobacterium bovis subsp bovis AF2122/97
caggcggugaacacc

SEQ ID NO: 3044022 - RNA, 19 nt, Mycobacterium bovis subsp bovis AF2122/97
caggcggugaacaccgccu

SEQ ID NO: 3044023 - RNA, 20 nt, Mycobacterium bovis subsp bovis AF2122/97
caggcggugaacaccgccuc

SEQ ID NO: 3044024 - RNA, 16 nt, Mycobacterium bovis subsp bovis AF2122/97
caggcguccaucagag

SEQ ID NO: 3044025 - RNA, 18 nt, Mycobacterium bovis subsp bovis AF2122/97
caggcguccaucgccacc

SEQ ID NO: 3044026 - RNA, 21 nt, Mycobacterium bovis subsp bovis AF2122/97
caggcguccaucgccaccgcg

SEQ ID NO: 3044027 - RNA, 14 nt, Mycobacterium bovis subsp bovis AF2122/97
caggcgucccagcc

SEQ ID NO: 3044028 - RNA, 16 nt, Mycobacterium bovis subsp bovis AF2122/97
caggcgucccagccga

SEQ ID NO: 3044029 - RNA, 18 nt, Mycobacterium bovis subsp bovis AF2122/97
caggcgucccagccgauc

SEQ ID NO: 3044030 - RNA, 23 nt, Mycobacterium bovis subsp bovis AF2122/97
caggcgucccagccgaucacggg

SEQ ID NO: 3044031 - RNA, 16 nt, Mycobacterium bovis subsp bovis AF2122/97
caggcgucccgcccgg

SEQ ID NO: 3044032 - RNA, 21 nt, Mycobacterium bovis subsp bovis AF2122/97
caggcgugcacaggucagcgc

SEQ ID NO: 3044033 - RNA, 19 nt, Mycobacterium bovis subsp bovis AF2122/97
caggcgugucgucgcggcc

SEQ ID NO: 3044034 - RNA, 20 nt, Mycobacterium bovis subsp bovis AF2122/97
caggcgugucgucgcggccg

SEQ ID NO: 3044035 - RNA, 22 nt, Mycobacterium bovis subsp bovis AF2122/97
caggcgugucgucgcggccggu

SEQ ID NO: 3044036 - RNA, 21 nt, Mycobacterium bovis subsp bovis AF2122/97
caggcguuuggcgugccgucg

SEQ ID NO: 3044037 - RNA, 18 nt, Mycobacterium bovis subsp bovis AF2122/97
caggcuaauagcucgccg

SEQ ID NO: 3044038 - RNA, 22 nt, Mycobacterium bovis subsp bovis AF2122/97
caggcuaaucagccaggccagu

SEQ ID NO: 3044039 - RNA, 18 nt, Mycobacterium bovis subsp bovis AF2122/97
caggcuaguugccaacac

SEQ ID NO: 3044040 - RNA, 22 nt, Mycobacterium bovis subsp bovis AF2122/97
caggcuauggugccggugaugg

SEQ ID NO: 3044041 - RNA, 22 nt, Mycobacterium bovis subsp bovis AF2122/97
caggcucacacucggccgggcu

SEQ ID NO: 3044042 - RNA, 13 nt, Mycobacterium bovis subsp bovis AF2122/97
caggcucagcugg

SEQ ID NO: 3044043 - RNA, 14 nt, Mycobacterium bovis subsp bovis AF2122/97
caggcucauccgcc

SEQ ID NO: 3044044 - RNA, 18 nt, Mycobacterium bovis subsp bovis AF2122/97
caggcucauccgccgggc

SEQ ID NO: 3044045 - RNA, 19 nt, Mycobacterium bovis subsp bovis AF2122/97
caggcucauccgccgggcc

SEQ ID NO: 3044046 - RNA, 13 nt, Mycobacterium bovis subsp bovis AF2122/97
caggcuccggccg

SEQ ID NO: 3044047 - RNA, 14 nt, Mycobacterium bovis subsp bovis AF2122/97
caggcuccggccgg

SEQ ID NO: 3044048 - RNA, 19 nt, Mycobacterium bovis subsp bovis AF2122/97
caggcuccggccggccagc

SEQ ID NO: 3044049 - RNA, 23 nt, Mycobacterium bovis subsp bovis AF2122/97
caggcuccggccggccagcaccc

SEQ ID NO: 3044050 - RNA, 18 nt, Mycobacterium bovis subsp bovis AF2122/97
caggcucgaaccgacgcg

SEQ ID NO: 3044051 - RNA, 23 nt, Mycobacterium bovis subsp bovis AF2122/97
caggcucgagguguagcccuccg

SEQ ID NO: 3044052 - RNA, 24 nt, Mycobacterium bovis subsp bovis AF2122/97
caggcucgagguguagcccuccga

SEQ ID NO: 3044053 - RNA, 15 nt, Mycobacterium bovis subsp bovis AF2122/97
caggcucgcaccgug

SEQ ID NO: 3044054 - RNA, 11 nt, Mycobacterium bovis subsp bovis AF2122/97
caggcucgccg

SEQ ID NO: 3044055 - RNA, 14 nt, Mycobacterium bovis subsp bovis AF2122/97
caggcucgccgaug

SEQ ID NO: 3044056 - RNA, 16 nt, Mycobacterium bovis subsp bovis AF2122/97
caggcucgccgaugcu

SEQ ID NO: 3044057 - RNA, 15 nt, Mycobacterium bovis subsp bovis AF2122/97
caggcucgggcaagg

SEQ ID NO: 3044058 - RNA, 20 nt, Mycobacterium bovis subsp bovis AF2122/97
caggcucgggcaaggccacc

SEQ ID NO: 3044059 - RNA, 23 nt, Mycobacterium bovis subsp bovis AF2122/97
caggcugaaggacggcagcuugg

SEQ ID NO: 3044060 - RNA, 22 nt, Mycobacterium bovis subsp bovis AF2122/97
caggcugcggcuuggccaucac

SEQ ID NO: 3044061 - RNA, 18 nt, Mycobacterium bovis subsp bovis AF2122/97
caggcuggcgagggcuga

SEQ ID NO: 3044062 - RNA, 17 nt, Mycobacterium bovis subsp bovis AF2122/97
caggcuggcgauggccg

SEQ ID NO: 3044063 - RNA, 15 nt, Mycobacterium bovis subsp bovis AF2122/97
caggcuggcgucacc

SEQ ID NO: 3044064 - RNA, 17 nt, Mycobacterium bovis subsp bovis AF2122/97
caggcuguccagcagcg

SEQ ID NO: 3044065 - RNA, 19 nt, Mycobacterium bovis subsp bovis AF2122/97
caggcugucgagucggucc

SEQ ID NO: 3044066 - RNA, 15 nt, Mycobacterium bovis subsp bovis AF2122/97
caggcuguggccagc

SEQ ID NO: 3044067 - RNA, 23 nt, Mycobacterium bovis subsp bovis AF2122/97
caggcuguggccagcaucaucaa

SEQ ID NO: 3044068 - RNA, 16 nt, Mycobacterium bovis subsp bovis AF2122/97
caggcuuccccgaucg

SEQ ID NO: 3044069 - RNA, 21 nt, Mycobacterium bovis subsp bovis AF2122/97
caggcuugacugcacaccacc

SEQ ID NO: 3044070 - RNA, 22 nt, Mycobacterium bovis subsp bovis AF2122/97
caggcuugacugcacaccaccg

SEQ ID NO: 3044071 - RNA, 15 nt, Mycobacterium bovis subsp bovis AF2122/97
caggcuugccgaugg

SEQ ID NO: 3044072 - RNA, 18 nt, Mycobacterium bovis subsp bovis AF2122/97
cagggaaccauugcccga

SEQ ID NO: 3044073 - RNA, 23 nt, Mycobacterium bovis subsp bovis AF2122/97
cagggaaccauugcccgacgaug

SEQ ID NO: 3044074 - RNA, 18 nt, Mycobacterium bovis subsp bovis AF2122/97
cagggacccgagaucacc

SEQ ID NO: 3044075 - RNA, 20 nt, Mycobacterium bovis subsp bovis AF2122/97
cagggacccgagaucaccgg

SEQ ID NO: 3044076 - RNA, 14 nt, Mycobacterium bovis subsp bovis AF2122/97
cagggacccggcgc

SEQ ID NO: 3044077 - RNA, 17 nt, Mycobacterium bovis subsp bovis AF2122/97
cagggacgaacugcuga

SEQ ID NO: 3044078 - RNA, 13 nt, Mycobacterium bovis subsp bovis AF2122/97
cagggacgaugcc

SEQ ID NO: 3044079 - RNA, 15 nt, Mycobacterium bovis subsp bovis AF2122/97
cagggagcggcugca

SEQ ID NO: 3044080 - RNA, 18 nt, Mycobacterium bovis subsp bovis AF2122/97
cagggaucagccgugcgg

SEQ ID NO: 3044081 - RNA, 21 nt, Mycobacterium bovis subsp bovis AF2122/97
cagggaucgauuuggaucggc

SEQ ID NO: 3044082 - RNA, 16 nt, Mycobacterium bovis subsp bovis AF2122/97
cagggauucuggaugc

SEQ ID NO: 3044083 - RNA, 18 nt, Mycobacterium bovis subsp bovis AF2122/97
cagggauuuccagcagug

SEQ ID NO: 3044084 - RNA, 17 nt, Mycobacterium bovis subsp bovis AF2122/97
cagggcacaucgggcgu

SEQ ID NO: 3044085 - RNA, 12 nt, Mycobacterium bovis subsp bovis AF2122/97
cagggcagcccg

SEQ ID NO: 3044086 - RNA, 20 nt, Mycobacterium bovis subsp bovis AF2122/97
cagggcagcccggcgaugag

SEQ ID NO: 3044087 - RNA, 14 nt, Mycobacterium bovis subsp bovis AF2122/97
cagggcagcggcca

SEQ ID NO: 3044088 - RNA, 17 nt, Mycobacterium bovis subsp bovis AF2122/97
cagggcagcggccaggg

SEQ ID NO: 3044089 - RNA, 18 nt, Mycobacterium bovis subsp bovis AF2122/97
cagggcagcggccagggc

SEQ ID NO: 3044090 - RNA, 17 nt, Mycobacterium bovis subsp bovis AF2122/97
cagggcaucagcagagc

SEQ ID NO: 3044091 - RNA, 21 nt, Mycobacterium bovis subsp bovis AF2122/97
cagggcaucagcagagccccg

SEQ ID NO: 3044092 - RNA, 23 nt, Mycobacterium bovis subsp bovis AF2122/97
cagggcaucagcagagccccggc

SEQ ID NO: 3044093 - RNA, 21 nt, Mycobacterium bovis subsp bovis AF2122/97
cagggcaucggucucgcacca

SEQ ID NO: 3044094 - RNA, 17 nt, Mycobacterium bovis subsp bovis AF2122/97
cagggcauugcggcccg

SEQ ID NO: 3044095 - RNA, 15 nt, Mycobacterium bovis subsp bovis AF2122/97
caggucgaucugcgc

SEQ ID NO: 3044096 - RNA, 13 nt, Mycobacterium bovis subsp bovis AF2122/97
caggucgaugcgg

SEQ ID NO: 3044097 - RNA, 17 nt, Mycobacterium bovis subsp bovis AF2122/97
caggucgaugcgggcga

SEQ ID NO: 3044098 - RNA, 15 nt, Mycobacterium bovis subsp bovis AF2122/97
caggucgaugcugcc

SEQ ID NO: 3044099 - RNA, 22 nt, Mycobacterium bovis subsp bovis AF2122/97
caggucgaugcugccagccaug

SEQ ID NO: 3044100 - RNA, 23 nt, Mycobacterium bovis subsp bovis AF2122/97
caggucgaugcugccagccaugg

SEQ ID NO: 3044101 - RNA, 14 nt, Mycobacterium bovis subsp bovis AF2122/97
caggucgcagacca

SEQ ID NO: 3044102 - RNA, 16 nt, Mycobacterium bovis subsp bovis AF2122/97
caggucgcagaccaga

SEQ ID NO: 3044103 - RNA, 17 nt, Mycobacterium bovis subsp bovis AF2122/97
caggucgccagcucggc

SEQ ID NO: 3044104 - RNA, 18 nt, Mycobacterium bovis subsp bovis AF2122/97
caggucgccagcucggca

SEQ ID NO: 3044105 - RNA, 22 nt, Mycobacterium bovis subsp bovis AF2122/97
caggucgcccaacaccgcgccg

SEQ ID NO: 3044106 - RNA, 16 nt, Mycobacterium bovis subsp bovis AF2122/97
caggucgcccggucuc

SEQ ID NO: 3044107 - RNA, 20 nt, Mycobacterium bovis subsp bovis AF2122/97
caggucgccuucccagccga

SEQ ID NO: 3044108 - RNA, 22 nt, Mycobacterium bovis subsp bovis AF2122/97
caggucgccuucuucgcggcgg

SEQ ID NO: 3044109 - RNA, 23 nt, Mycobacterium bovis subsp bovis AF2122/97
caggucgccuucuucgcggcggu

SEQ ID NO: 3044110 - RNA, 20 nt, Mycobacterium bovis subsp bovis AF2122/97
caggucgcgauagccgccgc

SEQ ID NO: 3044111 - RNA, 14 nt, Mycobacterium bovis subsp bovis AF2122/97
caggucgcuggccg

SEQ ID NO: 3044112 - RNA, 15 nt, Mycobacterium bovis subsp bovis AF2122/97
caggucgcuggccgu

SEQ ID NO: 3044113 - RNA, 20 nt, Mycobacterium bovis subsp bovis AF2122/97
caggucggaacuagccaguu

SEQ ID NO: 3044114 - RNA, 14 nt, Mycobacterium bovis subsp bovis AF2122/97
caggucggccaccg

SEQ ID NO: 3044115 - RNA, 22 nt, Mycobacterium bovis subsp bovis AF2122/97
caggucggcgaacaaccgccgc

SEQ ID NO: 3044116 - RNA, 21 nt, Mycobacterium bovis subsp bovis AF2122/97
caggucggcuucgacaaccuc

SEQ ID NO: 3044117 - RNA, 14 nt, Mycobacterium bovis subsp bovis AF2122/97
caggucgggcagca

SEQ ID NO: 3044118 - RNA, 16 nt, Mycobacterium bovis subsp bovis AF2122/97
caggucgggcagcacu

SEQ ID NO: 3044119 - RNA, 21 nt, Mycobacterium bovis subsp bovis AF2122/97
caggucggggucagauccagg

SEQ ID NO: 3044120 - RNA, 15 nt, Mycobacterium bovis subsp bovis AF2122/97
caggucggugacgaa

SEQ ID NO: 3044121 - RNA, 20 nt, Mycobacterium bovis subsp bovis AF2122/97
caggucggugacgaagagca

SEQ ID NO: 3044122 - RNA, 20 nt, Mycobacterium bovis subsp bovis AF2122/97
caggucggugugcaucgccg

SEQ ID NO: 3044123 - RNA, 13 nt, Mycobacterium bovis subsp bovis AF2122/97
caggucgucacgc

SEQ ID NO: 3044124 - RNA, 20 nt, Mycobacterium bovis subsp bovis AF2122/97
caggucguccaucgcgucgu

SEQ ID NO: 3044125 - RNA, 17 nt, Mycobacterium bovis subsp bovis AF2122/97
caggucgucggcgucgc

SEQ ID NO: 3044126 - RNA, 19 nt, Mycobacterium bovis subsp bovis AF2122/97
caggucgucggcgucgcgg

SEQ ID NO: 3044127 - RNA, 17 nt, Mycobacterium bovis subsp bovis AF2122/97
caggucgucguaccggc

SEQ ID NO: 3044128 - RNA, 19 nt, Mycobacterium bovis subsp bovis AF2122/97
caggucgugcccgggacca

SEQ ID NO: 3044129 - RNA, 15 nt, Mycobacterium bovis subsp bovis AF2122/97
caggucgugcuccca

SEQ ID NO: 3044130 - RNA, 21 nt, Mycobacterium bovis subsp bovis AF2122/97
caggucuccaucaaccgcgcu

SEQ ID NO: 3044131 - RNA, 15 nt, Mycobacterium bovis subsp bovis AF2122/97
caggucuccuugggc

SEQ ID NO: 3044132 - RNA, 19 nt, Mycobacterium bovis subsp bovis AF2122/97
caggucuucgauggccaug

SEQ ID NO: 3044133 - RNA, 17 nt, Mycobacterium bovis subsp bovis AF2122/97
caggucuucgcugucga

SEQ ID NO: 3044134 - RNA, 20 nt, Mycobacterium bovis subsp bovis AF2122/97
caggucuuucgaauccccgc

SEQ ID NO: 3044135 - RNA, 18 nt, Mycobacterium bovis subsp bovis AF2122/97
caggugaacaacagcgcu

SEQ ID NO: 3044136 - RNA, 15 nt, Mycobacterium bovis subsp bovis AF2122/97
caggugaacgccggu

SEQ ID NO: 3044137 - RNA, 23 nt, Mycobacterium bovis subsp bovis AF2122/97
caggugaacgccggugcgcugga

SEQ ID NO: 3044138 - RNA, 18 nt, Mycobacterium bovis subsp bovis AF2122/97
caggugacauguugccgc

SEQ ID NO: 3044139 - RNA, 20 nt, Mycobacterium bovis subsp bovis AF2122/97
caggugaccgagaucgucgc

SEQ ID NO: 3044140 - RNA, 16 nt, Mycobacterium bovis subsp bovis AF2122/97
caggugacgaucaggu

SEQ ID NO: 3044141 - RNA, 17 nt, Mycobacterium bovis subsp bovis AF2122/97
caggugacgaucagguc

SEQ ID NO: 3044142 - RNA, 20 nt, Mycobacterium bovis subsp bovis AF2122/97
caggugagccaguuggccag

SEQ ID NO: 3044143 - RNA, 17 nt, Mycobacterium bovis subsp bovis AF2122/97
caggugagugcggcgua

SEQ ID NO: 3044144 - RNA, 16 nt, Mycobacterium bovis subsp bovis AF2122/97
caggugaucccgaugg

SEQ ID NO: 3044145 - RNA, 15 nt, Mycobacterium bovis subsp bovis AF2122/97
caggugaugccgccg

SEQ ID NO: 3044146 - RNA, 20 nt, Mycobacterium bovis subsp bovis AF2122/97
caggugauucgcgcagcgcg

SEQ ID NO: 3044147 - RNA, 16 nt, Mycobacterium bovis subsp bovis AF2122/97
caggugcaagcgguuu

SEQ ID NO: 3044148 - RNA, 19 nt, Mycobacterium bovis subsp bovis AF2122/97
caggugcagcaccagccac

SEQ ID NO: 3044149 - RNA, 17 nt, Mycobacterium bovis subsp bovis AF2122/97
caggugccaaacgccgc

SEQ ID NO: 3044150 - RNA, 18 nt, Mycobacterium bovis subsp bovis AF2122/97
caggugccaaacgccgcc

SEQ ID NO: 3044151 - RNA, 19 nt, Mycobacterium bovis subsp bovis AF2122/97
caggugccaaacgccgccc

SEQ ID NO: 3044152 - RNA, 17 nt, Mycobacterium bovis subsp bovis AF2122/97
caggugccagaccaggg

SEQ ID NO: 3044153 - RNA, 19 nt, Mycobacterium bovis subsp bovis AF2122/97
caggugccagaccagggca

SEQ ID NO: 3044154 - RNA, 20 nt, Mycobacterium bovis subsp bovis AF2122/97
caggugccagaccagggcag

SEQ ID NO: 3044155 - RNA, 15 nt, Mycobacterium bovis subsp bovis AF2122/97
caggugccaggaugu

SEQ ID NO: 3044156 - RNA, 15 nt, Mycobacterium bovis subsp bovis AF2122/97
caggugcccaagcag

SEQ ID NO: 3044157 - RNA, 19 nt, Mycobacterium bovis subsp bovis AF2122/97
caggugcccaucggguggu

SEQ ID NO: 3044158 - RNA, 12 nt, Mycobacterium bovis subsp bovis AF2122/97
caggugcccggc

SEQ ID NO: 3044159 - RNA, 18 nt, Mycobacterium bovis subsp bovis AF2122/97
caggugcccggccaaaau

SEQ ID NO: 3044160 - RNA, 23 nt, Mycobacterium bovis subsp bovis AF2122/97
caggugccgugaucgcuggcgac

SEQ ID NO: 3044161 - RNA, 20 nt, Mycobacterium bovis subsp bovis AF2122/97
caggugccguggcuaccgca

SEQ ID NO: 3044162 - RNA, 15 nt, Mycobacterium bovis subsp bovis AF2122/97
caggugccuucuucg

SEQ ID NO: 3044163 - RNA, 13 nt, Mycobacterium bovis subsp bovis AF2122/97
caggugcggcggc

SEQ ID NO: 3044164 - RNA, 14 nt, Mycobacterium bovis subsp bovis AF2122/97
caggugcgggccgg

SEQ ID NO: 3044165 - RNA, 19 nt, Mycobacterium bovis subsp bovis AF2122/97
caggugcguccaggccagg

SEQ ID NO: 3044166 - RNA, 13 nt, Mycobacterium bovis subsp bovis AF2122/97
caggugcugggcg

SEQ ID NO: 3044167 - RNA, 17 nt, Mycobacterium bovis subsp bovis AF2122/97
cagguggaagugcaccu

SEQ ID NO: 3044168 - RNA, 16 nt, Mycobacterium bovis subsp bovis AF2122/97
cagguggccgcaucgc

SEQ ID NO: 3044169 - RNA, 18 nt, Mycobacterium bovis subsp bovis AF2122/97
cagguggccgcaucgccu

SEQ ID NO: 3044170 - RNA, 22 nt, Mycobacterium bovis subsp bovis AF2122/97
cagguggccgcucuccaccccg

SEQ ID NO: 3044171 - RNA, 16 nt, Mycobacterium bovis subsp bovis AF2122/97
cagguggccgucgccg

SEQ ID NO: 3044172 - RNA, 17 nt, Mycobacterium bovis subsp bovis AF2122/97
cagguggcgcggacccg

SEQ ID NO: 3044173 - RNA, 12 nt, Mycobacterium bovis subsp bovis AF2122/97
caggugggcagc

SEQ ID NO: 3044174 - RNA, 13 nt, Mycobacterium bovis subsp bovis AF2122/97
caggugggcagca

SEQ ID NO: 3044175 - RNA, 17 nt, Mycobacterium bovis subsp bovis AF2122/97
caggugggccgagagca

SEQ ID NO: 3044176 - RNA, 15 nt, Mycobacterium bovis subsp bovis AF2122/97
caggugggcguuggc

SEQ ID NO: 3044177 - RNA, 20 nt, Mycobacterium bovis subsp bovis AF2122/97
caggugggggucaggcagga

SEQ ID NO: 3044178 - RNA, 14 nt, Mycobacterium bovis subsp bovis AF2122/97
caggugggugaacg

SEQ ID NO: 3044179 - RNA, 17 nt, Mycobacterium bovis subsp bovis AF2122/97
cagguggucaucgccac

SEQ ID NO: 3044180 - RNA, 24 nt, Mycobacterium bovis subsp bovis AF2122/97
caggugguucaaccggacgaccgg

SEQ ID NO: 3044181 - RNA, 18 nt, Mycobacterium bovis subsp bovis AF2122/97
cagucccaggugcuggua

SEQ ID NO: 3044182 - RNA, 15 nt, Mycobacterium bovis subsp bovis AF2122/97
cagucccaguucguu

SEQ ID NO: 3044183 - RNA, 17 nt, Mycobacterium bovis subsp bovis AF2122/97
caguccccgccggccuc

SEQ ID NO: 3044184 - RNA, 14 nt, Mycobacterium bovis subsp bovis AF2122/97
cagucccggcgcac

SEQ ID NO: 3044185 - RNA, 15 nt, Mycobacterium bovis subsp bovis AF2122/97
cagucccucgccaac

SEQ ID NO: 3044186 - RNA, 19 nt, Mycobacterium bovis subsp bovis AF2122/97
cagucccucgccaaccagu

SEQ ID NO: 3044187 - RNA, 18 nt, Mycobacterium bovis subsp bovis AF2122/97
caguccgaaagccgccga

SEQ ID NO: 3044188 - RNA, 19 nt, Mycobacterium bovis subsp bovis AF2122/97
caguccgaaagccgccgag

SEQ ID NO: 3044189 - RNA, 16 nt, Mycobacterium bovis subsp bovis AF2122/97
caguccgacaccggcg

SEQ ID NO: 3044190 - RNA, 21 nt, Mycobacterium bovis subsp bovis AF2122/97
caguccgacaccggcggcauc

SEQ ID NO: 3044191 - RNA, 18 nt, Mycobacterium bovis subsp bovis AF2122/97
caguccgaucacccgcac

SEQ ID NO: 3044192 - RNA, 22 nt, Mycobacterium bovis subsp bovis AF2122/97
caguccgaugggaaucagugaa

SEQ ID NO: 3044193 - RNA, 12 nt, Mycobacterium bovis subsp bovis AF2122/97
caguccgauggu

SEQ ID NO: 3044194 - RNA, 20 nt, Mycobacterium bovis subsp bovis AF2122/97
caguccgaugguaugcccgc

SEQ ID NO: 3044195 - RNA, 22 nt, Mycobacterium bovis subsp bovis AF2122/97
caguccgaugguaugcccgccg

SEQ ID NO: 3044196 - RNA, 20 nt, Mycobacterium bovis subsp bovis AF2122/97
caguccggacggcagccggg

SEQ ID NO: 3044197 - RNA, 12 nt, Mycobacterium bovis subsp bovis AF2122/97
caguccggcccc

SEQ ID NO: 3044198 - RNA, 21 nt, Mycobacterium bovis subsp bovis AF2122/97
caguccggcccccgacuccgg

SEQ ID NO: 3044199 - RNA, 20 nt, Mycobacterium bovis subsp bovis AF2122/97
caguccggcggacgugacca

SEQ ID NO: 3044200 - RNA, 21 nt, Mycobacterium bovis subsp bovis AF2122/97
caguccggcguucccgccauu

SEQ ID NO: 3044201 - RNA, 14 nt, Mycobacterium bovis subsp bovis AF2122/97
caguccguccaggu

SEQ ID NO: 3044202 - RNA, 21 nt, Mycobacterium bovis subsp bovis AF2122/97
caguccuaucagugagccgcc

SEQ ID NO: 3044203 - RNA, 18 nt, Mycobacterium bovis subsp bovis AF2122/97
caguccucaucgagcgcg

SEQ ID NO: 3044204 - RNA, 14 nt, Mycobacterium bovis subsp bovis AF2122/97
caguccucgggcag

SEQ ID NO: 3044205 - RNA, 21 nt, Mycobacterium bovis subsp bovis AF2122/97
caguccucgggcaggcggcca

SEQ ID NO: 3044206 - RNA, 23 nt, Mycobacterium bovis subsp bovis AF2122/97
caguccucgggcaggcggccagc

SEQ ID NO: 3044207 - RNA, 22 nt, Mycobacterium bovis subsp bovis AF2122/97
cagucgaccggacacuccugca

SEQ ID NO: 3044208 - RNA, 15 nt, Mycobacterium bovis subsp bovis AF2122/97
cagucgagcaccugc

SEQ ID NO: 3044209 - RNA, 18 nt, Mycobacterium bovis subsp bovis AF2122/97
cagucgagcaccugccga

SEQ ID NO: 3044210 - RNA, 16 nt, Mycobacterium bovis subsp bovis AF2122/97
cagucgagcaucucgu

SEQ ID NO: 3044211 - RNA, 19 nt, Mycobacterium bovis subsp bovis AF2122/97
cagucgagcaucucgucgg

SEQ ID NO: 3044212 - RNA, 20 nt, Mycobacterium bovis subsp bovis AF2122/97
cagucgagugaagccgacau

SEQ ID NO: 3044213 - RNA, 16 nt, Mycobacterium bovis subsp bovis AF2122/97
cagucgaucgcggccc

SEQ ID NO: 3044214 - RNA, 21 nt, Mycobacterium bovis subsp bovis AF2122/97
cagucgaugagugacgguccg

SEQ ID NO: 3044215 - RNA, 19 nt, Mycobacterium bovis subsp bovis AF2122/97
cagucgaugucaaggaaca

SEQ ID NO: 3044216 - RNA, 21 nt, Mycobacterium bovis subsp bovis AF2122/97
cagucgaugucaaggaacagu

SEQ ID NO: 3044217 - RNA, 14 nt, Mycobacterium bovis subsp bovis AF2122/97
cagucgcagccagg

SEQ ID NO: 3044218 - RNA, 13 nt, Mycobacterium bovis subsp bovis AF2122/97
cagucgccggccg

SEQ ID NO: 3044219 - RNA, 18 nt, Mycobacterium bovis subsp bovis AF2122/97
cagucgcgcgcucgcggc

SEQ ID NO: 3044220 - RNA, 21 nt, Mycobacterium bovis subsp bovis AF2122/97
cagucgcgguaccaucaccgc

SEQ ID NO: 3044221 - RNA, 19 nt, Mycobacterium bovis subsp bovis AF2122/97
cagucgcuggguggcgggc

SEQ ID NO: 3044222 - RNA, 23 nt, Mycobacterium bovis subsp bovis AF2122/97
cagucgcuggguggcgggccgga

SEQ ID NO: 3044223 - RNA, 15 nt, Mycobacterium bovis subsp bovis AF2122/97
cagucggccaccugg

SEQ ID NO: 3044224 - RNA, 20 nt, Mycobacterium bovis subsp bovis AF2122/97
cagucggccaccuggucggc

SEQ ID NO: 3044225 - RNA, 14 nt, Mycobacterium bovis subsp bovis AF2122/97
cagucggcgccgcc

SEQ ID NO: 3044226 - RNA, 15 nt, Mycobacterium bovis subsp bovis AF2122/97
cagucgggcagcgcu

SEQ ID NO: 3044227 - RNA, 11 nt, Mycobacterium bovis subsp bovis AF2122/97
cagucggugca

SEQ ID NO: 3044228 - RNA, 12 nt, Mycobacterium bovis subsp bovis AF2122/97
cagucggugcgg

SEQ ID NO: 3044229 - RNA, 15 nt, Mycobacterium bovis subsp bovis AF2122/97
cagucggugcggugc

SEQ ID NO: 3044230 - RNA, 20 nt, Mycobacterium bovis subsp bovis AF2122/97
cagucguacucccaggccgc

SEQ ID NO: 3044231 - RNA, 20 nt, Mycobacterium bovis subsp bovis AF2122/97
cagucgucgcgcucgacaaa

SEQ ID NO: 3044232 - RNA, 17 nt, Mycobacterium bovis subsp bovis AF2122/97
cagucgugggcugugcg

SEQ ID NO: 3044233 - RNA, 18 nt, Mycobacterium bovis subsp bovis AF2122/97
cagucucguggcgcuggg

SEQ ID NO: 3044234 - RNA, 18 nt, Mycobacterium bovis subsp bovis AF2122/97
cagucugauuccacauca

SEQ ID NO: 3044235 - RNA, 22 nt, Mycobacterium bovis subsp bovis AF2122/97
cagucuuguugcuuugcuggcg

SEQ ID NO: 3044236 - RNA, 14 nt, Mycobacterium bovis subsp bovis AF2122/97
cagugaaaccaccg

SEQ ID NO: 3044237 - RNA, 16 nt, Mycobacterium bovis subsp bovis AF2122/97
cagugaaauugccgcc

SEQ ID NO: 3044238 - RNA, 20 nt, Mycobacterium bovis subsp bovis AF2122/97
cagugaaauugccgccgccg

SEQ ID NO: 3044239 - RNA, 14 nt, Mycobacterium bovis subsp bovis AF2122/97
cagugaacauuggg

SEQ ID NO: 3044240 - RNA, 19 nt, Mycobacterium bovis subsp bovis AF2122/97
cagugaacauuggguaccu

SEQ ID NO: 3044241 - RNA, 14 nt, Mycobacterium bovis subsp bovis AF2122/97
cagugaacgcgcgu

SEQ ID NO: 3044242 - RNA, 15 nt, Mycobacterium bovis subsp bovis AF2122/97
cagugaagacaccag

SEQ ID NO: 3044243 - RNA, 19 nt, Mycobacterium bovis subsp bovis AF2122/97
cagugaaucggaccgaccg

SEQ ID NO: 3044244 - RNA, 19 nt, Mycobacterium bovis subsp bovis AF2122/97
cagugacagugcgucgagc

SEQ ID NO: 3044245 - RNA, 15 nt, Mycobacterium bovis subsp bovis AF2122/97
cagugaccgcagucc

SEQ ID NO: 3044246 - RNA, 19 nt, Mycobacterium bovis subsp bovis AF2122/97
cagugaccgcagucccagc

SEQ ID NO: 3044247 - RNA, 18 nt, Mycobacterium bovis subsp bovis AF2122/97
cagugaccgcuggugugu

SEQ ID NO: 3044248 - RNA, 14 nt, Mycobacterium bovis subsp bovis AF2122/97
cagugaccucgucg

SEQ ID NO: 3044249 - RNA, 17 nt, Mycobacterium bovis subsp bovis AF2122/97
cagugaccucgucggcg

SEQ ID NO: 3044250 - RNA, 19 nt, Mycobacterium bovis subsp bovis AF2122/97
cagugaccucgucggcgac

SEQ ID NO: 3044251 - RNA, 20 nt, Mycobacterium bovis subsp bovis AF2122/97
cagugaccucgucggcgacg

SEQ ID NO: 3044252 - RNA, 15 nt, Mycobacterium bovis subsp bovis AF2122/97
cagugaccugggcgc

SEQ ID NO: 3044253 - RNA, 16 nt, Mycobacterium bovis subsp bovis AF2122/97
cagugaccugggcgcc

SEQ ID NO: 3044254 - RNA, 22 nt, Mycobacterium bovis subsp bovis AF2122/97
cagugaccugggcgccccaggg

SEQ ID NO: 3044255 - RNA, 14 nt, Mycobacterium bovis subsp bovis AF2122/97
cagugacgccucga

SEQ ID NO: 3044256 - RNA, 16 nt, Mycobacterium bovis subsp bovis AF2122/97
cagugacucgaucacc

SEQ ID NO: 3044257 - RNA, 15 nt, Mycobacterium bovis subsp bovis AF2122/97
cagugagcaugcgac

SEQ ID NO: 3044258 - RNA, 16 nt, Mycobacterium bovis subsp bovis AF2122/97
cagugaugcgccccgg

SEQ ID NO: 3044259 - RNA, 12 nt, Mycobacterium bovis subsp bovis AF2122/97
cagugauucggc

SEQ ID NO: 3044260 - RNA, 22 nt, Mycobacterium bovis subsp bovis AF2122/97
cagugauucggccugagcggcc

SEQ ID NO: 3044261 - RNA, 16 nt, Mycobacterium bovis subsp bovis AF2122/97
cagugauugagcagca

SEQ ID NO: 3044262 - RNA, 17 nt, Mycobacterium bovis subsp bovis AF2122/97
cagugcacccgggccgc

SEQ ID NO: 3044263 - RNA, 16 nt, Mycobacterium bovis subsp bovis AF2122/97
cagugcaccgcgucgu

SEQ ID NO: 3044264 - RNA, 18 nt, Mycobacterium bovis subsp bovis AF2122/97
cagugcacgcucggcgcc

SEQ ID NO: 3044265 - RNA, 17 nt, Mycobacterium bovis subsp bovis AF2122/97
cagugcagacaggcggc

SEQ ID NO: 3044266 - RNA, 12 nt, Mycobacterium bovis subsp bovis AF2122/97
cagugcaggcgg

SEQ ID NO: 3044267 - RNA, 13 nt, Mycobacterium bovis subsp bovis AF2122/97
cagugcaggcggc

SEQ ID NO: 3044268 - RNA, 16 nt, Mycobacterium bovis subsp bovis AF2122/97
cagugugggggucagg

SEQ ID NO: 3044269 - RNA, 14 nt, Mycobacterium bovis subsp bovis AF2122/97
caguguggugcggc

SEQ ID NO: 3044270 - RNA, 20 nt, Mycobacterium bovis subsp bovis AF2122/97
caguguguccugucgcacca

SEQ ID NO: 3044271 - RNA, 16 nt, Mycobacterium bovis subsp bovis AF2122/97
caguguuccgccaccc

SEQ ID NO: 3044272 - RNA, 17 nt, Mycobacterium bovis subsp bovis AF2122/97
caguguugcgcugcggc

SEQ ID NO: 3044273 - RNA, 21 nt, Mycobacterium bovis subsp bovis AF2122/97
caguguugcgcugcggccagc

SEQ ID NO: 3044274 - RNA, 22 nt, Mycobacterium bovis subsp bovis AF2122/97
caguguugcgcugcggccagcg

SEQ ID NO: 3044275 - RNA, 23 nt, Mycobacterium bovis subsp bovis AF2122/97
caguguuuuugcagacucggcga

SEQ ID NO: 3044276 - RNA, 14 nt, Mycobacterium bovis subsp bovis AF2122/97
caguuaaagguggu

SEQ ID NO: 3044277 - RNA, 17 nt, Mycobacterium bovis subsp bovis AF2122/97
caguuauccgguguccu

SEQ ID NO: 3044278 - RNA, 17 nt, Mycobacterium bovis subsp bovis AF2122/97
caguucaacgaggccga

SEQ ID NO: 3044279 - RNA, 15 nt, Mycobacterium bovis subsp bovis AF2122/97
caguucacguucggc

SEQ ID NO: 3044280 - RNA, 17 nt, Mycobacterium bovis subsp bovis AF2122/97
caguucaucgggcacca

SEQ ID NO: 3044281 - RNA, 15 nt, Mycobacterium bovis subsp bovis AF2122/97
caguuccaccgcgca

SEQ ID NO: 3044282 - RNA, 17 nt, Mycobacterium bovis subsp bovis AF2122/97
caguuccaccgcgcagg

SEQ ID NO: 3044283 - RNA, 16 nt, Mycobacterium bovis subsp bovis AF2122/97
caguuccagcucgcgg

SEQ ID NO: 3044284 - RNA, 14 nt, Mycobacterium bovis subsp bovis AF2122/97
caguucccagacca

SEQ ID NO: 3044285 - RNA, 13 nt, Mycobacterium bovis subsp bovis AF2122/97
caguucccggcca

SEQ ID NO: 3044286 - RNA, 13 nt, Mycobacterium bovis subsp bovis AF2122/97
caguuccgcugcg

SEQ ID NO: 3044287 - RNA, 16 nt, Mycobacterium bovis subsp bovis AF2122/97
caguucgacggcguca

SEQ ID NO: 3044288 - RNA, 13 nt, Mycobacterium bovis subsp bovis AF2122/97
caguucgccgcgc

SEQ ID NO: 3044289 - RNA, 18 nt, Mycobacterium bovis subsp bovis AF2122/97
caguucgccgcgcagcgu

SEQ ID NO: 3044290 - RNA, 15 nt, Mycobacterium bovis subsp bovis AF2122/97
caguucgcggccauc

SEQ ID NO: 3044291 - RNA, 21 nt, Mycobacterium bovis subsp bovis AF2122/97
caguucggccuugaucgugcu

SEQ ID NO: 3044292 - RNA, 20 nt, Mycobacterium bovis subsp bovis AF2122/97
caguucggcggccgccgcgu

SEQ ID NO: 3044293 - RNA, 16 nt, Mycobacterium bovis subsp bovis AF2122/97
caguucggcguacggu

SEQ ID NO: 3044294 - RNA, 21 nt, Mycobacterium bovis subsp bovis AF2122/97
caguucggcgucguccgcgcc

SEQ ID NO: 3044295 - RNA, 21 nt, Mycobacterium bovis subsp bovis AF2122/97
caguucggugagccgggcggc

SEQ ID NO: 3044296 - RNA, 17 nt, Mycobacterium bovis subsp bovis AF2122/97
caguucgguguuggaca

SEQ ID NO: 3044297 - RNA, 15 nt, Mycobacterium bovis subsp bovis AF2122/97
caguucgugacgugc

SEQ ID NO: 3044298 - RNA, 14 nt, Mycobacterium bovis subsp bovis AF2122/97
caguucguggcugg

SEQ ID NO: 3044299 - RNA, 23 nt, Mycobacterium bovis subsp bovis AF2122/97
caguucguggcuggcaugccggc

SEQ ID NO: 3044300 - RNA, 23 nt, Mycobacterium bovis subsp bovis AF2122/97
caguucguugguguuggaagcgc

SEQ ID NO: 3044301 - RNA, 20 nt, Mycobacterium bovis subsp bovis AF2122/97
caguucuaccaccuugccga

SEQ ID NO: 3044302 - RNA, 22 nt, Mycobacterium bovis subsp bovis AF2122/97
caguucucgcgcuugcgccgcc

SEQ ID NO: 3044303 - RNA, 22 nt, Mycobacterium bovis subsp bovis AF2122/97
caguucugcacagugcggcccc

SEQ ID NO: 3044304 - RNA, 18 nt, Mycobacterium bovis subsp bovis AF2122/97
caguucuuggcgaccuug

SEQ ID NO: 3044305 - RNA, 15 nt, Mycobacterium bovis subsp bovis AF2122/97
caguugaacucgacc

SEQ ID NO: 3044306 - RNA, 16 nt, Mycobacterium bovis subsp bovis AF2122/97
caguugaucaggccga

SEQ ID NO: 3044307 - RNA, 16 nt, Mycobacterium bovis subsp bovis AF2122/97
caguugauccugcagu

SEQ ID NO: 3044308 - RNA, 22 nt, Mycobacterium bovis subsp bovis AF2122/97
caguugauccugcaguacggcc

SEQ ID NO: 3044309 - RNA, 17 nt, Mycobacterium bovis subsp bovis AF2122/97
caguugcacaccgaucg

SEQ ID NO: 3044310 - RNA, 15 nt, Mycobacterium bovis subsp bovis AF2122/97
caguugcacaucggu

SEQ ID NO: 3044311 - RNA, 19 nt, Mycobacterium bovis subsp bovis AF2122/97
caguugcccgacgccgguc

SEQ ID NO: 3044312 - RNA, 18 nt, Mycobacterium bovis subsp bovis AF2122/97
caguugccgguugccacc

SEQ ID NO: 3044313 - RNA, 15 nt, Mycobacterium bovis subsp bovis AF2122/97
caguugcgcuccaac

SEQ ID NO: 3044314 - RNA, 17 nt, Mycobacterium bovis subsp bovis AF2122/97
caguuggaacugaugaa

SEQ ID NO: 3044315 - RNA, 13 nt, Mycobacterium bovis subsp bovis AF2122/97
caguuggcaccag

SEQ ID NO: 3044316 - RNA, 17 nt, Mycobacterium bovis subsp bovis AF2122/97
caguuggcaccagccgg

SEQ ID NO: 3044317 - RNA, 14 nt, Mycobacterium bovis subsp bovis AF2122/97
caguuggcagcgcu

SEQ ID NO: 3044318 - RNA, 15 nt, Mycobacterium bovis subsp bovis AF2122/97
caguugguagagcac

SEQ ID NO: 3044319 - RNA, 15 nt, Mycobacterium bovis subsp bovis AF2122/97
caguugguagccgcc

SEQ ID NO: 3044320 - RNA, 21 nt, Mycobacterium bovis subsp bovis AF2122/97
caguugucuggucauggccga

SEQ ID NO: 3044321 - RNA, 15 nt, Mycobacterium bovis subsp bovis AF2122/97
caguugugcggccag

SEQ ID NO: 3044322 - RNA, 18 nt, Mycobacterium bovis subsp bovis AF2122/97
caguuguggcgcugcguc

SEQ ID NO: 3044323 - RNA, 19 nt, Mycobacterium bovis subsp bovis AF2122/97
caguuuaccgugccgcccg

SEQ ID NO: 3044324 - RNA, 14 nt, Mycobacterium bovis subsp bovis AF2122/97
caguuugacgccga

SEQ ID NO: 3044325 - RNA, 15 nt, Mycobacterium bovis subsp bovis AF2122/97
caguuuggcggcgcg

SEQ ID NO: 3044326 - RNA, 20 nt, Mycobacterium bovis subsp bovis AF2122/97
caguuugggauccuggccga

SEQ ID NO: 3044327 - RNA, 14 nt, Mycobacterium bovis subsp bovis AF2122/97
caguuugugccgcc

SEQ ID NO: 3044328 - RNA, 13 nt, Mycobacterium bovis subsp bovis AF2122/97
caguuuucaccgc

SEQ ID NO: 3044329 - RNA, 20 nt, Mycobacterium bovis subsp bovis AF2122/97
cauaaaacucgggggcugca

SEQ ID NO: 3044330 - RNA, 19 nt, Mycobacterium bovis subsp bovis AF2122/97
cauaaaccgcguccgcgcg

SEQ ID NO: 3044331 - RNA, 19 nt, Mycobacterium bovis subsp bovis AF2122/97
cauaaagaucagcaugguc

SEQ ID NO: 3044332 - RNA, 17 nt, Mycobacterium bovis subsp bovis AF2122/97
cauaaagguccaaccac

SEQ ID NO: 3044333 - RNA, 15 nt, Mycobacterium bovis subsp bovis AF2122/97
cauaacaccggguag

SEQ ID NO: 3044334 - RNA, 12 nt, Mycobacterium bovis subsp bovis AF2122/97
cauaacagcugg

SEQ ID NO: 3044335 - RNA, 15 nt, Mycobacterium bovis subsp bovis AF2122/97
cauaacccgcaccgg

SEQ ID NO: 3044336 - RNA, 16 nt, Mycobacterium bovis subsp bovis AF2122/97
cauaacccuggccggu

SEQ ID NO: 3044337 - RNA, 18 nt, Mycobacterium bovis subsp bovis AF2122/97
cauaacccuggccggugc

SEQ ID NO: 3044338 - RNA, 15 nt, Mycobacterium bovis subsp bovis AF2122/97
cauaaccggcgcgcc

SEQ ID NO: 3044339 - RNA, 21 nt, Mycobacterium bovis subsp bovis AF2122/97
cauaaccggcgcgccccgccg

SEQ ID NO: 3044340 - RNA, 13 nt, Mycobacterium bovis subsp bovis AF2122/97
cauaaccgguggg

SEQ ID NO: 3044341 - RNA, 15 nt, Mycobacterium bovis subsp bovis AF2122/97
cauaacugcggccca

SEQ ID NO: 3044342 - RNA, 19 nt, Mycobacterium bovis subsp bovis AF2122/97
cauaagcccccgacacgcc

SEQ ID NO: 3044343 - RNA, 17 nt, Mycobacterium bovis subsp bovis AF2122/97
cauaagcccccgccacg

SEQ ID NO: 3044344 - RNA, 19 nt, Mycobacterium bovis subsp bovis AF2122/97
cauaagcgaggaucucggc

SEQ ID NO: 3044345 - RNA, 20 nt, Mycobacterium bovis subsp bovis AF2122/97
cauaagcgaggaucucggcg

SEQ ID NO: 3044346 - RNA, 18 nt, Mycobacterium bovis subsp bovis AF2122/97
cauaagcucguagagcac

SEQ ID NO: 3044347 - RNA, 16 nt, Mycobacterium bovis subsp bovis AF2122/97
cauaagugaacagcag

SEQ ID NO: 3044348 - RNA, 17 nt, Mycobacterium bovis subsp bovis AF2122/97
cauaauauugccgccuc

SEQ ID NO: 3044349 - RNA, 18 nt, Mycobacterium bovis subsp bovis AF2122/97
cauacaacuggugggcca

SEQ ID NO: 3044350 - RNA, 18 nt, Mycobacterium bovis subsp bovis AF2122/97
cauacaccggccggucca

SEQ ID NO: 3044351 - RNA, 14 nt, Mycobacterium bovis subsp bovis AF2122/97
cauacagccgccga

SEQ ID NO: 3044352 - RNA, 14 nt, Mycobacterium bovis subsp bovis AF2122/97
cauacagcgcccgg

SEQ ID NO: 3044353 - RNA, 21 nt, Mycobacterium bovis subsp bovis AF2122/97
cauacagcgggcgcuguaguc

SEQ ID NO: 3044354 - RNA, 18 nt, Mycobacterium bovis subsp bovis AF2122/97
cauaccaagcgcgguggu

SEQ ID NO: 3044355 - RNA, 18 nt, Mycobacterium bovis subsp bovis AF2122/97
caucaccaccggcaccgc

SEQ ID NO: 3044356 - RNA, 20 nt, Mycobacterium bovis subsp bovis AF2122/97
caucaccaccggcaccgcug

SEQ ID NO: 3044357 - RNA, 18 nt, Mycobacterium bovis subsp bovis AF2122/97
caucaccacggccgccga

SEQ ID NO: 3044358 - RNA, 15 nt, Mycobacterium bovis subsp bovis AF2122/97
caucaccacuggacc

SEQ ID NO: 3044359 - RNA, 16 nt, Mycobacterium bovis subsp bovis AF2122/97
caucaccacuggcggu

SEQ ID NO: 3044360 - RNA, 20 nt, Mycobacterium bovis subsp bovis AF2122/97
caucaccagaaauggcgcca

SEQ ID NO: 3044361 - RNA, 15 nt, Mycobacterium bovis subsp bovis AF2122/97
caucacccagcgccg

SEQ ID NO: 3044362 - RNA, 13 nt, Mycobacterium bovis subsp bovis AF2122/97
caucaccccggcc

SEQ ID NO: 3044363 - RNA, 16 nt, Mycobacterium bovis subsp bovis AF2122/97
caucaccccggccuug

SEQ ID NO: 3044364 - RNA, 20 nt, Mycobacterium bovis subsp bovis AF2122/97
caucaccgaacggcgaggug

SEQ ID NO: 3044365 - RNA, 15 nt, Mycobacterium bovis subsp bovis AF2122/97
caucaccgaccaacg

SEQ ID NO: 3044366 - RNA, 21 nt, Mycobacterium bovis subsp bovis AF2122/97
caucaccgaccaacgcggugu

SEQ ID NO: 3044367 - RNA, 18 nt, Mycobacterium bovis subsp bovis AF2122/97
caucaccgccagccccgc

SEQ ID NO: 3044368 - RNA, 15 nt, Mycobacterium bovis subsp bovis AF2122/97
caucaccgccgcggc

SEQ ID NO: 3044369 - RNA, 17 nt, Mycobacterium bovis subsp bovis AF2122/97
caucaccgccgcggccg

SEQ ID NO: 3044370 - RNA, 13 nt, Mycobacterium bovis subsp bovis AF2122/97
caucaccgccguu

SEQ ID NO: 3044371 - RNA, 12 nt, Mycobacterium bovis subsp bovis AF2122/97
caucaccgcgcc

SEQ ID NO: 3044372 - RNA, 14 nt, Mycobacterium bovis subsp bovis AF2122/97
caucaccgcgccag

SEQ ID NO: 3044373 - RNA, 12 nt, Mycobacterium bovis subsp bovis AF2122/97
caucaccggcau

SEQ ID NO: 3044374 - RNA, 21 nt, Mycobacterium bovis subsp bovis AF2122/97
caucaccggcaugcgugccgg

SEQ ID NO: 3044375 - RNA, 18 nt, Mycobacterium bovis subsp bovis AF2122/97
caucaccggcgcaccguc

SEQ ID NO: 3044376 - RNA, 20 nt, Mycobacterium bovis subsp bovis AF2122/97
caucaccggcggccccaggg

SEQ ID NO: 3044377 - RNA, 21 nt, Mycobacterium bovis subsp bovis AF2122/97
caucaccggugcgcuggaggc

SEQ ID NO: 3044378 - RNA, 19 nt, Mycobacterium bovis subsp bovis AF2122/97
caucaccucgaugccgccc

SEQ ID NO: 3044379 - RNA, 21 nt, Mycobacterium bovis subsp bovis AF2122/97
caucacgaaggcguucgccgg

SEQ ID NO: 3044380 - RNA, 15 nt, Mycobacterium bovis subsp bovis AF2122/97
caucacgaccagggu

SEQ ID NO: 3044381 - RNA, 18 nt, Mycobacterium bovis subsp bovis AF2122/97
caucacgcacugauguca

SEQ ID NO: 3044382 - RNA, 14 nt, Mycobacterium bovis subsp bovis AF2122/97
caucacgcccacga

SEQ ID NO: 3044383 - RNA, 11 nt, Mycobacterium bovis subsp bovis AF2122/97
caucacgcccu

SEQ ID NO: 3044384 - RNA, 13 nt, Mycobacterium bovis subsp bovis AF2122/97
caucacgccgccg

SEQ ID NO: 3044385 - RNA, 14 nt, Mycobacterium bovis subsp bovis AF2122/97
caucacgccgccgg

SEQ ID NO: 3044386 - RNA, 22 nt, Mycobacterium bovis subsp bovis AF2122/97
caucacggcggggaucgcuggc

SEQ ID NO: 3044387 - RNA, 20 nt, Mycobacterium bovis subsp bovis AF2122/97
caucacggucagccguacgc

SEQ ID NO: 3044388 - RNA, 14 nt, Mycobacterium bovis subsp bovis AF2122/97
caucacguccgcgg

SEQ ID NO: 3044389 - RNA, 16 nt, Mycobacterium bovis subsp bovis AF2122/97
caucacguccgcggug

SEQ ID NO: 3044390 - RNA, 14 nt, Mycobacterium bovis subsp bovis AF2122/97
caucacucgcgcca

SEQ ID NO: 3044391 - RNA, 17 nt, Mycobacterium bovis subsp bovis AF2122/97
caucacucgcgccagug

SEQ ID NO: 3044392 - RNA, 18 nt, Mycobacterium bovis subsp bovis AF2122/97
caucagaaccuccucggg

SEQ ID NO: 3044393 - RNA, 20 nt, Mycobacterium bovis subsp bovis AF2122/97
caucagaaucaggcucgccg

SEQ ID NO: 3044394 - RNA, 16 nt, Mycobacterium bovis subsp bovis AF2122/97
caucagagacagcagc

SEQ ID NO: 3044395 - RNA, 14 nt, Mycobacterium bovis subsp bovis AF2122/97
caucagcacgguga

SEQ ID NO: 3044396 - RNA, 14 nt, Mycobacterium bovis subsp bovis AF2122/97
caucagcacgucgc

SEQ ID NO: 3044397 - RNA, 19 nt, Mycobacterium bovis subsp bovis AF2122/97
caucagcaggaccaacgcc

SEQ ID NO: 3044398 - RNA, 14 nt, Mycobacterium bovis subsp bovis AF2122/97
caucagcccggcgc

SEQ ID NO: 3044399 - RNA, 15 nt, Mycobacterium bovis subsp bovis AF2122/97
caucagcccggcgcg

SEQ ID NO: 3044400 - RNA, 12 nt, Mycobacterium bovis subsp bovis AF2122/97
caucagccgcac

SEQ ID NO: 3044401 - RNA, 15 nt, Mycobacterium bovis subsp bovis AF2122/97
caucagccgcugcgu

SEQ ID NO: 3044402 - RNA, 14 nt, Mycobacterium bovis subsp bovis AF2122/97
caucagcgacagcg

SEQ ID NO: 3044403 - RNA, 13 nt, Mycobacterium bovis subsp bovis AF2122/97
caucagcgcgacc

SEQ ID NO: 3044404 - RNA, 13 nt, Mycobacterium bovis subsp bovis AF2122/97
caucagcggcgcc

SEQ ID NO: 3044405 - RNA, 19 nt, Mycobacterium bovis subsp bovis AF2122/97
caucagcggcgccaguaug

SEQ ID NO: 3044406 - RNA, 16 nt, Mycobacterium bovis subsp bovis AF2122/97
caucagcggcgccgca

SEQ ID NO: 3044407 - RNA, 18 nt, Mycobacterium bovis subsp bovis AF2122/97
caucagcucgaugccgug

SEQ ID NO: 3044408 - RNA, 20 nt, Mycobacterium bovis subsp bovis AF2122/97
caucaggaagcgugcggucg

SEQ ID NO: 3044409 - RNA, 18 nt, Mycobacterium bovis subsp bovis AF2122/97
caucaggccgcgcggacc

SEQ ID NO: 3044410 - RNA, 23 nt, Mycobacterium bovis subsp bovis AF2122/97
caucaggucggcgaacaaccgcc

SEQ ID NO: 3044411 - RNA, 20 nt, Mycobacterium bovis subsp bovis AF2122/97
caucaggucgguggucucga

SEQ ID NO: 3044412 - RNA, 16 nt, Mycobacterium bovis subsp bovis AF2122/97
caucagguuguacagg

SEQ ID NO: 3044413 - RNA, 17 nt, Mycobacterium bovis subsp bovis AF2122/97
caucagugcgccggcga

SEQ ID NO: 3044414 - RNA, 17 nt, Mycobacterium bovis subsp bovis AF2122/97
caucagugcucccgaua

SEQ ID NO: 3044415 - RNA, 17 nt, Mycobacterium bovis subsp bovis AF2122/97
caucaguuugacgccga

SEQ ID NO: 3044416 - RNA, 16 nt, Mycobacterium bovis subsp bovis AF2122/97
caucaucccgacccug

SEQ ID NO: 3044417 - RNA, 21 nt, Mycobacterium bovis subsp bovis AF2122/97
caucaucgacggugaucaggu

SEQ ID NO: 3044418 - RNA, 12 nt, Mycobacterium bovis subsp bovis AF2122/97
caucaucgccac

SEQ ID NO: 3044419 - RNA, 17 nt, Mycobacterium bovis subsp bovis AF2122/97
caucaucgccaccaccc

SEQ ID NO: 3044420 - RNA, 20 nt, Mycobacterium bovis subsp bovis AF2122/97
caucaucgcccugggcgccg

SEQ ID NO: 3044421 - RNA, 16 nt, Mycobacterium bovis subsp bovis AF2122/97
caucaucgcugugcgc

SEQ ID NO: 3044422 - RNA, 18 nt, Mycobacterium bovis subsp bovis AF2122/97
caucaucggguccacguc

SEQ ID NO: 3044423 - RNA, 14 nt, Mycobacterium bovis subsp bovis AF2122/97
caucaucucggugg

SEQ ID NO: 3044424 - RNA, 20 nt, Mycobacterium bovis subsp bovis AF2122/97
caucauggccggaucccagu

SEQ ID NO: 3044425 - RNA, 22 nt, Mycobacterium bovis subsp bovis AF2122/97
caucauggccgugaacugcgua

SEQ ID NO: 3044426 - RNA, 14 nt, Mycobacterium bovis subsp bovis AF2122/97
caucauggcggccc

SEQ ID NO: 3044427 - RNA, 20 nt, Mycobacterium bovis subsp bovis AF2122/97
caucaugucggcgcaggcgu

SEQ ID NO: 3044428 - RNA, 22 nt, Mycobacterium bovis subsp bovis AF2122/97
caucauguggucaacggccgac

SEQ ID NO: 3044429 - RNA, 18 nt, Mycobacterium bovis subsp bovis AF2122/97
cauccaaccguggucccu

SEQ ID NO: 3044430 - RNA, 15 nt, Mycobacterium bovis subsp bovis AF2122/97
cauccaacgcggcgc

SEQ ID NO: 3044431 - RNA, 23 nt, Mycobacterium bovis subsp bovis AF2122/97
cauccaacgcggcgcgagccugc

SEQ ID NO: 3044432 - RNA, 20 nt, Mycobacterium bovis subsp bovis AF2122/97
cauccaagaaagugcacaca

SEQ ID NO: 3044433 - RNA, 16 nt, Mycobacterium bovis subsp bovis AF2122/97
cauccaauaucgcuuu

SEQ ID NO: 3044434 - RNA, 14 nt, Mycobacterium bovis subsp bovis AF2122/97
cauccacaaucaca

SEQ ID NO: 3044435 - RNA, 13 nt, Mycobacterium bovis subsp bovis AF2122/97
cauccaccgaugg

SEQ ID NO: 3044436 - RNA, 14 nt, Mycobacterium bovis subsp bovis AF2122/97
cauccaccucgaug

SEQ ID NO: 3044437 - RNA, 18 nt, Mycobacterium bovis subsp bovis AF2122/97
cauccacgcacucacuac

SEQ ID NO: 3044438 - RNA, 14 nt, Mycobacterium bovis subsp bovis AF2122/97
cauccacgucgccc

SEQ ID NO: 3044439 - RNA, 14 nt, Mycobacterium bovis subsp bovis AF2122/97
cauccacugcggcg

SEQ ID NO: 3044440 - RNA, 22 nt, Mycobacterium bovis subsp bovis AF2122/97
cauccacugcggcgcugggacg

SEQ ID NO: 3044441 - RNA, 17 nt, Mycobacterium bovis subsp bovis AF2122/97
cauccagaagccggcca

SEQ ID NO: 3044442 - RNA, 22 nt, Mycobacterium bovis subsp bovis AF2122/97
cauccgugucgagaucucacgu

SEQ ID NO: 3044443 - RNA, 21 nt, Mycobacterium bovis subsp bovis AF2122/97
cauccuccucgucgacgucgg

SEQ ID NO: 3044444 - RNA, 16 nt, Mycobacterium bovis subsp bovis AF2122/97
cauccucgagcugcug

SEQ ID NO: 3044445 - RNA, 21 nt, Mycobacterium bovis subsp bovis AF2122/97
cauccucugaaccagcugagc

SEQ ID NO: 3044446 - RNA, 18 nt, Mycobacterium bovis subsp bovis AF2122/97
cauccuggcggcugcagc

SEQ ID NO: 3044447 - RNA, 19 nt, Mycobacterium bovis subsp bovis AF2122/97
cauccuggcggcugcagcc

SEQ ID NO: 3044448 - RNA, 19 nt, Mycobacterium bovis subsp bovis AF2122/97
cauccuguggcggggcaac

SEQ ID NO: 3044449 - RNA, 15 nt, Mycobacterium bovis subsp bovis AF2122/97
cauccuuaugcgcgg

SEQ ID NO: 3044450 - RNA, 16 nt, Mycobacterium bovis subsp bovis AF2122/97
cauccuuaugcgcggu

SEQ ID NO: 3044451 - RNA, 16 nt, Mycobacterium bovis subsp bovis AF2122/97
cauccuucgccggcgc

SEQ ID NO: 3044452 - RNA, 16 nt, Mycobacterium bovis subsp bovis AF2122/97
cauccuugacgcggcc

SEQ ID NO: 3044453 - RNA, 17 nt, Mycobacterium bovis subsp bovis AF2122/97
cauccuugccaaucgcc

SEQ ID NO: 3044454 - RNA, 19 nt, Mycobacterium bovis subsp bovis AF2122/97
caucgaaaaaccucgacgc

SEQ ID NO: 3044455 - RNA, 20 nt, Mycobacterium bovis subsp bovis AF2122/97
caucgaaaaaccucgacgcc

SEQ ID NO: 3044456 - RNA, 16 nt, Mycobacterium bovis subsp bovis AF2122/97
caucgaaaaccgaggc

SEQ ID NO: 3044457 - RNA, 12 nt, Mycobacterium bovis subsp bovis AF2122/97
caucgaacgacg

SEQ ID NO: 3044458 - RNA, 19 nt, Mycobacterium bovis subsp bovis AF2122/97
caucgaacuucgauucugg

SEQ ID NO: 3044459 - RNA, 15 nt, Mycobacterium bovis subsp bovis AF2122/97
caucgaaggugcugg

SEQ ID NO: 3044460 - RNA, 17 nt, Mycobacterium bovis subsp bovis AF2122/97
caucgaaggugcuggug

SEQ ID NO: 3044461 - RNA, 17 nt, Mycobacterium bovis subsp bovis AF2122/97
caucgaagugcggcccg

SEQ ID NO: 3044462 - RNA, 19 nt, Mycobacterium bovis subsp bovis AF2122/97
caucgaauuccagccagcc

SEQ ID NO: 3044463 - RNA, 22 nt, Mycobacterium bovis subsp bovis AF2122/97
caucgaauuccagccagccgcc

SEQ ID NO: 3044464 - RNA, 22 nt, Mycobacterium bovis subsp bovis AF2122/97
caucgacagcaucacgcccacg

SEQ ID NO: 3044465 - RNA, 13 nt, Mycobacterium bovis subsp bovis AF2122/97
caucgaccgcccg

SEQ ID NO: 3044466 - RNA, 14 nt, Mycobacterium bovis subsp bovis AF2122/97
caucgaccgcccgc

SEQ ID NO: 3044467 - RNA, 15 nt, Mycobacterium bovis subsp bovis AF2122/97
caucgaccgcccgcc

SEQ ID NO: 3044468 - RNA, 19 nt, Mycobacterium bovis subsp bovis AF2122/97
caucgaccgcccgccagcg

SEQ ID NO: 3044469 - RNA, 17 nt, Mycobacterium bovis subsp bovis AF2122/97
caucgaccgcggccggg

SEQ ID NO: 3044470 - RNA, 19 nt, Mycobacterium bovis subsp bovis AF2122/97
caucgaccgcggccgggug

SEQ ID NO: 3044471 - RNA, 21 nt, Mycobacterium bovis subsp bovis AF2122/97
caucgaccguccgggucacca

SEQ ID NO: 3044472 - RNA, 14 nt, Mycobacterium bovis subsp bovis AF2122/97
caucgaccuggcca

SEQ ID NO: 3044473 - RNA, 15 nt, Mycobacterium bovis subsp bovis AF2122/97
caucgaccuggccac

SEQ ID NO: 3044474 - RNA, 19 nt, Mycobacterium bovis subsp bovis AF2122/97
caucgacgagccgcggucg

SEQ ID NO: 3044475 - RNA, 14 nt, Mycobacterium bovis subsp bovis AF2122/97
caucgacgcgcgcu

SEQ ID NO: 3044476 - RNA, 15 nt, Mycobacterium bovis subsp bovis AF2122/97
caucgacgcggccaa

SEQ ID NO: 3044477 - RNA, 22 nt, Mycobacterium bovis subsp bovis AF2122/97
caucgacgcucaucucgggcac

SEQ ID NO: 3044478 - RNA, 23 nt, Mycobacterium bovis subsp bovis AF2122/97
caucgacgcucaucucgggcacg

SEQ ID NO: 3044479 - RNA, 17 nt, Mycobacterium bovis subsp bovis AF2122/97
caucgacggugaucagg

SEQ ID NO: 3044480 - RNA, 16 nt, Mycobacterium bovis subsp bovis AF2122/97
caucgacguuccagca

SEQ ID NO: 3044481 - RNA, 18 nt, Mycobacterium bovis subsp bovis AF2122/97
caucgacugccagcgccg

SEQ ID NO: 3044482 - RNA, 20 nt, Mycobacterium bovis subsp bovis AF2122/97
caucgacugccagcgccgcg

SEQ ID NO: 3044483 - RNA, 18 nt, Mycobacterium bovis subsp bovis AF2122/97
caucgagacgagccacgg

SEQ ID NO: 3044484 - RNA, 14 nt, Mycobacterium bovis subsp bovis AF2122/97
caucgagacgcacg

SEQ ID NO: 3044485 - RNA, 20 nt, Mycobacterium bovis subsp bovis AF2122/97
caucgagaguugaauccggg

SEQ ID NO: 3044486 - RNA, 19 nt, Mycobacterium bovis subsp bovis AF2122/97
caucgagcaccuccacugg

SEQ ID NO: 3044487 - RNA, 23 nt, Mycobacterium bovis subsp bovis AF2122/97
caucgagcaccuccacugggucg

SEQ ID NO: 3044488 - RNA, 18 nt, Mycobacterium bovis subsp bovis AF2122/97
caucgagcaguggccgcc

SEQ ID NO: 3044489 - RNA, 20 nt, Mycobacterium bovis subsp bovis AF2122/97
caucgagccaacgcgcagag

SEQ ID NO: 3044490 - RNA, 20 nt, Mycobacterium bovis subsp bovis AF2122/97
caucgagcccggacgagugc

SEQ ID NO: 3044491 - RNA, 14 nt, Mycobacterium bovis subsp bovis AF2122/97
caucgagcgggauc

SEQ ID NO: 3044492 - RNA, 18 nt, Mycobacterium bovis subsp bovis AF2122/97
caucgagcgggaucgggc

SEQ ID NO: 3044493 - RNA, 15 nt, Mycobacterium bovis subsp bovis AF2122/97
caucgaggccacgcc

SEQ ID NO: 3044494 - RNA, 14 nt, Mycobacterium bovis subsp bovis AF2122/97
caucgaguccacca

SEQ ID NO: 3044495 - RNA, 15 nt, Mycobacterium bovis subsp bovis AF2122/97
caucgaguccaccac

SEQ ID NO: 3044496 - RNA, 23 nt, Mycobacterium bovis subsp bovis AF2122/97
caucgagucgaagaaccugagca

SEQ ID NO: 3044497 - RNA, 17 nt, Mycobacterium bovis subsp bovis AF2122/97
caucgaguucggcccgc

SEQ ID NO: 3044498 - RNA, 22 nt, Mycobacterium bovis subsp bovis AF2122/97
caucgaguucggcccgcaaaca

SEQ ID NO: 3044499 - RNA, 17 nt, Mycobacterium bovis subsp bovis AF2122/97
caucgaguugcucggcc

SEQ ID NO: 3044500 - RNA, 18 nt, Mycobacterium bovis subsp bovis AF2122/97
caucgaguugcucggccg

SEQ ID NO: 3044501 - RNA, 23 nt, Mycobacterium bovis subsp bovis AF2122/97
caucgaucacacguccgcgcacc

SEQ ID NO: 3044502 - RNA, 18 nt, Mycobacterium bovis subsp bovis AF2122/97
caucgauccucgcccgca

SEQ ID NO: 3044503 - RNA, 15 nt, Mycobacterium bovis subsp bovis AF2122/97
caucgaugcggugaa

SEQ ID NO: 3044504 - RNA, 19 nt, Mycobacterium bovis subsp bovis AF2122/97
caucgaugucggcucggcc

SEQ ID NO: 3044505 - RNA, 15 nt, Mycobacterium bovis subsp bovis AF2122/97
caucgauuggcucga

SEQ ID NO: 3044506 - RNA, 18 nt, Mycobacterium bovis subsp bovis AF2122/97
caucgcacgggccaccag

SEQ ID NO: 3044507 - RNA, 19 nt, Mycobacterium bovis subsp bovis AF2122/97
caucgcacgggccaccagc

SEQ ID NO: 3044508 - RNA, 17 nt, Mycobacterium bovis subsp bovis AF2122/97
caucgcagacggcugcc

SEQ ID NO: 3044509 - RNA, 17 nt, Mycobacterium bovis subsp bovis AF2122/97
caucgcaggcaccccga

SEQ ID NO: 3044510 - RNA, 19 nt, Mycobacterium bovis subsp bovis AF2122/97
caucgcaggcaccccgauc

SEQ ID NO: 3044511 - RNA, 20 nt, Mycobacterium bovis subsp bovis AF2122/97
caucgcauccacuuccgggc

SEQ ID NO: 3044512 - RNA, 23 nt, Mycobacterium bovis subsp bovis AF2122/97
caucgcauccccagcacaaccag

SEQ ID NO: 3044513 - RNA, 15 nt, Mycobacterium bovis subsp bovis AF2122/97
caucgccaacaccaa

SEQ ID NO: 3044514 - RNA, 14 nt, Mycobacterium bovis subsp bovis AF2122/97
caucgccaccaccg

SEQ ID NO: 3044515 - RNA, 19 nt, Mycobacterium bovis subsp bovis AF2122/97
caucgccaccaucaccgcc

SEQ ID NO: 3044516 - RNA, 21 nt, Mycobacterium bovis subsp bovis AF2122/97
caucgccacuguugaagaagc

SEQ ID NO: 3044517 - RNA, 15 nt, Mycobacterium bovis subsp bovis AF2122/97
caucgccagccugug

SEQ ID NO: 3044518 - RNA, 12 nt, Mycobacterium bovis subsp bovis AF2122/97
caucgccagcgc

SEQ ID NO: 3044519 - RNA, 13 nt, Mycobacterium bovis subsp bovis AF2122/97
caucgccagcgcc

SEQ ID NO: 3044520 - RNA, 16 nt, Mycobacterium bovis subsp bovis AF2122/97
caucgccagcgccggc

SEQ ID NO: 3044521 - RNA, 19 nt, Mycobacterium bovis subsp bovis AF2122/97
caucgccagcgccggccag

SEQ ID NO: 3044522 - RNA, 21 nt, Mycobacterium bovis subsp bovis AF2122/97
caucgccagcgccggccaggc

SEQ ID NO: 3044523 - RNA, 13 nt, Mycobacterium bovis subsp bovis AF2122/97
caucgccagcggc

SEQ ID NO: 3044524 - RNA, 12 nt, Mycobacterium bovis subsp bovis AF2122/97
caucgccaggcc

SEQ ID NO: 3044525 - RNA, 17 nt, Mycobacterium bovis subsp bovis AF2122/97
caucgccauaccggccg

SEQ ID NO: 3044526 - RNA, 23 nt, Mycobacterium bovis subsp bovis AF2122/97
caucgccauaggagaacuccggg

SEQ ID NO: 3044527 - RNA, 23 nt, Mycobacterium bovis subsp bovis AF2122/97
caucgccaucguuucacccgggc

SEQ ID NO: 3044528 - RNA, 14 nt, Mycobacterium bovis subsp bovis AF2122/97
caucggcaccagcg

SEQ ID NO: 3044529 - RNA, 21 nt, Mycobacterium bovis subsp bovis AF2122/97
caucggcaccagcgcgcgccg

SEQ ID NO: 3044530 - RNA, 13 nt, Mycobacterium bovis subsp bovis AF2122/97
caucggcaccccg

SEQ ID NO: 3044531 - RNA, 17 nt, Mycobacterium bovis subsp bovis AF2122/97
caucggcaccccggcca

SEQ ID NO: 3044532 - RNA, 11 nt, Mycobacterium bovis subsp bovis AF2122/97
caucggcacgc

SEQ ID NO: 3044533 - RNA, 20 nt, Mycobacterium bovis subsp bovis AF2122/97
caucggcacgccauaccggc

SEQ ID NO: 3044534 - RNA, 18 nt, Mycobacterium bovis subsp bovis AF2122/97
caucggcauccgcgggga

SEQ ID NO: 3044535 - RNA, 18 nt, Mycobacterium bovis subsp bovis AF2122/97
caucggcaucgacugcca

SEQ ID NO: 3044536 - RNA, 19 nt, Mycobacterium bovis subsp bovis AF2122/97
caucggcaucgacugccag

SEQ ID NO: 3044537 - RNA, 15 nt, Mycobacterium bovis subsp bovis AF2122/97
caucggccagcagcg

SEQ ID NO: 3044538 - RNA, 13 nt, Mycobacterium bovis subsp bovis AF2122/97
caucggccagccg

SEQ ID NO: 3044539 - RNA, 14 nt, Mycobacterium bovis subsp bovis AF2122/97
caucggccagccgu

SEQ ID NO: 3044540 - RNA, 14 nt, Mycobacterium bovis subsp bovis AF2122/97
caucggccagcuug

SEQ ID NO: 3044541 - RNA, 18 nt, Mycobacterium bovis subsp bovis AF2122/97
caucggcccccaacgcgg

SEQ ID NO: 3044542 - RNA, 16 nt, Mycobacterium bovis subsp bovis AF2122/97
caucggcccgaucacc

SEQ ID NO: 3044543 - RNA, 17 nt, Mycobacterium bovis subsp bovis AF2122/97
caucggcccgcugacca

SEQ ID NO: 3044544 - RNA, 15 nt, Mycobacterium bovis subsp bovis AF2122/97
caucggccgcggucg

SEQ ID NO: 3044545 - RNA, 16 nt, Mycobacterium bovis subsp bovis AF2122/97
caucggccggcgucag

SEQ ID NO: 3044546 - RNA, 18 nt, Mycobacterium bovis subsp bovis AF2122/97
caucggccggcgucagcc

SEQ ID NO: 3044547 - RNA, 23 nt, Mycobacterium bovis subsp bovis AF2122/97
caucggccggcgucagccccgac

SEQ ID NO: 3044548 - RNA, 13 nt, Mycobacterium bovis subsp bovis AF2122/97
caucggccucuga

SEQ ID NO: 3044549 - RNA, 16 nt, Mycobacterium bovis subsp bovis AF2122/97
caucggccucugacca

SEQ ID NO: 3044550 - RNA, 20 nt, Mycobacterium bovis subsp bovis AF2122/97
caucggccucugaccagccg

SEQ ID NO: 3044551 - RNA, 21 nt, Mycobacterium bovis subsp bovis AF2122/97
caucggccucugaccagccgg

SEQ ID NO: 3044552 - RNA, 19 nt, Mycobacterium bovis subsp bovis AF2122/97
caucggccuguucgccguc

SEQ ID NO: 3044553 - RNA, 20 nt, Mycobacterium bovis subsp bovis AF2122/97
caucggccuguucgccgucg

SEQ ID NO: 3044554 - RNA, 21 nt, Mycobacterium bovis subsp bovis AF2122/97
caucggccuguucgccgucgc

SEQ ID NO: 3044555 - RNA, 16 nt, Mycobacterium bovis subsp bovis AF2122/97
caucggcgaccgccug

SEQ ID NO: 3044556 - RNA, 17 nt, Mycobacterium bovis subsp bovis AF2122/97
caucggcgaccgccugc

SEQ ID NO: 3044557 - RNA, 21 nt, Mycobacterium bovis subsp bovis AF2122/97
caucggcgaggccucggcggc

SEQ ID NO: 3044558 - RNA, 22 nt, Mycobacterium bovis subsp bovis AF2122/97
caucggcgaggccucggcggcc

SEQ ID NO: 3044559 - RNA, 11 nt, Mycobacterium bovis subsp bovis AF2122/97
caucggcgcca

SEQ ID NO: 3044560 - RNA, 21 nt, Mycobacterium bovis subsp bovis AF2122/97
caucggcgccagaucgacgcc

SEQ ID NO: 3044561 - RNA, 17 nt, Mycobacterium bovis subsp bovis AF2122/97
caucggcgcuggcaggc

SEQ ID NO: 3044562 - RNA, 19 nt, Mycobacterium bovis subsp bovis AF2122/97
caucggcggagucgacggu

SEQ ID NO: 3044563 - RNA, 18 nt, Mycobacterium bovis subsp bovis AF2122/97
caucggcggcaacggcgg

SEQ ID NO: 3044564 - RNA, 21 nt, Mycobacterium bovis subsp bovis AF2122/97
caucggcggcaacggcggauc

SEQ ID NO: 3044565 - RNA, 22 nt, Mycobacterium bovis subsp bovis AF2122/97
caucggcggcaaggguggugac

SEQ ID NO: 3044566 - RNA, 13 nt, Mycobacterium bovis subsp bovis AF2122/97
caucggcggcccu

SEQ ID NO: 3044567 - RNA, 15 nt, Mycobacterium bovis subsp bovis AF2122/97
caucggcggcgucga

SEQ ID NO: 3044568 - RNA, 18 nt, Mycobacterium bovis subsp bovis AF2122/97
caucggcggggcccacac

SEQ ID NO: 3044569 - RNA, 19 nt, Mycobacterium bovis subsp bovis AF2122/97
caucggcgggucuggguca

SEQ ID NO: 3044570 - RNA, 21 nt, Mycobacterium bovis subsp bovis AF2122/97
caucggcgugcuugcccaggu

SEQ ID NO: 3044571 - RNA, 15 nt, Mycobacterium bovis subsp bovis AF2122/97
caucggcucugaugg

SEQ ID NO: 3044572 - RNA, 19 nt, Mycobacterium bovis subsp bovis AF2122/97
caucggcugcgacaggacg

SEQ ID NO: 3044573 - RNA, 14 nt, Mycobacterium bovis subsp bovis AF2122/97
caucggcuggccgc

SEQ ID NO: 3044574 - RNA, 23 nt, Mycobacterium bovis subsp bovis AF2122/97
caucggcuggccgcgccucgguc

SEQ ID NO: 3044575 - RNA, 17 nt, Mycobacterium bovis subsp bovis AF2122/97
caucgggaccggggacg

SEQ ID NO: 3044576 - RNA, 20 nt, Mycobacterium bovis subsp bovis AF2122/97
caucgggaccggggacgcgc

SEQ ID NO: 3044577 - RNA, 22 nt, Mycobacterium bovis subsp bovis AF2122/97
caucgggacgccuugaucggcg

SEQ ID NO: 3044578 - RNA, 17 nt, Mycobacterium bovis subsp bovis AF2122/97
caucgggagccgcaccc

SEQ ID NO: 3044579 - RNA, 16 nt, Mycobacterium bovis subsp bovis AF2122/97
caucgggauggacacc

SEQ ID NO: 3044580 - RNA, 17 nt, Mycobacterium bovis subsp bovis AF2122/97
caucgggauggacacca

SEQ ID NO: 3044581 - RNA, 18 nt, Mycobacterium bovis subsp bovis AF2122/97
caucgggauggacaccac

SEQ ID NO: 3044582 - RNA, 15 nt, Mycobacterium bovis subsp bovis AF2122/97
caucgggcaccaacc

SEQ ID NO: 3044583 - RNA, 12 nt, Mycobacterium bovis subsp bovis AF2122/97
caucgggccaca

SEQ ID NO: 3044584 - RNA, 17 nt, Mycobacterium bovis subsp bovis AF2122/97
caucgggccacagcaac

SEQ ID NO: 3044585 - RNA, 15 nt, Mycobacterium bovis subsp bovis AF2122/97
caucgggccgccgag

SEQ ID NO: 3044586 - RNA, 13 nt, Mycobacterium bovis subsp bovis AF2122/97
caucgggcgccca

SEQ ID NO: 3044587 - RNA, 19 nt, Mycobacterium bovis subsp bovis AF2122/97
caucgggcgcgguaaccac

SEQ ID NO: 3044588 - RNA, 23 nt, Mycobacterium bovis subsp bovis AF2122/97
caucggggcuucaucuggcgccg

SEQ ID NO: 3044589 - RNA, 22 nt, Mycobacterium bovis subsp bovis AF2122/97
caucgggguggccaccagcggc

SEQ ID NO: 3044590 - RNA, 23 nt, Mycobacterium bovis subsp bovis AF2122/97
caucgggucacccccggccagcg

SEQ ID NO: 3044591 - RNA, 13 nt, Mycobacterium bovis subsp bovis AF2122/97
caucggguggcga

SEQ ID NO: 3044592 - RNA, 22 nt, Mycobacterium bovis subsp bovis AF2122/97
caucggguucuucaacuccggg

SEQ ID NO: 3044593 - RNA, 20 nt, Mycobacterium bovis subsp bovis AF2122/97
caucgguaucgagggcagcc

SEQ ID NO: 3044594 - RNA, 15 nt, Mycobacterium bovis subsp bovis AF2122/97
caucggucaaugcca

SEQ ID NO: 3044595 - RNA, 17 nt, Mycobacterium bovis subsp bovis AF2122/97
caucggucaccgcggca

SEQ ID NO: 3044596 - RNA, 15 nt, Mycobacterium bovis subsp bovis AF2122/97
caucggucagcgccg

SEQ ID NO: 3044597 - RNA, 19 nt, Mycobacterium bovis subsp bovis AF2122/97
caucggucagcgccgacuc

SEQ ID NO: 3044598 - RNA, 15 nt, Mycobacterium bovis subsp bovis AF2122/97
caucggucagcgcgg

SEQ ID NO: 3044599 - RNA, 17 nt, Mycobacterium bovis subsp bovis AF2122/97
caucgguccaaagcacg

SEQ ID NO: 3044600 - RNA, 17 nt, Mycobacterium bovis subsp bovis AF2122/97
caucggucccacugccg

SEQ ID NO: 3044601 - RNA, 22 nt, Mycobacterium bovis subsp bovis AF2122/97
caucggugaauguugccgccgc

SEQ ID NO: 3044602 - RNA, 20 nt, Mycobacterium bovis subsp bovis AF2122/97
caucggugagcccguugacc

SEQ ID NO: 3044603 - RNA, 21 nt, Mycobacterium bovis subsp bovis AF2122/97
caucggugagcccguugaccu

SEQ ID NO: 3044604 - RNA, 11 nt, Mycobacterium bovis subsp bovis AF2122/97
caucggugauc

SEQ ID NO: 3044605 - RNA, 19 nt, Mycobacterium bovis subsp bovis AF2122/97
caucggugaucaaaccggc

SEQ ID NO: 3044606 - RNA, 20 nt, Mycobacterium bovis subsp bovis AF2122/97
caucggugaucaaaccggcg

SEQ ID NO: 3044607 - RNA, 23 nt, Mycobacterium bovis subsp bovis AF2122/97
caucggugaucaaaccggcggcg

SEQ ID NO: 3044608 - RNA, 23 nt, Mycobacterium bovis subsp bovis AF2122/97
caucggugaugagucaggcgccg

SEQ ID NO: 3044609 - RNA, 17 nt, Mycobacterium bovis subsp bovis AF2122/97
caucggugcagcccgcc

SEQ ID NO: 3044610 - RNA, 18 nt, Mycobacterium bovis subsp bovis AF2122/97
caucggugcagcccgccg

SEQ ID NO: 3044611 - RNA, 16 nt, Mycobacterium bovis subsp bovis AF2122/97
caucggugcgggcgcc

SEQ ID NO: 3044612 - RNA, 20 nt, Mycobacterium bovis subsp bovis AF2122/97
caucggugcgguucgcugcg

SEQ ID NO: 3044613 - RNA, 20 nt, Mycobacterium bovis subsp bovis AF2122/97
caucgguggcgccgaacgcc

SEQ ID NO: 3044614 - RNA, 14 nt, Mycobacterium bovis subsp bovis AF2122/97
caugaaccggucga

SEQ ID NO: 3044615 - RNA, 19 nt, Mycobacterium bovis subsp bovis AF2122/97
caugaaccggucgaucccc

SEQ ID NO: 3044616 - RNA, 14 nt, Mycobacterium bovis subsp bovis AF2122/97
caugaacgaucgga

SEQ ID NO: 3044617 - RNA, 18 nt, Mycobacterium bovis subsp bovis AF2122/97
caugaacgaucggaccac

SEQ ID NO: 3044618 - RNA, 18 nt, Mycobacterium bovis subsp bovis AF2122/97
caugaacugcucgccgag

SEQ ID NO: 3044619 - RNA, 18 nt, Mycobacterium bovis subsp bovis AF2122/97
caugaagaacuggcugcu

SEQ ID NO: 3044620 - RNA, 22 nt, Mycobacterium bovis subsp bovis AF2122/97
caugaagauccagaacgcaucg

SEQ ID NO: 3044621 - RNA, 15 nt, Mycobacterium bovis subsp bovis AF2122/97
caugaagccgggcgc

SEQ ID NO: 3044622 - RNA, 21 nt, Mycobacterium bovis subsp bovis AF2122/97
caugaagccguugccgccacg

SEQ ID NO: 3044623 - RNA, 22 nt, Mycobacterium bovis subsp bovis AF2122/97
caugaagccguugccgccacgg

SEQ ID NO: 3044624 - RNA, 15 nt, Mycobacterium bovis subsp bovis AF2122/97
caugaauccacugaa

SEQ ID NO: 3044625 - RNA, 17 nt, Mycobacterium bovis subsp bovis AF2122/97
caugacaccggccacca

SEQ ID NO: 3044626 - RNA, 19 nt, Mycobacterium bovis subsp bovis AF2122/97
caugacaccggccaccagc

SEQ ID NO: 3044627 - RNA, 16 nt, Mycobacterium bovis subsp bovis AF2122/97
caugacagccccgccg

SEQ ID NO: 3044628 - RNA, 17 nt, Mycobacterium bovis subsp bovis AF2122/97
caugacagccccgccgc

SEQ ID NO: 3044629 - RNA, 21 nt, Mycobacterium bovis subsp bovis AF2122/97
caugaccaccgaaauacccag

SEQ ID NO: 3044630 - RNA, 14 nt, Mycobacterium bovis subsp bovis AF2122/97
caugaccgcucgga

SEQ ID NO: 3044631 - RNA, 13 nt, Mycobacterium bovis subsp bovis AF2122/97
caugaccggccgc

SEQ ID NO: 3044632 - RNA, 17 nt, Mycobacterium bovis subsp bovis AF2122/97
caugaccgggcuggcca

SEQ ID NO: 3044633 - RNA, 16 nt, Mycobacterium bovis subsp bovis AF2122/97
caugacgaucgcggcg

SEQ ID NO: 3044634 - RNA, 13 nt, Mycobacterium bovis subsp bovis AF2122/97
caugacgccggcg

SEQ ID NO: 3044635 - RNA, 12 nt, Mycobacterium bovis subsp bovis AF2122/97
caugagccggcg

SEQ ID NO: 3044636 - RNA, 23 nt, Mycobacterium bovis subsp bovis AF2122/97
caugagcguucagcacggugggc

SEQ ID NO: 3044637 - RNA, 16 nt, Mycobacterium bovis subsp bovis AF2122/97
caugagcuggaaucga

SEQ ID NO: 3044638 - RNA, 19 nt, Mycobacterium bovis subsp bovis AF2122/97
caugagguaggucgccgcc

SEQ ID NO: 3044639 - RNA, 19 nt, Mycobacterium bovis subsp bovis AF2122/97
caugaguggcaaucccgcc

SEQ ID NO: 3044640 - RNA, 18 nt, Mycobacterium bovis subsp bovis AF2122/97
caugaucacaccgcugcu

SEQ ID NO: 3044641 - RNA, 18 nt, Mycobacterium bovis subsp bovis AF2122/97
caugaucccgcugaccug

SEQ ID NO: 3044642 - RNA, 20 nt, Mycobacterium bovis subsp bovis AF2122/97
caugauccgcugggccgggg

SEQ ID NO: 3044643 - RNA, 17 nt, Mycobacterium bovis subsp bovis AF2122/97
caugaucgcaccgaggu

SEQ ID NO: 3044644 - RNA, 18 nt, Mycobacterium bovis subsp bovis AF2122/97
caugaucugccaccgcgg

SEQ ID NO: 3044645 - RNA, 13 nt, Mycobacterium bovis subsp bovis AF2122/97
caugaugaccggc

SEQ ID NO: 3044646 - RNA, 18 nt, Mycobacterium bovis subsp bovis AF2122/97
caugaugccuaccgggcc

SEQ ID NO: 3044647 - RNA, 21 nt, Mycobacterium bovis subsp bovis AF2122/97
caugauggccgucagccaggu

SEQ ID NO: 3044648 - RNA, 17 nt, Mycobacterium bovis subsp bovis AF2122/97
caugauugccaggaccg

SEQ ID NO: 3044649 - RNA, 15 nt, Mycobacterium bovis subsp bovis AF2122/97
caugcaacacaccgc

SEQ ID NO: 3044650 - RNA, 17 nt, Mycobacterium bovis subsp bovis AF2122/97
caugcaagccgacaucg

SEQ ID NO: 3044651 - RNA, 20 nt, Mycobacterium bovis subsp bovis AF2122/97
caugcaagucaaacgccguc

SEQ ID NO: 3044652 - RNA, 15 nt, Mycobacterium bovis subsp bovis AF2122/97
caugcaaugcuggcg

SEQ ID NO: 3044653 - RNA, 15 nt, Mycobacterium bovis subsp bovis AF2122/97
caugcaccgaugccg

SEQ ID NO: 3044654 - RNA, 15 nt, Mycobacterium bovis subsp bovis AF2122/97
caugcaccucgagcg

SEQ ID NO: 3044655 - RNA, 18 nt, Mycobacterium bovis subsp bovis AF2122/97
caugcaccucgagcgugg

SEQ ID NO: 3044656 - RNA, 13 nt, Mycobacterium bovis subsp bovis AF2122/97
caugcacgccgua

SEQ ID NO: 3044657 - RNA, 16 nt, Mycobacterium bovis subsp bovis AF2122/97
caugcacgccguagca

SEQ ID NO: 3044658 - RNA, 12 nt, Mycobacterium bovis subsp bovis AF2122/97
caugcacggccg

SEQ ID NO: 3044659 - RNA, 20 nt, Mycobacterium bovis subsp bovis AF2122/97
caugcacgucaucggcuggc

SEQ ID NO: 3044660 - RNA, 23 nt, Mycobacterium bovis subsp bovis AF2122/97
caugcacgucaucggcuggccgc

SEQ ID NO: 3044661 - RNA, 22 nt, Mycobacterium bovis subsp bovis AF2122/97
caugcacguugccgaacgucgc

SEQ ID NO: 3044662 - RNA, 16 nt, Mycobacterium bovis subsp bovis AF2122/97
caugcagaucucacgg

SEQ ID NO: 3044663 - RNA, 21 nt, Mycobacterium bovis subsp bovis AF2122/97
caugcaggaaugggugaucga

SEQ ID NO: 3044664 - RNA, 22 nt, Mycobacterium bovis subsp bovis AF2122/97
caugcaucugcuucugcguaua

SEQ ID NO: 3044665 - RNA, 15 nt, Mycobacterium bovis subsp bovis AF2122/97
caugccaagcuccaa

SEQ ID NO: 3044666 - RNA, 18 nt, Mycobacterium bovis subsp bovis AF2122/97
caugccaagcuccaacca

SEQ ID NO: 3044667 - RNA, 18 nt, Mycobacterium bovis subsp bovis AF2122/97
caugccacaacgccucga

SEQ ID NO: 3044668 - RNA, 24 nt, Mycobacterium bovis subsp bovis AF2122/97
caugccacaacgccucgauggcgg

SEQ ID NO: 3044669 - RNA, 13 nt, Mycobacterium bovis subsp bovis AF2122/97
caugccacacacu

SEQ ID NO: 3044670 - RNA, 14 nt, Mycobacterium bovis subsp bovis AF2122/97
caugccacacacug

SEQ ID NO: 3044671 - RNA, 13 nt, Mycobacterium bovis subsp bovis AF2122/97
caugccagccguc

SEQ ID NO: 3044672 - RNA, 20 nt, Mycobacterium bovis subsp bovis AF2122/97
caugccauagaugcccgcga

SEQ ID NO: 3044673 - RNA, 23 nt, Mycobacterium bovis subsp bovis AF2122/97
caugccauagaugcccgcgauca

SEQ ID NO: 3044674 - RNA, 24 nt, Mycobacterium bovis subsp bovis AF2122/97
caugccauggcccgugcgguuguu

SEQ ID NO: 3044675 - RNA, 14 nt, Mycobacterium bovis subsp bovis AF2122/97
caugcccaccgccu

SEQ ID NO: 3044676 - RNA, 20 nt, Mycobacterium bovis subsp bovis AF2122/97
caugcccaggugcguccagg

SEQ ID NO: 3044677 - RNA, 15 nt, Mycobacterium bovis subsp bovis AF2122/97
caugcccaugauggc

SEQ ID NO: 3044678 - RNA, 15 nt, Mycobacterium bovis subsp bovis AF2122/97
caugccccgaccgcg

SEQ ID NO: 3044679 - RNA, 17 nt, Mycobacterium bovis subsp bovis AF2122/97
caugccccgaccgcgua

SEQ ID NO: 3044680 - RNA, 17 nt, Mycobacterium bovis subsp bovis AF2122/97
caugcccgacgagucgc

SEQ ID NO: 3044681 - RNA, 20 nt, Mycobacterium bovis subsp bovis AF2122/97
caugcccgacgagucgccgc

SEQ ID NO: 3044682 - RNA, 17 nt, Mycobacterium bovis subsp bovis AF2122/97
caugcccgcacgcucgg

SEQ ID NO: 3044683 - RNA, 19 nt, Mycobacterium bovis subsp bovis AF2122/97
caugcccgcacgcucggcg

SEQ ID NO: 3044684 - RNA, 23 nt, Mycobacterium bovis subsp bovis AF2122/97
caugcccgcggugaccaccccgg

SEQ ID NO: 3044685 - RNA, 12 nt, Mycobacterium bovis subsp bovis AF2122/97
caugcccggcgg

SEQ ID NO: 3044686 - RNA, 15 nt, Mycobacterium bovis subsp bovis AF2122/97
caugcccgggaugac

SEQ ID NO: 3044687 - RNA, 16 nt, Mycobacterium bovis subsp bovis AF2122/97
caugcccguccugcag

SEQ ID NO: 3044688 - RNA, 14 nt, Mycobacterium bovis subsp bovis AF2122/97
caugcccucggcgc

SEQ ID NO: 3044689 - RNA, 18 nt, Mycobacterium bovis subsp bovis AF2122/97
caugcccugcgcucgggc

SEQ ID NO: 3044690 - RNA, 21 nt, Mycobacterium bovis subsp bovis AF2122/97
caugcccuggaccagcgggcg

SEQ ID NO: 3044691 - RNA, 22 nt, Mycobacterium bovis subsp bovis AF2122/97
caugcccuggaccagcgggcgg

SEQ ID NO: 3044692 - RNA, 15 nt, Mycobacterium bovis subsp bovis AF2122/97
caugccgaccggcac

SEQ ID NO: 3044693 - RNA, 23 nt, Mycobacterium bovis subsp bovis AF2122/97
caugccgacgacaacagccagcu

SEQ ID NO: 3044694 - RNA, 14 nt, Mycobacterium bovis subsp bovis AF2122/97
caugccgagcgacc

SEQ ID NO: 3044695 - RNA, 13 nt, Mycobacterium bovis subsp bovis AF2122/97
caugccgaucggc

SEQ ID NO: 3044696 - RNA, 15 nt, Mycobacterium bovis subsp bovis AF2122/97
caugccgaucggccu

SEQ ID NO: 3044697 - RNA, 16 nt, Mycobacterium bovis subsp bovis AF2122/97
caugccgaucggccug

SEQ ID NO: 3044698 - RNA, 21 nt, Mycobacterium bovis subsp bovis AF2122/97
caugccgaucggccugcagcg

SEQ ID NO: 3044699 - RNA, 21 nt, Mycobacterium bovis subsp bovis AF2122/97
caugccgccaugcgcaccagu

SEQ ID NO: 3044700 - RNA, 14 nt, Mycobacterium bovis subsp bovis AF2122/97
cauggcgccgcgcc

SEQ ID NO: 3044701 - RNA, 15 nt, Mycobacterium bovis subsp bovis AF2122/97
cauggcgccgcgccg

SEQ ID NO: 3044702 - RNA, 19 nt, Mycobacterium bovis subsp bovis AF2122/97
cauggcgccguugccggcg

SEQ ID NO: 3044703 - RNA, 16 nt, Mycobacterium bovis subsp bovis AF2122/97
cauggcgcgcaaccgc

SEQ ID NO: 3044704 - RNA, 18 nt, Mycobacterium bovis subsp bovis AF2122/97
cauggcgcgcaaccgcug

SEQ ID NO: 3044705 - RNA, 16 nt, Mycobacterium bovis subsp bovis AF2122/97
cauggcgcugggaugu

SEQ ID NO: 3044706 - RNA, 23 nt, Mycobacterium bovis subsp bovis AF2122/97
cauggcggcagcaacgacgucgu

SEQ ID NO: 3044707 - RNA, 19 nt, Mycobacterium bovis subsp bovis AF2122/97
cauggcggcuccgcccggc

SEQ ID NO: 3044708 - RNA, 22 nt, Mycobacterium bovis subsp bovis AF2122/97
cauggcggcuccgcccggcgug

SEQ ID NO: 3044709 - RNA, 16 nt, Mycobacterium bovis subsp bovis AF2122/97
cauggcgggucggucg

SEQ ID NO: 3044710 - RNA, 17 nt, Mycobacterium bovis subsp bovis AF2122/97
cauggcgucgaaccagu

SEQ ID NO: 3044711 - RNA, 13 nt, Mycobacterium bovis subsp bovis AF2122/97
cauggcuugcucu

SEQ ID NO: 3044712 - RNA, 19 nt, Mycobacterium bovis subsp bovis AF2122/97
cauggcuuuugcgccgaau

SEQ ID NO: 3044713 - RNA, 16 nt, Mycobacterium bovis subsp bovis AF2122/97
caugggcaaugguggu

SEQ ID NO: 3044714 - RNA, 21 nt, Mycobacterium bovis subsp bovis AF2122/97
caugggccaggucagccgcgc

SEQ ID NO: 3044715 - RNA, 12 nt, Mycobacterium bovis subsp bovis AF2122/97
caugggccggcg

SEQ ID NO: 3044716 - RNA, 18 nt, Mycobacterium bovis subsp bovis AF2122/97
caugggccggcgccgcac

SEQ ID NO: 3044717 - RNA, 20 nt, Mycobacterium bovis subsp bovis AF2122/97
caugggcgcguagcucagcg

SEQ ID NO: 3044718 - RNA, 22 nt, Mycobacterium bovis subsp bovis AF2122/97
cauggggcuauggcgcagcugg

SEQ ID NO: 3044719 - RNA, 19 nt, Mycobacterium bovis subsp bovis AF2122/97
caugggggcguuggcgggc

SEQ ID NO: 3044720 - RNA, 14 nt, Mycobacterium bovis subsp bovis AF2122/97
cauggguagccgcc

SEQ ID NO: 3044721 - RNA, 19 nt, Mycobacterium bovis subsp bovis AF2122/97
caugggucgugcaggcgac

SEQ ID NO: 3044722 - RNA, 14 nt, Mycobacterium bovis subsp bovis AF2122/97
cauggucaggcggc

SEQ ID NO: 3044723 - RNA, 17 nt, Mycobacterium bovis subsp bovis AF2122/97
caugguccaaccagcac

SEQ ID NO: 3044724 - RNA, 18 nt, Mycobacterium bovis subsp bovis AF2122/97
caugguccaaccagcacc

SEQ ID NO: 3044725 - RNA, 19 nt, Mycobacterium bovis subsp bovis AF2122/97
caugguccaaccagcacca

SEQ ID NO: 3044726 - RNA, 14 nt, Mycobacterium bovis subsp bovis AF2122/97
caugguccacagcc

SEQ ID NO: 3044727 - RNA, 17 nt, Mycobacterium bovis subsp bovis AF2122/97
caugguccacagccggc

SEQ ID NO: 3044728 - RNA, 18 nt, Mycobacterium bovis subsp bovis AF2122/97
caugguccacagccggcg

SEQ ID NO: 3044729 - RNA, 20 nt, Mycobacterium bovis subsp bovis AF2122/97
caugguccacagccggcggc

SEQ ID NO: 3044730 - RNA, 21 nt, Mycobacterium bovis subsp bovis AF2122/97
caugguccacagccggcggcu

SEQ ID NO: 3044731 - RNA, 20 nt, Mycobacterium bovis subsp bovis AF2122/97
caugguccagcacaucggcg

SEQ ID NO: 3044732 - RNA, 13 nt, Mycobacterium bovis subsp bovis AF2122/97
caugguccgacca

SEQ ID NO: 3044733 - RNA, 18 nt, Mycobacterium bovis subsp bovis AF2122/97
caugguccgaccagcggc

SEQ ID NO: 3044734 - RNA, 15 nt, Mycobacterium bovis subsp bovis AF2122/97
caugguccggccgcg

SEQ ID NO: 3044735 - RNA, 15 nt, Mycobacterium bovis subsp bovis AF2122/97
cauggucgagauugg

SEQ ID NO: 3044736 - RNA, 15 nt, Mycobacterium bovis subsp bovis AF2122/97
cauggucgcgccacc

SEQ ID NO: 3044737 - RNA, 21 nt, Mycobacterium bovis subsp bovis AF2122/97
cauggucggucaagucugucu

SEQ ID NO: 3044738 - RNA, 14 nt, Mycobacterium bovis subsp bovis AF2122/97
cauggucuucgcgg

SEQ ID NO: 3044739 - RNA, 20 nt, Mycobacterium bovis subsp bovis AF2122/97
cauggugaaggcaaacacca

SEQ ID NO: 3044740 - RNA, 22 nt, Mycobacterium bovis subsp bovis AF2122/97
cauggugcggcggcguccgggu

SEQ ID NO: 3044741 - RNA, 17 nt, Mycobacterium bovis subsp bovis AF2122/97
caugguggcgccgaccu

SEQ ID NO: 3044742 - RNA, 19 nt, Mycobacterium bovis subsp bovis AF2122/97
caugguggcgccgaccugg

SEQ ID NO: 3044743 - RNA, 20 nt, Mycobacterium bovis subsp bovis AF2122/97
caugguggcgccgaccugga

SEQ ID NO: 3044744 - RNA, 19 nt, Mycobacterium bovis subsp bovis AF2122/97
cauggugggaaaugaagug

SEQ ID NO: 3044745 - RNA, 16 nt, Mycobacterium bovis subsp bovis AF2122/97
cauggugguggccggg

SEQ ID NO: 3044746 - RNA, 20 nt, Mycobacterium bovis subsp bovis AF2122/97
caugguugaugacggcgucg

SEQ ID NO: 3044747 - RNA, 15 nt, Mycobacterium bovis subsp bovis AF2122/97
cauguaccgaccgcg

SEQ ID NO: 3044748 - RNA, 16 nt, Mycobacterium bovis subsp bovis AF2122/97
cauguaccgaccgcgu

SEQ ID NO: 3044749 - RNA, 16 nt, Mycobacterium bovis subsp bovis AF2122/97
cauguagcggucguag

SEQ ID NO: 3044750 - RNA, 21 nt, Mycobacterium bovis subsp bovis AF2122/97
caugucaagcgaugucccauc

SEQ ID NO: 3044751 - RNA, 20 nt, Mycobacterium bovis subsp bovis AF2122/97
caugucaaguucgccagcaa

SEQ ID NO: 3044752 - RNA, 13 nt, Mycobacterium bovis subsp bovis AF2122/97
caugucacaccca

SEQ ID NO: 3044753 - RNA, 14 nt, Mycobacterium bovis subsp bovis AF2122/97
caugucacacccac

SEQ ID NO: 3044754 - RNA, 21 nt, Mycobacterium bovis subsp bovis AF2122/97
caugucacacccacacccagc

SEQ ID NO: 3044755 - RNA, 20 nt, Mycobacterium bovis subsp bovis AF2122/97
caugucagcgcugagccgcu

SEQ ID NO: 3044756 - RNA, 14 nt, Mycobacterium bovis subsp bovis AF2122/97
cauguccagugccg

SEQ ID NO: 3044757 - RNA, 18 nt, Mycobacterium bovis subsp bovis AF2122/97
cauguccaucgcgcggcu

SEQ ID NO: 3044758 - RNA, 15 nt, Mycobacterium bovis subsp bovis AF2122/97
cauguccgcagcggu

SEQ ID NO: 3044759 - RNA, 18 nt, Mycobacterium bovis subsp bovis AF2122/97
cauguccgcaguucgguc

SEQ ID NO: 3044760 - RNA, 17 nt, Mycobacterium bovis subsp bovis AF2122/97
cauguccugggccgccg

SEQ ID NO: 3044761 - RNA, 18 nt, Mycobacterium bovis subsp bovis AF2122/97
caugucgaagaaccggcc

SEQ ID NO: 3044762 - RNA, 19 nt, Mycobacterium bovis subsp bovis AF2122/97
caugucgaagaaccggccg

SEQ ID NO: 3044763 - RNA, 20 nt, Mycobacterium bovis subsp bovis AF2122/97
caugucgaagaaccggccga

SEQ ID NO: 3044764 - RNA, 21 nt, Mycobacterium bovis subsp bovis AF2122/97
caugucgaagaaccggccgac

SEQ ID NO: 3044765 - RNA, 17 nt, Mycobacterium bovis subsp bovis AF2122/97
caugucgaucagcgcga

SEQ ID NO: 3044766 - RNA, 23 nt, Mycobacterium bovis subsp bovis AF2122/97
caugucgaucagcgcgacggucc

SEQ ID NO: 3044767 - RNA, 16 nt, Mycobacterium bovis subsp bovis AF2122/97
caugucgauccggcgc

SEQ ID NO: 3044768 - RNA, 14 nt, Mycobacterium bovis subsp bovis AF2122/97
caugucgaugucca

SEQ ID NO: 3044769 - RNA, 17 nt, Mycobacterium bovis subsp bovis AF2122/97
caugucgcugccgccgc

SEQ ID NO: 3044770 - RNA, 14 nt, Mycobacterium bovis subsp bovis AF2122/97
caugucggccaccg

SEQ ID NO: 3044771 - RNA, 17 nt, Mycobacterium bovis subsp bovis AF2122/97
caugucggccaccggcg

SEQ ID NO: 3044772 - RNA, 17 nt, Mycobacterium bovis subsp bovis AF2122/97
caugucggccggggcca

SEQ ID NO: 3044773 - RNA, 20 nt, Mycobacterium bovis subsp bovis AF2122/97
caugucggccggggccaccc

SEQ ID NO: 3044774 - RNA, 13 nt, Mycobacterium bovis subsp bovis AF2122/97
caugucggcgcgc

SEQ ID NO: 3044775 - RNA, 14 nt, Mycobacterium bovis subsp bovis AF2122/97
caugucggcgcgcc

SEQ ID NO: 3044776 - RNA, 15 nt, Mycobacterium bovis subsp bovis AF2122/97
caugucggcgcgccg

SEQ ID NO: 3044777 - RNA, 17 nt, Mycobacterium bovis subsp bovis AF2122/97
caugucggcgcgccgca

SEQ ID NO: 3044778 - RNA, 17 nt, Mycobacterium bovis subsp bovis AF2122/97
caugucgggccaggcga

SEQ ID NO: 3044779 - RNA, 17 nt, Mycobacterium bovis subsp bovis AF2122/97
caugucgggccgcucga

SEQ ID NO: 3044780 - RNA, 18 nt, Mycobacterium bovis subsp bovis AF2122/97
caugucuccgacauuggc

SEQ ID NO: 3044781 - RNA, 21 nt, Mycobacterium bovis subsp bovis AF2122/97
caugugacaucgggccgccga

SEQ ID NO: 3044782 - RNA, 17 nt, Mycobacterium bovis subsp bovis AF2122/97
caugugaccggcgaucg

SEQ ID NO: 3044783 - RNA, 17 nt, Mycobacterium bovis subsp bovis AF2122/97
caugugcgacauugguc

SEQ ID NO: 3044784 - RNA, 21 nt, Mycobacterium bovis subsp bovis AF2122/97
caugugcgcgaccacccgccg

SEQ ID NO: 3044785 - RNA, 14 nt, Mycobacterium bovis subsp bovis AF2122/97
cauguggccgccgu

SEQ ID NO: 3044786 - RNA, 13 nt, Mycobacterium bovis subsp bovis AF2122/97
cauugccggcgac

SEQ ID NO: 3044787 - RNA, 23 nt, Mycobacterium bovis subsp bovis AF2122/97
cauugccguccgguggaccgccg

SEQ ID NO: 3044788 - RNA, 20 nt, Mycobacterium bovis subsp bovis AF2122/97
cauugccguucucgucgagg

SEQ ID NO: 3044789 - RNA, 21 nt, Mycobacterium bovis subsp bovis AF2122/97
cauugccguucucgucgagga

SEQ ID NO: 3044790 - RNA, 22 nt, Mycobacterium bovis subsp bovis AF2122/97
cauugccugggcgaccggcucg

SEQ ID NO: 3044791 - RNA, 18 nt, Mycobacterium bovis subsp bovis AF2122/97
cauugcgaacucgcugcc

SEQ ID NO: 3044792 - RNA, 15 nt, Mycobacterium bovis subsp bovis AF2122/97
cauugcgcaggaugu

SEQ ID NO: 3044793 - RNA, 15 nt, Mycobacterium bovis subsp bovis AF2122/97
cauugcgccugaaua

SEQ ID NO: 3044794 - RNA, 14 nt, Mycobacterium bovis subsp bovis AF2122/97
cauugcggcccgcg

SEQ ID NO: 3044795 - RNA, 21 nt, Mycobacterium bovis subsp bovis AF2122/97
cauugcgggagccucgccugu

SEQ ID NO: 3044796 - RNA, 19 nt, Mycobacterium bovis subsp bovis AF2122/97
cauuggaugccauaggaca

SEQ ID NO: 3044797 - RNA, 20 nt, Mycobacterium bovis subsp bovis AF2122/97
cauuggcaggcauggcgccg

SEQ ID NO: 3044798 - RNA, 22 nt, Mycobacterium bovis subsp bovis AF2122/97
cauuggccaggucggccaccgu

SEQ ID NO: 3044799 - RNA, 18 nt, Mycobacterium bovis subsp bovis AF2122/97
cauuggccagguggcgag

SEQ ID NO: 3044800 - RNA, 18 nt, Mycobacterium bovis subsp bovis AF2122/97
cauuggcgaucagcagcc

SEQ ID NO: 3044801 - RNA, 15 nt, Mycobacterium bovis subsp bovis AF2122/97
cauuggcgccgccga

SEQ ID NO: 3044802 - RNA, 22 nt, Mycobacterium bovis subsp bovis AF2122/97
cauuggcgccgccgaucccguc

SEQ ID NO: 3044803 - RNA, 14 nt, Mycobacterium bovis subsp bovis AF2122/97
cauuggcggugcgc

SEQ ID NO: 3044804 - RNA, 20 nt, Mycobacterium bovis subsp bovis AF2122/97
cauuggcggugcgcaccacc

SEQ ID NO: 3044805 - RNA, 21 nt, Mycobacterium bovis subsp bovis AF2122/97
cauuggcggugcgcaccaccg

SEQ ID NO: 3044806 - RNA, 22 nt, Mycobacterium bovis subsp bovis AF2122/97
cauuggcgucgacaacacgccg

SEQ ID NO: 3044807 - RNA, 23 nt, Mycobacterium bovis subsp bovis AF2122/97
cauuggcgucgacaacacgccgu

SEQ ID NO: 3044808 - RNA, 23 nt, Mycobacterium bovis subsp bovis AF2122/97
cauuggcuccgaacauggccagc

SEQ ID NO: 3044809 - RNA, 16 nt, Mycobacterium bovis subsp bovis AF2122/97
cauuggcuuguccggu

SEQ ID NO: 3044810 - RNA, 13 nt, Mycobacterium bovis subsp bovis AF2122/97
cauugggcgggcu

SEQ ID NO: 3044811 - RNA, 16 nt, Mycobacterium bovis subsp bovis AF2122/97
cauugggguggcaucg

SEQ ID NO: 3044812 - RNA, 18 nt, Mycobacterium bovis subsp bovis AF2122/97
cauuggguaaccagcgcc

SEQ ID NO: 3044813 - RNA, 19 nt, Mycobacterium bovis subsp bovis AF2122/97
cauugguaccggcuucguc

SEQ ID NO: 3044814 - RNA, 22 nt, Mycobacterium bovis subsp bovis AF2122/97
cauugguaccggcuucgucggc

SEQ ID NO: 3044815 - RNA, 11 nt, Mycobacterium bovis subsp bovis AF2122/97
cauuggugagg

SEQ ID NO: 3044816 - RNA, 19 nt, Mycobacterium bovis subsp bovis AF2122/97
cauuggugagguggucagc

SEQ ID NO: 3044817 - RNA, 15 nt, Mycobacterium bovis subsp bovis AF2122/97
cauugguguccacca

SEQ ID NO: 3044818 - RNA, 20 nt, Mycobacterium bovis subsp bovis AF2122/97
cauugguguccaccaccggc

SEQ ID NO: 3044819 - RNA, 14 nt, Mycobacterium bovis subsp bovis AF2122/97
cauugugcucgccg

SEQ ID NO: 3044820 - RNA, 21 nt, Mycobacterium bovis subsp bovis AF2122/97
cauuucaacguauccccgacc

SEQ ID NO: 3044821 - RNA, 14 nt, Mycobacterium bovis subsp bovis AF2122/97
cauuuccacaucca

SEQ ID NO: 3044822 - RNA, 14 nt, Mycobacterium bovis subsp bovis AF2122/97
cauuucggaacgcc

SEQ ID NO: 3044823 - RNA, 16 nt, Mycobacterium bovis subsp bovis AF2122/97
cauuucguggcgcgcc

SEQ ID NO: 3044824 - RNA, 17 nt, Mycobacterium bovis subsp bovis AF2122/97
ccaaaaacccggugacc

SEQ ID NO: 3044825 - RNA, 14 nt, Mycobacterium bovis subsp bovis AF2122/97
ccaaaaacggcagc

SEQ ID NO: 3044826 - RNA, 16 nt, Mycobacterium bovis subsp bovis AF2122/97
ccaaaaagaccgccgc

SEQ ID NO: 3044827 - RNA, 19 nt, Mycobacterium bovis subsp bovis AF2122/97
ccaaaaaggaucccgccgc

SEQ ID NO: 3044828 - RNA, 17 nt, Mycobacterium bovis subsp bovis AF2122/97
ccaaaaaguagcugcgg

SEQ ID NO: 3044829 - RNA, 23 nt, Mycobacterium bovis subsp bovis AF2122/97
ccaaaacggucgaccgugcgucg

SEQ ID NO: 3044830 - RNA, 20 nt, Mycobacterium bovis subsp bovis AF2122/97
ccaaaagggcggcagcgagg

SEQ ID NO: 3044831 - RNA, 23 nt, Mycobacterium bovis subsp bovis AF2122/97
ccaaaauccuucgcgcucauugc

SEQ ID NO: 3044832 - RNA, 23 nt, Mycobacterium bovis subsp bovis AF2122/97
ccaaaaugccuuggcagcccagu

SEQ ID NO: 3044833 - RNA, 18 nt, Mycobacterium bovis subsp bovis AF2122/97
ccaaacaccccggccuug

SEQ ID NO: 3044834 - RNA, 17 nt, Mycobacterium bovis subsp bovis AF2122/97
ccaaacccaugucggcg

SEQ ID NO: 3044835 - RNA, 13 nt, Mycobacterium bovis subsp bovis AF2122/97
ccaaacccggcgg

SEQ ID NO: 3044836 - RNA, 17 nt, Mycobacterium bovis subsp bovis AF2122/97
ccaaaccggcccgcagc

SEQ ID NO: 3044837 - RNA, 22 nt, Mycobacterium bovis subsp bovis AF2122/97
ccaaaccggcccgcagcagcau

SEQ ID NO: 3044838 - RNA, 15 nt, Mycobacterium bovis subsp bovis AF2122/97
ccaaacgccgcccgc

SEQ ID NO: 3044839 - RNA, 18 nt, Mycobacterium bovis subsp bovis AF2122/97
ccaaacgcugcgcccgga

SEQ ID NO: 3044840 - RNA, 15 nt, Mycobacterium bovis subsp bovis AF2122/97
ccaaacuacccgccc

SEQ ID NO: 3044841 - RNA, 15 nt, Mycobacterium bovis subsp bovis AF2122/97
ccaaagcgacgagca

SEQ ID NO: 3044842 - RNA, 20 nt, Mycobacterium bovis subsp bovis AF2122/97
ccaaagcgccagcagccacc

SEQ ID NO: 3044843 - RNA, 14 nt, Mycobacterium bovis subsp bovis AF2122/97
ccaaaggacgacac

SEQ ID NO: 3044844 - RNA, 15 nt, Mycobacterium bovis subsp bovis AF2122/97
ccaaagggaguguuu

SEQ ID NO: 3044845 - RNA, 15 nt, Mycobacterium bovis subsp bovis AF2122/97
ccaaaucccagagca

SEQ ID NO: 3044846 - RNA, 14 nt, Mycobacterium bovis subsp bovis AF2122/97
ccaaauccggugcc

SEQ ID NO: 3044847 - RNA, 17 nt, Mycobacterium bovis subsp bovis AF2122/97
ccaaauccuucggcgug

SEQ ID NO: 3044848 - RNA, 13 nt, Mycobacterium bovis subsp bovis AF2122/97
ccaaaucggcauc

SEQ ID NO: 3044849 - RNA, 19 nt, Mycobacterium bovis subsp bovis AF2122/97
ccaaaucggcaucggcgac

SEQ ID NO: 3044850 - RNA, 14 nt, Mycobacterium bovis subsp bovis AF2122/97
ccaacaaaaggcca

SEQ ID NO: 3044851 - RNA, 15 nt, Mycobacterium bovis subsp bovis AF2122/97
ccaacaaaaggccau

SEQ ID NO: 3044852 - RNA, 16 nt, Mycobacterium bovis subsp bovis AF2122/97
ccaacaaaaggccauc

SEQ ID NO: 3044853 - RNA, 20 nt, Mycobacterium bovis subsp bovis AF2122/97
ccaacaacaucagcgacagc

SEQ ID NO: 3044854 - RNA, 19 nt, Mycobacterium bovis subsp bovis AF2122/97
ccaacaacccaacaaaagg

SEQ ID NO: 3044855 - RNA, 18 nt, Mycobacterium bovis subsp bovis AF2122/97
ccaacaacgcuucggcgu

SEQ ID NO: 3044856 - RNA, 13 nt, Mycobacterium bovis subsp bovis AF2122/97
ccaacacagccgu

SEQ ID NO: 3044857 - RNA, 19 nt, Mycobacterium bovis subsp bovis AF2122/97
ccaacacauugccggccac

SEQ ID NO: 3044858 - RNA, 16 nt, Mycobacterium bovis subsp bovis AF2122/97
ccaacaccagcagcac

SEQ ID NO: 3044859 - RNA, 15 nt, Mycobacterium bovis subsp bovis AF2122/97
ccaacaccagcgcgu

SEQ ID NO: 3044860 - RNA, 14 nt, Mycobacterium bovis subsp bovis AF2122/97
ccaacaccagguca

SEQ ID NO: 3044861 - RNA, 15 nt, Mycobacterium bovis subsp bovis AF2122/97
ccaacaccaggucau

SEQ ID NO: 3044862 - RNA, 15 nt, Mycobacterium bovis subsp bovis AF2122/97
ccaacacccgccggu

SEQ ID NO: 3044863 - RNA, 12 nt, Mycobacterium bovis subsp bovis AF2122/97
ccaacaccgccc

SEQ ID NO: 3044864 - RNA, 14 nt, Mycobacterium bovis subsp bovis AF2122/97
ccaacaccgcccgc

SEQ ID NO: 3044865 - RNA, 14 nt, Mycobacterium bovis subsp bovis AF2122/97
ccaacaccgcgccg

SEQ ID NO: 3044866 - RNA, 16 nt, Mycobacterium bovis subsp bovis AF2122/97
ccaacaccgcgccgac

SEQ ID NO: 3044867 - RNA, 12 nt, Mycobacterium bovis subsp bovis AF2122/97
ccaacaccgcgg

SEQ ID NO: 3044868 - RNA, 13 nt, Mycobacterium bovis subsp bovis AF2122/97
ccaacaccgcggc

SEQ ID NO: 3044869 - RNA, 15 nt, Mycobacterium bovis subsp bovis AF2122/97
ccaacaccgcggcgc

SEQ ID NO: 3044870 - RNA, 21 nt, Mycobacterium bovis subsp bovis AF2122/97
ccaacaccgguggcuucaacc

SEQ ID NO: 3044871 - RNA, 22 nt, Mycobacterium bovis subsp bovis AF2122/97
ccaacacuggggccccgggaag

SEQ ID NO: 3044872 - RNA, 21 nt, Mycobacterium bovis subsp bovis AF2122/97
ccaacaggauggugcggccgc

SEQ ID NO: 3044873 - RNA, 13 nt, Mycobacterium bovis subsp bovis AF2122/97
ccaacuccaccca

SEQ ID NO: 3044874 - RNA, 22 nt, Mycobacterium bovis subsp bovis AF2122/97
ccaacuccagcacccgcugcac

SEQ ID NO: 3044875 - RNA, 17 nt, Mycobacterium bovis subsp bovis AF2122/97
ccaacuccaucagcgcg

SEQ ID NO: 3044876 - RNA, 14 nt, Mycobacterium bovis subsp bovis AF2122/97
ccaacuccucagcc

SEQ ID NO: 3044877 - RNA, 18 nt, Mycobacterium bovis subsp bovis AF2122/97
ccaacuccugcagcccgg

SEQ ID NO: 3044878 - RNA, 23 nt, Mycobacterium bovis subsp bovis AF2122/97
ccaacucgacgugcacggucaac

SEQ ID NO: 3044879 - RNA, 12 nt, Mycobacterium bovis subsp bovis AF2122/97
ccaacucggcca

SEQ ID NO: 3044880 - RNA, 14 nt, Mycobacterium bovis subsp bovis AF2122/97
ccaacucggccagc

SEQ ID NO: 3044881 - RNA, 16 nt, Mycobacterium bovis subsp bovis AF2122/97
ccaacucggcccgggu

SEQ ID NO: 3044882 - RNA, 21 nt, Mycobacterium bovis subsp bovis AF2122/97
ccaacucggcccgggugacgg

SEQ ID NO: 3044883 - RNA, 13 nt, Mycobacterium bovis subsp bovis AF2122/97
ccaacucggcgac

SEQ ID NO: 3044884 - RNA, 17 nt, Mycobacterium bovis subsp bovis AF2122/97
ccaacucgguucgcccc

SEQ ID NO: 3044885 - RNA, 22 nt, Mycobacterium bovis subsp bovis AF2122/97
ccaacucguggaacuccguccg

SEQ ID NO: 3044886 - RNA, 22 nt, Mycobacterium bovis subsp bovis AF2122/97
ccaacucuucagcaagccaacc

SEQ ID NO: 3044887 - RNA, 14 nt, Mycobacterium bovis subsp bovis AF2122/97
ccaacugaaccgag

SEQ ID NO: 3044888 - RNA, 20 nt, Mycobacterium bovis subsp bovis AF2122/97
ccaacugcgaaacgccaccg

SEQ ID NO: 3044889 - RNA, 19 nt, Mycobacterium bovis subsp bovis AF2122/97
ccaacugcgccguucgcuc

SEQ ID NO: 3044890 - RNA, 14 nt, Mycobacterium bovis subsp bovis AF2122/97
ccaacuggccgcgu

SEQ ID NO: 3044891 - RNA, 17 nt, Mycobacterium bovis subsp bovis AF2122/97
ccaacuggccgcgucgc

SEQ ID NO: 3044892 - RNA, 13 nt, Mycobacterium bovis subsp bovis AF2122/97
ccaacugggccga

SEQ ID NO: 3044893 - RNA, 18 nt, Mycobacterium bovis subsp bovis AF2122/97
ccaacugggccgagcgcg

SEQ ID NO: 3044894 - RNA, 20 nt, Mycobacterium bovis subsp bovis AF2122/97
ccaacugggccgagcgcgcc

SEQ ID NO: 3044895 - RNA, 14 nt, Mycobacterium bovis subsp bovis AF2122/97
ccaacuggucgcca

SEQ ID NO: 3044896 - RNA, 16 nt, Mycobacterium bovis subsp bovis AF2122/97
ccaacuggucgccaac

SEQ ID NO: 3044897 - RNA, 22 nt, Mycobacterium bovis subsp bovis AF2122/97
ccaacuggucgccaacgccagc

SEQ ID NO: 3044898 - RNA, 23 nt, Mycobacterium bovis subsp bovis AF2122/97
ccaacuucugcacgaacgccugc

SEQ ID NO: 3044899 - RNA, 15 nt, Mycobacterium bovis subsp bovis AF2122/97
ccaacuuggcggcca

SEQ ID NO: 3044900 - RNA, 17 nt, Mycobacterium bovis subsp bovis AF2122/97
ccaacuuggcggccagc

SEQ ID NO: 3044901 - RNA, 21 nt, Mycobacterium bovis subsp bovis AF2122/97
ccaacuuggcggccagccgcu

SEQ ID NO: 3044902 - RNA, 21 nt, Mycobacterium bovis subsp bovis AF2122/97
ccaagaaagacgcuguccagg

SEQ ID NO: 3044903 - RNA, 14 nt, Mycobacterium bovis subsp bovis AF2122/97
ccaagaaccacgac

SEQ ID NO: 3044904 - RNA, 17 nt, Mycobacterium bovis subsp bovis AF2122/97
ccaagaaugugggcgac

SEQ ID NO: 3044905 - RNA, 22 nt, Mycobacterium bovis subsp bovis AF2122/97
ccaagacaccggccugcgcgac

SEQ ID NO: 3044906 - RNA, 15 nt, Mycobacterium bovis subsp bovis AF2122/97
ccaagacgucggcgu

SEQ ID NO: 3044907 - RNA, 18 nt, Mycobacterium bovis subsp bovis AF2122/97
ccaagagcgcgcagcagu

SEQ ID NO: 3044908 - RNA, 15 nt, Mycobacterium bovis subsp bovis AF2122/97
ccaagaugccgcccc

SEQ ID NO: 3044909 - RNA, 16 nt, Mycobacterium bovis subsp bovis AF2122/97
ccaagcagcgaccagc

SEQ ID NO: 3044910 - RNA, 12 nt, Mycobacterium bovis subsp bovis AF2122/97
ccaagcaggcgg

SEQ ID NO: 3044911 - RNA, 18 nt, Mycobacterium bovis subsp bovis AF2122/97
ccaagccauguggcgucg

SEQ ID NO: 3044912 - RNA, 15 nt, Mycobacterium bovis subsp bovis AF2122/97
ccaagccgccggcgc

SEQ ID NO: 3044913 - RNA, 15 nt, Mycobacterium bovis subsp bovis AF2122/97
ccaagccggagcccg

SEQ ID NO: 3044914 - RNA, 12 nt, Mycobacterium bovis subsp bovis AF2122/97
ccaagccggcga

SEQ ID NO: 3044915 - RNA, 18 nt, Mycobacterium bovis subsp bovis AF2122/97
ccaagccgggugggagca

SEQ ID NO: 3044916 - RNA, 21 nt, Mycobacterium bovis subsp bovis AF2122/97
ccaagccgggugggagcagcc

SEQ ID NO: 3044917 - RNA, 22 nt, Mycobacterium bovis subsp bovis AF2122/97
ccaagccgggugggagcagccg

SEQ ID NO: 3044918 - RNA, 21 nt, Mycobacterium bovis subsp bovis AF2122/97
ccaagccguaguaguggccgc

SEQ ID NO: 3044919 - RNA, 17 nt, Mycobacterium bovis subsp bovis AF2122/97
ccaagcgacucgccggc

SEQ ID NO: 3044920 - RNA, 19 nt, Mycobacterium bovis subsp bovis AF2122/97
ccaagcgacucgccggcga

SEQ ID NO: 3044921 - RNA, 22 nt, Mycobacterium bovis subsp bovis AF2122/97
ccaagcgcagccuggucgcgca

SEQ ID NO: 3044922 - RNA, 22 nt, Mycobacterium bovis subsp bovis AF2122/97
ccaagcggguuguggcacccgg

SEQ ID NO: 3044923 - RNA, 14 nt, Mycobacterium bovis subsp bovis AF2122/97
ccaagcguccgcug

SEQ ID NO: 3044924 - RNA, 15 nt, Mycobacterium bovis subsp bovis AF2122/97
ccaagcgugccugca

SEQ ID NO: 3044925 - RNA, 18 nt, Mycobacterium bovis subsp bovis AF2122/97
ccaagcgugcugccgccu

SEQ ID NO: 3044926 - RNA, 21 nt, Mycobacterium bovis subsp bovis AF2122/97
ccaagcuaccccgacggcgac

SEQ ID NO: 3044927 - RNA, 14 nt, Mycobacterium bovis subsp bovis AF2122/97
ccaagcucgacaac

SEQ ID NO: 3044928 - RNA, 15 nt, Mycobacterium bovis subsp bovis AF2122/97
ccaagcucggccacc

SEQ ID NO: 3044929 - RNA, 21 nt, Mycobacterium bovis subsp bovis AF2122/97
ccaagcucggccaccagcgcc

SEQ ID NO: 3044930 - RNA, 15 nt, Mycobacterium bovis subsp bovis AF2122/97
ccaagcucggccagc

SEQ ID NO: 3044931 - RNA, 13 nt, Mycobacterium bovis subsp bovis AF2122/97
ccaagcucggccc

SEQ ID NO: 3044932 - RNA, 23 nt, Mycobacterium bovis subsp bovis AF2122/97
ccaagcucggcccagcgcgccag

SEQ ID NO: 3044933 - RNA, 20 nt, Mycobacterium bovis subsp bovis AF2122/97
ccaagcugucaagcgggcug

SEQ ID NO: 3044934 - RNA, 23 nt, Mycobacterium bovis subsp bovis AF2122/97
ccaagcugucaagcgggcuggcg

SEQ ID NO: 3044935 - RNA, 14 nt, Mycobacterium bovis subsp bovis AF2122/97
ccaaggccuucagc

SEQ ID NO: 3044936 - RNA, 16 nt, Mycobacterium bovis subsp bovis AF2122/97
ccaaggccuucagcgg

SEQ ID NO: 3044937 - RNA, 14 nt, Mycobacterium bovis subsp bovis AF2122/97
ccaaggcgaugguc

SEQ ID NO: 3044938 - RNA, 16 nt, Mycobacterium bovis subsp bovis AF2122/97
ccaaggcucagcagcg

SEQ ID NO: 3044939 - RNA, 17 nt, Mycobacterium bovis subsp bovis AF2122/97
ccaaggcucagcagcgc

SEQ ID NO: 3044940 - RNA, 22 nt, Mycobacterium bovis subsp bovis AF2122/97
ccaaggcucagcagcgccgcgc

SEQ ID NO: 3044941 - RNA, 20 nt, Mycobacterium bovis subsp bovis AF2122/97
ccaagggauccgaagagcca

SEQ ID NO: 3044942 - RNA, 15 nt, Mycobacterium bovis subsp bovis AF2122/97
ccaagguaguucgac

SEQ ID NO: 3044943 - RNA, 18 nt, Mycobacterium bovis subsp bovis AF2122/97
ccaaggucuucaggccgc

SEQ ID NO: 3044944 - RNA, 20 nt, Mycobacterium bovis subsp bovis AF2122/97
ccaaggucuucaggccgcgc

SEQ ID NO: 3044945 - RNA, 23 nt, Mycobacterium bovis subsp bovis AF2122/97
ccaaggugagcagcaagaccgcg

SEQ ID NO: 3044946 - RNA, 15 nt, Mycobacterium bovis subsp bovis AF2122/97
ccaagguggccacca

SEQ ID NO: 3044947 - RNA, 13 nt, Mycobacterium bovis subsp bovis AF2122/97
ccaagguggcggc

SEQ ID NO: 3044948 - RNA, 15 nt, Mycobacterium bovis subsp bovis AF2122/97
ccaagguggcggcca

SEQ ID NO: 3044949 - RNA, 22 nt, Mycobacterium bovis subsp bovis AF2122/97
ccaagguguccagcaccugccg

SEQ ID NO: 3044950 - RNA, 17 nt, Mycobacterium bovis subsp bovis AF2122/97
ccaaguacgcgaccgcg

SEQ ID NO: 3044951 - RNA, 18 nt, Mycobacterium bovis subsp bovis AF2122/97
ccaaguacgcgaccgcga

SEQ ID NO: 3044952 - RNA, 21 nt, Mycobacterium bovis subsp bovis AF2122/97
ccaaguagucggguuuggccg

SEQ ID NO: 3044953 - RNA, 14 nt, Mycobacterium bovis subsp bovis AF2122/97
ccaagucacagcuc

SEQ ID NO: 3044954 - RNA, 21 nt, Mycobacterium bovis subsp bovis AF2122/97
ccaagucagaacggcggcagc

SEQ ID NO: 3044955 - RNA, 22 nt, Mycobacterium bovis subsp bovis AF2122/97
ccaagucagaacggcggcagcg

SEQ ID NO: 3044956 - RNA, 18 nt, Mycobacterium bovis subsp bovis AF2122/97
ccaaguccuccacggcgg

SEQ ID NO: 3044957 - RNA, 23 nt, Mycobacterium bovis subsp bovis AF2122/97
ccaagucgacgguggcgccgucg

SEQ ID NO: 3044958 - RNA, 14 nt, Mycobacterium bovis subsp bovis AF2122/97
ccaagucgccgagg

SEQ ID NO: 3044959 - RNA, 15 nt, Mycobacterium bovis subsp bovis AF2122/97
ccacaccuuggccgc

SEQ ID NO: 3044960 - RNA, 17 nt, Mycobacterium bovis subsp bovis AF2122/97
ccacaccuuggcggucg

SEQ ID NO: 3044961 - RNA, 18 nt, Mycobacterium bovis subsp bovis AF2122/97
ccacaccuuggcggucgg

SEQ ID NO: 3044962 - RNA, 16 nt, Mycobacterium bovis subsp bovis AF2122/97
ccacacgcccucgacg

SEQ ID NO: 3044963 - RNA, 16 nt, Mycobacterium bovis subsp bovis AF2122/97
ccacacgggaagccgc

SEQ ID NO: 3044964 - RNA, 13 nt, Mycobacterium bovis subsp bovis AF2122/97
ccacacggggccg

SEQ ID NO: 3044965 - RNA, 14 nt, Mycobacterium bovis subsp bovis AF2122/97
ccacacggggccgc

SEQ ID NO: 3044966 - RNA, 17 nt, Mycobacterium bovis subsp bovis AF2122/97
ccacacggggccgccag

SEQ ID NO: 3044967 - RNA, 13 nt, Mycobacterium bovis subsp bovis AF2122/97
ccacacggugcga

SEQ ID NO: 3044968 - RNA, 12 nt, Mycobacterium bovis subsp bovis AF2122/97
ccacacucagca

SEQ ID NO: 3044969 - RNA, 13 nt, Mycobacterium bovis subsp bovis AF2122/97
ccacacucagcac

SEQ ID NO: 3044970 - RNA, 15 nt, Mycobacterium bovis subsp bovis AF2122/97
ccacacucccgcgcc

SEQ ID NO: 3044971 - RNA, 23 nt, Mycobacterium bovis subsp bovis AF2122/97
ccacacucgccagggccaucugg

SEQ ID NO: 3044972 - RNA, 23 nt, Mycobacterium bovis subsp bovis AF2122/97
ccacacuggggauaaacugccgc

SEQ ID NO: 3044973 - RNA, 11 nt, Mycobacterium bovis subsp bovis AF2122/97
ccacagcaacg

SEQ ID NO: 3044974 - RNA, 14 nt, Mycobacterium bovis subsp bovis AF2122/97
ccacagcacccacg

SEQ ID NO: 3044975 - RNA, 20 nt, Mycobacterium bovis subsp bovis AF2122/97
ccacagcauaaagaucagca

SEQ ID NO: 3044976 - RNA, 14 nt, Mycobacterium bovis subsp bovis AF2122/97
ccacagcccggcgg

SEQ ID NO: 3044977 - RNA, 16 nt, Mycobacterium bovis subsp bovis AF2122/97
ccacagcccggcggcg

SEQ ID NO: 3044978 - RNA, 13 nt, Mycobacterium bovis subsp bovis AF2122/97
ccacagccgcgcc

SEQ ID NO: 3044979 - RNA, 14 nt, Mycobacterium bovis subsp bovis AF2122/97
ccacagccgcgccg

SEQ ID NO: 3044980 - RNA, 14 nt, Mycobacterium bovis subsp bovis AF2122/97
ccacagccggcggc

SEQ ID NO: 3044981 - RNA, 11 nt, Mycobacterium bovis subsp bovis AF2122/97
ccacagcgcca

SEQ ID NO: 3044982 - RNA, 19 nt, Mycobacterium bovis subsp bovis AF2122/97
ccacagcgccaucagacca

SEQ ID NO: 3044983 - RNA, 13 nt, Mycobacterium bovis subsp bovis AF2122/97
ccacagcggagac

SEQ ID NO: 3044984 - RNA, 13 nt, Mycobacterium bovis subsp bovis AF2122/97
ccacagcucgccg

SEQ ID NO: 3044985 - RNA, 22 nt, Mycobacterium bovis subsp bovis AF2122/97
ccacagcugacgagccgguggc

SEQ ID NO: 3044986 - RNA, 11 nt, Mycobacterium bovis subsp bovis AF2122/97
ccacagcuugc

SEQ ID NO: 3044987 - RNA, 14 nt, Mycobacterium bovis subsp bovis AF2122/97
ccacaggcggcgcu

SEQ ID NO: 3044988 - RNA, 19 nt, Mycobacterium bovis subsp bovis AF2122/97
ccacaggcugaagacgaau

SEQ ID NO: 3044989 - RNA, 16 nt, Mycobacterium bovis subsp bovis AF2122/97
ccacaggggcagcgcg

SEQ ID NO: 3044990 - RNA, 17 nt, Mycobacterium bovis subsp bovis AF2122/97
ccacaggggccagcgcg

SEQ ID NO: 3044991 - RNA, 16 nt, Mycobacterium bovis subsp bovis AF2122/97
ccacagguagaccguc

SEQ ID NO: 3044992 - RNA, 12 nt, Mycobacterium bovis subsp bovis AF2122/97
ccacaggugacc

SEQ ID NO: 3044993 - RNA, 15 nt, Mycobacterium bovis subsp bovis AF2122/97
ccacagguuugcgcc

SEQ ID NO: 3044994 - RNA, 14 nt, Mycobacterium bovis subsp bovis AF2122/97
ccacagucgccggc

SEQ ID NO: 3044995 - RNA, 16 nt, Mycobacterium bovis subsp bovis AF2122/97
ccacagucgccggccg

SEQ ID NO: 3044996 - RNA, 21 nt, Mycobacterium bovis subsp bovis AF2122/97
ccacagucgccggccggcccg

SEQ ID NO: 3044997 - RNA, 16 nt, Mycobacterium bovis subsp bovis AF2122/97
ccacagucgugagcca

SEQ ID NO: 3044998 - RNA, 20 nt, Mycobacterium bovis subsp bovis AF2122/97
ccacaguuaucagccgcgcg

SEQ ID NO: 3044999 - RNA, 21 nt, Mycobacterium bovis subsp bovis AF2122/97
ccacaguuaucagccgcgcgc

SEQ ID NO: 3045000 - RNA, 16 nt, Mycobacterium bovis subsp bovis AF2122/97
ccacauacaccggccg

SEQ ID NO: 3045001 - RNA, 13 nt, Mycobacterium bovis subsp bovis AF2122/97
ccacauaccccga

SEQ ID NO: 3045002 - RNA, 17 nt, Mycobacterium bovis subsp bovis AF2122/97
ccacaucaacuugccgc

SEQ ID NO: 3045003 - RNA, 22 nt, Mycobacterium bovis subsp bovis AF2122/97
ccacaucaccaaaaacccggug

SEQ ID NO: 3045004 - RNA, 15 nt, Mycobacterium bovis subsp bovis AF2122/97
ccacaucaugccagc

SEQ ID NO: 3045005 - RNA, 20 nt, Mycobacterium bovis subsp bovis AF2122/97
ccacauccaacgaccuccac

SEQ ID NO: 3045006 - RNA, 22 nt, Mycobacterium bovis subsp bovis AF2122/97
ccacauccagggugccggucac

SEQ ID NO: 3045007 - RNA, 16 nt, Mycobacterium bovis subsp bovis AF2122/97
ccacaucccacggugg

SEQ ID NO: 3045008 - RNA, 15 nt, Mycobacterium bovis subsp bovis AF2122/97
ccacauccuggcggc

SEQ ID NO: 3045009 - RNA, 17 nt, Mycobacterium bovis subsp bovis AF2122/97
ccacauccuggcggcug

SEQ ID NO: 3045010 - RNA, 24 nt, Mycobacterium bovis subsp bovis AF2122/97
ccacauccuggcggcugcagccga

SEQ ID NO: 3045011 - RNA, 23 nt, Mycobacterium bovis subsp bovis AF2122/97
ccacaucgaacgacgcauccgga

SEQ ID NO: 3045012 - RNA, 16 nt, Mycobacterium bovis subsp bovis AF2122/97
ccacaucgaugucggc

SEQ ID NO: 3045013 - RNA, 14 nt, Mycobacterium bovis subsp bovis AF2122/97
ccacaucgccagca

SEQ ID NO: 3045014 - RNA, 19 nt, Mycobacterium bovis subsp bovis AF2122/97
ccacaucgccagcagcaaa

SEQ ID NO: 3045015 - RNA, 14 nt, Mycobacterium bovis subsp bovis AF2122/97
ccacaucgggccgg

SEQ ID NO: 3045016 - RNA, 12 nt, Mycobacterium bovis subsp bovis AF2122/97
ccacaucggugu

SEQ ID NO: 3045017 - RNA, 21 nt, Mycobacterium bovis subsp bovis AF2122/97
ccacaucgguguggcccaaca

SEQ ID NO: 3045018 - RNA, 18 nt, Mycobacterium bovis subsp bovis AF2122/97
ccacaucgucggcgggcg

SEQ ID NO: 3045019 - RNA, 20 nt, Mycobacterium bovis subsp bovis AF2122/97
ccacaucgucggcgggcggc

SEQ ID NO: 3045020 - RNA, 17 nt, Mycobacterium bovis subsp bovis AF2122/97
ccacaugacgaucgcgg

SEQ ID NO: 3045021 - RNA, 21 nt, Mycobacterium bovis subsp bovis AF2122/97
ccacaugacgaucgcggcggg

SEQ ID NO: 3045022 - RNA, 22 nt, Mycobacterium bovis subsp bovis AF2122/97
ccacaugaucgagcaguuccag

SEQ ID NO: 3045023 - RNA, 15 nt, Mycobacterium bovis subsp bovis AF2122/97
ccacauggugaccau

SEQ ID NO: 3045024 - RNA, 21 nt, Mycobacterium bovis subsp bovis AF2122/97
ccacauguugucgacggucgg

SEQ ID NO: 3045025 - RNA, 20 nt, Mycobacterium bovis subsp bovis AF2122/97
ccacauuccguagccggcgg

SEQ ID NO: 3045026 - RNA, 18 nt, Mycobacterium bovis subsp bovis AF2122/97
ccacauuggcgaucagca

SEQ ID NO: 3045027 - RNA, 21 nt, Mycobacterium bovis subsp bovis AF2122/97
ccacauuggcgaucagcagcc

SEQ ID NO: 3045028 - RNA, 21 nt, Mycobacterium bovis subsp bovis AF2122/97
ccacauuucaccaccguggcc

SEQ ID NO: 3045029 - RNA, 14 nt, Mycobacterium bovis subsp bovis AF2122/97
ccaccaaaccccaa

SEQ ID NO: 3045030 - RNA, 21 nt, Mycobacterium bovis subsp bovis AF2122/97
ccaccaaacgcugcuggcaug

SEQ ID NO: 3045031 - RNA, 20 nt, Mycobacterium bovis subsp bovis AF2122/97
ccaccaacgagucagugcca

SEQ ID NO: 3045032 - RNA, 22 nt, Mycobacterium bovis subsp bovis AF2122/97
ccaccaacgagucagugccauc

SEQ ID NO: 3045033 - RNA, 13 nt, Mycobacterium bovis subsp bovis AF2122/97
ccaccaacucggc

SEQ ID NO: 3045034 - RNA, 14 nt, Mycobacterium bovis subsp bovis AF2122/97
ccaccaagcucgca

SEQ ID NO: 3045035 - RNA, 14 nt, Mycobacterium bovis subsp bovis AF2122/97
ccaccaagcucggc

SEQ ID NO: 3045036 - RNA, 15 nt, Mycobacterium bovis subsp bovis AF2122/97
ccaccaaggugagca

SEQ ID NO: 3045037 - RNA, 19 nt, Mycobacterium bovis subsp bovis AF2122/97
ccaccaagguguggccuug

SEQ ID NO: 3045038 - RNA, 20 nt, Mycobacterium bovis subsp bovis AF2122/97
ccaccaagguguggccuugc

SEQ ID NO: 3045039 - RNA, 23 nt, Mycobacterium bovis subsp bovis AF2122/97
ccaccacaacgccaggaacccgu

SEQ ID NO: 3045040 - RNA, 15 nt, Mycobacterium bovis subsp bovis AF2122/97
ccaccacaccggagc

SEQ ID NO: 3045041 - RNA, 18 nt, Mycobacterium bovis subsp bovis AF2122/97
ccaccacaccggagccga

SEQ ID NO: 3045042 - RNA, 16 nt, Mycobacterium bovis subsp bovis AF2122/97
ccaccacaccugcggc

SEQ ID NO: 3045043 - RNA, 20 nt, Mycobacterium bovis subsp bovis AF2122/97
ccaccacaccugcggcugcu

SEQ ID NO: 3045044 - RNA, 18 nt, Mycobacterium bovis subsp bovis AF2122/97
ccaccacaugcgagucgc

SEQ ID NO: 3045045 - RNA, 12 nt, Mycobacterium bovis subsp bovis AF2122/97
ccaccaccaacg

SEQ ID NO: 3045046 - RNA, 16 nt, Mycobacterium bovis subsp bovis AF2122/97
ccacccagaugcagcg

SEQ ID NO: 3045047 - RNA, 24 nt, Mycobacterium bovis subsp bovis AF2122/97
ccacccagauugccugggcggccg

SEQ ID NO: 3045048 - RNA, 13 nt, Mycobacterium bovis subsp bovis AF2122/97
ccacccagcgacu

SEQ ID NO: 3045049 - RNA, 12 nt, Mycobacterium bovis subsp bovis AF2122/97
ccacccaggccg

SEQ ID NO: 3045050 - RNA, 18 nt, Mycobacterium bovis subsp bovis AF2122/97
ccacccauagacccggcu

SEQ ID NO: 3045051 - RNA, 14 nt, Mycobacterium bovis subsp bovis AF2122/97
ccaccccacccagc

SEQ ID NO: 3045052 - RNA, 17 nt, Mycobacterium bovis subsp bovis AF2122/97
ccaccccagcggccacc

SEQ ID NO: 3045053 - RNA, 19 nt, Mycobacterium bovis subsp bovis AF2122/97
ccaccccagcggccaccga

SEQ ID NO: 3045054 - RNA, 14 nt, Mycobacterium bovis subsp bovis AF2122/97
ccacccccaccgaa

SEQ ID NO: 3045055 - RNA, 13 nt, Mycobacterium bovis subsp bovis AF2122/97
ccacccccgguuc

SEQ ID NO: 3045056 - RNA, 17 nt, Mycobacterium bovis subsp bovis AF2122/97
ccaccccgaccucccgg

SEQ ID NO: 3045057 - RNA, 15 nt, Mycobacterium bovis subsp bovis AF2122/97
ccaccccgagcucac

SEQ ID NO: 3045058 - RNA, 14 nt, Mycobacterium bovis subsp bovis AF2122/97
ccaccccgaggccg

SEQ ID NO: 3045059 - RNA, 16 nt, Mycobacterium bovis subsp bovis AF2122/97
ccaccccgaggccgac

SEQ ID NO: 3045060 - RNA, 20 nt, Mycobacterium bovis subsp bovis AF2122/97
ccaccccgaggccgaccucg

SEQ ID NO: 3045061 - RNA, 14 nt, Mycobacterium bovis subsp bovis AF2122/97
ccaccccgauccgc

SEQ ID NO: 3045062 - RNA, 17 nt, Mycobacterium bovis subsp bovis AF2122/97
ccaccccgauccgccac

SEQ ID NO: 3045063 - RNA, 21 nt, Mycobacterium bovis subsp bovis AF2122/97
ccaccccgcgcgccagcucgg

SEQ ID NO: 3045064 - RNA, 19 nt, Mycobacterium bovis subsp bovis AF2122/97
ccaccccgcguaugccagg

SEQ ID NO: 3045065 - RNA, 23 nt, Mycobacterium bovis subsp bovis AF2122/97
ccaccccgcuuggaccguugccg

SEQ ID NO: 3045066 - RNA, 24 nt, Mycobacterium bovis subsp bovis AF2122/97
ccaccccgcuuggaccguugccga

SEQ ID NO: 3045067 - RNA, 13 nt, Mycobacterium bovis subsp bovis AF2122/97
ccaccccggccgc

SEQ ID NO: 3045068 - RNA, 14 nt, Mycobacterium bovis subsp bovis AF2122/97
ccaccccggccgca

SEQ ID NO: 3045069 - RNA, 15 nt, Mycobacterium bovis subsp bovis AF2122/97
ccaccccggccgcau

SEQ ID NO: 3045070 - RNA, 23 nt, Mycobacterium bovis subsp bovis AF2122/97
ccaccccggucggagcggugccg

SEQ ID NO: 3045071 - RNA, 22 nt, Mycobacterium bovis subsp bovis AF2122/97
ccaccccugcgguccgcugcca

SEQ ID NO: 3045072 - RNA, 22 nt, Mycobacterium bovis subsp bovis AF2122/97
ccacccgacaacgcugggcggc

SEQ ID NO: 3045073 - RNA, 12 nt, Mycobacterium bovis subsp bovis AF2122/97
ccacccgacaug

SEQ ID NO: 3045074 - RNA, 17 nt, Mycobacterium bovis subsp bovis AF2122/97
ccacccgacaugcgccg

SEQ ID NO: 3045075 - RNA, 15 nt, Mycobacterium bovis subsp bovis AF2122/97
ccacccgagcacuga

SEQ ID NO: 3045076 - RNA, 13 nt, Mycobacterium bovis subsp bovis AF2122/97
ccacccgagcucu

SEQ ID NO: 3045077 - RNA, 16 nt, Mycobacterium bovis subsp bovis AF2122/97
ccacccgaucgggcgu

SEQ ID NO: 3045078 - RNA, 18 nt, Mycobacterium bovis subsp bovis AF2122/97
ccacccgauuggccaacc

SEQ ID NO: 3045079 - RNA, 19 nt, Mycobacterium bovis subsp bovis AF2122/97
ccacccgcaccaccggccc

SEQ ID NO: 3045080 - RNA, 22 nt, Mycobacterium bovis subsp bovis AF2122/97
ccacccgcaccaccggccccac

SEQ ID NO: 3045081 - RNA, 16 nt, Mycobacterium bovis subsp bovis AF2122/97
ccacccgcaccgccgg

SEQ ID NO: 3045082 - RNA, 14 nt, Mycobacterium bovis subsp bovis AF2122/97
ccacccgcaccgcg

SEQ ID NO: 3045083 - RNA, 16 nt, Mycobacterium bovis subsp bovis AF2122/97
ccacccgcaccucacc

SEQ ID NO: 3045084 - RNA, 14 nt, Mycobacterium bovis subsp bovis AF2122/97
ccacccgccacggu

SEQ ID NO: 3045085 - RNA, 14 nt, Mycobacterium bovis subsp bovis AF2122/97
ccacccgccgccgc

SEQ ID NO: 3045086 - RNA, 16 nt, Mycobacterium bovis subsp bovis AF2122/97
ccacccgccgccgccc

SEQ ID NO: 3045087 - RNA, 17 nt, Mycobacterium bovis subsp bovis AF2122/97
ccacccgccgccgcccg

SEQ ID NO: 3045088 - RNA, 16 nt, Mycobacterium bovis subsp bovis AF2122/97
ccacccgcgaagccgc

SEQ ID NO: 3045089 - RNA, 13 nt, Mycobacterium bovis subsp bovis AF2122/97
ccacccgcgccgc

SEQ ID NO: 3045090 - RNA, 19 nt, Mycobacterium bovis subsp bovis AF2122/97
ccacccgcgcgaugcuggc

SEQ ID NO: 3045091 - RNA, 13 nt, Mycobacterium bovis subsp bovis AF2122/97
ccacccgcggcgc

SEQ ID NO: 3045092 - RNA, 15 nt, Mycobacterium bovis subsp bovis AF2122/97
ccacccgcggcgccg

SEQ ID NO: 3045093 - RNA, 20 nt, Mycobacterium bovis subsp bovis AF2122/97
ccacccgcggcgccguugcc

SEQ ID NO: 3045094 - RNA, 18 nt, Mycobacterium bovis subsp bovis AF2122/97
ccacccgcggugccugca

SEQ ID NO: 3045095 - RNA, 21 nt, Mycobacterium bovis subsp bovis AF2122/97
ccacccgcggugccugcagcu

SEQ ID NO: 3045096 - RNA, 21 nt, Mycobacterium bovis subsp bovis AF2122/97
ccacccggcauugagccgggc

SEQ ID NO: 3045097 - RNA, 12 nt, Mycobacterium bovis subsp bovis AF2122/97
ccacccggccgc

SEQ ID NO: 3045098 - RNA, 13 nt, Mycobacterium bovis subsp bovis AF2122/97
ccacccggccgcg

SEQ ID NO: 3045099 - RNA, 15 nt, Mycobacterium bovis subsp bovis AF2122/97
ccacccggccgcgcg

SEQ ID NO: 3045100 - RNA, 16 nt, Mycobacterium bovis subsp bovis AF2122/97
ccacccggccgcgcgg

SEQ ID NO: 3045101 - RNA, 12 nt, Mycobacterium bovis subsp bovis AF2122/97
ccacccgggcgu

SEQ ID NO: 3045102 - RNA, 24 nt, Mycobacterium bovis subsp bovis AF2122/97
ccacccugcacugcgcgugcucga

SEQ ID NO: 3045103 - RNA, 13 nt, Mycobacterium bovis subsp bovis AF2122/97
ccacccuugccga

SEQ ID NO: 3045104 - RNA, 17 nt, Mycobacterium bovis subsp bovis AF2122/97
ccacccuugccgaugac

SEQ ID NO: 3045105 - RNA, 15 nt, Mycobacterium bovis subsp bovis AF2122/97
ccacccuugccgccg

SEQ ID NO: 3045106 - RNA, 15 nt, Mycobacterium bovis subsp bovis AF2122/97
ccacccuugccgcug

SEQ ID NO: 3045107 - RNA, 16 nt, Mycobacterium bovis subsp bovis AF2122/97
ccacccuugccgcugg

SEQ ID NO: 3045108 - RNA, 17 nt, Mycobacterium bovis subsp bovis AF2122/97
ccacccuuggcccggug

SEQ ID NO: 3045109 - RNA, 13 nt, Mycobacterium bovis subsp bovis AF2122/97
ccaccgaaaaguc

SEQ ID NO: 3045110 - RNA, 19 nt, Mycobacterium bovis subsp bovis AF2122/97
ccaccgaaaaguccgccgc

SEQ ID NO: 3045111 - RNA, 19 nt, Mycobacterium bovis subsp bovis AF2122/97
ccaccgaaaccggucagca

SEQ ID NO: 3045112 - RNA, 23 nt, Mycobacterium bovis subsp bovis AF2122/97
ccaccgaaauacccagcgcagca

SEQ ID NO: 3045113 - RNA, 23 nt, Mycobacterium bovis subsp bovis AF2122/97
ccaccgaaauugcccuagcagca

SEQ ID NO: 3045114 - RNA, 17 nt, Mycobacterium bovis subsp bovis AF2122/97
ccaccgaacgcggccac

SEQ ID NO: 3045115 - RNA, 21 nt, Mycobacterium bovis subsp bovis AF2122/97
ccaccgaacgcggccaccgac

SEQ ID NO: 3045116 - RNA, 22 nt, Mycobacterium bovis subsp bovis AF2122/97
ccaccgaacgcggccaccgacc

SEQ ID NO: 3045117 - RNA, 23 nt, Mycobacterium bovis subsp bovis AF2122/97
ccaccgaacgcggccaccgaccg

SEQ ID NO: 3045118 - RNA, 24 nt, Mycobacterium bovis subsp bovis AF2122/97
ccaccgaacgcggccaccgaccgc

SEQ ID NO: 3045119 - RNA, 20 nt, Mycobacterium bovis subsp bovis AF2122/97
ccaccgaacgugugggccau

SEQ ID NO: 3045120 - RNA, 12 nt, Mycobacterium bovis subsp bovis AF2122/97
ccaccgacagca

SEQ ID NO: 3045121 - RNA, 14 nt, Mycobacterium bovis subsp bovis AF2122/97
ccaccgacagcacc

SEQ ID NO: 3045122 - RNA, 22 nt, Mycobacterium bovis subsp bovis AF2122/97
ccaccgacagcacccggccacc

SEQ ID NO: 3045123 - RNA, 22 nt, Mycobacterium bovis subsp bovis AF2122/97
ccaccgacauguguggcagccc

SEQ ID NO: 3045124 - RNA, 15 nt, Mycobacterium bovis subsp bovis AF2122/97
ccaccgaccgcguaa

SEQ ID NO: 3045125 - RNA, 20 nt, Mycobacterium bovis subsp bovis AF2122/97
ccaccgaccgcguaaaggcc

SEQ ID NO: 3045126 - RNA, 22 nt, Mycobacterium bovis subsp bovis AF2122/97
ccaccgacgacaucgguggccc

SEQ ID NO: 3045127 - RNA, 23 nt, Mycobacterium bovis subsp bovis AF2122/97
ccaccgacggaaugucagccggu

SEQ ID NO: 3045128 - RNA, 19 nt, Mycobacterium bovis subsp bovis AF2122/97
ccaccgacguggccagccc

SEQ ID NO: 3045129 - RNA, 16 nt, Mycobacterium bovis subsp bovis AF2122/97
ccaccgagaucaugcc

SEQ ID NO: 3045130 - RNA, 20 nt, Mycobacterium bovis subsp bovis AF2122/97
ccaccgagaucaugccggcg

SEQ ID NO: 3045131 - RNA, 22 nt, Mycobacterium bovis subsp bovis AF2122/97
ccaccgauaccgucagcgccgc

SEQ ID NO: 3045132 - RNA, 18 nt, Mycobacterium bovis subsp bovis AF2122/97
ccaccgaucgacugcagc

SEQ ID NO: 3045133 - RNA, 16 nt, Mycobacterium bovis subsp bovis AF2122/97
ccaccggccccaccga

SEQ ID NO: 3045134 - RNA, 18 nt, Mycobacterium bovis subsp bovis AF2122/97
ccaccggccccaccgaca

SEQ ID NO: 3045135 - RNA, 18 nt, Mycobacterium bovis subsp bovis AF2122/97
ccaccggccccaccggca

SEQ ID NO: 3045136 - RNA, 19 nt, Mycobacterium bovis subsp bovis AF2122/97
ccaccggccccaccggcac

SEQ ID NO: 3045137 - RNA, 21 nt, Mycobacterium bovis subsp bovis AF2122/97
ccaccggccccaccggcaccc

SEQ ID NO: 3045138 - RNA, 15 nt, Mycobacterium bovis subsp bovis AF2122/97
ccaccggcccucgcc

SEQ ID NO: 3045139 - RNA, 14 nt, Mycobacterium bovis subsp bovis AF2122/97
ccaccggccgcgca

SEQ ID NO: 3045140 - RNA, 13 nt, Mycobacterium bovis subsp bovis AF2122/97
ccaccggccggcg

SEQ ID NO: 3045141 - RNA, 14 nt, Mycobacterium bovis subsp bovis AF2122/97
ccaccggccguccc

SEQ ID NO: 3045142 - RNA, 18 nt, Mycobacterium bovis subsp bovis AF2122/97
ccaccggcgccaccggcg

SEQ ID NO: 3045143 - RNA, 19 nt, Mycobacterium bovis subsp bovis AF2122/97
ccaccggcgccaccggcgc

SEQ ID NO: 3045144 - RNA, 15 nt, Mycobacterium bovis subsp bovis AF2122/97
ccaccggcgccgccc

SEQ ID NO: 3045145 - RNA, 16 nt, Mycobacterium bovis subsp bovis AF2122/97
ccaccggcgccgccgg

SEQ ID NO: 3045146 - RNA, 18 nt, Mycobacterium bovis subsp bovis AF2122/97
ccaccggcgccgccggca

SEQ ID NO: 3045147 - RNA, 16 nt, Mycobacterium bovis subsp bovis AF2122/97
ccaccggcgccgccgu

SEQ ID NO: 3045148 - RNA, 15 nt, Mycobacterium bovis subsp bovis AF2122/97
ccaccggcgccuccg

SEQ ID NO: 3045149 - RNA, 19 nt, Mycobacterium bovis subsp bovis AF2122/97
ccaccggcgccuccggcac

SEQ ID NO: 3045150 - RNA, 15 nt, Mycobacterium bovis subsp bovis AF2122/97
ccaccggcggugccg

SEQ ID NO: 3045151 - RNA, 18 nt, Mycobacterium bovis subsp bovis AF2122/97
ccaccggcggugccggug

SEQ ID NO: 3045152 - RNA, 22 nt, Mycobacterium bovis subsp bovis AF2122/97
ccaccggcgucgacgucggccc

SEQ ID NO: 3045153 - RNA, 22 nt, Mycobacterium bovis subsp bovis AF2122/97
ccaccggcgucugcccgcccag

SEQ ID NO: 3045154 - RNA, 17 nt, Mycobacterium bovis subsp bovis AF2122/97
ccaccggcuaugcuggc

SEQ ID NO: 3045155 - RNA, 19 nt, Mycobacterium bovis subsp bovis AF2122/97
ccaccggcuaugcuggcgc

SEQ ID NO: 3045156 - RNA, 20 nt, Mycobacterium bovis subsp bovis AF2122/97
ccaccggcuaugcuggcgca

SEQ ID NO: 3045157 - RNA, 23 nt, Mycobacterium bovis subsp bovis AF2122/97
ccaccggcuaugcuggcgcagcg

SEQ ID NO: 3045158 - RNA, 23 nt, Mycobacterium bovis subsp bovis AF2122/97
ccaccggcugauucgagccacau

SEQ ID NO: 3045159 - RNA, 15 nt, Mycobacterium bovis subsp bovis AF2122/97
ccaccggcugcaacc

SEQ ID NO: 3045160 - RNA, 15 nt, Mycobacterium bovis subsp bovis AF2122/97
ccaccggcuggugcc

SEQ ID NO: 3045161 - RNA, 20 nt, Mycobacterium bovis subsp bovis AF2122/97
ccaccgggauagccgcgacc

SEQ ID NO: 3045162 - RNA, 21 nt, Mycobacterium bovis subsp bovis AF2122/97
ccaccgggauggcucacccag

SEQ ID NO: 3045163 - RNA, 14 nt, Mycobacterium bovis subsp bovis AF2122/97
ccaccgggcccgcc

SEQ ID NO: 3045164 - RNA, 16 nt, Mycobacterium bovis subsp bovis AF2122/97
ccaccgggcccgccgg

SEQ ID NO: 3045165 - RNA, 19 nt, Mycobacterium bovis subsp bovis AF2122/97
ccaccgggcccgccggccc

SEQ ID NO: 3045166 - RNA, 15 nt, Mycobacterium bovis subsp bovis AF2122/97
ccaccgggcgcugcu

SEQ ID NO: 3045167 - RNA, 21 nt, Mycobacterium bovis subsp bovis AF2122/97
ccaccgggcgugcggcggccc

SEQ ID NO: 3045168 - RNA, 16 nt, Mycobacterium bovis subsp bovis AF2122/97
ccaccgguaccgccac

SEQ ID NO: 3045169 - RNA, 16 nt, Mycobacterium bovis subsp bovis AF2122/97
ccaccgguaccgccgg

SEQ ID NO: 3045170 - RNA, 19 nt, Mycobacterium bovis subsp bovis AF2122/97
ccaccgguaccgccggcuc

SEQ ID NO: 3045171 - RNA, 18 nt, Mycobacterium bovis subsp bovis AF2122/97
ccaccgguaccggcgacg

SEQ ID NO: 3045172 - RNA, 16 nt, Mycobacterium bovis subsp bovis AF2122/97
ccaccgguccagcgcc

SEQ ID NO: 3045173 - RNA, 17 nt, Mycobacterium bovis subsp bovis AF2122/97
ccaccgguccagcgccg

SEQ ID NO: 3045174 - RNA, 13 nt, Mycobacterium bovis subsp bovis AF2122/97
ccaccggugccgc

SEQ ID NO: 3045175 - RNA, 17 nt, Mycobacterium bovis subsp bovis AF2122/97
ccaccggugccgcccgc

SEQ ID NO: 3045176 - RNA, 20 nt, Mycobacterium bovis subsp bovis AF2122/97
ccaccggugccgcccgcgcc

SEQ ID NO: 3045177 - RNA, 21 nt, Mycobacterium bovis subsp bovis AF2122/97
ccaccggugccgcccgcgccg

SEQ ID NO: 3045178 - RNA, 15 nt, Mycobacterium bovis subsp bovis AF2122/97
ccaccggugccgccg

SEQ ID NO: 3045179 - RNA, 20 nt, Mycobacterium bovis subsp bovis AF2122/97
ccaccggugccgccguugcc

SEQ ID NO: 3045180 - RNA, 17 nt, Mycobacterium bovis subsp bovis AF2122/97
ccaccgguuauggcauu

SEQ ID NO: 3045181 - RNA, 21 nt, Mycobacterium bovis subsp bovis AF2122/97
ccaccguaaacagcgcgccgg

SEQ ID NO: 3045182 - RNA, 22 nt, Mycobacterium bovis subsp bovis AF2122/97
ccaccguacgacagucgcaguc

SEQ ID NO: 3045183 - RNA, 15 nt, Mycobacterium bovis subsp bovis AF2122/97
ccaccguagacgaca

SEQ ID NO: 3045184 - RNA, 20 nt, Mycobacterium bovis subsp bovis AF2122/97
ccaccguagacgacaucguc

SEQ ID NO: 3045185 - RNA, 16 nt, Mycobacterium bovis subsp bovis AF2122/97
ccaccguagccgaggg

SEQ ID NO: 3045186 - RNA, 19 nt, Mycobacterium bovis subsp bovis AF2122/97
ccaccgucacccccgauac

SEQ ID NO: 3045187 - RNA, 15 nt, Mycobacterium bovis subsp bovis AF2122/97
ccaccgucaccgccg

SEQ ID NO: 3045188 - RNA, 19 nt, Mycobacterium bovis subsp bovis AF2122/97
ccaccgucaccgccggcac

SEQ ID NO: 3045189 - RNA, 16 nt, Mycobacterium bovis subsp bovis AF2122/97
ccaccgucaccgccgu

SEQ ID NO: 3045190 - RNA, 18 nt, Mycobacterium bovis subsp bovis AF2122/97
ccaccgucaccgccguca

SEQ ID NO: 3045191 - RNA, 20 nt, Mycobacterium bovis subsp bovis AF2122/97
ccaccgucaccgccguugcc

SEQ ID NO: 3045192 - RNA, 14 nt, Mycobacterium bovis subsp bovis AF2122/97
ccaccgucagcgcg

SEQ ID NO: 3045193 - RNA, 15 nt, Mycobacterium bovis subsp bovis AF2122/97
ccaccgucagcgcga

SEQ ID NO: 3045194 - RNA, 13 nt, Mycobacterium bovis subsp bovis AF2122/97
ccaccgucccugu

SEQ ID NO: 3045195 - RNA, 15 nt, Mycobacterium bovis subsp bovis AF2122/97
ccaccgucgcugccc

SEQ ID NO: 3045196 - RNA, 15 nt, Mycobacterium bovis subsp bovis AF2122/97
ccaccgucucgccgc

SEQ ID NO: 3045197 - RNA, 15 nt, Mycobacterium bovis subsp bovis AF2122/97
ccaccgucugcuggc

SEQ ID NO: 3045198 - RNA, 18 nt, Mycobacterium bovis subsp bovis AF2122/97
ccaccgucugcuggccgg

SEQ ID NO: 3045199 - RNA, 20 nt, Mycobacterium bovis subsp bovis AF2122/97
ccaccgugaagcccuggcca

SEQ ID NO: 3045200 - RNA, 14 nt, Mycobacterium bovis subsp bovis AF2122/97
ccaccgugaccgag

SEQ ID NO: 3045201 - RNA, 20 nt, Mycobacterium bovis subsp bovis AF2122/97
ccaccgugaccgagaagccc

SEQ ID NO: 3045202 - RNA, 22 nt, Mycobacterium bovis subsp bovis AF2122/97
ccaccgugcgguauuugaacgc

SEQ ID NO: 3045203 - RNA, 23 nt, Mycobacterium bovis subsp bovis AF2122/97
ccaccgugucacgcgaccaccgc

SEQ ID NO: 3045204 - RNA, 19 nt, Mycobacterium bovis subsp bovis AF2122/97
ccaccgugugcacgcgaug

SEQ ID NO: 3045205 - RNA, 15 nt, Mycobacterium bovis subsp bovis AF2122/97
ccaccguuaccgccg

SEQ ID NO: 3045206 - RNA, 16 nt, Mycobacterium bovis subsp bovis AF2122/97
ccaccguuaccgccgu

SEQ ID NO: 3045207 - RNA, 20 nt, Mycobacterium bovis subsp bovis AF2122/97
ccaccguugccgaaccacgc

SEQ ID NO: 3045208 - RNA, 16 nt, Mycobacterium bovis subsp bovis AF2122/97
ccaccguugggccgac

SEQ ID NO: 3045209 - RNA, 18 nt, Mycobacterium bovis subsp bovis AF2122/97
ccaccguuugagcggcca

SEQ ID NO: 3045210 - RNA, 22 nt, Mycobacterium bovis subsp bovis AF2122/97
ccaccguuugagcggccaccgu

SEQ ID NO: 3045211 - RNA, 16 nt, Mycobacterium bovis subsp bovis AF2122/97
ccaccucccacgccgc

SEQ ID NO: 3045212 - RNA, 12 nt, Mycobacterium bovis subsp bovis AF2122/97
ccaccucccagg

SEQ ID NO: 3045213 - RNA, 15 nt, Mycobacterium bovis subsp bovis AF2122/97
ccaccuccgaggccg

SEQ ID NO: 3045214 - RNA, 15 nt, Mycobacterium bovis subsp bovis AF2122/97
ccaccuccugguuga

SEQ ID NO: 3045215 - RNA, 22 nt, Mycobacterium bovis subsp bovis AF2122/97
ccaccuccugguugaccucggu

SEQ ID NO: 3045216 - RNA, 18 nt, Mycobacterium bovis subsp bovis AF2122/97
ccaccucgacgagcacca

SEQ ID NO: 3045217 - RNA, 13 nt, Mycobacterium bovis subsp bovis AF2122/97
ccaccucgacgca

SEQ ID NO: 3045218 - RNA, 16 nt, Mycobacterium bovis subsp bovis AF2122/97
ccaccucgccggccgu

SEQ ID NO: 3045219 - RNA, 15 nt, Mycobacterium bovis subsp bovis AF2122/97
ccacgcccgacgcca

SEQ ID NO: 3045220 - RNA, 12 nt, Mycobacterium bovis subsp bovis AF2122/97
ccacgcccggcc

SEQ ID NO: 3045221 - RNA, 21 nt, Mycobacterium bovis subsp bovis AF2122/97
ccacgcccggccccgcggcca

SEQ ID NO: 3045222 - RNA, 15 nt, Mycobacterium bovis subsp bovis AF2122/97
ccacgccgaccaucu

SEQ ID NO: 3045223 - RNA, 19 nt, Mycobacterium bovis subsp bovis AF2122/97
ccacgccgaccaucucacc

SEQ ID NO: 3045224 - RNA, 14 nt, Mycobacterium bovis subsp bovis AF2122/97
ccacgccgacggca

SEQ ID NO: 3045225 - RNA, 18 nt, Mycobacterium bovis subsp bovis AF2122/97
ccacgccgacggcaccga

SEQ ID NO: 3045226 - RNA, 18 nt, Mycobacterium bovis subsp bovis AF2122/97
ccacgccgaggcguucga

SEQ ID NO: 3045227 - RNA, 14 nt, Mycobacterium bovis subsp bovis AF2122/97
ccacgccgaucaac

SEQ ID NO: 3045228 - RNA, 22 nt, Mycobacterium bovis subsp bovis AF2122/97
ccacgccgaucaacaugccggu

SEQ ID NO: 3045229 - RNA, 15 nt, Mycobacterium bovis subsp bovis AF2122/97
ccacgccgaugcggu

SEQ ID NO: 3045230 - RNA, 14 nt, Mycobacterium bovis subsp bovis AF2122/97
ccacgccgauggga

SEQ ID NO: 3045231 - RNA, 11 nt, Mycobacterium bovis subsp bovis AF2122/97
ccacgccgccg

SEQ ID NO: 3045232 - RNA, 15 nt, Mycobacterium bovis subsp bovis AF2122/97
ccacgccgccggcgc

SEQ ID NO: 3045233 - RNA, 16 nt, Mycobacterium bovis subsp bovis AF2122/97
ccacgccgccggcgcu

SEQ ID NO: 3045234 - RNA, 13 nt, Mycobacterium bovis subsp bovis AF2122/97
ccacgccgccggu

SEQ ID NO: 3045235 - RNA, 14 nt, Mycobacterium bovis subsp bovis AF2122/97
ccacgccgccggug

SEQ ID NO: 3045236 - RNA, 12 nt, Mycobacterium bovis subsp bovis AF2122/97
ccacgccggcau

SEQ ID NO: 3045237 - RNA, 16 nt, Mycobacterium bovis subsp bovis AF2122/97
ccacgccggcaucguc

SEQ ID NO: 3045238 - RNA, 18 nt, Mycobacterium bovis subsp bovis AF2122/97
ccacgccggcaucgucga

SEQ ID NO: 3045239 - RNA, 20 nt, Mycobacterium bovis subsp bovis AF2122/97
ccacgccgggcaaggccacc

SEQ ID NO: 3045240 - RNA, 12 nt, Mycobacterium bovis subsp bovis AF2122/97
ccacgccgguga

SEQ ID NO: 3045241 - RNA, 21 nt, Mycobacterium bovis subsp bovis AF2122/97
ccacgccgguggcacggcccc

SEQ ID NO: 3045242 - RNA, 16 nt, Mycobacterium bovis subsp bovis AF2122/97
ccacgccguagcgcag

SEQ ID NO: 3045243 - RNA, 20 nt, Mycobacterium bovis subsp bovis AF2122/97
ccacgccguagcgcagcgcc

SEQ ID NO: 3045244 - RNA, 14 nt, Mycobacterium bovis subsp bovis AF2122/97
ccacgccgucgaca

SEQ ID NO: 3045245 - RNA, 16 nt, Mycobacterium bovis subsp bovis AF2122/97
ccacgccguggagauc

SEQ ID NO: 3045246 - RNA, 16 nt, Mycobacterium bovis subsp bovis AF2122/97
ccacgccguggcccgc

SEQ ID NO: 3045247 - RNA, 17 nt, Mycobacterium bovis subsp bovis AF2122/97
ccacgccguggcccgcu

SEQ ID NO: 3045248 - RNA, 19 nt, Mycobacterium bovis subsp bovis AF2122/97
ccacgccugagccaccaac

SEQ ID NO: 3045249 - RNA, 13 nt, Mycobacterium bovis subsp bovis AF2122/97
ccacgccugccga

SEQ ID NO: 3045250 - RNA, 22 nt, Mycobacterium bovis subsp bovis AF2122/97
ccacgcgcccgcaccaccggcc

SEQ ID NO: 3045251 - RNA, 15 nt, Mycobacterium bovis subsp bovis AF2122/97
ccacgcgccgcacau

SEQ ID NO: 3045252 - RNA, 18 nt, Mycobacterium bovis subsp bovis AF2122/97
ccacgcgcucggugccgc

SEQ ID NO: 3045253 - RNA, 22 nt, Mycobacterium bovis subsp bovis AF2122/97
ccacgcggauaucuugcgcaug

SEQ ID NO: 3045254 - RNA, 21 nt, Mycobacterium bovis subsp bovis AF2122/97
ccacgcggcggucguugccga

SEQ ID NO: 3045255 - RNA, 16 nt, Mycobacterium bovis subsp bovis AF2122/97
ccacgcguagcggucc

SEQ ID NO: 3045256 - RNA, 20 nt, Mycobacterium bovis subsp bovis AF2122/97
ccacgcgucgcuguuggcga

SEQ ID NO: 3045257 - RNA, 14 nt, Mycobacterium bovis subsp bovis AF2122/97
ccacgcguugacga

SEQ ID NO: 3045258 - RNA, 23 nt, Mycobacterium bovis subsp bovis AF2122/97
ccacgcguugacgaucuccgcca

SEQ ID NO: 3045259 - RNA, 21 nt, Mycobacterium bovis subsp bovis AF2122/97
ccacgcguuucgaaccgcacg

SEQ ID NO: 3045260 - RNA, 16 nt, Mycobacterium bovis subsp bovis AF2122/97
ccacgcucaacccgug

SEQ ID NO: 3045261 - RNA, 16 nt, Mycobacterium bovis subsp bovis AF2122/97
ccacgcuccccagcga

SEQ ID NO: 3045262 - RNA, 18 nt, Mycobacterium bovis subsp bovis AF2122/97
ccacgcucggugcugcgc

SEQ ID NO: 3045263 - RNA, 15 nt, Mycobacterium bovis subsp bovis AF2122/97
ccacgcugaccaacg

SEQ ID NO: 3045264 - RNA, 21 nt, Mycobacterium bovis subsp bovis AF2122/97
ccacgcugcccacgggccggc

SEQ ID NO: 3045265 - RNA, 14 nt, Mycobacterium bovis subsp bovis AF2122/97
ccacgcugccgcag

SEQ ID NO: 3045266 - RNA, 20 nt, Mycobacterium bovis subsp bovis AF2122/97
ccacgcugccgcaguucauc

SEQ ID NO: 3045267 - RNA, 15 nt, Mycobacterium bovis subsp bovis AF2122/97
ccacgcuggcgcccc

SEQ ID NO: 3045268 - RNA, 22 nt, Mycobacterium bovis subsp bovis AF2122/97
ccacgcugucccgcgggccagc

SEQ ID NO: 3045269 - RNA, 18 nt, Mycobacterium bovis subsp bovis AF2122/97
ccacgcuuaacagcgggu

SEQ ID NO: 3045270 - RNA, 20 nt, Mycobacterium bovis subsp bovis AF2122/97
ccacgcuuaacagcgggucc

SEQ ID NO: 3045271 - RNA, 18 nt, Mycobacterium bovis subsp bovis AF2122/97
ccacgcuucuuccgcgcg

SEQ ID NO: 3045272 - RNA, 19 nt, Mycobacterium bovis subsp bovis AF2122/97
ccacgcuucuuccgcgcgc

SEQ ID NO: 3045273 - RNA, 21 nt, Mycobacterium bovis subsp bovis AF2122/97
ccacggaaguaucgccggccg

SEQ ID NO: 3045274 - RNA, 21 nt, Mycobacterium bovis subsp bovis AF2122/97
ccacggacgugacgucguggc

SEQ ID NO: 3045275 - RNA, 17 nt, Mycobacterium bovis subsp bovis AF2122/97
ccacggagaccggccgg

SEQ ID NO: 3045276 - RNA, 16 nt, Mycobacterium bovis subsp bovis AF2122/97
ccacggaucgcggcgg

SEQ ID NO: 3045277 - RNA, 17 nt, Mycobacterium bovis subsp bovis AF2122/97
ccacggcaaaggcgcuc

SEQ ID NO: 3045278 - RNA, 22 nt, Mycobacterium bovis subsp bovis AF2122/97
ccacggcaaaggcgcucugcug

SEQ ID NO: 3045279 - RNA, 13 nt, Mycobacterium bovis subsp bovis AF2122/97
ccacggcaagcca

SEQ ID NO: 3045280 - RNA, 18 nt, Mycobacterium bovis subsp bovis AF2122/97
ccacggcaaucaacgcaa

SEQ ID NO: 3045281 - RNA, 21 nt, Mycobacterium bovis subsp bovis AF2122/97
ccacggcacuggguccacgcg

SEQ ID NO: 3045282 - RNA, 12 nt, Mycobacterium bovis subsp bovis AF2122/97
ccacggcagcca

SEQ ID NO: 3045283 - RNA, 18 nt, Mycobacterium bovis subsp bovis AF2122/97
ccacggcagccaaccggc

SEQ ID NO: 3045284 - RNA, 20 nt, Mycobacterium bovis subsp bovis AF2122/97
ccacggcagccaaccggcgc

SEQ ID NO: 3045285 - RNA, 23 nt, Mycobacterium bovis subsp bovis AF2122/97
ccacggcagccaaccggcgcagu

SEQ ID NO: 3045286 - RNA, 14 nt, Mycobacterium bovis subsp bovis AF2122/97
ccacggcagcgccg

SEQ ID NO: 3045287 - RNA, 23 nt, Mycobacterium bovis subsp bovis AF2122/97
ccacggcaggcagggcagcccgg

SEQ ID NO: 3045288 - RNA, 16 nt, Mycobacterium bovis subsp bovis AF2122/97
ccacggcauucgaccu

SEQ ID NO: 3045289 - RNA, 20 nt, Mycobacterium bovis subsp bovis AF2122/97
ccacggccagaaacccggcg

SEQ ID NO: 3045290 - RNA, 14 nt, Mycobacterium bovis subsp bovis AF2122/97
ccacggccagcggg

SEQ ID NO: 3045291 - RNA, 20 nt, Mycobacterium bovis subsp bovis AF2122/97
ccacggccaggucgacgggc

SEQ ID NO: 3045292 - RNA, 15 nt, Mycobacterium bovis subsp bovis AF2122/97
ccacggcgaccacgc

SEQ ID NO: 3045293 - RNA, 18 nt, Mycobacterium bovis subsp bovis AF2122/97
ccacggcgaccacgccgc

SEQ ID NO: 3045294 - RNA, 19 nt, Mycobacterium bovis subsp bovis AF2122/97
ccacggcgaccaggagccu

SEQ ID NO: 3045295 - RNA, 19 nt, Mycobacterium bovis subsp bovis AF2122/97
ccacggcgauccggucggc

SEQ ID NO: 3045296 - RNA, 15 nt, Mycobacterium bovis subsp bovis AF2122/97
ccacggcgaugcagc

SEQ ID NO: 3045297 - RNA, 17 nt, Mycobacterium bovis subsp bovis AF2122/97
ccacggcgaugcagcca

SEQ ID NO: 3045298 - RNA, 20 nt, Mycobacterium bovis subsp bovis AF2122/97
ccacggcgaugcagccacau

SEQ ID NO: 3045299 - RNA, 13 nt, Mycobacterium bovis subsp bovis AF2122/97
ccacggcgcagua

SEQ ID NO: 3045300 - RNA, 21 nt, Mycobacterium bovis subsp bovis AF2122/97
ccacggcgccuacaccggcgc

SEQ ID NO: 3045301 - RNA, 17 nt, Mycobacterium bovis subsp bovis AF2122/97
ccacggcgcgcgcgccg

SEQ ID NO: 3045302 - RNA, 23 nt, Mycobacterium bovis subsp bovis AF2122/97
ccacggcgcgcgcgccggcugcc

SEQ ID NO: 3045303 - RNA, 15 nt, Mycobacterium bovis subsp bovis AF2122/97
ccacggcgcguagug

SEQ ID NO: 3045304 - RNA, 20 nt, Mycobacterium bovis subsp bovis AF2122/97
ccacggcggcaucaccuggc

SEQ ID NO: 3045305 - RNA, 14 nt, Mycobacterium bovis subsp bovis AF2122/97
ccacggcggccacc

SEQ ID NO: 3045306 - RNA, 14 nt, Mycobacterium bovis subsp bovis AF2122/97
ccacgucucgauca

SEQ ID NO: 3045307 - RNA, 17 nt, Mycobacterium bovis subsp bovis AF2122/97
ccacgucucgcgaggug

SEQ ID NO: 3045308 - RNA, 15 nt, Mycobacterium bovis subsp bovis AF2122/97
ccacguggggccggg

SEQ ID NO: 3045309 - RNA, 17 nt, Mycobacterium bovis subsp bovis AF2122/97
ccacguucgcgggcguc

SEQ ID NO: 3045310 - RNA, 21 nt, Mycobacterium bovis subsp bovis AF2122/97
ccacguugaugaugccggcgu

SEQ ID NO: 3045311 - RNA, 14 nt, Mycobacterium bovis subsp bovis AF2122/97
ccacguugcgcaua

SEQ ID NO: 3045312 - RNA, 16 nt, Mycobacterium bovis subsp bovis AF2122/97
ccacguugcugaugcc

SEQ ID NO: 3045313 - RNA, 18 nt, Mycobacterium bovis subsp bovis AF2122/97
ccacguuguccgcgacgu

SEQ ID NO: 3045314 - RNA, 18 nt, Mycobacterium bovis subsp bovis AF2122/97
ccacguugugcagcgcgu

SEQ ID NO: 3045315 - RNA, 15 nt, Mycobacterium bovis subsp bovis AF2122/97
ccacuacaucgauca

SEQ ID NO: 3045316 - RNA, 12 nt, Mycobacterium bovis subsp bovis AF2122/97
ccacuacggccu

SEQ ID NO: 3045317 - RNA, 21 nt, Mycobacterium bovis subsp bovis AF2122/97
ccacuagcuucgcuugccgau

SEQ ID NO: 3045318 - RNA, 22 nt, Mycobacterium bovis subsp bovis AF2122/97
ccacuagcuucgcuugccgaua

SEQ ID NO: 3045319 - RNA, 22 nt, Mycobacterium bovis subsp bovis AF2122/97
ccacucaagauaacggcgaccg

SEQ ID NO: 3045320 - RNA, 13 nt, Mycobacterium bovis subsp bovis AF2122/97
ccacucagcccga

SEQ ID NO: 3045321 - RNA, 21 nt, Mycobacterium bovis subsp bovis AF2122/97
ccacucaggaucccgguggca

SEQ ID NO: 3045322 - RNA, 16 nt, Mycobacterium bovis subsp bovis AF2122/97
ccacuccacgcagccc

SEQ ID NO: 3045323 - RNA, 18 nt, Mycobacterium bovis subsp bovis AF2122/97
ccacuccagcagcucgcc

SEQ ID NO: 3045324 - RNA, 21 nt, Mycobacterium bovis subsp bovis AF2122/97
ccacuccagcgaaccgacccg

SEQ ID NO: 3045325 - RNA, 20 nt, Mycobacterium bovis subsp bovis AF2122/97
ccacucccagccaacccguc

SEQ ID NO: 3045326 - RNA, 14 nt, Mycobacterium bovis subsp bovis AF2122/97
ccacucccgccccg

SEQ ID NO: 3045327 - RNA, 17 nt, Mycobacterium bovis subsp bovis AF2122/97
ccacucccgccccgcuc

SEQ ID NO: 3045328 - RNA, 14 nt, Mycobacterium bovis subsp bovis AF2122/97
ccacuccgugcuuc

SEQ ID NO: 3045329 - RNA, 17 nt, Mycobacterium bovis subsp bovis AF2122/97
ccacucgaucaccggca

SEQ ID NO: 3045330 - RNA, 16 nt, Mycobacterium bovis subsp bovis AF2122/97
ccacucgcagcagcau

SEQ ID NO: 3045331 - RNA, 22 nt, Mycobacterium bovis subsp bovis AF2122/97
ccacucgccggcggacgcccgg

SEQ ID NO: 3045332 - RNA, 14 nt, Mycobacterium bovis subsp bovis AF2122/97
ccacucggcccggc

SEQ ID NO: 3045333 - RNA, 17 nt, Mycobacterium bovis subsp bovis AF2122/97
ccacucggcccggcagg

SEQ ID NO: 3045334 - RNA, 21 nt, Mycobacterium bovis subsp bovis AF2122/97
ccacucgggacuucccgcgag

SEQ ID NO: 3045335 - RNA, 20 nt, Mycobacterium bovis subsp bovis AF2122/97
ccacucgucgaacaccgucc

SEQ ID NO: 3045336 - RNA, 17 nt, Mycobacterium bovis subsp bovis AF2122/97
ccacucucgccacgccg

SEQ ID NO: 3045337 - RNA, 19 nt, Mycobacterium bovis subsp bovis AF2122/97
ccacucucgccacgccgug

SEQ ID NO: 3045338 - RNA, 16 nt, Mycobacterium bovis subsp bovis AF2122/97
ccacucuucgggcggc

SEQ ID NO: 3045339 - RNA, 17 nt, Mycobacterium bovis subsp bovis AF2122/97
ccacucuucgggcggcg

SEQ ID NO: 3045340 - RNA, 16 nt, Mycobacterium bovis subsp bovis AF2122/97
ccacugaaccguagcg

SEQ ID NO: 3045341 - RNA, 22 nt, Mycobacterium bovis subsp bovis AF2122/97
ccacugaaccguagcgcccacu

SEQ ID NO: 3045342 - RNA, 14 nt, Mycobacterium bovis subsp bovis AF2122/97
ccacugaccgcgau

SEQ ID NO: 3045343 - RNA, 19 nt, Mycobacterium bovis subsp bovis AF2122/97
ccacugaccgcgaucgccg

SEQ ID NO: 3045344 - RNA, 21 nt, Mycobacterium bovis subsp bovis AF2122/97
ccacugacgucucaucaaacc

SEQ ID NO: 3045345 - RNA, 14 nt, Mycobacterium bovis subsp bovis AF2122/97
ccacugagccacag

SEQ ID NO: 3045346 - RNA, 15 nt, Mycobacterium bovis subsp bovis AF2122/97
ccacugagccacagg

SEQ ID NO: 3045347 - RNA, 16 nt, Mycobacterium bovis subsp bovis AF2122/97
ccacugagucugaugg

SEQ ID NO: 3045348 - RNA, 16 nt, Mycobacterium bovis subsp bovis AF2122/97
ccacugaucaggccga

SEQ ID NO: 3045349 - RNA, 19 nt, Mycobacterium bovis subsp bovis AF2122/97
ccacugaucaggccgauga

SEQ ID NO: 3045350 - RNA, 13 nt, Mycobacterium bovis subsp bovis AF2122/97
ccacugccaccgc

SEQ ID NO: 3045351 - RNA, 15 nt, Mycobacterium bovis subsp bovis AF2122/97
ccacugccaccgcga

SEQ ID NO: 3045352 - RNA, 12 nt, Mycobacterium bovis subsp bovis AF2122/97
ccacugcccgcc

SEQ ID NO: 3045353 - RNA, 13 nt, Mycobacterium bovis subsp bovis AF2122/97
ccacugcccgccg

SEQ ID NO: 3045354 - RNA, 20 nt, Mycobacterium bovis subsp bovis AF2122/97
ccacugcccgccgacgccag

SEQ ID NO: 3045355 - RNA, 19 nt, Mycobacterium bovis subsp bovis AF2122/97
ccacugccgcgcgcccgcc

SEQ ID NO: 3045356 - RNA, 14 nt, Mycobacterium bovis subsp bovis AF2122/97
ccacugccggcagc

SEQ ID NO: 3045357 - RNA, 17 nt, Mycobacterium bovis subsp bovis AF2122/97
ccacugccggcagcgcc

SEQ ID NO: 3045358 - RNA, 20 nt, Mycobacterium bovis subsp bovis AF2122/97
ccacugccgugccggugugu

SEQ ID NO: 3045359 - RNA, 16 nt, Mycobacterium bovis subsp bovis AF2122/97
ccacugccguugccgc

SEQ ID NO: 3045360 - RNA, 16 nt, Mycobacterium bovis subsp bovis AF2122/97
ccacugcgccgugacc

SEQ ID NO: 3045361 - RNA, 13 nt, Mycobacterium bovis subsp bovis AF2122/97
ccacugcgcgucg

SEQ ID NO: 3045362 - RNA, 13 nt, Mycobacterium bovis subsp bovis AF2122/97
ccacugcggcaug

SEQ ID NO: 3045363 - RNA, 17 nt, Mycobacterium bovis subsp bovis AF2122/97
ccacugcggcauggcag

SEQ ID NO: 3045364 - RNA, 20 nt, Mycobacterium bovis subsp bovis AF2122/97
ccacugcguuccaucgccga

SEQ ID NO: 3045365 - RNA, 18 nt, Mycobacterium bovis subsp bovis AF2122/97
ccacugcuuccggaacaa

SEQ ID NO: 3045366 - RNA, 12 nt, Mycobacterium bovis subsp bovis AF2122/97
ccacuggauggc

SEQ ID NO: 3045367 - RNA, 17 nt, Mycobacterium bovis subsp bovis AF2122/97
ccacuggauggcucgcc

SEQ ID NO: 3045368 - RNA, 19 nt, Mycobacterium bovis subsp bovis AF2122/97
ccacuggauggcucgccga

SEQ ID NO: 3045369 - RNA, 12 nt, Mycobacterium bovis subsp bovis AF2122/97
ccacuggcacac

SEQ ID NO: 3045370 - RNA, 21 nt, Mycobacterium bovis subsp bovis AF2122/97
ccacuggcacacggucaccgg

SEQ ID NO: 3045371 - RNA, 21 nt, Mycobacterium bovis subsp bovis AF2122/97
ccacuggcgccggugccgccg

SEQ ID NO: 3045372 - RNA, 14 nt, Mycobacterium bovis subsp bovis AF2122/97
ccacugggccugcc

SEQ ID NO: 3045373 - RNA, 14 nt, Mycobacterium bovis subsp bovis AF2122/97
ccacuggugcagcg

SEQ ID NO: 3045374 - RNA, 18 nt, Mycobacterium bovis subsp bovis AF2122/97
ccacuguagggccgguga

SEQ ID NO: 3045375 - RNA, 15 nt, Mycobacterium bovis subsp bovis AF2122/97
ccacuguuacggcca

SEQ ID NO: 3045376 - RNA, 18 nt, Mycobacterium bovis subsp bovis AF2122/97
ccacuguuggugccgcca

SEQ ID NO: 3045377 - RNA, 19 nt, Mycobacterium bovis subsp bovis AF2122/97
ccacuguuggugccgccac

SEQ ID NO: 3045378 - RNA, 20 nt, Mycobacterium bovis subsp bovis AF2122/97
ccacuucagaucggcgaauc

SEQ ID NO: 3045379 - RNA, 18 nt, Mycobacterium bovis subsp bovis AF2122/97
ccacuucagcacccggcu

SEQ ID NO: 3045380 - RNA, 18 nt, Mycobacterium bovis subsp bovis AF2122/97
ccacuuccgggcgaccaa

SEQ ID NO: 3045381 - RNA, 17 nt, Mycobacterium bovis subsp bovis AF2122/97
ccacuucggcgccgcgc

SEQ ID NO: 3045382 - RNA, 13 nt, Mycobacterium bovis subsp bovis AF2122/97
ccacuucuucacu

SEQ ID NO: 3045383 - RNA, 14 nt, Mycobacterium bovis subsp bovis AF2122/97
ccacuugaugcucg

SEQ ID NO: 3045384 - RNA, 22 nt, Mycobacterium bovis subsp bovis AF2122/97
ccacuuggggcgccagggucgg

SEQ ID NO: 3045385 - RNA, 15 nt, Mycobacterium bovis subsp bovis AF2122/97
ccacuuggguggcgc

SEQ ID NO: 3045386 - RNA, 17 nt, Mycobacterium bovis subsp bovis AF2122/97
ccacuuucgacccgcgg

SEQ ID NO: 3045387 - RNA, 16 nt, Mycobacterium bovis subsp bovis AF2122/97
ccacuuugcguuccca

SEQ ID NO: 3045388 - RNA, 17 nt, Mycobacterium bovis subsp bovis AF2122/97
ccacuuuucgguggcgg

SEQ ID NO: 3045389 - RNA, 21 nt, Mycobacterium bovis subsp bovis AF2122/97
ccacuuuucgguggcggcagc

SEQ ID NO: 3045390 - RNA, 16 nt, Mycobacterium bovis subsp bovis AF2122/97
ccagaaacccggcgac

SEQ ID NO: 3045391 - RNA, 15 nt, Mycobacterium bovis subsp bovis AF2122/97
ccagaacccggacag

SEQ ID NO: 3045392 - RNA, 12 nt, Mycobacterium bovis subsp bovis AF2122/97
ccagaaccggcu

SEQ ID NO: 3045393 - RNA, 14 nt, Mycobacterium bovis subsp bovis AF2122/97
ccagaugcagcggu

SEQ ID NO: 3045394 - RNA, 14 nt, Mycobacterium bovis subsp bovis AF2122/97
ccagaugcccagca

SEQ ID NO: 3045395 - RNA, 16 nt, Mycobacterium bovis subsp bovis AF2122/97
ccagaugcccagcagg

SEQ ID NO: 3045396 - RNA, 21 nt, Mycobacterium bovis subsp bovis AF2122/97
ccagaugccgguaacgaacag

SEQ ID NO: 3045397 - RNA, 23 nt, Mycobacterium bovis subsp bovis AF2122/97
ccagaugccgguaacgaacagcg

SEQ ID NO: 3045398 - RNA, 17 nt, Mycobacterium bovis subsp bovis AF2122/97
ccagauggcucucggug

SEQ ID NO: 3045399 - RNA, 21 nt, Mycobacterium bovis subsp bovis AF2122/97
ccagauguaccucaucgcaga

SEQ ID NO: 3045400 - RNA, 22 nt, Mycobacterium bovis subsp bovis AF2122/97
ccagauguccgacgcaccaacg

SEQ ID NO: 3045401 - RNA, 18 nt, Mycobacterium bovis subsp bovis AF2122/97
ccagauucgccgcccaga

SEQ ID NO: 3045402 - RNA, 17 nt, Mycobacterium bovis subsp bovis AF2122/97
ccagauuggcgcugccc

SEQ ID NO: 3045403 - RNA, 20 nt, Mycobacterium bovis subsp bovis AF2122/97
ccagauuggcgcugcccgcc

SEQ ID NO: 3045404 - RNA, 15 nt, Mycobacterium bovis subsp bovis AF2122/97
ccagcaaaacccgcu

SEQ ID NO: 3045405 - RNA, 17 nt, Mycobacterium bovis subsp bovis AF2122/97
ccagcaaaggggugugu

SEQ ID NO: 3045406 - RNA, 21 nt, Mycobacterium bovis subsp bovis AF2122/97
ccagcaaaggggugugugcug

SEQ ID NO: 3045407 - RNA, 16 nt, Mycobacterium bovis subsp bovis AF2122/97
ccagcaaaugcggcgc

SEQ ID NO: 3045408 - RNA, 19 nt, Mycobacterium bovis subsp bovis AF2122/97
ccagcaacagcccgaggcc

SEQ ID NO: 3045409 - RNA, 15 nt, Mycobacterium bovis subsp bovis AF2122/97
ccagcaacagcgagc

SEQ ID NO: 3045410 - RNA, 23 nt, Mycobacterium bovis subsp bovis AF2122/97
ccagcaacagcgagcgguugauc

SEQ ID NO: 3045411 - RNA, 18 nt, Mycobacterium bovis subsp bovis AF2122/97
ccagcaacgcgguggacc

SEQ ID NO: 3045412 - RNA, 23 nt, Mycobacterium bovis subsp bovis AF2122/97
ccagcaacuaccuguugacacaa

SEQ ID NO: 3045413 - RNA, 16 nt, Mycobacterium bovis subsp bovis AF2122/97
ccagcaagacgaugac

SEQ ID NO: 3045414 - RNA, 14 nt, Mycobacterium bovis subsp bovis AF2122/97
ccagcaaggccagc

SEQ ID NO: 3045415 - RNA, 16 nt, Mycobacterium bovis subsp bovis AF2122/97
ccagcaaggcccgaaa

SEQ ID NO: 3045416 - RNA, 22 nt, Mycobacterium bovis subsp bovis AF2122/97
ccagcaagucugcccgacugcc

SEQ ID NO: 3045417 - RNA, 22 nt, Mycobacterium bovis subsp bovis AF2122/97
ccagcaagugugagcagaccca

SEQ ID NO: 3045418 - RNA, 19 nt, Mycobacterium bovis subsp bovis AF2122/97
ccagcaaugcccgcaccgc

SEQ ID NO: 3045419 - RNA, 15 nt, Mycobacterium bovis subsp bovis AF2122/97
ccagcaaugccgacu

SEQ ID NO: 3045420 - RNA, 13 nt, Mycobacterium bovis subsp bovis AF2122/97
ccagcacaaccag

SEQ ID NO: 3045421 - RNA, 15 nt, Mycobacterium bovis subsp bovis AF2122/97
ccagcacacccagau

SEQ ID NO: 3045422 - RNA, 14 nt, Mycobacterium bovis subsp bovis AF2122/97
ccagcacacccccg

SEQ ID NO: 3045423 - RNA, 23 nt, Mycobacterium bovis subsp bovis AF2122/97
ccagcacacccccgucugcgugg

SEQ ID NO: 3045424 - RNA, 14 nt, Mycobacterium bovis subsp bovis AF2122/97
ccagcacacccguc

SEQ ID NO: 3045425 - RNA, 16 nt, Mycobacterium bovis subsp bovis AF2122/97
ccagcacaccgcccgc

SEQ ID NO: 3045426 - RNA, 17 nt, Mycobacterium bovis subsp bovis AF2122/97
ccagcacaccgcccgca

SEQ ID NO: 3045427 - RNA, 18 nt, Mycobacterium bovis subsp bovis AF2122/97
ccagcacacgccuaccgc

SEQ ID NO: 3045428 - RNA, 20 nt, Mycobacterium bovis subsp bovis AF2122/97
ccagcacacgccuaccgcga

SEQ ID NO: 3045429 - RNA, 17 nt, Mycobacterium bovis subsp bovis AF2122/97
ccagcacaucggcgagc

SEQ ID NO: 3045430 - RNA, 19 nt, Mycobacterium bovis subsp bovis AF2122/97
ccagcaccacaacgucggc

SEQ ID NO: 3045431 - RNA, 13 nt, Mycobacterium bovis subsp bovis AF2122/97
ccagcaccaccgc

SEQ ID NO: 3045432 - RNA, 14 nt, Mycobacterium bovis subsp bovis AF2122/97
ccagcaccaccgcg

SEQ ID NO: 3045433 - RNA, 15 nt, Mycobacterium bovis subsp bovis AF2122/97
ccagcaccaccgcgg

SEQ ID NO: 3045434 - RNA, 17 nt, Mycobacterium bovis subsp bovis AF2122/97
ccagcaccaccgcggug

SEQ ID NO: 3045435 - RNA, 22 nt, Mycobacterium bovis subsp bovis AF2122/97
ccagcaccaccgcggugugcgu

SEQ ID NO: 3045436 - RNA, 16 nt, Mycobacterium bovis subsp bovis AF2122/97
ccagcaccaccggcuc

SEQ ID NO: 3045437 - RNA, 19 nt, Mycobacterium bovis subsp bovis AF2122/97
ccagcaccacggccagcgg

SEQ ID NO: 3045438 - RNA, 15 nt, Mycobacterium bovis subsp bovis AF2122/97
ccagcaccagcacgg

SEQ ID NO: 3045439 - RNA, 16 nt, Mycobacterium bovis subsp bovis AF2122/97
ccagcaccagcacggc

SEQ ID NO: 3045440 - RNA, 22 nt, Mycobacterium bovis subsp bovis AF2122/97
ccagcaccagcgucgcggccac

SEQ ID NO: 3045441 - RNA, 13 nt, Mycobacterium bovis subsp bovis AF2122/97
ccagcaccagggc

SEQ ID NO: 3045442 - RNA, 18 nt, Mycobacterium bovis subsp bovis AF2122/97
ccagcacccccugcaccg

SEQ ID NO: 3045443 - RNA, 19 nt, Mycobacterium bovis subsp bovis AF2122/97
ccagcacccccugcaccgu

SEQ ID NO: 3045444 - RNA, 13 nt, Mycobacterium bovis subsp bovis AF2122/97
ccagcaccccgag

SEQ ID NO: 3045445 - RNA, 16 nt, Mycobacterium bovis subsp bovis AF2122/97
ccagcaccccgagguc

SEQ ID NO: 3045446 - RNA, 17 nt, Mycobacterium bovis subsp bovis AF2122/97
ccagcaccccgaucugg

SEQ ID NO: 3045447 - RNA, 13 nt, Mycobacterium bovis subsp bovis AF2122/97
ccagcacccgagc

SEQ ID NO: 3045448 - RNA, 16 nt, Mycobacterium bovis subsp bovis AF2122/97
ccagcacccgcagccg

SEQ ID NO: 3045449 - RNA, 13 nt, Mycobacterium bovis subsp bovis AF2122/97
ccagcacccggcu

SEQ ID NO: 3045450 - RNA, 16 nt, Mycobacterium bovis subsp bovis AF2122/97
ccagcacccggcuucg

SEQ ID NO: 3045451 - RNA, 16 nt, Mycobacterium bovis subsp bovis AF2122/97
ccagcacccggucgau

SEQ ID NO: 3045452 - RNA, 14 nt, Mycobacterium bovis subsp bovis AF2122/97
ccagcacccucagg

SEQ ID NO: 3045453 - RNA, 13 nt, Mycobacterium bovis subsp bovis AF2122/97
ccagcaccgccgc

SEQ ID NO: 3045454 - RNA, 15 nt, Mycobacterium bovis subsp bovis AF2122/97
ccagcaccgccgcgc

SEQ ID NO: 3045455 - RNA, 16 nt, Mycobacterium bovis subsp bovis AF2122/97
ccagcaccgccgcgcc

SEQ ID NO: 3045456 - RNA, 17 nt, Mycobacterium bovis subsp bovis AF2122/97
ccagcaccgccgcgccg

SEQ ID NO: 3045457 - RNA, 21 nt, Mycobacterium bovis subsp bovis AF2122/97
ccagcaccgccgcgccggcgg

SEQ ID NO: 3045458 - RNA, 22 nt, Mycobacterium bovis subsp bovis AF2122/97
ccagcaccgccgcgccggcggc

SEQ ID NO: 3045459 - RNA, 16 nt, Mycobacterium bovis subsp bovis AF2122/97
ccagcaccgccgcugc

SEQ ID NO: 3045460 - RNA, 22 nt, Mycobacterium bovis subsp bovis AF2122/97
ccagcaccgggaagucgggguc

SEQ ID NO: 3045461 - RNA, 21 nt, Mycobacterium bovis subsp bovis AF2122/97
ccagcaccuagucgcggccgu

SEQ ID NO: 3045462 - RNA, 17 nt, Mycobacterium bovis subsp bovis AF2122/97
ccagcaccucggccagc

SEQ ID NO: 3045463 - RNA, 23 nt, Mycobacterium bovis subsp bovis AF2122/97
ccagcaccucggccagcuccgcc

SEQ ID NO: 3045464 - RNA, 14 nt, Mycobacterium bovis subsp bovis AF2122/97
ccagcacgacugca

SEQ ID NO: 3045465 - RNA, 13 nt, Mycobacterium bovis subsp bovis AF2122/97
ccagcacgcccgc

SEQ ID NO: 3045466 - RNA, 14 nt, Mycobacterium bovis subsp bovis AF2122/97
ccagcacgcccucg

SEQ ID NO: 3045467 - RNA, 19 nt, Mycobacterium bovis subsp bovis AF2122/97
ccagcacgccgccggccgc

SEQ ID NO: 3045468 - RNA, 13 nt, Mycobacterium bovis subsp bovis AF2122/97
ccagcacgcucgu

SEQ ID NO: 3045469 - RNA, 16 nt, Mycobacterium bovis subsp bovis AF2122/97
ccagcacggcaaccag

SEQ ID NO: 3045470 - RNA, 18 nt, Mycobacterium bovis subsp bovis AF2122/97
ccagcacgguggcuucga

SEQ ID NO: 3045471 - RNA, 13 nt, Mycobacterium bovis subsp bovis AF2122/97
ccagcacgugcca

SEQ ID NO: 3045472 - RNA, 17 nt, Mycobacterium bovis subsp bovis AF2122/97
ccagcacuccaccgcug

SEQ ID NO: 3045473 - RNA, 21 nt, Mycobacterium bovis subsp bovis AF2122/97
ccagcacuccgcgggguugau

SEQ ID NO: 3045474 - RNA, 14 nt, Mycobacterium bovis subsp bovis AF2122/97
ccagcagagcggca

SEQ ID NO: 3045475 - RNA, 14 nt, Mycobacterium bovis subsp bovis AF2122/97
ccagcagaucaggu

SEQ ID NO: 3045476 - RNA, 16 nt, Mycobacterium bovis subsp bovis AF2122/97
ccagcagauccaggcg

SEQ ID NO: 3045477 - RNA, 20 nt, Mycobacterium bovis subsp bovis AF2122/97
ccagcagauccaggcgucgg

SEQ ID NO: 3045478 - RNA, 17 nt, Mycobacterium bovis subsp bovis AF2122/97
ccagcagcaaucagccg

SEQ ID NO: 3045479 - RNA, 10 nt, Mycobacterium bovis subsp bovis AF2122/97
ccagcagcac

SEQ ID NO: 3045480 - RNA, 18 nt, Mycobacterium bovis subsp bovis AF2122/97
ccagccagccugcuggcc

SEQ ID NO: 3045481 - RNA, 13 nt, Mycobacterium bovis subsp bovis AF2122/97
ccagccagcgggc

SEQ ID NO: 3045482 - RNA, 15 nt, Mycobacterium bovis subsp bovis AF2122/97
ccagccagcgggcga

SEQ ID NO: 3045483 - RNA, 13 nt, Mycobacterium bovis subsp bovis AF2122/97
ccagccagcgggu

SEQ ID NO: 3045484 - RNA, 16 nt, Mycobacterium bovis subsp bovis AF2122/97
ccagccaggcgaagua

SEQ ID NO: 3045485 - RNA, 17 nt, Mycobacterium bovis subsp bovis AF2122/97
ccagccaggcgauugcc

SEQ ID NO: 3045486 - RNA, 21 nt, Mycobacterium bovis subsp bovis AF2122/97
ccagccaggugauuaccuggu

SEQ ID NO: 3045487 - RNA, 21 nt, Mycobacterium bovis subsp bovis AF2122/97
ccagccauagugcggcagcgg

SEQ ID NO: 3045488 - RNA, 13 nt, Mycobacterium bovis subsp bovis AF2122/97
ccagccauggcag

SEQ ID NO: 3045489 - RNA, 19 nt, Mycobacterium bovis subsp bovis AF2122/97
ccagcccaacucggccagc

SEQ ID NO: 3045490 - RNA, 14 nt, Mycobacterium bovis subsp bovis AF2122/97
ccagcccaccggcg

SEQ ID NO: 3045491 - RNA, 17 nt, Mycobacterium bovis subsp bovis AF2122/97
ccagcccaccggcgccg

SEQ ID NO: 3045492 - RNA, 18 nt, Mycobacterium bovis subsp bovis AF2122/97
ccagcccaccggcgccgc

SEQ ID NO: 3045493 - RNA, 13 nt, Mycobacterium bovis subsp bovis AF2122/97
ccagcccagcacg

SEQ ID NO: 3045494 - RNA, 14 nt, Mycobacterium bovis subsp bovis AF2122/97
ccagcccaggccuu

SEQ ID NO: 3045495 - RNA, 21 nt, Mycobacterium bovis subsp bovis AF2122/97
ccagcccaugcgccacgccac

SEQ ID NO: 3045496 - RNA, 21 nt, Mycobacterium bovis subsp bovis AF2122/97
ccagcccaugucgagcacgcc

SEQ ID NO: 3045497 - RNA, 13 nt, Mycobacterium bovis subsp bovis AF2122/97
ccagccccccggc

SEQ ID NO: 3045498 - RNA, 19 nt, Mycobacterium bovis subsp bovis AF2122/97
ccagccccccggcgacggc

SEQ ID NO: 3045499 - RNA, 16 nt, Mycobacterium bovis subsp bovis AF2122/97
ccagccccgcgcccac

SEQ ID NO: 3045500 - RNA, 19 nt, Mycobacterium bovis subsp bovis AF2122/97
ccagccccgcgcccacccc

SEQ ID NO: 3045501 - RNA, 17 nt, Mycobacterium bovis subsp bovis AF2122/97
ccagccccgcuggucga

SEQ ID NO: 3045502 - RNA, 19 nt, Mycobacterium bovis subsp bovis AF2122/97
ccagccccgcuggucgacc

SEQ ID NO: 3045503 - RNA, 19 nt, Mycobacterium bovis subsp bovis AF2122/97
ccagcccgacagcagguug

SEQ ID NO: 3045504 - RNA, 14 nt, Mycobacterium bovis subsp bovis AF2122/97
ccagcccgagcaga

SEQ ID NO: 3045505 - RNA, 21 nt, Mycobacterium bovis subsp bovis AF2122/97
ccagcccgaugaucccgccac

SEQ ID NO: 3045506 - RNA, 13 nt, Mycobacterium bovis subsp bovis AF2122/97
ccagcccgcccag

SEQ ID NO: 3045507 - RNA, 12 nt, Mycobacterium bovis subsp bovis AF2122/97
ccagcccgccga

SEQ ID NO: 3045508 - RNA, 13 nt, Mycobacterium bovis subsp bovis AF2122/97
ccagcccggaacc

SEQ ID NO: 3045509 - RNA, 15 nt, Mycobacterium bovis subsp bovis AF2122/97
ccagcccggcccagu

SEQ ID NO: 3045510 - RNA, 13 nt, Mycobacterium bovis subsp bovis AF2122/97
ccagcccggccgg

SEQ ID NO: 3045511 - RNA, 15 nt, Mycobacterium bovis subsp bovis AF2122/97
ccagcccggcgugca

SEQ ID NO: 3045512 - RNA, 21 nt, Mycobacterium bovis subsp bovis AF2122/97
ccagcccggugauggugccau

SEQ ID NO: 3045513 - RNA, 23 nt, Mycobacterium bovis subsp bovis AF2122/97
ccagcccguccaggcgcugcagc

SEQ ID NO: 3045514 - RNA, 15 nt, Mycobacterium bovis subsp bovis AF2122/97
ccagcccguccggcc

SEQ ID NO: 3045515 - RNA, 18 nt, Mycobacterium bovis subsp bovis AF2122/97
ccagcccuguuugacugc

SEQ ID NO: 3045516 - RNA, 14 nt, Mycobacterium bovis subsp bovis AF2122/97
ccagcccuucagcg

SEQ ID NO: 3045517 - RNA, 15 nt, Mycobacterium bovis subsp bovis AF2122/97
ccagcccuuggcgcg

SEQ ID NO: 3045518 - RNA, 20 nt, Mycobacterium bovis subsp bovis AF2122/97
ccagccgaagaaccggucgc

SEQ ID NO: 3045519 - RNA, 24 nt, Mycobacterium bovis subsp bovis AF2122/97
ccagccgaagaaccggucgcagug

SEQ ID NO: 3045520 - RNA, 20 nt, Mycobacterium bovis subsp bovis AF2122/97
ccagccgacaacuguccugc

SEQ ID NO: 3045521 - RNA, 13 nt, Mycobacterium bovis subsp bovis AF2122/97
ccagccgacguac

SEQ ID NO: 3045522 - RNA, 16 nt, Mycobacterium bovis subsp bovis AF2122/97
ccagccgagcggcggc

SEQ ID NO: 3045523 - RNA, 13 nt, Mycobacterium bovis subsp bovis AF2122/97
ccagccgaucauc

SEQ ID NO: 3045524 - RNA, 17 nt, Mycobacterium bovis subsp bovis AF2122/97
ccagccgcaacaccccc

SEQ ID NO: 3045525 - RNA, 13 nt, Mycobacterium bovis subsp bovis AF2122/97
ccagccgcacggu

SEQ ID NO: 3045526 - RNA, 15 nt, Mycobacterium bovis subsp bovis AF2122/97
ccagccgcagcaccu

SEQ ID NO: 3045527 - RNA, 16 nt, Mycobacterium bovis subsp bovis AF2122/97
ccagccgcagcaccuc

SEQ ID NO: 3045528 - RNA, 14 nt, Mycobacterium bovis subsp bovis AF2122/97
ccagccgccccggc

SEQ ID NO: 3045529 - RNA, 15 nt, Mycobacterium bovis subsp bovis AF2122/97
ccagccgccccggcu

SEQ ID NO: 3045530 - RNA, 15 nt, Mycobacterium bovis subsp bovis AF2122/97
ccagccgcccucggg

SEQ ID NO: 3045531 - RNA, 14 nt, Mycobacterium bovis subsp bovis AF2122/97
ccagccgcgagccg

SEQ ID NO: 3045532 - RNA, 16 nt, Mycobacterium bovis subsp bovis AF2122/97
ccagccgcgagccggu

SEQ ID NO: 3045533 - RNA, 17 nt, Mycobacterium bovis subsp bovis AF2122/97
ccagccgcgagccggug

SEQ ID NO: 3045534 - RNA, 14 nt, Mycobacterium bovis subsp bovis AF2122/97
ccagccgcgccagc

SEQ ID NO: 3045535 - RNA, 16 nt, Mycobacterium bovis subsp bovis AF2122/97
ccagccgcgcguccgg

SEQ ID NO: 3045536 - RNA, 16 nt, Mycobacterium bovis subsp bovis AF2122/97
ccagccgcggaucauc

SEQ ID NO: 3045537 - RNA, 22 nt, Mycobacterium bovis subsp bovis AF2122/97
ccagccgcggcccucgaugccg

SEQ ID NO: 3045538 - RNA, 15 nt, Mycobacterium bovis subsp bovis AF2122/97
ccagccgcgggccgc

SEQ ID NO: 3045539 - RNA, 16 nt, Mycobacterium bovis subsp bovis AF2122/97
ccagccgcucacccgg

SEQ ID NO: 3045540 - RNA, 13 nt, Mycobacterium bovis subsp bovis AF2122/97
ccagccggaccgc

SEQ ID NO: 3045541 - RNA, 20 nt, Mycobacterium bovis subsp bovis AF2122/97
ccagccggaccgcgacggcg

SEQ ID NO: 3045542 - RNA, 21 nt, Mycobacterium bovis subsp bovis AF2122/97
ccagccggaccgcgacggcgc

SEQ ID NO: 3045543 - RNA, 13 nt, Mycobacterium bovis subsp bovis AF2122/97
ccagccggcagca

SEQ ID NO: 3045544 - RNA, 15 nt, Mycobacterium bovis subsp bovis AF2122/97
ccagccggcagcagc

SEQ ID NO: 3045545 - RNA, 13 nt, Mycobacterium bovis subsp bovis AF2122/97
ccagccggccuca

SEQ ID NO: 3045546 - RNA, 22 nt, Mycobacterium bovis subsp bovis AF2122/97
ccagccggcgaaugcgguccuc

SEQ ID NO: 3045547 - RNA, 22 nt, Mycobacterium bovis subsp bovis AF2122/97
ccagccggcgagaaacacgaca

SEQ ID NO: 3045548 - RNA, 15 nt, Mycobacterium bovis subsp bovis AF2122/97
ccagccggcgcacuc

SEQ ID NO: 3045549 - RNA, 16 nt, Mycobacterium bovis subsp bovis AF2122/97
ccagccggcgcacucc

SEQ ID NO: 3045550 - RNA, 14 nt, Mycobacterium bovis subsp bovis AF2122/97
ccagccggcgcgcc

SEQ ID NO: 3045551 - RNA, 24 nt, Mycobacterium bovis subsp bovis AF2122/97
ccagccgggagucgucggcauggg

SEQ ID NO: 3045552 - RNA, 17 nt, Mycobacterium bovis subsp bovis AF2122/97
ccagccgggcaaggccc

SEQ ID NO: 3045553 - RNA, 18 nt, Mycobacterium bovis subsp bovis AF2122/97
ccagccgguagccgggca

SEQ ID NO: 3045554 - RNA, 17 nt, Mycobacterium bovis subsp bovis AF2122/97
ccagccgguccagaccc

SEQ ID NO: 3045555 - RNA, 24 nt, Mycobacterium bovis subsp bovis AF2122/97
ccagccgguccagacccagcucgu

SEQ ID NO: 3045556 - RNA, 20 nt, Mycobacterium bovis subsp bovis AF2122/97
ccagccgguccagcagcucg

SEQ ID NO: 3045557 - RNA, 14 nt, Mycobacterium bovis subsp bovis AF2122/97
ccagccggucuugg

SEQ ID NO: 3045558 - RNA, 20 nt, Mycobacterium bovis subsp bovis AF2122/97
ccagccggucuuggacagca

SEQ ID NO: 3045559 - RNA, 11 nt, Mycobacterium bovis subsp bovis AF2122/97
ccagccgguga

SEQ ID NO: 3045560 - RNA, 20 nt, Mycobacterium bovis subsp bovis AF2122/97
ccagccggugagcgagcgcg

SEQ ID NO: 3045561 - RNA, 14 nt, Mycobacterium bovis subsp bovis AF2122/97
ccagccggugccgc

SEQ ID NO: 3045562 - RNA, 20 nt, Mycobacterium bovis subsp bovis AF2122/97
ccagccgguuggcugccggc

SEQ ID NO: 3045563 - RNA, 14 nt, Mycobacterium bovis subsp bovis AF2122/97
ccagccgucggcgc

SEQ ID NO: 3045564 - RNA, 23 nt, Mycobacterium bovis subsp bovis AF2122/97
ccagccgucggcgcugcgcgcga

SEQ ID NO: 3045565 - RNA, 20 nt, Mycobacterium bovis subsp bovis AF2122/97
ccagccgucgucagguggcc

SEQ ID NO: 3045566 - RNA, 22 nt, Mycobacterium bovis subsp bovis AF2122/97
ccagccgucgucagguggccaa

SEQ ID NO: 3045567 - RNA, 12 nt, Mycobacterium bovis subsp bovis AF2122/97
ccagcgccuuga

SEQ ID NO: 3045568 - RNA, 18 nt, Mycobacterium bovis subsp bovis AF2122/97
ccagcgccuugaccagca

SEQ ID NO: 3045569 - RNA, 15 nt, Mycobacterium bovis subsp bovis AF2122/97
ccagcgccuugacgc

SEQ ID NO: 3045570 - RNA, 20 nt, Mycobacterium bovis subsp bovis AF2122/97
ccagcgcgacguccaccagc

SEQ ID NO: 3045571 - RNA, 13 nt, Mycobacterium bovis subsp bovis AF2122/97
ccagcgcgagccc

SEQ ID NO: 3045572 - RNA, 18 nt, Mycobacterium bovis subsp bovis AF2122/97
ccagcgcgccacccagca

SEQ ID NO: 3045573 - RNA, 22 nt, Mycobacterium bovis subsp bovis AF2122/97
ccagcgcgcccgcggccgccag

SEQ ID NO: 3045574 - RNA, 22 nt, Mycobacterium bovis subsp bovis AF2122/97
ccagcgcgccgaucacgguggg

SEQ ID NO: 3045575 - RNA, 14 nt, Mycobacterium bovis subsp bovis AF2122/97
ccagcgcgcgccgc

SEQ ID NO: 3045576 - RNA, 17 nt, Mycobacterium bovis subsp bovis AF2122/97
ccagcgcgcgcgggugc

SEQ ID NO: 3045577 - RNA, 14 nt, Mycobacterium bovis subsp bovis AF2122/97
ccagcgcgcuggga

SEQ ID NO: 3045578 - RNA, 22 nt, Mycobacterium bovis subsp bovis AF2122/97
ccagcgcggccauuagcagcac

SEQ ID NO: 3045579 - RNA, 12 nt, Mycobacterium bovis subsp bovis AF2122/97
ccagcgcggcga

SEQ ID NO: 3045580 - RNA, 13 nt, Mycobacterium bovis subsp bovis AF2122/97
ccagcgcggcgag

SEQ ID NO: 3045581 - RNA, 23 nt, Mycobacterium bovis subsp bovis AF2122/97
ccagcgcggcgcgcggggccucg

SEQ ID NO: 3045582 - RNA, 20 nt, Mycobacterium bovis subsp bovis AF2122/97
ccagcgcgguguagagcgca

SEQ ID NO: 3045583 - RNA, 22 nt, Mycobacterium bovis subsp bovis AF2122/97
ccagcgcgguguagagcgcacc

SEQ ID NO: 3045584 - RNA, 22 nt, Mycobacterium bovis subsp bovis AF2122/97
ccagcgcguaguccgcauccgc

SEQ ID NO: 3045585 - RNA, 13 nt, Mycobacterium bovis subsp bovis AF2122/97
ccagcgcguggaa

SEQ ID NO: 3045586 - RNA, 21 nt, Mycobacterium bovis subsp bovis AF2122/97
ccagcgcuagccgggcgcgcc

SEQ ID NO: 3045587 - RNA, 16 nt, Mycobacterium bovis subsp bovis AF2122/97
ccagcgcucaccggcg

SEQ ID NO: 3045588 - RNA, 19 nt, Mycobacterium bovis subsp bovis AF2122/97
ccagcgcucaccggcgucg

SEQ ID NO: 3045589 - RNA, 14 nt, Mycobacterium bovis subsp bovis AF2122/97
ccagcgcuccagca

SEQ ID NO: 3045590 - RNA, 22 nt, Mycobacterium bovis subsp bovis AF2122/97
ccagcgcugucguaccgcggau

SEQ ID NO: 3045591 - RNA, 16 nt, Mycobacterium bovis subsp bovis AF2122/97
ccagcgcuucggccug

SEQ ID NO: 3045592 - RNA, 21 nt, Mycobacterium bovis subsp bovis AF2122/97
ccagcgcuucgucggccggca

SEQ ID NO: 3045593 - RNA, 17 nt, Mycobacterium bovis subsp bovis AF2122/97
ccagcggaagcgguuga

SEQ ID NO: 3045594 - RNA, 19 nt, Mycobacterium bovis subsp bovis AF2122/97
ccagcggaagcgguugacc

SEQ ID NO: 3045595 - RNA, 21 nt, Mycobacterium bovis subsp bovis AF2122/97
ccagcggaagcgguugaccca

SEQ ID NO: 3045596 - RNA, 14 nt, Mycobacterium bovis subsp bovis AF2122/97
ccagcggaucgaca

SEQ ID NO: 3045597 - RNA, 18 nt, Mycobacterium bovis subsp bovis AF2122/97
ccagcggcaauggccagc

SEQ ID NO: 3045598 - RNA, 18 nt, Mycobacterium bovis subsp bovis AF2122/97
ccagcggcacacccauca

SEQ ID NO: 3045599 - RNA, 20 nt, Mycobacterium bovis subsp bovis AF2122/97
ccagcggcacacccaucacc

SEQ ID NO: 3045600 - RNA, 14 nt, Mycobacterium bovis subsp bovis AF2122/97
ccagcggcaccgcg

SEQ ID NO: 3045601 - RNA, 15 nt, Mycobacterium bovis subsp bovis AF2122/97
ccagcggcaccgcgc

SEQ ID NO: 3045602 - RNA, 16 nt, Mycobacterium bovis subsp bovis AF2122/97
ccagcggcaccgcgga

SEQ ID NO: 3045603 - RNA, 17 nt, Mycobacterium bovis subsp bovis AF2122/97
ccagcggcaccgcggau

SEQ ID NO: 3045604 - RNA, 18 nt, Mycobacterium bovis subsp bovis AF2122/97
ccagcggcaccgcggcca

SEQ ID NO: 3045605 - RNA, 19 nt, Mycobacterium bovis subsp bovis AF2122/97
ccagcggcauauggauguu

SEQ ID NO: 3045606 - RNA, 12 nt, Mycobacterium bovis subsp bovis AF2122/97
ccagcggccacc

SEQ ID NO: 3045607 - RNA, 14 nt, Mycobacterium bovis subsp bovis AF2122/97
ccagcggccauccg

SEQ ID NO: 3045608 - RNA, 19 nt, Mycobacterium bovis subsp bovis AF2122/97
ccagcggcccgucaccgcg

SEQ ID NO: 3045609 - RNA, 20 nt, Mycobacterium bovis subsp bovis AF2122/97
ccagcggcccgucaccgcgg

SEQ ID NO: 3045610 - RNA, 23 nt, Mycobacterium bovis subsp bovis AF2122/97
ccagcggcccgucaccgcgggca

SEQ ID NO: 3045611 - RNA, 21 nt, Mycobacterium bovis subsp bovis AF2122/97
ccagcggccgaccgcgacccg

SEQ ID NO: 3045612 - RNA, 12 nt, Mycobacterium bovis subsp bovis AF2122/97
ccagcggccgcc

SEQ ID NO: 3045613 - RNA, 14 nt, Mycobacterium bovis subsp bovis AF2122/97
ccagcggccgccgc

SEQ ID NO: 3045614 - RNA, 17 nt, Mycobacterium bovis subsp bovis AF2122/97
ccagcggccgccgcggc

SEQ ID NO: 3045615 - RNA, 23 nt, Mycobacterium bovis subsp bovis AF2122/97
ccagcggcgaaggucuggccugc

SEQ ID NO: 3045616 - RNA, 13 nt, Mycobacterium bovis subsp bovis AF2122/97
ccagcggcgccac

SEQ ID NO: 3045617 - RNA, 17 nt, Mycobacterium bovis subsp bovis AF2122/97
ccagcggcgccacgugg

SEQ ID NO: 3045618 - RNA, 21 nt, Mycobacterium bovis subsp bovis AF2122/97
ccagcggcgccacguggucga

SEQ ID NO: 3045619 - RNA, 12 nt, Mycobacterium bovis subsp bovis AF2122/97
ccagcggcggca

SEQ ID NO: 3045620 - RNA, 22 nt, Mycobacterium bovis subsp bovis AF2122/97
ccagcggcgggggcgucgccgc

SEQ ID NO: 3045621 - RNA, 23 nt, Mycobacterium bovis subsp bovis AF2122/97
ccagcggcggucuuuuugggcuu

SEQ ID NO: 3045622 - RNA, 21 nt, Mycobacterium bovis subsp bovis AF2122/97
ccagcggcugcccaucgguga

SEQ ID NO: 3045623 - RNA, 23 nt, Mycobacterium bovis subsp bovis AF2122/97
ccagcgggcauaacccgcaccgg

SEQ ID NO: 3045624 - RNA, 14 nt, Mycobacterium bovis subsp bovis AF2122/97
ccagcgggcaucgc

SEQ ID NO: 3045625 - RNA, 15 nt, Mycobacterium bovis subsp bovis AF2122/97
ccagcgggcggcccu

SEQ ID NO: 3045626 - RNA, 21 nt, Mycobacterium bovis subsp bovis AF2122/97
ccagcggggucuugacggcgc

SEQ ID NO: 3045627 - RNA, 16 nt, Mycobacterium bovis subsp bovis AF2122/97
ccagcgguaaugccag

SEQ ID NO: 3045628 - RNA, 22 nt, Mycobacterium bovis subsp bovis AF2122/97
ccagcgguaaugccagcggcac

SEQ ID NO: 3045629 - RNA, 16 nt, Mycobacterium bovis subsp bovis AF2122/97
ccagcgguagccgagc

SEQ ID NO: 3045630 - RNA, 16 nt, Mycobacterium bovis subsp bovis AF2122/97
ccagcgguagcugccc

SEQ ID NO: 3045631 - RNA, 23 nt, Mycobacterium bovis subsp bovis AF2122/97
ccagcgguaucccccagccgcgg

SEQ ID NO: 3045632 - RNA, 17 nt, Mycobacterium bovis subsp bovis AF2122/97
ccagcggucagccggcc

SEQ ID NO: 3045633 - RNA, 19 nt, Mycobacterium bovis subsp bovis AF2122/97
ccagcggucagccggccau

SEQ ID NO: 3045634 - RNA, 14 nt, Mycobacterium bovis subsp bovis AF2122/97
ccagcggucggcga

SEQ ID NO: 3045635 - RNA, 24 nt, Mycobacterium bovis subsp bovis AF2122/97
ccagcggucggcgaccaccagcgc

SEQ ID NO: 3045636 - RNA, 14 nt, Mycobacterium bovis subsp bovis AF2122/97
ccagcggucggcgg

SEQ ID NO: 3045637 - RNA, 14 nt, Mycobacterium bovis subsp bovis AF2122/97
ccagcgguggacca

SEQ ID NO: 3045638 - RNA, 17 nt, Mycobacterium bovis subsp bovis AF2122/97
ccagcgguucggugauc

SEQ ID NO: 3045639 - RNA, 23 nt, Mycobacterium bovis subsp bovis AF2122/97
ccagcgguugacccucgggucgu

SEQ ID NO: 3045640 - RNA, 20 nt, Mycobacterium bovis subsp bovis AF2122/97
ccagcgguugccgucugcgg

SEQ ID NO: 3045641 - RNA, 17 nt, Mycobacterium bovis subsp bovis AF2122/97
ccagcgguuuccgcacg

SEQ ID NO: 3045642 - RNA, 18 nt, Mycobacterium bovis subsp bovis AF2122/97
ccagcguaaauagcgccc

SEQ ID NO: 3045643 - RNA, 23 nt, Mycobacterium bovis subsp bovis AF2122/97
ccagcguaucggccggcagauug

SEQ ID NO: 3045644 - RNA, 22 nt, Mycobacterium bovis subsp bovis AF2122/97
ccagcgucagcuguuugccggc

SEQ ID NO: 3045645 - RNA, 22 nt, Mycobacterium bovis subsp bovis AF2122/97
ccagcguccaacccaggguggc

SEQ ID NO: 3045646 - RNA, 15 nt, Mycobacterium bovis subsp bovis AF2122/97
ccagcguccagccgc

SEQ ID NO: 3045647 - RNA, 18 nt, Mycobacterium bovis subsp bovis AF2122/97
ccagcguccagccgcccu

SEQ ID NO: 3045648 - RNA, 21 nt, Mycobacterium bovis subsp bovis AF2122/97
ccagcguccagccgcccucgg

SEQ ID NO: 3045649 - RNA, 20 nt, Mycobacterium bovis subsp bovis AF2122/97
ccagcguccauggucgcgcc

SEQ ID NO: 3045650 - RNA, 22 nt, Mycobacterium bovis subsp bovis AF2122/97
ccagcgucccgauguaugacag

SEQ ID NO: 3045651 - RNA, 14 nt, Mycobacterium bovis subsp bovis AF2122/97
ccagcguccuggcg

SEQ ID NO: 3045652 - RNA, 21 nt, Mycobacterium bovis subsp bovis AF2122/97
ccagcguccuggcguagugca

SEQ ID NO: 3045653 - RNA, 17 nt, Mycobacterium bovis subsp bovis AF2122/97
ccagcuuguagcgcucg

SEQ ID NO: 3045654 - RNA, 12 nt, Mycobacterium bovis subsp bovis AF2122/97
ccaggaacccgu

SEQ ID NO: 3045655 - RNA, 15 nt, Mycobacterium bovis subsp bovis AF2122/97
ccaggaacccgugga

SEQ ID NO: 3045656 - RNA, 14 nt, Mycobacterium bovis subsp bovis AF2122/97
ccaggaaccgcagu

SEQ ID NO: 3045657 - RNA, 16 nt, Mycobacterium bovis subsp bovis AF2122/97
ccaggaacgggacgcc

SEQ ID NO: 3045658 - RNA, 17 nt, Mycobacterium bovis subsp bovis AF2122/97
ccaggaacucggcccac

SEQ ID NO: 3045659 - RNA, 22 nt, Mycobacterium bovis subsp bovis AF2122/97
ccaggaagcacaugcucggccu

SEQ ID NO: 3045660 - RNA, 17 nt, Mycobacterium bovis subsp bovis AF2122/97
ccaggaaggcgacgccg

SEQ ID NO: 3045661 - RNA, 20 nt, Mycobacterium bovis subsp bovis AF2122/97
ccaggaaguagaugagcaga

SEQ ID NO: 3045662 - RNA, 13 nt, Mycobacterium bovis subsp bovis AF2122/97
ccaggaagucccg

SEQ ID NO: 3045663 - RNA, 14 nt, Mycobacterium bovis subsp bovis AF2122/97
ccaggaagucccgg

SEQ ID NO: 3045664 - RNA, 21 nt, Mycobacterium bovis subsp bovis AF2122/97
ccaggaaucccucggccgcag

SEQ ID NO: 3045665 - RNA, 23 nt, Mycobacterium bovis subsp bovis AF2122/97
ccaggaaugucuccaguagccgg

SEQ ID NO: 3045666 - RNA, 23 nt, Mycobacterium bovis subsp bovis AF2122/97
ccaggacaccuugcguccguagc

SEQ ID NO: 3045667 - RNA, 18 nt, Mycobacterium bovis subsp bovis AF2122/97
ccaggacagcagccgccg

SEQ ID NO: 3045668 - RNA, 17 nt, Mycobacterium bovis subsp bovis AF2122/97
ccaggacccaucgccag

SEQ ID NO: 3045669 - RNA, 12 nt, Mycobacterium bovis subsp bovis AF2122/97
ccaggaccgcgc

SEQ ID NO: 3045670 - RNA, 15 nt, Mycobacterium bovis subsp bovis AF2122/97
ccaggaccgcgccga

SEQ ID NO: 3045671 - RNA, 18 nt, Mycobacterium bovis subsp bovis AF2122/97
ccaggaccgcgccgauca

SEQ ID NO: 3045672 - RNA, 17 nt, Mycobacterium bovis subsp bovis AF2122/97
ccaggacgacgccgacg

SEQ ID NO: 3045673 - RNA, 21 nt, Mycobacterium bovis subsp bovis AF2122/97
ccaggacggcuaccaccgcac

SEQ ID NO: 3045674 - RNA, 14 nt, Mycobacterium bovis subsp bovis AF2122/97
ccaggacggucgcc

SEQ ID NO: 3045675 - RNA, 19 nt, Mycobacterium bovis subsp bovis AF2122/97
ccaggacgguugguccgcc

SEQ ID NO: 3045676 - RNA, 17 nt, Mycobacterium bovis subsp bovis AF2122/97
ccaggacuccggccgca

SEQ ID NO: 3045677 - RNA, 22 nt, Mycobacterium bovis subsp bovis AF2122/97
ccaggacuccggccgcacgccg

SEQ ID NO: 3045678 - RNA, 17 nt, Mycobacterium bovis subsp bovis AF2122/97
ccaggacuggcaccgcc

SEQ ID NO: 3045679 - RNA, 18 nt, Mycobacterium bovis subsp bovis AF2122/97
ccaggacuggcaccgcca

SEQ ID NO: 3045680 - RNA, 18 nt, Mycobacterium bovis subsp bovis AF2122/97
ccaggagagaucgucgac

SEQ ID NO: 3045681 - RNA, 21 nt, Mycobacterium bovis subsp bovis AF2122/97
ccaggagcaccucgaagugca

SEQ ID NO: 3045682 - RNA, 18 nt, Mycobacterium bovis subsp bovis AF2122/97
ccaggagcauuuggccga

SEQ ID NO: 3045683 - RNA, 14 nt, Mycobacterium bovis subsp bovis AF2122/97
ccaggagccgauca

SEQ ID NO: 3045684 - RNA, 22 nt, Mycobacterium bovis subsp bovis AF2122/97
ccaggagccuccagcgcaccgg

SEQ ID NO: 3045685 - RNA, 17 nt, Mycobacterium bovis subsp bovis AF2122/97
ccaggagcgcggcccgc

SEQ ID NO: 3045686 - RNA, 18 nt, Mycobacterium bovis subsp bovis AF2122/97
ccaggagcgcggcccgcc

SEQ ID NO: 3045687 - RNA, 20 nt, Mycobacterium bovis subsp bovis AF2122/97
ccaggagcgugucggccggc

SEQ ID NO: 3045688 - RNA, 15 nt, Mycobacterium bovis subsp bovis AF2122/97
ccaggagugcgggca

SEQ ID NO: 3045689 - RNA, 20 nt, Mycobacterium bovis subsp bovis AF2122/97
ccaggagugcgggcaugccg

SEQ ID NO: 3045690 - RNA, 15 nt, Mycobacterium bovis subsp bovis AF2122/97
ccaggauaaguccgg

SEQ ID NO: 3045691 - RNA, 17 nt, Mycobacterium bovis subsp bovis AF2122/97
ccaggaucagcccggac

SEQ ID NO: 3045692 - RNA, 23 nt, Mycobacterium bovis subsp bovis AF2122/97
ccaggauccgaccccgcgccgac

SEQ ID NO: 3045693 - RNA, 13 nt, Mycobacterium bovis subsp bovis AF2122/97
ccaggaucgccgc

SEQ ID NO: 3045694 - RNA, 12 nt, Mycobacterium bovis subsp bovis AF2122/97
ccaggaucgcgg

SEQ ID NO: 3045695 - RNA, 15 nt, Mycobacterium bovis subsp bovis AF2122/97
ccaggaucgcggcgc

SEQ ID NO: 3045696 - RNA, 16 nt, Mycobacterium bovis subsp bovis AF2122/97
ccaggaucgcggcgcc

SEQ ID NO: 3045697 - RNA, 18 nt, Mycobacterium bovis subsp bovis AF2122/97
ccaggaucgcguggcgca

SEQ ID NO: 3045698 - RNA, 22 nt, Mycobacterium bovis subsp bovis AF2122/97
ccaggaucgcguggcgcaccac

SEQ ID NO: 3045699 - RNA, 19 nt, Mycobacterium bovis subsp bovis AF2122/97
ccaggaucgcuacgucgac

SEQ ID NO: 3045700 - RNA, 21 nt, Mycobacterium bovis subsp bovis AF2122/97
ccaggaucucuucucggcuac

SEQ ID NO: 3045701 - RNA, 22 nt, Mycobacterium bovis subsp bovis AF2122/97
ccaggaugaauuuggugaagug

SEQ ID NO: 3045702 - RNA, 16 nt, Mycobacterium bovis subsp bovis AF2122/97
ccaggcaaccggucag

SEQ ID NO: 3045703 - RNA, 18 nt, Mycobacterium bovis subsp bovis AF2122/97
ccaggcaaccggucagcc

SEQ ID NO: 3045704 - RNA, 20 nt, Mycobacterium bovis subsp bovis AF2122/97
ccaggcaagccagcacugcc

SEQ ID NO: 3045705 - RNA, 19 nt, Mycobacterium bovis subsp bovis AF2122/97
ccaggcacaacaucgccgc

SEQ ID NO: 3045706 - RNA, 20 nt, Mycobacterium bovis subsp bovis AF2122/97
ccaggcacaacaucgccgca

SEQ ID NO: 3045707 - RNA, 21 nt, Mycobacterium bovis subsp bovis AF2122/97
ccaggcacaacaucgccgcag

SEQ ID NO: 3045708 - RNA, 12 nt, Mycobacterium bovis subsp bovis AF2122/97
ccaggcaccacg

SEQ ID NO: 3045709 - RNA, 15 nt, Mycobacterium bovis subsp bovis AF2122/97
ccaggcaccacgacc

SEQ ID NO: 3045710 - RNA, 17 nt, Mycobacterium bovis subsp bovis AF2122/97
ccaggcaccacgaccga

SEQ ID NO: 3045711 - RNA, 14 nt, Mycobacterium bovis subsp bovis AF2122/97
ccaggcacuccagc

SEQ ID NO: 3045712 - RNA, 17 nt, Mycobacterium bovis subsp bovis AF2122/97
ccaggcacuccagcggc

SEQ ID NO: 3045713 - RNA, 13 nt, Mycobacterium bovis subsp bovis AF2122/97
ccaggcagcuugc

SEQ ID NO: 3045714 - RNA, 14 nt, Mycobacterium bovis subsp bovis AF2122/97
ccaggcauggccug

SEQ ID NO: 3045715 - RNA, 13 nt, Mycobacterium bovis subsp bovis AF2122/97
ccaggccaacggc

SEQ ID NO: 3045716 - RNA, 14 nt, Mycobacterium bovis subsp bovis AF2122/97
ccaggccaacggcg

SEQ ID NO: 3045717 - RNA, 13 nt, Mycobacterium bovis subsp bovis AF2122/97
ccaggccaccggc

SEQ ID NO: 3045718 - RNA, 15 nt, Mycobacterium bovis subsp bovis AF2122/97
ccaggccaccggcug

SEQ ID NO: 3045719 - RNA, 20 nt, Mycobacterium bovis subsp bovis AF2122/97
ccaggccaccggcugcaacc

SEQ ID NO: 3045720 - RNA, 15 nt, Mycobacterium bovis subsp bovis AF2122/97
ccaggccacugccga

SEQ ID NO: 3045721 - RNA, 15 nt, Mycobacterium bovis subsp bovis AF2122/97
ccaggccagggcggu

SEQ ID NO: 3045722 - RNA, 17 nt, Mycobacterium bovis subsp bovis AF2122/97
ccaggccagugccaccu

SEQ ID NO: 3045723 - RNA, 15 nt, Mycobacterium bovis subsp bovis AF2122/97
ccaggcccaagccgu

SEQ ID NO: 3045724 - RNA, 19 nt, Mycobacterium bovis subsp bovis AF2122/97
ccaggcccagccgagcggc

SEQ ID NO: 3045725 - RNA, 23 nt, Mycobacterium bovis subsp bovis AF2122/97
ccaggcccagccgagcggcggca

SEQ ID NO: 3045726 - RNA, 18 nt, Mycobacterium bovis subsp bovis AF2122/97
ccaggcccauacgugccg

SEQ ID NO: 3045727 - RNA, 19 nt, Mycobacterium bovis subsp bovis AF2122/97
ccaggcccauacgugccgc

SEQ ID NO: 3045728 - RNA, 17 nt, Mycobacterium bovis subsp bovis AF2122/97
ccaggcccgacacggcg

SEQ ID NO: 3045729 - RNA, 20 nt, Mycobacterium bovis subsp bovis AF2122/97
ccaggcccgacacggcggcu

SEQ ID NO: 3045730 - RNA, 14 nt, Mycobacterium bovis subsp bovis AF2122/97
ccaggcccggcggu

SEQ ID NO: 3045731 - RNA, 16 nt, Mycobacterium bovis subsp bovis AF2122/97
ccaggcccuggccagc

SEQ ID NO: 3045732 - RNA, 23 nt, Mycobacterium bovis subsp bovis AF2122/97
ccaggcccuggccagcccgagcu

SEQ ID NO: 3045733 - RNA, 15 nt, Mycobacterium bovis subsp bovis AF2122/97
ccaggccgaccgcgc

SEQ ID NO: 3045734 - RNA, 16 nt, Mycobacterium bovis subsp bovis AF2122/97
ccaggccgaccgcgca

SEQ ID NO: 3045735 - RNA, 19 nt, Mycobacterium bovis subsp bovis AF2122/97
ccaggccgagcccggugcu

SEQ ID NO: 3045736 - RNA, 16 nt, Mycobacterium bovis subsp bovis AF2122/97
ccaggccgagccgccc

SEQ ID NO: 3045737 - RNA, 17 nt, Mycobacterium bovis subsp bovis AF2122/97
ccaggccgagcucguug

SEQ ID NO: 3045738 - RNA, 21 nt, Mycobacterium bovis subsp bovis AF2122/97
ccaggccgagcucguugcugg

SEQ ID NO: 3045739 - RNA, 18 nt, Mycobacterium bovis subsp bovis AF2122/97
ccaggccgaucagcgcgg

SEQ ID NO: 3045740 - RNA, 15 nt, Mycobacterium bovis subsp bovis AF2122/97
ccagggcccugcugg

SEQ ID NO: 3045741 - RNA, 11 nt, Mycobacterium bovis subsp bovis AF2122/97
ccagggccgac

SEQ ID NO: 3045742 - RNA, 16 nt, Mycobacterium bovis subsp bovis AF2122/97
ccagggccgagcagcu

SEQ ID NO: 3045743 - RNA, 16 nt, Mycobacterium bovis subsp bovis AF2122/97
ccagggccgaguccga

SEQ ID NO: 3045744 - RNA, 11 nt, Mycobacterium bovis subsp bovis AF2122/97
ccagggccgcc

SEQ ID NO: 3045745 - RNA, 16 nt, Mycobacterium bovis subsp bovis AF2122/97
ccagggccgccgcugc

SEQ ID NO: 3045746 - RNA, 21 nt, Mycobacterium bovis subsp bovis AF2122/97
ccagggccgccgcugccgccu

SEQ ID NO: 3045747 - RNA, 21 nt, Mycobacterium bovis subsp bovis AF2122/97
ccagggccucgaccgccagcc

SEQ ID NO: 3045748 - RNA, 22 nt, Mycobacterium bovis subsp bovis AF2122/97
ccagggccucgaccgccagccg

SEQ ID NO: 3045749 - RNA, 23 nt, Mycobacterium bovis subsp bovis AF2122/97
ccagggccucgaccgccagccgc

SEQ ID NO: 3045750 - RNA, 16 nt, Mycobacterium bovis subsp bovis AF2122/97
ccagggccuuccugag

SEQ ID NO: 3045751 - RNA, 15 nt, Mycobacterium bovis subsp bovis AF2122/97
ccagggccuucgggc

SEQ ID NO: 3045752 - RNA, 22 nt, Mycobacterium bovis subsp bovis AF2122/97
ccagggcgccgaauuggcccgg

SEQ ID NO: 3045753 - RNA, 14 nt, Mycobacterium bovis subsp bovis AF2122/97
ccagggcggcaucc

SEQ ID NO: 3045754 - RNA, 18 nt, Mycobacterium bovis subsp bovis AF2122/97
ccagggcgguggccaccc

SEQ ID NO: 3045755 - RNA, 20 nt, Mycobacterium bovis subsp bovis AF2122/97
ccagggcgguggccacccgg

SEQ ID NO: 3045756 - RNA, 15 nt, Mycobacterium bovis subsp bovis AF2122/97
ccagggcgugcgcga

SEQ ID NO: 3045757 - RNA, 16 nt, Mycobacterium bovis subsp bovis AF2122/97
ccagggcguuggcggc

SEQ ID NO: 3045758 - RNA, 19 nt, Mycobacterium bovis subsp bovis AF2122/97
ccagggcucggcggcccgg

SEQ ID NO: 3045759 - RNA, 15 nt, Mycobacterium bovis subsp bovis AF2122/97
ccaggggaccgcggc

SEQ ID NO: 3045760 - RNA, 17 nt, Mycobacterium bovis subsp bovis AF2122/97
ccaggggaccgcggcgc

SEQ ID NO: 3045761 - RNA, 18 nt, Mycobacterium bovis subsp bovis AF2122/97
ccaggggaccgcggcgcg

SEQ ID NO: 3045762 - RNA, 19 nt, Mycobacterium bovis subsp bovis AF2122/97
ccaggggagcugaccacuu

SEQ ID NO: 3045763 - RNA, 18 nt, Mycobacterium bovis subsp bovis AF2122/97
ccaggggauugccccgca

SEQ ID NO: 3045764 - RNA, 15 nt, Mycobacterium bovis subsp bovis AF2122/97
ccaggggcaccagcg

SEQ ID NO: 3045765 - RNA, 13 nt, Mycobacterium bovis subsp bovis AF2122/97
ccaggggcgcaac

SEQ ID NO: 3045766 - RNA, 16 nt, Mycobacterium bovis subsp bovis AF2122/97
ccagggggcgugccgc

SEQ ID NO: 3045767 - RNA, 17 nt, Mycobacterium bovis subsp bovis AF2122/97
ccagggggcgugccgcc

SEQ ID NO: 3045768 - RNA, 20 nt, Mycobacterium bovis subsp bovis AF2122/97
ccagggggcgugccgccgca

SEQ ID NO: 3045769 - RNA, 21 nt, Mycobacterium bovis subsp bovis AF2122/97
ccaggggucgcugugcagcgg

SEQ ID NO: 3045770 - RNA, 15 nt, Mycobacterium bovis subsp bovis AF2122/97
ccagggucccgccgc

SEQ ID NO: 3045771 - RNA, 15 nt, Mycobacterium bovis subsp bovis AF2122/97
ccagggucgaugucg

SEQ ID NO: 3045772 - RNA, 15 nt, Mycobacterium bovis subsp bovis AF2122/97
ccagggucugcucau

SEQ ID NO: 3045773 - RNA, 16 nt, Mycobacterium bovis subsp bovis AF2122/97
ccagggucugcucauc

SEQ ID NO: 3045774 - RNA, 17 nt, Mycobacterium bovis subsp bovis AF2122/97
ccagggugaccaggccg

SEQ ID NO: 3045775 - RNA, 21 nt, Mycobacterium bovis subsp bovis AF2122/97
ccagggugcccucggccgccu

SEQ ID NO: 3045776 - RNA, 13 nt, Mycobacterium bovis subsp bovis AF2122/97
ccagggugccggc

SEQ ID NO: 3045777 - RNA, 16 nt, Mycobacterium bovis subsp bovis AF2122/97
ccagggugccggcggu

SEQ ID NO: 3045778 - RNA, 17 nt, Mycobacterium bovis subsp bovis AF2122/97
ccaggguggcgacguca

SEQ ID NO: 3045779 - RNA, 17 nt, Mycobacterium bovis subsp bovis AF2122/97
ccaggguguauggccac

SEQ ID NO: 3045780 - RNA, 20 nt, Mycobacterium bovis subsp bovis AF2122/97
ccaggguguauggccaccac

SEQ ID NO: 3045781 - RNA, 16 nt, Mycobacterium bovis subsp bovis AF2122/97
ccaggguguccgucga

SEQ ID NO: 3045782 - RNA, 16 nt, Mycobacterium bovis subsp bovis AF2122/97
ccagggugucugugau

SEQ ID NO: 3045783 - RNA, 20 nt, Mycobacterium bovis subsp bovis AF2122/97
ccaggguuggcaccgucaga

SEQ ID NO: 3045784 - RNA, 23 nt, Mycobacterium bovis subsp bovis AF2122/97
ccaggguuggcaccgucagacca

SEQ ID NO: 3045785 - RNA, 18 nt, Mycobacterium bovis subsp bovis AF2122/97
ccagguaaacggauucga

SEQ ID NO: 3045786 - RNA, 17 nt, Mycobacterium bovis subsp bovis AF2122/97
ccagguaauugccgacc

SEQ ID NO: 3045787 - RNA, 22 nt, Mycobacterium bovis subsp bovis AF2122/97
ccagguaauugccgaccgccug

SEQ ID NO: 3045788 - RNA, 21 nt, Mycobacterium bovis subsp bovis AF2122/97
ccagguacgcgaucagcgcgc

SEQ ID NO: 3045789 - RNA, 14 nt, Mycobacterium bovis subsp bovis AF2122/97
ccagguacucagug

SEQ ID NO: 3045790 - RNA, 15 nt, Mycobacterium bovis subsp bovis AF2122/97
ccagguacucagugu

SEQ ID NO: 3045791 - RNA, 23 nt, Mycobacterium bovis subsp bovis AF2122/97
ccagguacucaguguuccgccac

SEQ ID NO: 3045792 - RNA, 15 nt, Mycobacterium bovis subsp bovis AF2122/97
ccagguagaccaggu

SEQ ID NO: 3045793 - RNA, 15 nt, Mycobacterium bovis subsp bovis AF2122/97
ccagguagucgacca

SEQ ID NO: 3045794 - RNA, 15 nt, Mycobacterium bovis subsp bovis AF2122/97
ccaggucagccgcgc

SEQ ID NO: 3045795 - RNA, 17 nt, Mycobacterium bovis subsp bovis AF2122/97
ccaggucagccgcgcgg

SEQ ID NO: 3045796 - RNA, 18 nt, Mycobacterium bovis subsp bovis AF2122/97
ccaggucauugccggcga

SEQ ID NO: 3045797 - RNA, 23 nt, Mycobacterium bovis subsp bovis AF2122/97
ccaggucauugccggcgacgaua

SEQ ID NO: 3045798 - RNA, 13 nt, Mycobacterium bovis subsp bovis AF2122/97
ccagguccacauc

SEQ ID NO: 3045799 - RNA, 14 nt, Mycobacterium bovis subsp bovis AF2122/97
ccagguccaccccg

SEQ ID NO: 3045800 - RNA, 17 nt, Mycobacterium bovis subsp bovis AF2122/97
ccagguccaccccgccg

SEQ ID NO: 3045801 - RNA, 18 nt, Mycobacterium bovis subsp bovis AF2122/97
ccagguccaccccgccga

SEQ ID NO: 3045802 - RNA, 15 nt, Mycobacterium bovis subsp bovis AF2122/97
ccagguccgccggug

SEQ ID NO: 3045803 - RNA, 21 nt, Mycobacterium bovis subsp bovis AF2122/97
ccagguccgccggugccgccg

SEQ ID NO: 3045804 - RNA, 14 nt, Mycobacterium bovis subsp bovis AF2122/97
ccaggucgacaccg

SEQ ID NO: 3045805 - RNA, 16 nt, Mycobacterium bovis subsp bovis AF2122/97
ccaggucgacaccgcg

SEQ ID NO: 3045806 - RNA, 17 nt, Mycobacterium bovis subsp bovis AF2122/97
ccaggucgacaccgcgg

SEQ ID NO: 3045807 - RNA, 17 nt, Mycobacterium bovis subsp bovis AF2122/97
ccaggucgagcaccggc

SEQ ID NO: 3045808 - RNA, 18 nt, Mycobacterium bovis subsp bovis AF2122/97
ccaggucgagcaccggcu

SEQ ID NO: 3045809 - RNA, 19 nt, Mycobacterium bovis subsp bovis AF2122/97
ccaggucgaggcaggccuc

SEQ ID NO: 3045810 - RNA, 22 nt, Mycobacterium bovis subsp bovis AF2122/97
ccaggucgaggcaggccucggc

SEQ ID NO: 3045811 - RNA, 17 nt, Mycobacterium bovis subsp bovis AF2122/97
ccaggucgaugcgggcg

SEQ ID NO: 3045812 - RNA, 21 nt, Mycobacterium bovis subsp bovis AF2122/97
ccaggucgaugcgggcgacga

SEQ ID NO: 3045813 - RNA, 21 nt, Mycobacterium bovis subsp bovis AF2122/97
ccaggucgcgauagccgccgc

SEQ ID NO: 3045814 - RNA, 23 nt, Mycobacterium bovis subsp bovis AF2122/97
ccaggucgcgauagccgccgcgg

SEQ ID NO: 3045815 - RNA, 13 nt, Mycobacterium bovis subsp bovis AF2122/97
ccaggucggccac

SEQ ID NO: 3045816 - RNA, 14 nt, Mycobacterium bovis subsp bovis AF2122/97
ccaggucggccacc

SEQ ID NO: 3045817 - RNA, 13 nt, Mycobacterium bovis subsp bovis AF2122/97
ccaggucggccgc

SEQ ID NO: 3045818 - RNA, 12 nt, Mycobacterium bovis subsp bovis AF2122/97
ccaggucggcga

SEQ ID NO: 3045819 - RNA, 18 nt, Mycobacterium bovis subsp bovis AF2122/97
ccaggucggcguugaucg

SEQ ID NO: 3045820 - RNA, 14 nt, Mycobacterium bovis subsp bovis AF2122/97
ccaggucggucauc

SEQ ID NO: 3045821 - RNA, 22 nt, Mycobacterium bovis subsp bovis AF2122/97
ccaggucggucauccggauggg

SEQ ID NO: 3045822 - RNA, 17 nt, Mycobacterium bovis subsp bovis AF2122/97
ccaggucggugggcggc

SEQ ID NO: 3045823 - RNA, 19 nt, Mycobacterium bovis subsp bovis AF2122/97
ccaggucggugggcggcga

SEQ ID NO: 3045824 - RNA, 23 nt, Mycobacterium bovis subsp bovis AF2122/97
ccaggucggugugcaucgccggc

SEQ ID NO: 3045825 - RNA, 22 nt, Mycobacterium bovis subsp bovis AF2122/97
ccaggucguaggcgcuaggaac

SEQ ID NO: 3045826 - RNA, 18 nt, Mycobacterium bovis subsp bovis AF2122/97
ccaggucgugcccgggac

SEQ ID NO: 3045827 - RNA, 16 nt, Mycobacterium bovis subsp bovis AF2122/97
ccagugaaucggaccg

SEQ ID NO: 3045828 - RNA, 21 nt, Mycobacterium bovis subsp bovis AF2122/97
ccagugaccgcagucccagca

SEQ ID NO: 3045829 - RNA, 16 nt, Mycobacterium bovis subsp bovis AF2122/97
ccagugacucaccgug

SEQ ID NO: 3045830 - RNA, 18 nt, Mycobacterium bovis subsp bovis AF2122/97
ccagugacucaccgugaa

SEQ ID NO: 3045831 - RNA, 20 nt, Mycobacterium bovis subsp bovis AF2122/97
ccagugagcaugcgacguca

SEQ ID NO: 3045832 - RNA, 19 nt, Mycobacterium bovis subsp bovis AF2122/97
ccagugcacgcucggcgcc

SEQ ID NO: 3045833 - RNA, 17 nt, Mycobacterium bovis subsp bovis AF2122/97
ccagugcaucggucagc

SEQ ID NO: 3045834 - RNA, 22 nt, Mycobacterium bovis subsp bovis AF2122/97
ccagugcaucggucagcgccga

SEQ ID NO: 3045835 - RNA, 15 nt, Mycobacterium bovis subsp bovis AF2122/97
ccagugccaccuggg

SEQ ID NO: 3045836 - RNA, 17 nt, Mycobacterium bovis subsp bovis AF2122/97
ccagugccaccugggcg

SEQ ID NO: 3045837 - RNA, 14 nt, Mycobacterium bovis subsp bovis AF2122/97
ccagugccacgccu

SEQ ID NO: 3045838 - RNA, 17 nt, Mycobacterium bovis subsp bovis AF2122/97
ccagugccagaacccgg

SEQ ID NO: 3045839 - RNA, 19 nt, Mycobacterium bovis subsp bovis AF2122/97
ccagugccagaacccggac

SEQ ID NO: 3045840 - RNA, 18 nt, Mycobacterium bovis subsp bovis AF2122/97
ccagugccccgccgagcg

SEQ ID NO: 3045841 - RNA, 19 nt, Mycobacterium bovis subsp bovis AF2122/97
ccagugcccgcacugccgc

SEQ ID NO: 3045842 - RNA, 17 nt, Mycobacterium bovis subsp bovis AF2122/97
ccagugccgcccaccac

SEQ ID NO: 3045843 - RNA, 23 nt, Mycobacterium bovis subsp bovis AF2122/97
ccagugccgcccaccacacagcc

SEQ ID NO: 3045844 - RNA, 19 nt, Mycobacterium bovis subsp bovis AF2122/97
ccagugcgcaacccagccg

SEQ ID NO: 3045845 - RNA, 21 nt, Mycobacterium bovis subsp bovis AF2122/97
ccagugcgcaacccagccgcg

SEQ ID NO: 3045846 - RNA, 21 nt, Mycobacterium bovis subsp bovis AF2122/97
ccagugcgcagaacaccaccg

SEQ ID NO: 3045847 - RNA, 22 nt, Mycobacterium bovis subsp bovis AF2122/97
ccagugcgcagaacaccaccgc

SEQ ID NO: 3045848 - RNA, 23 nt, Mycobacterium bovis subsp bovis AF2122/97
ccagugcgcagaacaccaccgcc

SEQ ID NO: 3045849 - RNA, 13 nt, Mycobacterium bovis subsp bovis AF2122/97
ccagugcgcagcc

SEQ ID NO: 3045850 - RNA, 20 nt, Mycobacterium bovis subsp bovis AF2122/97
ccagugcgguggccagugcg

SEQ ID NO: 3045851 - RNA, 15 nt, Mycobacterium bovis subsp bovis AF2122/97
ccagugcugcaccga

SEQ ID NO: 3045852 - RNA, 11 nt, Mycobacterium bovis subsp bovis AF2122/97
ccagugcugga

SEQ ID NO: 3045853 - RNA, 21 nt, Mycobacterium bovis subsp bovis AF2122/97
ccaguggcgcccauggccacc

SEQ ID NO: 3045854 - RNA, 21 nt, Mycobacterium bovis subsp bovis AF2122/97
ccagugggaugaccuuggccg

SEQ ID NO: 3045855 - RNA, 24 nt, Mycobacterium bovis subsp bovis AF2122/97
ccagugggaugaccuuggccgugc

SEQ ID NO: 3045856 - RNA, 18 nt, Mycobacterium bovis subsp bovis AF2122/97
ccagugguaggccgccgg

SEQ ID NO: 3045857 - RNA, 14 nt, Mycobacterium bovis subsp bovis AF2122/97
ccaguggugcaccg

SEQ ID NO: 3045858 - RNA, 15 nt, Mycobacterium bovis subsp bovis AF2122/97
ccagugucagcacga

SEQ ID NO: 3045859 - RNA, 18 nt, Mycobacterium bovis subsp bovis AF2122/97
ccaguguggugcggcgcg

SEQ ID NO: 3045860 - RNA, 22 nt, Mycobacterium bovis subsp bovis AF2122/97
ccaguguguccugucgcaccag

SEQ ID NO: 3045861 - RNA, 24 nt, Mycobacterium bovis subsp bovis AF2122/97
ccaguguugcaguggcgacgagca

SEQ ID NO: 3045862 - RNA, 16 nt, Mycobacterium bovis subsp bovis AF2122/97
ccaguguugcgcugcg

SEQ ID NO: 3045863 - RNA, 22 nt, Mycobacterium bovis subsp bovis AF2122/97
ccaguguugcgcugcggccagc

SEQ ID NO: 3045864 - RNA, 17 nt, Mycobacterium bovis subsp bovis AF2122/97
ccaguuccacccggugc

SEQ ID NO: 3045865 - RNA, 21 nt, Mycobacterium bovis subsp bovis AF2122/97
ccaguuccacccggugccgca

SEQ ID NO: 3045866 - RNA, 19 nt, Mycobacterium bovis subsp bovis AF2122/97
ccaguucccuacacccauu

SEQ ID NO: 3045867 - RNA, 19 nt, Mycobacterium bovis subsp bovis AF2122/97
ccaguuccgcugcggugcc

SEQ ID NO: 3045868 - RNA, 16 nt, Mycobacterium bovis subsp bovis AF2122/97
ccaguucgcgccacgc

SEQ ID NO: 3045869 - RNA, 19 nt, Mycobacterium bovis subsp bovis AF2122/97
ccaguucggcggccgccgc

SEQ ID NO: 3045870 - RNA, 16 nt, Mycobacterium bovis subsp bovis AF2122/97
ccaguucggugagccg

SEQ ID NO: 3045871 - RNA, 16 nt, Mycobacterium bovis subsp bovis AF2122/97
ccaguucgugggucaa

SEQ ID NO: 3045872 - RNA, 21 nt, Mycobacterium bovis subsp bovis AF2122/97
ccaguucuaccaccuugccga

SEQ ID NO: 3045873 - RNA, 14 nt, Mycobacterium bovis subsp bovis AF2122/97
ccaguucugcagga

SEQ ID NO: 3045874 - RNA, 21 nt, Mycobacterium bovis subsp bovis AF2122/97
ccauaagcucguagagcaccg

SEQ ID NO: 3045875 - RNA, 17 nt, Mycobacterium bovis subsp bovis AF2122/97
ccauaauauugccgccu

SEQ ID NO: 3045876 - RNA, 17 nt, Mycobacterium bovis subsp bovis AF2122/97
ccauaauucgcccgcuc

SEQ ID NO: 3045877 - RNA, 20 nt, Mycobacterium bovis subsp bovis AF2122/97
ccauaccggcuggccaggug

SEQ ID NO: 3045878 - RNA, 20 nt, Mycobacterium bovis subsp bovis AF2122/97
ccauaccucggcgaccuccg

SEQ ID NO: 3045879 - RNA, 17 nt, Mycobacterium bovis subsp bovis AF2122/97
ccauaccuucggcgauc

SEQ ID NO: 3045880 - RNA, 13 nt, Mycobacterium bovis subsp bovis AF2122/97
ccauacgcaccgg

SEQ ID NO: 3045881 - RNA, 19 nt, Mycobacterium bovis subsp bovis AF2122/97
ccauacggaagggcccggu

SEQ ID NO: 3045882 - RNA, 21 nt, Mycobacterium bovis subsp bovis AF2122/97
ccauacuaauggcgccaccgg

SEQ ID NO: 3045883 - RNA, 15 nt, Mycobacterium bovis subsp bovis AF2122/97
ccauacuggcggucc

SEQ ID NO: 3045884 - RNA, 20 nt, Mycobacterium bovis subsp bovis AF2122/97
ccauagacaucccugacgaa

SEQ ID NO: 3045885 - RNA, 17 nt, Mycobacterium bovis subsp bovis AF2122/97
ccauagacccggcugag

SEQ ID NO: 3045886 - RNA, 12 nt, Mycobacterium bovis subsp bovis AF2122/97
ccauagccaggu

SEQ ID NO: 3045887 - RNA, 14 nt, Mycobacterium bovis subsp bovis AF2122/97
ccauagccugcgcc

SEQ ID NO: 3045888 - RNA, 17 nt, Mycobacterium bovis subsp bovis AF2122/97
ccauagccugcgccgac

SEQ ID NO: 3045889 - RNA, 23 nt, Mycobacterium bovis subsp bovis AF2122/97
ccauagccugcgccgacccgcgc

SEQ ID NO: 3045890 - RNA, 16 nt, Mycobacterium bovis subsp bovis AF2122/97
ccauagcgccgcgccc

SEQ ID NO: 3045891 - RNA, 23 nt, Mycobacterium bovis subsp bovis AF2122/97
ccauagcgccgcgcccaccauga

SEQ ID NO: 3045892 - RNA, 18 nt, Mycobacterium bovis subsp bovis AF2122/97
ccauaggcccacggcagc

SEQ ID NO: 3045893 - RNA, 20 nt, Mycobacterium bovis subsp bovis AF2122/97
ccauaggcccacggcagcgc

SEQ ID NO: 3045894 - RNA, 18 nt, Mycobacterium bovis subsp bovis AF2122/97
ccauagugaggccgacca

SEQ ID NO: 3045895 - RNA, 20 nt, Mycobacterium bovis subsp bovis AF2122/97
ccauagugaggccgaccagc

SEQ ID NO: 3045896 - RNA, 13 nt, Mycobacterium bovis subsp bovis AF2122/97
ccauaucgcccac

SEQ ID NO: 3045897 - RNA, 17 nt, Mycobacterium bovis subsp bovis AF2122/97
ccauaugggggaaagcu

SEQ ID NO: 3045898 - RNA, 23 nt, Mycobacterium bovis subsp bovis AF2122/97
ccaucaacaggccucgaccgcgg

SEQ ID NO: 3045899 - RNA, 18 nt, Mycobacterium bovis subsp bovis AF2122/97
ccaucaacaucggcccgc

SEQ ID NO: 3045900 - RNA, 22 nt, Mycobacterium bovis subsp bovis AF2122/97
ccaucaacauugugcucgccga

SEQ ID NO: 3045901 - RNA, 21 nt, Mycobacterium bovis subsp bovis AF2122/97
ccaucaacgccggcgacggcg

SEQ ID NO: 3045902 - RNA, 16 nt, Mycobacterium bovis subsp bovis AF2122/97
ccaucaacugcaucac

SEQ ID NO: 3045903 - RNA, 23 nt, Mycobacterium bovis subsp bovis AF2122/97
ccaucaacugcaucaccacugga

SEQ ID NO: 3045904 - RNA, 14 nt, Mycobacterium bovis subsp bovis AF2122/97
ccaucaagagcgcg

SEQ ID NO: 3045905 - RNA, 12 nt, Mycobacterium bovis subsp bovis AF2122/97
ccaucaaggcca

SEQ ID NO: 3045906 - RNA, 12 nt, Mycobacterium bovis subsp bovis AF2122/97
ccaucacaccca

SEQ ID NO: 3045907 - RNA, 14 nt, Mycobacterium bovis subsp bovis AF2122/97
ccaucacacccauc

SEQ ID NO: 3045908 - RNA, 15 nt, Mycobacterium bovis subsp bovis AF2122/97
ccaucacacccggua

SEQ ID NO: 3045909 - RNA, 17 nt, Mycobacterium bovis subsp bovis AF2122/97
ccaucacaucggccucu

SEQ ID NO: 3045910 - RNA, 12 nt, Mycobacterium bovis subsp bovis AF2122/97
ccaucaccaccg

SEQ ID NO: 3045911 - RNA, 18 nt, Mycobacterium bovis subsp bovis AF2122/97
ccaucaccacggccgccg

SEQ ID NO: 3045912 - RNA, 23 nt, Mycobacterium bovis subsp bovis AF2122/97
ccaucaccacggccgccgacucc

SEQ ID NO: 3045913 - RNA, 12 nt, Mycobacterium bovis subsp bovis AF2122/97
ccaucgggcgcg

SEQ ID NO: 3045914 - RNA, 12 nt, Mycobacterium bovis subsp bovis AF2122/97
ccaucggggccg

SEQ ID NO: 3045915 - RNA, 20 nt, Mycobacterium bovis subsp bovis AF2122/97
ccaucggggccgucggggag

SEQ ID NO: 3045916 - RNA, 15 nt, Mycobacterium bovis subsp bovis AF2122/97
ccaucgggucacccc

SEQ ID NO: 3045917 - RNA, 17 nt, Mycobacterium bovis subsp bovis AF2122/97
ccaucgggucacccccg

SEQ ID NO: 3045918 - RNA, 22 nt, Mycobacterium bovis subsp bovis AF2122/97
ccaucgguaucgagggcagccg

SEQ ID NO: 3045919 - RNA, 12 nt, Mycobacterium bovis subsp bovis AF2122/97
ccaucggugcgc

SEQ ID NO: 3045920 - RNA, 19 nt, Mycobacterium bovis subsp bovis AF2122/97
ccaucgucgagccgccaga

SEQ ID NO: 3045921 - RNA, 13 nt, Mycobacterium bovis subsp bovis AF2122/97
ccaucgucgcgcc

SEQ ID NO: 3045922 - RNA, 14 nt, Mycobacterium bovis subsp bovis AF2122/97
ccaucgucggcaac

SEQ ID NO: 3045923 - RNA, 16 nt, Mycobacterium bovis subsp bovis AF2122/97
ccaucgugcugaagcu

SEQ ID NO: 3045924 - RNA, 20 nt, Mycobacterium bovis subsp bovis AF2122/97
ccaucguucguugacucugc

SEQ ID NO: 3045925 - RNA, 21 nt, Mycobacterium bovis subsp bovis AF2122/97
ccaucguugccggugccgccg

SEQ ID NO: 3045926 - RNA, 19 nt, Mycobacterium bovis subsp bovis AF2122/97
ccaucguuguugaccacca

SEQ ID NO: 3045927 - RNA, 16 nt, Mycobacterium bovis subsp bovis AF2122/97
ccaucguuucacccgg

SEQ ID NO: 3045928 - RNA, 16 nt, Mycobacterium bovis subsp bovis AF2122/97
ccaucuaccagcucac

SEQ ID NO: 3045929 - RNA, 16 nt, Mycobacterium bovis subsp bovis AF2122/97
ccaucucaccgggccc

SEQ ID NO: 3045930 - RNA, 14 nt, Mycobacterium bovis subsp bovis AF2122/97
ccaucucaugcauc

SEQ ID NO: 3045931 - RNA, 14 nt, Mycobacterium bovis subsp bovis AF2122/97
ccaucuccgccguc

SEQ ID NO: 3045932 - RNA, 16 nt, Mycobacterium bovis subsp bovis AF2122/97
ccaucuccgccgucgc

SEQ ID NO: 3045933 - RNA, 22 nt, Mycobacterium bovis subsp bovis AF2122/97
ccaucuccggugugaucggcgg

SEQ ID NO: 3045934 - RNA, 23 nt, Mycobacterium bovis subsp bovis AF2122/97
ccaucuccgguguguuuggcaug

SEQ ID NO: 3045935 - RNA, 13 nt, Mycobacterium bovis subsp bovis AF2122/97
ccaucucggacca

SEQ ID NO: 3045936 - RNA, 14 nt, Mycobacterium bovis subsp bovis AF2122/97
ccaucucggaccac

SEQ ID NO: 3045937 - RNA, 17 nt, Mycobacterium bovis subsp bovis AF2122/97
ccaucucggaccacauc

SEQ ID NO: 3045938 - RNA, 20 nt, Mycobacterium bovis subsp bovis AF2122/97
ccaucucggaccacaucugg

SEQ ID NO: 3045939 - RNA, 16 nt, Mycobacterium bovis subsp bovis AF2122/97
ccaucucgggcaggcc

SEQ ID NO: 3045940 - RNA, 19 nt, Mycobacterium bovis subsp bovis AF2122/97
ccaucucgggcaggccguc

SEQ ID NO: 3045941 - RNA, 21 nt, Mycobacterium bovis subsp bovis AF2122/97
ccaucugauccggugccgcga

SEQ ID NO: 3045942 - RNA, 20 nt, Mycobacterium bovis subsp bovis AF2122/97
ccaucugaucgggcccgucc

SEQ ID NO: 3045943 - RNA, 14 nt, Mycobacterium bovis subsp bovis AF2122/97
ccaucugcuggcug

SEQ ID NO: 3045944 - RNA, 12 nt, Mycobacterium bovis subsp bovis AF2122/97
ccaucuggcgcg

SEQ ID NO: 3045945 - RNA, 16 nt, Mycobacterium bovis subsp bovis AF2122/97
ccaucuggcgcgccgu

SEQ ID NO: 3045946 - RNA, 21 nt, Mycobacterium bovis subsp bovis AF2122/97
ccaucuucaucgccucgagga

SEQ ID NO: 3045947 - RNA, 14 nt, Mycobacterium bovis subsp bovis AF2122/97
ccaucuucggacgc

SEQ ID NO: 3045948 - RNA, 18 nt, Mycobacterium bovis subsp bovis AF2122/97
ccaucuucggacgccagc

SEQ ID NO: 3045949 - RNA, 13 nt, Mycobacterium bovis subsp bovis AF2122/97
ccaucuugaccaa

SEQ ID NO: 3045950 - RNA, 13 nt, Mycobacterium bovis subsp bovis AF2122/97
ccaugaaggagau

SEQ ID NO: 3045951 - RNA, 21 nt, Mycobacterium bovis subsp bovis AF2122/97
ccaugagguaggucgccgccg

SEQ ID NO: 3045952 - RNA, 17 nt, Mycobacterium bovis subsp bovis AF2122/97
ccaugaucacaccgagc

SEQ ID NO: 3045953 - RNA, 18 nt, Mycobacterium bovis subsp bovis AF2122/97
ccaugaucacaccgagcg

SEQ ID NO: 3045954 - RNA, 15 nt, Mycobacterium bovis subsp bovis AF2122/97
ccaugaucucggcga

SEQ ID NO: 3045955 - RNA, 14 nt, Mycobacterium bovis subsp bovis AF2122/97
ccaugaugaugaca

SEQ ID NO: 3045956 - RNA, 15 nt, Mycobacterium bovis subsp bovis AF2122/97
ccaugauggacagcu

SEQ ID NO: 3045957 - RNA, 12 nt, Mycobacterium bovis subsp bovis AF2122/97
ccaugauggccg

SEQ ID NO: 3045958 - RNA, 14 nt, Mycobacterium bovis subsp bovis AF2122/97
ccaugauggccguc

SEQ ID NO: 3045959 - RNA, 19 nt, Mycobacterium bovis subsp bovis AF2122/97
ccaugauggucacggcguc

SEQ ID NO: 3045960 - RNA, 22 nt, Mycobacterium bovis subsp bovis AF2122/97
ccaugaugugcagcgagucggg

SEQ ID NO: 3045961 - RNA, 20 nt, Mycobacterium bovis subsp bovis AF2122/97
ccaugauugccaggaccgcg

SEQ ID NO: 3045962 - RNA, 21 nt, Mycobacterium bovis subsp bovis AF2122/97
ccaugauugccaggaccgcgc

SEQ ID NO: 3045963 - RNA, 23 nt, Mycobacterium bovis subsp bovis AF2122/97
ccaugauugccaggaccgcgccg

SEQ ID NO: 3045964 - RNA, 16 nt, Mycobacterium bovis subsp bovis AF2122/97
ccaugcaccgaugccg

SEQ ID NO: 3045965 - RNA, 19 nt, Mycobacterium bovis subsp bovis AF2122/97
ccaugcacggccgagcagg

SEQ ID NO: 3045966 - RNA, 16 nt, Mycobacterium bovis subsp bovis AF2122/97
ccaugcagcgcgucgc

SEQ ID NO: 3045967 - RNA, 17 nt, Mycobacterium bovis subsp bovis AF2122/97
ccaugccacaacgccuc

SEQ ID NO: 3045968 - RNA, 18 nt, Mycobacterium bovis subsp bovis AF2122/97
ccaugccacaacgccucg

SEQ ID NO: 3045969 - RNA, 23 nt, Mycobacterium bovis subsp bovis AF2122/97
ccaugccgaauaccgguggcagc

SEQ ID NO: 3045970 - RNA, 16 nt, Mycobacterium bovis subsp bovis AF2122/97
ccaugccgaccggcac

SEQ ID NO: 3045971 - RNA, 19 nt, Mycobacterium bovis subsp bovis AF2122/97
ccaugccgaccggcacccg

SEQ ID NO: 3045972 - RNA, 14 nt, Mycobacterium bovis subsp bovis AF2122/97
ccaugccgaucggc

SEQ ID NO: 3045973 - RNA, 18 nt, Mycobacterium bovis subsp bovis AF2122/97
ccaugccgaucggccugc

SEQ ID NO: 3045974 - RNA, 23 nt, Mycobacterium bovis subsp bovis AF2122/97
ccaugccgaucggccugcagcga

SEQ ID NO: 3045975 - RNA, 15 nt, Mycobacterium bovis subsp bovis AF2122/97
ccaugccgcucggca

SEQ ID NO: 3045976 - RNA, 13 nt, Mycobacterium bovis subsp bovis AF2122/97
ccaugcgaccggc

SEQ ID NO: 3045977 - RNA, 18 nt, Mycobacterium bovis subsp bovis AF2122/97
ccaugcgaccggcaacgc

SEQ ID NO: 3045978 - RNA, 18 nt, Mycobacterium bovis subsp bovis AF2122/97
ccaugcgcaccaguccag

SEQ ID NO: 3045979 - RNA, 12 nt, Mycobacterium bovis subsp bovis AF2122/97
ccaugcgccaac

SEQ ID NO: 3045980 - RNA, 16 nt, Mycobacterium bovis subsp bovis AF2122/97
ccaugcgccaacccgg

SEQ ID NO: 3045981 - RNA, 17 nt, Mycobacterium bovis subsp bovis AF2122/97
ccaugcgccaacccggc

SEQ ID NO: 3045982 - RNA, 18 nt, Mycobacterium bovis subsp bovis AF2122/97
ccaugcgccaacccggcc

SEQ ID NO: 3045983 - RNA, 23 nt, Mycobacterium bovis subsp bovis AF2122/97
ccaugcggaauuugcuugggccc

SEQ ID NO: 3045984 - RNA, 18 nt, Mycobacterium bovis subsp bovis AF2122/97
ccaugcggcaggugccca

SEQ ID NO: 3045985 - RNA, 21 nt, Mycobacterium bovis subsp bovis AF2122/97
ccaugcggguaaaccaggugg

SEQ ID NO: 3045986 - RNA, 20 nt, Mycobacterium bovis subsp bovis AF2122/97
ccaugcgggugucgggcagc

SEQ ID NO: 3045987 - RNA, 22 nt, Mycobacterium bovis subsp bovis AF2122/97
ccaugcgggugucgggcagcaa

SEQ ID NO: 3045988 - RNA, 18 nt, Mycobacterium bovis subsp bovis AF2122/97
ccaugcgguuagcagccg

SEQ ID NO: 3045989 - RNA, 22 nt, Mycobacterium bovis subsp bovis AF2122/97
ccaugcgguuuggaucacccgc

SEQ ID NO: 3045990 - RNA, 14 nt, Mycobacterium bovis subsp bovis AF2122/97
ccaugcuaggacca

SEQ ID NO: 3045991 - RNA, 19 nt, Mycobacterium bovis subsp bovis AF2122/97
ccaugcuaggaccaccagc

SEQ ID NO: 3045992 - RNA, 21 nt, Mycobacterium bovis subsp bovis AF2122/97
ccaugcuaggaccaccagcgc

SEQ ID NO: 3045993 - RNA, 23 nt, Mycobacterium bovis subsp bovis AF2122/97
ccaugcuaggaccaccagcgcuc

SEQ ID NO: 3045994 - RNA, 19 nt, Mycobacterium bovis subsp bovis AF2122/97
ccaugcuccuaucacugga

SEQ ID NO: 3045995 - RNA, 19 nt, Mycobacterium bovis subsp bovis AF2122/97
ccaugcugcccuuguugaa

SEQ ID NO: 3045996 - RNA, 16 nt, Mycobacterium bovis subsp bovis AF2122/97
ccaugcuucggagacc

SEQ ID NO: 3045997 - RNA, 14 nt, Mycobacterium bovis subsp bovis AF2122/97
ccauggcacugccg

SEQ ID NO: 3045998 - RNA, 16 nt, Mycobacterium bovis subsp bovis AF2122/97
ccauggcacugccggc

SEQ ID NO: 3045999 - RNA, 18 nt, Mycobacterium bovis subsp bovis AF2122/97
ccauggcacugccggcac

SEQ ID NO: 3046000 - RNA, 23 nt, Mycobacterium bovis subsp bovis AF2122/97
cccaacccuaaaccagccaccac

SEQ ID NO: 3046001 - RNA, 13 nt, Mycobacterium bovis subsp bovis AF2122/97
cccaaccgaaccg

SEQ ID NO: 3046002 - RNA, 17 nt, Mycobacterium bovis subsp bovis AF2122/97
cccaaccgaaccgcguu

SEQ ID NO: 3046003 - RNA, 13 nt, Mycobacterium bovis subsp bovis AF2122/97
cccaaccgcgcca

SEQ ID NO: 3046004 - RNA, 17 nt, Mycobacterium bovis subsp bovis AF2122/97
cccaaccgcgccaccuc

SEQ ID NO: 3046005 - RNA, 14 nt, Mycobacterium bovis subsp bovis AF2122/97
cccaaccgguggcc

SEQ ID NO: 3046006 - RNA, 15 nt, Mycobacterium bovis subsp bovis AF2122/97
cccaaccgguggccg

SEQ ID NO: 3046007 - RNA, 14 nt, Mycobacterium bovis subsp bovis AF2122/97
cccaacgaccacca

SEQ ID NO: 3046008 - RNA, 20 nt, Mycobacterium bovis subsp bovis AF2122/97
cccaacgacggcaacagcca

SEQ ID NO: 3046009 - RNA, 21 nt, Mycobacterium bovis subsp bovis AF2122/97
cccaacgcgguaaagccccgc

SEQ ID NO: 3046010 - RNA, 23 nt, Mycobacterium bovis subsp bovis AF2122/97
cccaacgcgguaaagccccgcuc

SEQ ID NO: 3046011 - RNA, 23 nt, Mycobacterium bovis subsp bovis AF2122/97
cccaacggugggugggcgccgca

SEQ ID NO: 3046012 - RNA, 19 nt, Mycobacterium bovis subsp bovis AF2122/97
cccaacuccaucagcgcga

SEQ ID NO: 3046013 - RNA, 15 nt, Mycobacterium bovis subsp bovis AF2122/97
cccaacucggccagc

SEQ ID NO: 3046014 - RNA, 19 nt, Mycobacterium bovis subsp bovis AF2122/97
cccaacugcgaaacgccac

SEQ ID NO: 3046015 - RNA, 14 nt, Mycobacterium bovis subsp bovis AF2122/97
cccaagcaguccac

SEQ ID NO: 3046016 - RNA, 15 nt, Mycobacterium bovis subsp bovis AF2122/97
cccaagcccucgacg

SEQ ID NO: 3046017 - RNA, 15 nt, Mycobacterium bovis subsp bovis AF2122/97
cccaagccgccggcg

SEQ ID NO: 3046018 - RNA, 23 nt, Mycobacterium bovis subsp bovis AF2122/97
cccaagccgccggcgccagcgcc

SEQ ID NO: 3046019 - RNA, 18 nt, Mycobacterium bovis subsp bovis AF2122/97
cccaagccugccgaaccc

SEQ ID NO: 3046020 - RNA, 15 nt, Mycobacterium bovis subsp bovis AF2122/97
cccaagcgugcugcc

SEQ ID NO: 3046021 - RNA, 20 nt, Mycobacterium bovis subsp bovis AF2122/97
cccaagcgugcugccgccuu

SEQ ID NO: 3046022 - RNA, 20 nt, Mycobacterium bovis subsp bovis AF2122/97
cccaagcuaccccgacggcg

SEQ ID NO: 3046023 - RNA, 15 nt, Mycobacterium bovis subsp bovis AF2122/97
cccaaggccaggauc

SEQ ID NO: 3046024 - RNA, 15 nt, Mycobacterium bovis subsp bovis AF2122/97
cccaaguccagcagc

SEQ ID NO: 3046025 - RNA, 18 nt, Mycobacterium bovis subsp bovis AF2122/97
cccaaguccagcagcgac

SEQ ID NO: 3046026 - RNA, 19 nt, Mycobacterium bovis subsp bovis AF2122/97
cccaaguccagcagcgacg

SEQ ID NO: 3046027 - RNA, 21 nt, Mycobacterium bovis subsp bovis AF2122/97
cccaaguccagcagcgacgcu

SEQ ID NO: 3046028 - RNA, 19 nt, Mycobacterium bovis subsp bovis AF2122/97
cccaaucagugcagcgugg

SEQ ID NO: 3046029 - RNA, 21 nt, Mycobacterium bovis subsp bovis AF2122/97
cccaauccaccgauucggcga

SEQ ID NO: 3046030 - RNA, 22 nt, Mycobacterium bovis subsp bovis AF2122/97
cccaauccaccgauucggcgac

SEQ ID NO: 3046031 - RNA, 22 nt, Mycobacterium bovis subsp bovis AF2122/97
cccaauccgcaacagcucggcc

SEQ ID NO: 3046032 - RNA, 14 nt, Mycobacterium bovis subsp bovis AF2122/97
cccaaucgaccgcc

SEQ ID NO: 3046033 - RNA, 15 nt, Mycobacterium bovis subsp bovis AF2122/97
cccaaucgaccgccc

SEQ ID NO: 3046034 - RNA, 22 nt, Mycobacterium bovis subsp bovis AF2122/97
cccaaucgggaucgcugccagc

SEQ ID NO: 3046035 - RNA, 17 nt, Mycobacterium bovis subsp bovis AF2122/97
cccaaucgucggccagc

SEQ ID NO: 3046036 - RNA, 19 nt, Mycobacterium bovis subsp bovis AF2122/97
cccaaugccaccgcggccg

SEQ ID NO: 3046037 - RNA, 13 nt, Mycobacterium bovis subsp bovis AF2122/97
cccaaugcgggcu

SEQ ID NO: 3046038 - RNA, 15 nt, Mycobacterium bovis subsp bovis AF2122/97
cccaauguccaggcg

SEQ ID NO: 3046039 - RNA, 14 nt, Mycobacterium bovis subsp bovis AF2122/97
cccacaacucggca

SEQ ID NO: 3046040 - RNA, 21 nt, Mycobacterium bovis subsp bovis AF2122/97
cccacaagcgauggcaccacu

SEQ ID NO: 3046041 - RNA, 21 nt, Mycobacterium bovis subsp bovis AF2122/97
cccacaaucagcccgacaccg

SEQ ID NO: 3046042 - RNA, 19 nt, Mycobacterium bovis subsp bovis AF2122/97
cccacaaugacucggccgc

SEQ ID NO: 3046043 - RNA, 16 nt, Mycobacterium bovis subsp bovis AF2122/97
cccacacagucggugc

SEQ ID NO: 3046044 - RNA, 15 nt, Mycobacterium bovis subsp bovis AF2122/97
cccacaccagcgcag

SEQ ID NO: 3046045 - RNA, 13 nt, Mycobacterium bovis subsp bovis AF2122/97
cccacacccagcg

SEQ ID NO: 3046046 - RNA, 13 nt, Mycobacterium bovis subsp bovis AF2122/97
cccacacccggga

SEQ ID NO: 3046047 - RNA, 20 nt, Mycobacterium bovis subsp bovis AF2122/97
cccacacccgggacgaaccg

SEQ ID NO: 3046048 - RNA, 12 nt, Mycobacterium bovis subsp bovis AF2122/97
cccacaccuugg

SEQ ID NO: 3046049 - RNA, 21 nt, Mycobacterium bovis subsp bovis AF2122/97
cccacacggucgucgcgagcg

SEQ ID NO: 3046050 - RNA, 13 nt, Mycobacterium bovis subsp bovis AF2122/97
cccacacggugcg

SEQ ID NO: 3046051 - RNA, 14 nt, Mycobacterium bovis subsp bovis AF2122/97
cccacacggugcga

SEQ ID NO: 3046052 - RNA, 12 nt, Mycobacterium bovis subsp bovis AF2122/97
cccacagcagga

SEQ ID NO: 3046053 - RNA, 14 nt, Mycobacterium bovis subsp bovis AF2122/97
cccacagcgugcgg

SEQ ID NO: 3046054 - RNA, 22 nt, Mycobacterium bovis subsp bovis AF2122/97
cccacagcugacgagccggugg

SEQ ID NO: 3046055 - RNA, 15 nt, Mycobacterium bovis subsp bovis AF2122/97
cccacagcuugcccg

SEQ ID NO: 3046056 - RNA, 13 nt, Mycobacterium bovis subsp bovis AF2122/97
cccacaggcggcg

SEQ ID NO: 3046057 - RNA, 17 nt, Mycobacterium bovis subsp bovis AF2122/97
cccacaggggcagcgcg

SEQ ID NO: 3046058 - RNA, 20 nt, Mycobacterium bovis subsp bovis AF2122/97
cccacagguuugcgccgcgc

SEQ ID NO: 3046059 - RNA, 16 nt, Mycobacterium bovis subsp bovis AF2122/97
cccacaguggcucgcg

SEQ ID NO: 3046060 - RNA, 18 nt, Mycobacterium bovis subsp bovis AF2122/97
cccacaguuaucagccgc

SEQ ID NO: 3046061 - RNA, 19 nt, Mycobacterium bovis subsp bovis AF2122/97
cccacaucagccgcaccag

SEQ ID NO: 3046062 - RNA, 22 nt, Mycobacterium bovis subsp bovis AF2122/97
cccacaucagccgcaccagugg

SEQ ID NO: 3046063 - RNA, 17 nt, Mycobacterium bovis subsp bovis AF2122/97
cccacaucaggucggcg

SEQ ID NO: 3046064 - RNA, 15 nt, Mycobacterium bovis subsp bovis AF2122/97
cccacaucgucggcg

SEQ ID NO: 3046065 - RNA, 19 nt, Mycobacterium bovis subsp bovis AF2122/97
cccacaugacgaucgcggc

SEQ ID NO: 3046066 - RNA, 14 nt, Mycobacterium bovis subsp bovis AF2122/97
cccaccacacagcc

SEQ ID NO: 3046067 - RNA, 22 nt, Mycobacterium bovis subsp bovis AF2122/97
cccaccacacagccgcgcugcg

SEQ ID NO: 3046068 - RNA, 14 nt, Mycobacterium bovis subsp bovis AF2122/97
cccaccaccaccgc

SEQ ID NO: 3046069 - RNA, 22 nt, Mycobacterium bovis subsp bovis AF2122/97
cccaccaccaccgccggugccg

SEQ ID NO: 3046070 - RNA, 15 nt, Mycobacterium bovis subsp bovis AF2122/97
cccaccaccgacagc

SEQ ID NO: 3046071 - RNA, 13 nt, Mycobacterium bovis subsp bovis AF2122/97
cccaccagcgcag

SEQ ID NO: 3046072 - RNA, 19 nt, Mycobacterium bovis subsp bovis AF2122/97
cccaccagcggcggcaacg

SEQ ID NO: 3046073 - RNA, 22 nt, Mycobacterium bovis subsp bovis AF2122/97
cccaccagugcaucgaucaccg

SEQ ID NO: 3046074 - RNA, 16 nt, Mycobacterium bovis subsp bovis AF2122/97
cccaccaugugcgaca

SEQ ID NO: 3046075 - RNA, 18 nt, Mycobacterium bovis subsp bovis AF2122/97
cccaccauucgcgggccg

SEQ ID NO: 3046076 - RNA, 22 nt, Mycobacterium bovis subsp bovis AF2122/97
cccaccauucgcgggccgaggc

SEQ ID NO: 3046077 - RNA, 23 nt, Mycobacterium bovis subsp bovis AF2122/97
cccaccauucgcgggccgaggcc

SEQ ID NO: 3046078 - RNA, 13 nt, Mycobacterium bovis subsp bovis AF2122/97
cccacccacgccg

SEQ ID NO: 3046079 - RNA, 22 nt, Mycobacterium bovis subsp bovis AF2122/97
cccacccagcgacucggccagg

SEQ ID NO: 3046080 - RNA, 21 nt, Mycobacterium bovis subsp bovis AF2122/97
cccacccccgguucaccuccc

SEQ ID NO: 3046081 - RNA, 14 nt, Mycobacterium bovis subsp bovis AF2122/97
cccacccgcaccgc

SEQ ID NO: 3046082 - RNA, 15 nt, Mycobacterium bovis subsp bovis AF2122/97
cccacccgcaccgcc

SEQ ID NO: 3046083 - RNA, 13 nt, Mycobacterium bovis subsp bovis AF2122/97
cccacccgccgcc

SEQ ID NO: 3046084 - RNA, 14 nt, Mycobacterium bovis subsp bovis AF2122/97
cccacccgccgccg

SEQ ID NO: 3046085 - RNA, 16 nt, Mycobacterium bovis subsp bovis AF2122/97
cccacccgccgccgcc

SEQ ID NO: 3046086 - RNA, 16 nt, Mycobacterium bovis subsp bovis AF2122/97
cccacccgcggcgccg

SEQ ID NO: 3046087 - RNA, 23 nt, Mycobacterium bovis subsp bovis AF2122/97
cccacugccgugccggugugucc

SEQ ID NO: 3046088 - RNA, 18 nt, Mycobacterium bovis subsp bovis AF2122/97
cccacuggcacacgguca

SEQ ID NO: 3046089 - RNA, 13 nt, Mycobacterium bovis subsp bovis AF2122/97
cccacuggcggac

SEQ ID NO: 3046090 - RNA, 13 nt, Mycobacterium bovis subsp bovis AF2122/97
cccacugggccgg

SEQ ID NO: 3046091 - RNA, 14 nt, Mycobacterium bovis subsp bovis AF2122/97
cccacugggccggu

SEQ ID NO: 3046092 - RNA, 23 nt, Mycobacterium bovis subsp bovis AF2122/97
cccagaaaaccgccgcaaccgcg

SEQ ID NO: 3046093 - RNA, 13 nt, Mycobacterium bovis subsp bovis AF2122/97
cccagaacgccgu

SEQ ID NO: 3046094 - RNA, 17 nt, Mycobacterium bovis subsp bovis AF2122/97
cccagaauuccggcgga

SEQ ID NO: 3046095 - RNA, 18 nt, Mycobacterium bovis subsp bovis AF2122/97
cccagacaauccgccgcc

SEQ ID NO: 3046096 - RNA, 14 nt, Mycobacterium bovis subsp bovis AF2122/97
cccagaccgccaca

SEQ ID NO: 3046097 - RNA, 22 nt, Mycobacterium bovis subsp bovis AF2122/97
cccagaccgccgaagaagguga

SEQ ID NO: 3046098 - RNA, 15 nt, Mycobacterium bovis subsp bovis AF2122/97
cccagaccgccgacg

SEQ ID NO: 3046099 - RNA, 20 nt, Mycobacterium bovis subsp bovis AF2122/97
cccagagcaucagguuguac

SEQ ID NO: 3046100 - RNA, 19 nt, Mycobacterium bovis subsp bovis AF2122/97
cccagagccgcugcggcac

SEQ ID NO: 3046101 - RNA, 13 nt, Mycobacterium bovis subsp bovis AF2122/97
cccagagcugguc

SEQ ID NO: 3046102 - RNA, 15 nt, Mycobacterium bovis subsp bovis AF2122/97
cccagauacccgcgu

SEQ ID NO: 3046103 - RNA, 21 nt, Mycobacterium bovis subsp bovis AF2122/97
cccagauauugaaccgggcca

SEQ ID NO: 3046104 - RNA, 15 nt, Mycobacterium bovis subsp bovis AF2122/97
cccagauccgcagcg

SEQ ID NO: 3046105 - RNA, 13 nt, Mycobacterium bovis subsp bovis AF2122/97
cccagaucggcga

SEQ ID NO: 3046106 - RNA, 15 nt, Mycobacterium bovis subsp bovis AF2122/97
cccagaucggcgacg

SEQ ID NO: 3046107 - RNA, 13 nt, Mycobacterium bovis subsp bovis AF2122/97
cccagaucggcgu

SEQ ID NO: 3046108 - RNA, 19 nt, Mycobacterium bovis subsp bovis AF2122/97
cccagaucgguugaucggc

SEQ ID NO: 3046109 - RNA, 19 nt, Mycobacterium bovis subsp bovis AF2122/97
cccagaucuugcagugcgc

SEQ ID NO: 3046110 - RNA, 15 nt, Mycobacterium bovis subsp bovis AF2122/97
cccagauugcccaac

SEQ ID NO: 3046111 - RNA, 21 nt, Mycobacterium bovis subsp bovis AF2122/97
cccagauugccugggcggccg

SEQ ID NO: 3046112 - RNA, 20 nt, Mycobacterium bovis subsp bovis AF2122/97
cccagcaaccgcucggcgau

SEQ ID NO: 3046113 - RNA, 15 nt, Mycobacterium bovis subsp bovis AF2122/97
cccagcacaaccagc

SEQ ID NO: 3046114 - RNA, 17 nt, Mycobacterium bovis subsp bovis AF2122/97
cccagcacaaccagcug

SEQ ID NO: 3046115 - RNA, 18 nt, Mycobacterium bovis subsp bovis AF2122/97
cccagcacacccccgucu

SEQ ID NO: 3046116 - RNA, 16 nt, Mycobacterium bovis subsp bovis AF2122/97
cccagcacauucugca

SEQ ID NO: 3046117 - RNA, 24 nt, Mycobacterium bovis subsp bovis AF2122/97
cccagcacauucugcagcgucucc

SEQ ID NO: 3046118 - RNA, 18 nt, Mycobacterium bovis subsp bovis AF2122/97
cccagcaccacaacgucg

SEQ ID NO: 3046119 - RNA, 15 nt, Mycobacterium bovis subsp bovis AF2122/97
cccagcaccaccgcg

SEQ ID NO: 3046120 - RNA, 16 nt, Mycobacterium bovis subsp bovis AF2122/97
cccagcaccaccgcgg

SEQ ID NO: 3046121 - RNA, 21 nt, Mycobacterium bovis subsp bovis AF2122/97
cccagcacccccugcaccguc

SEQ ID NO: 3046122 - RNA, 15 nt, Mycobacterium bovis subsp bovis AF2122/97
cccagcacccggcuu

SEQ ID NO: 3046123 - RNA, 13 nt, Mycobacterium bovis subsp bovis AF2122/97
cccagcacccuca

SEQ ID NO: 3046124 - RNA, 17 nt, Mycobacterium bovis subsp bovis AF2122/97
cccagcacgcgcgcgac

SEQ ID NO: 3046125 - RNA, 14 nt, Mycobacterium bovis subsp bovis AF2122/97
cccagcacgcuggc

SEQ ID NO: 3046126 - RNA, 15 nt, Mycobacterium bovis subsp bovis AF2122/97
cccagcacgcuggcg

SEQ ID NO: 3046127 - RNA, 17 nt, Mycobacterium bovis subsp bovis AF2122/97
cccagcacgcuggcguu

SEQ ID NO: 3046128 - RNA, 22 nt, Mycobacterium bovis subsp bovis AF2122/97
cccagcacgcuggcguuguuga

SEQ ID NO: 3046129 - RNA, 13 nt, Mycobacterium bovis subsp bovis AF2122/97
cccagcacgguca

SEQ ID NO: 3046130 - RNA, 14 nt, Mycobacterium bovis subsp bovis AF2122/97
cccagcagcgcgac

SEQ ID NO: 3046131 - RNA, 15 nt, Mycobacterium bovis subsp bovis AF2122/97
cccagcaggcccuug

SEQ ID NO: 3046132 - RNA, 14 nt, Mycobacterium bovis subsp bovis AF2122/97
cccagcagggugug

SEQ ID NO: 3046133 - RNA, 21 nt, Mycobacterium bovis subsp bovis AF2122/97
cccagcaucuuuggcggccgc

SEQ ID NO: 3046134 - RNA, 22 nt, Mycobacterium bovis subsp bovis AF2122/97
cccagcaucuuuggcggccgca

SEQ ID NO: 3046135 - RNA, 16 nt, Mycobacterium bovis subsp bovis AF2122/97
cccagcaugaaguccc

SEQ ID NO: 3046136 - RNA, 15 nt, Mycobacterium bovis subsp bovis AF2122/97
cccagccaacccguc

SEQ ID NO: 3046137 - RNA, 16 nt, Mycobacterium bovis subsp bovis AF2122/97
cccagccaacucaggc

SEQ ID NO: 3046138 - RNA, 21 nt, Mycobacterium bovis subsp bovis AF2122/97
cccagccagcagcggcgagcc

SEQ ID NO: 3046139 - RNA, 16 nt, Mycobacterium bovis subsp bovis AF2122/97
cccagccaugcugcuc

SEQ ID NO: 3046140 - RNA, 13 nt, Mycobacterium bovis subsp bovis AF2122/97
cccagcccagccg

SEQ ID NO: 3046141 - RNA, 12 nt, Mycobacterium bovis subsp bovis AF2122/97
cccagcccaugu

SEQ ID NO: 3046142 - RNA, 13 nt, Mycobacterium bovis subsp bovis AF2122/97
cccagcccauguc

SEQ ID NO: 3046143 - RNA, 14 nt, Mycobacterium bovis subsp bovis AF2122/97
cccagcccaugucg

SEQ ID NO: 3046144 - RNA, 23 nt, Mycobacterium bovis subsp bovis AF2122/97
cccagcccaugucgagcacgcca

SEQ ID NO: 3046145 - RNA, 16 nt, Mycobacterium bovis subsp bovis AF2122/97
cccagccccacccgcc

SEQ ID NO: 3046146 - RNA, 20 nt, Mycobacterium bovis subsp bovis AF2122/97
cccagccccacccgccgccg

SEQ ID NO: 3046147 - RNA, 13 nt, Mycobacterium bovis subsp bovis AF2122/97
cccagccccgacu

SEQ ID NO: 3046148 - RNA, 14 nt, Mycobacterium bovis subsp bovis AF2122/97
cccagcccggccca

SEQ ID NO: 3046149 - RNA, 18 nt, Mycobacterium bovis subsp bovis AF2122/97
cccagcccggcccagugg

SEQ ID NO: 3046150 - RNA, 13 nt, Mycobacterium bovis subsp bovis AF2122/97
cccagcccggcgu

SEQ ID NO: 3046151 - RNA, 15 nt, Mycobacterium bovis subsp bovis AF2122/97
cccagcccuuggcgc

SEQ ID NO: 3046152 - RNA, 17 nt, Mycobacterium bovis subsp bovis AF2122/97
cccagccgagcggcggc

SEQ ID NO: 3046153 - RNA, 12 nt, Mycobacterium bovis subsp bovis AF2122/97
cccagccgcagc

SEQ ID NO: 3046154 - RNA, 16 nt, Mycobacterium bovis subsp bovis AF2122/97
cccagccgcaucgggc

SEQ ID NO: 3046155 - RNA, 13 nt, Mycobacterium bovis subsp bovis AF2122/97
cccagccgccagc

SEQ ID NO: 3046156 - RNA, 18 nt, Mycobacterium bovis subsp bovis AF2122/97
cccagccgccagcccguc

SEQ ID NO: 3046157 - RNA, 13 nt, Mycobacterium bovis subsp bovis AF2122/97
cccagccgcgcca

SEQ ID NO: 3046158 - RNA, 14 nt, Mycobacterium bovis subsp bovis AF2122/97
cccagccgcgccag

SEQ ID NO: 3046159 - RNA, 16 nt, Mycobacterium bovis subsp bovis AF2122/97
cccagccgcgccagcu

SEQ ID NO: 3046160 - RNA, 14 nt, Mycobacterium bovis subsp bovis AF2122/97
cccagccgcggcgc

SEQ ID NO: 3046161 - RNA, 17 nt, Mycobacterium bovis subsp bovis AF2122/97
cccagccgcgggccgcg

SEQ ID NO: 3046162 - RNA, 19 nt, Mycobacterium bovis subsp bovis AF2122/97
cccagccgcgggccgcguc

SEQ ID NO: 3046163 - RNA, 13 nt, Mycobacterium bovis subsp bovis AF2122/97
cccagccggcagc

SEQ ID NO: 3046164 - RNA, 17 nt, Mycobacterium bovis subsp bovis AF2122/97
cccagccggcagcagcg

SEQ ID NO: 3046165 - RNA, 16 nt, Mycobacterium bovis subsp bovis AF2122/97
cccagccguucgucgc

SEQ ID NO: 3046166 - RNA, 19 nt, Mycobacterium bovis subsp bovis AF2122/97
cccagcgaaucacccgcga

SEQ ID NO: 3046167 - RNA, 20 nt, Mycobacterium bovis subsp bovis AF2122/97
cccagcgaaucacccgcgag

SEQ ID NO: 3046168 - RNA, 24 nt, Mycobacterium bovis subsp bovis AF2122/97
cccagcgaauccaggccguacucg

SEQ ID NO: 3046169 - RNA, 13 nt, Mycobacterium bovis subsp bovis AF2122/97
cccagcgaaugcu

SEQ ID NO: 3046170 - RNA, 14 nt, Mycobacterium bovis subsp bovis AF2122/97
cccagcgacccggc

SEQ ID NO: 3046171 - RNA, 16 nt, Mycobacterium bovis subsp bovis AF2122/97
cccagcgaccgcugca

SEQ ID NO: 3046172 - RNA, 20 nt, Mycobacterium bovis subsp bovis AF2122/97
cccagcgaccgcugcagauu

SEQ ID NO: 3046173 - RNA, 18 nt, Mycobacterium bovis subsp bovis AF2122/97
cccagcgacgcggccagc

SEQ ID NO: 3046174 - RNA, 14 nt, Mycobacterium bovis subsp bovis AF2122/97
cccagggcugccgg

SEQ ID NO: 3046175 - RNA, 15 nt, Mycobacterium bovis subsp bovis AF2122/97
cccagggggcgugcc

SEQ ID NO: 3046176 - RNA, 21 nt, Mycobacterium bovis subsp bovis AF2122/97
cccagggggcgugccgccgca

SEQ ID NO: 3046177 - RNA, 14 nt, Mycobacterium bovis subsp bovis AF2122/97
cccaggguggcgac

SEQ ID NO: 3046178 - RNA, 13 nt, Mycobacterium bovis subsp bovis AF2122/97
cccaggucaacga

SEQ ID NO: 3046179 - RNA, 19 nt, Mycobacterium bovis subsp bovis AF2122/97
cccaggucaacgacguuga

SEQ ID NO: 3046180 - RNA, 15 nt, Mycobacterium bovis subsp bovis AF2122/97
cccagguccgcgugc

SEQ ID NO: 3046181 - RNA, 18 nt, Mycobacterium bovis subsp bovis AF2122/97
cccaggucgaugcgggcg

SEQ ID NO: 3046182 - RNA, 16 nt, Mycobacterium bovis subsp bovis AF2122/97
cccaggucguaggcgc

SEQ ID NO: 3046183 - RNA, 19 nt, Mycobacterium bovis subsp bovis AF2122/97
cccaggugcguccaggcca

SEQ ID NO: 3046184 - RNA, 22 nt, Mycobacterium bovis subsp bovis AF2122/97
cccaggugcguccaggccaggg

SEQ ID NO: 3046185 - RNA, 18 nt, Mycobacterium bovis subsp bovis AF2122/97
cccaggugggcagcaggc

SEQ ID NO: 3046186 - RNA, 21 nt, Mycobacterium bovis subsp bovis AF2122/97
cccaggugggccgagagcagc

SEQ ID NO: 3046187 - RNA, 22 nt, Mycobacterium bovis subsp bovis AF2122/97
cccaggugguucaaccggacga

SEQ ID NO: 3046188 - RNA, 19 nt, Mycobacterium bovis subsp bovis AF2122/97
cccagguguguggcggcgu

SEQ ID NO: 3046189 - RNA, 20 nt, Mycobacterium bovis subsp bovis AF2122/97
cccagguguguggcggcguc

SEQ ID NO: 3046190 - RNA, 17 nt, Mycobacterium bovis subsp bovis AF2122/97
cccagguuccgcugucg

SEQ ID NO: 3046191 - RNA, 20 nt, Mycobacterium bovis subsp bovis AF2122/97
cccagguuccgcugucgagc

SEQ ID NO: 3046192 - RNA, 21 nt, Mycobacterium bovis subsp bovis AF2122/97
cccagguugccuuggcggcca

SEQ ID NO: 3046193 - RNA, 20 nt, Mycobacterium bovis subsp bovis AF2122/97
cccagguuggagcccgagcu

SEQ ID NO: 3046194 - RNA, 21 nt, Mycobacterium bovis subsp bovis AF2122/97
cccagguuggagcccgagcuc

SEQ ID NO: 3046195 - RNA, 21 nt, Mycobacterium bovis subsp bovis AF2122/97
cccagguuucauuccugguua

SEQ ID NO: 3046196 - RNA, 14 nt, Mycobacterium bovis subsp bovis AF2122/97
cccaguagaucgcc

SEQ ID NO: 3046197 - RNA, 14 nt, Mycobacterium bovis subsp bovis AF2122/97
cccagucgcggcgc

SEQ ID NO: 3046198 - RNA, 14 nt, Mycobacterium bovis subsp bovis AF2122/97
cccagucggcgccg

SEQ ID NO: 3046199 - RNA, 17 nt, Mycobacterium bovis subsp bovis AF2122/97
cccagucggcgccgccg

SEQ ID NO: 3046200 - RNA, 22 nt, Mycobacterium bovis subsp bovis AF2122/97
cccagucggcgccgccguccag

SEQ ID NO: 3046201 - RNA, 19 nt, Mycobacterium bovis subsp bovis AF2122/97
cccagugaaucggaccgac

SEQ ID NO: 3046202 - RNA, 20 nt, Mycobacterium bovis subsp bovis AF2122/97
cccagugcagacaggcggcg

SEQ ID NO: 3046203 - RNA, 22 nt, Mycobacterium bovis subsp bovis AF2122/97
cccagugcagacaggcggcggc

SEQ ID NO: 3046204 - RNA, 14 nt, Mycobacterium bovis subsp bovis AF2122/97
cccagugccacgcc

SEQ ID NO: 3046205 - RNA, 16 nt, Mycobacterium bovis subsp bovis AF2122/97
cccagugccagaaccc

SEQ ID NO: 3046206 - RNA, 20 nt, Mycobacterium bovis subsp bovis AF2122/97
cccagugcgcaacccagccg

SEQ ID NO: 3046207 - RNA, 21 nt, Mycobacterium bovis subsp bovis AF2122/97
cccagugcgcaacccagccgc

SEQ ID NO: 3046208 - RNA, 15 nt, Mycobacterium bovis subsp bovis AF2122/97
cccaguucggcgucu

SEQ ID NO: 3046209 - RNA, 14 nt, Mycobacterium bovis subsp bovis AF2122/97
cccaguucugcagg

SEQ ID NO: 3046210 - RNA, 15 nt, Mycobacterium bovis subsp bovis AF2122/97
cccaguugggccuca

SEQ ID NO: 3046211 - RNA, 18 nt, Mycobacterium bovis subsp bovis AF2122/97
cccaguugugcggccagg

SEQ ID NO: 3046212 - RNA, 16 nt, Mycobacterium bovis subsp bovis AF2122/97
cccauaccuucggcga

SEQ ID NO: 3046213 - RNA, 23 nt, Mycobacterium bovis subsp bovis AF2122/97
cccauaccuucggcgaucuugac

SEQ ID NO: 3046214 - RNA, 12 nt, Mycobacterium bovis subsp bovis AF2122/97
cccauacgccgg

SEQ ID NO: 3046215 - RNA, 15 nt, Mycobacterium bovis subsp bovis AF2122/97
cccauacgccggccg

SEQ ID NO: 3046216 - RNA, 17 nt, Mycobacterium bovis subsp bovis AF2122/97
cccauacgccggccgcg

SEQ ID NO: 3046217 - RNA, 18 nt, Mycobacterium bovis subsp bovis AF2122/97
cccauacucggcggcuuc

SEQ ID NO: 3046218 - RNA, 17 nt, Mycobacterium bovis subsp bovis AF2122/97
cccauacuugcgccgac

SEQ ID NO: 3046219 - RNA, 15 nt, Mycobacterium bovis subsp bovis AF2122/97
cccauagcaccucga

SEQ ID NO: 3046220 - RNA, 15 nt, Mycobacterium bovis subsp bovis AF2122/97
cccauagccagccga

SEQ ID NO: 3046221 - RNA, 17 nt, Mycobacterium bovis subsp bovis AF2122/97
cccauagccgguggucg

SEQ ID NO: 3046222 - RNA, 22 nt, Mycobacterium bovis subsp bovis AF2122/97
cccauagccgguggucgcgccc

SEQ ID NO: 3046223 - RNA, 16 nt, Mycobacterium bovis subsp bovis AF2122/97
cccauagcugccggcc

SEQ ID NO: 3046224 - RNA, 22 nt, Mycobacterium bovis subsp bovis AF2122/97
cccauaucgaucggaucggcac

SEQ ID NO: 3046225 - RNA, 19 nt, Mycobacterium bovis subsp bovis AF2122/97
cccaucacccuguuugccc

SEQ ID NO: 3046226 - RNA, 14 nt, Mycobacterium bovis subsp bovis AF2122/97
cccaucaccgccag

SEQ ID NO: 3046227 - RNA, 20 nt, Mycobacterium bovis subsp bovis AF2122/97
cccaucagaaugccuggccc

SEQ ID NO: 3046228 - RNA, 19 nt, Mycobacterium bovis subsp bovis AF2122/97
cccaucccaugucgaggaa

SEQ ID NO: 3046229 - RNA, 22 nt, Mycobacterium bovis subsp bovis AF2122/97
cccauccccgguucugcgccca

SEQ ID NO: 3046230 - RNA, 23 nt, Mycobacterium bovis subsp bovis AF2122/97
cccauccccgguucugcgcccac

SEQ ID NO: 3046231 - RNA, 18 nt, Mycobacterium bovis subsp bovis AF2122/97
cccaucccgauccugccc

SEQ ID NO: 3046232 - RNA, 22 nt, Mycobacterium bovis subsp bovis AF2122/97
cccaucccgauccugcccacca

SEQ ID NO: 3046233 - RNA, 17 nt, Mycobacterium bovis subsp bovis AF2122/97
cccaucccgauccuggc

SEQ ID NO: 3046234 - RNA, 21 nt, Mycobacterium bovis subsp bovis AF2122/97
cccauccggccgucgggcagc

SEQ ID NO: 3046235 - RNA, 16 nt, Mycobacterium bovis subsp bovis AF2122/97
cccaucgaaaaaccuc

SEQ ID NO: 3046236 - RNA, 14 nt, Mycobacterium bovis subsp bovis AF2122/97
cccaucgaccgccc

SEQ ID NO: 3046237 - RNA, 15 nt, Mycobacterium bovis subsp bovis AF2122/97
cccaucgaccgcccg

SEQ ID NO: 3046238 - RNA, 14 nt, Mycobacterium bovis subsp bovis AF2122/97
cccaucgccacacc

SEQ ID NO: 3046239 - RNA, 19 nt, Mycobacterium bovis subsp bovis AF2122/97
cccaucgcccggugcgucg

SEQ ID NO: 3046240 - RNA, 23 nt, Mycobacterium bovis subsp bovis AF2122/97
cccaucgcgacuagacgccgccg

SEQ ID NO: 3046241 - RNA, 15 nt, Mycobacterium bovis subsp bovis AF2122/97
cccaucgggcgccca

SEQ ID NO: 3046242 - RNA, 23 nt, Mycobacterium bovis subsp bovis AF2122/97
cccaucggggcuacaacugccga

SEQ ID NO: 3046243 - RNA, 18 nt, Mycobacterium bovis subsp bovis AF2122/97
cccaucgucgagccgcca

SEQ ID NO: 3046244 - RNA, 15 nt, Mycobacterium bovis subsp bovis AF2122/97
cccaugaccggccgc

SEQ ID NO: 3046245 - RNA, 16 nt, Mycobacterium bovis subsp bovis AF2122/97
cccaugaccggccgcc

SEQ ID NO: 3046246 - RNA, 22 nt, Mycobacterium bovis subsp bovis AF2122/97
cccaugaucccgcugaccuggg

SEQ ID NO: 3046247 - RNA, 16 nt, Mycobacterium bovis subsp bovis AF2122/97
cccaugauggccgcgg

SEQ ID NO: 3046248 - RNA, 18 nt, Mycobacterium bovis subsp bovis AF2122/97
cccaugaugugcagcgag

SEQ ID NO: 3046249 - RNA, 19 nt, Mycobacterium bovis subsp bovis AF2122/97
cccaugcaaucggauaggu

SEQ ID NO: 3046250 - RNA, 17 nt, Mycobacterium bovis subsp bovis AF2122/97
cccaugcacggccgagc

SEQ ID NO: 3046251 - RNA, 21 nt, Mycobacterium bovis subsp bovis AF2122/97
cccaugcacggccgagcaggu

SEQ ID NO: 3046252 - RNA, 14 nt, Mycobacterium bovis subsp bovis AF2122/97
cccaugcagcggcg

SEQ ID NO: 3046253 - RNA, 13 nt, Mycobacterium bovis subsp bovis AF2122/97
cccaugccgaccg

SEQ ID NO: 3046254 - RNA, 22 nt, Mycobacterium bovis subsp bovis AF2122/97
cccaugccgaccggcacccgcg

SEQ ID NO: 3046255 - RNA, 13 nt, Mycobacterium bovis subsp bovis AF2122/97
cccaugccgaugc

SEQ ID NO: 3046256 - RNA, 15 nt, Mycobacterium bovis subsp bovis AF2122/97
cccaugccgucgggu

SEQ ID NO: 3046257 - RNA, 12 nt, Mycobacterium bovis subsp bovis AF2122/97
cccaugccucca

SEQ ID NO: 3046258 - RNA, 13 nt, Mycobacterium bovis subsp bovis AF2122/97
cccaugcgccagc

SEQ ID NO: 3046259 - RNA, 14 nt, Mycobacterium bovis subsp bovis AF2122/97
cccaugcggcaggu

SEQ ID NO: 3046260 - RNA, 16 nt, Mycobacterium bovis subsp bovis AF2122/97
ccccauggccaccgaa

SEQ ID NO: 3046261 - RNA, 15 nt, Mycobacterium bovis subsp bovis AF2122/97
ccccauggccagcgc

SEQ ID NO: 3046262 - RNA, 13 nt, Mycobacterium bovis subsp bovis AF2122/97
ccccauugccgcc

SEQ ID NO: 3046263 - RNA, 14 nt, Mycobacterium bovis subsp bovis AF2122/97
ccccauugcgcccc

SEQ ID NO: 3046264 - RNA, 22 nt, Mycobacterium bovis subsp bovis AF2122/97
cccccaaaucaacagggugggc

SEQ ID NO: 3046265 - RNA, 15 nt, Mycobacterium bovis subsp bovis AF2122/97
cccccaaccgccggc

SEQ ID NO: 3046266 - RNA, 16 nt, Mycobacterium bovis subsp bovis AF2122/97
cccccaagcucugcgu

SEQ ID NO: 3046267 - RNA, 14 nt, Mycobacterium bovis subsp bovis AF2122/97
cccccacggcccgu

SEQ ID NO: 3046268 - RNA, 21 nt, Mycobacterium bovis subsp bovis AF2122/97
cccccagacaauccgccgccg

SEQ ID NO: 3046269 - RNA, 14 nt, Mycobacterium bovis subsp bovis AF2122/97
cccccagcgcccgc

SEQ ID NO: 3046270 - RNA, 12 nt, Mycobacterium bovis subsp bovis AF2122/97
cccccaggcgaa

SEQ ID NO: 3046271 - RNA, 20 nt, Mycobacterium bovis subsp bovis AF2122/97
cccccaggcgcucagcgcgg

SEQ ID NO: 3046272 - RNA, 18 nt, Mycobacterium bovis subsp bovis AF2122/97
cccccagguagugcacac

SEQ ID NO: 3046273 - RNA, 23 nt, Mycobacterium bovis subsp bovis AF2122/97
cccccagugcacgcucggcgccg

SEQ ID NO: 3046274 - RNA, 15 nt, Mycobacterium bovis subsp bovis AF2122/97
cccccaguucggcgu

SEQ ID NO: 3046275 - RNA, 20 nt, Mycobacterium bovis subsp bovis AF2122/97
cccccauugccgccgucgcc

SEQ ID NO: 3046276 - RNA, 14 nt, Mycobacterium bovis subsp bovis AF2122/97
ccccccacccacca

SEQ ID NO: 3046277 - RNA, 14 nt, Mycobacterium bovis subsp bovis AF2122/97
ccccccgggcccgc

SEQ ID NO: 3046278 - RNA, 19 nt, Mycobacterium bovis subsp bovis AF2122/97
cccccgaaccugcggcagc

SEQ ID NO: 3046279 - RNA, 23 nt, Mycobacterium bovis subsp bovis AF2122/97
cccccgaaguggugaccgacgcg

SEQ ID NO: 3046280 - RNA, 21 nt, Mycobacterium bovis subsp bovis AF2122/97
cccccgacuccggcaggcccg

SEQ ID NO: 3046281 - RNA, 17 nt, Mycobacterium bovis subsp bovis AF2122/97
cccccgauagcgaccgc

SEQ ID NO: 3046282 - RNA, 22 nt, Mycobacterium bovis subsp bovis AF2122/97
cccccgauggcgucgccggccc

SEQ ID NO: 3046283 - RNA, 14 nt, Mycobacterium bovis subsp bovis AF2122/97
cccccgcacgcacg

SEQ ID NO: 3046284 - RNA, 18 nt, Mycobacterium bovis subsp bovis AF2122/97
cccccgcacgcucggcgu

SEQ ID NO: 3046285 - RNA, 13 nt, Mycobacterium bovis subsp bovis AF2122/97
cccccgccaaccc

SEQ ID NO: 3046286 - RNA, 22 nt, Mycobacterium bovis subsp bovis AF2122/97
cccccggauuccagcagccugc

SEQ ID NO: 3046287 - RNA, 13 nt, Mycobacterium bovis subsp bovis AF2122/97
cccccggcaccgc

SEQ ID NO: 3046288 - RNA, 19 nt, Mycobacterium bovis subsp bovis AF2122/97
cccccggcaccgccggcuc

SEQ ID NO: 3046289 - RNA, 14 nt, Mycobacterium bovis subsp bovis AF2122/97
cccccggccauggc

SEQ ID NO: 3046290 - RNA, 15 nt, Mycobacterium bovis subsp bovis AF2122/97
cccccggcgcggcgg

SEQ ID NO: 3046291 - RNA, 12 nt, Mycobacterium bovis subsp bovis AF2122/97
cccccgggcccg

SEQ ID NO: 3046292 - RNA, 15 nt, Mycobacterium bovis subsp bovis AF2122/97
cccccggggcgcucg

SEQ ID NO: 3046293 - RNA, 20 nt, Mycobacterium bovis subsp bovis AF2122/97
cccccggggcgcucgcgcgc

SEQ ID NO: 3046294 - RNA, 20 nt, Mycobacterium bovis subsp bovis AF2122/97
cccccggguagaccaccugc

SEQ ID NO: 3046295 - RNA, 22 nt, Mycobacterium bovis subsp bovis AF2122/97
cccccgggugcgggugggacac

SEQ ID NO: 3046296 - RNA, 17 nt, Mycobacterium bovis subsp bovis AF2122/97
cccccggugccgcccgc

SEQ ID NO: 3046297 - RNA, 24 nt, Mycobacterium bovis subsp bovis AF2122/97
cccccggugccguuggagccgcca

SEQ ID NO: 3046298 - RNA, 16 nt, Mycobacterium bovis subsp bovis AF2122/97
cccccgucgccaccga

SEQ ID NO: 3046299 - RNA, 14 nt, Mycobacterium bovis subsp bovis AF2122/97
cccccgucggccuu

SEQ ID NO: 3046300 - RNA, 16 nt, Mycobacterium bovis subsp bovis AF2122/97
cccccguugccgccgu

SEQ ID NO: 3046301 - RNA, 19 nt, Mycobacterium bovis subsp bovis AF2122/97
cccccguugccgccguugc

SEQ ID NO: 3046302 - RNA, 18 nt, Mycobacterium bovis subsp bovis AF2122/97
cccccguuuacggcccgg

SEQ ID NO: 3046303 - RNA, 14 nt, Mycobacterium bovis subsp bovis AF2122/97
cccccuucacccuc

SEQ ID NO: 3046304 - RNA, 17 nt, Mycobacterium bovis subsp bovis AF2122/97
cccccuuuacaccccca

SEQ ID NO: 3046305 - RNA, 17 nt, Mycobacterium bovis subsp bovis AF2122/97
ccccgaacauccgccgc

SEQ ID NO: 3046306 - RNA, 19 nt, Mycobacterium bovis subsp bovis AF2122/97
ccccgaacauccgccgccc

SEQ ID NO: 3046307 - RNA, 19 nt, Mycobacterium bovis subsp bovis AF2122/97
ccccgaacauugcgcccag

SEQ ID NO: 3046308 - RNA, 23 nt, Mycobacterium bovis subsp bovis AF2122/97
ccccgacacucaaccugaaccgg

SEQ ID NO: 3046309 - RNA, 13 nt, Mycobacterium bovis subsp bovis AF2122/97
ccccgaccgccac

SEQ ID NO: 3046310 - RNA, 16 nt, Mycobacterium bovis subsp bovis AF2122/97
ccccgaccgccaccgc

SEQ ID NO: 3046311 - RNA, 12 nt, Mycobacterium bovis subsp bovis AF2122/97
ccccgaccgccg

SEQ ID NO: 3046312 - RNA, 13 nt, Mycobacterium bovis subsp bovis AF2122/97
ccccgaccgccgu

SEQ ID NO: 3046313 - RNA, 12 nt, Mycobacterium bovis subsp bovis AF2122/97
ccccgaccgcgc

SEQ ID NO: 3046314 - RNA, 16 nt, Mycobacterium bovis subsp bovis AF2122/97
ccccgaccugcaagac

SEQ ID NO: 3046315 - RNA, 23 nt, Mycobacterium bovis subsp bovis AF2122/97
ccccgacgaugcgcacucccggc

SEQ ID NO: 3046316 - RNA, 20 nt, Mycobacterium bovis subsp bovis AF2122/97
ccccgacggacuccggccgg

SEQ ID NO: 3046317 - RNA, 20 nt, Mycobacterium bovis subsp bovis AF2122/97
ccccgacggugaaccaccac

SEQ ID NO: 3046318 - RNA, 23 nt, Mycobacterium bovis subsp bovis AF2122/97
ccccgagaccucgucgucgaagu

SEQ ID NO: 3046319 - RNA, 16 nt, Mycobacterium bovis subsp bovis AF2122/97
ccccgagauccguccg

SEQ ID NO: 3046320 - RNA, 18 nt, Mycobacterium bovis subsp bovis AF2122/97
ccccgagauccguccgcu

SEQ ID NO: 3046321 - RNA, 16 nt, Mycobacterium bovis subsp bovis AF2122/97
ccccgagccgugcacc

SEQ ID NO: 3046322 - RNA, 17 nt, Mycobacterium bovis subsp bovis AF2122/97
ccccgagcggagccgcc

SEQ ID NO: 3046323 - RNA, 14 nt, Mycobacterium bovis subsp bovis AF2122/97
ccccgaucaggccg

SEQ ID NO: 3046324 - RNA, 15 nt, Mycobacterium bovis subsp bovis AF2122/97
ccccgauccgccacg

SEQ ID NO: 3046325 - RNA, 13 nt, Mycobacterium bovis subsp bovis AF2122/97
ccccgaugaccgc

SEQ ID NO: 3046326 - RNA, 21 nt, Mycobacterium bovis subsp bovis AF2122/97
ccccgauggcgucgccggccc

SEQ ID NO: 3046327 - RNA, 13 nt, Mycobacterium bovis subsp bovis AF2122/97
ccccgcacgcggg

SEQ ID NO: 3046328 - RNA, 15 nt, Mycobacterium bovis subsp bovis AF2122/97
ccccgcacgcucgcc

SEQ ID NO: 3046329 - RNA, 14 nt, Mycobacterium bovis subsp bovis AF2122/97
ccccgcacgcucgg

SEQ ID NO: 3046330 - RNA, 18 nt, Mycobacterium bovis subsp bovis AF2122/97
ccccgcacggaaggucga

SEQ ID NO: 3046331 - RNA, 20 nt, Mycobacterium bovis subsp bovis AF2122/97
ccccgcacggaaggucgaca

SEQ ID NO: 3046332 - RNA, 20 nt, Mycobacterium bovis subsp bovis AF2122/97
ccccgcagaauccggcaacc

SEQ ID NO: 3046333 - RNA, 19 nt, Mycobacterium bovis subsp bovis AF2122/97
ccccgcagcacucgcccaa

SEQ ID NO: 3046334 - RNA, 20 nt, Mycobacterium bovis subsp bovis AF2122/97
ccccgcagcucaccucauga

SEQ ID NO: 3046335 - RNA, 17 nt, Mycobacterium bovis subsp bovis AF2122/97
ccccgcauugccgucgg

SEQ ID NO: 3046336 - RNA, 13 nt, Mycobacterium bovis subsp bovis AF2122/97
ccccgccaacccc

SEQ ID NO: 3046337 - RNA, 15 nt, Mycobacterium bovis subsp bovis AF2122/97
ccccgccaccucgcc

SEQ ID NO: 3046338 - RNA, 16 nt, Mycobacterium bovis subsp bovis AF2122/97
ccccgccagcggcagc

SEQ ID NO: 3046339 - RNA, 15 nt, Mycobacterium bovis subsp bovis AF2122/97
ccccgccauugccgc

SEQ ID NO: 3046340 - RNA, 13 nt, Mycobacterium bovis subsp bovis AF2122/97
ccccgcccgcacc

SEQ ID NO: 3046341 - RNA, 19 nt, Mycobacterium bovis subsp bovis AF2122/97
ccccgcccuugccgccagc

SEQ ID NO: 3046342 - RNA, 15 nt, Mycobacterium bovis subsp bovis AF2122/97
ccccgccgagcaccg

SEQ ID NO: 3046343 - RNA, 13 nt, Mycobacterium bovis subsp bovis AF2122/97
ccccgccgagcgg

SEQ ID NO: 3046344 - RNA, 15 nt, Mycobacterium bovis subsp bovis AF2122/97
ccccgccgaucaccg

SEQ ID NO: 3046345 - RNA, 19 nt, Mycobacterium bovis subsp bovis AF2122/97
ccccgccgaugccgccggc

SEQ ID NO: 3046346 - RNA, 14 nt, Mycobacterium bovis subsp bovis AF2122/97
ccccgccgccggug

SEQ ID NO: 3046347 - RNA, 19 nt, Mycobacterium bovis subsp bovis AF2122/97
ccccguuggucagcgugga

SEQ ID NO: 3046348 - RNA, 18 nt, Mycobacterium bovis subsp bovis AF2122/97
ccccguugugucaccggc

SEQ ID NO: 3046349 - RNA, 18 nt, Mycobacterium bovis subsp bovis AF2122/97
ccccguuuacggcccggc

SEQ ID NO: 3046350 - RNA, 17 nt, Mycobacterium bovis subsp bovis AF2122/97
ccccguuucggucgaca

SEQ ID NO: 3046351 - RNA, 20 nt, Mycobacterium bovis subsp bovis AF2122/97
ccccguuucggucgacaacg

SEQ ID NO: 3046352 - RNA, 11 nt, Mycobacterium bovis subsp bovis AF2122/97
ccccuaaaccg

SEQ ID NO: 3046353 - RNA, 15 nt, Mycobacterium bovis subsp bovis AF2122/97
ccccucccaccagcg

SEQ ID NO: 3046354 - RNA, 14 nt, Mycobacterium bovis subsp bovis AF2122/97
ccccuccgcgccga

SEQ ID NO: 3046355 - RNA, 18 nt, Mycobacterium bovis subsp bovis AF2122/97
ccccuccuucggugaggu

SEQ ID NO: 3046356 - RNA, 13 nt, Mycobacterium bovis subsp bovis AF2122/97
ccccucggccgcc

SEQ ID NO: 3046357 - RNA, 14 nt, Mycobacterium bovis subsp bovis AF2122/97
ccccucggccgccc

SEQ ID NO: 3046358 - RNA, 16 nt, Mycobacterium bovis subsp bovis AF2122/97
ccccucggcuucggag

SEQ ID NO: 3046359 - RNA, 13 nt, Mycobacterium bovis subsp bovis AF2122/97
ccccucggugcca

SEQ ID NO: 3046360 - RNA, 17 nt, Mycobacterium bovis subsp bovis AF2122/97
ccccucggugccacugc

SEQ ID NO: 3046361 - RNA, 21 nt, Mycobacterium bovis subsp bovis AF2122/97
ccccucgucgucaucgagcgg

SEQ ID NO: 3046362 - RNA, 19 nt, Mycobacterium bovis subsp bovis AF2122/97
ccccugaaucaccggagcg

SEQ ID NO: 3046363 - RNA, 13 nt, Mycobacterium bovis subsp bovis AF2122/97
ccccugccacagc

SEQ ID NO: 3046364 - RNA, 21 nt, Mycobacterium bovis subsp bovis AF2122/97
ccccugcgcggccaccucauc

SEQ ID NO: 3046365 - RNA, 20 nt, Mycobacterium bovis subsp bovis AF2122/97
ccccuggaaagggccgccgc

SEQ ID NO: 3046366 - RNA, 19 nt, Mycobacterium bovis subsp bovis AF2122/97
ccccuggacuucgggggcc

SEQ ID NO: 3046367 - RNA, 14 nt, Mycobacterium bovis subsp bovis AF2122/97
ccccuggcaccucg

SEQ ID NO: 3046368 - RNA, 21 nt, Mycobacterium bovis subsp bovis AF2122/97
ccccuggccagcagagcggca

SEQ ID NO: 3046369 - RNA, 12 nt, Mycobacterium bovis subsp bovis AF2122/97
ccccuggccgcc

SEQ ID NO: 3046370 - RNA, 13 nt, Mycobacterium bovis subsp bovis AF2122/97
ccccuggccgccg

SEQ ID NO: 3046371 - RNA, 14 nt, Mycobacterium bovis subsp bovis AF2122/97
ccccuggccgccgc

SEQ ID NO: 3046372 - RNA, 17 nt, Mycobacterium bovis subsp bovis AF2122/97
ccccuggccgccggcgc

SEQ ID NO: 3046373 - RNA, 11 nt, Mycobacterium bovis subsp bovis AF2122/97
ccccuggcgau

SEQ ID NO: 3046374 - RNA, 15 nt, Mycobacterium bovis subsp bovis AF2122/97
ccccuggcgauuucg

SEQ ID NO: 3046375 - RNA, 21 nt, Mycobacterium bovis subsp bovis AF2122/97
ccccugggcggauggccucga

SEQ ID NO: 3046376 - RNA, 16 nt, Mycobacterium bovis subsp bovis AF2122/97
ccccugucaacgccgc

SEQ ID NO: 3046377 - RNA, 14 nt, Mycobacterium bovis subsp bovis AF2122/97
ccccuucaaagcgg

SEQ ID NO: 3046378 - RNA, 16 nt, Mycobacterium bovis subsp bovis AF2122/97
ccccuucgccagcgcc

SEQ ID NO: 3046379 - RNA, 19 nt, Mycobacterium bovis subsp bovis AF2122/97
ccccuuggcgccaccggcg

SEQ ID NO: 3046380 - RNA, 17 nt, Mycobacterium bovis subsp bovis AF2122/97
ccccuugguggccagcc

SEQ ID NO: 3046381 - RNA, 19 nt, Mycobacterium bovis subsp bovis AF2122/97
ccccuuuugccgcagcauc

SEQ ID NO: 3046382 - RNA, 21 nt, Mycobacterium bovis subsp bovis AF2122/97
cccgaaaacccaacacccaga

SEQ ID NO: 3046383 - RNA, 17 nt, Mycobacterium bovis subsp bovis AF2122/97
cccgaaacaccgucugg

SEQ ID NO: 3046384 - RNA, 13 nt, Mycobacterium bovis subsp bovis AF2122/97
cccgaaacccgau

SEQ ID NO: 3046385 - RNA, 18 nt, Mycobacterium bovis subsp bovis AF2122/97
cccgaaaccuguaccgcc

SEQ ID NO: 3046386 - RNA, 21 nt, Mycobacterium bovis subsp bovis AF2122/97
cccgaaaccuguaccgccacg

SEQ ID NO: 3046387 - RNA, 17 nt, Mycobacterium bovis subsp bovis AF2122/97
cccgaaauucucgcccu

SEQ ID NO: 3046388 - RNA, 13 nt, Mycobacterium bovis subsp bovis AF2122/97
cccgaaccaccac

SEQ ID NO: 3046389 - RNA, 14 nt, Mycobacterium bovis subsp bovis AF2122/97
cccgaaccaccacc

SEQ ID NO: 3046390 - RNA, 16 nt, Mycobacterium bovis subsp bovis AF2122/97
cccgaaccaccgcguu

SEQ ID NO: 3046391 - RNA, 14 nt, Mycobacterium bovis subsp bovis AF2122/97
cccgaaccccgacc

SEQ ID NO: 3046392 - RNA, 15 nt, Mycobacterium bovis subsp bovis AF2122/97
cccgaaccccgaccg

SEQ ID NO: 3046393 - RNA, 14 nt, Mycobacterium bovis subsp bovis AF2122/97
cccgaaccgcgcug

SEQ ID NO: 3046394 - RNA, 17 nt, Mycobacterium bovis subsp bovis AF2122/97
cccgaaccugcggcagc

SEQ ID NO: 3046395 - RNA, 18 nt, Mycobacterium bovis subsp bovis AF2122/97
cccgaacugggcgaucga

SEQ ID NO: 3046396 - RNA, 23 nt, Mycobacterium bovis subsp bovis AF2122/97
cccgaacuucugguaggcggcca

SEQ ID NO: 3046397 - RNA, 23 nt, Mycobacterium bovis subsp bovis AF2122/97
cccgaagaccuggccugcggcag

SEQ ID NO: 3046398 - RNA, 15 nt, Mycobacterium bovis subsp bovis AF2122/97
cccgaagacggggug

SEQ ID NO: 3046399 - RNA, 17 nt, Mycobacterium bovis subsp bovis AF2122/97
cccgaagaugaccucgg

SEQ ID NO: 3046400 - RNA, 22 nt, Mycobacterium bovis subsp bovis AF2122/97
cccgaagaugaccucggcgacg

SEQ ID NO: 3046401 - RNA, 20 nt, Mycobacterium bovis subsp bovis AF2122/97
cccgaagauuuugggcgccg

SEQ ID NO: 3046402 - RNA, 17 nt, Mycobacterium bovis subsp bovis AF2122/97
cccgaagccgaccgggu

SEQ ID NO: 3046403 - RNA, 16 nt, Mycobacterium bovis subsp bovis AF2122/97
cccgaagccggugccg

SEQ ID NO: 3046404 - RNA, 14 nt, Mycobacterium bovis subsp bovis AF2122/97
cccgaaggcggcuc

SEQ ID NO: 3046405 - RNA, 12 nt, Mycobacterium bovis subsp bovis AF2122/97
cccgaagguggg

SEQ ID NO: 3046406 - RNA, 18 nt, Mycobacterium bovis subsp bovis AF2122/97
cccgaaguagaagcccag

SEQ ID NO: 3046407 - RNA, 15 nt, Mycobacterium bovis subsp bovis AF2122/97
cccgaaguggugacc

SEQ ID NO: 3046408 - RNA, 17 nt, Mycobacterium bovis subsp bovis AF2122/97
cccgaaguggugaccga

SEQ ID NO: 3046409 - RNA, 12 nt, Mycobacterium bovis subsp bovis AF2122/97
cccgaaucgugc

SEQ ID NO: 3046410 - RNA, 19 nt, Mycobacterium bovis subsp bovis AF2122/97
cccgaaugccuucgaugaa

SEQ ID NO: 3046411 - RNA, 16 nt, Mycobacterium bovis subsp bovis AF2122/97
cccgacaacgcugggc

SEQ ID NO: 3046412 - RNA, 18 nt, Mycobacterium bovis subsp bovis AF2122/97
cccgacaauggcgccagc

SEQ ID NO: 3046413 - RNA, 12 nt, Mycobacterium bovis subsp bovis AF2122/97
cccgacacccgu

SEQ ID NO: 3046414 - RNA, 19 nt, Mycobacterium bovis subsp bovis AF2122/97
cccgacacccguaagcgga

SEQ ID NO: 3046415 - RNA, 14 nt, Mycobacterium bovis subsp bovis AF2122/97
cccgacaccgaucg

SEQ ID NO: 3046416 - RNA, 16 nt, Mycobacterium bovis subsp bovis AF2122/97
cccgacaccgaucgga

SEQ ID NO: 3046417 - RNA, 17 nt, Mycobacterium bovis subsp bovis AF2122/97
cccgacaccgccccgcc

SEQ ID NO: 3046418 - RNA, 23 nt, Mycobacterium bovis subsp bovis AF2122/97
cccgacacucgauccggauucag

SEQ ID NO: 3046419 - RNA, 22 nt, Mycobacterium bovis subsp bovis AF2122/97
cccgacagauggucacccacgu

SEQ ID NO: 3046420 - RNA, 17 nt, Mycobacterium bovis subsp bovis AF2122/97
cccgacauacgucgggg

SEQ ID NO: 3046421 - RNA, 14 nt, Mycobacterium bovis subsp bovis AF2122/97
cccgacaucgcugc

SEQ ID NO: 3046422 - RNA, 14 nt, Mycobacterium bovis subsp bovis AF2122/97
cccgacaugcgccg

SEQ ID NO: 3046423 - RNA, 20 nt, Mycobacterium bovis subsp bovis AF2122/97
cccgacaugguccgaccagc

SEQ ID NO: 3046424 - RNA, 18 nt, Mycobacterium bovis subsp bovis AF2122/97
cccgaccacaccgggaug

SEQ ID NO: 3046425 - RNA, 15 nt, Mycobacterium bovis subsp bovis AF2122/97
cccgaccagcaccag

SEQ ID NO: 3046426 - RNA, 18 nt, Mycobacterium bovis subsp bovis AF2122/97
cccgaccagcaccagaac

SEQ ID NO: 3046427 - RNA, 18 nt, Mycobacterium bovis subsp bovis AF2122/97
cccgacccaucaccagcg

SEQ ID NO: 3046428 - RNA, 20 nt, Mycobacterium bovis subsp bovis AF2122/97
cccgacccaucaccagcggc

SEQ ID NO: 3046429 - RNA, 14 nt, Mycobacterium bovis subsp bovis AF2122/97
cccgaccccgacgg

SEQ ID NO: 3046430 - RNA, 15 nt, Mycobacterium bovis subsp bovis AF2122/97
cccgacccgccgacg

SEQ ID NO: 3046431 - RNA, 16 nt, Mycobacterium bovis subsp bovis AF2122/97
cccgacccgccgacgc

SEQ ID NO: 3046432 - RNA, 15 nt, Mycobacterium bovis subsp bovis AF2122/97
cccgacccgccgaug

SEQ ID NO: 3046433 - RNA, 12 nt, Mycobacterium bovis subsp bovis AF2122/97
cccgaccgccac

SEQ ID NO: 3046434 - RNA, 22 nt, Mycobacterium bovis subsp bovis AF2122/97
cccgaucaccuucggccgaccg

SEQ ID NO: 3046435 - RNA, 16 nt, Mycobacterium bovis subsp bovis AF2122/97
cccgaucagcaccgac

SEQ ID NO: 3046436 - RNA, 16 nt, Mycobacterium bovis subsp bovis AF2122/97
cccgaucaggccgacg

SEQ ID NO: 3046437 - RNA, 15 nt, Mycobacterium bovis subsp bovis AF2122/97
cccgaucccggccag

SEQ ID NO: 3046438 - RNA, 13 nt, Mycobacterium bovis subsp bovis AF2122/97
cccgauccgccac

SEQ ID NO: 3046439 - RNA, 17 nt, Mycobacterium bovis subsp bovis AF2122/97
cccgauccugcccacca

SEQ ID NO: 3046440 - RNA, 19 nt, Mycobacterium bovis subsp bovis AF2122/97
cccgauccugcccaccauc

SEQ ID NO: 3046441 - RNA, 23 nt, Mycobacterium bovis subsp bovis AF2122/97
cccgauccugcccaccaucccgc

SEQ ID NO: 3046442 - RNA, 13 nt, Mycobacterium bovis subsp bovis AF2122/97
cccgaucgcgcca

SEQ ID NO: 3046443 - RNA, 20 nt, Mycobacterium bovis subsp bovis AF2122/97
cccgaucggccaccaucgcc

SEQ ID NO: 3046444 - RNA, 14 nt, Mycobacterium bovis subsp bovis AF2122/97
cccgaucggugacg

SEQ ID NO: 3046445 - RNA, 23 nt, Mycobacterium bovis subsp bovis AF2122/97
cccgaucgucgagccgaucgccc

SEQ ID NO: 3046446 - RNA, 13 nt, Mycobacterium bovis subsp bovis AF2122/97
cccgaugaccgcc

SEQ ID NO: 3046447 - RNA, 15 nt, Mycobacterium bovis subsp bovis AF2122/97
cccgaugaccgccuu

SEQ ID NO: 3046448 - RNA, 20 nt, Mycobacterium bovis subsp bovis AF2122/97
cccgaugaucccgccaccga

SEQ ID NO: 3046449 - RNA, 13 nt, Mycobacterium bovis subsp bovis AF2122/97
cccgaugcuggca

SEQ ID NO: 3046450 - RNA, 17 nt, Mycobacterium bovis subsp bovis AF2122/97
cccgauggcgucgccgg

SEQ ID NO: 3046451 - RNA, 18 nt, Mycobacterium bovis subsp bovis AF2122/97
cccgauggcgucgccggc

SEQ ID NO: 3046452 - RNA, 19 nt, Mycobacterium bovis subsp bovis AF2122/97
cccgauggcgucgccggcc

SEQ ID NO: 3046453 - RNA, 21 nt, Mycobacterium bovis subsp bovis AF2122/97
cccgaugguacccgcgccgcg

SEQ ID NO: 3046454 - RNA, 22 nt, Mycobacterium bovis subsp bovis AF2122/97
cccgaugguacccgcgccgcgc

SEQ ID NO: 3046455 - RNA, 13 nt, Mycobacterium bovis subsp bovis AF2122/97
cccgauggugccg

SEQ ID NO: 3046456 - RNA, 17 nt, Mycobacterium bovis subsp bovis AF2122/97
cccgaugguggugccga

SEQ ID NO: 3046457 - RNA, 20 nt, Mycobacterium bovis subsp bovis AF2122/97
cccgaugguggugccgaccu

SEQ ID NO: 3046458 - RNA, 16 nt, Mycobacterium bovis subsp bovis AF2122/97
cccgaugucgucgacg

SEQ ID NO: 3046459 - RNA, 23 nt, Mycobacterium bovis subsp bovis AF2122/97
cccgauguuacggccccacagcg

SEQ ID NO: 3046460 - RNA, 19 nt, Mycobacterium bovis subsp bovis AF2122/97
cccgauugaccuucgacaa

SEQ ID NO: 3046461 - RNA, 21 nt, Mycobacterium bovis subsp bovis AF2122/97
cccgauuuauccggaucggcc

SEQ ID NO: 3046462 - RNA, 20 nt, Mycobacterium bovis subsp bovis AF2122/97
cccgcaaaccgguccggguc

SEQ ID NO: 3046463 - RNA, 20 nt, Mycobacterium bovis subsp bovis AF2122/97
cccgcaacccguauggcggc

SEQ ID NO: 3046464 - RNA, 14 nt, Mycobacterium bovis subsp bovis AF2122/97
cccgcaacgacuga

SEQ ID NO: 3046465 - RNA, 14 nt, Mycobacterium bovis subsp bovis AF2122/97
cccgcaacuacggc

SEQ ID NO: 3046466 - RNA, 23 nt, Mycobacterium bovis subsp bovis AF2122/97
cccgcaacuacggcguccccgac

SEQ ID NO: 3046467 - RNA, 14 nt, Mycobacterium bovis subsp bovis AF2122/97
cccgcaagucgaga

SEQ ID NO: 3046468 - RNA, 17 nt, Mycobacterium bovis subsp bovis AF2122/97
cccgcaaugcgcgcgau

SEQ ID NO: 3046469 - RNA, 18 nt, Mycobacterium bovis subsp bovis AF2122/97
cccgcaauucgcgguccg

SEQ ID NO: 3046470 - RNA, 20 nt, Mycobacterium bovis subsp bovis AF2122/97
cccgcaauuguucgcggccg

SEQ ID NO: 3046471 - RNA, 22 nt, Mycobacterium bovis subsp bovis AF2122/97
cccgcaauuguucgcggccguc

SEQ ID NO: 3046472 - RNA, 14 nt, Mycobacterium bovis subsp bovis AF2122/97
cccgcaccaccggc

SEQ ID NO: 3046473 - RNA, 16 nt, Mycobacterium bovis subsp bovis AF2122/97
cccgcaccaccggccc

SEQ ID NO: 3046474 - RNA, 17 nt, Mycobacterium bovis subsp bovis AF2122/97
cccgcaccaccggcccc

SEQ ID NO: 3046475 - RNA, 18 nt, Mycobacterium bovis subsp bovis AF2122/97
cccgcaccaccggcccca

SEQ ID NO: 3046476 - RNA, 13 nt, Mycobacterium bovis subsp bovis AF2122/97
cccgcaccccggc

SEQ ID NO: 3046477 - RNA, 14 nt, Mycobacterium bovis subsp bovis AF2122/97
cccgcaccccggcc

SEQ ID NO: 3046478 - RNA, 21 nt, Mycobacterium bovis subsp bovis AF2122/97
cccgcaccccggccgcgcgca

SEQ ID NO: 3046479 - RNA, 13 nt, Mycobacterium bovis subsp bovis AF2122/97
cccgcaccgccgg

SEQ ID NO: 3046480 - RNA, 22 nt, Mycobacterium bovis subsp bovis AF2122/97
cccgcaccgcgguacgccgguc

SEQ ID NO: 3046481 - RNA, 13 nt, Mycobacterium bovis subsp bovis AF2122/97
cccgcaccgcguu

SEQ ID NO: 3046482 - RNA, 23 nt, Mycobacterium bovis subsp bovis AF2122/97
cccgcaccggaucggcuaccuaa

SEQ ID NO: 3046483 - RNA, 13 nt, Mycobacterium bovis subsp bovis AF2122/97
cccgcaccggggu

SEQ ID NO: 3046484 - RNA, 15 nt, Mycobacterium bovis subsp bovis AF2122/97
cccgcaccggugacg

SEQ ID NO: 3046485 - RNA, 16 nt, Mycobacterium bovis subsp bovis AF2122/97
cccgcacgaaccgguc

SEQ ID NO: 3046486 - RNA, 14 nt, Mycobacterium bovis subsp bovis AF2122/97
cccgcacgaagccg

SEQ ID NO: 3046487 - RNA, 20 nt, Mycobacterium bovis subsp bovis AF2122/97
cccgcacgaguuaccggugg

SEQ ID NO: 3046488 - RNA, 12 nt, Mycobacterium bovis subsp bovis AF2122/97
cccgcacgcggg

SEQ ID NO: 3046489 - RNA, 13 nt, Mycobacterium bovis subsp bovis AF2122/97
cccgcacgcucgc

SEQ ID NO: 3046490 - RNA, 15 nt, Mycobacterium bovis subsp bovis AF2122/97
cccgcacgcucgccc

SEQ ID NO: 3046491 - RNA, 14 nt, Mycobacterium bovis subsp bovis AF2122/97
cccgcacgcucggc

SEQ ID NO: 3046492 - RNA, 15 nt, Mycobacterium bovis subsp bovis AF2122/97
cccgcacgcucggcg

SEQ ID NO: 3046493 - RNA, 21 nt, Mycobacterium bovis subsp bovis AF2122/97
cccgcacgcucggcgugucgg

SEQ ID NO: 3046494 - RNA, 12 nt, Mycobacterium bovis subsp bovis AF2122/97
cccgcacggccg

SEQ ID NO: 3046495 - RNA, 16 nt, Mycobacterium bovis subsp bovis AF2122/97
cccgcacggccggguc

SEQ ID NO: 3046496 - RNA, 22 nt, Mycobacterium bovis subsp bovis AF2122/97
cccgcacguucacgcgcggauc

SEQ ID NO: 3046497 - RNA, 19 nt, Mycobacterium bovis subsp bovis AF2122/97
cccgcacguuggcggccag

SEQ ID NO: 3046498 - RNA, 20 nt, Mycobacterium bovis subsp bovis AF2122/97
cccgcacuccacgaucggcc

SEQ ID NO: 3046499 - RNA, 14 nt, Mycobacterium bovis subsp bovis AF2122/97
cccgcacugccgcc

SEQ ID NO: 3046500 - RNA, 15 nt, Mycobacterium bovis subsp bovis AF2122/97
cccgcacugccgccg

SEQ ID NO: 3046501 - RNA, 18 nt, Mycobacterium bovis subsp bovis AF2122/97
cccgcagaauccggcaac

SEQ ID NO: 3046502 - RNA, 23 nt, Mycobacterium bovis subsp bovis AF2122/97
cccgcagaauccggcaaccaccg

SEQ ID NO: 3046503 - RNA, 13 nt, Mycobacterium bovis subsp bovis AF2122/97
cccgcagaccgcc

SEQ ID NO: 3046504 - RNA, 14 nt, Mycobacterium bovis subsp bovis AF2122/97
cccgcagaccgcca

SEQ ID NO: 3046505 - RNA, 14 nt, Mycobacterium bovis subsp bovis AF2122/97
cccgcagccgcgag

SEQ ID NO: 3046506 - RNA, 15 nt, Mycobacterium bovis subsp bovis AF2122/97
cccgcagccgcgagu

SEQ ID NO: 3046507 - RNA, 16 nt, Mycobacterium bovis subsp bovis AF2122/97
cccgcagccgcgaguc

SEQ ID NO: 3046508 - RNA, 23 nt, Mycobacterium bovis subsp bovis AF2122/97
cccgcagccgcgaguccaggcug

SEQ ID NO: 3046509 - RNA, 20 nt, Mycobacterium bovis subsp bovis AF2122/97
cccgcagcgccuaccagcac

SEQ ID NO: 3046510 - RNA, 19 nt, Mycobacterium bovis subsp bovis AF2122/97
cccgcagcuaucuccaugc

SEQ ID NO: 3046511 - RNA, 14 nt, Mycobacterium bovis subsp bovis AF2122/97
cccgcagcucgacc

SEQ ID NO: 3046512 - RNA, 19 nt, Mycobacterium bovis subsp bovis AF2122/97
cccgcagcucgaccaggaa

SEQ ID NO: 3046513 - RNA, 14 nt, Mycobacterium bovis subsp bovis AF2122/97
cccgcagcugcgga

SEQ ID NO: 3046514 - RNA, 12 nt, Mycobacterium bovis subsp bovis AF2122/97
cccgcaggacgc

SEQ ID NO: 3046515 - RNA, 17 nt, Mycobacterium bovis subsp bovis AF2122/97
cccgcaggacgcugccg

SEQ ID NO: 3046516 - RNA, 20 nt, Mycobacterium bovis subsp bovis AF2122/97
cccgcaggcucaccgagccg

SEQ ID NO: 3046517 - RNA, 14 nt, Mycobacterium bovis subsp bovis AF2122/97
cccgcagggccgcc

SEQ ID NO: 3046518 - RNA, 15 nt, Mycobacterium bovis subsp bovis AF2122/97
cccgcagggccgccg

SEQ ID NO: 3046519 - RNA, 18 nt, Mycobacterium bovis subsp bovis AF2122/97
cccgcauccacgucgccc

SEQ ID NO: 3046520 - RNA, 15 nt, Mycobacterium bovis subsp bovis AF2122/97
cccgcaucgcccaag

SEQ ID NO: 3046521 - RNA, 13 nt, Mycobacterium bovis subsp bovis AF2122/97
cccgccgcacgca

SEQ ID NO: 3046522 - RNA, 20 nt, Mycobacterium bovis subsp bovis AF2122/97
cccgccgccacgggugacga

SEQ ID NO: 3046523 - RNA, 15 nt, Mycobacterium bovis subsp bovis AF2122/97
cccgccgccccacaa

SEQ ID NO: 3046524 - RNA, 12 nt, Mycobacterium bovis subsp bovis AF2122/97
cccgccgcgacc

SEQ ID NO: 3046525 - RNA, 15 nt, Mycobacterium bovis subsp bovis AF2122/97
cccgccgcgaccacg

SEQ ID NO: 3046526 - RNA, 17 nt, Mycobacterium bovis subsp bovis AF2122/97
cccgccgcgaccacgca

SEQ ID NO: 3046527 - RNA, 13 nt, Mycobacterium bovis subsp bovis AF2122/97
cccgccgcgcauc

SEQ ID NO: 3046528 - RNA, 21 nt, Mycobacterium bovis subsp bovis AF2122/97
cccgccgcgcauccgcagccc

SEQ ID NO: 3046529 - RNA, 13 nt, Mycobacterium bovis subsp bovis AF2122/97
cccgccgcgcccg

SEQ ID NO: 3046530 - RNA, 13 nt, Mycobacterium bovis subsp bovis AF2122/97
cccgccgcgcguc

SEQ ID NO: 3046531 - RNA, 15 nt, Mycobacterium bovis subsp bovis AF2122/97
cccgccgcugccgcc

SEQ ID NO: 3046532 - RNA, 22 nt, Mycobacterium bovis subsp bovis AF2122/97
cccgccgcugccgccggugccg

SEQ ID NO: 3046533 - RNA, 14 nt, Mycobacterium bovis subsp bovis AF2122/97
cccgccggaacugc

SEQ ID NO: 3046534 - RNA, 15 nt, Mycobacterium bovis subsp bovis AF2122/97
cccgccggacccgcc

SEQ ID NO: 3046535 - RNA, 16 nt, Mycobacterium bovis subsp bovis AF2122/97
cccgccggacccgccc

SEQ ID NO: 3046536 - RNA, 17 nt, Mycobacterium bovis subsp bovis AF2122/97
cccgccggacccgcccu

SEQ ID NO: 3046537 - RNA, 24 nt, Mycobacterium bovis subsp bovis AF2122/97
cccgccggauccgccagaccgcgg

SEQ ID NO: 3046538 - RNA, 15 nt, Mycobacterium bovis subsp bovis AF2122/97
cccgccggccccgcc

SEQ ID NO: 3046539 - RNA, 19 nt, Mycobacterium bovis subsp bovis AF2122/97
cccgccggccccgccggcc

SEQ ID NO: 3046540 - RNA, 12 nt, Mycobacterium bovis subsp bovis AF2122/97
cccgccggccgc

SEQ ID NO: 3046541 - RNA, 15 nt, Mycobacterium bovis subsp bovis AF2122/97
cccgccggccgcgcc

SEQ ID NO: 3046542 - RNA, 21 nt, Mycobacterium bovis subsp bovis AF2122/97
cccgccggccgcgccggcccc

SEQ ID NO: 3046543 - RNA, 13 nt, Mycobacterium bovis subsp bovis AF2122/97
cccgccggccucc

SEQ ID NO: 3046544 - RNA, 12 nt, Mycobacterium bovis subsp bovis AF2122/97
cccgccggcgcc

SEQ ID NO: 3046545 - RNA, 13 nt, Mycobacterium bovis subsp bovis AF2122/97
cccgccggcgccg

SEQ ID NO: 3046546 - RNA, 16 nt, Mycobacterium bovis subsp bovis AF2122/97
cccgccggcgccgccc

SEQ ID NO: 3046547 - RNA, 17 nt, Mycobacterium bovis subsp bovis AF2122/97
cccgccggcgccgccca

SEQ ID NO: 3046548 - RNA, 20 nt, Mycobacterium bovis subsp bovis AF2122/97
cccgccggcgcgagccggcu

SEQ ID NO: 3046549 - RNA, 17 nt, Mycobacterium bovis subsp bovis AF2122/97
cccgccgggaugccucg

SEQ ID NO: 3046550 - RNA, 14 nt, Mycobacterium bovis subsp bovis AF2122/97
cccgccgggcucca

SEQ ID NO: 3046551 - RNA, 15 nt, Mycobacterium bovis subsp bovis AF2122/97
cccgccggguccgcc

SEQ ID NO: 3046552 - RNA, 17 nt, Mycobacterium bovis subsp bovis AF2122/97
cccgccggguccgccgg

SEQ ID NO: 3046553 - RNA, 19 nt, Mycobacterium bovis subsp bovis AF2122/97
cccgccggguccgccgggc

SEQ ID NO: 3046554 - RNA, 21 nt, Mycobacterium bovis subsp bovis AF2122/97
cccgccggguccgccgggccc

SEQ ID NO: 3046555 - RNA, 18 nt, Mycobacterium bovis subsp bovis AF2122/97
cccgccggguuggucuuc

SEQ ID NO: 3046556 - RNA, 13 nt, Mycobacterium bovis subsp bovis AF2122/97
cccgccggucacg

SEQ ID NO: 3046557 - RNA, 15 nt, Mycobacterium bovis subsp bovis AF2122/97
cccgccgguggccgc

SEQ ID NO: 3046558 - RNA, 13 nt, Mycobacterium bovis subsp bovis AF2122/97
cccgccguagacc

SEQ ID NO: 3046559 - RNA, 12 nt, Mycobacterium bovis subsp bovis AF2122/97
cccgccgucacc

SEQ ID NO: 3046560 - RNA, 14 nt, Mycobacterium bovis subsp bovis AF2122/97
cccgccgucacccc

SEQ ID NO: 3046561 - RNA, 15 nt, Mycobacterium bovis subsp bovis AF2122/97
cccgccgucaccgcc

SEQ ID NO: 3046562 - RNA, 18 nt, Mycobacterium bovis subsp bovis AF2122/97
cccgccgucaccgccguu

SEQ ID NO: 3046563 - RNA, 12 nt, Mycobacterium bovis subsp bovis AF2122/97
cccgccgucgcc

SEQ ID NO: 3046564 - RNA, 22 nt, Mycobacterium bovis subsp bovis AF2122/97
cccgccgucuuggcccgguccg

SEQ ID NO: 3046565 - RNA, 24 nt, Mycobacterium bovis subsp bovis AF2122/97
cccgccgucuuggcccgguccgcc

SEQ ID NO: 3046566 - RNA, 16 nt, Mycobacterium bovis subsp bovis AF2122/97
cccgccguugccaccg

SEQ ID NO: 3046567 - RNA, 20 nt, Mycobacterium bovis subsp bovis AF2122/97
cccgccguugccaccggugc

SEQ ID NO: 3046568 - RNA, 18 nt, Mycobacterium bovis subsp bovis AF2122/97
cccgccguugccgccguc

SEQ ID NO: 3046569 - RNA, 15 nt, Mycobacterium bovis subsp bovis AF2122/97
cccgccguuuccgcc

SEQ ID NO: 3046570 - RNA, 17 nt, Mycobacterium bovis subsp bovis AF2122/97
cccgccguuuccgccgc

SEQ ID NO: 3046571 - RNA, 18 nt, Mycobacterium bovis subsp bovis AF2122/97
cccgccguuuccgccgcc

SEQ ID NO: 3046572 - RNA, 19 nt, Mycobacterium bovis subsp bovis AF2122/97
cccgccuaaucggccugcc

SEQ ID NO: 3046573 - RNA, 15 nt, Mycobacterium bovis subsp bovis AF2122/97
cccgccucgaccgcc

SEQ ID NO: 3046574 - RNA, 18 nt, Mycobacterium bovis subsp bovis AF2122/97
cccgccucgaccgccagc

SEQ ID NO: 3046575 - RNA, 17 nt, Mycobacterium bovis subsp bovis AF2122/97
cccgccucgggccggcg

SEQ ID NO: 3046576 - RNA, 19 nt, Mycobacterium bovis subsp bovis AF2122/97
cccgccucugucuucagcu

SEQ ID NO: 3046577 - RNA, 15 nt, Mycobacterium bovis subsp bovis AF2122/97
cccgccugaccgcca

SEQ ID NO: 3046578 - RNA, 21 nt, Mycobacterium bovis subsp bovis AF2122/97
cccgccuucucccgcacggcc

SEQ ID NO: 3046579 - RNA, 18 nt, Mycobacterium bovis subsp bovis AF2122/97
cccgcgaaccgcggaucg

SEQ ID NO: 3046580 - RNA, 18 nt, Mycobacterium bovis subsp bovis AF2122/97
cccgcgaacgaucccgcc

SEQ ID NO: 3046581 - RNA, 18 nt, Mycobacterium bovis subsp bovis AF2122/97
cccgcgaacgcgacagcc

SEQ ID NO: 3046582 - RNA, 19 nt, Mycobacterium bovis subsp bovis AF2122/97
cccgcgaacgcgacagcca

SEQ ID NO: 3046583 - RNA, 21 nt, Mycobacterium bovis subsp bovis AF2122/97
cccgcgaacgcgacagccacc

SEQ ID NO: 3046584 - RNA, 22 nt, Mycobacterium bovis subsp bovis AF2122/97
cccgcgaauacgaggacgacga

SEQ ID NO: 3046585 - RNA, 17 nt, Mycobacterium bovis subsp bovis AF2122/97
cccgcgagaucgggccg

SEQ ID NO: 3046586 - RNA, 20 nt, Mycobacterium bovis subsp bovis AF2122/97
cccgcgagaucgggccggcc

SEQ ID NO: 3046587 - RNA, 23 nt, Mycobacterium bovis subsp bovis AF2122/97
cccgcgagaucgggccggccgcc

SEQ ID NO: 3046588 - RNA, 18 nt, Mycobacterium bovis subsp bovis AF2122/97
cccgcgagcagcccggcg

SEQ ID NO: 3046589 - RNA, 13 nt, Mycobacterium bovis subsp bovis AF2122/97
cccgcgagcaucg

SEQ ID NO: 3046590 - RNA, 17 nt, Mycobacterium bovis subsp bovis AF2122/97
cccgcgaggacagcugg

SEQ ID NO: 3046591 - RNA, 23 nt, Mycobacterium bovis subsp bovis AF2122/97
cccgcgaggacagcugguugugc

SEQ ID NO: 3046592 - RNA, 19 nt, Mycobacterium bovis subsp bovis AF2122/97
cccgcgagguugaccacca

SEQ ID NO: 3046593 - RNA, 23 nt, Mycobacterium bovis subsp bovis AF2122/97
cccgcgagguugaccaccagcgu

SEQ ID NO: 3046594 - RNA, 23 nt, Mycobacterium bovis subsp bovis AF2122/97
cccgcgaucgcgacacggccauc

SEQ ID NO: 3046595 - RNA, 13 nt, Mycobacterium bovis subsp bovis AF2122/97
cccgcgaucgggc

SEQ ID NO: 3046596 - RNA, 15 nt, Mycobacterium bovis subsp bovis AF2122/97
cccgcgaucgggccg

SEQ ID NO: 3046597 - RNA, 20 nt, Mycobacterium bovis subsp bovis AF2122/97
cccgcgaugcgcaccagcgg

SEQ ID NO: 3046598 - RNA, 21 nt, Mycobacterium bovis subsp bovis AF2122/97
cccgcgaugcgcaccagcggc

SEQ ID NO: 3046599 - RNA, 17 nt, Mycobacterium bovis subsp bovis AF2122/97
cccgcgauucgcggcag

SEQ ID NO: 3046600 - RNA, 15 nt, Mycobacterium bovis subsp bovis AF2122/97
cccgcgcagcacugc

SEQ ID NO: 3046601 - RNA, 18 nt, Mycobacterium bovis subsp bovis AF2122/97
cccgcgcagcgguccgcc

SEQ ID NO: 3046602 - RNA, 19 nt, Mycobacterium bovis subsp bovis AF2122/97
cccgcgccaccagcaccgc

SEQ ID NO: 3046603 - RNA, 18 nt, Mycobacterium bovis subsp bovis AF2122/97
cccgcgccaccgauaccg

SEQ ID NO: 3046604 - RNA, 20 nt, Mycobacterium bovis subsp bovis AF2122/97
cccgcgccaccucccacgcc

SEQ ID NO: 3046605 - RNA, 22 nt, Mycobacterium bovis subsp bovis AF2122/97
cccgcgccaccucccacgccgc

SEQ ID NO: 3046606 - RNA, 14 nt, Mycobacterium bovis subsp bovis AF2122/97
cccgcgcccggccg

SEQ ID NO: 3046607 - RNA, 12 nt, Mycobacterium bovis subsp bovis AF2122/97
cccgcgccgaca

SEQ ID NO: 3046608 - RNA, 20 nt, Mycobacterium bovis subsp bovis AF2122/97
cccgcucgagcagcgcgccg

SEQ ID NO: 3046609 - RNA, 14 nt, Mycobacterium bovis subsp bovis AF2122/97
cccgcucgaucggc

SEQ ID NO: 3046610 - RNA, 17 nt, Mycobacterium bovis subsp bovis AF2122/97
cccgcucgaucggcagc

SEQ ID NO: 3046611 - RNA, 21 nt, Mycobacterium bovis subsp bovis AF2122/97
cccgcucgaucggcagccagg

SEQ ID NO: 3046612 - RNA, 18 nt, Mycobacterium bovis subsp bovis AF2122/97
cccgcucgaucugcccgg

SEQ ID NO: 3046613 - RNA, 12 nt, Mycobacterium bovis subsp bovis AF2122/97
cccgcucgaugu

SEQ ID NO: 3046614 - RNA, 14 nt, Mycobacterium bovis subsp bovis AF2122/97
cccgcucgcccgcc

SEQ ID NO: 3046615 - RNA, 16 nt, Mycobacterium bovis subsp bovis AF2122/97
cccgcucgcccgccgc

SEQ ID NO: 3046616 - RNA, 17 nt, Mycobacterium bovis subsp bovis AF2122/97
cccgcucgcccgccgcc

SEQ ID NO: 3046617 - RNA, 21 nt, Mycobacterium bovis subsp bovis AF2122/97
cccgcucgcccgccgccacca

SEQ ID NO: 3046618 - RNA, 15 nt, Mycobacterium bovis subsp bovis AF2122/97
cccgcucgcggcgac

SEQ ID NO: 3046619 - RNA, 13 nt, Mycobacterium bovis subsp bovis AF2122/97
cccgcucggccgc

SEQ ID NO: 3046620 - RNA, 14 nt, Mycobacterium bovis subsp bovis AF2122/97
cccgcucggccgca

SEQ ID NO: 3046621 - RNA, 14 nt, Mycobacterium bovis subsp bovis AF2122/97
cccgcucggccgcc

SEQ ID NO: 3046622 - RNA, 16 nt, Mycobacterium bovis subsp bovis AF2122/97
cccgcucggccgccgg

SEQ ID NO: 3046623 - RNA, 14 nt, Mycobacterium bovis subsp bovis AF2122/97
cccgcucggccguc

SEQ ID NO: 3046624 - RNA, 19 nt, Mycobacterium bovis subsp bovis AF2122/97
cccgcucguaggaccucag

SEQ ID NO: 3046625 - RNA, 12 nt, Mycobacterium bovis subsp bovis AF2122/97
cccgcucgucgg

SEQ ID NO: 3046626 - RNA, 20 nt, Mycobacterium bovis subsp bovis AF2122/97
cccgcugaccaucacaccca

SEQ ID NO: 3046627 - RNA, 23 nt, Mycobacterium bovis subsp bovis AF2122/97
cccgcugagcacucaugaugccg

SEQ ID NO: 3046628 - RNA, 15 nt, Mycobacterium bovis subsp bovis AF2122/97
cccgcugagccagcu

SEQ ID NO: 3046629 - RNA, 14 nt, Mycobacterium bovis subsp bovis AF2122/97
cccgcugcacgccg

SEQ ID NO: 3046630 - RNA, 12 nt, Mycobacterium bovis subsp bovis AF2122/97
cccgcugccauu

SEQ ID NO: 3046631 - RNA, 23 nt, Mycobacterium bovis subsp bovis AF2122/97
cccgcugccgucggagaccagcu

SEQ ID NO: 3046632 - RNA, 22 nt, Mycobacterium bovis subsp bovis AF2122/97
cccgcugcgagaucgcggcgac

SEQ ID NO: 3046633 - RNA, 12 nt, Mycobacterium bovis subsp bovis AF2122/97
cccgcugcgccg

SEQ ID NO: 3046634 - RNA, 18 nt, Mycobacterium bovis subsp bovis AF2122/97
cccgcuggcgagcagacg

SEQ ID NO: 3046635 - RNA, 16 nt, Mycobacterium bovis subsp bovis AF2122/97
cccgcuggcucaucga

SEQ ID NO: 3046636 - RNA, 14 nt, Mycobacterium bovis subsp bovis AF2122/97
cccgcugggucgac

SEQ ID NO: 3046637 - RNA, 18 nt, Mycobacterium bovis subsp bovis AF2122/97
cccgcuggugguucccga

SEQ ID NO: 3046638 - RNA, 15 nt, Mycobacterium bovis subsp bovis AF2122/97
cccgcuugcgcggcu

SEQ ID NO: 3046639 - RNA, 17 nt, Mycobacterium bovis subsp bovis AF2122/97
cccgcuuggcgugaccu

SEQ ID NO: 3046640 - RNA, 16 nt, Mycobacterium bovis subsp bovis AF2122/97
cccgcuuugcacugug

SEQ ID NO: 3046641 - RNA, 18 nt, Mycobacterium bovis subsp bovis AF2122/97
cccgcuuuuucccggcgg

SEQ ID NO: 3046642 - RNA, 21 nt, Mycobacterium bovis subsp bovis AF2122/97
cccgcuuuuucccggcggcgc

SEQ ID NO: 3046643 - RNA, 22 nt, Mycobacterium bovis subsp bovis AF2122/97
cccggaaaaauuucuucgccga

SEQ ID NO: 3046644 - RNA, 20 nt, Mycobacterium bovis subsp bovis AF2122/97
cccggaaagaucucggucac

SEQ ID NO: 3046645 - RNA, 15 nt, Mycobacterium bovis subsp bovis AF2122/97
cccggaacaccgacg

SEQ ID NO: 3046646 - RNA, 17 nt, Mycobacterium bovis subsp bovis AF2122/97
cccggaaccagccgcgg

SEQ ID NO: 3046647 - RNA, 15 nt, Mycobacterium bovis subsp bovis AF2122/97
cccggaacgccgcca

SEQ ID NO: 3046648 - RNA, 16 nt, Mycobacterium bovis subsp bovis AF2122/97
cccggaacgccgccag

SEQ ID NO: 3046649 - RNA, 19 nt, Mycobacterium bovis subsp bovis AF2122/97
cccggaacgccgccagcgc

SEQ ID NO: 3046650 - RNA, 13 nt, Mycobacterium bovis subsp bovis AF2122/97
cccggaagcgccg

SEQ ID NO: 3046651 - RNA, 17 nt, Mycobacterium bovis subsp bovis AF2122/97
cccggaagcgccggccc

SEQ ID NO: 3046652 - RNA, 18 nt, Mycobacterium bovis subsp bovis AF2122/97
cccggaauauggcggccg

SEQ ID NO: 3046653 - RNA, 23 nt, Mycobacterium bovis subsp bovis AF2122/97
cccggaaucgcgaaacagcuugc

SEQ ID NO: 3046654 - RNA, 16 nt, Mycobacterium bovis subsp bovis AF2122/97
cccggaaucgucgcgg

SEQ ID NO: 3046655 - RNA, 19 nt, Mycobacterium bovis subsp bovis AF2122/97
cccggaaucgucgcggccg

SEQ ID NO: 3046656 - RNA, 14 nt, Mycobacterium bovis subsp bovis AF2122/97
cccggaccaucgcc

SEQ ID NO: 3046657 - RNA, 15 nt, Mycobacterium bovis subsp bovis AF2122/97
cccggacccaccaau

SEQ ID NO: 3046658 - RNA, 12 nt, Mycobacterium bovis subsp bovis AF2122/97
cccggaccgccc

SEQ ID NO: 3046659 - RNA, 20 nt, Mycobacterium bovis subsp bovis AF2122/97
cccggaccgcccgugccguc

SEQ ID NO: 3046660 - RNA, 17 nt, Mycobacterium bovis subsp bovis AF2122/97
cccggaccgucguggcg

SEQ ID NO: 3046661 - RNA, 14 nt, Mycobacterium bovis subsp bovis AF2122/97
cccggaccugggcg

SEQ ID NO: 3046662 - RNA, 16 nt, Mycobacterium bovis subsp bovis AF2122/97
cccggaccugggcgac

SEQ ID NO: 3046663 - RNA, 22 nt, Mycobacterium bovis subsp bovis AF2122/97
cccggacgauggcgucggccag

SEQ ID NO: 3046664 - RNA, 17 nt, Mycobacterium bovis subsp bovis AF2122/97
cccggacguaggcaccc

SEQ ID NO: 3046665 - RNA, 18 nt, Mycobacterium bovis subsp bovis AF2122/97
cccggacgucggcggccg

SEQ ID NO: 3046666 - RNA, 19 nt, Mycobacterium bovis subsp bovis AF2122/97
cccggacucuccccuggcc

SEQ ID NO: 3046667 - RNA, 13 nt, Mycobacterium bovis subsp bovis AF2122/97
cccggagccgcca

SEQ ID NO: 3046668 - RNA, 24 nt, Mycobacterium bovis subsp bovis AF2122/97
cccggagccgccaggugcucgucg

SEQ ID NO: 3046669 - RNA, 12 nt, Mycobacterium bovis subsp bovis AF2122/97
cccggagccgcu

SEQ ID NO: 3046670 - RNA, 18 nt, Mycobacterium bovis subsp bovis AF2122/97
cccggagcgauccggcaa

SEQ ID NO: 3046671 - RNA, 16 nt, Mycobacterium bovis subsp bovis AF2122/97
cccggagcggucagcg

SEQ ID NO: 3046672 - RNA, 15 nt, Mycobacterium bovis subsp bovis AF2122/97
cccggaggcaauccg

SEQ ID NO: 3046673 - RNA, 20 nt, Mycobacterium bovis subsp bovis AF2122/97
cccggaggguucggacggcu

SEQ ID NO: 3046674 - RNA, 23 nt, Mycobacterium bovis subsp bovis AF2122/97
cccggaguggccaguuggccggc

SEQ ID NO: 3046675 - RNA, 17 nt, Mycobacterium bovis subsp bovis AF2122/97
cccggauagacggcgac

SEQ ID NO: 3046676 - RNA, 20 nt, Mycobacterium bovis subsp bovis AF2122/97
cccggauaucgaccaccggg

SEQ ID NO: 3046677 - RNA, 23 nt, Mycobacterium bovis subsp bovis AF2122/97
cccggaucuggugggugcggcca

SEQ ID NO: 3046678 - RNA, 14 nt, Mycobacterium bovis subsp bovis AF2122/97
cccggaugcgaugc

SEQ ID NO: 3046679 - RNA, 21 nt, Mycobacterium bovis subsp bovis AF2122/97
cccggauuccucgucaccgcg

SEQ ID NO: 3046680 - RNA, 19 nt, Mycobacterium bovis subsp bovis AF2122/97
cccggcaaacuccagcuug

SEQ ID NO: 3046681 - RNA, 13 nt, Mycobacterium bovis subsp bovis AF2122/97
cccggcaacaacg

SEQ ID NO: 3046682 - RNA, 12 nt, Mycobacterium bovis subsp bovis AF2122/97
cccggcaaccgg

SEQ ID NO: 3046683 - RNA, 17 nt, Mycobacterium bovis subsp bovis AF2122/97
cccggcaaccuggacug

SEQ ID NO: 3046684 - RNA, 14 nt, Mycobacterium bovis subsp bovis AF2122/97
cccggcaagcgcag

SEQ ID NO: 3046685 - RNA, 22 nt, Mycobacterium bovis subsp bovis AF2122/97
cccggcacccaguuccacccgg

SEQ ID NO: 3046686 - RNA, 15 nt, Mycobacterium bovis subsp bovis AF2122/97
cccggcaccccuuug

SEQ ID NO: 3046687 - RNA, 17 nt, Mycobacterium bovis subsp bovis AF2122/97
cccggcaccccuuugac

SEQ ID NO: 3046688 - RNA, 17 nt, Mycobacterium bovis subsp bovis AF2122/97
cccggcacccggugaga

SEQ ID NO: 3046689 - RNA, 12 nt, Mycobacterium bovis subsp bovis AF2122/97
cccggcaccgcg

SEQ ID NO: 3046690 - RNA, 17 nt, Mycobacterium bovis subsp bovis AF2122/97
cccggcacggugucgcg

SEQ ID NO: 3046691 - RNA, 17 nt, Mycobacterium bovis subsp bovis AF2122/97
cccggcacugaccgcga

SEQ ID NO: 3046692 - RNA, 23 nt, Mycobacterium bovis subsp bovis AF2122/97
cccggcacugaccgcgaugaucg

SEQ ID NO: 3046693 - RNA, 14 nt, Mycobacterium bovis subsp bovis AF2122/97
cccggcagagcacg

SEQ ID NO: 3046694 - RNA, 15 nt, Mycobacterium bovis subsp bovis AF2122/97
cccggcagaugcagc

SEQ ID NO: 3046695 - RNA, 22 nt, Mycobacterium bovis subsp bovis AF2122/97
cccggcgccgucgaugaccagc

SEQ ID NO: 3046696 - RNA, 16 nt, Mycobacterium bovis subsp bovis AF2122/97
cccggcgcgauccccg

SEQ ID NO: 3046697 - RNA, 12 nt, Mycobacterium bovis subsp bovis AF2122/97
cccggcgcgccg

SEQ ID NO: 3046698 - RNA, 15 nt, Mycobacterium bovis subsp bovis AF2122/97
cccggcgcggcggac

SEQ ID NO: 3046699 - RNA, 23 nt, Mycobacterium bovis subsp bovis AF2122/97
cccggcgcuagcgccgcgcuugc

SEQ ID NO: 3046700 - RNA, 12 nt, Mycobacterium bovis subsp bovis AF2122/97
cccggcggcagc

SEQ ID NO: 3046701 - RNA, 17 nt, Mycobacterium bovis subsp bovis AF2122/97
cccggcggcagcugcug

SEQ ID NO: 3046702 - RNA, 17 nt, Mycobacterium bovis subsp bovis AF2122/97
cccggcggccaucccgc

SEQ ID NO: 3046703 - RNA, 23 nt, Mycobacterium bovis subsp bovis AF2122/97
cccggcggccaucccgcguucga

SEQ ID NO: 3046704 - RNA, 22 nt, Mycobacterium bovis subsp bovis AF2122/97
cccggcggcccgauagaucgcg

SEQ ID NO: 3046705 - RNA, 12 nt, Mycobacterium bovis subsp bovis AF2122/97
cccggcggcgcg

SEQ ID NO: 3046706 - RNA, 20 nt, Mycobacterium bovis subsp bovis AF2122/97
cccggcggcguccaucgcgc

SEQ ID NO: 3046707 - RNA, 15 nt, Mycobacterium bovis subsp bovis AF2122/97
cccggcgggcccgcc

SEQ ID NO: 3046708 - RNA, 19 nt, Mycobacterium bovis subsp bovis AF2122/97
cccggcgggcccgccggcc

SEQ ID NO: 3046709 - RNA, 20 nt, Mycobacterium bovis subsp bovis AF2122/97
cccggcgggcccgccggccc

SEQ ID NO: 3046710 - RNA, 21 nt, Mycobacterium bovis subsp bovis AF2122/97
cccggcgggcccgccggcccc

SEQ ID NO: 3046711 - RNA, 17 nt, Mycobacterium bovis subsp bovis AF2122/97
cccggcgggcggugggc

SEQ ID NO: 3046712 - RNA, 19 nt, Mycobacterium bovis subsp bovis AF2122/97
cccggcgguaaagcucacc

SEQ ID NO: 3046713 - RNA, 15 nt, Mycobacterium bovis subsp bovis AF2122/97
cccggcgguaccgcc

SEQ ID NO: 3046714 - RNA, 17 nt, Mycobacterium bovis subsp bovis AF2122/97
cccggcgguaccgccgc

SEQ ID NO: 3046715 - RNA, 21 nt, Mycobacterium bovis subsp bovis AF2122/97
cccggcgguaccggagcagcu

SEQ ID NO: 3046716 - RNA, 16 nt, Mycobacterium bovis subsp bovis AF2122/97
cccggcggucagcggc

SEQ ID NO: 3046717 - RNA, 21 nt, Mycobacterium bovis subsp bovis AF2122/97
cccggcggugccgucagcggc

SEQ ID NO: 3046718 - RNA, 21 nt, Mycobacterium bovis subsp bovis AF2122/97
cccggcggugugcgcauggug

SEQ ID NO: 3046719 - RNA, 19 nt, Mycobacterium bovis subsp bovis AF2122/97
cccggcgguuggugcagcg

SEQ ID NO: 3046720 - RNA, 20 nt, Mycobacterium bovis subsp bovis AF2122/97
cccggcguauugcaccgcca

SEQ ID NO: 3046721 - RNA, 16 nt, Mycobacterium bovis subsp bovis AF2122/97
cccggcguccgaccgg

SEQ ID NO: 3046722 - RNA, 14 nt, Mycobacterium bovis subsp bovis AF2122/97
cccggcgucgacga

SEQ ID NO: 3046723 - RNA, 15 nt, Mycobacterium bovis subsp bovis AF2122/97
cccggcgucucgcag

SEQ ID NO: 3046724 - RNA, 19 nt, Mycobacterium bovis subsp bovis AF2122/97
cccggcguggugagccucg

SEQ ID NO: 3046725 - RNA, 16 nt, Mycobacterium bovis subsp bovis AF2122/97
cccggcgugucgccgc

SEQ ID NO: 3046726 - RNA, 17 nt, Mycobacterium bovis subsp bovis AF2122/97
cccggcgugucgccgcc

SEQ ID NO: 3046727 - RNA, 21 nt, Mycobacterium bovis subsp bovis AF2122/97
cccggcgugucgccgccacca

SEQ ID NO: 3046728 - RNA, 22 nt, Mycobacterium bovis subsp bovis AF2122/97
cccggcguuguugaccagcacg

SEQ ID NO: 3046729 - RNA, 21 nt, Mycobacterium bovis subsp bovis AF2122/97
cccggcuaggagaucagcacc

SEQ ID NO: 3046730 - RNA, 22 nt, Mycobacterium bovis subsp bovis AF2122/97
cccggcuaggagaucagcaccg

SEQ ID NO: 3046731 - RNA, 14 nt, Mycobacterium bovis subsp bovis AF2122/97
cccggcucacagca

SEQ ID NO: 3046732 - RNA, 23 nt, Mycobacterium bovis subsp bovis AF2122/97
cccggcucacagcacagcgcagc

SEQ ID NO: 3046733 - RNA, 15 nt, Mycobacterium bovis subsp bovis AF2122/97
cccggcuccagcacc

SEQ ID NO: 3046734 - RNA, 21 nt, Mycobacterium bovis subsp bovis AF2122/97
cccggcuccuccccggcccgc

SEQ ID NO: 3046735 - RNA, 12 nt, Mycobacterium bovis subsp bovis AF2122/97
cccggcucggcc

SEQ ID NO: 3046736 - RNA, 14 nt, Mycobacterium bovis subsp bovis AF2122/97
cccggcucggccac

SEQ ID NO: 3046737 - RNA, 15 nt, Mycobacterium bovis subsp bovis AF2122/97
cccggcucggccacc

SEQ ID NO: 3046738 - RNA, 16 nt, Mycobacterium bovis subsp bovis AF2122/97
cccggcucggccaccg

SEQ ID NO: 3046739 - RNA, 18 nt, Mycobacterium bovis subsp bovis AF2122/97
cccggcucggccagccag

SEQ ID NO: 3046740 - RNA, 22 nt, Mycobacterium bovis subsp bovis AF2122/97
cccggcucggccagccagcggg

SEQ ID NO: 3046741 - RNA, 14 nt, Mycobacterium bovis subsp bovis AF2122/97
cccggcucggugcg

SEQ ID NO: 3046742 - RNA, 18 nt, Mycobacterium bovis subsp bovis AF2122/97
cccggcucggugcgccag

SEQ ID NO: 3046743 - RNA, 17 nt, Mycobacterium bovis subsp bovis AF2122/97
cccggcucucuucgcgc

SEQ ID NO: 3046744 - RNA, 21 nt, Mycobacterium bovis subsp bovis AF2122/97
cccggcucucuucgcgcgcug

SEQ ID NO: 3046745 - RNA, 19 nt, Mycobacterium bovis subsp bovis AF2122/97
cccggcugagcgugcggug

SEQ ID NO: 3046746 - RNA, 15 nt, Mycobacterium bovis subsp bovis AF2122/97
cccggcugccagcgc

SEQ ID NO: 3046747 - RNA, 17 nt, Mycobacterium bovis subsp bovis AF2122/97
cccggcugccagcgccg

SEQ ID NO: 3046748 - RNA, 20 nt, Mycobacterium bovis subsp bovis AF2122/97
cccggcugccagcgccgccg

SEQ ID NO: 3046749 - RNA, 21 nt, Mycobacterium bovis subsp bovis AF2122/97
cccggcugccagcgccgccgc

SEQ ID NO: 3046750 - RNA, 14 nt, Mycobacterium bovis subsp bovis AF2122/97
cccggcugggaucg

SEQ ID NO: 3046751 - RNA, 14 nt, Mycobacterium bovis subsp bovis AF2122/97
cccggcuggggccg

SEQ ID NO: 3046752 - RNA, 20 nt, Mycobacterium bovis subsp bovis AF2122/97
cccggcuguucucgccgaag

SEQ ID NO: 3046753 - RNA, 17 nt, Mycobacterium bovis subsp bovis AF2122/97
cccggcuucgccgcgcu

SEQ ID NO: 3046754 - RNA, 18 nt, Mycobacterium bovis subsp bovis AF2122/97
cccggcuuucccaccgcu

SEQ ID NO: 3046755 - RNA, 15 nt, Mycobacterium bovis subsp bovis AF2122/97
cccggcuuuuccggc

SEQ ID NO: 3046756 - RNA, 23 nt, Mycobacterium bovis subsp bovis AF2122/97
cccgggaaauagauucccggcuc

SEQ ID NO: 3046757 - RNA, 20 nt, Mycobacterium bovis subsp bovis AF2122/97
cccgggaccauagccugcgc

SEQ ID NO: 3046758 - RNA, 18 nt, Mycobacterium bovis subsp bovis AF2122/97
cccgggacgaaccggccg

SEQ ID NO: 3046759 - RNA, 20 nt, Mycobacterium bovis subsp bovis AF2122/97
cccgggacguuguccaccgc

SEQ ID NO: 3046760 - RNA, 22 nt, Mycobacterium bovis subsp bovis AF2122/97
cccgggauaguuuucggccgcc

SEQ ID NO: 3046761 - RNA, 23 nt, Mycobacterium bovis subsp bovis AF2122/97
cccgggauaguuuucggccgcca

SEQ ID NO: 3046762 - RNA, 16 nt, Mycobacterium bovis subsp bovis AF2122/97
cccgggaucagcuccu

SEQ ID NO: 3046763 - RNA, 21 nt, Mycobacterium bovis subsp bovis AF2122/97
cccgggaucagcuccuccgac

SEQ ID NO: 3046764 - RNA, 15 nt, Mycobacterium bovis subsp bovis AF2122/97
cccgggaucggggca

SEQ ID NO: 3046765 - RNA, 22 nt, Mycobacterium bovis subsp bovis AF2122/97
cccgggaucuagaugcggaacg

SEQ ID NO: 3046766 - RNA, 16 nt, Mycobacterium bovis subsp bovis AF2122/97
cccgggaugaccaccg

SEQ ID NO: 3046767 - RNA, 14 nt, Mycobacterium bovis subsp bovis AF2122/97
cccgggaugcuccc

SEQ ID NO: 3046768 - RNA, 11 nt, Mycobacterium bovis subsp bovis AF2122/97
cccgggcaccg

SEQ ID NO: 3046769 - RNA, 14 nt, Mycobacterium bovis subsp bovis AF2122/97
cccgggcaccggcc

SEQ ID NO: 3046770 - RNA, 13 nt, Mycobacterium bovis subsp bovis AF2122/97
cccgggcaccguc

SEQ ID NO: 3046771 - RNA, 14 nt, Mycobacterium bovis subsp bovis AF2122/97
cccgggcagcacca

SEQ ID NO: 3046772 - RNA, 15 nt, Mycobacterium bovis subsp bovis AF2122/97
cccgggcagcaccag

SEQ ID NO: 3046773 - RNA, 14 nt, Mycobacterium bovis subsp bovis AF2122/97
cccgggcagccgca

SEQ ID NO: 3046774 - RNA, 14 nt, Mycobacterium bovis subsp bovis AF2122/97
cccgggcagccugc

SEQ ID NO: 3046775 - RNA, 23 nt, Mycobacterium bovis subsp bovis AF2122/97
cccgggcauccuucaccagcugc

SEQ ID NO: 3046776 - RNA, 14 nt, Mycobacterium bovis subsp bovis AF2122/97
cccgggccacgucg

SEQ ID NO: 3046777 - RNA, 14 nt, Mycobacterium bovis subsp bovis AF2122/97
cccgggccaggcug

SEQ ID NO: 3046778 - RNA, 21 nt, Mycobacterium bovis subsp bovis AF2122/97
cccgggccaucgcauccccag

SEQ ID NO: 3046779 - RNA, 16 nt, Mycobacterium bovis subsp bovis AF2122/97
cccgggcccgucgucg

SEQ ID NO: 3046780 - RNA, 13 nt, Mycobacterium bovis subsp bovis AF2122/97
cccgggccgccag

SEQ ID NO: 3046781 - RNA, 17 nt, Mycobacterium bovis subsp bovis AF2122/97
cccggugaugaagcgcg

SEQ ID NO: 3046782 - RNA, 19 nt, Mycobacterium bovis subsp bovis AF2122/97
cccggugaugaccggacgc

SEQ ID NO: 3046783 - RNA, 22 nt, Mycobacterium bovis subsp bovis AF2122/97
cccggugaugaccggacgcuga

SEQ ID NO: 3046784 - RNA, 19 nt, Mycobacterium bovis subsp bovis AF2122/97
cccggugcagaugcggcug

SEQ ID NO: 3046785 - RNA, 20 nt, Mycobacterium bovis subsp bovis AF2122/97
cccggugcccgcggugacga

SEQ ID NO: 3046786 - RNA, 14 nt, Mycobacterium bovis subsp bovis AF2122/97
cccggugccgcagc

SEQ ID NO: 3046787 - RNA, 23 nt, Mycobacterium bovis subsp bovis AF2122/97
cccggugccgcagcaggggacga

SEQ ID NO: 3046788 - RNA, 14 nt, Mycobacterium bovis subsp bovis AF2122/97
cccggugccgcccg

SEQ ID NO: 3046789 - RNA, 15 nt, Mycobacterium bovis subsp bovis AF2122/97
cccggugccgcccgc

SEQ ID NO: 3046790 - RNA, 17 nt, Mycobacterium bovis subsp bovis AF2122/97
cccggugccgcccgcgc

SEQ ID NO: 3046791 - RNA, 21 nt, Mycobacterium bovis subsp bovis AF2122/97
cccggugccguuggagccgcc

SEQ ID NO: 3046792 - RNA, 22 nt, Mycobacterium bovis subsp bovis AF2122/97
cccggugccguuggagccgcca

SEQ ID NO: 3046793 - RNA, 23 nt, Mycobacterium bovis subsp bovis AF2122/97
cccggugccguuggagccgccac

SEQ ID NO: 3046794 - RNA, 18 nt, Mycobacterium bovis subsp bovis AF2122/97
cccggugcuaaccgacgc

SEQ ID NO: 3046795 - RNA, 14 nt, Mycobacterium bovis subsp bovis AF2122/97
cccggugcucaagc

SEQ ID NO: 3046796 - RNA, 16 nt, Mycobacterium bovis subsp bovis AF2122/97
cccgguggacagaauc

SEQ ID NO: 3046797 - RNA, 21 nt, Mycobacterium bovis subsp bovis AF2122/97
cccgguggacagaaucgaccg

SEQ ID NO: 3046798 - RNA, 24 nt, Mycobacterium bovis subsp bovis AF2122/97
cccgguggacagaaucgaccgccg

SEQ ID NO: 3046799 - RNA, 22 nt, Mycobacterium bovis subsp bovis AF2122/97
cccgguggcguggucucgguca

SEQ ID NO: 3046800 - RNA, 18 nt, Mycobacterium bovis subsp bovis AF2122/97
cccggugggcggcucguc

SEQ ID NO: 3046801 - RNA, 14 nt, Mycobacterium bovis subsp bovis AF2122/97
cccgguguccagcc

SEQ ID NO: 3046802 - RNA, 23 nt, Mycobacterium bovis subsp bovis AF2122/97
cccgguguccagccacgcugucc

SEQ ID NO: 3046803 - RNA, 14 nt, Mycobacterium bovis subsp bovis AF2122/97
cccgguguccagug

SEQ ID NO: 3046804 - RNA, 13 nt, Mycobacterium bovis subsp bovis AF2122/97
cccggugucgaug

SEQ ID NO: 3046805 - RNA, 19 nt, Mycobacterium bovis subsp bovis AF2122/97
cccggugucgaugcgcagc

SEQ ID NO: 3046806 - RNA, 17 nt, Mycobacterium bovis subsp bovis AF2122/97
cccggugucgugggcac

SEQ ID NO: 3046807 - RNA, 19 nt, Mycobacterium bovis subsp bovis AF2122/97
cccgguguguauucgccga

SEQ ID NO: 3046808 - RNA, 23 nt, Mycobacterium bovis subsp bovis AF2122/97
cccgguguucaucacgccgccgg

SEQ ID NO: 3046809 - RNA, 19 nt, Mycobacterium bovis subsp bovis AF2122/97
cccgguguuccggucgccc

SEQ ID NO: 3046810 - RNA, 12 nt, Mycobacterium bovis subsp bovis AF2122/97
cccgguguugag

SEQ ID NO: 3046811 - RNA, 21 nt, Mycobacterium bovis subsp bovis AF2122/97
cccgguuagggcacgucgagc

SEQ ID NO: 3046812 - RNA, 15 nt, Mycobacterium bovis subsp bovis AF2122/97
cccgguucagcgcug

SEQ ID NO: 3046813 - RNA, 21 nt, Mycobacterium bovis subsp bovis AF2122/97
cccgguucagcgcuggcaggc

SEQ ID NO: 3046814 - RNA, 18 nt, Mycobacterium bovis subsp bovis AF2122/97
cccgguucgaggaucccg

SEQ ID NO: 3046815 - RNA, 14 nt, Mycobacterium bovis subsp bovis AF2122/97
cccgguucugcgcc

SEQ ID NO: 3046816 - RNA, 12 nt, Mycobacterium bovis subsp bovis AF2122/97
cccgguugacgc

SEQ ID NO: 3046817 - RNA, 21 nt, Mycobacterium bovis subsp bovis AF2122/97
cccgguugacgccgguccccg

SEQ ID NO: 3046818 - RNA, 20 nt, Mycobacterium bovis subsp bovis AF2122/97
cccgguugacucgcuccgac

SEQ ID NO: 3046819 - RNA, 17 nt, Mycobacterium bovis subsp bovis AF2122/97
cccgguuggaccacgug

SEQ ID NO: 3046820 - RNA, 18 nt, Mycobacterium bovis subsp bovis AF2122/97
cccgguugugcgcgcgcc

SEQ ID NO: 3046821 - RNA, 19 nt, Mycobacterium bovis subsp bovis AF2122/97
cccgguugugcgcgcgccc

SEQ ID NO: 3046822 - RNA, 21 nt, Mycobacterium bovis subsp bovis AF2122/97
cccgguuguggaaccacggcg

SEQ ID NO: 3046823 - RNA, 23 nt, Mycobacterium bovis subsp bovis AF2122/97
cccgguuguggaaccacggcgca

SEQ ID NO: 3046824 - RNA, 13 nt, Mycobacterium bovis subsp bovis AF2122/97
cccgguuucgauc

SEQ ID NO: 3046825 - RNA, 17 nt, Mycobacterium bovis subsp bovis AF2122/97
cccguaagcggaugucc

SEQ ID NO: 3046826 - RNA, 14 nt, Mycobacterium bovis subsp bovis AF2122/97
cccguaccagcccg

SEQ ID NO: 3046827 - RNA, 18 nt, Mycobacterium bovis subsp bovis AF2122/97
cccguacccacgacgggc

SEQ ID NO: 3046828 - RNA, 15 nt, Mycobacterium bovis subsp bovis AF2122/97
cccguacgccggcgg

SEQ ID NO: 3046829 - RNA, 18 nt, Mycobacterium bovis subsp bovis AF2122/97
cccguagaccuucgagua

SEQ ID NO: 3046830 - RNA, 14 nt, Mycobacterium bovis subsp bovis AF2122/97
cccguagcaccaca

SEQ ID NO: 3046831 - RNA, 14 nt, Mycobacterium bovis subsp bovis AF2122/97
cccguagccgugcc

SEQ ID NO: 3046832 - RNA, 18 nt, Mycobacterium bovis subsp bovis AF2122/97
cccguagcugcgcagcgc

SEQ ID NO: 3046833 - RNA, 13 nt, Mycobacterium bovis subsp bovis AF2122/97
cccguaggcgccg

SEQ ID NO: 3046834 - RNA, 15 nt, Mycobacterium bovis subsp bovis AF2122/97
cccguaggguggccg

SEQ ID NO: 3046835 - RNA, 18 nt, Mycobacterium bovis subsp bovis AF2122/97
cccguauugaugcugccc

SEQ ID NO: 3046836 - RNA, 20 nt, Mycobacterium bovis subsp bovis AF2122/97
cccguauugccaaagcccga

SEQ ID NO: 3046837 - RNA, 16 nt, Mycobacterium bovis subsp bovis AF2122/97
cccguauuucaccgaa

SEQ ID NO: 3046838 - RNA, 13 nt, Mycobacterium bovis subsp bovis AF2122/97
cccgucaccgccg

SEQ ID NO: 3046839 - RNA, 15 nt, Mycobacterium bovis subsp bovis AF2122/97
cccgucaccgcgggc

SEQ ID NO: 3046840 - RNA, 13 nt, Mycobacterium bovis subsp bovis AF2122/97
cccgucacgcccg

SEQ ID NO: 3046841 - RNA, 14 nt, Mycobacterium bovis subsp bovis AF2122/97
cccgucacgcccgc

SEQ ID NO: 3046842 - RNA, 22 nt, Mycobacterium bovis subsp bovis AF2122/97
cccgucacgcccgcgaaccgcg

SEQ ID NO: 3046843 - RNA, 13 nt, Mycobacterium bovis subsp bovis AF2122/97
cccgucacucacc

SEQ ID NO: 3046844 - RNA, 19 nt, Mycobacterium bovis subsp bovis AF2122/97
cccgucacucaccccaaca

SEQ ID NO: 3046845 - RNA, 19 nt, Mycobacterium bovis subsp bovis AF2122/97
cccgucauacucgacaccg

SEQ ID NO: 3046846 - RNA, 20 nt, Mycobacterium bovis subsp bovis AF2122/97
cccgucaugcccaccgccug

SEQ ID NO: 3046847 - RNA, 18 nt, Mycobacterium bovis subsp bovis AF2122/97
cccguccaacuacgccag

SEQ ID NO: 3046848 - RNA, 22 nt, Mycobacterium bovis subsp bovis AF2122/97
cccguccaacuacgccagccgc

SEQ ID NO: 3046849 - RNA, 14 nt, Mycobacterium bovis subsp bovis AF2122/97
cccguccaggcccg

SEQ ID NO: 3046850 - RNA, 22 nt, Mycobacterium bovis subsp bovis AF2122/97
cccgucccagcugaccagcguc

SEQ ID NO: 3046851 - RNA, 12 nt, Mycobacterium bovis subsp bovis AF2122/97
cccgucccccgc

SEQ ID NO: 3046852 - RNA, 12 nt, Mycobacterium bovis subsp bovis AF2122/97
cccguccgccgc

SEQ ID NO: 3046853 - RNA, 13 nt, Mycobacterium bovis subsp bovis AF2122/97
cccguccgcgccc

SEQ ID NO: 3046854 - RNA, 19 nt, Mycobacterium bovis subsp bovis AF2122/97
cccguccgcgcccaccggc

SEQ ID NO: 3046855 - RNA, 15 nt, Mycobacterium bovis subsp bovis AF2122/97
cccguccgcgcgccg

SEQ ID NO: 3046856 - RNA, 23 nt, Mycobacterium bovis subsp bovis AF2122/97
cccgucgaacgcgcgcguggucg

SEQ ID NO: 3046857 - RNA, 16 nt, Mycobacterium bovis subsp bovis AF2122/97
cccgucgacgagcgcc

SEQ ID NO: 3046858 - RNA, 15 nt, Mycobacterium bovis subsp bovis AF2122/97
cccgucgagccgugc

SEQ ID NO: 3046859 - RNA, 18 nt, Mycobacterium bovis subsp bovis AF2122/97
cccgucgaguagguaacg

SEQ ID NO: 3046860 - RNA, 21 nt, Mycobacterium bovis subsp bovis AF2122/97
cccgucgaucagaacgugacg

SEQ ID NO: 3046861 - RNA, 19 nt, Mycobacterium bovis subsp bovis AF2122/97
cccgucgaucagcggcagc

SEQ ID NO: 3046862 - RNA, 18 nt, Mycobacterium bovis subsp bovis AF2122/97
cccgucgccaaucugcgc

SEQ ID NO: 3046863 - RNA, 14 nt, Mycobacterium bovis subsp bovis AF2122/97
cccgucgccagggc

SEQ ID NO: 3046864 - RNA, 16 nt, Mycobacterium bovis subsp bovis AF2122/97
cccgucgccgaucaac

SEQ ID NO: 3046865 - RNA, 23 nt, Mycobacterium bovis subsp bovis AF2122/97
cccgucgccgaucaacagcaccg

SEQ ID NO: 3046866 - RNA, 12 nt, Mycobacterium bovis subsp bovis AF2122/97
cccgucgccgcc

SEQ ID NO: 3046867 - RNA, 19 nt, Mycobacterium bovis subsp bovis AF2122/97
cccgucgccgcccgugccg

SEQ ID NO: 3046868 - RNA, 20 nt, Mycobacterium bovis subsp bovis AF2122/97
cccgucgccgcccgugccgc

SEQ ID NO: 3046869 - RNA, 13 nt, Mycobacterium bovis subsp bovis AF2122/97
cccgucgcggccg

SEQ ID NO: 3046870 - RNA, 15 nt, Mycobacterium bovis subsp bovis AF2122/97
cccgucgcggccggc

SEQ ID NO: 3046871 - RNA, 14 nt, Mycobacterium bovis subsp bovis AF2122/97
cccgucgcuggccg

SEQ ID NO: 3046872 - RNA, 12 nt, Mycobacterium bovis subsp bovis AF2122/97
cccgucggcgcc

SEQ ID NO: 3046873 - RNA, 13 nt, Mycobacterium bovis subsp bovis AF2122/97
cccgucggcgccg

SEQ ID NO: 3046874 - RNA, 14 nt, Mycobacterium bovis subsp bovis AF2122/97
cccgucggcggcgu

SEQ ID NO: 3046875 - RNA, 19 nt, Mycobacterium bovis subsp bovis AF2122/97
cccgucgggcacaccgacg

SEQ ID NO: 3046876 - RNA, 13 nt, Mycobacterium bovis subsp bovis AF2122/97
cccgucgguggug

SEQ ID NO: 3046877 - RNA, 22 nt, Mycobacterium bovis subsp bovis AF2122/97
cccgucgucggcaaccaaccgc

SEQ ID NO: 3046878 - RNA, 12 nt, Mycobacterium bovis subsp bovis AF2122/97
cccgucgucguc

SEQ ID NO: 3046879 - RNA, 13 nt, Mycobacterium bovis subsp bovis AF2122/97
cccgucgugaccg

SEQ ID NO: 3046880 - RNA, 16 nt, Mycobacterium bovis subsp bovis AF2122/97
cccgucuccagcacca

SEQ ID NO: 3046881 - RNA, 16 nt, Mycobacterium bovis subsp bovis AF2122/97
cccgucucguugacca

SEQ ID NO: 3046882 - RNA, 21 nt, Mycobacterium bovis subsp bovis AF2122/97
cccgucugcgugggccugcgc

SEQ ID NO: 3046883 - RNA, 12 nt, Mycobacterium bovis subsp bovis AF2122/97
cccgucuuccag

SEQ ID NO: 3046884 - RNA, 18 nt, Mycobacterium bovis subsp bovis AF2122/97
cccgugacauucugcagc

SEQ ID NO: 3046885 - RNA, 17 nt, Mycobacterium bovis subsp bovis AF2122/97
cccgugauccgccgaca

SEQ ID NO: 3046886 - RNA, 21 nt, Mycobacterium bovis subsp bovis AF2122/97
cccgugauccgccgacagccc

SEQ ID NO: 3046887 - RNA, 15 nt, Mycobacterium bovis subsp bovis AF2122/97
cccgugcacgaucgc

SEQ ID NO: 3046888 - RNA, 18 nt, Mycobacterium bovis subsp bovis AF2122/97
cccgugcacgaucgcggu

SEQ ID NO: 3046889 - RNA, 14 nt, Mycobacterium bovis subsp bovis AF2122/97
cccgugccgcccgc

SEQ ID NO: 3046890 - RNA, 13 nt, Mycobacterium bovis subsp bovis AF2122/97
cccgugccuggcc

SEQ ID NO: 3046891 - RNA, 13 nt, Mycobacterium bovis subsp bovis AF2122/97
cccgugcgcgcgc

SEQ ID NO: 3046892 - RNA, 14 nt, Mycobacterium bovis subsp bovis AF2122/97
cccgugcgcgcgca

SEQ ID NO: 3046893 - RNA, 18 nt, Mycobacterium bovis subsp bovis AF2122/97
cccgugcgcgcgcagcug

SEQ ID NO: 3046894 - RNA, 19 nt, Mycobacterium bovis subsp bovis AF2122/97
cccgugcggcucgccggcg

SEQ ID NO: 3046895 - RNA, 17 nt, Mycobacterium bovis subsp bovis AF2122/97
cccgugcuggcgccgaa

SEQ ID NO: 3046896 - RNA, 21 nt, Mycobacterium bovis subsp bovis AF2122/97
cccgugcuuuccuugcgcgcc

SEQ ID NO: 3046897 - RNA, 22 nt, Mycobacterium bovis subsp bovis AF2122/97
cccgugcuuuccuugcgcgcca

SEQ ID NO: 3046898 - RNA, 20 nt, Mycobacterium bovis subsp bovis AF2122/97
cccguggcgaauucgaccac

SEQ ID NO: 3046899 - RNA, 21 nt, Mycobacterium bovis subsp bovis AF2122/97
cccgugggccucgaucagcgc

SEQ ID NO: 3046900 - RNA, 17 nt, Mycobacterium bovis subsp bovis AF2122/97
cccguguucgccacacc

SEQ ID NO: 3046901 - RNA, 17 nt, Mycobacterium bovis subsp bovis AF2122/97
cccguuaugcgccgccc

SEQ ID NO: 3046902 - RNA, 14 nt, Mycobacterium bovis subsp bovis AF2122/97
cccguuccacgauc

SEQ ID NO: 3046903 - RNA, 14 nt, Mycobacterium bovis subsp bovis AF2122/97
cccguuccacgccg

SEQ ID NO: 3046904 - RNA, 16 nt, Mycobacterium bovis subsp bovis AF2122/97
cccguuccacgccggc

SEQ ID NO: 3046905 - RNA, 22 nt, Mycobacterium bovis subsp bovis AF2122/97
cccguucggggccccgcggcgc

SEQ ID NO: 3046906 - RNA, 20 nt, Mycobacterium bovis subsp bovis AF2122/97
cccguugaagacggccaccg

SEQ ID NO: 3046907 - RNA, 22 nt, Mycobacterium bovis subsp bovis AF2122/97
cccguugagauaccccgagacc

SEQ ID NO: 3046908 - RNA, 18 nt, Mycobacterium bovis subsp bovis AF2122/97
cccguugagcagcaccca

SEQ ID NO: 3046909 - RNA, 23 nt, Mycobacterium bovis subsp bovis AF2122/97
cccguugaucgcggacacugcga

SEQ ID NO: 3046910 - RNA, 13 nt, Mycobacterium bovis subsp bovis AF2122/97
cccguugcaggug

SEQ ID NO: 3046911 - RNA, 17 nt, Mycobacterium bovis subsp bovis AF2122/97
cccguugccgccguugc

SEQ ID NO: 3046912 - RNA, 22 nt, Mycobacterium bovis subsp bovis AF2122/97
cccguugccgccugucccgccg

SEQ ID NO: 3046913 - RNA, 23 nt, Mycobacterium bovis subsp bovis AF2122/97
cccguugguagccggugaccgcg

SEQ ID NO: 3046914 - RNA, 11 nt, Mycobacterium bovis subsp bovis AF2122/97
cccguugucga

SEQ ID NO: 3046915 - RNA, 18 nt, Mycobacterium bovis subsp bovis AF2122/97
cccguugucgaccgaaac

SEQ ID NO: 3046916 - RNA, 12 nt, Mycobacterium bovis subsp bovis AF2122/97
cccuagcagcaa

SEQ ID NO: 3046917 - RNA, 12 nt, Mycobacterium bovis subsp bovis AF2122/97
cccuagccggcg

SEQ ID NO: 3046918 - RNA, 16 nt, Mycobacterium bovis subsp bovis AF2122/97
cccuagccggcgcgcc

SEQ ID NO: 3046919 - RNA, 13 nt, Mycobacterium bovis subsp bovis AF2122/97
cccuauacgcaac

SEQ ID NO: 3046920 - RNA, 18 nt, Mycobacterium bovis subsp bovis AF2122/97
cccucaacgucccagccc

SEQ ID NO: 3046921 - RNA, 22 nt, Mycobacterium bovis subsp bovis AF2122/97
cccucaaggucuuuagccgccg

SEQ ID NO: 3046922 - RNA, 12 nt, Mycobacterium bovis subsp bovis AF2122/97
cccucaccgccu

SEQ ID NO: 3046923 - RNA, 22 nt, Mycobacterium bovis subsp bovis AF2122/97
cccucaccgcgagggcgcgugu

SEQ ID NO: 3046924 - RNA, 21 nt, Mycobacterium bovis subsp bovis AF2122/97
cccucacguggacugaccucg

SEQ ID NO: 3046925 - RNA, 14 nt, Mycobacterium bovis subsp bovis AF2122/97
cccucagcaccgcu

SEQ ID NO: 3046926 - RNA, 19 nt, Mycobacterium bovis subsp bovis AF2122/97
cccucagccgcgccggguc

SEQ ID NO: 3046927 - RNA, 18 nt, Mycobacterium bovis subsp bovis AF2122/97
cccucagccgcggccaca

SEQ ID NO: 3046928 - RNA, 18 nt, Mycobacterium bovis subsp bovis AF2122/97
cccucagcuagcgcgggc

SEQ ID NO: 3046929 - RNA, 20 nt, Mycobacterium bovis subsp bovis AF2122/97
cccucaguguacaccgcgcc

SEQ ID NO: 3046930 - RNA, 21 nt, Mycobacterium bovis subsp bovis AF2122/97
cccucaguguacaccgcgccc

SEQ ID NO: 3046931 - RNA, 14 nt, Mycobacterium bovis subsp bovis AF2122/97
cccucaguucacgu

SEQ ID NO: 3046932 - RNA, 18 nt, Mycobacterium bovis subsp bovis AF2122/97
cccucaguucacguucgg

SEQ ID NO: 3046933 - RNA, 20 nt, Mycobacterium bovis subsp bovis AF2122/97
cccucaguucacguucggcg

SEQ ID NO: 3046934 - RNA, 17 nt, Mycobacterium bovis subsp bovis AF2122/97
cccucaugucgggcaac

SEQ ID NO: 3046935 - RNA, 15 nt, Mycobacterium bovis subsp bovis AF2122/97
cccuccacagcggcc

SEQ ID NO: 3046936 - RNA, 18 nt, Mycobacterium bovis subsp bovis AF2122/97
cccuccagauaccaccgc

SEQ ID NO: 3046937 - RNA, 19 nt, Mycobacterium bovis subsp bovis AF2122/97
cccuccagauaccaccgcc

SEQ ID NO: 3046938 - RNA, 21 nt, Mycobacterium bovis subsp bovis AF2122/97
cccuccagauaccaccgccgc

SEQ ID NO: 3046939 - RNA, 14 nt, Mycobacterium bovis subsp bovis AF2122/97
cccuccagcacgcc

SEQ ID NO: 3046940 - RNA, 20 nt, Mycobacterium bovis subsp bovis AF2122/97
cccuccagggcccugcuggc

SEQ ID NO: 3046941 - RNA, 13 nt, Mycobacterium bovis subsp bovis AF2122/97
cccucccaccagc

SEQ ID NO: 3046942 - RNA, 16 nt, Mycobacterium bovis subsp bovis AF2122/97
cccucccaccagcggc

SEQ ID NO: 3046943 - RNA, 15 nt, Mycobacterium bovis subsp bovis AF2122/97
cccucccuggggccg

SEQ ID NO: 3046944 - RNA, 23 nt, Mycobacterium bovis subsp bovis AF2122/97
cccuccgagcacaggaucaccca

SEQ ID NO: 3046945 - RNA, 12 nt, Mycobacterium bovis subsp bovis AF2122/97
cccuccgcagcu

SEQ ID NO: 3046946 - RNA, 19 nt, Mycobacterium bovis subsp bovis AF2122/97
cccuccgcgccgaucagcg

SEQ ID NO: 3046947 - RNA, 14 nt, Mycobacterium bovis subsp bovis AF2122/97
cccuccggcgcagc

SEQ ID NO: 3046948 - RNA, 20 nt, Mycobacterium bovis subsp bovis AF2122/97
cccuccgggcccaucgcccg

SEQ ID NO: 3046949 - RNA, 16 nt, Mycobacterium bovis subsp bovis AF2122/97
cccuccgggcgcacca

SEQ ID NO: 3046950 - RNA, 19 nt, Mycobacterium bovis subsp bovis AF2122/97
cccuccggguauggcggcg

SEQ ID NO: 3046951 - RNA, 16 nt, Mycobacterium bovis subsp bovis AF2122/97
cccuccucgaccgcgg

SEQ ID NO: 3046952 - RNA, 12 nt, Mycobacterium bovis subsp bovis AF2122/97
cccuccucgaug

SEQ ID NO: 3046953 - RNA, 18 nt, Mycobacterium bovis subsp bovis AF2122/97
cccucgaauucggccggc

SEQ ID NO: 3046954 - RNA, 20 nt, Mycobacterium bovis subsp bovis AF2122/97
cccuggccgccggccccgcc

SEQ ID NO: 3046955 - RNA, 23 nt, Mycobacterium bovis subsp bovis AF2122/97
cccuggccgccggccccgccguu

SEQ ID NO: 3046956 - RNA, 14 nt, Mycobacterium bovis subsp bovis AF2122/97
cccuggccgcgccg

SEQ ID NO: 3046957 - RNA, 22 nt, Mycobacterium bovis subsp bovis AF2122/97
cccuggccgucccaccagccga

SEQ ID NO: 3046958 - RNA, 16 nt, Mycobacterium bovis subsp bovis AF2122/97
cccuggcgaccagccg

SEQ ID NO: 3046959 - RNA, 14 nt, Mycobacterium bovis subsp bovis AF2122/97
cccuggcgauuucg

SEQ ID NO: 3046960 - RNA, 14 nt, Mycobacterium bovis subsp bovis AF2122/97
cccuggcgugugug

SEQ ID NO: 3046961 - RNA, 22 nt, Mycobacterium bovis subsp bovis AF2122/97
cccuggcgugugugcgccuccg

SEQ ID NO: 3046962 - RNA, 21 nt, Mycobacterium bovis subsp bovis AF2122/97
cccugggcaaacugggcaccg

SEQ ID NO: 3046963 - RNA, 22 nt, Mycobacterium bovis subsp bovis AF2122/97
cccugggcccuuugcugucccc

SEQ ID NO: 3046964 - RNA, 15 nt, Mycobacterium bovis subsp bovis AF2122/97
cccugggcgccggcg

SEQ ID NO: 3046965 - RNA, 23 nt, Mycobacterium bovis subsp bovis AF2122/97
cccugggcgucgaccacgcaagg

SEQ ID NO: 3046966 - RNA, 16 nt, Mycobacterium bovis subsp bovis AF2122/97
cccuggggguggcagc

SEQ ID NO: 3046967 - RNA, 23 nt, Mycobacterium bovis subsp bovis AF2122/97
cccuggggguggcagcgcggccg

SEQ ID NO: 3046968 - RNA, 14 nt, Mycobacterium bovis subsp bovis AF2122/97
cccugggguccagc

SEQ ID NO: 3046969 - RNA, 21 nt, Mycobacterium bovis subsp bovis AF2122/97
cccugggguugcaucaugccg

SEQ ID NO: 3046970 - RNA, 14 nt, Mycobacterium bovis subsp bovis AF2122/97
cccugguccacccg

SEQ ID NO: 3046971 - RNA, 21 nt, Mycobacterium bovis subsp bovis AF2122/97
cccugguggucagucaccaac

SEQ ID NO: 3046972 - RNA, 14 nt, Mycobacterium bovis subsp bovis AF2122/97
cccuggugucgauc

SEQ ID NO: 3046973 - RNA, 15 nt, Mycobacterium bovis subsp bovis AF2122/97
cccugucaacgccgc

SEQ ID NO: 3046974 - RNA, 13 nt, Mycobacterium bovis subsp bovis AF2122/97
cccugucgcgcac

SEQ ID NO: 3046975 - RNA, 15 nt, Mycobacterium bovis subsp bovis AF2122/97
cccugucgcgcaccg

SEQ ID NO: 3046976 - RNA, 18 nt, Mycobacterium bovis subsp bovis AF2122/97
cccugucgggucgagucc

SEQ ID NO: 3046977 - RNA, 22 nt, Mycobacterium bovis subsp bovis AF2122/97
cccugugccagcagcagcgccg

SEQ ID NO: 3046978 - RNA, 16 nt, Mycobacterium bovis subsp bovis AF2122/97
cccugugucgccgucg

SEQ ID NO: 3046979 - RNA, 22 nt, Mycobacterium bovis subsp bovis AF2122/97
cccugugucgccgucgcggcac

SEQ ID NO: 3046980 - RNA, 23 nt, Mycobacterium bovis subsp bovis AF2122/97
cccuguucggcccuauggguucc

SEQ ID NO: 3046981 - RNA, 21 nt, Mycobacterium bovis subsp bovis AF2122/97
cccuguucuccgugaucgagg

SEQ ID NO: 3046982 - RNA, 20 nt, Mycobacterium bovis subsp bovis AF2122/97
cccuguugccccuccagggg

SEQ ID NO: 3046983 - RNA, 17 nt, Mycobacterium bovis subsp bovis AF2122/97
cccuguuguugucggug

SEQ ID NO: 3046984 - RNA, 22 nt, Mycobacterium bovis subsp bovis AF2122/97
cccuguuguugucggugucggu

SEQ ID NO: 3046985 - RNA, 16 nt, Mycobacterium bovis subsp bovis AF2122/97
cccuucaaagcggccu

SEQ ID NO: 3046986 - RNA, 23 nt, Mycobacterium bovis subsp bovis AF2122/97
cccuucaaagcggccucgaccuc

SEQ ID NO: 3046987 - RNA, 15 nt, Mycobacterium bovis subsp bovis AF2122/97
cccuucaccagccac

SEQ ID NO: 3046988 - RNA, 20 nt, Mycobacterium bovis subsp bovis AF2122/97
cccuucgcgagcagacgcgg

SEQ ID NO: 3046989 - RNA, 14 nt, Mycobacterium bovis subsp bovis AF2122/97
cccuugaccaugug

SEQ ID NO: 3046990 - RNA, 16 nt, Mycobacterium bovis subsp bovis AF2122/97
cccuugacggugagau

SEQ ID NO: 3046991 - RNA, 18 nt, Mycobacterium bovis subsp bovis AF2122/97
cccuugacggugagaucg

SEQ ID NO: 3046992 - RNA, 16 nt, Mycobacterium bovis subsp bovis AF2122/97
cccuugccgccuuggc

SEQ ID NO: 3046993 - RNA, 18 nt, Mycobacterium bovis subsp bovis AF2122/97
cccuugccgccuuggccc

SEQ ID NO: 3046994 - RNA, 12 nt, Mycobacterium bovis subsp bovis AF2122/97
cccuugccgucc

SEQ ID NO: 3046995 - RNA, 19 nt, Mycobacterium bovis subsp bovis AF2122/97
cccuugcucguccaggucg

SEQ ID NO: 3046996 - RNA, 16 nt, Mycobacterium bovis subsp bovis AF2122/97
cccuugguggccagcc

SEQ ID NO: 3046997 - RNA, 17 nt, Mycobacterium bovis subsp bovis AF2122/97
cccuugguggccagcca

SEQ ID NO: 3046998 - RNA, 23 nt, Mycobacterium bovis subsp bovis AF2122/97
cccuugugaacggugucaacggc

SEQ ID NO: 3046999 - RNA, 14 nt, Mycobacterium bovis subsp bovis AF2122/97
cccuuuacaccccc

SEQ ID NO: 3047000 - RNA, 14 nt, Mycobacterium bovis subsp bovis AF2122/97
cccuuucgcgccgc

SEQ ID NO: 3047001 - RNA, 17 nt, Mycobacterium bovis subsp bovis AF2122/97
cccuuugcacgguggca

SEQ ID NO: 3047002 - RNA, 18 nt, Mycobacterium bovis subsp bovis AF2122/97
cccuuugcuguccccgcc

SEQ ID NO: 3047003 - RNA, 20 nt, Mycobacterium bovis subsp bovis AF2122/97
cccuuuggguagcaaacccc

SEQ ID NO: 3047004 - RNA, 16 nt, Mycobacterium bovis subsp bovis AF2122/97
cccuuuguggggccgg

SEQ ID NO: 3047005 - RNA, 17 nt, Mycobacterium bovis subsp bovis AF2122/97
ccgaaaaacaccagcga

SEQ ID NO: 3047006 - RNA, 15 nt, Mycobacterium bovis subsp bovis AF2122/97
ccgaaaaacgacccc

SEQ ID NO: 3047007 - RNA, 23 nt, Mycobacterium bovis subsp bovis AF2122/97
ccgaaaaccucgccccaccggcc

SEQ ID NO: 3047008 - RNA, 18 nt, Mycobacterium bovis subsp bovis AF2122/97
ccgaaaaguccgccgccu

SEQ ID NO: 3047009 - RNA, 16 nt, Mycobacterium bovis subsp bovis AF2122/97
ccgaaaccaugccgcc

SEQ ID NO: 3047010 - RNA, 23 nt, Mycobacterium bovis subsp bovis AF2122/97
ccgaaaccaugccgccgaagccg

SEQ ID NO: 3047011 - RNA, 11 nt, Mycobacterium bovis subsp bovis AF2122/97
ccgaaacccga

SEQ ID NO: 3047012 - RNA, 20 nt, Mycobacterium bovis subsp bovis AF2122/97
ccgaaacgccgaccgcgccg

SEQ ID NO: 3047013 - RNA, 12 nt, Mycobacterium bovis subsp bovis AF2122/97
ccgaaacgccgg

SEQ ID NO: 3047014 - RNA, 17 nt, Mycobacterium bovis subsp bovis AF2122/97
ccgaaacggggcgacgu

SEQ ID NO: 3047015 - RNA, 15 nt, Mycobacterium bovis subsp bovis AF2122/97
ccgaaacucgacgug

SEQ ID NO: 3047016 - RNA, 13 nt, Mycobacterium bovis subsp bovis AF2122/97
ccgaaagccaggc

SEQ ID NO: 3047017 - RNA, 13 nt, Mycobacterium bovis subsp bovis AF2122/97
ccgaaagccucuc

SEQ ID NO: 3047018 - RNA, 14 nt, Mycobacterium bovis subsp bovis AF2122/97
ccgaaauacccagc

SEQ ID NO: 3047019 - RNA, 20 nt, Mycobacterium bovis subsp bovis AF2122/97
ccgaaaucaguugcgcucca

SEQ ID NO: 3047020 - RNA, 23 nt, Mycobacterium bovis subsp bovis AF2122/97
ccgaaaucaguugcgcuccaaca

SEQ ID NO: 3047021 - RNA, 21 nt, Mycobacterium bovis subsp bovis AF2122/97
ccgaaaugccgggcccgacgu

SEQ ID NO: 3047022 - RNA, 18 nt, Mycobacterium bovis subsp bovis AF2122/97
ccgaacaacaucacugcc

SEQ ID NO: 3047023 - RNA, 20 nt, Mycobacterium bovis subsp bovis AF2122/97
ccgaacaacaucacugccuu

SEQ ID NO: 3047024 - RNA, 20 nt, Mycobacterium bovis subsp bovis AF2122/97
ccgaacaauuucugcagccc

SEQ ID NO: 3047025 - RNA, 15 nt, Mycobacterium bovis subsp bovis AF2122/97
ccgaacaccacaccg

SEQ ID NO: 3047026 - RNA, 11 nt, Mycobacterium bovis subsp bovis AF2122/97
ccgaacaccga

SEQ ID NO: 3047027 - RNA, 13 nt, Mycobacterium bovis subsp bovis AF2122/97
ccgaacaccgccg

SEQ ID NO: 3047028 - RNA, 11 nt, Mycobacterium bovis subsp bovis AF2122/97
ccgaacaccgu

SEQ ID NO: 3047029 - RNA, 15 nt, Mycobacterium bovis subsp bovis AF2122/97
ccgaacaccgucagc

SEQ ID NO: 3047030 - RNA, 18 nt, Mycobacterium bovis subsp bovis AF2122/97
ccgaacaccucggcacgg

SEQ ID NO: 3047031 - RNA, 19 nt, Mycobacterium bovis subsp bovis AF2122/97
ccgaacaccucggcacgga

SEQ ID NO: 3047032 - RNA, 18 nt, Mycobacterium bovis subsp bovis AF2122/97
ccgaacacuuugcgcacu

SEQ ID NO: 3047033 - RNA, 19 nt, Mycobacterium bovis subsp bovis AF2122/97
ccgaacagcgaaccgccgg

SEQ ID NO: 3047034 - RNA, 15 nt, Mycobacterium bovis subsp bovis AF2122/97
ccgaacagcggcagc

SEQ ID NO: 3047035 - RNA, 12 nt, Mycobacterium bovis subsp bovis AF2122/97
ccgaacagcugc

SEQ ID NO: 3047036 - RNA, 15 nt, Mycobacterium bovis subsp bovis AF2122/97
ccgaacagcugcccg

SEQ ID NO: 3047037 - RNA, 17 nt, Mycobacterium bovis subsp bovis AF2122/97
ccgaacagcugcccgcc

SEQ ID NO: 3047038 - RNA, 21 nt, Mycobacterium bovis subsp bovis AF2122/97
ccgaacagcugcccgccagcg

SEQ ID NO: 3047039 - RNA, 22 nt, Mycobacterium bovis subsp bovis AF2122/97
ccgaacagcugcccgccagcgc

SEQ ID NO: 3047040 - RNA, 21 nt, Mycobacterium bovis subsp bovis AF2122/97
ccgaaguagaagcccaggacg

SEQ ID NO: 3047041 - RNA, 21 nt, Mycobacterium bovis subsp bovis AF2122/97
ccgaaguagccgaccggcagc

SEQ ID NO: 3047042 - RNA, 13 nt, Mycobacterium bovis subsp bovis AF2122/97
ccgaaguccacgc

SEQ ID NO: 3047043 - RNA, 22 nt, Mycobacterium bovis subsp bovis AF2122/97
ccgaaguccacgcaccacgagc

SEQ ID NO: 3047044 - RNA, 17 nt, Mycobacterium bovis subsp bovis AF2122/97
ccgaaguggugaccgac

SEQ ID NO: 3047045 - RNA, 12 nt, Mycobacterium bovis subsp bovis AF2122/97
ccgaaguugaag

SEQ ID NO: 3047046 - RNA, 19 nt, Mycobacterium bovis subsp bovis AF2122/97
ccgaaguuuuggaagcccg

SEQ ID NO: 3047047 - RNA, 17 nt, Mycobacterium bovis subsp bovis AF2122/97
ccgaauaccgccgcgca

SEQ ID NO: 3047048 - RNA, 17 nt, Mycobacterium bovis subsp bovis AF2122/97
ccgaaucagcacggugu

SEQ ID NO: 3047049 - RNA, 14 nt, Mycobacterium bovis subsp bovis AF2122/97
ccgaauccaccagc

SEQ ID NO: 3047050 - RNA, 14 nt, Mycobacterium bovis subsp bovis AF2122/97
ccgaauccaucgag

SEQ ID NO: 3047051 - RNA, 17 nt, Mycobacterium bovis subsp bovis AF2122/97
ccgaaucggcaccgugc

SEQ ID NO: 3047052 - RNA, 16 nt, Mycobacterium bovis subsp bovis AF2122/97
ccgaaucgggucggcc

SEQ ID NO: 3047053 - RNA, 14 nt, Mycobacterium bovis subsp bovis AF2122/97
ccgaaucucaccgu

SEQ ID NO: 3047054 - RNA, 17 nt, Mycobacterium bovis subsp bovis AF2122/97
ccgaaugcacgacggug

SEQ ID NO: 3047055 - RNA, 18 nt, Mycobacterium bovis subsp bovis AF2122/97
ccgaaugccaccucgacg

SEQ ID NO: 3047056 - RNA, 15 nt, Mycobacterium bovis subsp bovis AF2122/97
ccgaauggccgaucc

SEQ ID NO: 3047057 - RNA, 12 nt, Mycobacterium bovis subsp bovis AF2122/97
ccgaauggccgc

SEQ ID NO: 3047058 - RNA, 13 nt, Mycobacterium bovis subsp bovis AF2122/97
ccgaauggccgcc

SEQ ID NO: 3047059 - RNA, 14 nt, Mycobacterium bovis subsp bovis AF2122/97
ccgaauggccgccg

SEQ ID NO: 3047060 - RNA, 15 nt, Mycobacterium bovis subsp bovis AF2122/97
ccgaauggccgccgc

SEQ ID NO: 3047061 - RNA, 17 nt, Mycobacterium bovis subsp bovis AF2122/97
ccgaauggccgccgcag

SEQ ID NO: 3047062 - RNA, 18 nt, Mycobacterium bovis subsp bovis AF2122/97
ccgaauuacgcaccgagg

SEQ ID NO: 3047063 - RNA, 17 nt, Mycobacterium bovis subsp bovis AF2122/97
ccgaauuugucggcgaa

SEQ ID NO: 3047064 - RNA, 17 nt, Mycobacterium bovis subsp bovis AF2122/97
ccgacaaccccgccagg

SEQ ID NO: 3047065 - RNA, 18 nt, Mycobacterium bovis subsp bovis AF2122/97
ccgacaacccggccgggc

SEQ ID NO: 3047066 - RNA, 19 nt, Mycobacterium bovis subsp bovis AF2122/97
ccgacaacccggccgggcc

SEQ ID NO: 3047067 - RNA, 15 nt, Mycobacterium bovis subsp bovis AF2122/97
ccgacaaccuuggcg

SEQ ID NO: 3047068 - RNA, 18 nt, Mycobacterium bovis subsp bovis AF2122/97
ccgacaaccuuggcgacu

SEQ ID NO: 3047069 - RNA, 19 nt, Mycobacterium bovis subsp bovis AF2122/97
ccgacaacgacgucgccga

SEQ ID NO: 3047070 - RNA, 24 nt, Mycobacterium bovis subsp bovis AF2122/97
ccgacaacgacgucgccgacccgg

SEQ ID NO: 3047071 - RNA, 21 nt, Mycobacterium bovis subsp bovis AF2122/97
ccgacaacgcugggcggcuac

SEQ ID NO: 3047072 - RNA, 19 nt, Mycobacterium bovis subsp bovis AF2122/97
ccgacaacuguccugccag

SEQ ID NO: 3047073 - RNA, 20 nt, Mycobacterium bovis subsp bovis AF2122/97
ccgacaacuguccugccaga

SEQ ID NO: 3047074 - RNA, 19 nt, Mycobacterium bovis subsp bovis AF2122/97
ccgacaagcugucggcgac

SEQ ID NO: 3047075 - RNA, 16 nt, Mycobacterium bovis subsp bovis AF2122/97
ccgacaaucaccaacg

SEQ ID NO: 3047076 - RNA, 21 nt, Mycobacterium bovis subsp bovis AF2122/97
ccgacaauggcgccagccgac

SEQ ID NO: 3047077 - RNA, 17 nt, Mycobacterium bovis subsp bovis AF2122/97
ccgacaaugucggcgau

SEQ ID NO: 3047078 - RNA, 19 nt, Mycobacterium bovis subsp bovis AF2122/97
ccgacaaugucggcgaugc

SEQ ID NO: 3047079 - RNA, 22 nt, Mycobacterium bovis subsp bovis AF2122/97
ccgacaccaccagguccacccc

SEQ ID NO: 3047080 - RNA, 20 nt, Mycobacterium bovis subsp bovis AF2122/97
ccgacaccaccggcgccgcc

SEQ ID NO: 3047081 - RNA, 18 nt, Mycobacterium bovis subsp bovis AF2122/97
ccgacaccacggaccagc

SEQ ID NO: 3047082 - RNA, 22 nt, Mycobacterium bovis subsp bovis AF2122/97
ccgacaccacggaccagcgccg

SEQ ID NO: 3047083 - RNA, 14 nt, Mycobacterium bovis subsp bovis AF2122/97
ccgacacccucggg

SEQ ID NO: 3047084 - RNA, 22 nt, Mycobacterium bovis subsp bovis AF2122/97
ccgacacccucgggcaacucgg

SEQ ID NO: 3047085 - RNA, 18 nt, Mycobacterium bovis subsp bovis AF2122/97
ccgacaccgaucggacgu

SEQ ID NO: 3047086 - RNA, 13 nt, Mycobacterium bovis subsp bovis AF2122/97
ccgacaccgccac

SEQ ID NO: 3047087 - RNA, 23 nt, Mycobacterium bovis subsp bovis AF2122/97
ccgacaccgccccgccgcgacgg

SEQ ID NO: 3047088 - RNA, 14 nt, Mycobacterium bovis subsp bovis AF2122/97
ccgacaccggccgc

SEQ ID NO: 3047089 - RNA, 18 nt, Mycobacterium bovis subsp bovis AF2122/97
ccgacaccggccgcgacg

SEQ ID NO: 3047090 - RNA, 21 nt, Mycobacterium bovis subsp bovis AF2122/97
ccgacaccggccgcgacggau

SEQ ID NO: 3047091 - RNA, 12 nt, Mycobacterium bovis subsp bovis AF2122/97
ccgacaccggcg

SEQ ID NO: 3047092 - RNA, 13 nt, Mycobacterium bovis subsp bovis AF2122/97
ccgacaccggcgg

SEQ ID NO: 3047093 - RNA, 17 nt, Mycobacterium bovis subsp bovis AF2122/97
ccgacaccggcggcauc

SEQ ID NO: 3047094 - RNA, 14 nt, Mycobacterium bovis subsp bovis AF2122/97
ccgacaccggcuga

SEQ ID NO: 3047095 - RNA, 13 nt, Mycobacterium bovis subsp bovis AF2122/97
ccgacaccgucca

SEQ ID NO: 3047096 - RNA, 15 nt, Mycobacterium bovis subsp bovis AF2122/97
ccgacaccgugccgc

SEQ ID NO: 3047097 - RNA, 15 nt, Mycobacterium bovis subsp bovis AF2122/97
ccgacaccgugucgc

SEQ ID NO: 3047098 - RNA, 23 nt, Mycobacterium bovis subsp bovis AF2122/97
ccgacaccgugucgccggcgaag

SEQ ID NO: 3047099 - RNA, 17 nt, Mycobacterium bovis subsp bovis AF2122/97
ccgacacgccgaugccg

SEQ ID NO: 3047100 - RNA, 15 nt, Mycobacterium bovis subsp bovis AF2122/97
ccgacacgccgugcg

SEQ ID NO: 3047101 - RNA, 13 nt, Mycobacterium bovis subsp bovis AF2122/97
ccgacacgccguu

SEQ ID NO: 3047102 - RNA, 15 nt, Mycobacterium bovis subsp bovis AF2122/97
ccgacacgccguugg

SEQ ID NO: 3047103 - RNA, 20 nt, Mycobacterium bovis subsp bovis AF2122/97
ccgacacgccguuggggccg

SEQ ID NO: 3047104 - RNA, 21 nt, Mycobacterium bovis subsp bovis AF2122/97
ccgacacgccguuggggccgu

SEQ ID NO: 3047105 - RNA, 19 nt, Mycobacterium bovis subsp bovis AF2122/97
ccgacacggcucgccggcu

SEQ ID NO: 3047106 - RNA, 18 nt, Mycobacterium bovis subsp bovis AF2122/97
ccgacacguugcagcucg

SEQ ID NO: 3047107 - RNA, 23 nt, Mycobacterium bovis subsp bovis AF2122/97
ccgacacguugcagcucgauccg

SEQ ID NO: 3047108 - RNA, 23 nt, Mycobacterium bovis subsp bovis AF2122/97
ccgacacguuucacguggucggc

SEQ ID NO: 3047109 - RNA, 23 nt, Mycobacterium bovis subsp bovis AF2122/97
ccgacagauggucacccacguug

SEQ ID NO: 3047110 - RNA, 17 nt, Mycobacterium bovis subsp bovis AF2122/97
ccgacagauggucgguc

SEQ ID NO: 3047111 - RNA, 13 nt, Mycobacterium bovis subsp bovis AF2122/97
ccgacagcacccg

SEQ ID NO: 3047112 - RNA, 17 nt, Mycobacterium bovis subsp bovis AF2122/97
ccgacagcacccggcca

SEQ ID NO: 3047113 - RNA, 18 nt, Mycobacterium bovis subsp bovis AF2122/97
ccgacagcacccggccac

SEQ ID NO: 3047114 - RNA, 14 nt, Mycobacterium bovis subsp bovis AF2122/97
ccgacagcagccgg

SEQ ID NO: 3047115 - RNA, 18 nt, Mycobacterium bovis subsp bovis AF2122/97
ccgacagcagccggugcc

SEQ ID NO: 3047116 - RNA, 19 nt, Mycobacterium bovis subsp bovis AF2122/97
ccgacagcagguugccgaa

SEQ ID NO: 3047117 - RNA, 14 nt, Mycobacterium bovis subsp bovis AF2122/97
ccgacagccaccgc

SEQ ID NO: 3047118 - RNA, 12 nt, Mycobacterium bovis subsp bovis AF2122/97
ccgacagcccca

SEQ ID NO: 3047119 - RNA, 13 nt, Mycobacterium bovis subsp bovis AF2122/97
ccgacaggccggc

SEQ ID NO: 3047120 - RNA, 14 nt, Mycobacterium bovis subsp bovis AF2122/97
ccgacaggccggcc

SEQ ID NO: 3047121 - RNA, 16 nt, Mycobacterium bovis subsp bovis AF2122/97
ccgacaggccggccac

SEQ ID NO: 3047122 - RNA, 21 nt, Mycobacterium bovis subsp bovis AF2122/97
ccgacaggccggccaccaguc

SEQ ID NO: 3047123 - RNA, 22 nt, Mycobacterium bovis subsp bovis AF2122/97
ccgacagggacccgagaucacc

SEQ ID NO: 3047124 - RNA, 21 nt, Mycobacterium bovis subsp bovis AF2122/97
ccgacagggccuugaucggca

SEQ ID NO: 3047125 - RNA, 16 nt, Mycobacterium bovis subsp bovis AF2122/97
ccgacaggugcucguc

SEQ ID NO: 3047126 - RNA, 14 nt, Mycobacterium bovis subsp bovis AF2122/97
ccgacaguccgcgc

SEQ ID NO: 3047127 - RNA, 13 nt, Mycobacterium bovis subsp bovis AF2122/97
ccgaccgcaccgu

SEQ ID NO: 3047128 - RNA, 15 nt, Mycobacterium bovis subsp bovis AF2122/97
ccgaccgcaccgugc

SEQ ID NO: 3047129 - RNA, 17 nt, Mycobacterium bovis subsp bovis AF2122/97
ccgaccgcacgaccagc

SEQ ID NO: 3047130 - RNA, 13 nt, Mycobacterium bovis subsp bovis AF2122/97
ccgaccgccaccg

SEQ ID NO: 3047131 - RNA, 15 nt, Mycobacterium bovis subsp bovis AF2122/97
ccgaccgccaccgcc

SEQ ID NO: 3047132 - RNA, 24 nt, Mycobacterium bovis subsp bovis AF2122/97
ccgaccgccaccgccagcgucgac

SEQ ID NO: 3047133 - RNA, 14 nt, Mycobacterium bovis subsp bovis AF2122/97
ccgaccgccauccu

SEQ ID NO: 3047134 - RNA, 14 nt, Mycobacterium bovis subsp bovis AF2122/97
ccgaccgccgagcg

SEQ ID NO: 3047135 - RNA, 21 nt, Mycobacterium bovis subsp bovis AF2122/97
ccgaccgcgacccggcccagc

SEQ ID NO: 3047136 - RNA, 13 nt, Mycobacterium bovis subsp bovis AF2122/97
ccgaccgcgccgc

SEQ ID NO: 3047137 - RNA, 16 nt, Mycobacterium bovis subsp bovis AF2122/97
ccgaccgcgccgcauc

SEQ ID NO: 3047138 - RNA, 19 nt, Mycobacterium bovis subsp bovis AF2122/97
ccgaccgcgggucgugcca

SEQ ID NO: 3047139 - RNA, 24 nt, Mycobacterium bovis subsp bovis AF2122/97
ccgaccgcgggucgugccagcagc

SEQ ID NO: 3047140 - RNA, 20 nt, Mycobacterium bovis subsp bovis AF2122/97
ccgaccgcguuguccgcggc

SEQ ID NO: 3047141 - RNA, 22 nt, Mycobacterium bovis subsp bovis AF2122/97
ccgaccgcguuguccgcggcca

SEQ ID NO: 3047142 - RNA, 22 nt, Mycobacterium bovis subsp bovis AF2122/97
ccgaccgcguuuugcaggcccg

SEQ ID NO: 3047143 - RNA, 13 nt, Mycobacterium bovis subsp bovis AF2122/97
ccgaccggcaccc

SEQ ID NO: 3047144 - RNA, 15 nt, Mycobacterium bovis subsp bovis AF2122/97
ccgaccggcacccgc

SEQ ID NO: 3047145 - RNA, 17 nt, Mycobacterium bovis subsp bovis AF2122/97
ccgaccggcacccgcgg

SEQ ID NO: 3047146 - RNA, 13 nt, Mycobacterium bovis subsp bovis AF2122/97
ccgaccggcagcg

SEQ ID NO: 3047147 - RNA, 21 nt, Mycobacterium bovis subsp bovis AF2122/97
ccgaccggcccgcauccgcac

SEQ ID NO: 3047148 - RNA, 13 nt, Mycobacterium bovis subsp bovis AF2122/97
ccgaccggcggca

SEQ ID NO: 3047149 - RNA, 23 nt, Mycobacterium bovis subsp bovis AF2122/97
ccgaccgggcucuggccaguccg

SEQ ID NO: 3047150 - RNA, 22 nt, Mycobacterium bovis subsp bovis AF2122/97
ccgaccgggucgcaaccgccgc

SEQ ID NO: 3047151 - RNA, 18 nt, Mycobacterium bovis subsp bovis AF2122/97
ccgaccggguugauggcg

SEQ ID NO: 3047152 - RNA, 22 nt, Mycobacterium bovis subsp bovis AF2122/97
ccgaccgguacccguagcacca

SEQ ID NO: 3047153 - RNA, 17 nt, Mycobacterium bovis subsp bovis AF2122/97
ccgaccggucuggcgau

SEQ ID NO: 3047154 - RNA, 19 nt, Mycobacterium bovis subsp bovis AF2122/97
ccgaccggucuggcgauga

SEQ ID NO: 3047155 - RNA, 22 nt, Mycobacterium bovis subsp bovis AF2122/97
ccgaccgguggcaccggcggcg

SEQ ID NO: 3047156 - RNA, 23 nt, Mycobacterium bovis subsp bovis AF2122/97
ccgaccgguggcaccggcggcga

SEQ ID NO: 3047157 - RNA, 13 nt, Mycobacterium bovis subsp bovis AF2122/97
ccgaccgguggcg

SEQ ID NO: 3047158 - RNA, 14 nt, Mycobacterium bovis subsp bovis AF2122/97
ccgaccgucgucgu

SEQ ID NO: 3047159 - RNA, 23 nt, Mycobacterium bovis subsp bovis AF2122/97
ccgaccgucgucgugcaggcgca

SEQ ID NO: 3047160 - RNA, 19 nt, Mycobacterium bovis subsp bovis AF2122/97
ccgaccgugaucagcgcgu

SEQ ID NO: 3047161 - RNA, 23 nt, Mycobacterium bovis subsp bovis AF2122/97
ccgaccguuucuccgccgcccag

SEQ ID NO: 3047162 - RNA, 20 nt, Mycobacterium bovis subsp bovis AF2122/97
ccgaccuaaagaucguugcc

SEQ ID NO: 3047163 - RNA, 15 nt, Mycobacterium bovis subsp bovis AF2122/97
ccgaccuaccgucga

SEQ ID NO: 3047164 - RNA, 17 nt, Mycobacterium bovis subsp bovis AF2122/97
ccgaccuaccgucgacc

SEQ ID NO: 3047165 - RNA, 16 nt, Mycobacterium bovis subsp bovis AF2122/97
ccgaccuagcucgcgg

SEQ ID NO: 3047166 - RNA, 16 nt, Mycobacterium bovis subsp bovis AF2122/97
ccgaccucaucggcac

SEQ ID NO: 3047167 - RNA, 14 nt, Mycobacterium bovis subsp bovis AF2122/97
ccgaccucgccgcg

SEQ ID NO: 3047168 - RNA, 17 nt, Mycobacterium bovis subsp bovis AF2122/97
ccgaccucgccgcgcgu

SEQ ID NO: 3047169 - RNA, 16 nt, Mycobacterium bovis subsp bovis AF2122/97
ccgaccucggcgaccg

SEQ ID NO: 3047170 - RNA, 21 nt, Mycobacterium bovis subsp bovis AF2122/97
ccgaccucguucgucaccacg

SEQ ID NO: 3047171 - RNA, 18 nt, Mycobacterium bovis subsp bovis AF2122/97
ccgaccucugcguccagc

SEQ ID NO: 3047172 - RNA, 14 nt, Mycobacterium bovis subsp bovis AF2122/97
ccgaccugcaagac

SEQ ID NO: 3047173 - RNA, 17 nt, Mycobacterium bovis subsp bovis AF2122/97
ccgaccugcaagacgcc

SEQ ID NO: 3047174 - RNA, 15 nt, Mycobacterium bovis subsp bovis AF2122/97
ccgaccugcgcgacg

SEQ ID NO: 3047175 - RNA, 19 nt, Mycobacterium bovis subsp bovis AF2122/97
ccgaccugcucgauacggc

SEQ ID NO: 3047176 - RNA, 11 nt, Mycobacterium bovis subsp bovis AF2122/97
ccgaccuggac

SEQ ID NO: 3047177 - RNA, 21 nt, Mycobacterium bovis subsp bovis AF2122/97
ccgaccuuccguuggcggcuc

SEQ ID NO: 3047178 - RNA, 22 nt, Mycobacterium bovis subsp bovis AF2122/97
ccgaccuuccguuggcggcucg

SEQ ID NO: 3047179 - RNA, 14 nt, Mycobacterium bovis subsp bovis AF2122/97
ccgaccuucggccc

SEQ ID NO: 3047180 - RNA, 20 nt, Mycobacterium bovis subsp bovis AF2122/97
ccgacgaacaguugcggcug

SEQ ID NO: 3047181 - RNA, 19 nt, Mycobacterium bovis subsp bovis AF2122/97
ccgacgaacgaaccgccgc

SEQ ID NO: 3047182 - RNA, 20 nt, Mycobacterium bovis subsp bovis AF2122/97
ccgacgaacgaaccgccgcc

SEQ ID NO: 3047183 - RNA, 21 nt, Mycobacterium bovis subsp bovis AF2122/97
ccgacgaacgaaccgccgccg

SEQ ID NO: 3047184 - RNA, 14 nt, Mycobacterium bovis subsp bovis AF2122/97
ccgacgaacugcag

SEQ ID NO: 3047185 - RNA, 16 nt, Mycobacterium bovis subsp bovis AF2122/97
ccgacgaagaucgcug

SEQ ID NO: 3047186 - RNA, 17 nt, Mycobacterium bovis subsp bovis AF2122/97
ccgacgacaccagagcg

SEQ ID NO: 3047187 - RNA, 21 nt, Mycobacterium bovis subsp bovis AF2122/97
ccgacgacauugggcgcggug

SEQ ID NO: 3047188 - RNA, 14 nt, Mycobacterium bovis subsp bovis AF2122/97
ccgacgaccagcag

SEQ ID NO: 3047189 - RNA, 11 nt, Mycobacterium bovis subsp bovis AF2122/97
ccgacgaccau

SEQ ID NO: 3047190 - RNA, 15 nt, Mycobacterium bovis subsp bovis AF2122/97
ccgacgacgacguuc

SEQ ID NO: 3047191 - RNA, 16 nt, Mycobacterium bovis subsp bovis AF2122/97
ccgacgacggcaccga

SEQ ID NO: 3047192 - RNA, 15 nt, Mycobacterium bovis subsp bovis AF2122/97
ccgacgacggcgacg

SEQ ID NO: 3047193 - RNA, 19 nt, Mycobacterium bovis subsp bovis AF2122/97
ccgacgacgggguuguggu

SEQ ID NO: 3047194 - RNA, 20 nt, Mycobacterium bovis subsp bovis AF2122/97
ccgacgagauacggccacca

SEQ ID NO: 3047195 - RNA, 23 nt, Mycobacterium bovis subsp bovis AF2122/97
ccgacgagauacggccaccaggu

SEQ ID NO: 3047196 - RNA, 23 nt, Mycobacterium bovis subsp bovis AF2122/97
ccgacgagauugccgggccgccg

SEQ ID NO: 3047197 - RNA, 21 nt, Mycobacterium bovis subsp bovis AF2122/97
ccgacgaggacgucaccguca

SEQ ID NO: 3047198 - RNA, 15 nt, Mycobacterium bovis subsp bovis AF2122/97
ccgacgaggaugucg

SEQ ID NO: 3047199 - RNA, 18 nt, Mycobacterium bovis subsp bovis AF2122/97
ccgacgaggggcgcgggu

SEQ ID NO: 3047200 - RNA, 20 nt, Mycobacterium bovis subsp bovis AF2122/97
ccgacgaggggcgcgggugg

SEQ ID NO: 3047201 - RNA, 18 nt, Mycobacterium bovis subsp bovis AF2122/97
ccgacgaguacacgaucu

SEQ ID NO: 3047202 - RNA, 18 nt, Mycobacterium bovis subsp bovis AF2122/97
ccgacgaucgacgccgcc

SEQ ID NO: 3047203 - RNA, 21 nt, Mycobacterium bovis subsp bovis AF2122/97
ccgacgaucgacgccgccacc

SEQ ID NO: 3047204 - RNA, 17 nt, Mycobacterium bovis subsp bovis AF2122/97
ccgacgaugcgggcgau

SEQ ID NO: 3047205 - RNA, 21 nt, Mycobacterium bovis subsp bovis AF2122/97
ccgacgaugugcacggugugc

SEQ ID NO: 3047206 - RNA, 19 nt, Mycobacterium bovis subsp bovis AF2122/97
ccgacgcacaggcgacggc

SEQ ID NO: 3047207 - RNA, 19 nt, Mycobacterium bovis subsp bovis AF2122/97
ccgacgcaccaacgcgauc

SEQ ID NO: 3047208 - RNA, 17 nt, Mycobacterium bovis subsp bovis AF2122/97
ccgacgcaccucggugg

SEQ ID NO: 3047209 - RNA, 21 nt, Mycobacterium bovis subsp bovis AF2122/97
ccgacgcagaacggcguugcg

SEQ ID NO: 3047210 - RNA, 13 nt, Mycobacterium bovis subsp bovis AF2122/97
ccgacgcagguga

SEQ ID NO: 3047211 - RNA, 21 nt, Mycobacterium bovis subsp bovis AF2122/97
ccgacgcaggugaacgccggu

SEQ ID NO: 3047212 - RNA, 16 nt, Mycobacterium bovis subsp bovis AF2122/97
ccgacgccaacgccag

SEQ ID NO: 3047213 - RNA, 19 nt, Mycobacterium bovis subsp bovis AF2122/97
ccgacgucaggcagcuccg

SEQ ID NO: 3047214 - RNA, 21 nt, Mycobacterium bovis subsp bovis AF2122/97
ccgacgucaggcagcuccgcc

SEQ ID NO: 3047215 - RNA, 23 nt, Mycobacterium bovis subsp bovis AF2122/97
ccgacgucaggcagcuccgccgc

SEQ ID NO: 3047216 - RNA, 13 nt, Mycobacterium bovis subsp bovis AF2122/97
ccgacgucgacga

SEQ ID NO: 3047217 - RNA, 15 nt, Mycobacterium bovis subsp bovis AF2122/97
ccgacgucgacgaga

SEQ ID NO: 3047218 - RNA, 19 nt, Mycobacterium bovis subsp bovis AF2122/97
ccgacgucgacgccggcca

SEQ ID NO: 3047219 - RNA, 17 nt, Mycobacterium bovis subsp bovis AF2122/97
ccgacgucgccaagacc

SEQ ID NO: 3047220 - RNA, 22 nt, Mycobacterium bovis subsp bovis AF2122/97
ccgacgucgcggaguagccgca

SEQ ID NO: 3047221 - RNA, 20 nt, Mycobacterium bovis subsp bovis AF2122/97
ccgacgucugguuggcuggc

SEQ ID NO: 3047222 - RNA, 21 nt, Mycobacterium bovis subsp bovis AF2122/97
ccgacgugagggucaugucga

SEQ ID NO: 3047223 - RNA, 14 nt, Mycobacterium bovis subsp bovis AF2122/97
ccgacgugcggcgg

SEQ ID NO: 3047224 - RNA, 17 nt, Mycobacterium bovis subsp bovis AF2122/97
ccgacgugcggcggccu

SEQ ID NO: 3047225 - RNA, 17 nt, Mycobacterium bovis subsp bovis AF2122/97
ccgacguggaacugcag

SEQ ID NO: 3047226 - RNA, 21 nt, Mycobacterium bovis subsp bovis AF2122/97
ccgacguggaugguggugccg

SEQ ID NO: 3047227 - RNA, 20 nt, Mycobacterium bovis subsp bovis AF2122/97
ccgacguggccagcccgccc

SEQ ID NO: 3047228 - RNA, 21 nt, Mycobacterium bovis subsp bovis AF2122/97
ccgacguggccagcccgccca

SEQ ID NO: 3047229 - RNA, 21 nt, Mycobacterium bovis subsp bovis AF2122/97
ccgacguuccccuucagcacg

SEQ ID NO: 3047230 - RNA, 19 nt, Mycobacterium bovis subsp bovis AF2122/97
ccgacguugaagccgccgg

SEQ ID NO: 3047231 - RNA, 18 nt, Mycobacterium bovis subsp bovis AF2122/97
ccgacguugcuggcuggg

SEQ ID NO: 3047232 - RNA, 15 nt, Mycobacterium bovis subsp bovis AF2122/97
ccgacuaucggccgc

SEQ ID NO: 3047233 - RNA, 17 nt, Mycobacterium bovis subsp bovis AF2122/97
ccgacuaucggccgccg

SEQ ID NO: 3047234 - RNA, 18 nt, Mycobacterium bovis subsp bovis AF2122/97
ccgacucaggucggugcg

SEQ ID NO: 3047235 - RNA, 24 nt, Mycobacterium bovis subsp bovis AF2122/97
ccgacucaggucggugcggucauc

SEQ ID NO: 3047236 - RNA, 15 nt, Mycobacterium bovis subsp bovis AF2122/97
ccgacucaucggccg

SEQ ID NO: 3047237 - RNA, 19 nt, Mycobacterium bovis subsp bovis AF2122/97
ccgacucaucggccgcggu

SEQ ID NO: 3047238 - RNA, 14 nt, Mycobacterium bovis subsp bovis AF2122/97
ccgacuccaguucg

SEQ ID NO: 3047239 - RNA, 23 nt, Mycobacterium bovis subsp bovis AF2122/97
ccgacucccccucuaccuccgcc

SEQ ID NO: 3047240 - RNA, 17 nt, Mycobacterium bovis subsp bovis AF2122/97
ccgacuccccgccgggc

SEQ ID NO: 3047241 - RNA, 18 nt, Mycobacterium bovis subsp bovis AF2122/97
ccgacuccccgccgggca

SEQ ID NO: 3047242 - RNA, 20 nt, Mycobacterium bovis subsp bovis AF2122/97
ccgacuccccgccgggcaau

SEQ ID NO: 3047243 - RNA, 23 nt, Mycobacterium bovis subsp bovis AF2122/97
ccgacuccggcaggcccgacggc

SEQ ID NO: 3047244 - RNA, 17 nt, Mycobacterium bovis subsp bovis AF2122/97
ccgacucggcaccgcgg

SEQ ID NO: 3047245 - RNA, 17 nt, Mycobacterium bovis subsp bovis AF2122/97
ccgacucggccgugacc

SEQ ID NO: 3047246 - RNA, 21 nt, Mycobacterium bovis subsp bovis AF2122/97
ccgacucgucggccugguacu

SEQ ID NO: 3047247 - RNA, 18 nt, Mycobacterium bovis subsp bovis AF2122/97
ccgacugaacgucaccgu

SEQ ID NO: 3047248 - RNA, 23 nt, Mycobacterium bovis subsp bovis AF2122/97
ccgacugacagaagcgguucgca

SEQ ID NO: 3047249 - RNA, 13 nt, Mycobacterium bovis subsp bovis AF2122/97
ccgacugccgcgg

SEQ ID NO: 3047250 - RNA, 16 nt, Mycobacterium bovis subsp bovis AF2122/97
ccgacugccgcgggca

SEQ ID NO: 3047251 - RNA, 18 nt, Mycobacterium bovis subsp bovis AF2122/97
ccgacugccgcgggcagc

SEQ ID NO: 3047252 - RNA, 18 nt, Mycobacterium bovis subsp bovis AF2122/97
ccgacugccguucagcgg

SEQ ID NO: 3047253 - RNA, 23 nt, Mycobacterium bovis subsp bovis AF2122/97
ccgacugccguucagcggcgggu

SEQ ID NO: 3047254 - RNA, 15 nt, Mycobacterium bovis subsp bovis AF2122/97
ccgacugcugaauca

SEQ ID NO: 3047255 - RNA, 14 nt, Mycobacterium bovis subsp bovis AF2122/97
ccgacuggccccgc

SEQ ID NO: 3047256 - RNA, 15 nt, Mycobacterium bovis subsp bovis AF2122/97
ccgacuggccccgcc

SEQ ID NO: 3047257 - RNA, 13 nt, Mycobacterium bovis subsp bovis AF2122/97
ccgacugggcgcg

SEQ ID NO: 3047258 - RNA, 18 nt, Mycobacterium bovis subsp bovis AF2122/97
ccgacugggcgcgacccc

SEQ ID NO: 3047259 - RNA, 21 nt, Mycobacterium bovis subsp bovis AF2122/97
ccgacugggcgcgaccccagg

SEQ ID NO: 3047260 - RNA, 20 nt, Mycobacterium bovis subsp bovis AF2122/97
ccgacuguagaaaacccgua

SEQ ID NO: 3047261 - RNA, 17 nt, Mycobacterium bovis subsp bovis AF2122/97
ccgacuguccccguuga

SEQ ID NO: 3047262 - RNA, 15 nt, Mycobacterium bovis subsp bovis AF2122/97
ccgacuucaagacag

SEQ ID NO: 3047263 - RNA, 21 nt, Mycobacterium bovis subsp bovis AF2122/97
ccgacuucggaaaggucggcc

SEQ ID NO: 3047264 - RNA, 15 nt, Mycobacterium bovis subsp bovis AF2122/97
ccgacuucuccaggc

SEQ ID NO: 3047265 - RNA, 18 nt, Mycobacterium bovis subsp bovis AF2122/97
ccgacuucuccaggcuga

SEQ ID NO: 3047266 - RNA, 17 nt, Mycobacterium bovis subsp bovis AF2122/97
ccgacuugacggcgggu

SEQ ID NO: 3047267 - RNA, 21 nt, Mycobacterium bovis subsp bovis AF2122/97
ccgacuugauuucgaucgcgg

SEQ ID NO: 3047268 - RNA, 14 nt, Mycobacterium bovis subsp bovis AF2122/97
ccgacuuggugacc

SEQ ID NO: 3047269 - RNA, 21 nt, Mycobacterium bovis subsp bovis AF2122/97
ccgacuuugagucguuggacg

SEQ ID NO: 3047270 - RNA, 23 nt, Mycobacterium bovis subsp bovis AF2122/97
ccgacuuugagucguuggacggc

SEQ ID NO: 3047271 - RNA, 13 nt, Mycobacterium bovis subsp bovis AF2122/97
ccgacuuuggcca

SEQ ID NO: 3047272 - RNA, 21 nt, Mycobacterium bovis subsp bovis AF2122/97
ccgacuuugucgcggagucug

SEQ ID NO: 3047273 - RNA, 14 nt, Mycobacterium bovis subsp bovis AF2122/97
ccgagaaagugcag

SEQ ID NO: 3047274 - RNA, 13 nt, Mycobacterium bovis subsp bovis AF2122/97
ccgagaacaccac

SEQ ID NO: 3047275 - RNA, 19 nt, Mycobacterium bovis subsp bovis AF2122/97
ccgagaacaccacgcaguc

SEQ ID NO: 3047276 - RNA, 14 nt, Mycobacterium bovis subsp bovis AF2122/97
ccgagaacaccggc

SEQ ID NO: 3047277 - RNA, 21 nt, Mycobacterium bovis subsp bovis AF2122/97
ccgagaacgauguccgcgcga

SEQ ID NO: 3047278 - RNA, 15 nt, Mycobacterium bovis subsp bovis AF2122/97
ccgagaacgcccgag

SEQ ID NO: 3047279 - RNA, 21 nt, Mycobacterium bovis subsp bovis AF2122/97
ccgagaacgcccgagugacca

SEQ ID NO: 3047280 - RNA, 14 nt, Mycobacterium bovis subsp bovis AF2122/97
ccgagaacggcggg

SEQ ID NO: 3047281 - RNA, 18 nt, Mycobacterium bovis subsp bovis AF2122/97
ccgagaacugcucgaucc

SEQ ID NO: 3047282 - RNA, 17 nt, Mycobacterium bovis subsp bovis AF2122/97
ccgagaagacgcaaaag

SEQ ID NO: 3047283 - RNA, 22 nt, Mycobacterium bovis subsp bovis AF2122/97
ccgagaagcccaccgucugcug

SEQ ID NO: 3047284 - RNA, 22 nt, Mycobacterium bovis subsp bovis AF2122/97
ccgagaagcguugcacugcugg

SEQ ID NO: 3047285 - RNA, 15 nt, Mycobacterium bovis subsp bovis AF2122/97
ccgagaagugggcgg

SEQ ID NO: 3047286 - RNA, 12 nt, Mycobacterium bovis subsp bovis AF2122/97
ccgagacaccac

SEQ ID NO: 3047287 - RNA, 16 nt, Mycobacterium bovis subsp bovis AF2122/97
ccgagacaccacguug

SEQ ID NO: 3047288 - RNA, 17 nt, Mycobacterium bovis subsp bovis AF2122/97
ccgagaccacgcgcguc

SEQ ID NO: 3047289 - RNA, 17 nt, Mycobacterium bovis subsp bovis AF2122/97
ccgagaccaugccgacg

SEQ ID NO: 3047290 - RNA, 18 nt, Mycobacterium bovis subsp bovis AF2122/97
ccgagaccaugccgacga

SEQ ID NO: 3047291 - RNA, 18 nt, Mycobacterium bovis subsp bovis AF2122/97
ccgagaccgccgcugccg

SEQ ID NO: 3047292 - RNA, 22 nt, Mycobacterium bovis subsp bovis AF2122/97
ccgagaccgccgcugccgccga

SEQ ID NO: 3047293 - RNA, 13 nt, Mycobacterium bovis subsp bovis AF2122/97
ccgagaccgcgug

SEQ ID NO: 3047294 - RNA, 15 nt, Mycobacterium bovis subsp bovis AF2122/97
ccgagaccggccagu

SEQ ID NO: 3047295 - RNA, 23 nt, Mycobacterium bovis subsp bovis AF2122/97
ccgagacgaccuccucgaugacc

SEQ ID NO: 3047296 - RNA, 20 nt, Mycobacterium bovis subsp bovis AF2122/97
ccgagacggcgucgggccgu

SEQ ID NO: 3047297 - RNA, 13 nt, Mycobacterium bovis subsp bovis AF2122/97
ccgagacgucggc

SEQ ID NO: 3047298 - RNA, 15 nt, Mycobacterium bovis subsp bovis AF2122/97
ccgagacgucggcgu

SEQ ID NO: 3047299 - RNA, 18 nt, Mycobacterium bovis subsp bovis AF2122/97
ccgagccggugccacugc

SEQ ID NO: 3047300 - RNA, 17 nt, Mycobacterium bovis subsp bovis AF2122/97
ccgagccguugcgccuc

SEQ ID NO: 3047301 - RNA, 14 nt, Mycobacterium bovis subsp bovis AF2122/97
ccgagccucgcucu

SEQ ID NO: 3047302 - RNA, 14 nt, Mycobacterium bovis subsp bovis AF2122/97
ccgagccuggauca

SEQ ID NO: 3047303 - RNA, 22 nt, Mycobacterium bovis subsp bovis AF2122/97
ccgagccuggaucacacccacg

SEQ ID NO: 3047304 - RNA, 16 nt, Mycobacterium bovis subsp bovis AF2122/97
ccgagccuugagcgcg

SEQ ID NO: 3047305 - RNA, 17 nt, Mycobacterium bovis subsp bovis AF2122/97
ccgagccuugagcgcgg

SEQ ID NO: 3047306 - RNA, 18 nt, Mycobacterium bovis subsp bovis AF2122/97
ccgagccuugagcgcggc

SEQ ID NO: 3047307 - RNA, 22 nt, Mycobacterium bovis subsp bovis AF2122/97
ccgagcgaccgucccagcgccg

SEQ ID NO: 3047308 - RNA, 18 nt, Mycobacterium bovis subsp bovis AF2122/97
ccgagcgaugcgaccgac

SEQ ID NO: 3047309 - RNA, 22 nt, Mycobacterium bovis subsp bovis AF2122/97
ccgagcgcaacucccagcacgg

SEQ ID NO: 3047310 - RNA, 22 nt, Mycobacterium bovis subsp bovis AF2122/97
ccgagcgcaaucgaccacgacg

SEQ ID NO: 3047311 - RNA, 15 nt, Mycobacterium bovis subsp bovis AF2122/97
ccgagcgcaccgcug

SEQ ID NO: 3047312 - RNA, 18 nt, Mycobacterium bovis subsp bovis AF2122/97
ccgagcgccaguucgcgg

SEQ ID NO: 3047313 - RNA, 14 nt, Mycobacterium bovis subsp bovis AF2122/97
ccgagcgcccgcaa

SEQ ID NO: 3047314 - RNA, 21 nt, Mycobacterium bovis subsp bovis AF2122/97
ccgagcgcgccgaaggccgcc

SEQ ID NO: 3047315 - RNA, 14 nt, Mycobacterium bovis subsp bovis AF2122/97
ccgagcgcgccggc

SEQ ID NO: 3047316 - RNA, 12 nt, Mycobacterium bovis subsp bovis AF2122/97
ccgagcgcgcgc

SEQ ID NO: 3047317 - RNA, 16 nt, Mycobacterium bovis subsp bovis AF2122/97
ccgagcgcgcgcuguu

SEQ ID NO: 3047318 - RNA, 14 nt, Mycobacterium bovis subsp bovis AF2122/97
ccgagcgcggcggc

SEQ ID NO: 3047319 - RNA, 15 nt, Mycobacterium bovis subsp bovis AF2122/97
ccgagcgcggcggcg

SEQ ID NO: 3047320 - RNA, 18 nt, Mycobacterium bovis subsp bovis AF2122/97
ccgagcgcucgaucacgg

SEQ ID NO: 3047321 - RNA, 19 nt, Mycobacterium bovis subsp bovis AF2122/97
ccgagcgcuugaccccgcc

SEQ ID NO: 3047322 - RNA, 20 nt, Mycobacterium bovis subsp bovis AF2122/97
ccgagcgcuugaccccgccg

SEQ ID NO: 3047323 - RNA, 19 nt, Mycobacterium bovis subsp bovis AF2122/97
ccgagcggaccaccgcucg

SEQ ID NO: 3047324 - RNA, 22 nt, Mycobacterium bovis subsp bovis AF2122/97
ccgagcggaccaccgcucgcca

SEQ ID NO: 3047325 - RNA, 13 nt, Mycobacterium bovis subsp bovis AF2122/97
ccgagcggcaucg

SEQ ID NO: 3047326 - RNA, 20 nt, Mycobacterium bovis subsp bovis AF2122/97
ccgagcggcccuucaccagc

SEQ ID NO: 3047327 - RNA, 12 nt, Mycobacterium bovis subsp bovis AF2122/97
ccgagcgggaac

SEQ ID NO: 3047328 - RNA, 18 nt, Mycobacterium bovis subsp bovis AF2122/97
ccgagcgggaacgagcca

SEQ ID NO: 3047329 - RNA, 22 nt, Mycobacterium bovis subsp bovis AF2122/97
ccgagcgggaacgagccacgcc

SEQ ID NO: 3047330 - RNA, 22 nt, Mycobacterium bovis subsp bovis AF2122/97
ccgagcggguugucuuucacau

SEQ ID NO: 3047331 - RNA, 23 nt, Mycobacterium bovis subsp bovis AF2122/97
ccgagcggucaacgaguugcgga

SEQ ID NO: 3047332 - RNA, 16 nt, Mycobacterium bovis subsp bovis AF2122/97
ccgagcggucgaucug

SEQ ID NO: 3047333 - RNA, 17 nt, Mycobacterium bovis subsp bovis AF2122/97
ccgagcggucgaucuga

SEQ ID NO: 3047334 - RNA, 20 nt, Mycobacterium bovis subsp bovis AF2122/97
ccgagcggugaauucggcga

SEQ ID NO: 3047335 - RNA, 15 nt, Mycobacterium bovis subsp bovis AF2122/97
ccgagcggugccggc

SEQ ID NO: 3047336 - RNA, 16 nt, Mycobacterium bovis subsp bovis AF2122/97
ccgagcggugccggcg

SEQ ID NO: 3047337 - RNA, 14 nt, Mycobacterium bovis subsp bovis AF2122/97
ccgagcggugguga

SEQ ID NO: 3047338 - RNA, 20 nt, Mycobacterium bovis subsp bovis AF2122/97
ccgagcgguugccuucuugg

SEQ ID NO: 3047339 - RNA, 17 nt, Mycobacterium bovis subsp bovis AF2122/97
ccgagcguaaugcugcu

SEQ ID NO: 3047340 - RNA, 19 nt, Mycobacterium bovis subsp bovis AF2122/97
ccgagcguaaugcugcugc

SEQ ID NO: 3047341 - RNA, 22 nt, Mycobacterium bovis subsp bovis AF2122/97
ccgagcgugaagucacggcggc

SEQ ID NO: 3047342 - RNA, 12 nt, Mycobacterium bovis subsp bovis AF2122/97
ccgagcguggcg

SEQ ID NO: 3047343 - RNA, 19 nt, Mycobacterium bovis subsp bovis AF2122/97
ccgagcguggcguuggcgg

SEQ ID NO: 3047344 - RNA, 22 nt, Mycobacterium bovis subsp bovis AF2122/97
ccgagcuacgaccguugggaug

SEQ ID NO: 3047345 - RNA, 22 nt, Mycobacterium bovis subsp bovis AF2122/97
ccgagcucacuucacgccgccc

SEQ ID NO: 3047346 - RNA, 15 nt, Mycobacterium bovis subsp bovis AF2122/97
ccgagcuccgcggcg

SEQ ID NO: 3047347 - RNA, 15 nt, Mycobacterium bovis subsp bovis AF2122/97
ccgagcuccuccacc

SEQ ID NO: 3047348 - RNA, 18 nt, Mycobacterium bovis subsp bovis AF2122/97
ccgagcucggucaccacg

SEQ ID NO: 3047349 - RNA, 23 nt, Mycobacterium bovis subsp bovis AF2122/97
ccgagcucggucaccacggcggc

SEQ ID NO: 3047350 - RNA, 21 nt, Mycobacterium bovis subsp bovis AF2122/97
ccgagcucguugaccaggaau

SEQ ID NO: 3047351 - RNA, 18 nt, Mycobacterium bovis subsp bovis AF2122/97
ccgagcucguugcuggcg

SEQ ID NO: 3047352 - RNA, 15 nt, Mycobacterium bovis subsp bovis AF2122/97
ccgagcugagcggcc

SEQ ID NO: 3047353 - RNA, 14 nt, Mycobacterium bovis subsp bovis AF2122/97
ccgagcugauccgg

SEQ ID NO: 3047354 - RNA, 17 nt, Mycobacterium bovis subsp bovis AF2122/97
ccgagcugauccgggug

SEQ ID NO: 3047355 - RNA, 18 nt, Mycobacterium bovis subsp bovis AF2122/97
ccgagcugauccgggugg

SEQ ID NO: 3047356 - RNA, 14 nt, Mycobacterium bovis subsp bovis AF2122/97
ccgagcugccgucg

SEQ ID NO: 3047357 - RNA, 20 nt, Mycobacterium bovis subsp bovis AF2122/97
ccgagcugccgucgcugccc

SEQ ID NO: 3047358 - RNA, 19 nt, Mycobacterium bovis subsp bovis AF2122/97
ccgagcuggcaacgccgcg

SEQ ID NO: 3047359 - RNA, 22 nt, Mycobacterium bovis subsp bovis AF2122/97
ccgagcuggcaacgccgcgccg

SEQ ID NO: 3047360 - RNA, 23 nt, Mycobacterium bovis subsp bovis AF2122/97
ccgagcuggcaacgccgcgccgu

SEQ ID NO: 3047361 - RNA, 17 nt, Mycobacterium bovis subsp bovis AF2122/97
ccgagcuggccgucagc

SEQ ID NO: 3047362 - RNA, 22 nt, Mycobacterium bovis subsp bovis AF2122/97
ccgagcuggccgucagcgucgg

SEQ ID NO: 3047363 - RNA, 20 nt, Mycobacterium bovis subsp bovis AF2122/97
ccgagcuggcgcgcggggug

SEQ ID NO: 3047364 - RNA, 15 nt, Mycobacterium bovis subsp bovis AF2122/97
ccgagcugugcgcag

SEQ ID NO: 3047365 - RNA, 15 nt, Mycobacterium bovis subsp bovis AF2122/97
ccgagcuucagcgcg

SEQ ID NO: 3047366 - RNA, 16 nt, Mycobacterium bovis subsp bovis AF2122/97
ccgagcuucagcgcgc

SEQ ID NO: 3047367 - RNA, 19 nt, Mycobacterium bovis subsp bovis AF2122/97
ccgagcuucagcgcgcugc

SEQ ID NO: 3047368 - RNA, 21 nt, Mycobacterium bovis subsp bovis AF2122/97
ccgagcuucagcgcgcugcag

SEQ ID NO: 3047369 - RNA, 23 nt, Mycobacterium bovis subsp bovis AF2122/97
ccgagcuucagcgcgcugcagug

SEQ ID NO: 3047370 - RNA, 20 nt, Mycobacterium bovis subsp bovis AF2122/97
ccgagcuuccaaacccggug

SEQ ID NO: 3047371 - RNA, 22 nt, Mycobacterium bovis subsp bovis AF2122/97
ccgagcuugagcgugagcgccg

SEQ ID NO: 3047372 - RNA, 14 nt, Mycobacterium bovis subsp bovis AF2122/97
ccgagcuuggccgc

SEQ ID NO: 3047373 - RNA, 18 nt, Mycobacterium bovis subsp bovis AF2122/97
ccgagcuuggccgccgcc

SEQ ID NO: 3047374 - RNA, 19 nt, Mycobacterium bovis subsp bovis AF2122/97
ccgagcuuggccgccgcca

SEQ ID NO: 3047375 - RNA, 19 nt, Mycobacterium bovis subsp bovis AF2122/97
ccgagcuugggccggugca

SEQ ID NO: 3047376 - RNA, 19 nt, Mycobacterium bovis subsp bovis AF2122/97
ccgagcuugucgagcaggc

SEQ ID NO: 3047377 - RNA, 23 nt, Mycobacterium bovis subsp bovis AF2122/97
ccgaggaaguccagcuggccggg

SEQ ID NO: 3047378 - RNA, 20 nt, Mycobacterium bovis subsp bovis AF2122/97
ccgaggaauacucucgcgac

SEQ ID NO: 3047379 - RNA, 14 nt, Mycobacterium bovis subsp bovis AF2122/97
ccgaggaccagagg

SEQ ID NO: 3047380 - RNA, 16 nt, Mycobacterium bovis subsp bovis AF2122/97
ccgaggacgccggcgc

SEQ ID NO: 3047381 - RNA, 20 nt, Mycobacterium bovis subsp bovis AF2122/97
ccgaggacgccggcgccgcc

SEQ ID NO: 3047382 - RNA, 21 nt, Mycobacterium bovis subsp bovis AF2122/97
ccgaggacgccggcgccgcca

SEQ ID NO: 3047383 - RNA, 19 nt, Mycobacterium bovis subsp bovis AF2122/97
ccgaggagggccgcgaucg

SEQ ID NO: 3047384 - RNA, 12 nt, Mycobacterium bovis subsp bovis AF2122/97
ccgaggaucgcg

SEQ ID NO: 3047385 - RNA, 21 nt, Mycobacterium bovis subsp bovis AF2122/97
ccgauagaacuagaucgucgu

SEQ ID NO: 3047386 - RNA, 19 nt, Mycobacterium bovis subsp bovis AF2122/97
ccgauagacgugucauccc

SEQ ID NO: 3047387 - RNA, 13 nt, Mycobacterium bovis subsp bovis AF2122/97
ccgauagaucgcg

SEQ ID NO: 3047388 - RNA, 19 nt, Mycobacterium bovis subsp bovis AF2122/97
ccgauagccugcggcggcg

SEQ ID NO: 3047389 - RNA, 17 nt, Mycobacterium bovis subsp bovis AF2122/97
ccgauagcgaccgcggc

SEQ ID NO: 3047390 - RNA, 17 nt, Mycobacterium bovis subsp bovis AF2122/97
ccgauagcgcggcacca

SEQ ID NO: 3047391 - RNA, 18 nt, Mycobacterium bovis subsp bovis AF2122/97
ccgauaguucuggcccgc

SEQ ID NO: 3047392 - RNA, 14 nt, Mycobacterium bovis subsp bovis AF2122/97
ccgauauaccaggg

SEQ ID NO: 3047393 - RNA, 13 nt, Mycobacterium bovis subsp bovis AF2122/97
ccgauaucgcaga

SEQ ID NO: 3047394 - RNA, 22 nt, Mycobacterium bovis subsp bovis AF2122/97
ccgauaucggugaccguggcgg

SEQ ID NO: 3047395 - RNA, 23 nt, Mycobacterium bovis subsp bovis AF2122/97
ccgaucaacggaaugaaggcacc

SEQ ID NO: 3047396 - RNA, 23 nt, Mycobacterium bovis subsp bovis AF2122/97
ccgaucaauccgcccuugccgcc

SEQ ID NO: 3047397 - RNA, 13 nt, Mycobacterium bovis subsp bovis AF2122/97
ccgaucaccaucc

SEQ ID NO: 3047398 - RNA, 21 nt, Mycobacterium bovis subsp bovis AF2122/97
ccgaucaccauccagcccauc

SEQ ID NO: 3047399 - RNA, 12 nt, Mycobacterium bovis subsp bovis AF2122/97
ccgaucaccccg

SEQ ID NO: 3047400 - RNA, 15 nt, Mycobacterium bovis subsp bovis AF2122/97
ccgaucaccccgguc

SEQ ID NO: 3047401 - RNA, 19 nt, Mycobacterium bovis subsp bovis AF2122/97
ccgaucaccccggucggcc

SEQ ID NO: 3047402 - RNA, 22 nt, Mycobacterium bovis subsp bovis AF2122/97
ccgaucaccccggucggcccgc

SEQ ID NO: 3047403 - RNA, 12 nt, Mycobacterium bovis subsp bovis AF2122/97
ccgaucacccgc

SEQ ID NO: 3047404 - RNA, 16 nt, Mycobacterium bovis subsp bovis AF2122/97
ccgaucacccgcaggu

SEQ ID NO: 3047405 - RNA, 12 nt, Mycobacterium bovis subsp bovis AF2122/97
ccgaucaccgcc

SEQ ID NO: 3047406 - RNA, 19 nt, Mycobacterium bovis subsp bovis AF2122/97
ccgaucaccucggcgacgu

SEQ ID NO: 3047407 - RNA, 16 nt, Mycobacterium bovis subsp bovis AF2122/97
ccgaucaccuucggcc

SEQ ID NO: 3047408 - RNA, 17 nt, Mycobacterium bovis subsp bovis AF2122/97
ccgaucaccuucggccg

SEQ ID NO: 3047409 - RNA, 19 nt, Mycobacterium bovis subsp bovis AF2122/97
ccgaucaccuucggccgac

SEQ ID NO: 3047410 - RNA, 22 nt, Mycobacterium bovis subsp bovis AF2122/97
ccgaucaccuucggccgaccgg

SEQ ID NO: 3047411 - RNA, 18 nt, Mycobacterium bovis subsp bovis AF2122/97
ccgaucacgcuggguggg

SEQ ID NO: 3047412 - RNA, 15 nt, Mycobacterium bovis subsp bovis AF2122/97
ccgaucacggugggc

SEQ ID NO: 3047413 - RNA, 19 nt, Mycobacterium bovis subsp bovis AF2122/97
ccgaucacggugggcgccg

SEQ ID NO: 3047414 - RNA, 21 nt, Mycobacterium bovis subsp bovis AF2122/97
ccgaucacggugggcgccgac

SEQ ID NO: 3047415 - RNA, 17 nt, Mycobacterium bovis subsp bovis AF2122/97
ccgaucagcaccgacgg

SEQ ID NO: 3047416 - RNA, 20 nt, Mycobacterium bovis subsp bovis AF2122/97
ccgaucagcaccgacggcgc

SEQ ID NO: 3047417 - RNA, 22 nt, Mycobacterium bovis subsp bovis AF2122/97
ccgaucagcaccgacggcgcau

SEQ ID NO: 3047418 - RNA, 20 nt, Mycobacterium bovis subsp bovis AF2122/97
ccgaucagcagggcggcguu

SEQ ID NO: 3047419 - RNA, 15 nt, Mycobacterium bovis subsp bovis AF2122/97
ccgaucagcccggcc

SEQ ID NO: 3047420 - RNA, 16 nt, Mycobacterium bovis subsp bovis AF2122/97
ccgaucagcccggccu

SEQ ID NO: 3047421 - RNA, 23 nt, Mycobacterium bovis subsp bovis AF2122/97
ccgaucagcccggccuugccgcc

SEQ ID NO: 3047422 - RNA, 16 nt, Mycobacterium bovis subsp bovis AF2122/97
ccgaucagccguggca

SEQ ID NO: 3047423 - RNA, 13 nt, Mycobacterium bovis subsp bovis AF2122/97
ccgaucagcgacg

SEQ ID NO: 3047424 - RNA, 16 nt, Mycobacterium bovis subsp bovis AF2122/97
ccgaucagcgcggcgc

SEQ ID NO: 3047425 - RNA, 17 nt, Mycobacterium bovis subsp bovis AF2122/97
ccgaucagcguggcgcc

SEQ ID NO: 3047426 - RNA, 12 nt, Mycobacterium bovis subsp bovis AF2122/97
ccgaucagcugc

SEQ ID NO: 3047427 - RNA, 13 nt, Mycobacterium bovis subsp bovis AF2122/97
ccgaucaggccga

SEQ ID NO: 3047428 - RNA, 13 nt, Mycobacterium bovis subsp bovis AF2122/97
ccgaucaguccgg

SEQ ID NO: 3047429 - RNA, 19 nt, Mycobacterium bovis subsp bovis AF2122/97
ccgaucaucauauccgccc

SEQ ID NO: 3047430 - RNA, 23 nt, Mycobacterium bovis subsp bovis AF2122/97
ccgaucaucauauccgccccagc

SEQ ID NO: 3047431 - RNA, 14 nt, Mycobacterium bovis subsp bovis AF2122/97
ccgaucaucgacga

SEQ ID NO: 3047432 - RNA, 14 nt, Mycobacterium bovis subsp bovis AF2122/97
ccgaucaugucggc

SEQ ID NO: 3047433 - RNA, 13 nt, Mycobacterium bovis subsp bovis AF2122/97
ccgauccagcagg

SEQ ID NO: 3047434 - RNA, 18 nt, Mycobacterium bovis subsp bovis AF2122/97
ccgauccagcaggccguc

SEQ ID NO: 3047435 - RNA, 22 nt, Mycobacterium bovis subsp bovis AF2122/97
ccgauccagcaggccgucgauc

SEQ ID NO: 3047436 - RNA, 12 nt, Mycobacterium bovis subsp bovis AF2122/97
ccgauccccagg

SEQ ID NO: 3047437 - RNA, 14 nt, Mycobacterium bovis subsp bovis AF2122/97
ccgauccccaggcc

SEQ ID NO: 3047438 - RNA, 12 nt, Mycobacterium bovis subsp bovis AF2122/97
ccgaucccgccc

SEQ ID NO: 3047439 - RNA, 20 nt, Mycobacterium bovis subsp bovis AF2122/97
ccgaucccggccagcuccuc

SEQ ID NO: 3047440 - RNA, 21 nt, Mycobacterium bovis subsp bovis AF2122/97
ccgaucccggcgagcacccgc

SEQ ID NO: 3047441 - RNA, 17 nt, Mycobacterium bovis subsp bovis AF2122/97
ccgaucccgugguggcg

SEQ ID NO: 3047442 - RNA, 15 nt, Mycobacterium bovis subsp bovis AF2122/97
ccgauccgaucgcag

SEQ ID NO: 3047443 - RNA, 16 nt, Mycobacterium bovis subsp bovis AF2122/97
ccgauccgcucacccg

SEQ ID NO: 3047444 - RNA, 21 nt, Mycobacterium bovis subsp bovis AF2122/97
ccgauccgcucacccgcccgg

SEQ ID NO: 3047445 - RNA, 22 nt, Mycobacterium bovis subsp bovis AF2122/97
ccgauccggaucccaccaccgc

SEQ ID NO: 3047446 - RNA, 22 nt, Mycobacterium bovis subsp bovis AF2122/97
ccgauccgguggcuggccgcca

SEQ ID NO: 3047447 - RNA, 13 nt, Mycobacterium bovis subsp bovis AF2122/97
ccgauccugccca

SEQ ID NO: 3047448 - RNA, 22 nt, Mycobacterium bovis subsp bovis AF2122/97
ccgauccugcccaccaucccgc

SEQ ID NO: 3047449 - RNA, 18 nt, Mycobacterium bovis subsp bovis AF2122/97
ccgaucgaacagugccug

SEQ ID NO: 3047450 - RNA, 18 nt, Mycobacterium bovis subsp bovis AF2122/97
ccgaucgaaccgcugcuc

SEQ ID NO: 3047451 - RNA, 17 nt, Mycobacterium bovis subsp bovis AF2122/97
ccgaucgacacccgcuc

SEQ ID NO: 3047452 - RNA, 21 nt, Mycobacterium bovis subsp bovis AF2122/97
ccgaucgaccgcuggaucgcg

SEQ ID NO: 3047453 - RNA, 14 nt, Mycobacterium bovis subsp bovis AF2122/97
ccgaucgacugcag

SEQ ID NO: 3047454 - RNA, 22 nt, Mycobacterium bovis subsp bovis AF2122/97
ccgaucgaucagcaacucggcc

SEQ ID NO: 3047455 - RNA, 16 nt, Mycobacterium bovis subsp bovis AF2122/97
ccgaucgcggcggccu

SEQ ID NO: 3047456 - RNA, 18 nt, Mycobacterium bovis subsp bovis AF2122/97
ccgaucgcggcggccucc

SEQ ID NO: 3047457 - RNA, 17 nt, Mycobacterium bovis subsp bovis AF2122/97
ccgaucgcuccggcccu

SEQ ID NO: 3047458 - RNA, 23 nt, Mycobacterium bovis subsp bovis AF2122/97
ccgaucgcuccggcccugccgcc

SEQ ID NO: 3047459 - RNA, 14 nt, Mycobacterium bovis subsp bovis AF2122/97
ccgaucggcaaccc

SEQ ID NO: 3047460 - RNA, 17 nt, Mycobacterium bovis subsp bovis AF2122/97
ccgaucggcaaucgacu

SEQ ID NO: 3047461 - RNA, 15 nt, Mycobacterium bovis subsp bovis AF2122/97
ccgaucggcaccgug

SEQ ID NO: 3047462 - RNA, 12 nt, Mycobacterium bovis subsp bovis AF2122/97
ccgaucggcagg

SEQ ID NO: 3047463 - RNA, 12 nt, Mycobacterium bovis subsp bovis AF2122/97
ccgaucggccaa

SEQ ID NO: 3047464 - RNA, 16 nt, Mycobacterium bovis subsp bovis AF2122/97
ccgaucggccaacagg

SEQ ID NO: 3047465 - RNA, 12 nt, Mycobacterium bovis subsp bovis AF2122/97
ccgaucggccac

SEQ ID NO: 3047466 - RNA, 14 nt, Mycobacterium bovis subsp bovis AF2122/97
ccgaucggccacca

SEQ ID NO: 3047467 - RNA, 17 nt, Mycobacterium bovis subsp bovis AF2122/97
ccgaucggccaccaucg

SEQ ID NO: 3047468 - RNA, 13 nt, Mycobacterium bovis subsp bovis AF2122/97
ccgaucggcgcgc

SEQ ID NO: 3047469 - RNA, 15 nt, Mycobacterium bovis subsp bovis AF2122/97
ccgaucggcgcgccg

SEQ ID NO: 3047470 - RNA, 20 nt, Mycobacterium bovis subsp bovis AF2122/97
ccgaucgggcccaccgcugc

SEQ ID NO: 3047471 - RNA, 16 nt, Mycobacterium bovis subsp bovis AF2122/97
ccgaucgggcucacuc

SEQ ID NO: 3047472 - RNA, 21 nt, Mycobacterium bovis subsp bovis AF2122/97
ccgcaccagcugucgggcagc

SEQ ID NO: 3047473 - RNA, 14 nt, Mycobacterium bovis subsp bovis AF2122/97
ccgcaccaguggcg

SEQ ID NO: 3047474 - RNA, 15 nt, Mycobacterium bovis subsp bovis AF2122/97
ccgcacccagaccgc

SEQ ID NO: 3047475 - RNA, 20 nt, Mycobacterium bovis subsp bovis AF2122/97
ccgcacccaugaucccgcug

SEQ ID NO: 3047476 - RNA, 21 nt, Mycobacterium bovis subsp bovis AF2122/97
ccgcaccccauacucggcggc

SEQ ID NO: 3047477 - RNA, 18 nt, Mycobacterium bovis subsp bovis AF2122/97
ccgcacccccgucgauca

SEQ ID NO: 3047478 - RNA, 19 nt, Mycobacterium bovis subsp bovis AF2122/97
ccgcacccccuccgcgaug

SEQ ID NO: 3047479 - RNA, 22 nt, Mycobacterium bovis subsp bovis AF2122/97
ccgcacccccuccgcgaugccg

SEQ ID NO: 3047480 - RNA, 13 nt, Mycobacterium bovis subsp bovis AF2122/97
ccgcaccccgccc

SEQ ID NO: 3047481 - RNA, 17 nt, Mycobacterium bovis subsp bovis AF2122/97
ccgcaccccgcccgacg

SEQ ID NO: 3047482 - RNA, 15 nt, Mycobacterium bovis subsp bovis AF2122/97
ccgcaccccggccgc

SEQ ID NO: 3047483 - RNA, 16 nt, Mycobacterium bovis subsp bovis AF2122/97
ccgcaccccggccgcg

SEQ ID NO: 3047484 - RNA, 17 nt, Mycobacterium bovis subsp bovis AF2122/97
ccgcaccccggccgcgc

SEQ ID NO: 3047485 - RNA, 18 nt, Mycobacterium bovis subsp bovis AF2122/97
ccgcaccccggccgcgcg

SEQ ID NO: 3047486 - RNA, 14 nt, Mycobacterium bovis subsp bovis AF2122/97
ccgcacccgcuccc

SEQ ID NO: 3047487 - RNA, 22 nt, Mycobacterium bovis subsp bovis AF2122/97
ccgcacccgcucccgugcuggc

SEQ ID NO: 3047488 - RNA, 17 nt, Mycobacterium bovis subsp bovis AF2122/97
ccgcacccgcucgucgg

SEQ ID NO: 3047489 - RNA, 15 nt, Mycobacterium bovis subsp bovis AF2122/97
ccgcacccggccgcg

SEQ ID NO: 3047490 - RNA, 16 nt, Mycobacterium bovis subsp bovis AF2122/97
ccgcacccggccgcgc

SEQ ID NO: 3047491 - RNA, 14 nt, Mycobacterium bovis subsp bovis AF2122/97
ccgcacccgggacg

SEQ ID NO: 3047492 - RNA, 14 nt, Mycobacterium bovis subsp bovis AF2122/97
ccgcacccguccgg

SEQ ID NO: 3047493 - RNA, 16 nt, Mycobacterium bovis subsp bovis AF2122/97
ccgcacccguccggcc

SEQ ID NO: 3047494 - RNA, 17 nt, Mycobacterium bovis subsp bovis AF2122/97
ccgcacccguugcuccc

SEQ ID NO: 3047495 - RNA, 19 nt, Mycobacterium bovis subsp bovis AF2122/97
ccgcaccgaaaccaugccg

SEQ ID NO: 3047496 - RNA, 20 nt, Mycobacterium bovis subsp bovis AF2122/97
ccgcaccgaaaccaugccgc

SEQ ID NO: 3047497 - RNA, 12 nt, Mycobacterium bovis subsp bovis AF2122/97
ccgcaccgccgg

SEQ ID NO: 3047498 - RNA, 13 nt, Mycobacterium bovis subsp bovis AF2122/97
ccgcaccgccggc

SEQ ID NO: 3047499 - RNA, 14 nt, Mycobacterium bovis subsp bovis AF2122/97
ccgcaccgccugcu

SEQ ID NO: 3047500 - RNA, 23 nt, Mycobacterium bovis subsp bovis AF2122/97
ccgcaccgcgguacgccggucgg

SEQ ID NO: 3047501 - RNA, 15 nt, Mycobacterium bovis subsp bovis AF2122/97
ccgcaccgcugaccc

SEQ ID NO: 3047502 - RNA, 16 nt, Mycobacterium bovis subsp bovis AF2122/97
ccgcaccgcugacccc

SEQ ID NO: 3047503 - RNA, 22 nt, Mycobacterium bovis subsp bovis AF2122/97
ccgcaccgcugaccccggcagc

SEQ ID NO: 3047504 - RNA, 20 nt, Mycobacterium bovis subsp bovis AF2122/97
ccgcaccggaucaccgcgcc

SEQ ID NO: 3047505 - RNA, 21 nt, Mycobacterium bovis subsp bovis AF2122/97
ccgcaccggaucaccgcgccc

SEQ ID NO: 3047506 - RNA, 17 nt, Mycobacterium bovis subsp bovis AF2122/97
ccgcaccggaucggcua

SEQ ID NO: 3047507 - RNA, 14 nt, Mycobacterium bovis subsp bovis AF2122/97
ccgcaccggccgcu

SEQ ID NO: 3047508 - RNA, 23 nt, Mycobacterium bovis subsp bovis AF2122/97
ccgcaccggggugugcgggcggu

SEQ ID NO: 3047509 - RNA, 20 nt, Mycobacterium bovis subsp bovis AF2122/97
ccgcaccggugacgcacagc

SEQ ID NO: 3047510 - RNA, 12 nt, Mycobacterium bovis subsp bovis AF2122/97
ccgcaccgucgc

SEQ ID NO: 3047511 - RNA, 15 nt, Mycobacterium bovis subsp bovis AF2122/97
ccgcaccugcgauga

SEQ ID NO: 3047512 - RNA, 17 nt, Mycobacterium bovis subsp bovis AF2122/97
ccgcaccugggcggcgc

SEQ ID NO: 3047513 - RNA, 21 nt, Mycobacterium bovis subsp bovis AF2122/97
ccgcaccugggcggcgcgaag

SEQ ID NO: 3047514 - RNA, 22 nt, Mycobacterium bovis subsp bovis AF2122/97
ccgcaccugggcggcgcgaagu

SEQ ID NO: 3047515 - RNA, 13 nt, Mycobacterium bovis subsp bovis AF2122/97
ccgcacgaugccg

SEQ ID NO: 3047516 - RNA, 15 nt, Mycobacterium bovis subsp bovis AF2122/97
ccgcacgaugccggg

SEQ ID NO: 3047517 - RNA, 12 nt, Mycobacterium bovis subsp bovis AF2122/97
ccgcacgauggc

SEQ ID NO: 3047518 - RNA, 21 nt, Mycobacterium bovis subsp bovis AF2122/97
ccgcacgauggccgucgauca

SEQ ID NO: 3047519 - RNA, 23 nt, Mycobacterium bovis subsp bovis AF2122/97
ccgcacgcaaugcgggcccucua

SEQ ID NO: 3047520 - RNA, 15 nt, Mycobacterium bovis subsp bovis AF2122/97
ccgcacgcacgccac

SEQ ID NO: 3047521 - RNA, 18 nt, Mycobacterium bovis subsp bovis AF2122/97
ccgcacgcacgccacugg

SEQ ID NO: 3047522 - RNA, 17 nt, Mycobacterium bovis subsp bovis AF2122/97
ccgcacgcacggcgugu

SEQ ID NO: 3047523 - RNA, 15 nt, Mycobacterium bovis subsp bovis AF2122/97
ccgcacgccgaccag

SEQ ID NO: 3047524 - RNA, 15 nt, Mycobacterium bovis subsp bovis AF2122/97
ccgcacgccgaccgg

SEQ ID NO: 3047525 - RNA, 16 nt, Mycobacterium bovis subsp bovis AF2122/97
ccgcacgccgaccggc

SEQ ID NO: 3047526 - RNA, 17 nt, Mycobacterium bovis subsp bovis AF2122/97
ccgcacgccgaccggcc

SEQ ID NO: 3047527 - RNA, 19 nt, Mycobacterium bovis subsp bovis AF2122/97
ccgcacgccgaccggcccg

SEQ ID NO: 3047528 - RNA, 20 nt, Mycobacterium bovis subsp bovis AF2122/97
ccgcacgccgaccggcccgc

SEQ ID NO: 3047529 - RNA, 12 nt, Mycobacterium bovis subsp bovis AF2122/97
ccgcacgccggc

SEQ ID NO: 3047530 - RNA, 13 nt, Mycobacterium bovis subsp bovis AF2122/97
ccgcacgccggca

SEQ ID NO: 3047531 - RNA, 14 nt, Mycobacterium bovis subsp bovis AF2122/97
ccgcacgccggcau

SEQ ID NO: 3047532 - RNA, 16 nt, Mycobacterium bovis subsp bovis AF2122/97
ccgcacgcucgcccua

SEQ ID NO: 3047533 - RNA, 15 nt, Mycobacterium bovis subsp bovis AF2122/97
ccgcacgcucggcgu

SEQ ID NO: 3047534 - RNA, 14 nt, Mycobacterium bovis subsp bovis AF2122/97
ccgcacgcuggcgg

SEQ ID NO: 3047535 - RNA, 19 nt, Mycobacterium bovis subsp bovis AF2122/97
ccgcacgcuggcgggcacu

SEQ ID NO: 3047536 - RNA, 16 nt, Mycobacterium bovis subsp bovis AF2122/97
ccgcacggaaggucga

SEQ ID NO: 3047537 - RNA, 16 nt, Mycobacterium bovis subsp bovis AF2122/97
ccgcacggaugucgcc

SEQ ID NO: 3047538 - RNA, 13 nt, Mycobacterium bovis subsp bovis AF2122/97
ccgcacggccggg

SEQ ID NO: 3047539 - RNA, 13 nt, Mycobacterium bovis subsp bovis AF2122/97
ccgcacggccucc

SEQ ID NO: 3047540 - RNA, 13 nt, Mycobacterium bovis subsp bovis AF2122/97
ccgcacgggccca

SEQ ID NO: 3047541 - RNA, 15 nt, Mycobacterium bovis subsp bovis AF2122/97
ccgcacgggcccagg

SEQ ID NO: 3047542 - RNA, 18 nt, Mycobacterium bovis subsp bovis AF2122/97
ccgcacgguguauccgac

SEQ ID NO: 3047543 - RNA, 18 nt, Mycobacterium bovis subsp bovis AF2122/97
ccgcacgguugccgucag

SEQ ID NO: 3047544 - RNA, 22 nt, Mycobacterium bovis subsp bovis AF2122/97
ccgcacguagaaguaggcggcg

SEQ ID NO: 3047545 - RNA, 14 nt, Mycobacterium bovis subsp bovis AF2122/97
ccgcacguucggcg

SEQ ID NO: 3047546 - RNA, 14 nt, Mycobacterium bovis subsp bovis AF2122/97
ccgcacguuggcgg

SEQ ID NO: 3047547 - RNA, 15 nt, Mycobacterium bovis subsp bovis AF2122/97
ccgcacguuggcggc

SEQ ID NO: 3047548 - RNA, 17 nt, Mycobacterium bovis subsp bovis AF2122/97
ccgcacguuggcggcca

SEQ ID NO: 3047549 - RNA, 22 nt, Mycobacterium bovis subsp bovis AF2122/97
ccgcacuccacgaucggcccag

SEQ ID NO: 3047550 - RNA, 21 nt, Mycobacterium bovis subsp bovis AF2122/97
ccgcacucggucgggggugcu

SEQ ID NO: 3047551 - RNA, 13 nt, Mycobacterium bovis subsp bovis AF2122/97
ccgcacugccgcc

SEQ ID NO: 3047552 - RNA, 22 nt, Mycobacterium bovis subsp bovis AF2122/97
ccgcacugggcgaugacgccau

SEQ ID NO: 3047553 - RNA, 19 nt, Mycobacterium bovis subsp bovis AF2122/97
ccgcacugggugcgucgac

SEQ ID NO: 3047554 - RNA, 14 nt, Mycobacterium bovis subsp bovis AF2122/97
ccgcacuuggcugc

SEQ ID NO: 3047555 - RNA, 15 nt, Mycobacterium bovis subsp bovis AF2122/97
ccgcacuuucuuccu

SEQ ID NO: 3047556 - RNA, 19 nt, Mycobacterium bovis subsp bovis AF2122/97
ccgcagaaugucguaggcg

SEQ ID NO: 3047557 - RNA, 14 nt, Mycobacterium bovis subsp bovis AF2122/97
ccgcagaccgccac

SEQ ID NO: 3047558 - RNA, 15 nt, Mycobacterium bovis subsp bovis AF2122/97
ccgcagaccgccacc

SEQ ID NO: 3047559 - RNA, 14 nt, Mycobacterium bovis subsp bovis AF2122/97
ccgcauccgcgacg

SEQ ID NO: 3047560 - RNA, 18 nt, Mycobacterium bovis subsp bovis AF2122/97
ccgcauccgcgacggcgc

SEQ ID NO: 3047561 - RNA, 15 nt, Mycobacterium bovis subsp bovis AF2122/97
ccgcauccggucucg

SEQ ID NO: 3047562 - RNA, 17 nt, Mycobacterium bovis subsp bovis AF2122/97
ccgcaucgacgcucauc

SEQ ID NO: 3047563 - RNA, 15 nt, Mycobacterium bovis subsp bovis AF2122/97
ccgcaucgcaccagg

SEQ ID NO: 3047564 - RNA, 12 nt, Mycobacterium bovis subsp bovis AF2122/97
ccgcaucgccga

SEQ ID NO: 3047565 - RNA, 14 nt, Mycobacterium bovis subsp bovis AF2122/97
ccgcaucgccucac

SEQ ID NO: 3047566 - RNA, 16 nt, Mycobacterium bovis subsp bovis AF2122/97
ccgcaucgccucacca

SEQ ID NO: 3047567 - RNA, 19 nt, Mycobacterium bovis subsp bovis AF2122/97
ccgcaucgccucaccacgu

SEQ ID NO: 3047568 - RNA, 14 nt, Mycobacterium bovis subsp bovis AF2122/97
ccgcaucgcggcau

SEQ ID NO: 3047569 - RNA, 21 nt, Mycobacterium bovis subsp bovis AF2122/97
ccgcaucgcggcaucgacgcg

SEQ ID NO: 3047570 - RNA, 14 nt, Mycobacterium bovis subsp bovis AF2122/97
ccgcaucggcacgc

SEQ ID NO: 3047571 - RNA, 15 nt, Mycobacterium bovis subsp bovis AF2122/97
ccgcaucggcgaaca

SEQ ID NO: 3047572 - RNA, 15 nt, Mycobacterium bovis subsp bovis AF2122/97
ccgcaucggcgccag

SEQ ID NO: 3047573 - RNA, 20 nt, Mycobacterium bovis subsp bovis AF2122/97
ccgcaucgggcuugcgcagc

SEQ ID NO: 3047574 - RNA, 19 nt, Mycobacterium bovis subsp bovis AF2122/97
ccgcaucgguggggcgccg

SEQ ID NO: 3047575 - RNA, 22 nt, Mycobacterium bovis subsp bovis AF2122/97
ccgcaucgguggggcgccgggg

SEQ ID NO: 3047576 - RNA, 16 nt, Mycobacterium bovis subsp bovis AF2122/97
ccgcaucgucgagcca

SEQ ID NO: 3047577 - RNA, 18 nt, Mycobacterium bovis subsp bovis AF2122/97
ccgcaucgucgagccaca

SEQ ID NO: 3047578 - RNA, 14 nt, Mycobacterium bovis subsp bovis AF2122/97
ccgcaucguuuucg

SEQ ID NO: 3047579 - RNA, 18 nt, Mycobacterium bovis subsp bovis AF2122/97
ccgcaucguuuucgccga

SEQ ID NO: 3047580 - RNA, 22 nt, Mycobacterium bovis subsp bovis AF2122/97
ccgcaucguuuucgccgauccc

SEQ ID NO: 3047581 - RNA, 15 nt, Mycobacterium bovis subsp bovis AF2122/97
ccgcaucuggccggc

SEQ ID NO: 3047582 - RNA, 17 nt, Mycobacterium bovis subsp bovis AF2122/97
ccgcaucuggccggcgg

SEQ ID NO: 3047583 - RNA, 17 nt, Mycobacterium bovis subsp bovis AF2122/97
ccgcaugacgccggcgg

SEQ ID NO: 3047584 - RNA, 12 nt, Mycobacterium bovis subsp bovis AF2122/97
ccgcaugccacg

SEQ ID NO: 3047585 - RNA, 19 nt, Mycobacterium bovis subsp bovis AF2122/97
ccgcaugccacggcaagcc

SEQ ID NO: 3047586 - RNA, 15 nt, Mycobacterium bovis subsp bovis AF2122/97
ccgcaugccggcgca

SEQ ID NO: 3047587 - RNA, 14 nt, Mycobacterium bovis subsp bovis AF2122/97
ccgcaugcgcuccg

SEQ ID NO: 3047588 - RNA, 23 nt, Mycobacterium bovis subsp bovis AF2122/97
ccgcaugcgcuccggcgcgacgc

SEQ ID NO: 3047589 - RNA, 15 nt, Mycobacterium bovis subsp bovis AF2122/97
ccgcauggacgcgau

SEQ ID NO: 3047590 - RNA, 18 nt, Mycobacterium bovis subsp bovis AF2122/97
ccgcauggcagcggcggu

SEQ ID NO: 3047591 - RNA, 14 nt, Mycobacterium bovis subsp bovis AF2122/97
ccgcauggcgcggg

SEQ ID NO: 3047592 - RNA, 21 nt, Mycobacterium bovis subsp bovis AF2122/97
ccgcauggcgcggguccagcc

SEQ ID NO: 3047593 - RNA, 15 nt, Mycobacterium bovis subsp bovis AF2122/97
ccgcaugggcuuaau

SEQ ID NO: 3047594 - RNA, 18 nt, Mycobacterium bovis subsp bovis AF2122/97
ccgcauggugggugccgg

SEQ ID NO: 3047595 - RNA, 16 nt, Mycobacterium bovis subsp bovis AF2122/97
ccgcauucgcgacaac

SEQ ID NO: 3047596 - RNA, 13 nt, Mycobacterium bovis subsp bovis AF2122/97
ccgcauucggacg

SEQ ID NO: 3047597 - RNA, 15 nt, Mycobacterium bovis subsp bovis AF2122/97
ccgcauucggacgcc

SEQ ID NO: 3047598 - RNA, 19 nt, Mycobacterium bovis subsp bovis AF2122/97
ccgcauucguggagccggc

SEQ ID NO: 3047599 - RNA, 23 nt, Mycobacterium bovis subsp bovis AF2122/97
ccgcauugccaacgcccacguua

SEQ ID NO: 3047600 - RNA, 15 nt, Mycobacterium bovis subsp bovis AF2122/97
ccgccaaacgcugcg

SEQ ID NO: 3047601 - RNA, 20 nt, Mycobacterium bovis subsp bovis AF2122/97
ccgccaaacgcugcgcccgg

SEQ ID NO: 3047602 - RNA, 19 nt, Mycobacterium bovis subsp bovis AF2122/97
ccgccaacaucuccgcguc

SEQ ID NO: 3047603 - RNA, 23 nt, Mycobacterium bovis subsp bovis AF2122/97
ccgccaaccccaacaucccggac

SEQ ID NO: 3047604 - RNA, 13 nt, Mycobacterium bovis subsp bovis AF2122/97
ccgccaaccgcgu

SEQ ID NO: 3047605 - RNA, 20 nt, Mycobacterium bovis subsp bovis AF2122/97
ccgccaacuccagcacccgc

SEQ ID NO: 3047606 - RNA, 12 nt, Mycobacterium bovis subsp bovis AF2122/97
ccgccaacuccu

SEQ ID NO: 3047607 - RNA, 19 nt, Mycobacterium bovis subsp bovis AF2122/97
ccgccaacuccucagccgc

SEQ ID NO: 3047608 - RNA, 23 nt, Mycobacterium bovis subsp bovis AF2122/97
ccgccaauuacagcuugcgcagc

SEQ ID NO: 3047609 - RNA, 16 nt, Mycobacterium bovis subsp bovis AF2122/97
ccgccacaaacccgau

SEQ ID NO: 3047610 - RNA, 14 nt, Mycobacterium bovis subsp bovis AF2122/97
ccgccacaccaacg

SEQ ID NO: 3047611 - RNA, 12 nt, Mycobacterium bovis subsp bovis AF2122/97
ccgccacaccgc

SEQ ID NO: 3047612 - RNA, 15 nt, Mycobacterium bovis subsp bovis AF2122/97
ccgccacaccgccgc

SEQ ID NO: 3047613 - RNA, 18 nt, Mycobacterium bovis subsp bovis AF2122/97
ccgccacacggggccgcc

SEQ ID NO: 3047614 - RNA, 21 nt, Mycobacterium bovis subsp bovis AF2122/97
ccgccacacggggccgccagc

SEQ ID NO: 3047615 - RNA, 15 nt, Mycobacterium bovis subsp bovis AF2122/97
ccgccaccaccaggg

SEQ ID NO: 3047616 - RNA, 16 nt, Mycobacterium bovis subsp bovis AF2122/97
ccgccaccaccagggc

SEQ ID NO: 3047617 - RNA, 18 nt, Mycobacterium bovis subsp bovis AF2122/97
ccgccaccaccagggcaa

SEQ ID NO: 3047618 - RNA, 12 nt, Mycobacterium bovis subsp bovis AF2122/97
ccgccaccaccg

SEQ ID NO: 3047619 - RNA, 18 nt, Mycobacterium bovis subsp bovis AF2122/97
ccgccaccaccgcugccg

SEQ ID NO: 3047620 - RNA, 20 nt, Mycobacterium bovis subsp bovis AF2122/97
ccgccaccaccgcugccggc

SEQ ID NO: 3047621 - RNA, 22 nt, Mycobacterium bovis subsp bovis AF2122/97
ccgccaccaccgcugccggcgc

SEQ ID NO: 3047622 - RNA, 15 nt, Mycobacterium bovis subsp bovis AF2122/97
ccgccaccacgguca

SEQ ID NO: 3047623 - RNA, 22 nt, Mycobacterium bovis subsp bovis AF2122/97
ccgccaccacggucaagccggc

SEQ ID NO: 3047624 - RNA, 13 nt, Mycobacterium bovis subsp bovis AF2122/97
ccgccaccagcgc

SEQ ID NO: 3047625 - RNA, 15 nt, Mycobacterium bovis subsp bovis AF2122/97
ccgccaccagcgcga

SEQ ID NO: 3047626 - RNA, 12 nt, Mycobacterium bovis subsp bovis AF2122/97
ccgccaccaggg

SEQ ID NO: 3047627 - RNA, 20 nt, Mycobacterium bovis subsp bovis AF2122/97
ccgccaccagggcacguucg

SEQ ID NO: 3047628 - RNA, 18 nt, Mycobacterium bovis subsp bovis AF2122/97
ccgccaccagggcggccu

SEQ ID NO: 3047629 - RNA, 23 nt, Mycobacterium bovis subsp bovis AF2122/97
ccgccaccagggcggccuccccg

SEQ ID NO: 3047630 - RNA, 11 nt, Mycobacterium bovis subsp bovis AF2122/97
ccgccaccauc

SEQ ID NO: 3047631 - RNA, 12 nt, Mycobacterium bovis subsp bovis AF2122/97
ccgccaccccgg

SEQ ID NO: 3047632 - RNA, 12 nt, Mycobacterium bovis subsp bovis AF2122/97
ccgccacccgca

SEQ ID NO: 3047633 - RNA, 20 nt, Mycobacterium bovis subsp bovis AF2122/97
ccgccacccgccaacgccaa

SEQ ID NO: 3047634 - RNA, 14 nt, Mycobacterium bovis subsp bovis AF2122/97
ccgccacccggcgg

SEQ ID NO: 3047635 - RNA, 17 nt, Mycobacterium bovis subsp bovis AF2122/97
ccgccacccggcgggcg

SEQ ID NO: 3047636 - RNA, 11 nt, Mycobacterium bovis subsp bovis AF2122/97
ccgccacccuu

SEQ ID NO: 3047637 - RNA, 20 nt, Mycobacterium bovis subsp bovis AF2122/97
ccgccacccuuggcccggug

SEQ ID NO: 3047638 - RNA, 19 nt, Mycobacterium bovis subsp bovis AF2122/97
ccgccaccgaagccgccgg

SEQ ID NO: 3047639 - RNA, 21 nt, Mycobacterium bovis subsp bovis AF2122/97
ccgccaccgaagccgccgggu

SEQ ID NO: 3047640 - RNA, 22 nt, Mycobacterium bovis subsp bovis AF2122/97
ccgccaccgaagccgccgggug

SEQ ID NO: 3047641 - RNA, 12 nt, Mycobacterium bovis subsp bovis AF2122/97
ccgccaccgcac

SEQ ID NO: 3047642 - RNA, 13 nt, Mycobacterium bovis subsp bovis AF2122/97
ccgccaccgcacg

SEQ ID NO: 3047643 - RNA, 12 nt, Mycobacterium bovis subsp bovis AF2122/97
ccgccaccgcca

SEQ ID NO: 3047644 - RNA, 14 nt, Mycobacterium bovis subsp bovis AF2122/97
ccgccaccgccagc

SEQ ID NO: 3047645 - RNA, 16 nt, Mycobacterium bovis subsp bovis AF2122/97
ccgccaccgcggccug

SEQ ID NO: 3047646 - RNA, 22 nt, Mycobacterium bovis subsp bovis AF2122/97
ccgccaggucgaggcaggccuc

SEQ ID NO: 3047647 - RNA, 17 nt, Mycobacterium bovis subsp bovis AF2122/97
ccgccaggugcucgucg

SEQ ID NO: 3047648 - RNA, 15 nt, Mycobacterium bovis subsp bovis AF2122/97
ccgccagucccccgc

SEQ ID NO: 3047649 - RNA, 19 nt, Mycobacterium bovis subsp bovis AF2122/97
ccgccaguccgaucgccga

SEQ ID NO: 3047650 - RNA, 17 nt, Mycobacterium bovis subsp bovis AF2122/97
ccgccaguccggacggc

SEQ ID NO: 3047651 - RNA, 20 nt, Mycobacterium bovis subsp bovis AF2122/97
ccgccaguccggacggcagc

SEQ ID NO: 3047652 - RNA, 13 nt, Mycobacterium bovis subsp bovis AF2122/97
ccgccaguucggc

SEQ ID NO: 3047653 - RNA, 20 nt, Mycobacterium bovis subsp bovis AF2122/97
ccgccaguucggcgucgucc

SEQ ID NO: 3047654 - RNA, 21 nt, Mycobacterium bovis subsp bovis AF2122/97
ccgccaucaacaaggggcagc

SEQ ID NO: 3047655 - RNA, 22 nt, Mycobacterium bovis subsp bovis AF2122/97
ccgccaucaacaaggggcagca

SEQ ID NO: 3047656 - RNA, 20 nt, Mycobacterium bovis subsp bovis AF2122/97
ccgccaucaccgccguuacc

SEQ ID NO: 3047657 - RNA, 16 nt, Mycobacterium bovis subsp bovis AF2122/97
ccgccaucagcccggc

SEQ ID NO: 3047658 - RNA, 21 nt, Mycobacterium bovis subsp bovis AF2122/97
ccgccaucaucgcuuggccua

SEQ ID NO: 3047659 - RNA, 18 nt, Mycobacterium bovis subsp bovis AF2122/97
ccgccaucauggcggccc

SEQ ID NO: 3047660 - RNA, 19 nt, Mycobacterium bovis subsp bovis AF2122/97
ccgccaucauggcggcccg

SEQ ID NO: 3047661 - RNA, 11 nt, Mycobacterium bovis subsp bovis AF2122/97
ccgccaucccc

SEQ ID NO: 3047662 - RNA, 14 nt, Mycobacterium bovis subsp bovis AF2122/97
ccgccauccgaugg

SEQ ID NO: 3047663 - RNA, 21 nt, Mycobacterium bovis subsp bovis AF2122/97
ccgccauccgauggcccggcu

SEQ ID NO: 3047664 - RNA, 23 nt, Mycobacterium bovis subsp bovis AF2122/97
ccgccauccgauggcccggcuca

SEQ ID NO: 3047665 - RNA, 19 nt, Mycobacterium bovis subsp bovis AF2122/97
ccgccaucgccaacaccaa

SEQ ID NO: 3047666 - RNA, 13 nt, Mycobacterium bovis subsp bovis AF2122/97
ccgccaucgccgc

SEQ ID NO: 3047667 - RNA, 15 nt, Mycobacterium bovis subsp bovis AF2122/97
ccgccaucgccgccg

SEQ ID NO: 3047668 - RNA, 22 nt, Mycobacterium bovis subsp bovis AF2122/97
ccgccaucgucgaagaccucaa

SEQ ID NO: 3047669 - RNA, 13 nt, Mycobacterium bovis subsp bovis AF2122/97
ccgccaucugccu

SEQ ID NO: 3047670 - RNA, 15 nt, Mycobacterium bovis subsp bovis AF2122/97
ccgccaugcggcgcg

SEQ ID NO: 3047671 - RNA, 16 nt, Mycobacterium bovis subsp bovis AF2122/97
ccgccaugcggcgcgu

SEQ ID NO: 3047672 - RNA, 18 nt, Mycobacterium bovis subsp bovis AF2122/97
ccgccaugcggcgcgucg

SEQ ID NO: 3047673 - RNA, 19 nt, Mycobacterium bovis subsp bovis AF2122/97
ccgccauuccagccggugc

SEQ ID NO: 3047674 - RNA, 21 nt, Mycobacterium bovis subsp bovis AF2122/97
ccgccauuccagccggugccg

SEQ ID NO: 3047675 - RNA, 15 nt, Mycobacterium bovis subsp bovis AF2122/97
ccgccauugacgccg

SEQ ID NO: 3047676 - RNA, 20 nt, Mycobacterium bovis subsp bovis AF2122/97
ccgccauugacgccguugcc

SEQ ID NO: 3047677 - RNA, 16 nt, Mycobacterium bovis subsp bovis AF2122/97
ccgccauugccgccgg

SEQ ID NO: 3047678 - RNA, 19 nt, Mycobacterium bovis subsp bovis AF2122/97
ccgccauugccgccggcgc

SEQ ID NO: 3047679 - RNA, 22 nt, Mycobacterium bovis subsp bovis AF2122/97
ccgccauugccgccggcgccgc

SEQ ID NO: 3047680 - RNA, 17 nt, Mycobacterium bovis subsp bovis AF2122/97
ccgccauugccgccggu

SEQ ID NO: 3047681 - RNA, 21 nt, Mycobacterium bovis subsp bovis AF2122/97
ccgccauugccgccggugccg

SEQ ID NO: 3047682 - RNA, 18 nt, Mycobacterium bovis subsp bovis AF2122/97
ccgccauugccgccgucg

SEQ ID NO: 3047683 - RNA, 19 nt, Mycobacterium bovis subsp bovis AF2122/97
ccgccauugccgccgucgc

SEQ ID NO: 3047684 - RNA, 16 nt, Mycobacterium bovis subsp bovis AF2122/97
ccgccauugccguccg

SEQ ID NO: 3047685 - RNA, 17 nt, Mycobacterium bovis subsp bovis AF2122/97
ccgccauugccguccgg

SEQ ID NO: 3047686 - RNA, 21 nt, Mycobacterium bovis subsp bovis AF2122/97
ccgccauugccguccggugga

SEQ ID NO: 3047687 - RNA, 15 nt, Mycobacterium bovis subsp bovis AF2122/97
ccgccauuggcaggc

SEQ ID NO: 3047688 - RNA, 16 nt, Mycobacterium bovis subsp bovis AF2122/97
ccgccauugucgaucu

SEQ ID NO: 3047689 - RNA, 17 nt, Mycobacterium bovis subsp bovis AF2122/97
ccgcccaagccgccggc

SEQ ID NO: 3047690 - RNA, 18 nt, Mycobacterium bovis subsp bovis AF2122/97
ccgcccaauccaccgaag

SEQ ID NO: 3047691 - RNA, 17 nt, Mycobacterium bovis subsp bovis AF2122/97
ccgcccaccacacagcc

SEQ ID NO: 3047692 - RNA, 22 nt, Mycobacterium bovis subsp bovis AF2122/97
ccgcccaccacacagccgcgcu

SEQ ID NO: 3047693 - RNA, 18 nt, Mycobacterium bovis subsp bovis AF2122/97
ccgcccacggcaccacca

SEQ ID NO: 3047694 - RNA, 15 nt, Mycobacterium bovis subsp bovis AF2122/97
ccgcccagaccgccg

SEQ ID NO: 3047695 - RNA, 16 nt, Mycobacterium bovis subsp bovis AF2122/97
ccgcccagaccgccga

SEQ ID NO: 3047696 - RNA, 18 nt, Mycobacterium bovis subsp bovis AF2122/97
ccgcccagaccgccgacg

SEQ ID NO: 3047697 - RNA, 19 nt, Mycobacterium bovis subsp bovis AF2122/97
ccgcccagcagcaccugca

SEQ ID NO: 3047698 - RNA, 13 nt, Mycobacterium bovis subsp bovis AF2122/97
ccgcccagcccgg

SEQ ID NO: 3047699 - RNA, 14 nt, Mycobacterium bovis subsp bovis AF2122/97
ccgcccagcccggc

SEQ ID NO: 3047700 - RNA, 12 nt, Mycobacterium bovis subsp bovis AF2122/97
ccgcccagccgc

SEQ ID NO: 3047701 - RNA, 13 nt, Mycobacterium bovis subsp bovis AF2122/97
ccgcccagccgca

SEQ ID NO: 3047702 - RNA, 15 nt, Mycobacterium bovis subsp bovis AF2122/97
ccgcccagccgcagc

SEQ ID NO: 3047703 - RNA, 13 nt, Mycobacterium bovis subsp bovis AF2122/97
ccgcccagcgagg

SEQ ID NO: 3047704 - RNA, 16 nt, Mycobacterium bovis subsp bovis AF2122/97
ccgcccagcgaggugg

SEQ ID NO: 3047705 - RNA, 21 nt, Mycobacterium bovis subsp bovis AF2122/97
ccgcccagcggaaucaccgaa

SEQ ID NO: 3047706 - RNA, 16 nt, Mycobacterium bovis subsp bovis AF2122/97
ccgcccagcguugucg

SEQ ID NO: 3047707 - RNA, 12 nt, Mycobacterium bovis subsp bovis AF2122/97
ccgcccaucacc

SEQ ID NO: 3047708 - RNA, 12 nt, Mycobacterium bovis subsp bovis AF2122/97
ccgcccaugccg

SEQ ID NO: 3047709 - RNA, 18 nt, Mycobacterium bovis subsp bovis AF2122/97
ccgcccaugccuccagaa

SEQ ID NO: 3047710 - RNA, 22 nt, Mycobacterium bovis subsp bovis AF2122/97
ccgcccaugccuccagaaccga

SEQ ID NO: 3047711 - RNA, 21 nt, Mycobacterium bovis subsp bovis AF2122/97
ccgccccacaacaugcuggag

SEQ ID NO: 3047712 - RNA, 13 nt, Mycobacterium bovis subsp bovis AF2122/97
ccgcccccgcccg

SEQ ID NO: 3047713 - RNA, 17 nt, Mycobacterium bovis subsp bovis AF2122/97
ccgcccccgccggccgc

SEQ ID NO: 3047714 - RNA, 21 nt, Mycobacterium bovis subsp bovis AF2122/97
ccgcccccgccggccgcgccg

SEQ ID NO: 3047715 - RNA, 23 nt, Mycobacterium bovis subsp bovis AF2122/97
ccgcccccgccggccgcgccggc

SEQ ID NO: 3047716 - RNA, 18 nt, Mycobacterium bovis subsp bovis AF2122/97
ccgcccccgucggccuug

SEQ ID NO: 3047717 - RNA, 14 nt, Mycobacterium bovis subsp bovis AF2122/97
ccgcccccgugggg

SEQ ID NO: 3047718 - RNA, 22 nt, Mycobacterium bovis subsp bovis AF2122/97
ccgcccccguuuacggcccggc

SEQ ID NO: 3047719 - RNA, 13 nt, Mycobacterium bovis subsp bovis AF2122/97
ccgccccgcccgc

SEQ ID NO: 3047720 - RNA, 13 nt, Mycobacterium bovis subsp bovis AF2122/97
ccgccccgcucgg

SEQ ID NO: 3047721 - RNA, 12 nt, Mycobacterium bovis subsp bovis AF2122/97
ccgccccggcgg

SEQ ID NO: 3047722 - RNA, 14 nt, Mycobacterium bovis subsp bovis AF2122/97
ccgccccggcggcg

SEQ ID NO: 3047723 - RNA, 14 nt, Mycobacterium bovis subsp bovis AF2122/97
ccgccccgggccac

SEQ ID NO: 3047724 - RNA, 20 nt, Mycobacterium bovis subsp bovis AF2122/97
ccgccccguaaucgguggug

SEQ ID NO: 3047725 - RNA, 23 nt, Mycobacterium bovis subsp bovis AF2122/97
ccgccccguaaucgguggugugc

SEQ ID NO: 3047726 - RNA, 20 nt, Mycobacterium bovis subsp bovis AF2122/97
ccgccccguugugucaccgg

SEQ ID NO: 3047727 - RNA, 21 nt, Mycobacterium bovis subsp bovis AF2122/97
ccgccccugcgcggccaccuc

SEQ ID NO: 3047728 - RNA, 23 nt, Mycobacterium bovis subsp bovis AF2122/97
ccgcccgaguuguggacgcccga

SEQ ID NO: 3047729 - RNA, 20 nt, Mycobacterium bovis subsp bovis AF2122/97
ccgcccgcacguucacgcgc

SEQ ID NO: 3047730 - RNA, 16 nt, Mycobacterium bovis subsp bovis AF2122/97
ccgcccgcagggccgc

SEQ ID NO: 3047731 - RNA, 17 nt, Mycobacterium bovis subsp bovis AF2122/97
ccgcccgcagggccgcc

SEQ ID NO: 3047732 - RNA, 14 nt, Mycobacterium bovis subsp bovis AF2122/97
ccgccgacgccgcc

SEQ ID NO: 3047733 - RNA, 14 nt, Mycobacterium bovis subsp bovis AF2122/97
ccgccgacgccguu

SEQ ID NO: 3047734 - RNA, 14 nt, Mycobacterium bovis subsp bovis AF2122/97
ccgccgacggaucg

SEQ ID NO: 3047735 - RNA, 12 nt, Mycobacterium bovis subsp bovis AF2122/97
ccgccgacguga

SEQ ID NO: 3047736 - RNA, 15 nt, Mycobacterium bovis subsp bovis AF2122/97
ccgccgacguugggg

SEQ ID NO: 3047737 - RNA, 17 nt, Mycobacterium bovis subsp bovis AF2122/97
ccgccgacuccccgccg

SEQ ID NO: 3047738 - RNA, 17 nt, Mycobacterium bovis subsp bovis AF2122/97
ccgccgacuuccgcguc

SEQ ID NO: 3047739 - RNA, 18 nt, Mycobacterium bovis subsp bovis AF2122/97
ccgccgacuuccgcgucg

SEQ ID NO: 3047740 - RNA, 13 nt, Mycobacterium bovis subsp bovis AF2122/97
ccgccgacuugau

SEQ ID NO: 3047741 - RNA, 23 nt, Mycobacterium bovis subsp bovis AF2122/97
ccgccgacuugauuucgaucgcg

SEQ ID NO: 3047742 - RNA, 22 nt, Mycobacterium bovis subsp bovis AF2122/97
ccgccgagauagcaacgaagcc

SEQ ID NO: 3047743 - RNA, 22 nt, Mycobacterium bovis subsp bovis AF2122/97
ccgccgagaugaugcugccggc

SEQ ID NO: 3047744 - RNA, 22 nt, Mycobacterium bovis subsp bovis AF2122/97
ccgccgagaugcuggucggcga

SEQ ID NO: 3047745 - RNA, 23 nt, Mycobacterium bovis subsp bovis AF2122/97
ccgccgagcgcaacucccagcac

SEQ ID NO: 3047746 - RNA, 19 nt, Mycobacterium bovis subsp bovis AF2122/97
ccgccgagcggaccaccgc

SEQ ID NO: 3047747 - RNA, 16 nt, Mycobacterium bovis subsp bovis AF2122/97
ccgccgagcggugccg

SEQ ID NO: 3047748 - RNA, 16 nt, Mycobacterium bovis subsp bovis AF2122/97
ccgccgagcgguugcc

SEQ ID NO: 3047749 - RNA, 14 nt, Mycobacterium bovis subsp bovis AF2122/97
ccgccgagcuggcg

SEQ ID NO: 3047750 - RNA, 23 nt, Mycobacterium bovis subsp bovis AF2122/97
ccgccgaggacacauugaccagg

SEQ ID NO: 3047751 - RNA, 15 nt, Mycobacterium bovis subsp bovis AF2122/97
ccgccgagggcgccg

SEQ ID NO: 3047752 - RNA, 20 nt, Mycobacterium bovis subsp bovis AF2122/97
ccgccgagggcuugcaccug

SEQ ID NO: 3047753 - RNA, 16 nt, Mycobacterium bovis subsp bovis AF2122/97
ccgccgauaccgccgg

SEQ ID NO: 3047754 - RNA, 20 nt, Mycobacterium bovis subsp bovis AF2122/97
ccgccgauaccgccggcccc

SEQ ID NO: 3047755 - RNA, 21 nt, Mycobacterium bovis subsp bovis AF2122/97
ccgccgauaccgccggcccca

SEQ ID NO: 3047756 - RNA, 22 nt, Mycobacterium bovis subsp bovis AF2122/97
ccgccgauaccgccggccccac

SEQ ID NO: 3047757 - RNA, 15 nt, Mycobacterium bovis subsp bovis AF2122/97
ccgccgaucaccgcu

SEQ ID NO: 3047758 - RNA, 18 nt, Mycobacterium bovis subsp bovis AF2122/97
ccgccgaucccgucgggc

SEQ ID NO: 3047759 - RNA, 22 nt, Mycobacterium bovis subsp bovis AF2122/97
ccgccgaucccgucgggcacac

SEQ ID NO: 3047760 - RNA, 15 nt, Mycobacterium bovis subsp bovis AF2122/97
ccgccgaucgacacc

SEQ ID NO: 3047761 - RNA, 21 nt, Mycobacterium bovis subsp bovis AF2122/97
ccgccgaucgacacccgcucg

SEQ ID NO: 3047762 - RNA, 15 nt, Mycobacterium bovis subsp bovis AF2122/97
ccgccgaucgggcuu

SEQ ID NO: 3047763 - RNA, 22 nt, Mycobacterium bovis subsp bovis AF2122/97
ccgccgaucgggcuucggccag

SEQ ID NO: 3047764 - RNA, 18 nt, Mycobacterium bovis subsp bovis AF2122/97
ccgccgaugaugcggcgc

SEQ ID NO: 3047765 - RNA, 21 nt, Mycobacterium bovis subsp bovis AF2122/97
ccgccgaugaugcggcgcagc

SEQ ID NO: 3047766 - RNA, 16 nt, Mycobacterium bovis subsp bovis AF2122/97
ccgccgaugccaccgc

SEQ ID NO: 3047767 - RNA, 17 nt, Mycobacterium bovis subsp bovis AF2122/97
ccgccgaugccaccgcu

SEQ ID NO: 3047768 - RNA, 19 nt, Mycobacterium bovis subsp bovis AF2122/97
ccgccgaugccaccgcuug

SEQ ID NO: 3047769 - RNA, 21 nt, Mycobacterium bovis subsp bovis AF2122/97
ccgccgaugcgauuccgcguc

SEQ ID NO: 3047770 - RNA, 15 nt, Mycobacterium bovis subsp bovis AF2122/97
ccgccgaugcugccg

SEQ ID NO: 3047771 - RNA, 18 nt, Mycobacterium bovis subsp bovis AF2122/97
ccgccgaugcugccgccg

SEQ ID NO: 3047772 - RNA, 21 nt, Mycobacterium bovis subsp bovis AF2122/97
ccgccgaugcugccgccgccg

SEQ ID NO: 3047773 - RNA, 18 nt, Mycobacterium bovis subsp bovis AF2122/97
ccgccgaugucgacgaca

SEQ ID NO: 3047774 - RNA, 21 nt, Mycobacterium bovis subsp bovis AF2122/97
ccgccgauguggucggcuguc

SEQ ID NO: 3047775 - RNA, 17 nt, Mycobacterium bovis subsp bovis AF2122/97
ccgccgcaaccgcgaag

SEQ ID NO: 3047776 - RNA, 15 nt, Mycobacterium bovis subsp bovis AF2122/97
ccgccgcaccgccgc

SEQ ID NO: 3047777 - RNA, 17 nt, Mycobacterium bovis subsp bovis AF2122/97
ccgccgcacgcuagccg

SEQ ID NO: 3047778 - RNA, 21 nt, Mycobacterium bovis subsp bovis AF2122/97
ccgccgcacgcuagccgacag

SEQ ID NO: 3047779 - RNA, 20 nt, Mycobacterium bovis subsp bovis AF2122/97
ccgccgcagaugggccucca

SEQ ID NO: 3047780 - RNA, 21 nt, Mycobacterium bovis subsp bovis AF2122/97
ccgccgcagcuuguccgguga

SEQ ID NO: 3047781 - RNA, 18 nt, Mycobacterium bovis subsp bovis AF2122/97
ccgccgccaagcucggcc

SEQ ID NO: 3047782 - RNA, 12 nt, Mycobacterium bovis subsp bovis AF2122/97
ccgccgccacca

SEQ ID NO: 3047783 - RNA, 14 nt, Mycobacterium bovis subsp bovis AF2122/97
ccgccgccaccacc

SEQ ID NO: 3047784 - RNA, 21 nt, Mycobacterium bovis subsp bovis AF2122/97
ccgccgccaccacccaacagc

SEQ ID NO: 3047785 - RNA, 12 nt, Mycobacterium bovis subsp bovis AF2122/97
ccgccgccaccg

SEQ ID NO: 3047786 - RNA, 23 nt, Mycobacterium bovis subsp bovis AF2122/97
ccgccgccaccggcgccgccguc

SEQ ID NO: 3047787 - RNA, 14 nt, Mycobacterium bovis subsp bovis AF2122/97
ccgccgccacggca

SEQ ID NO: 3047788 - RNA, 18 nt, Mycobacterium bovis subsp bovis AF2122/97
ccgccgccaguccggacg

SEQ ID NO: 3047789 - RNA, 23 nt, Mycobacterium bovis subsp bovis AF2122/97
ccgccgccaguccggacggcagc

SEQ ID NO: 3047790 - RNA, 12 nt, Mycobacterium bovis subsp bovis AF2122/97
ccgccgcccagc

SEQ ID NO: 3047791 - RNA, 23 nt, Mycobacterium bovis subsp bovis AF2122/97
ccgccgccccacaacaugcugga

SEQ ID NO: 3047792 - RNA, 16 nt, Mycobacterium bovis subsp bovis AF2122/97
ccgccgcccccgcccg

SEQ ID NO: 3047793 - RNA, 17 nt, Mycobacterium bovis subsp bovis AF2122/97
ccgccgcccccgccggc

SEQ ID NO: 3047794 - RNA, 19 nt, Mycobacterium bovis subsp bovis AF2122/97
ccgccgcccccgccggccg

SEQ ID NO: 3047795 - RNA, 18 nt, Mycobacterium bovis subsp bovis AF2122/97
ccgccgccccggcgcugg

SEQ ID NO: 3047796 - RNA, 12 nt, Mycobacterium bovis subsp bovis AF2122/97
ccgccgcccgca

SEQ ID NO: 3047797 - RNA, 22 nt, Mycobacterium bovis subsp bovis AF2122/97
ccgccgcccugguccaggcccu

SEQ ID NO: 3047798 - RNA, 23 nt, Mycobacterium bovis subsp bovis AF2122/97
ccgccgcccugguccaggcccug

SEQ ID NO: 3047799 - RNA, 12 nt, Mycobacterium bovis subsp bovis AF2122/97
ccgccgccgaag

SEQ ID NO: 3047800 - RNA, 21 nt, Mycobacterium bovis subsp bovis AF2122/97
ccgccgccgaagcgaugccgu

SEQ ID NO: 3047801 - RNA, 16 nt, Mycobacterium bovis subsp bovis AF2122/97
ccgccgccgacgccgc

SEQ ID NO: 3047802 - RNA, 17 nt, Mycobacterium bovis subsp bovis AF2122/97
ccgccgccgccaccggc

SEQ ID NO: 3047803 - RNA, 14 nt, Mycobacterium bovis subsp bovis AF2122/97
ccgccgccgcccgg

SEQ ID NO: 3047804 - RNA, 14 nt, Mycobacterium bovis subsp bovis AF2122/97
ccgccgccgcccgu

SEQ ID NO: 3047805 - RNA, 16 nt, Mycobacterium bovis subsp bovis AF2122/97
ccgccgccgccgacgc

SEQ ID NO: 3047806 - RNA, 13 nt, Mycobacterium bovis subsp bovis AF2122/97
ccgccgccgccgc

SEQ ID NO: 3047807 - RNA, 16 nt, Mycobacterium bovis subsp bovis AF2122/97
ccgccgccgccgccau

SEQ ID NO: 3047808 - RNA, 14 nt, Mycobacterium bovis subsp bovis AF2122/97
ccgccgccgccggc

SEQ ID NO: 3047809 - RNA, 16 nt, Mycobacterium bovis subsp bovis AF2122/97
ccgccgccgccggcgc

SEQ ID NO: 3047810 - RNA, 14 nt, Mycobacterium bovis subsp bovis AF2122/97
ccgccgccgcguac

SEQ ID NO: 3047811 - RNA, 21 nt, Mycobacterium bovis subsp bovis AF2122/97
ccgccgccggaucgccgguga

SEQ ID NO: 3047812 - RNA, 15 nt, Mycobacterium bovis subsp bovis AF2122/97
ccgccgccggcgccg

SEQ ID NO: 3047813 - RNA, 13 nt, Mycobacterium bovis subsp bovis AF2122/97
ccgccgccgucgg

SEQ ID NO: 3047814 - RNA, 16 nt, Mycobacterium bovis subsp bovis AF2122/97
ccgccgccgucggcga

SEQ ID NO: 3047815 - RNA, 15 nt, Mycobacterium bovis subsp bovis AF2122/97
ccgccgccugcccgg

SEQ ID NO: 3047816 - RNA, 20 nt, Mycobacterium bovis subsp bovis AF2122/97
ccgccgccugugcgcgguga

SEQ ID NO: 3047817 - RNA, 22 nt, Mycobacterium bovis subsp bovis AF2122/97
ccgccgccugugcgcggugacg

SEQ ID NO: 3047818 - RNA, 14 nt, Mycobacterium bovis subsp bovis AF2122/97
ccgccggccgccag

SEQ ID NO: 3047819 - RNA, 15 nt, Mycobacterium bovis subsp bovis AF2122/97
ccgccggccgccagc

SEQ ID NO: 3047820 - RNA, 16 nt, Mycobacterium bovis subsp bovis AF2122/97
ccgccggccgccagcg

SEQ ID NO: 3047821 - RNA, 12 nt, Mycobacterium bovis subsp bovis AF2122/97
ccgccggccgcg

SEQ ID NO: 3047822 - RNA, 15 nt, Mycobacterium bovis subsp bovis AF2122/97
ccgccggccgcgccg

SEQ ID NO: 3047823 - RNA, 13 nt, Mycobacterium bovis subsp bovis AF2122/97
ccgccggccggca

SEQ ID NO: 3047824 - RNA, 18 nt, Mycobacterium bovis subsp bovis AF2122/97
ccgccggccgucgaucuu

SEQ ID NO: 3047825 - RNA, 18 nt, Mycobacterium bovis subsp bovis AF2122/97
ccgccggccgucggccgg

SEQ ID NO: 3047826 - RNA, 20 nt, Mycobacterium bovis subsp bovis AF2122/97
ccgccggccuugugcucgau

SEQ ID NO: 3047827 - RNA, 14 nt, Mycobacterium bovis subsp bovis AF2122/97
ccgccggcgacugc

SEQ ID NO: 3047828 - RNA, 16 nt, Mycobacterium bovis subsp bovis AF2122/97
ccgccggcgacugcag

SEQ ID NO: 3047829 - RNA, 16 nt, Mycobacterium bovis subsp bovis AF2122/97
ccgccggcgccacccg

SEQ ID NO: 3047830 - RNA, 17 nt, Mycobacterium bovis subsp bovis AF2122/97
ccgccggcgccacccgc

SEQ ID NO: 3047831 - RNA, 21 nt, Mycobacterium bovis subsp bovis AF2122/97
ccgccggcgccacccgcgccg

SEQ ID NO: 3047832 - RNA, 15 nt, Mycobacterium bovis subsp bovis AF2122/97
ccgccggcgccaccg

SEQ ID NO: 3047833 - RNA, 17 nt, Mycobacterium bovis subsp bovis AF2122/97
ccgccggcgccaccguc

SEQ ID NO: 3047834 - RNA, 22 nt, Mycobacterium bovis subsp bovis AF2122/97
ccgccggcgccaccgucaccgc

SEQ ID NO: 3047835 - RNA, 19 nt, Mycobacterium bovis subsp bovis AF2122/97
ccgccggcgccaccgucgc

SEQ ID NO: 3047836 - RNA, 14 nt, Mycobacterium bovis subsp bovis AF2122/97
ccgccggcgccagc

SEQ ID NO: 3047837 - RNA, 16 nt, Mycobacterium bovis subsp bovis AF2122/97
ccgccggcgccagcgc

SEQ ID NO: 3047838 - RNA, 13 nt, Mycobacterium bovis subsp bovis AF2122/97
ccgccggcgccca

SEQ ID NO: 3047839 - RNA, 15 nt, Mycobacterium bovis subsp bovis AF2122/97
ccgccggcgcccagg

SEQ ID NO: 3047840 - RNA, 18 nt, Mycobacterium bovis subsp bovis AF2122/97
ccgccggcgcccaggccg

SEQ ID NO: 3047841 - RNA, 22 nt, Mycobacterium bovis subsp bovis AF2122/97
ccgccggcgcccaggccgauca

SEQ ID NO: 3047842 - RNA, 12 nt, Mycobacterium bovis subsp bovis AF2122/97
ccgccggcgccg

SEQ ID NO: 3047843 - RNA, 22 nt, Mycobacterium bovis subsp bovis AF2122/97
ccgccggcgccgccauugccau

SEQ ID NO: 3047844 - RNA, 15 nt, Mycobacterium bovis subsp bovis AF2122/97
ccgccggcgccgccc

SEQ ID NO: 3047845 - RNA, 16 nt, Mycobacterium bovis subsp bovis AF2122/97
ccgccggcgccgcccg

SEQ ID NO: 3047846 - RNA, 20 nt, Mycobacterium bovis subsp bovis AF2122/97
ccgccggcgccgcccgcgcc

SEQ ID NO: 3047847 - RNA, 21 nt, Mycobacterium bovis subsp bovis AF2122/97
ccgccggcgccgcccgcgccg

SEQ ID NO: 3047848 - RNA, 18 nt, Mycobacterium bovis subsp bovis AF2122/97
ccgccggcgccgccgaug

SEQ ID NO: 3047849 - RNA, 13 nt, Mycobacterium bovis subsp bovis AF2122/97
ccgccggcgccgg

SEQ ID NO: 3047850 - RNA, 20 nt, Mycobacterium bovis subsp bovis AF2122/97
ccgccggcgccggagccgcc

SEQ ID NO: 3047851 - RNA, 14 nt, Mycobacterium bovis subsp bovis AF2122/97
ccgccggcgccggc

SEQ ID NO: 3047852 - RNA, 18 nt, Mycobacterium bovis subsp bovis AF2122/97
ccgccggcgccggugccg

SEQ ID NO: 3047853 - RNA, 21 nt, Mycobacterium bovis subsp bovis AF2122/97
ccgccggcgccggugccgccu

SEQ ID NO: 3047854 - RNA, 15 nt, Mycobacterium bovis subsp bovis AF2122/97
ccgccggcgcuggcg

SEQ ID NO: 3047855 - RNA, 18 nt, Mycobacterium bovis subsp bovis AF2122/97
ccgccggcgcuggcgggc

SEQ ID NO: 3047856 - RNA, 19 nt, Mycobacterium bovis subsp bovis AF2122/97
ccgccggcgcuggcgggcg

SEQ ID NO: 3047857 - RNA, 13 nt, Mycobacterium bovis subsp bovis AF2122/97
ccgccggcggcgg

SEQ ID NO: 3047858 - RNA, 14 nt, Mycobacterium bovis subsp bovis AF2122/97
ccgccggcggcggc

SEQ ID NO: 3047859 - RNA, 18 nt, Mycobacterium bovis subsp bovis AF2122/97
ccgccggcggcggccgca

SEQ ID NO: 3047860 - RNA, 13 nt, Mycobacterium bovis subsp bovis AF2122/97
ccgccggcgggcg

SEQ ID NO: 3047861 - RNA, 17 nt, Mycobacterium bovis subsp bovis AF2122/97
ccgccggcggugaugug

SEQ ID NO: 3047862 - RNA, 21 nt, Mycobacterium bovis subsp bovis AF2122/97
ccgccggcgugucgcgucgug

SEQ ID NO: 3047863 - RNA, 22 nt, Mycobacterium bovis subsp bovis AF2122/97
ccgccggcucgucgauccccgc

SEQ ID NO: 3047864 - RNA, 21 nt, Mycobacterium bovis subsp bovis AF2122/97
ccgccgggauaacccagcacc

SEQ ID NO: 3047865 - RNA, 23 nt, Mycobacterium bovis subsp bovis AF2122/97
ccgccgggcaucggugccacggc

SEQ ID NO: 3047866 - RNA, 16 nt, Mycobacterium bovis subsp bovis AF2122/97
ccgccgggccaggccg

SEQ ID NO: 3047867 - RNA, 19 nt, Mycobacterium bovis subsp bovis AF2122/97
ccgccgggcccccgccuac

SEQ ID NO: 3047868 - RNA, 20 nt, Mycobacterium bovis subsp bovis AF2122/97
ccgccgggcccccgccuacg

SEQ ID NO: 3047869 - RNA, 13 nt, Mycobacterium bovis subsp bovis AF2122/97
ccgccgggccccg

SEQ ID NO: 3047870 - RNA, 18 nt, Mycobacterium bovis subsp bovis AF2122/97
ccgccgggcccucgccau

SEQ ID NO: 3047871 - RNA, 17 nt, Mycobacterium bovis subsp bovis AF2122/97
ccgccggggcagcucac

SEQ ID NO: 3047872 - RNA, 20 nt, Mycobacterium bovis subsp bovis AF2122/97
ccgccgggggcaccguuacc

SEQ ID NO: 3047873 - RNA, 23 nt, Mycobacterium bovis subsp bovis AF2122/97
ccgccggguauugauugacugcu

SEQ ID NO: 3047874 - RNA, 20 nt, Mycobacterium bovis subsp bovis AF2122/97
ccgccggguccggaaccggu

SEQ ID NO: 3047875 - RNA, 20 nt, Mycobacterium bovis subsp bovis AF2122/97
ccgccgggucgaacgcaugc

SEQ ID NO: 3047876 - RNA, 22 nt, Mycobacterium bovis subsp bovis AF2122/97
ccgccgggugcgccguugccgc

SEQ ID NO: 3047877 - RNA, 15 nt, Mycobacterium bovis subsp bovis AF2122/97
ccgccggguuggcgc

SEQ ID NO: 3047878 - RNA, 17 nt, Mycobacterium bovis subsp bovis AF2122/97
ccgccggguuggcgccg

SEQ ID NO: 3047879 - RNA, 15 nt, Mycobacterium bovis subsp bovis AF2122/97
ccgccggucacgacg

SEQ ID NO: 3047880 - RNA, 18 nt, Mycobacterium bovis subsp bovis AF2122/97
ccgccggugaucggcggc

SEQ ID NO: 3047881 - RNA, 12 nt, Mycobacterium bovis subsp bovis AF2122/97
ccgccggugcca

SEQ ID NO: 3047882 - RNA, 21 nt, Mycobacterium bovis subsp bovis AF2122/97
ccgccggugccacccuugccg

SEQ ID NO: 3047883 - RNA, 17 nt, Mycobacterium bovis subsp bovis AF2122/97
ccgccggugccaccgac

SEQ ID NO: 3047884 - RNA, 19 nt, Mycobacterium bovis subsp bovis AF2122/97
ccgccggugccaccgacgc

SEQ ID NO: 3047885 - RNA, 12 nt, Mycobacterium bovis subsp bovis AF2122/97
ccgccggugccg

SEQ ID NO: 3047886 - RNA, 17 nt, Mycobacterium bovis subsp bovis AF2122/97
ccgccggugccgaugac

SEQ ID NO: 3047887 - RNA, 13 nt, Mycobacterium bovis subsp bovis AF2122/97
ccgccggugccgc

SEQ ID NO: 3047888 - RNA, 22 nt, Mycobacterium bovis subsp bovis AF2122/97
ccgccggugccgccauugacgc

SEQ ID NO: 3047889 - RNA, 15 nt, Mycobacterium bovis subsp bovis AF2122/97
ccgccggugccgccg

SEQ ID NO: 3047890 - RNA, 16 nt, Mycobacterium bovis subsp bovis AF2122/97
ccgccggugccgccgg

SEQ ID NO: 3047891 - RNA, 16 nt, Mycobacterium bovis subsp bovis AF2122/97
ccgccggugccgccgu

SEQ ID NO: 3047892 - RNA, 20 nt, Mycobacterium bovis subsp bovis AF2122/97
ccgccggugccgccgucgcc

SEQ ID NO: 3047893 - RNA, 22 nt, Mycobacterium bovis subsp bovis AF2122/97
ccgccggugccgccgucgccgc

SEQ ID NO: 3047894 - RNA, 17 nt, Mycobacterium bovis subsp bovis AF2122/97
ccgccggugccgccugc

SEQ ID NO: 3047895 - RNA, 15 nt, Mycobacterium bovis subsp bovis AF2122/97
ccgccggugcggcca

SEQ ID NO: 3047896 - RNA, 13 nt, Mycobacterium bovis subsp bovis AF2122/97
ccgccgguggccg

SEQ ID NO: 3047897 - RNA, 14 nt, Mycobacterium bovis subsp bovis AF2122/97
ccgccgguggccgc

SEQ ID NO: 3047898 - RNA, 15 nt, Mycobacterium bovis subsp bovis AF2122/97
ccgccgguggcgccg

SEQ ID NO: 3047899 - RNA, 18 nt, Mycobacterium bovis subsp bovis AF2122/97
ccgccgguggcgccgggg

SEQ ID NO: 3047900 - RNA, 20 nt, Mycobacterium bovis subsp bovis AF2122/97
ccgccgguggcgccggggcc

SEQ ID NO: 3047901 - RNA, 22 nt, Mycobacterium bovis subsp bovis AF2122/97
ccgccgguggcgccggggccgc

SEQ ID NO: 3047902 - RNA, 23 nt, Mycobacterium bovis subsp bovis AF2122/97
ccgccgguggcgccggggccgcc

SEQ ID NO: 3047903 - RNA, 22 nt, Mycobacterium bovis subsp bovis AF2122/97
ccgccgguggugccggcgccgc

SEQ ID NO: 3047904 - RNA, 16 nt, Mycobacterium bovis subsp bovis AF2122/97
ccgccggugugcccgc

SEQ ID NO: 3047905 - RNA, 19 nt, Mycobacterium bovis subsp bovis AF2122/97
ccgccguugggccgcgccc

SEQ ID NO: 3047906 - RNA, 15 nt, Mycobacterium bovis subsp bovis AF2122/97
ccgccguugucgacc

SEQ ID NO: 3047907 - RNA, 15 nt, Mycobacterium bovis subsp bovis AF2122/97
ccgccguuuccgccg

SEQ ID NO: 3047908 - RNA, 19 nt, Mycobacterium bovis subsp bovis AF2122/97
ccgccguuuccgccgccgc

SEQ ID NO: 3047909 - RNA, 20 nt, Mycobacterium bovis subsp bovis AF2122/97
ccgccguuugcgccguugcc

SEQ ID NO: 3047910 - RNA, 19 nt, Mycobacterium bovis subsp bovis AF2122/97
ccgccuaaagcgugucgcc

SEQ ID NO: 3047911 - RNA, 20 nt, Mycobacterium bovis subsp bovis AF2122/97
ccgccuaaagcgugucgccc

SEQ ID NO: 3047912 - RNA, 21 nt, Mycobacterium bovis subsp bovis AF2122/97
ccgccuaagcauucagcgcgc

SEQ ID NO: 3047913 - RNA, 23 nt, Mycobacterium bovis subsp bovis AF2122/97
ccgccuaagcauucagcgcgccg

SEQ ID NO: 3047914 - RNA, 19 nt, Mycobacterium bovis subsp bovis AF2122/97
ccgccuaaucggccugccg

SEQ ID NO: 3047915 - RNA, 21 nt, Mycobacterium bovis subsp bovis AF2122/97
ccgccuaaucggccugccggc

SEQ ID NO: 3047916 - RNA, 18 nt, Mycobacterium bovis subsp bovis AF2122/97
ccgccuacccguucuucg

SEQ ID NO: 3047917 - RNA, 20 nt, Mycobacterium bovis subsp bovis AF2122/97
ccgccuaggugaguaagccc

SEQ ID NO: 3047918 - RNA, 16 nt, Mycobacterium bovis subsp bovis AF2122/97
ccgccucaaugaccac

SEQ ID NO: 3047919 - RNA, 13 nt, Mycobacterium bovis subsp bovis AF2122/97
ccgccuccaccgc

SEQ ID NO: 3047920 - RNA, 15 nt, Mycobacterium bovis subsp bovis AF2122/97
ccgccuccaccgccg

SEQ ID NO: 3047921 - RNA, 19 nt, Mycobacterium bovis subsp bovis AF2122/97
ccgccuccaccgccgcgcg

SEQ ID NO: 3047922 - RNA, 20 nt, Mycobacterium bovis subsp bovis AF2122/97
ccgccuccaccgccgcgcgg

SEQ ID NO: 3047923 - RNA, 12 nt, Mycobacterium bovis subsp bovis AF2122/97
ccgccuccgccg

SEQ ID NO: 3047924 - RNA, 14 nt, Mycobacterium bovis subsp bovis AF2122/97
ccgccuccgccgag

SEQ ID NO: 3047925 - RNA, 18 nt, Mycobacterium bovis subsp bovis AF2122/97
ccgccuccgccgaggccg

SEQ ID NO: 3047926 - RNA, 21 nt, Mycobacterium bovis subsp bovis AF2122/97
ccgccuccgccgaggccgccg

SEQ ID NO: 3047927 - RNA, 13 nt, Mycobacterium bovis subsp bovis AF2122/97
ccgccuccgccug

SEQ ID NO: 3047928 - RNA, 14 nt, Mycobacterium bovis subsp bovis AF2122/97
ccgccuccgccugc

SEQ ID NO: 3047929 - RNA, 14 nt, Mycobacterium bovis subsp bovis AF2122/97
ccgccuccucgaua

SEQ ID NO: 3047930 - RNA, 21 nt, Mycobacterium bovis subsp bovis AF2122/97
ccgccuccucgauagcggcgc

SEQ ID NO: 3047931 - RNA, 15 nt, Mycobacterium bovis subsp bovis AF2122/97
ccgccuccugcgggu

SEQ ID NO: 3047932 - RNA, 18 nt, Mycobacterium bovis subsp bovis AF2122/97
ccgccucgaccgccagcc

SEQ ID NO: 3047933 - RNA, 22 nt, Mycobacterium bovis subsp bovis AF2122/97
ccgccucgaccgccagcccggu

SEQ ID NO: 3047934 - RNA, 21 nt, Mycobacterium bovis subsp bovis AF2122/97
ccgccucgcggaugagcucgg

SEQ ID NO: 3047935 - RNA, 22 nt, Mycobacterium bovis subsp bovis AF2122/97
ccgccucgggcaccuggucggc

SEQ ID NO: 3047936 - RNA, 12 nt, Mycobacterium bovis subsp bovis AF2122/97
ccgccucgggug

SEQ ID NO: 3047937 - RNA, 20 nt, Mycobacterium bovis subsp bovis AF2122/97
ccgccucguacggaccgucg

SEQ ID NO: 3047938 - RNA, 21 nt, Mycobacterium bovis subsp bovis AF2122/97
ccgccucguacggaccgucgc

SEQ ID NO: 3047939 - RNA, 22 nt, Mycobacterium bovis subsp bovis AF2122/97
ccgccucguacggaccgucgcc

SEQ ID NO: 3047940 - RNA, 12 nt, Mycobacterium bovis subsp bovis AF2122/97
ccgccugaccgc

SEQ ID NO: 3047941 - RNA, 15 nt, Mycobacterium bovis subsp bovis AF2122/97
ccgccugaccgccac

SEQ ID NO: 3047942 - RNA, 18 nt, Mycobacterium bovis subsp bovis AF2122/97
ccgccugaccgccaccgu

SEQ ID NO: 3047943 - RNA, 13 nt, Mycobacterium bovis subsp bovis AF2122/97
ccgccugcaccgc

SEQ ID NO: 3047944 - RNA, 16 nt, Mycobacterium bovis subsp bovis AF2122/97
ccgccugcaccgccgc

SEQ ID NO: 3047945 - RNA, 21 nt, Mycobacterium bovis subsp bovis AF2122/97
ccgccugcagguuuccggccu

SEQ ID NO: 3047946 - RNA, 16 nt, Mycobacterium bovis subsp bovis AF2122/97
ccgccugccccacccg

SEQ ID NO: 3047947 - RNA, 17 nt, Mycobacterium bovis subsp bovis AF2122/97
ccgccugccccacccgc

SEQ ID NO: 3047948 - RNA, 15 nt, Mycobacterium bovis subsp bovis AF2122/97
ccgccugcccggccc

SEQ ID NO: 3047949 - RNA, 16 nt, Mycobacterium bovis subsp bovis AF2122/97
ccgccugcccggcccg

SEQ ID NO: 3047950 - RNA, 17 nt, Mycobacterium bovis subsp bovis AF2122/97
ccgccugcccggcccgc

SEQ ID NO: 3047951 - RNA, 14 nt, Mycobacterium bovis subsp bovis AF2122/97
ccgccugccucgcc

SEQ ID NO: 3047952 - RNA, 14 nt, Mycobacterium bovis subsp bovis AF2122/97
ccgccugcgccgcc

SEQ ID NO: 3047953 - RNA, 19 nt, Mycobacterium bovis subsp bovis AF2122/97
ccgccugcgccgccagcgc

SEQ ID NO: 3047954 - RNA, 20 nt, Mycobacterium bovis subsp bovis AF2122/97
ccgccugcgccgccagcgcc

SEQ ID NO: 3047955 - RNA, 22 nt, Mycobacterium bovis subsp bovis AF2122/97
ccgccugcgccgccagcgccgc

SEQ ID NO: 3047956 - RNA, 17 nt, Mycobacterium bovis subsp bovis AF2122/97
ccgccugcgccgcccgc

SEQ ID NO: 3047957 - RNA, 23 nt, Mycobacterium bovis subsp bovis AF2122/97
ccgccugcgcggcugccgucucc

SEQ ID NO: 3047958 - RNA, 15 nt, Mycobacterium bovis subsp bovis AF2122/97
ccgccugcuccugcg

SEQ ID NO: 3047959 - RNA, 15 nt, Mycobacterium bovis subsp bovis AF2122/97
ccgccugcuggccgc

SEQ ID NO: 3047960 - RNA, 15 nt, Mycobacterium bovis subsp bovis AF2122/97
ccgccuggacgccgc

SEQ ID NO: 3047961 - RNA, 17 nt, Mycobacterium bovis subsp bovis AF2122/97
ccgccuggacgccgccg

SEQ ID NO: 3047962 - RNA, 18 nt, Mycobacterium bovis subsp bovis AF2122/97
ccgccuggaucagcgcgu

SEQ ID NO: 3047963 - RNA, 13 nt, Mycobacterium bovis subsp bovis AF2122/97
ccgccugggcggc

SEQ ID NO: 3047964 - RNA, 18 nt, Mycobacterium bovis subsp bovis AF2122/97
ccgccugggcggccagca

SEQ ID NO: 3047965 - RNA, 19 nt, Mycobacterium bovis subsp bovis AF2122/97
ccgccugggcggccagcac

SEQ ID NO: 3047966 - RNA, 21 nt, Mycobacterium bovis subsp bovis AF2122/97
ccgccuggggguucuggccgu

SEQ ID NO: 3047967 - RNA, 15 nt, Mycobacterium bovis subsp bovis AF2122/97
ccgccuggguugacc

SEQ ID NO: 3047968 - RNA, 19 nt, Mycobacterium bovis subsp bovis AF2122/97
ccgccuggguugaccgcca

SEQ ID NO: 3047969 - RNA, 20 nt, Mycobacterium bovis subsp bovis AF2122/97
ccgccuggguugaccgccac

SEQ ID NO: 3047970 - RNA, 21 nt, Mycobacterium bovis subsp bovis AF2122/97
ccgccugguguacacacccgc

SEQ ID NO: 3047971 - RNA, 18 nt, Mycobacterium bovis subsp bovis AF2122/97
ccgccugucccgccggcc

SEQ ID NO: 3047972 - RNA, 19 nt, Mycobacterium bovis subsp bovis AF2122/97
ccgccugucccgccggccc

SEQ ID NO: 3047973 - RNA, 20 nt, Mycobacterium bovis subsp bovis AF2122/97
ccgccugucccgccggcccc

SEQ ID NO: 3047974 - RNA, 16 nt, Mycobacterium bovis subsp bovis AF2122/97
ccgccugugccgccgg
